United States Patent 11,141,474 (ARTIFICIAL NUCLEIC ACID MOLECULES ENCODING A NOROVIRUS ANTIGEN AND USES THEREOF) - sequence listing, part 16

SEQ ID NO: 34063 - RNA, 1617 nt, Artificial Sequence
  derived and/or modified sequence opt6 from VP1__Norovirus_and/or_Norovirus-like__AB220923
augaaaauggcaucaaacgaugccagcccaucagauggaucaaccgccaaccuaguaccagaaguaaacaaugaaguaauggcacucgaacccguuguaggagcagcaauagccgccccaguagcaggacaacaaaacguuauagauccauggauaagaaauaauuuuguucaagcaccaggcggagaguucacagucaguccaagaaacgccccaggagaaauauuauggucagccccauuaggaccugauuuaaauccauaucuaucucaucuagccagaauguauaaugguuacgcaggaggauuugaaguccaaguaauacuagccggaaaugccuuuacagcuggaaaaauaauauuugcugcuguuccuccuaauuuuccaacagaaggauuaucaccaagccaaguaacaauguuuccccauauaauaguagacguaagacaauuagaaccaguacuuauaccacugccagaugucagaaacaacuuuuaucacuauaaccaaaguaaugacucaacuauaaaauuaauagcaauguuauacacuccauuaagagcaaacaaugcaggagacgauguauuuacaguaucaugcagaguucuaacaagaccaaguccugacuuugauuuuauauuccuaguuccaccaacagucgaaucaagaacaaaaccauuuacaguuccaauauuaacuguagaagaaaugacuaauucaagauuuccaaucccacuugaaaaacuauucacagggccaucaucagcauuugucguacaaccacagaacggacgauguacaacagauggaguacuacuaggaacaacucaauuaucaccaguaaauaucuguacauuucgaggagacguaacacacauaaguggaacaagaacauacagaaugaaucucgcaucacaaaacuggaacaacuacgauccaacagaagaaaucccugcaccauuaggaaccccagauuuuguagguaaaauacaaggaaugcuaacacaaacaacaaaaggagaugguucaacaagaggucauaaagcuaccguuaguacuggaucuguagacuucacaccaaaacuaggaucaguacaauuugcaaccgauaccgauaaugauuucgaaacaggacaaaacaccagauuuacaccugucggaguaauucaagacggcuccuccacacacagaaaugaaccacaacaauggguucuaccagauuauucaggaagaacaguccauaacguacaucuagcaccagcaguugcaccaacauuuccaggagaacaacuacuauucuuuagaaguacaaugcccgguugcucaggauauccaaauauggaccuagauugccuacucccacaagaauggguacaacauuucuaccaagaagcagcaccaucacaaagcgauguagcccuauuacgauucguuaacccagacacaggcagaguauuauucgaauguaaacuacacaaagcaggauacguaacaguagcacacacaggacaacaugaucucguuauaccaccaaauggauacuuuagauucgauaguuggguaaaucaauucuacacucuagcaccaaugggcaauggagcaggcagaagaagauaa

SEQ ID NO: 34064 - RNA, 1617 nt, Artificial Sequence
  derived and/or modified sequence opt6 from VP1__Norovirus_and/or_Norovirus-like__AY588016
augaaaauggcaaguaaugaugcaaacccaucugacggcucaacagcaaaucuaguuccugaaguaaauaaugaaguaauggcauuagaaccaguaguaggagcagcaauagcagcaccuguagcaggucaacaaaauguuauagauccauggauacgaaacaauuuuguacaagcuccaggcggugaauuuacaguauccccacgcaacgcaccaggagaaauauuauggucagcaccauuagggccagaucuaaaucccuaucuaucccacuuagcaagaauguacaauggauaugcaggaggauuugaaguacaaguaauauuagcaggaaacgccuuuaccgccggaaaaauaaucuuugcugcaguaccuccaaacuucccaaccgaaggccuauccccaucucaaguuacaauguucccacacauaauuguugacguacgacaacucgaaccugucuuaauccccuuaccagacguuagaaauaauuucuaccacuacaaccaauccaaugauccaacaauaaaacuaaucgcaauguuauacacaccauuaagagcuaacaacgccggagaagauguauucaccguaucaugcagaguauuaacaagacccucacccgacuuugauuuuauauuccuaguaccaccuaccguagaaucacgcaccaaacccuuuacaguuccaauauuaacagucgaagaaaugacaaauuccagauuuccaauuccucuagaaaaacucuuuacaggucccucaggagcauucguaguacaaccacaaaaugguagauguaccacugaugguguauuauuaggaaccacacaacuaucaccuguuaacauauguacauuucgaggagacgucacacauaucgcaggaacacacaauuauacaaugaaucuagcuucacaaaacuggaauaauuaugaccccacugaagaaaucccagcaccauuaggaacuccagacuuuguaggucgcauacaaggaauguuaacacaaacaacaagaggagacggaucaacucgaggacauaaagcaacuguuucaacaggagacguacauuuuacaccaaaauuaggcucaauacaauucaauacagacacaaauaacgauuucgaaaccggacaaaauacaaaauuuacaccaguagguguaguccaagauggaaaugguacacaccaaaacgaaccucaacaauggguacuaccaucauauuccggaagaacaggacauaacguacacuuagccccugcaguugcaccaacauuuccaggagaacaguuauuauucuuuagaucagcaaugccaggaugcuccggcuaucccaacaugaauuuagauugccuauuaccucaagaauggguacaacauuuuuaucaagaagcagcacccgcacaaucugauguagccuuacuaagauuuguuaacccagauacuggacgaguauuauucgaaugcaaacuacauaaaucuggauauguaacugucgcacauacuggacaacaugaucuaguaauaccaccaaauggcuauuucagauucgauuccugggucaaucaauuuuacacauuagcacccauggguaacgguacaggaagaagaagauaa

SEQ ID NO: 34065 - RNA, 1617 nt, Artificial Sequence
  derived and/or modified sequence opt6 from VP1__Norovirus_and/or_Norovirus-like__AY502022
augaaaauggcaucaaaugacgccaacccuagugauggaagcacagcuaaucuaguaccugaagucaacaacgaaguuauggcccuugaaccaguuguaggcgcagcaauagcagcaccaguagcaggacaacaaaacgucauagauccauggauccgaaauaauuuuguacaagccccaggcggagaauuuacaguaucaccaagaaaugcaccaggagaaauacuauggagugcaccauuaggaccagauuuaaauccauaucuaucccaccuagcaagaauguauaacggauacgcgggaggauucgaaguacaaguaauauuagcuggaaaugcauucacagcaggaaaaauaaucuucgccgcaguacccccaaauuuuccaacagaaggacuaucaccaucacaaguaaccauguucccucauauaauugucgacguuagacaacuagaaccuguacuaauaccauuaccagauguacguaacaacuuuuaucacuauaaccaauccaaugacccaacaauaaaauuaauagcaauguuauauacaccauuaagagcaaacaaugccggagaagauguuuucaccguaucaugcagaguacuuacaagaccuucuccagauuuugauuuuauauuccuuguaccaccgacaguagaaagcagaacaaaaccauucacaguaccaauccuaaccguagaagaaaugacaaauucccgauuccccaucccauuagaaaaacuauuuacaggacccucaggcgcauuugugguacaaccacaaaacgguagauguaccacugacggaguuuuacuagguaccacacaacuaucacccguaaauauauguacauuccgaggugauguaacgcauauagcuggaacacauaauuauacaaugaaccuugcaucccaaaacuggaacaauuacgaucccacugaagaaauaccagcaccacuuggaacaccugacuuuguugguagaauacaaggaaugcuuacacaaacaacaagaggagauggaucaacaagaggacacaaagccacaguuucaacaggagauguucacuuuacaccaaaauuaggaucuauucaauuuaauacagauacaaacaaugauuuugaaacaggccaaaacacaaaauuuacaccaguagguguuguacaagacggaaauggcacacaucaaaaugaaccacaacaauggguucuaccaucauacucuggaagaacaggacauaacguacaucucgcuccagcaguagccccaacauuucccggagagcaacuacuauucuucagaaguacaaugcccggaugcucaggauauccaaauaugaaucuagauugccuauuaccacaagaguggguccaacacuucuaucaagaagcagcaccagcacaauccgacguagcacuuuugagauuuguaaacccagauaccggaagaguccuauucgaaugcaaauuacauaaaucuggauauguuaccguugcacacacuggccaacaugaucuaguaauuccuccaaauggauauuuccgauucgacucuuggguaaaucaauucuacacucuugcuccaaugggaaacgguacaggacgccgacgauaa

SEQ ID NO: 34066 - RNA, 1617 nt, Artificial Sequence
  derived and/or modified sequence opt6 from VP1__Norovirus_and/or_Norovirus-like__KX158280
augaaaauggccuccagugacgcuaacccaucagauggaucagccgcuaacuuaguaccagaaguaaauaaugaaguuauggcuuuagaaccuguaguaggugcagcaauagcagccccuguagcgggacaacaaaauguaauagacccauggauaagaaacaauuuuguacaagccccaggaggugaauuuaccguuucaccgagaaaugccccaggagaaauacuauggucagcuccccuaggaccagaucuaaauccauaucucagucauuuagcccguauguacaacggauaugcaggaggauuugaaguacaaguaauuuuagcagguaaugcauuuacagcuggaaaagucauauuugcugcaguucccccaaauuuuccaacagaaggacuuucaccuucccaaguaacuauguuuccacauauuguaguagauguaagacaacucgaaccaguauuaauaccauuaccugacguucgaaacaauuuuuaccauuauaaucaaucaaaugacccaacaauaaaacuuauagcaauguuauacacaccacuaagagcaaacaaugcaggagacgacguauucacugucuccugcagaguacuaacucgaccaucaccagauuuugacuuuauauuccuaguucccccaaccguagaaucacgaacuaaaccauuuucaguuccuguccuaacuguagaagaaaugacaaauucaagauuuccaauuccacuagaaaaacuauuuacaggaccuucuucagccuucgucguacaaccacaaaauggcagauguaccacagacggcguacuacuaggaacaacacaauuaucaccaguaaacauaugcacauuuagaggugacguaacacacauaacaggaucucgaaauuacacaaugaaucuagcuucccaaaacuggaacaauuacgacccuacugaagaaauaccagcaccacuaggaacaccugacuucguaggcaaaauacaaggaguucuaacccaaacuacaagaacagauggauccacaagaggacacaaagcaacagucuauacaggauccgcugauuuugcaccuaaauuagguagaguacaauucgaaacagauacugaccacgacuucgaagccaaucaaaacacaaaauucacaccaguaggcguaauacaagacggaucaacuacacauagaaacgaaccccaacaauggguacuaccaucauacucaggaagaaauacaccaaacguacauuuagcaccagcaguagccccaacauuuccaggagaacaauuacuauucuuucgaucaacuaugccagguugcucaggauacccaaauauggaucucgauugcuuauuaccacaagaauggguucaauauuuuuaucaagaagccgcuccagcacaaucagaugucgcacuacuaagauucguaaacccagacacaggaagaguccuauucgagugcaaacuucauaaaucaggauauguaacaguagcacacacuggacaacacgauuuaguaaucccaccaaauggauauuucagauucgauucauggguaaaucaauucuauaccuuagcacccauggguaauggaacaggaagaagaagauaa

SEQ ID NO: 34067 - RNA, 1617 nt, Artificial Sequence
  derived and/or modified sequence opt6 from VP1__Norovirus_and/or_Norovirus-like__KX371606
augaaaauggcaucaucagaugccaauccaucagacggaucagcagcaaauuuaguacccgaaguaaacaacgaaguaauggcacuagaaccaguaguaggagccgcaauagcagcaccaguugcaggacaacaaaacgucauagauccauggauaagaaauaacuuuguucaagcaccaggaggagaauuuacuguaucaccacgcaaugcaccaggagaaauacuauggucagccccgcuaggaccagaucuaaacccauaccuaucacaucuugcacgaauguacaacggauacgcaggagguuuugaaguacaagucauuuuagcuggaaaugcauuuaccgccggaaaagucauauuugcagcagucccuccuaacuuuccaaccgaaggccuaucaccuucacaaguuacaauguucccacacauagucguugauguaagacaacucgaaccaguauuaauaccccuaccugauguacgaaauaauuuuuaucacuauaaucaaucaaacgacccaacaauaaaauuaauagcaauguuauauacacccuuaagagcuaauaaugcaggcgaugauguauucacuguaucauguagaguacucacaagaccauccccagacuuugacuuuauauuuuuaguaccaccaacaguagaaucacguaccaaacccuuuucaguaccuguacuaaccguagaagaaaugacaaauucccgcuuuccaauaccauuagaaaaacucuucacaggcccaucaucagcauuuguaguacaaccacaaaacggaagaugcacaaccgacgguguauuauuaggcacaacucaauuaucaccaguaaauauauguacauuccgaggagacguuacacauauuacaggcaguagaaacuacacaaugaaucuagcuagccaaaacuggaacaauuacgacccaacagaagaaauaccugcaccacucggaaccccugauuuuguagguaaaauacaaggaguuuuaacacaaacaacacgaacagacggaucaacaagaggacauaaagcaacaguauauacaggaucagcagacuuugcacccaaacuaggcagaguucaauucgaaacagauacagaucaugacuucgaagcaaaucaaaauacaaaauuuacaccaguuggaguaauacaagacggauccacgacccauagaaaugaaccacaacaauggguacucccauccuauucagguaggaacacccauaacguacaccuagcacccgccguagcacccaccuucccuggagaacaacuauuauuuuucagauccacgaugcccggauguucagguuauccaaauauggaccuugacuguuuacuaccccaagaauggguccaauauuucuaucaagaagccgcucccgcucaaucagacguugcccuacuacgauucguaaaccccgauacagguagaguacuauucgaaugcaaacuacauaaaucaggauacguaacaguagcacacacagggcaacacgacuuaguuauaccucccaauggauacuucagauuugauuccuggguaaaucaauucuauacuuuagcacccaugggaaauggaacaggaagaagacguuaa

SEQ ID NO: 34068 - RNA, 1617 nt, Artificial Sequence
  derived and/or modified sequence opt6 from VP1__Norovirus_and/or_Norovirus-like__KX371605
augaaaauggccucaucagaugcaaaucccucagacggaucagccgcaaaccucguaccugaaguaaacaaugaagucauggcacuagaacccguagucggagcagcaauagcagcaccuguagcaggacaacaaaacgucauagacccauggauaaggaauaauuucguacaagcaccaggaggugaauuuacaguaucaccacgaaaugcuccaggugaaauauuauggucagcuccuuuaggaccagauuuaaacccauaccuaucucaccuugcaagaauguauaacgguuacgcugguggauucgaaguacaaguaauucuagcaggcaaugccuuuacagcaggcaaaguaauauuugcugcgguaccaccaaacuuuccaacagaaggucuuucaccuucucaaguaacuauguuuccccacaucguaguugacguucgucaauuagaaccaguacuuauuccacuaccugauguacguaacaauuuuuaucacuauaaccaauccaaugacccaacaaucaaacuuauagcuauguuauacacuccccuaagagcaaauaaugcaggagacgauguauuuacaguaucauguagaguuuuaacaagaccaaguccagacuuugauuuuauauuucuaguuccaccaacaguugaaagucgaacuaaaccauucucuguaccaguacuaacaguugaagaaaugacaaacucacgauuucccaucccauuagaaaaguuauucaccgguccaucuucagcuuucguaguacaaccacaaaacggaagauguacaacagauggaguacuacuuggcacaacccaacuaucaccaguaaacaucugcaccuuuagaggagauguuacacauauaaccggauccagaaauuacacaaugaauuuagcaucacaaaacuggucaaauuaugacccuacagaagaaauaccagcaccuuuaggaaccccagauuuuguagguaaaauacaaggaguuuuaacacaaacaacuagaacugacggaucaacaagaggacauaaggcaacaguauauacuggaucagcugauuuugccccuaaacuaggacguguacaauuugaaacagauacagaucacgauuucgaagcaaaucaaucaaccaaauucacacccguaggcguuauacaagacggaucaacaacucauagaaaugaaccucaacaauggguucuaccaucauauaguggacgcaauacaccaaacguacaccuugcuccggcaguugcucccacauuuccaggagaacaauuacuauucuuucguuccacaaugccagguugcucaggauauccaaauauggaucuagacugcuuacuaccacaagaauggguacaauauuucuaccaagaagcagcaccagcacaauccgacguugcucuacuaagauucguaaauccagacacuggaagaguguuauuugaaugcaaauuacauaaaucaggauauguaacuguagcccauacaggacaacacgacuuaguuauaccaccuaauggauauuuuagauucgauucuuggguaaaucaauucuauacacucgcaccaaugggaaauggcacgggacguagaagauaa

SEQ ID NO: 34069 - RNA, 1617 nt, Artificial Sequence
  derived and/or modified sequence opt6 from VP1__Norovirus_and/or_Norovirus-like__KX354128
augaaaauggcaucuaaugacgcuaauccaucagauggcagcgcugcuaacuuaguacccgaaguaaauaaugaaguaauggcacuagaacccguaguaggcgcugcaaucgccgcaccuguagcuggccaacaaaacgucauagacccuuggauaagaaacaauuucguccaagcaccaggaggagaauuuaccguuagcccaagaaaugccccaggugaaauacuauggucagcaccacuuggaccagauuuaaauccauaccuaucucauuuagcacgaauguauaacggauaugcugguggauuugaaguacaaguaauacuugccggaaaugccuuuacagcaggaaaaauaauauucgcagcaguacccccuaauuuuccuacagaaggauuaucaccaucucaaguaaccauguuuccacacauuauaguagacguuagacaacuagaaccaguacuaauaccauuaccagaugucagaaacaauuucuaucauuacaaccaaaguaacgacucaacaauaaaauuaaucgcaauguuauacacuccacuuagagcaaacaaugcaggagaagacguauuuacaguaucaugucgaguccuaacaagaccaucaccagacuucgauuuuauauuuuuaguaccaccuacaguagaaucaagaacaaaaccuuucacuguaccaauacuaacuguagaagaaaugacaaacucaagauuucccaucccccuagaaaaauuauuuacagguccaucaucagcauucgucguccaaccccaaaacggaagaugcacaacagauggcguauuacuaggaacaacccaacucuccccuguaaauauauguacuuuucgaggagaugucacccauauagcugguucaagaaauuauaccaugaaccuagcaucauuaaacuggaacaacuacgaccccacagaagaaauaccagcuccacuuggaacaccagauuuuguugguaaaauacaaggauuauuaacacaaaccacaaaaggagacggaucaacuagaggucacaaagcaacagucuacacaggaucagccccauuuacaccaaaacuaggaucuguacaauucgaaacagauacagaaaacgacuucgaaacacaucaaaauacaaaauucaccccaguaggaguaauacaagacggaggaacaacacauagaaacgaaccacaacaauggguucuaccaucuuauucaggaagaaauguaccaaacguucacuuagcaccagcaguagcaccaacuuucccaggugaacaacuauuauucuuuagaucuaccaugccaggauguucaggauaccccaacauggauuuagauugccuauuaccacaagaauggguucaacacuucuaccaagaagcugcuccagcacaaucugacguugcauuauuacguuucguuaauccagauacaggacgaguauuauucgaauguaaauuacacaaaucaggcuacguaacuguagcucacacaggccaacacgaucuuguaauaccacccaauggauauuucagauucgauucuuggguaaaucaauucuauaccuuagccccaaugggaaacggaacaggacgcagacgauaa

SEQ ID NO: 34070 - RNA, 1617 nt, Artificial Sequence
  derived and/or modified sequence opt6 from VP1__Norovirus_and/or_Norovirus-like__KX354099
augaaaauggcuagcucugacgcaaguccuuccgauggaagugcagccucauuaguaccagaaguuaacaaugaagucauggcauuagaaccaguaguaggagcagcaaucgccgcaccuguagcaggacaacaaaacgucauagauccauggauaagaaauaacuuuguucaagcaccugguggagaauuuacaguaucaccuagaaaugcaccaggggaaaucuuauggucagcaccauuaggaccagaucuaaacccuuaucuaucucauuuagccagaauguauaauggauacgcaggaggauuugaaguacaaguaauucuagcaggcaacgcuuuuacagcaggaaaaguaauauucgcagcuguacccccaaauuuccccacagaaggauuaucaccaucccaagucacuauguucccacacaucguuguagacguaagacaacuugaaccaguccucaucccacucccagauguuagaaacaauuucuaucacuauaaccaauuaaaugacccaacaauuaaauuaauagccauguuauauacaccauuaagagcuaauaacgccggugacgacguuuuuacaguaucuuguagaguauuaacaagaccaucuccagauuuugacuuuauuuuucuuguuccucccacaguagaaucaagaacuaaaccguucucuguaccaguucuaacaguugaagaaaugacaaacucaagauucccaauaccauuagaaaaacuauuuaccggaccaucuucugcauuuguaguucaaccacaaaauggaagaugcaccacagacggagucuuacucggaacaacacaacuuucaccuguaaauauauguacauucagaggcgauguaacacauauaacaggaucacauaacuacacaaugaaucucgcaagucaaaacuggaauaauuaugauccaacagaggaaauaccagcuccauuagguacacccgacuuuguagguaaaauacaaggaguauuaacacaaacaacacgagcagauggcucaacuagaggucauaaagcaacaguauauacagguucagcagauuucgcaccaaaauuaggacguguacaauucgagacagauacugaccacgacuucgaaaccaaccaaaauacuaaauucacaccaguaggaguaauccaagacgguggcacaacacaucgaaaugaaccacaacaauggguauuaccaucauauagugguagaaauacucauaauguucaccuagcaccagccguagcaccaacauuuccaggcgaacaacuacuuuucuuucgauccacaaugccaggcuguucaggauauccaaauauggacuuagauugucuacuaccacaagaauggguacaauacuuuuaucaagaagcagcaccagcccaaucagauguagcauuauuaagguuuguaaacccagauacaggaagaguucuuuucgaauguaaacuacacaaaucuggauaugucacugucgcacauacuggacaacacgaccuaguaauuccuccuaauggauacuuuagauucgauucaugggugaaccaauuuuauacucucgcaccaaugggaaauggagcaggucgacgccgauaa

SEQ ID NO: 34071 - RNA, 1617 nt, Artificial Sequence
  derived and/or modified sequence opt6 from VP1__Norovirus_and/or_Norovirus-like__KX354087
augaaaauggcaucaaaugacgccaacccuucagacggaucagcagcaaacuuagucccagaaguaaacaaugaaguaauggcacuugaaccuguuguaggagcugcaauagcagcuccuguagcuggacaacaaaauguaauagaccccuggauucguaacaacuuuguacaagcuccugguggagaauuuacaguaucaccaagaaaugcuccaggagaaauauuauggucagcaccauuaggccccgauuuaaauccauacuuaucacaccuagcucgaauguauaauggauacgcaggagguuucgaaguccaaguaauauuagcuggaaacgcauuuacagcaggaaaaaucaucuuugcugccguuccaccaaacuuccccacagaaggucuaucaccaucccaaguaacaauguucccacacauaauaguagauguuagacaacuagaaccaguauuaauaccauuaccggauguacgaaauaauuucuaucacuauaaccaaucaaacgauaguacaauaaaauuaauagccaugcuauauacaccacuaagagcuaauaaugcuggugacgauguauucacaguaucuuguagaguucuaacaagaccuucaccagacuuugauuuuauauuccucguaccacccacaguagaaucaagaacuaaacuauuuacaguccccauauuaacagucgaagaaaugaccaauucaagauuucccauaccauuagaaaaacuauucacuggaccauccucagcauucguaguucaaccacaaaacggucgcugcacaaccgauggaguauuacuaggaacaacacaacuaucaccuguaaauauauguacauucagaggcgacguuacacauauagcaggauccagaaacuacacuaugaacuuagcaucacuaaacuggaacaauuaugauccaaccgaagaaauaccagcuccacuaggaacaccugauuuuguaggaaaaauacaaggugucuuaacccaaacaaccaaaggagacgguucaacaagaggucacaaagcaaccguuuacaccggaucagccgacuucacaccuaaauuagguucaguacaauucgcaaccgacacagaaaaugauuucgaaauacaucaaaauacacguuucacaccugucggaguuauucaagacggaggcacaacacaucgaaaugaaccacaacaauggguccuaccuucauacucagguagaaauguacauaacguacauuuagcaccagcuguugcgccaaacuuucccggagaacaacuauuauucuuuagaucuacaaugccaggauguucaggauauccaaacauggaccuagauuguuuacuaccacaagaauggguucaacacuucuaccaagaagcagcaccagcucaaucugacguugcacuccuaagauuuguaaacccugauacaggaagaguacuauuugaauguaaauuacauaaaucaggauauguaacagucgcacacacaggacaauacgacuuaguuauuccacccaaugguuauuuccgauuugauuccuggguaaaucaauucuauacucuagcaccaaugggcaacggaacuggacgaagacgauaa

SEQ ID NO: 34072 - RNA, 1617 nt, Artificial Sequence
  derived and/or modified sequence opt6 from VP1__Norovirus_and/or_Norovirus-like__KX354009
augaaaauggcaucuuccgaugcaaauccuagugacggaucagcagcaaauuuaguaccagaaguaaacaacgaaguuauggcucuagaacccguaguaggugccgcaauagcagcucccguagcaggacaacaaaacguaauagauccuuggauuagaaauaacuuuguucaagcuccagguggagaauuuacaguuucaccacguaaugcacccggagaaauacucuggucagcaccacuagguccagaccuaaacccauaccuaucacaccuagcaagaauguauaauggauacgcaggaggauuugaaguacaaguuauccuagcaggaaacgcauuuacagcaggaaaaauaauuuucgcagcaguuccuccuaacuuucccacagaaggauuaucaccuucacaaguaacaauguuuccacacauaguaguugacguuagacaacuagaaccaguauuaauaccauugccugauguuagaaauaauuuuuaucacuauaaccaaucuaaugauccaacuauaaaauuaauagcuauguuauauacuccauuaagagccaacaaugccggugacgauguauucacuguauccuguagaguccuaacuagaccuagccccgauuucgacuuuaucuuucuagucccaccuacagucgaaagcagaacaaaaccauuuucaguaccaguauuaaccguagaagaaaugacaaacucacgauucccaaucccauuagaaaaacuauucacaggaccaucuucagcauuugucguacaaccgcaaaacggaagauguacaacugacgguguucuccuaggaaccacacaacuaucaccuguaaacauuuguacuuucagaggagacguaacacauauaaccggaucuagaaauuacacaaugaaucuugcuucacaaaauuggaacaauuacgauccaacagaagaaauaccagcacccuuaggaaccccagauuuuguugguaaaauacaaggaguccuaacacaaacgacaagaaccgauggcucaacucguggccacaaagcaacagucuauacaggaagcgcagauuuugcgcccaaauuaggaagaguacaauuugaaaccgauacugaccacgauuucgaagcaaaucaaaauacaaaauucacaccaguaggaguaauacaagacggcucaacuacccauagaaacgaaccacaacaauggguuuuaccaucuuauucugguagaaauacacacaacguacaccuagccccagcaguugcaccuacauuuccaggagaacaacuauuauucuuuagaucuacaaugccugguuguagcggcuacccaaauauggacuuagauugucuacuaccacaagaauggguucaauauuucuaucaagaagcagcaccagcacaaucugacguagcacuauuacgauuuguaaauccagacacagguagagucuuauucgaaugcaaauuacacaaaaguggauauguaacuguagcucacacaggacaacaugaccuaguaauacccccaaauggauauuuuagauucgauucaugggucaaucaauuuuacacccuagcaccaaugggaaauggaacuggaaggcguagauaa

SEQ ID NO: 34073 - RNA, 1617 nt, Artificial Sequence
  derived and/or modified sequence opt6 from VP1__Norovirus_and/or_Norovirus-like__KR131784
augaaaauggcaucauccgaugcuaauccaucagacggaucagccgcaaacuuaguaccagaaguaaacaaugaaguaauggcauuagaaccuguaguaggagcugcaauagcugcaccaguagcaggucaacaaaauguaaucgauccauggauacgaaauaacuuuguacaagccccaggaggugaauuuacagucucaccaagaaaugcaccaggagaaauuuuauggucagcuccauuaggaccugaccuaaauccauauuuaucacaucuugcacgaauguauaacggauacgcaggaggauucgaaguacaaguaauuuuagcaggaaacgcauuuaccgccggcaaaguaauauuugcugcuguaccuccuaauuuuccaacagaaggauuaucacccucucagguuaccauguuuccucauauaguaguugacguaagacaauuagaaccaguauuaaucccauuaccagauguucgaaauaauuucuaucacuauaaucaauccaaugauccuacaauaaaacuaauagcaauguuauacacuccauuaagagcaaauaaugcuggagaugauguauucacuguaucaugcagaguacuuacaagaccaagcccugacuuugauuuuauauuuuuaguacccccaacuguggaaucgcgaaccaaaccauuuucaguaccaguacuuacaguagaagaaaugacuaauucacguuucccaauuccauuggaaaaacuauuuacaggaccaucaucagcauuuguaguucaaccccaaaaugguagauguacaaccgaugguguccuuuuaggaacuacacaacuauccccaguaaauauauguacauuuagaggcgauguaacucauauaacaggaagccgcaacuauacaaugaacauggcaucucaaaauuggaauaauuaugacccuacagaagaaauuccagccccacuagguaccccugauuuuguaggaaaaauacaaggaguuuuaacgcaaaccacucguacugauggaucaaccagaggacacaaagccacaguuuacacaggaucugcagacuuugcuccuaaacuuggaagaguacaauucgaaacagauacagaucacgauuuugaagccaaccaaaauacuaaauucacacccguaggaguaauacaagauggaucuacaacucaucgaaacgaaccacaacaauggguccuaccuucauacucagguagaaacacacauaauguacauuuagcuccugcaguagcaccaacauuuccaggcgaacaauuacuauucuucagaucgacuaugcccggauguaguggauaucccaauauggaccucgacugcuuacugccacaagaauggguacaauauuuuuaucaagaagcagcacccgcacaaucagacguagcauuauuacgauucguaaacccugacacaggaagaguauuauucgaauguaaauuacacaaaucggguuacgucacaguagcucacacaggacaacaugaucuaguaauaccacccaacggauauuuccguuucgauucauggguaaaccaguucuauacauuagcccccauggguaauggaacaggaagacgcagauaa

SEQ ID NO: 34074 - RNA, 1617 nt, Artificial Sequence
  derived and/or modified sequence opt6 from VP1__Norovirus_and/or_Norovirus-like__AB972527
augaaaauggcuucaucggacgcuaacccaucugauggauccgccgcaaacuuagucccagaaguaaacaaugaaguaauggcacuagaaccaguaguaggagccgcuauugccgcaccaguagcaggccaacaaaaugucauugacccauggauaagaaauaacuuuguacaagcccccggaggugaauuuacaguuucaccacgaaaugcacccggagaaauacuauggucagcaccauuaggaccugaccuaaacccauauuuaucucaccucgcaagaauguauaauggauaugcuggaggcuucgaaguucaaguuauuuuagccggaaaugcauucacagcaggaaaaguaauauucgcagcaguuccaccaaacuucccaacagaaggauuaucaccaucacaaguaaccauguucccucauauagucguagacguaagacaacuagaacccguauuaauaccauuaccagacguaagaaauaauuuuuaccacuacaaccaaaguaacgacccaacuauaaaacuaauagcaaugcucuacacacccuuaagagcuaauaacgcaggagaugauguauuuacaguaucaugucgcguauuaacaagaccaagcccagauuuugacuucauauuccuaguaccuccuacagucgaaucaagaacaaaaccauucucugucccaguauugacaguagaagaaaugacaaauucacgcuucccaauaccucuugaaaaauuauuuacaggaccaucuuccgcauuuguaguacaaccccaaaacggaagaugcacaacagacggcguauuacuaggaacaacacaacucucaccuguuaauauaugcacuuuuaggggugacguuacucauauaacaggaucaagaaacuauacaaugaaucucgcaagucaaaauuggagcaauuacgacccaaccgaagaaauaccagcaccacuaggcaccccugauuuugucggaaaaauacaaggaguguuaacucaaacaacaagaacagaugguuccacuagaggucauaaagcuacaguauauacaggaucagcagacuuugcacccaaauuaggucguguccaauucgaaacagauacagauagagauuucgaagcaaaucaaaauacaaaauucacuccaguuggaguaauucaagauggauccacaacacacagaaaugaaccucaacaauggguacucccaucauauuccggacgauacacaccaaauguacacuuggccccagcagucgcuccaacauuuccaggagaacaacuauuauucuuuagaucaacaaugccaggauguuccggcuauccuaauauggaccuagacugcuuauuaccacaagaaugggugcaauauuuuuaucaagaagcugcaccagcucagucagauguagcuuuacucagauuugucaacccagacacaggaagaguacuuuucgaauguaaguuacacaaaucaggauauguaacaguagcacacacaggccaacacgauuuaguaauaccaccgaauggcuauuuuagauuugauucuugggucaaucaauucuauacucuagcaccaaugggaaauggaacaggacgaagaagauaa

SEQ ID NO: 34075 - RNA, 1617 nt, Artificial Sequence
  derived and/or modified sequence opt6 from VP1__Norovirus_and/or_Norovirus-like__AB972525
augaaaauggcaucaaaugacgcaaaccccucagacggcucagcagcaaaucuaguuccagaaguaaauaaugaagucauggcacuagaaccaguaguaggagcugcaaucgcagcaccaguagcaggacaacaaaauguaauagaccccuggauuagaaacaacuuuguacaagccccaggaggagaauuuacaguauccccaagaaacgcccccggagaaauauuauggucugcaccacucggaccagaucuaaauccauaucuaucucaucuugcaagaauguacaacggcuaugcaggagguuuugaaguacaaguaauuuuagcaggaaacgcauuuacagcagguaaaaucauauuugcagcuguaccaccgaacuuuccaacagaaggucuauccccaucacaaguuacaauguucccacacauaauaguagauguaagacaauuagaaccaguauuaauaccauuaccagacguaagaaacaauuucuaccacuauaaccaaucaaacgauucuacaauaaaacuaauagcaaugcuuuacacaccuuuaagagccaauaaugccggugaagauguauuuacagugucuuguagaguacuaacacgcccaucuccagauuuugacuuuauauuucuaguuccuccuacaguagaaucaagaacaaaaccauuuacagucccuauccucacaguagaagaaaugacaaauucuagauucccaauaccacuagagaaauuauucacaggucccucaucggcauuuguuguacaaccacaaaauggccguuguacuacagacggaguacuacucggaacaacccaauuaucuccaguuaacaucuguacuuucagaggagacguaacacauaucgcagguucaagaaauuauaccaugaauuuagcaucacuaaauuggaauaauuaugaucccacagaagaaauaccagcaccauuaggaacaccagauuuuguagguaaaauccaaggaaugcuuacacaaacaacaaaaggagacgguuccacuagaggacacaaagcaacaguauacacagguucagcaccauuuacaccaaaauuaggaucaguacaguucgaaacagauacagaaaaugauuucgaaacacaucaaaauacaaaauucaccccaguaggaguaauacaagacggugguacaacacaucgaaaugaaccacaacaauggguacucccaucuuauucaggacgaaacguaccaaacguacaccuagccccugcaguagcaccaacauuuccaggugaacaauuauuauuuuucagaucaacuguacccggauguucaggcuauccaaauauggauuuagacugccuauuaccacaagaauggguccaacauuuuuaucaagaagcagcacccgcucaaucagacguagcauuacuuagauucguaaacccagauacaggacgaguccuauucgaauguaaacuacauaaaaguggauauguaacaguagcacauaccggacaacacgaucuaguaauuccuccaaacggcuacuuuagauucgauucauggguaaaccaauuuuacacacuugccccuauggguaauggaaccgguagaagaagauaa

SEQ ID NO: 34076 - RNA, 1617 nt, Artificial Sequence
  derived and/or modified sequence opt6 from VP1__Norovirus_and/or_Norovirus-like__KT780388
augaaaauggcuuccucagacgcuaauccaucagauggcucagcagcaaaucucguaccagaaguaaacaaugaaguuauggccuuagaaccaguuguaggagccgcaauagcagcaccaguagcaggacaacaaaauguaauagauccauggauuagaaacaacuuuguacaagcaccaggaggcgaauuuacaguauccccaagaaacgcaccaggagaaauauuauggucagcuccauuaggucccgaucuaaauccuuaccuuucacaccuagcaagaauguacaacggcuaugcaggaggcuucgaaguacaaguuaucuuagcuggaaacgcauuuacagcagguaaaguuaucuuugcagcaguacccccaaauuuuccaacagaaggccuuucaccaucacaaguaaccauguuuccucacauaguagucgauguacgacaacuagagccuguacuuauaccacucccugauguuagaaacaauuuuuaucauuauaaucaaucaaacgauccaacaauaaaauuaauagcaaugcuauacacacccuuacgagccaauaacgccggugaugacguauuuacaguauccugcagaguauuaacaagaccaucaccagacuucgauuucauauuuuuaguaccaccuacaguagaauccagaacuaaaccuuucucaguaccaguuuuaacaguugaagaaaugacaaacucuagauuuccaauuccacuagaaaaacuauucacaggaccaucaucagcauucguaguacaaccccaaaacgguagauguaccacagauggaguauuacuagguacaacucaacuaucaccaguaaacaucuguaccuucagaggagauguaacgcauacaacaggaucccauaauuacacaaugaaucuugcaucacaaaauugguccaauuaugacccaacagaagaaauucccgcaccccuuggaacuccagacuucgucggaaaaauacaagguguacuaacacaaacaacaagaacagauggauccacaagaggccauaaagcaaccguauacacaggcucagcagacuuugcaccuaaauuaggaagaguucaauuugcaacagauacagaucacgacuucgaagccaaccaaaauaccaaauucaccccuguuggugucauacaagauggaggcacuacucacaggaaugaaccacaacaauggguauuacccaguuauucaggcagaaauacaccaaauguacauuuagcacccgcaguagcaccuaccuuuccaggagaacaauuacuuuucuucagauccacaaugcccggauguucugguuaccccaacauggacuuagauugcuuacuaccucaagaauggguccaauauuucuaucaagaagcagcuccagcacaaucagauguagcauuacuaagguuuguaaacccugacaccggacguguacuauucgagugcaaacuacauaaauccggcuauguuacaguagcucauacuggucaacacgacuuaguaauaccaccaaacggguauuuucguuuugauucauggguaaaucaauucuacacauuagcaccaaugggaaauggaacaggaagaagaagauaa

SEQ ID NO: 34077 - RNA, 1617 nt, Artificial Sequence
  derived and/or modified sequence opt6 from VP1__Norovirus_and/or_Norovirus-like__KT780373
augaaaauggcauccucagaugcaaauccuuccgauggaagcgcagcaaaucuuguaccugaagucaauaacgaaguaauggcuuuagaaccagucguaggagcagcuauagcugcaccaguagcaggacaacaaaauguaauagauccauggauaagaaauaacuuuguacaagcuccuggaggagaauuuaccguaucaccacgaaaugcaccuggcgaaauauuauggucugcuccucucggaccugaucugaauccauaucuaucucaccuggcaagaauguacaauggauacgcuggaggauuugaaguacaagucauucuagccggaaaugcauuuacugcaggaaaaguuauauucgcagcaguaccaccaaacuucccaacagaaggccuaucuccaucacaaguuacuauguuuccacacauaguaguagacguaagacaacuagaacccguacuaauaccacuuccugauguaagaaauaauuucuaucauuauaaucaaucaaacgacccaacaauaaaacucauagcaauguuauauaccccacuaagagcaaauaaugcaggagaugaugucuuuacaguaucuugcagaguacuaacaagaccaucuccagauuuugauuucauauuuuuaguaccaccaacaguagaaucacgaacaaaaccauucaguguaccaguacuaacuguugaagaaaugacaaauucuagauucccaauaccuuuagaaaaacucuuuacagguccaucaucagcuuucguuguacaaccacagaauggcagauguacuacugauggaguguuacuaggaacuacacaauuaucucccguaaauauauguacauuuagaggcgaugucacacacauuacaggaucccacaauuacacuaugaauuuagcaucacaaaauuggucaaauuaugacccaacugaagaaaucccagcuccacuagguacaccagacuuuguaggaaaaauacaaggaguucuaacacaaacaacaagaacagacgguucaacaagaggucauaaagcaacaguauauacaggaucagcagacuuugcaccuaaauuaggaagaguccaauucgcuacagacacagaccaugacuuuguagcaaaccaaaauacaaaauuuacacccguuggaguaauucaagacggcggaacaacacaucguaaugaaccacaacaauggguauuaccaaguuauaguggccguaacacaccaaauguacauuuagcaccagcaguagcaccuacauuucccggcgaacagcuucuuuucuuuagaucaacaaugccuggaugcucuggauauccuaauauggauuuagauuguuuacuaccacaagaauggguucaauauuuuuaucaagaagccgcccccgcacaaucagauguagcauuauuaagauuugugaacccugacacaggaagaguacuauuugaaugcaaacuucacaaaucaggcuacguaaccgucgcacacacuggccaacaugauuuaguaauaccuccaaauggauacuuuagauuugacucauggguaaaucaauuuuauacacuagcuccaaugggcaauggcaccggacgaagacgauag

SEQ ID NO: 34078 - RNA, 1617 nt, Artificial Sequence
  derived and/or modified sequence opt6 from VP1__Norovirus_and/or_Norovirus-like__AB933723
augaaaauggcauccaacgacgcaaacccuuccgacggaucagcagcaaaucucguaccagaaguuaacaaugaaguaauggcauuagaaccggucguaggagcagcuauagcggcccccguagcaggucaacaaaaugucauagauccauggauaagaaauaauuuuguucaagcaccuggaggagaauuuacagucuccccaagaaaugcacccggagaaauauuauggagugcaccacuaggaccagaccuaaauccauaucuaucacaccuagccagaauguacaacagcuacgcuggagguuucgaaguacaaguaauacuagcaggcaaugcauucacagcaggaaaaaucaucuucgcugcaguaccaccaaacuucccaacagaaggucuaucaccaucucaagucacuauguuuccucauaucauaguagacguaagacaacuagagccaguacuaauaccauuaccagauguaagaaacaauuucuaccauuacaaucaaucaaaugauucuacaaucaaacucauagcaaugcuauauacuccauuacgagcaaacaaugccggugaagauguauucacaguuaguuguagaguacuaacuagaccaucaccugacuuugauuuuauauuuuuaguaccaccaacagucgaaucaagaacuaaaccauuuaccgucccaauuuuaacaguagaagaaaugacaaacucuagauuuccaauuccauuagaaaaauuauucacaggaccaucuuccgcauuuguaguacaaccacaaaacggaagauguaccaccgacggugucuuacuaggcacaacucaauuauccccaguaaauauauguacauuuagaggagauguaacacauauagcaucaaguagaaauuacacaaugaauuuagcaucacuaaacuggaacaacuacgauccaacagaagaaauaccagccccauuaggaacaccagacuucguagguaaaauacaaggaauguuaacacaaacuaccaaaggagacggcucaacacgaggacauaaagcaaccguauacacaggauccgcuccauuuacaccaaaacuaggaucuguacaauucucaacagauacagaaaacgacuucgaaacacaucaaaauaccaaauucacaccaguaggaguaauacaagacggaucaacuacacacagaaaugaaccccaacaauggguacuuccauccuauucaggaagaaacguuccaaacguacaucuugcacccgcaguagccccugcauuucccggcgaacaauuauuauucuuccgaucaacaaugccaggauguuccggauauccaaauauggaucuagacugccuacuaccacaagaauggguacaacauuucuaucaagaagcagccccugcacaaucagacguagcacucuuaagauucguaaaccccgauacuggaagaguccuauuugaaugcaaauuacauaaaucuggauauguuacagucgcacauaccggacaacacgaucuagucauaccaccaaauggcuauuucagauuugauuccuggguaaaucaauucuacacuuuagcaccuaugggaaauggaacaggaagaagacguuaa

SEQ ID NO: 34079 - RNA, 1617 nt, Artificial Sequence
  derived and/or modified sequence opt6 from VP1__Norovirus_and/or_Norovirus-like__AB933708
augaaaauggcaucaucagacgcuaacccauccgauggaucugcagcaaacuuaguaccagaaguaaacaacgaaguaauggcucuagaaccaguaguaggagccgccaucgccgcaccuguagcaggacaacaaaauguuauagaucccuggauuagaaacaacuucguacaagcaccaggaggagaauuuacaguuucacccagaaaugcaccaggcgaaauauuauggucugcuccauuaggaccagaucuaaaucccuauuuaucucaccucgcaagaauguacaacggauacgcuggaggauucgaaguacaagucauucuagcgggaaacgcuuucacagcuggaaaaauaauauucgcagcaguacccccaaacuuuccaaccgaaggauuaaguccaucucaaguaacaauguucccacauauaauaguagauguacgucaacuagaaccaguacuaauaccauuaccugauguaagaaacaauuuuuaccauuauaaucaaucaaaugauucaacaauaaaauuaauagcuauguuauauacuccccuaagagccaacaaugcuggagaagaugucuuuaccgucuccugcagaguucucacuagaccuuccccugacuuugauuuuauauuucuaguaccuccuacaguagaauccagaacaaaaccauucacaguaccuauauuaaccguagaagaaaugacaaacucucgcuuucccauaccccuagaaaaacuauucaccggcccaucuucagccuucguaguacaaccccaaaacggaagauguacaaccgacggaguacuauuaggaaccacacaauuaucccccguaaauauauguaccuucagaggagacguaacacacauagcaggaucacgaaacuacacuaugaaucuagcaucauuaaacuggaacaauuacgauccaacagaagaaauacccgcaccacuaggaacacccgacuuugucggaaaaauacaaggaaugcuaacacaaacaaccaaaggagaugguucuacaagaggacacaaagcaacuguauauacuggauccgcaccauuuacucccaaacuaggaucuguacaauucuccaccgauacagaaaaugauuucgaaacacaucaaaacacaaaauucaccccagucggaguaauucaagacggaucaaccacccaucgcaacgaaccacaacaauggguucuuccuucuuauuccgguagaaacguacccaauguacaucucgcaccagcaguagcaccaacauuuccaggagaacaacuauuauucuuuagaucaacaaugccaggcugcuccggcuauccuaauauggaucuagauugccuacuaccucaagaauggguccaacacuucuaucaagaagcagcgccagcacaaucugauguagcauuacucagauucguuaacccagacaccggaagaguauuauuugaaugcaaacuucacaagucuggcuacgucacaguagcacacacuggacaacacgaucuaguuaucccaccaaauggauauuucagauucgauuccuggguaaaucaauucuacacacucgcuccaaugggcaauggcacaggacgacguagauaa

SEQ ID NO: 34080 - RNA, 1617 nt, Artificial Sequence
  derived and/or modified sequence opt6 from VP1__Norovirus_and/or_Norovirus-like__LC066046
augaaaauggcaucuucagaugcaaaucccucagacggaucggcagcaaacuuaguaccagaaguaaauaaugaaguaauggcacuagaaccagugguuggagccgcuaucgcagcaccuguagcaggacaacaaaauguaaucgauccauggauaagaaacaacuuuguucaagcaccuggaggagaauuuacagucucaccacgcaacgcaccaggugaaauauuauggagugcaccauuaggacccgaucuuaauccuuaucuaucccaucuagcuagaauguacaacggauaugcaggagguuuugaaguucaaguaauacucgcaggcaaugcauuuacagcaggaaaaguaauauuugcagcaguuccaccaaauuuuccaacagaaggauuaucaccuucccaaguaacuauguuuccacauauagucguugacguuagacaauuagaaccaguucugauacccuuaccggauguacgcaacaauuuuuaucauuauaaccaaagcaacgacccuacaauaaaauuaauagcaauguuauauacaccauuacgagcaaacaaugcuggugaugauguauuuacaguaucaugucgaguacuaacaagaccaucaccugauuuugacuuuauauuuuuaguaccaccaacuguagaaucaagaacuaaaccuuuuucagugccuguacuuaccguugaagaaaugacaaacucuagauuuccaauaccuuuagaaaaacuauuuacaggacccucaucagcauuuguaguacaaccacaaaauggccgauguaccacagauggagucuuacuuggcacuacacaauuauccccaguaaauauauguacauuuagaggcgaugucacucacacaacaggaucccacaauuacacaaugaauuuagcaucacaaaacuggucaaacuacgauccaacugaagaaauaccagcaccacuaggaaccccagauuuuguuggaaaaauacaaggaguauuaacccaaacaaccagaacugacggaucaacacguggacacaaagcaacaguauauacuggaagcgcagacuuugcaccaaaauuaggaagaguacaauuugaaacugacacuaaucaugacuuugaagcaaaucaaaauaccaaauucacaccaguagguguaauacaagauggaggcacuacacacagaaaugaaccucaacaauggguucucccaucauauaguggaagaaacacuccaaauguacaucuagcuccugcaguagcaccaacauuucccggcgaacaauuauuauucuuuagaucaaccaugccaggaugcucaggauauccuaauauggacuuagauugcuuacuaccucaagaauggguacaauauuuuuaucaagaagcagcaccagcacaaucagacguugcauuauuacguuuuguaaaccccgauacuggacgaguauuauuugaauguaaacuccauaaauccggauauguuaccguagcacauacaggccaacaugauuuaguaauaccuccaaauggcuauuuuagauuugauuccugggucaaucaauuuuauacucuagcaccaauggguaauggcacaggacgacgaagauaa

SEQ ID NO: 34081 - RNA, 1617 nt, Artificial Sequence
  derived and/or modified sequence opt6 from VP1__Norovirus_and/or_Norovirus-like__KJ678140
augaaaauggcaucaucagaugcuaaucccuccgauggaucagcagcaucccuaguacccgaaguaaauaaugaaguaauggcacucgaacccguaguaggagcagcuauagcugcaccugucgcuggacaacaaaacguaauagauccauggauacgaaacaauuucguacaagcaccugguggagaauuuacagucucuccacguaaugcaccaggagaaaucuuaugguccgcaccauuaggucccgauuuaaacccauaucuaucccaucuagcaagaauguauaacggauacgcugguggauuugaaguccaaguaauacuggcagguaacgcauuuacugcaggaaaaguaauauuugcagcuguacccccuaacuuuccaacagaaggauuaucacccucucaagucacaauguuuccacacguagucauagauguaagacaacuugaacccguacuaauaccauuaccagauguaagaaauaacuuuuaucauuauaaucaaucaaacgacccaacaauuaaauuaauagcaaugcuuuacacaccccuaagagcaaauaaugccggcgacgauguauuuacaguuuccugccguguacuaacacguccuaguccagacuucgacuucauauuucuaguuccaccaacaguagaaucacgaacaaaaccauuuucaguccccguacuaacuguagaagaaaugacaaacagucgauucccuauuccacucgaaaaauuauuuacaggaccaucuuccgcauucguuguacaaccccaaaaugguagauguacuacagauggaguucuacuaggaacuacacaacuaucaccaguaaauauauguacauuucgaggcgauguaacacauauaacaggaagucguaauuauacuaugaaucuagcuucacaaaauuggucaaauuaugauccaacagaagaaauaccagccccauuaggcaccccugauuuuguaggaaaaauacaaggagucuuaacccaaacaacaagaacagacggcucaacaagaggacacaaagcaacagucuauacuggauccgcugauuucgcaccaaaacuuggucgaguacaauucgaaacagacacagaucacgauuuugaaaccaaucaaaauacaaaauucacuccaguaggugucauacaagacggaggcaccacacauagaaaugaaccacaacaauggguacuaccaaguuauucaggaagaaauacuccaaauguacaccuagcaccagcaguagcaccaacauucccaggugaacaacuauuauucuuuagaucaacaaugccugggugcucaggauauccaaacauggaucuagauugcuuauuaccccaagaauggguacaauacuuuuaucaagaagcagcaccagcucaaucugacguagcauuauuacgauuuguaaacccagacacaggcagaguacuauuugaaugcaaauuacauaaaucaggauauguaacaguagcacacacuggucaacaugaccuagucauaccaccaaacggauauuuuagauuugacucuuggguaaaccaauuuuauacauuagcaccaaugggaaaugggacaggacgacgcagauaa

SEQ ID NO: 34082 - RNA, 1617 nt, Artificial Sequence
  derived and/or modified sequence opt6 from VP1__Norovirus_and/or_Norovirus-like__KJ678139
augaaaauggcaucaucagaugcaaacccuucagauggauccgcagccucuuuaguaccugaaguuaacaacgaaguuauggccuuagaaccuguuguaggagcagcuauagcugcaccuguagcaggacaacaaaauguaauagacccauggauuagaaauaacuuuguacaggcaccaggcggagaauuuacaguaucuccaagaaaugccccuggugaaauacuauggucagcaccccuaggaccagauuuaaauccauauuuaucacacuuagcaagaauguacaacgguuacgccgguggauucgaaguacaagucauacuagcagguaaugcauuuaccgcuggaaagguaauauuugcagcuguuccuccaaacuuuccaacugaaggacuaucacccucucaagucacaauguucccacauauaguagucgauguaagacaacuagaaccaguccuaauuccauuaccagaugucagaaauaacuucuaucauuauaaccaaucaaacgacccuacaauaaaacuaauagcaaugcuauacacaccacuaagagcuaacaaugcaggagacgauguauucacaguaucuugucgaguacuaacaagaccuagcccagauuucgacuucauauuuuuaguaccaccaacaguagaaucuagaaccaaaccauucucaguaccaguacuuacagucgaagaaaugacaaauucucgauuuccaauacccuuagaaaaauuauuuacaggaccaucaucagcauucguaguacaaccucaaaacggaagauguaccacugacgguguccuauuagguaccacucaauuaucucccguaaacauauguacauuuagaggagacguaacacauauaacaggaucaagaaacuacacuaugaaucuagcaucacaaaacuggucuaauuaugaucccacagaagaaauacccgcaccacuaggaacaccagacuuuguuggaaaaauccaaggcguacuaacacaaacaacccgcacagacggaaguacaagaggacacaaagcaacagucuauaccggcucggcagauuucgcaccaaaauuagguagaguacaauuugaaacagauacagaccaugauuucgaagcuaaccaaaauacaaaauuuacuccaguaggaguaauucaagacggaucaacuacacaucgaaacgaaccacaacaauggguccuaccaucauauuccggaagaaauacaccaaauguacaccuugcaccagcaguagccccaacauucccgggagaacaacuacuauucuuuagauccacaaugccggguugcaguggauacccaaauauggacuuagauugccucuuaccacaagaauggguccaauauuuuuaccaagaagcagccccugcccaaucagauguagcacucuuaagauucgucaauccagauacgggucgaguacuuuucgaauguaaauuacacaaaucaggauacgucacaguagcacacaccggucaacacgaucuuguaauaccaccuaaugguuauuucagauuugacucauggguaaaucaauuuuacacauuagcaccaaugggaaauggaacaggccgacguagauaa

SEQ ID NO: 34083 - RNA, 1617 nt, Artificial Sequence
  derived and/or modified sequence opt6 from VP1__Norovirus_and/or_Norovirus-like__EU921383
augaaaauggcaucaaacgacgcaaacccaucugauggaagcgcagccaacuuaguaccagaaguaaguaaugaagucauggccuuagaacccguuguaggagcugcuauagcagcacccgucgccggucaacaaaauguaauagacccauggauaagaaauaauuucguacaagcaccuggaggagaauuuacaguaucgccuagaaaugcaccuggagaaauuuuauggucagcaccacuaggaccugacuuaaauccauauuuaucacauuuagcaagaauguauaacggauaugcugguggauucgaaguucaaguaauccucgcaggaaaugcauucacagcaggaaaaauuauauucgccgcaguacccccuaacuuuccaacugaaggacuuucuccaucccaaguaacaauguuuccacauauaaucguugacguacgucaauuagaaccaguacuaauaccacuuccugacguacgaaauaauuuuuaucacuauaaccaaucaaaugauucuacaauuaaacuuaucgcuaugcuauacacaccccuacgagcaaacaaugcaggagaagacguauuuacaguaucaugucgaguucucacuagaccauccccagacuucgacuucauauuucuuguaccaccaacaguagaaagcagaacaaaaccauuuacaguaccaauucuuacuguagaagaaaugacuaauucuagauuuccaauaccacuagaaaaacuauuuacuggacccucaggagcauucguaguacaaccacaaaauggaagauguacaacagacggaguccuuuuaggaacaacacaauuaucaccaguaaauauuuguacauuccguggagauguaacacauauagcaggaucuagaaacuauacaaugaaccuugcaucacuuaacuggaauaauuacgacccaacagaagaaauuccugcaccauuagguacuccagacuuuguaggaaaaauacaaggaguauuaacacaaaccacuaaaggagacggaucuacaagaggacauaaagcaacaguauauaccgguucagcacccuuuacccccaaauuaggaucaguucaauuuucuacugauacagaaaaugauuuugaagcacaccaaaauacaaaauuuacaccaguaggaguaauacaagauggugguacaacacacagaaacgaaccacaacaauggguauuaccuucuuauuccggaagaaauguacacaacguacacuuagcacccgcaguagcaccaacauuuccaggagaacaacuucuauucuuucguagcaccaugccagguugcuccgguuacccaaauauggauuuagauugccuuuuaccucaagaauggguucaacacuuuuaccaggaagcugccccugcacaaucugauguugcacuauuaagauuuguuaauccagacacaggaagaguacuauuugaauguaaauuacacaaaucaggauauguuacuguagcacacacuggacaacacgaucuaguuauaccuccaaauggauauuuuagauuugauucauggguaaaucaauucuacacauuagcaccuaugggaaauggaacaggacgaagacguuaa

SEQ ID NO: 34084 - RNA, 1617 nt, Artificial Sequence
  derived and/or modified sequence opt6 from VP1__Norovirus_and/or_Norovirus-like__KP176405
augaaaauggcaucaucagaugcaaacccauccgauggcucagcagccaauuuagucccagaaguuaacaaugaggucauggcuuuagaacccguaguaggugcagcaauagcagcuccaguagcaggacaacaaaacguaauagauccauggauaagaaauaacuuuguucaagccccaggcggagaauuuacuguuucaccacgcaacgcaccaggcgaaauacuauggucugcaccacucggaccagaacucaauccauaccuaucccauuuagcacgaauguauaaugguuacgcaggcggauucgaaguacaaguaauuuuagcaggaaaugccuucacagcagguaaaguaauauucgcugcaguaccaccaaauuuuccaacagaagguuuaucaccaucccaaguuacaauguucccacacaucguaguagacguaagacaacuagaaccaguacuaauaccacuaccagacguaagaaacaauuuuuaucauuacaaccaaucuaaugauccaaccauaaaacuaaucgcaauguuauacacaccuuuacgagcaaauaaugccggagaugauguauucacaguaucaugucguguacuaacccgcccuucuccagacuuugauuucauauuuuuaguuccaccuacaguagaaucuagaacaaaaccauuuucaguaccuguacuaacuguagaagaaaugacaaacucaagauuuccaaucccauuagaaaaacuauuuacaggaccaucuucagccuucguaguucaaccacaaaacggaagaugcaccacagacgguguauuauuaggaacuacccaauuaucaccugucaauauauguacauuuagaggugacguaacccauauaacugguucuagaaauuacacaaugaaucuagcaucacaaaacuggucaaauuaugauccaacagaagaaaucccagcaccacuaggaacaccagauuucguagguaaaauucaaggcguacuaacucaaacaacacgaacagauggaaguacaagaggucacaaagcaacuguauacacaggcucugccgauuuugcuccuaaacuaggaagaguucaauuugaaacagauacagauagagacuuugaagcaaaucaaaauacaaaauucacuccaguaggaguaauucaagacggcucaacaacucacagaaaugaaccacaacaauggguauuaccuucauauucaggucguaacacaccaaauguacacuuagcaccagccgucgcaccaacauucccaggagaacaauuacuauucuuuagaucaaccaugccaggaugcucaggauacccaaauauggaucuagacuguuuauuaccucaggaauggguacaauauuuuuaucaagaagcagcaccagcccaaucugauguugcacuccuuagauucguaaauccagacacaggacgagucuuauucgaauguaaauuacauaaaucaggcuacguaacaguagcccacacuggacaacaugaucuaguaauaccaccaaauggauauuucagauucgauucauggguaaaucaauuuuauacauuagccccaaugggaaauggaacuggcagacgaagguaa

SEQ ID NO: 34085 - RNA, 1617 nt, Artificial Sequence
  derived and/or modified sequence opt6 from VP1__Norovirus_and/or_Norovirus-like__KP176403
augaaaauggcaucuucagacgcaaauccaucagacgguuccgcugcaaaucuaguaccugaaguaaauaaugaaguaauggcauuagaaccaguuguaggugcagcgauagcagcuccaguagccggacaacaaaauguuauagacccauggauacgaaauaacuuuguacaagcuccaggaggagaauuuacaguaucuccuagaaacgcaccuggagaaauacuauggucagcaccucuaggaccagauuuaaaucccuaccuaucacaucuugcuagaauguauaacggauaugcuggagguuuugaaguacaaguaauucuagcaggaaacgcuuuuacugcaggaaaagucauauuugcagcagucccuccaaacuucccaacagaaggcuuaaguccaucacaaguuacaauguuuccacauauaguaguugaugucagacaauuagaaccaguauuaauaccacuaccugauguaagaaacaauuuuuaccacuauaaccaaaguaaugauccuacaauaaaauuaauagcaauguuauacacaccuuuacgagcaaauaaugcaggagaugaugucuuuaccguaucuugccguguacuaacacgaccaucacccgauuucgauuuuauauuucuaguuccaccaacaguagaaucuagaacaaaaccauucucaguaccaguacuaacaguagaagaaaugacuaauucaagauuuccaauaccccuagaaaaauuauuuacaggaccaucaagcgcuuucguaguacaaccacaaaacggacgauguaccacagacgguguacuauuaggaacuacacaauuauccccaguaaacauauguacauuuagaggcgacguaacacauaucacaggcucaagaaacuauacaaugaauuuagcuagccaaaauuggaauaauuacgaucccacagaagaaauaccagccccauuaggaacaccagauuuuguuggaaaaauucaaggaguacucacacaaaccacaagaacagauggaucuacucguggacacaaagccacaguauacacuggcucagcagacuuugcaccaaaacuaggcagaguccaauuugaaacagacacagaucaugacuucgaagcaaaucaaaauacucguuuuacaccagucggagucauacaagauggugguacaacacauagaaacgaaccucaacaauggguauuaccaucauacucaggaagaaauacaccaaaugugcauuuagcaccagcaguagcuccuacauuuccuggcgaacaacuauuauucuuucgaucaaccaugcccgguugcucagguuauccaaauauggaucuagauuguuuacuaccccaagaauggguccaacauuuuuaucaagaagcagcucccgcccaaucagacguagcuuuauuaagauuuguaaacccagacacaggaagaguauuauucgaaugcaaacuacauaaaucaggauauguuacaguugcacacacaggucaacacgaccuaguaauaccaccuaacggauauuuccgauucgauucaugggucaaucaauuuuauacccucgcaccaauggggaacgguacaggacgucgcagauaa

SEQ ID NO: 34086 - RNA, 1617 nt, Artificial Sequence
  derived and/or modified sequence opt6 from VP1__Norovirus_and/or_Norovirus-like__KP096343
augaaaauggcaucuucugacgcuaacccaucagacggaucagcagccaaucuaguaccagaagucaauaaugaaguaauggcacuagaaccaguaguaggugcagcuauagcagcaccuguagcaggucagcaaaauguaauagacccauggauucgaaacaauuucguacaagcacccggaggagaauuuacuguaaguccaagaaaugcaccaggugaaauccuauggucagccccauuaggaccagaucuaaauccauaccuaucacaucuagcaagaauguauaauggcuaugcaggaggauuugaaguacaaguaauacuugcuggaaaugcuuuuacagcaggaaaaguuauauuugcagcaguuccaccaaacuucccaacugaaggauuauccccaucacaaguuacaauguucccccauauaguuguagauguuagacaacuagaaccaguacuaauacccuuaccugauguaaggaauaauuucuaccauuauaaucaaucaaaugacccgacaauaaaauuaauagcaaugcuauacacuccuuuaagagccaauaaugcaggagacgauguauucacaguaucauguagaguacuaacaagaccaaguccagacuucgacuuuauauucuuaguaccaccaaccguugaaaguagaacuaaaccauuuagcguacccguacuaaccguagaagaaaugacaaacucaagauuucccguaccauuagaaaaacuauuuacaggaccaucauccgcuuucgucguacaaccccaaaauggaagauguacaacugacggaguucuccuagguacaacucaauuaucaccagucaauauauguacauuccgaggagacguaacacauauaaccgguucucacaacuauacaaugaauuuagcaucacagaauuggucaaauuacgauccaacagaagaaauaccagccccauuaggaaccccugauuuuguagguaaaauacaagguguacuaacacaaacaacaagaacugacggaucaaccagaggacacaaagcuacaguauauacaggaucagcagauuuugcaccaaaacuaggacguguucaauucgaaacagauacagacagagauuuugaagcuaaucaaaauacaaaauucacaccaguaggcguuauccaagauggaggaacaacacacagaaaugaaccucaacaauggguauuacccucauauucuggccgaaauacaccuaacguacaccuagcaccagcagucgcaccaacauuucccggugaacaacuacuauucuuccgaucaacaaugccaggaugcucaggauauccaaacauggaccucgauugcuuacuuccacaagaauggguacaauacuuuuaucaagaagccgcaccagcccaauccgacguagcauuauuaagauuugucaaccccgacacaggaagaguauuauuugaauguaaacuucacaaaucuggguacgucacaguagcacauacuggacaacaugacuuaguaauaccaccaaauggauacuucagauucgauucuuggguaaaucaauuuuacacacuagcaccuaugggaaauggaacaggacgaagacgauaa

SEQ ID NO: 34087 - RNA, 1617 nt, Artificial Sequence
  derived and/or modified sequence opt6 from VP1__Norovirus_and/or_Norovirus-like__KM268101
augaaaauggcaucuucagacgccaauccaucugauggaucugcagcuaacuuaguaccugaaguaaauaaugaaguaauggcauuagaaccuguaguaggagcugcaaucgcugccccaguagcaggacaacaaaaugucauagacccuuggauaagaaacaauuuuguacaagccccaggaggugaauuuacaguaucaccacgaaaugccccaggcgaaauccuauggucagcuccuuuagguccggaucuaaauccuuaccuaucucacuuagcaagaauguacaacggcuacgccgguggauuugaaguacaaguaauauuagcaggaaaugcauuuaccgcaggaaaaguaaucuuugcugcaguuccaccaaacuucccaaccgaaggacuaucaccaucucaaguaacaauguuuccucauauagucguugacguaagacaauuagaaccaguauuaauaccucucccagacguaagaaauaacuuuuaucauuauaaccaaucaaaugacccaacaauaaaauuaauagccauguuauauacuccccuaagagccaauaacgcuggugacgauguuuucacaguaucauguagaguauuaacaagaccaucaccagauuuugacuuuaucuuucuaguaccaccuacagucgagucuagaacaaaaccauucucaguaccaguacuaacaguugaagaaaugacaaauucaagauucccaauaccacuagaaaaauuauucacaggaccaucaucagcauucguaguacaaccacaaaauggaagauguaccaccgauggaguacuacucggaacaacacaacuaucuccugucaauauauguaccuuccguggagacguaacccauaucacaggaucucacaacuacacaaugaauuuagcaucucaaaacuggaauaauuaugauccaacugaagaaauaccagcaccauuaggcacuccugauuuuguaggaaaaauacaagguguucuaacccaaacaacuagaacugaugguuccacacgcggacauaaagcaacaguuuauacaggaagugcagauuuugcucccaaauuaggaaggauucaauuugaaacagauacaaaucacgauuuugaagcaaaucaaaauacaaaauucaccccaguaggcguaauacaagauggaggcacuacccauagaaaugaaccacaacaauggguauuaccuaguuacucaggcagaaauacaccuaacguacauuuagcacccgcaguagcaccuacauuucccggcgaacaacuccuuuucuuucgaucaacaaugccaggauguucaggcuacccaaauauggacuuagauugccuacuuccucaagaauggguacaauacuuuuaucaagaagccgcuccagcacaauccgauguagcauuacugcgauucgucaauccagacacagguagaguauuauucgaaugcaaacuucauaaaucuggauauguuacaguagcccacacaggucaacaugauuuaguaauaccaccaaacggcuauuuuagauucgauucauggguaaaucaauucuauacacuugcuccaauggguaauggaacaggcagaagacgauaa

SEQ ID NO: 34088 - RNA, 1617 nt, Artificial Sequence
  derived and/or modified sequence opt6 from VP1__Norovirus_and/or_Norovirus-like__KM198568
augaaaauggcauccaaugacgcaaauccaucagacggaucagcagccaauuuaguuccagaagucaauaaugaagucauggcauuagaaccaguaguaggugccgcaauagcagcaccugucgcaggacaacaaaauguuauagacccauggauacgcaacaacuuuguucaagcaccuggaggagaguucacuguauccccaagaaacgcuccaggagaaauucuuuggucagcaccacuaggacccgaucugaauccauaucuaucacacuuagcaaggauguauaauggauaugccggaggauuugaaguacaaguaauucuagcugguaaugcauuuacugcuggcaaaauaauauucgcagcaguuccaccuaauuucccaacagaaggucucucaccuucacaaguaacuauguuuccacauauaauaguugauguacgccaacuagaaccaguacuaauucccuuaccagauguaagaaacaauuucuaucacuauaaucaaucaaaugacucaacuauaaaauuaauagcaaugcuauacacaccucuaagggcuaauaaugcaggagaagauguuuuuacaguauccugucgaguauuaacaagaccaucaccagacuuugauuuuaucuuuuuaguaccaccuacaguugaaucaagaacuaaaccauuuacaguaccaauacuuaccguugaagaaaugacaaacucaagauucccaauaccauuagaaaaauuauuuacaggaccaucaggagcauucauuguacaaccacaaaacgguagaugcaccacagauggaguuuuacuuggaacaacucaauuaucaccaguaaauauauguacauuccgaggaggagucacccauauagcuggaucacgcaauuauacaaugaacuuagccagucuaaacuggaauaauuaugauccaacagaagaaauaccagcaccucucgguacaccugacuuuguuggaaaaauacaaggagucuuaacacaaacuacuaaaggagacggaagcacuagaggucacaaagcaacuguauauaccggaagugcaccauuuacaccaaaauuagguucuguucaauuuucaacugauaccgaaaaugacuucgaagcacaccaaaauacaaaauucaccccuguaggaguaauacaagauggaggaaccacacacagaaacgaaccacaacaauggguucuaccuucauauagcgguagagacguacauaauguccaucucgcucccgcaguagcuccaacauucccaggagaacaacuacuauucuuucgaucaacaaugcccgguuguucaggauauccaaauauggauuuagacugccuuuuaccucaagaauggguacaacauuucuaucaagaagcagcucccgcucaauccgacguagcacuauuaagauuuguaaacccagacaccggaagaguauuauucgaauguaaauuacauaaaucuggauauguaacuguugcacacacaggccaacacgaucucguaauaccacccaauggauacuuucgauuugauagcuggguaaaucaauucuauacacuagcacccauggguaacggaacaggaagacgcagauaa

SEQ ID NO: 34089 - RNA, 1617 nt, Artificial Sequence
  derived and/or modified sequence opt6 from VP1__Norovirus_and/or_Norovirus-like__KM198532
augaaaauggcauccaaugacgcaaacccaucugacggaucagcagcaaacuuaguaccagaaguuuccaacgaaguaauggcacuagaaccaguagugggagcagcaauagcagcaccagucgcaggucaacaaaacgucauugauccauggauuagaaauaacuuugugcaagcaccagguggagaauuuacaguuucaccaagaaaugcaccaggagaaauccuguggucagcuccucuaggaccagacuuaaauccauauuuaucacacuuagccagaauguacaacggauaugcuggaggauucgaaguacaaguuauucuagcaggaaaugcauuuacagcagguaaaauaauuuucgcugccguaccaccaaauuucccaaccgaaggauuaucaccaucccaaguaacuauguuuccacauauaauaguugauguuagacaauuagaaccaguauuaauaccuuugccugauguaaggaacaauuucuaucauuauaaccaaacaaacgacuccacaauaaaacucauagcaauguuauauacaccacuacgagcaaacaaugcuggagaagacguauucacaguuucauguagaguacuaacacgaccaaguccagauuuugacuuuauauuuuuaguuccaccaacaguagaaucacgaacaaaaccauucacaguaccuauacucacaguagaagaaaugacaaacucaagauuccccguaccauuagaaaaacuauucaccggaccuucaggugcauuuguuguacagccacaaaaugguagauguacaacagacggcguacuucuagguacaacucaacuaucuccuguaaauauauguaccuuucgaggugaugugacacauauagcaggaucaagaaauuacacaaugaaccuagcaagccucaacuggaacaauuacgauccaacugaagaaauaccugcuccauuaggaacaccagauuuugucggaaaaauccaaggcguacuuacacaaaccacaaaaggagacgguuccacuagaggacacaaagcaacaguauacacuggaucagcaccauuuaccccuaaauuaggaucaguacaauucagcacagauaccgaaaaugauuuugaaacacaccaaaauaccaaauucacaccaguaggagucauacaagauggaggaacaacacauagaaaugaaccacaacaauggguacucccuaguuacaguggaagagacgugcauaacguucauuuagccccagcaguugcaccaacauuucccggugaacaauuacuauuuuucagauccacaaugccugguuguucaggauaucccaauauggaccuagauugucuuuuaccccaagaauggguacaacauuucuaucaagaagcagcuccugcacaauccgacguagcauuacuaagauucguaaauccagacacaggaagaguauuauucgaauguaaauuacauaaaucaggauacgucacaguagcccauacaggccaacaugauuuaguaauuccaccaaacggcuauuuucgauuugauagcuggguaaaucaauucuacacacuagcaccuauggguaauggaacaggacgucgaagauaa

SEQ ID NO: 34090 - RNA, 1617 nt, Artificial Sequence
  derived and/or modified sequence opt6 from VP1__Norovirus_and/or_Norovirus-like__KM198527
augaagauggccucuaaugacgcaaauccaagugauggaucugccgcaaaccuuguuccugaaguaucuaaugaaguaauggcccuagaaccuguaguaggugcugcaauagcagcaccuguagcuggccaacaaaauguuauagauccauggaucagaaauaacuuuguacaagcuccaggcggcgaauuuacaguaucaccaagaaacgcuccaggagaaauacuuuggucagcaccauuaggaccagauuuaaaucccuaucuaucacaccuagcucgaauguauaauggauaugccgguggauuugaaguacaagucauccuagcaggaaaugcauuuacagcaggaaaaauuauauuugcagcuguuccaccaaacuucccaacagaagguuuaucaccaucacaagucacaauguucccucauauaauagucgacguccgccaacucgaacccguucucauaccacuaccagauguuagaaacaauuuuuaccauuacaaucaaacaaaugacucaacaauaaaauuaauagcuaugcucuacaccccauuaagagcaaauaaugcuggugaagacguauuuacaguaucaugucgaguuuuaacuagaccaucaccagacuuugacuuuaucuuucucguuccacccacaguagaaucaagaacaaaaccauucacaguaccaauccuuacgguagaagaaaugacuaacucuagauucccaauaccauuagaaaaacuuuuuacagguccuucaggagcauucguaguucaaccacaaaacggucgauguacuacugauggaguauuacuaggaacaacucaguuaucuccaguaaauauuugcacauucagaggagauguuacucauauagcuggauccagaaacuauacaaugaauuuagcaucacuaaauuggaacaacuaugacccaacagaagaaaucccagcaccucuagguacuccagacuuugucgguaaaauacaaggaguacuaacacaaacaacaaaaggcgacggaucaacucgaggacauaaagcaacaguauauacuggaucagcaccauuuacaccaaaauuaggcucaguacaauucucaacagacacagaaaacgauuuugaaacacaucaaaauacaaaauucacaccaguaggcgucauacaagacggaucuacuacccaucgaaacgaaccacaacaauggguccucccauccuacucaggaagagacguacauaauguacauuuagccccagcuguagcaccuacauucccaggagaacaacuauuauucuuucgaucaacaaugccaggcugcucaggauauccaaauauggauuuagacuguuuauuaccacaagaauggguccaacacuuuuaucaagaagcugccccugcacaauccgauguugcauuacuccgauuuguaaauccagauacaggaagaguccuauuugaaugcaaauuacacaaaucagguuauguuacaguagcacacacaggucaacacgaucugguaaucccaccuaauggauauuuucgauucgauucauggguaaaucaauuuuauacacucgcaccuaugggaaauggaaccggaagaagacguuaa

SEQ ID NO: 34091 - RNA, 1617 nt, Artificial Sequence
  derived and/or modified sequence opt6 from VP1__Norovirus_and/or_Norovirus-like__KF177448
augaaaauggcaaguucagaugcaaacccuuccgauggaucugcagcaaacuuaguaccagaaguuaacaaugaaguaauggcauuagaacccguugugggagcagcuauagcagcaccuguugcaggacaacaaaauguaauagacccauggauacgaaacaauuuuguacaagcaccuggaggagaguuuacaguaucaccaagaaaugcuccaggagaaauauuauggucagcuccuuuaggaccagaccuaaacccauauuuaucucaccuagcacguauguacaauggauacgcaggagguuuugaaguacaagucauacuagcuggaaacgcauucaccgcaggaaaaguaauauuugcagcagucccacccaauuucccaacugaaggauuaucacccucacaaguaaccauguuuccacacauuguaguagacguacgacaauuagaaccaguauuaauaccacuaccagacguucgaaacaauuuuuaucacuauaaccaaucaucagacccuacaauaaaauuaauagccauguuauauacaccucuacgugcaaacaaugccggcgacgauguauuuacaguaucauguagaguacuaacaagaccuucaccagacuucgauuucauauuuuuaguaccucccaccguagaaucaagaacuaaaccauucucaguaccaguuuuaacaguagaagaaaugacuaacucaagauucccaauacccuuagaaaaauuauuuaccggaccaucuucagcauucguaguacaaccucaaaauggacgauguacaacagauggaguuuuacuaggaacuacacaauuaagcccaguaaauauaugcacauuuagaggcgacguuacacacauaacaggaucuagaaauuauacuaugaauuuagcaucacaaaauuggaacaauuacgacccaacagaagaaauccccgcaccacuaggcacuccagacuucguaggaaaaauacaagguguacuaacccaaacaacaagaacugacgguucaacucgaggacauaaagcuacagucuacacuggaagcgcugauuuugcacccaaacuuggaagaguacaauucgaaacagauaccgaucacgauuuugaagcaaaucaaaacacaaaauuuacacccguaggcguaauacaagauggcucaacaacacauagaaacgaaccacaacaauggguacuaccaucauauuccggaagaaauacccacaacguacacuuagcacccgccguagcuccuacauuucccggcgaacaauuacucuuuuuccgaucaacaaugccaggcugcagcggauaucccaauauggaucuagauugucuacuuccucaagaauggguacaauauuucuaucaagaagcagcaccagcacaaucagauguagccuuacuacgauucguaaacccagacacuggacgaguucuauucgaaugcaaauuacauaaaucaggauauguaacugucgcacauacaggucaacaugauuuaguaaucccuccuaaugguuauuucagauucgauuccuggguaaaucaauuuuacacccuagcaccaaugggaaacggcacaggaagacgaagauaa

SEQ ID NO: 34092 - RNA, 1617 nt, Artificial Sequence
  derived and/or modified sequence opt6 from VP1__Norovirus_and/or_Norovirus-like__KF008244
augaaaauggcuucaucagaugcuaacccaucagauggguccgcagccaaccuaguucccgaaguuaauaaugaaguaauggcacuugaaccagucguaggugcagcuauagcagcuccaguagcaggacaacaaaauguaauagauccuuggauacgaaacaauuuuguccaagcaccuggaggagaauuuaccguaaguccucgcaaugccccaggugaaauacuauggucugcaccacuaggaccagaucuaaauccauauuuaagucauuuagcuagaauguauaacggauaugcaggaggauuugaaguacaaguaauacuagcuggaaaugccuucacugcaggaaaaguuauuuuugccgcaguacccccaaauuuucccaccgaagguuuaaguccaucccaaguaacaauguuuccucacauaguaguagacguaagacaauuagaaccuguauuaaucccauuaccagauguuagaaacaauuuuuaucacuauaaccaaucuaaugacccuacaauaaaacuaauugcaaugcuuuauaccccauuaagagcuaacaacgcaggagacgacguuuuuacaguuucauguagaguucuaacucguccaucacccgacuuugacuucauauuuuuaguaccaccuacaguagaaucaagaacaaaaccauuuucuguaccuguccuaacaguagaagaaaugacaaauagcagauuuccaauaccauuagaaaaauuguuuacuggaccaaguucugcauucguaguacaaccacaaaauggaagauguacaacagauggaguacuucuaggaacaacacaacucucaccagucaacauuugcacuuucagaggugauguaacucauauaacaggaucacguaacuacacuaugaaucuugcaucacaaaacuggaacaacuacgauccaacagaagaaauuccggcuccuuuaggaacaccagacuucgucggaaaaauacaaggaguauuaacccaaacaacacguacagaugguucaacuagaggacauaaagcaacagucuauacaggaucagcagauuuugcaccaaaauuaggacgaguccaauucgaaacagauacagaccacgauuucgaaacaaaucaaaacacaaaauuuacaccuguagguguaauacaagauggaucaacaacacaucgaaacgaaccucaacaauggguccuaccauccuauaguggacguaacacacacaacguacaucuagcuccugcaguagcaccaaccuuuccaggagaacaacuauuauuuuucagaucaacuaugccaggaugcucagguuacccaaauauggaucuagauugucuuuuaccacaagaauggguacaauauuuuuaucaagaagcagcuccugcacaaucagacguagcacuacucagauucguaaaucccgauacaggacgaguauuauuugaaugcaaacuucauaaaucaggauacguaacagucgcacacacgggacaacaugaccucguaaucccaccuaauggauauuuuagauuugauucauggguaaaucaauucuacacauuagccccaaugggaaacgguacaggaagaagaagauaa

SEQ ID NO: 34093 - RNA, 1617 nt, Artificial Sequence
  derived and/or modified sequence opt6 from VP1__Norovirus_and/or_Norovirus-like__KF060103
augaaaauggcaaguucagacgcaaacccaagcgacggaucaacagcaaauuuaguaccagaaguaaauaacgaaguaauggcucuagagccaguugucggagcugcaauagcagcaccaguagcuggacaacaaaacguaauagauccauggauaagaaauaauuuuguacaagcaccuggcggcgaguucacagucucaccuagaaacgcaccaggagaaauacuuuggucagcaccuuuagguccagauuuaaacccauaucuaucacaucuagcccguauguauaacggauacgccgguggcuuugaaguacaaguaauauuagcaggaaacgcauuuacagccggaaaaauuauuuucgcagcaguaccaccaaauuuuccuacugaaggacuaucaccaucacaaguuacaauguucccacauauaauaguugacguacgacaauuagaaccuguccucauacccuuaccagacguaagaaauaauuuuuaccacuacaaccaaucaaaugacccaacuauaaaauuaauagcaauguuauauacuccuuuaagagcaaacaaugcuggagacgauguuuucacaguaucaugucgcguucucacacgaccaagucccgacuuugacuuuauauuucuuguaccuccuacaguagaaucacgaacuaaaccauucucaguaccaguauuaacaguagaagaaaugacaaacucccguuuuccaauaccauuagaaaaauuauuuaccggaccauccagcgcauucguaguacaaccacaaaauggaagauguacaacugauggaguauuacuaggcaccacacaauuauccccaguaaacauauguaccuuccguggcgauguaacccauaucucaggcucucacaacuacacaaugaauuuagcaucucaaaacuggaacucuuaugacccuacagaagaaauaccagcaccccuugguacaccagauuuuguaggaaaaauacaaggaguauuaacacaaacuacucgaacagacggcucaacuagaggucauaaagcaacaguauacacaggauccgccgacuuuagcccuaaauuagguagaguucaauucgcaaccgacaccgauaaugacuuugaaacaaaucaaaauacaaaauuuaccccaguuggcguaauucaagaugguggaacgacacauagaaaugaaccacaacaauggguauuaccaucauacucagguagaaauauacauaacguucaucuugcccccgcuguagcacccacauuuccaggagaacaacucuuauucuuuagaucaacuaugcccgguugcucaggauauccaaauauggaccuagauugcuuacuaccacaagaauggguucaauauuucuaccaagaagcagcaccagcacaaucagauguagcauuacuaagauuuguaaauccugacacaggaagaguauuauucgaaugcaaacuucauaaauccggauacguuacuguagcacacacaggacaacaugaucuuguaauaccaccaaauggauauuuuagauuugauucauggguaaaucaauuuuacaccuuagcaccaaugggaaauggcacuggaagaagacgauaa

SEQ ID NO: 34094 - RNA, 1617 nt, Artificial Sequence
  derived and/or modified sequence opt6 from VP1__Norovirus_and/or_Norovirus-like__KC960615
augaaaauggcuucaaacgacgcaaauccaucagaugguucggcagcaaaccuaguaccagaaguauccaaugaaguaauggcauuagaaccuguaguaggugcagcaauagcagcaccaguagcaggacaacaaaauguaauugacccauggauacgcaauaacuuuguacaagcaccaggaggagaauuuacuguuuccccacgaaaugcuccaggagaaauacucuggucagcaccacuaggaccagaucuaaauccauauuuaucacacuuggccagaauguacaacggauacgcaggagguuuugaaguaagaguaauacucgcuggaaaugcauuuacagcuggaaaaauaauuuucgcagcgguaccaccaaacuuuccaaccgaaggauuauccccaucucaaguaacaauguucccacacauaauaguagacguaagacaacucgaaccuguacuaauaccuuuaccagauguucgaaacaauuucuaucauuacaaccaaaccaaugacuccacaauaaaacuaaucgcuauguuauauacaccguuacgagcaaacaaugcuggagaagauguauucacaguauccuguagagucuuaacaagaccauccccagacuucgacuucauauuuuuaguuccaccuacaguagaaucacgcacaaaaccuuucacaguaccaauauuaaccguagaagaaaugacaaacuccagauuucccauaccuuuagaaaaacucuucacagguccaucaucagcuuuuguuguacaaccacaaaacggaagauguacgacagacggaguauuacuaggcacaacccaacuaucaccuguuaauauauguacauuuagaggugacguaacacacauagcagguucaagaaacuauacuaugaaucuugcgucacuuaauuggaacaacuacgacccuacagaagaaauaccagcaccauuaggaacaccagacuuuguaggaaaaauacaagguguucuuacucaaacuacaaaaggugacgguucaacaagaggacauaaagcaacaguauauaccggaucugcuccuuucacaccaaaauuagguucaguacaauucagcacagauacagaaaacgacuuugaaauucaucaaaacacaaaauuuacaccaguuggagucauacaagacggaggaacaacacacagaaaugaaccacaacaauggguauuaccaucauauucaggaagagauguccauaauguacaccucgccccagcaguugccccuaccuucccaggagaacaauuauuauucuuuagaaguacaaugcccggauguucaggauacccuaacauggaucuagauugucucuuaccucaagaauggguccaacacuuuuaucaagaagcugccccagcucaaucugacguugcauuacuccguuucguaaauccagauacaggaagaguccuauuugaauguaaacuacauaaaucaggauauguaacaguagcucacacuggacaacacgaccuuguaauacccccaaauggcuacuucagauuugauuccugggucaaucaauucuauacucuagcuccaaugggaaacggaaccgguagaagacgauaa

SEQ ID NO: 34095 - RNA, 1617 nt, Artificial Sequence
  derived and/or modified sequence opt6 from VP1__Norovirus_and/or_Norovirus-like__KC517373
augaaaauggcaucaaaugacgcuaauccaucagauggaucugccgcaaauuuaguaccugaaguaaacaaugaaguaauggcacuagaaccaguuguaggggcagcaauagcagcaccaguugccggucaacaaaacguaauagacccauggauaagaaauaacuuuguucaagcaccaggaggagaguucacaguaucaccaagaaacgcucccggagaaauccuaugguccgcuccguuagguccagaucucaacccauauuuaucgcauuuggcucgaauguauaacggauacgcaggaggauuugaaguucagguuauauuagcagguaaugcauuuacagcaggaaaaauaauuuucgcagcaguacccccaaacuuuccaacugaaggccuaucacccagucaaguaacaauguucccacauauaaucguagacguaagacaacuagaaccaguauuaauaccauuacccgauguaagaaauaacuucuaucacuauaaccaaagcaacgauucuacaauaaaacuaauugcuauguuauauacuccauuaagagcaaauaacgcgggagaagacgucuucacuguaucauguagaguacuaacaagaccaucaccagacuuugauuuuauauuccuaguaccaccaacaguagaaucacgaacuaaacccuuuacagucccaauauuaacaguagaagaaaugacuaacucaggauuucccaucccauuagaaaaacuauucacaggucccaguuccgccuuuguuguacaaccacaaaaugguagauguacaacggauggaguacuauuaggcacaacacaauuaagcccuguuaauauauguacauuuagaggagacguaacacacauagcaggaagcagaaauuauacuaugaacuuagcaucauuaaacuggaauaauuacgauccaacagaagaaaucccugcaccacuuggaacaccagauuucgucggaaaaguucaaggaguauuaacccaaaccacaaaaggagauggcaguaccagaggacacaaagcaacuguuuacacagguucagccccauuuaccccaaaauuaggaucaguucaauuugaaaccgauacagaaaacgauuuugaaacacaucaaaauacaaaauuuacaccaguuggaguuauacaagacggaggcacagcacacagaaacgaaccucaacaauggguccuaccaucauacucaggaagaaauguaccuaauguacacuuagcacccgcaguugcuccaacauuuccaggagaacaauuauuauucuuuagaucuacuaugccagguuguucaggauauccuaauauggauuuagacugcuuacucccacaagaauggguacaacauuucuaucaagaagcagcaccagcacaaagugacguggcacuacuaagauucguaaaccccgacacaggacguguauuauuugaaugcaaauuacauaaaaguggauauguaacagucgcacacacaggacaaagagaucuuguaauaccuccaaauggauauuucagauucgacucauggguaaaucaauucuauacacuagcaccuaugggaaacggaacuggcagaagaagauaa

SEQ ID NO: 34096 - RNA, 1617 nt, Artificial Sequence
  derived and/or modified sequence opt6 from VP1__Norovirus_and/or_Norovirus-like__JX459615
augaaaauggcauccaaugaugcaaacccaagcgauggaucugcagcaaauuuaguaccugaagucaacaaugaaguaauggcuuuagaaccagucguaggagcagcuaucgcagcaccaguagcaggacaacaaaauguaauagacccuuggaucagaaauaauuuuguccaagcuccaggcggagaauuuacaguuucuccaagaaaugcaccaggugaaauccuauggucugcaccacuaggaccagacuuaaauccauacuuaucacauuuagccagaauguauaacggauacgcaggagguuucgaaguccaagucauacuagcuggaaaugccuucaccgcaggcaaaauaauauucgcagcuguaccaccaaauuuccccacugaaggauuauccccaucucaagucacaauguucccucauauaauaguagauguaagacaauuagaaccaguccucaucccauuaccugauguacgaaauaauuucuaucacuauaaccaaucaaaugauucaacaauaaaacuuauagcaaugcuauacaccccauuacgcgcaaacaaugcuggggaagacguauuuacagucucaugccgaguauuaacgagaccaucaccagaauuugauuuuauauuccuaguaccacccacaguagaaucaagaacaaaaccauucacuguaccuauauuaacaguagaagaaaugacuaauucaagauucccuauaccauuagaaaaauuauuuacaggaccaucuggagcauuuguaguucaaccacaaaauggcagauguacaacagacggaguauuauuaggaacaacacaacucucaccaguuaacauauguaccuuucgaggugacguaacccacauagcaggaucaagaaauuacaccaugaaucuagccucauuaaacuggaacaauuaugacccaacagaagaaauaccagcaccacuaggcacaccugauuuuguaggcaaaauacaagguguacucacacaaacaacaaaaggagacggcucaacucgaggacauaaagcaacugucuacacaggcuccgcuccuuucacaccaaaacuaggaucuguacaauuuucgacagacacagaaaaugauuuugaaacacaucaaaauacaaaauucacacccguagguguaauacaagacgguggcacaacccaucguaaugaaccucaacaauggguccuaccaucguauucaggaagaaacguccauaacguacaucuugcaccagcaguagcacccacuuucccaggagaacaauuauuauucuuuagaucaaccaugccaggauguucaggcuaucccaauauggauuuagacugcuuacuaccucaagaauggguacaacauuucuaccaagaagccgcuccagcccaaucugacguagcauuacuaagauucguaaauccagauaccggaagagucuuauucgaaugcaaauuacauaaaucgggauauguaacaguugcacauacuggacaacacgaccuaguuauacccccaaauggauauuuuagauucgacucaugggucaaucaauuuuauacacuagcuccaaugggaaacggaacaggaagaagaagauaa

SEQ ID NO: 34097 - RNA, 1617 nt, Artificial Sequence
  derived and/or modified sequence opt6 from VP1__Norovirus_and/or_Norovirus-like__JX459603
augaaaauggcaagcaacgacgcaaccccaucggauggaguagcagcacacuuaguaccagaaguuaacaaugaagucauggcacuugaaccaguaguaggagcagcuauagcagccccuguagcaggacaacaaaauguaauugauccuuggauacgaaauaauuuuguacaagcaccuggcggagaauuuacaguaucaccacgaaacgcaccaggagaaauuuuguggucagcaccauuaggaccagaucucaacccauaucuaucacauuuagcaagaauguauaauggcuacgcaggaggauucgaaguacaaguaauucuagcugguaaugcauuuacagcuggaaaaauaauauuugcagcaguaccaccaaauuuuccuacagaaggauuaucaccaucacaaguaaccauguucccucacauaauagucgacguaagacaauuagaacccguauuaauaccuuuaccagauguacgaaauaauuuuuaucacuauaaccaaucuaaugacucgacaauaaaacuuaucgcuauguuauacacaccacuaagagcaaacaaugcaggcgaagauguauuuacugucagcuguagaguacuaacuagaccaaguccagacuuugauuuuauauuucuagugccacccacagucgaaucccgaacuaaaccuuuuacaguaccaauccuuacaguagaagaaaugacaaauucaagauuuccaauuccccucgaaaaauuauucaccggcccuucaggagcauucgugguacaaccacaaaacgguagguguacuacagacgguguuuuacucgguacaacacaacuuucacccguaaauauauguacauuuagaggagacguuacacauauagcaggaucaagaaacuacacaaugaaucuagcaucacuaaauuggaauaauuacgaucccacagaagaaaucccagcaccucuagguaccccagacuuuguagguaaaauucaaggaguauuaacacaaacaacuaaaggugacggaucaacucgaggacacaaagcaacuguauauacaggcagcgcaccauuuacuccaaaauuaggauccguacaauuuucaacagauacagaaaaugacuuugaaacacaucaaaauacaaaauucacaccgguaggaguuauucaagauggcggaacaacacauagaaaugaaccacaacaauggguuuuaccaaguuauuccggaagaaauguacauaacguucacuuagcuccugcuguagcuccaaccuuccccggagaacaauuacuuuucuuucgauccacaaugccagguugcucaggcuauccuaacauggauuuagacugucuuuuaccacaagaauggguacaacauuuuuaccaagaagcugcccccgcucaaucagacguagcacuccuacgauuuguuaauccagacacaggaagaguauuauuugaaugcaaguuacauaaaucaggauacguaacuguagcacacaccggacaacaugauuuagucauaccaccaaauggauauuucagauucgauucauggguuaaucaauuuuacacacuagcaccaaugggcaauggaacugguagaagaagauaa

SEQ ID NO: 34098 - RNA, 1617 nt, Artificial Sequence
  derived and/or modified sequence opt6 from VP1__Norovirus_and/or_Norovirus-like__JX155746
augaaaauggcaucaaaugacgcuaacccaucagauggaucagccgccaaccuaguaccagaagucaacaaugaaguuauggccuuagaaccagucguuggagccgcuauagccgcaccaguagcuggccaacaaaauguuauugacccauggaucagaaauaauuuuguacaagcaccuggaggugaauuuacagucucuccaagaaaugccccaggagaaauucuauggagugccccuuuaggaccugaucuaaaucccuauuuaucccacuuagcuagaauguauaacgguuacgccggcggauucgaaguacaaguuauccuugccggaaacgcauucacagcagguaaaaucauauucgcagcagugcccccaaacuuucccacagaaggacuaucuccaucccaaguaacaauguucccccacaucauagucgacguaagacaauuagaacccguacuuauuccacuaccugauguacgaaacaauuuuuaucauuauaaccaaucaaaugauuccacuauuaaacuaauugcaaugcuauacacaccauuaagagcaaauaaugcaggcgaagauguauuuacaguaucauguagaguauuaacaagaccaaguccugauuucgacuuuaucuuccuaguaccacccacagucgaaucuagaacuaaaccauuuacuguaccuauacuuacaguugaagaaaugacaaacucaagauuuccuauccccuuagaaaaacuauuuacaggaccaucuuccgcuuuuguuguacaaccacaaaacggacgcuguaccacugauggaguacuacuaggaaccacucaacuaucaccaguaaauauuuguacuuuuagaggcgauguuacucacauagcaggcucccgaaauuauacaaugaaccuagcaucauuaaauuggaacaauuacgauccaacagaagaaauuccagcaccacuaggaacaccagacuucgucgguaaaauucaaggaaugcuaacacaaaccacuaaaggagacggauccacuagaggacauaaagcaacaguauauacuggaucagcaccauuuacucccaaacuaggaucaguacaauuuucuacugauacagaaaacgacuuugaaacacaccaaaacacgaaauucacaccaguaggaguaauacaagacggaucaaccacacaucgaaaugaaccacaacaauggguucuaccuucauauagcgguagaaauguaccaaacguacacuuagcaccagcagucgcccccaccuucccaggugaacaauuauuauucuuuagaucaacaaugcccggaugcucuggauauccuaauauggauuuagauugcuuacuaccucaagaauggguacaacauuuuuaucaagaagccgcacccgcacaaucagaugucgcccuauuaagauucguaaacccagacacaggcagaguauuauuugaauguaaacuacauaaaccaggauauguaaccguagcacauacaggacaacacgauuuagucauaccacccaacggauauuuccgauucgacaguugggucaaccaauuuuacacacuagcaccuaugggaaauggaacaggcagacguagauaa

SEQ ID NO: 34099 - RNA, 1617 nt, Artificial Sequence
  derived and/or modified sequence opt6 from VP1__Norovirus_and/or_Norovirus-like__AB541333
augaaaauggcuucaaacgacgcaaacccaucagauggcucugcagcuaauuuaguaccagaaguuaauaacgaaguaauggcacuagaaccaguaguaggagcagcaauagcagccccaguagcaggacaacaaaauguaauagacccuuggauuagaaauaacuuuguccaagcuccaggcggugaauuuacaguaucaccaagaaaugcaccaggcgaaauauuaugguccgcaccauuagaucccgaucuuaaucccuaucucucacaacuagccagaauguauaauggauaugccggcgguuucgaaguacaaguaauacuugcaggaaaugcauucacagcagguaaaauaauuuucgcagcaguaccaccaaauuuuccuacagaaggccuuucaccaucucaaguuacuauguucccucauaucauaguagacguaagacaacuugaaccaguauuaauaccuuuaccggauguccgaaacaauuuuuaucauuacaaucaaucaaacgauaguaccauaaaauuaauagcaauguuauauacaccacuuagagcaaauaacgccggagaagauguauucaccguuucauguagaguccuaacacguccaucacccgauuucgauuuuauuuucuuaguaccaccaacuguugaaucaagaacuaaaccuuucaccguaccaauacuaaccguagaagaaaugacaaauucccgauucccuauaccacuugaaaaauuauuuaccggaccauccuccgcauuugucguacaaccacaaaacggaagauguacaacugacggaguuuuacuaggaacaacacaacuaaguccugucaacauauguacauucagaggagacguuacacauauagcgggcuccagaaauuacacaaugaacuuagcaucuuuaaacuggaacaauuacgauccuacugaagaaauuccagcuccacuuggaacuccagauuuugucgguaaaauacaagguguuuuaacccaaacuacaaaaggcgauggaucaacaagaggacacaaggcaacaguauacaccggcagugcuccauuuacaccaaaacucggaucaguccaauucucuacagauaccgaaaacgauuucgaaacacaucaaaauacaaaauucacaccaguaggaguaauccaagacggaggaacaacacauagaaaugaaccacaacaauggguacuaccuucauauucaggacgcaacguaccuaacguacauuuagcuccagcaguagcaccaacauuuccaggagaacaacuauuauucuuuagguccacaaugccagguugcucaggauacccaaauauggaccuagauuguuuauuaccacaagaauggguacaacauuuuuaucaagaagcagcaccagcacagucagauguagcauuacuuagauucguaaacccagauacaggaagaguacuuuuugaauguaaauuacauaaaucaggauauguuacaguagcacacacaggccaacaugaucuaguaauaccaccaaauggauacuuccguuucgauucauggguuaaucaauucuacacucuagcacccaugggaaaugguacaggaagaagaagauaa

SEQ ID NO: 34100 - RNA, 1617 nt, Artificial Sequence
  derived and/or modified sequence opt6 from VP1__Norovirus_and/or_Norovirus-like__AB541220
augaaaauggcaucuaaugacgccaauccaucagauggaagcgccgcaaaccuaguacccgaaguaaauaacgaaguaauggcacuagaaccaguaguaggagcagcaauagcagccccaguugcaggucaacaaaacguuauagauccuuggauaagaaauaacuuuguacaagcaccaggcggagaauuuacaguaucaccaagaaacgcuccaggagaaauacuauggucagcaccacuagguccagauuuaaauccuuacuuaucacaccuagcacgaauguacaacggcuacgcaggaggauucgaaguacaaguaauuuuagccggcaacgcauuuacagcaggaaaaauaauuuucgccgccguaccaccuaacuucccaacagaaggauuaucaccaucacaaguaacaauguucccacauauuauugucgacguaagacaauuagaaccaguacuaauaccauuaccagauguccgaaauaauuucuaucauuauaaccaaucaaaugacucaaccauaaaacuuauagcaauguuauacacuccacuaagagcaaauaaugcuggugaagacguauucacagucuccugucgaguucuaacaagaccaucaccagacuuugacuuuauauucuuaguuccacccacagucgaaucuaggacaaaaccuuucacaguacccauccuuaccguugaagaaaugacaaacuccagauuccccauuccccuagaaaaacuauuuacaggaccaagcagugcauuuguuguacaaccacaaaacggaagauguacuacagacggaguauuacuaggaacaacacaacuaucuccagucaauaucuguacauuuagaggagacguuacacauauagcaggaucucgaaauuauaccaugaauuuagcaucacuaaauuggaacaacuaugauccaaccgaagaaauaccagcaccauuagguacaccagauuucguaggaaaaauacaaggcguacuuacacaaaccacuaaaggagacggauccacuagaggacauaaagcaacaguauauacaggauccgcaccauuuacacccaaacuaggaucuguccaauucucaacagacacagaaaaugauuuugaaacccaucaaaauacaaaauucacccccgucggaguaauacaagacgguggaacaacacaccguaacgaaccccaacaauggguccuaccuucauacuccggaagaaacguaccuaacguacacuuagccccugcaguagcaccaacauuuccaggagaacaauuauuauucuucagaucaaccaugccuggaugcuccggauauccaaauauggaucucgauuguuuauuaccucaagaauggguacaacacuuuuaucaagaagcagcaccagcacaauccgaugucgcauuacuacgcuucguuaacccagauacaggcagaguccuauucgaaugcaaacuauauaaaucagguuauguaacagucgcacauacaggacaacaugacuuagucauacccccuaauggcuauuucagauucgauucauggguaaaccaauuuuacacacuagcaccaaugggaaauggcacaggaagaagaagauaa

SEQ ID NO: 34101 - RNA, 1617 nt, Artificial Sequence
  derived and/or modified sequence opt6 from VP1__Norovirus_and/or_Norovirus-like__AB504312
augaaaauggcaucuaaugaugcuacaccaucagacggauccacagcgaauuuaguccccgaaguaaacaacgaaguaauggcucuagaaccaguaguaggagccgcuauugccgccccagucgcaggacaacaaaauguaauagacccuuggauaagaaauaauuuuguacaagccccagguggcgaauuuacaguaucuccaagaaaugcaccaggagaaauauuauggucagcaccauuaggacccgaccuaaauccauaucuaucacauuuagccagaauguauaacggauaugcaggaggguucgaaguacaaguuauacuagcaggaaaugcuuuuacagcaggcaaaauaauauuugcugcaguaccaccuaauuuuccaacagaaggacucucaccaucacaaguuacuauguucccacacauaauagucgauguaagacaauuagagccaguacuaauaccuuuaccagauguccgaaacaacuucuaucacuacaaccaaucaaacgauucuacaauaaaauuaauagcuauguuauacaccccuuuaagagcuaauaaugcaggagacgacguauuuacaguaucaugccgaguacucacucgcccauccccagacuuugacuucauauucuuaguaccaccgacaguagaauccagaacaaaaccauuuagcguaccuauauuaacagucgaagaaaugacgaacucaagauuccccauaccauuagaaaaacuauuuacagguccaucuucagcauucguuguacaaccacaaaaugguagauguacuacagauggaguauuauuaggcacuacucaauuaucuccaguaaauauuuguacuuuucgcggagacguaacacacaucgcaggaacacaaaauuacacuaugaaccuagcaucucaaaacuggaauaauuacgauccuacagaagaaauaccagcacccuuaggaacaccagauuuuguaggaaaaauacaaggcguauuaacccaaaccacuagaagagauggaucaacacguggacacaaagcaacaguaucaacaggauccguacauuuuacaccaaaauuaggcucaguacaauucucaacagauacaaguaacgauuucgaaacaggucaaaauacaagguucacucccguaggagucguacaagacggaagcacaacacaucaaaacgaaccucaacaauggguacuaccaaacuacucuggacgagacucacauaacguacacuuagcuccagcuguagcaccaaccuuccccggagaacaauuauuauuuuuccgaucaacuaugccagguugcucuggauauccaaauaugaauuuagacugcuuacuaccucaagaauggguacaacauuuuuaucaagaaucagcuccagcucaaucagacgucgcacuccucagauucguaaacccagauacagggcgaguccuuuuugaaugcgaacuacauaaaucuggauauguaacaguagcucacaccggacaacaugauuuagucauaccgccaaaugguuauuuucgcuucgauucaugggucaaccaauucuacacauuagcucccaugggaaacggagcaggcagacgaagauaa

SEQ ID NO: 34102 - RNA, 1617 nt, Artificial Sequence
  derived and/or modified sequence opt6 from VP1__Norovirus_and/or_Norovirus-like__GQ849126
augaaaauggcaucaucugacgcaaauccaucagacggaucuaccgcaaacuuagucccagaaguaaacaaugaaguuauggcacuagaacccguaguuggugcagcaauagccgcaccaguagcuggacaacaaaaugucauugacccuuggauaagaaauaauuuuguacaagcaccagguggcgaauuuaccguuucuccaagaaaugcacccggugaaauucuauggucagcacccuuagguccagauuuaaaccccuaucuaucacacuuagccagaauguauaauucauaugcaggagguuuugaaguacaaguaauacucgcaggcaacgccuucacagcaggaaaaauuauauucgcugcaguuccacccaauuuuccaacagaaggauuaucaccaucacaaguuacuauguuuccucauauugucguagauguaagacaacuugaaccaguacuaauaccccuuccagacguaagaaacaauuuuuaccacuauaaccaaucaaacgaccccacaauaaaauuaaucgcuaugcuauacacccccuuacgagcaaauaacgcaggagaugaugucuuuacaguaucaugucgaguacuaacaagacccucaccagauuuugauuuuauauuuuuaguaccaccaacaguagaaagcagaacaaaaccauucucuguaccaauuuuaacaguagaagaaaugacaaacucaagauucccaauaccauuagaaaaacuauucacuggaccaucuucugcauuuguuguccaaccacaaaacgguagauguacgacagauggaguucuacuaggaacaacacaauuaagccccguaaauauauguacauuucguggaaauguaacacauaucgcaggcacacaagaauacacaaugaaucuagcaucccaaaacuggaacaacuacgauccaacugaagaaauacccgcaccacuuggaacaccagacuucguaggcaaaauacaagguguacuaacacaaacuacaaggagagacggauccacaagaggccauaaagcaacuguaucaacugguucaguacauuuuacaccaaaacuagguagaauacaauuuuccacagacacaucaaaugacuucgaaacaggucaaaacacacgauucacuccaguagguguaguacaagauggaucaacuacucaccaaaaugaaccucaacaauggguacuacccaauuauuccggcagagacucucauaauguacacuuagcaccagcaguagcucccaguuuuccaggugaacaauuauuauucuucagaucaacaaugccagguuguucugguuaucccaauaugaaucuagauuguuuacucccacaagaauggguacaacauuucuaucaagaagcagcaccagcucaauccgauguugcacuauuaagauuuguuaacccugauacagguagaguacuauuugaaugcaaacuccacaaaucagguuauguaacuguagcacacacaggccaacacgauuuagucauaccaccaaauggauauuuuagauucgacucauggguuaaucaauuuuacacacuugccccaaugggaaauggaaccggacgaagacguuaa

SEQ ID NO: 34103 - RNA, 1617 nt, Artificial Sequence
  derived and/or modified sequence opt6 from VP1__Norovirus_and/or_Norovirus-like__AB447459
augaaaauggcaucuaaugaugcuaauccaucagacggaucagcagcaaauuuaguaccagaagucaauaacgaagugauggcacuagaacccguaguaggagccgcaauugcugcaccaguugcaggacaacaaaacguaauagacccuuggauaagaaauaauuucguacaagcacccggaggagaauuuacaguuucaccaagaaacgcaccaggcgaaauacuauggucagcaccccuugguccagauuuaaauccauauuuaucacaucuagcaagaauguauaacgguuacgcuggagguuucgaaguacaaguaauucuugcuggaaaugcauuuacagcugguaaaauaauuuuugcagccguacccccaaacuuuccaacagaaggacuaucaccaucacaaguuaccauguucccucacauaauuguagacgucagacaacuagaaccaguucuuauaccccuaccagauguuagaaacaauuucuaccacuauaaccaauccaaugauucaaccauaaaacuaauugcaauguuauauacaccacuuagagcaaauaaugcuggcgaagacgucuucacaguaucaugccgcguccucacuagaccaucaccagacuuugacuuuauuuuucuaguaccaccaacaguugaaucuagaacuaaaccauucacuguacccauauuaacuguagaagaaaugaccaacuccagauuuccuauuccauuagaaaaacuauuuacaggaccuucaggagcauucguaguacaaccacaaaacggacgaugcacuacagacggaguauuauuaggaacaacacaauuaucaccaguaaauauauguaccuucagaggagacguaacacauauagcgggaucucgaaacuacacaaugaaucuagcaucucuuaacuggaauaacuaugaccccacugaagaaauaccagcaccauuagguacaccugauuuuguaggaaaaauacaaggacuauuaacacaaacaacaaaaggagauggaucaacacgaggccauaaagccacaguauauacaggaagcgcaccauuuacaccuaaacuuggaucuguacaguuuucaaccgauacugaaaacgauuucgaaacacaucaaaauacaaaauucacgccaguaggcguaauacaagacggcuccacaacccauagaaacgaaccucaacaauggguauuaccuuccuauucaggaagaaauguccauaacguacauuuagcuccugcaguagcaccuacauuuccaggagaacaacuaauuuucuucagaucuacaaugccagguugcaguggauaucccaacauggacuuagacugccucuuaccacaagaauggguacaacauuuuuaucaagaagccgcuccagcucaaucugauguagcacuuuuacgauucgucaauccagacacaggaagaguauuauuugaaugcaaauuacauaaaucaggauauguaacaguagcacacacuggccaacacgaucuaguaauaccaccaaacggauacuuuagauuugauucauggguaaaucaauuuuacacucuagcaccuaugggaaauggaacaggaagaagaagauaa

SEQ ID NO: 34104 - RNA, 1617 nt, Artificial Sequence
  derived and/or modified sequence opt6 from VP1__Norovirus_and/or_Norovirus-like__EU078413
augaaaauggcaucaaacgacgcaaacccaucagacggaucaaccgcuaauuuagucccagaaguaaacaaugaaguuauggcuuuagaaccaguaguaggcgcagcaaucgcugcacccguugcaggucaacaaaauguaauagauccauggauaagaaauaauuuuguacaagcaccuggaggagaauuuacaguaaguccacgaaaugcaccaggagaaauuuuauggucagcaccacuaggaccagaucucaauccauauuuaucacaucuugcaagaauguacaacggauaugcaggcgguuucgaaguacaaguaauucuagcaggcaaugcauuuacagcuggaaaaauaauauucgcagccguaccaccaaacuuucccacagaaggacuaagucccucacaaguaacaauguucccacauauaaucguagacguacgacaacuagaaccaguacuaauaccuuuaccugauguaagaaacaauuuuuaucauuauaaccaaucaaaugacucaacaauaaaauuaauagcaauguuauacacacccuuacgagcaaauaaugcaggagacgauguuuuuacaguaucauguagaguacuaaccagacccucaccugacuucgauuuuauauucuuaguaccacccacuguagaaucaagaacuaaacccuucaccguacccauacucacgguagaagaaaugacaaacucaagauuucccauaccacuagaaaaauuauucacuggacccucaggugcauucgugguacaaccacaaaacggaagauguacaaccgacggaguauuauuaggaacaacccaauuaucaccaguaaauauauguacauuucgcggagacguaacacacaucgcuggaacuagaaacuauacaaugaaccuagcaagucaaaacuggaacaauuacgauccuacagaagaaauaccagcaccacuaggaacaccagacuuuguagguagaauacaaggaauguuaacacaaacaacuagaagagacggaaguacacguggacauaaagcuacagucaguacaggagaugcucauuuuaccccaaaacuuggcucaauaauguucuccacagacacagauaacgauuuugaaacuggacaaaacaccaaauucacaccagucggcguaguacaagacggaaacggaacacaucaaaacgaaccacaacaauggguacuaccuucauauagcggaagaaccggacauaacguacauuuagcaccagcuguagcaccaacauuuccaggagaacaauuauuauucuuccgaaguacaaugccagguuguucaggcuaccccaacaugaauuuagacuguuuacuaccacaagaauggguucaacauuucuaucaagaagcagcaccagcccaaucagacguagcuuuacucagauuugucaauccagacacuggccgaguacuuuuugaauguaagcuacauaaaucugguuauguaacaguagcacacacaggccaacacgaccuaguaauaccaccaaauggauacuucagauuugacuccuggguuaaucaauuuuauaccuuagcaccaaugggaaauggaacaggaagaagacguuaa

SEQ ID NO: 34105 - RNA, 1617 nt, Artificial Sequence
  derived and/or modified sequence opt6 from VP1__Norovirus_and/or_Norovirus-like__EU078411
augaaaauggcaucaaacgacgcaucacccagugauggaucuacagcaaaucuugucccagaaguaaacaaugagguaauggcauuagaaccagucguaggagcagcaaucgcugcaccagucgcaggacaacaaaauguaauugauccuuggauaagaaacaauuuuguucaagcaccaggcggagaauuuacaguaucuccaagaaacgcuccaggagaaauacuauggucagcaccacuaggucccgaucuaaacccauaccuuucucauuuagccagaauguauaacggauaugcuggaggcuuugaaguacaaguuauacuagcaggcaaugcuuuuacagcagguaaaauaaucuuugcagcaguaccacccaauuuuccuaccgaaggauuaucccccucucaaguaaccauguucccacacauaaucguagacgucagacaauuagaaccaguacuaauucccuuaccagauguacgaaauaauuucuaccacuauaaccaaaguaacgaucccaccauaaaauuaauagcaaugcuuuauacaccacuaagagcaaauaaugccggagacgauguuuuuaccguauccugcagaguacuaacaagaccaaguccagacuuugacuuuauauuccucguaccaccaacaguagaaucccgaacuaaaccauucacuguaccaauauuaaccguugaagaaaugacaaacucuagauuuccaauuccacuagagaaacuauuuacuggaccaaguucagcauucguaguucaaccacaaaauggaagauguaccacagacggcguauuauuaggaacaacccaauuaagcccaguaaacauuuguacauuuagaggagacguuacccauauaccaggaacaagaacuuacagaaugaauuuagcaagucaaaacuggaauaacuaugacccaacagaagaaauaccagcaccauuaggaacaccugacuuuguaggaaaaauacaaggaaugcuaacacaaacaacaaaaggagacgguucaacacgaggucacaaagcaaccguaucaaccgguucaguugacuuuacaccaaaauuaggaucaguucaauucgcaacagauacagacaaugacuuugaaacuggucaaaauacacgauuuacuccuguaggcguaauccaagacggaucaagugcccauagaaaugaaccacaacaauggguucuacccgacuacucaggacgaacaguacauaauguacaucuagccccagcaguagccccaacauuuccaggagaacaauuauuauucuuuagaucaacuaugccaggauguucuggcuauccaaauauggacuuagauugcuuauuaccacaagaauggguacaacacuuuuaccaagaagcugcaccagcacaaucugacguagcacuauuaagauuuguaaauccugauacugguagaguacuauuugaauguaaacuacacaagacuggcuauguaacaguagcccauacaggacaacaugaucuaguaauacccccaaauggauauuuuagauucgauucauggguaaaccaauuuuauacauuagcaccaaugggaaauggagcaggacgacguagauaa

SEQ ID NO: 34106 - RNA, 1617 nt, Artificial Sequence
  derived and/or modified sequence opt6 from VP1__Norovirus_and/or_Norovirus-like__AB385632
augaaaauggccuccuccgaugcuaacccuucagauggaucuacagcuaaccuagucccugaaguaaauaacgaaguaauggcucuugaacccguaguaggagccgcuauagcagcuccugucgcuggacaacaaaaugucaucgauccauggauaagaaauaauuucguucaagcgccuggcggugaauuuacaguaucuccucgaaacgcaccaggcgaaauauuauggucugcaccacuaggaccugaucuaaacccguacuuaagucauuuagcaagaauguauaauucauacgcaggaggcuucgaaguacaaguaauacuagcuggaaaugcauucacagcuggaaaaaucguauuugcagccguaccaccaaauuuucccacagaaggucuaucaccuucacaaguaaccauguuuccacacauaaucguugacguaagacaacuagaacccguccuaauaccacuaccagauguccgaaacaacuucuaucacuauaaucaaucaaaugacccuacaauuaaacuaaucgcaaugcuauauacaccauuacgagcaaacaaugcuggagaugauguauucacaguaucaugcagaguauuaaccaggccaucuccugacuucgacuucauauuuuuagucccaccuaccguugaaucucgcacaaaaccuuucucuguaccaauacuuacaguagaagaaaugacaaacucuagauuucccauacccuuagaaagauuauucacagguccgaguucagcuuucguaguacaaccacaaaacgguagauguacuaccgacgguguacuacucggcacaacacaacuaucaccuguuaacauuuguaccuuuagaggagacguaacacauauagcugguacucaagaauauacaaugaacuuagccucacaaaauuggaacaacuaugaucccacagaagaaguaccagcaccacuaggaaccccagacuuuaugggaaaaauacaagguguauuaacacaaacaacacgacgagauggcucaacaagaggacacaaagcaacaguaucaacaggauccguacauuucacuccuaaacuaggacgcauacaauuuuccacagauaccucuaacgacuuugaaaccggccaaaacacacgauucacuccaguaggaguaguacaagauggaagcacuacacaucaaaaugaaccucaacaauggguacuaccaaacuauucagguagagacucacauaacguacacuuagccccagcuguagcaccaucauucccaggagaacaacuucucuucuuuagaucaacaaugccuggauguucuggcuauccaaauaugaauuuagacugcuuauuaccacaagaauggguacaacacuucuaccaagaagcugcaccagcacaaucugacguagcacuacuaagauuuguaucuccagacacuggacgaguauuauucgaaugcaaacuacauaaaucuggcuauguaacaguagcucauacuggacaacacgauuuaguaauaccaccuaaugguuauuucagauucgacucauggguuaaccaauuuuauaccuuagcaccaaugggaaauggaacuggaagaagaagauaa

SEQ ID NO: 34107 - RNA, 1617 nt, Artificial Sequence
  derived and/or modified sequence opt6 from VP1__Norovirus_and/or_Norovirus-like__EU839595
augaaaauggcauccaacgacgcaaaccccucagauggcuccgccgcaaaucuaguaccugaaguaaacaaugaagucauggcucucgaaccagucguaggugccgccauagcugcaccaguugcuggacaacaaaaugucauagauccauggauacgaaacaauuucguccaagcaccaggaggagaauuuacaguuucaccacgaaaugcuccaggagaaauauuaugguccgcaccucuagguccagaccuaaauccauaucuaucacauuuagcaagaauguacaauggauaugcuggcggcuucgaaguucaaguaauauuagcaggaaaugcauucacagcaggaaaaauaauuuucgcagccguaccuccaaacuuuccaacugaagguuuaucuccaucucaaguuacaauguucccacacauaauagucgacguuagacaauuagaaccuguucuaauaccauuaccugauguaagaaacaauuucuaucacuauaaccaaucuaacgacuccaccauaaaauuaauagccaugcuauauacaccacuaagagcuaauaaugcaggcgaagacguuuuuaccguaucuugucguguacuaacccgacccucuccuggauuugacuuuauauuucuaguaccaccaacuguagaaucaagaacaaaaccuuucacaguacccauacuuacaguagaagaaaugacaaacucaagauuucccauacccuuagaaaaauuauuuacgggacccucaagcgcauuuguaguacaaccucaaaacggaagaugcacaacugacgguguauuauuaggaacaacacaacuaucaccagucaacauauguacauuucgaggcgacguaacacacauagcaggaaguagaaauuacacuaugaaucuagcaucacuaaauuggaacaauuaugauccaaccgaagaaauaccagcaccacuaggaacuccugauuuuguuggaaaaauacaaggaguauuaacccaaacaacaaaaggugauggaucaaccagaggacacaaagcaacagucuauacagguucugcaccuuuuacaccuaaacugggaucaguacaauuuucaaccgauacagaaaacgauuuugaaacacaucaaaacaccaaauucacaccugucggaguuauacaagauggaggaacaacacauagaaacgaaccucaacaauggguacuaccuucuuacaguggaagaaauguaccuaacguucauuuagcuccugcaguagcaccaacauuuccaggagaacaauuacucuucuuuagaucuacaaugccaggaugcaguggcuauccaaauauggaucuagacugccuauuaccucaagaauggguccaacauuuuuaucaagaagcagccccugcacaaucagauguugcuuuacuacgauuuguuaauccagauacaggacgagucuuauuugaauguaaacuucauaaaucaggauacguaacagucgcacauacaggacaacaugaccuuguaauaccgcccaauggauauuuuagauucgauucuugggucaaucaauucuauaccuuagcacccaugggcaauggaacaggaagaagaagauaa

SEQ ID NO: 34108 - RNA, 1617 nt, Artificial Sequence
  derived and/or modified sequence opt6 from VP1__Norovirus_and/or_Norovirus-like__AB294788
augaaaauggcaucaaaugacgcuacacccucagacggaagcacagccaaccuuguaccagaaguuaauaaugaaguaauggcuuuagaaccagucguaggcgccgcaauagcugcacccguagcaggccaacaaaacgucauugacccauggauaagaaacaacuuuguacaagcaccaggaggagaauuuacagucucaccuagaaacgcaccuggagaaauacuaugguccgcaccauuaggaccagauuuaaacccuuaucuuucacauuuagccagaauguauaacggauaugcuggcggauuugaaguacaaguuauucuugcaggaaaugccuuuaccgcaggaaaaauaaucuucgcagcuguaccacccaauuuucccacugaagguuuaucaccaagucaaguaacaauguucccacacaucaucguagauguacgccaauuagaacccguucuaauaccucuuccagauguaagaaauaauuucuaucacuauaaucaauccaaugauucaacaauaaaacuaauagcaaugcuauacacaccuuuaagagcaaacaaugccggagacgauguuuuuacuguaagcugucguguacuaacaagaccaucaccagacuuugacuucauauuuuuaguacccccaacaguagaaucaagaacuaagcccuucucuguaccaauucuaacaguagaagaaaugacaaacucacgauuuccaauacccuuagaaaaacuauuuacugguccuucuucagcauuuguaguacagccucaaaacgguagauguacuacagacggcguucuauuagguacaacccaacuuucaccaguaaauauauguaccuuuagaggagacguaacucacaucgcaggaacacaaaauuacacaaugaauuuagcaucccaaaacuggaacaacuacgacccuacugaagaaauaccugcuccauuaggaacuccagauuucguuggaaaaauccaaggugucuuaacacaaacaacaacaagagacggcucuacaagaggucauaaagccacaguaucgaccggaucuguucauuuuacaccuaaacuaggaucuguacaauuuucaacagauaccucaaacgauuucgaaacaggacaaaauacacgauucacacccguugguguaguacaagacggaucaacaacacaccaaaacgaaccucaacaauggguucuacccgauuacucaggaagagacucucacaauguacaccuugcaccagcaguagcaccuacauuuccaggugaacaacuccuauucuuuagauccaccaugccaggcugcucugguuauccaaauaugaaucuagacugcuuauuaccacaagaauggguacaacauuuuuaucaagaaucagcacccgcucaaucagauguagcauuacuaagauucguaaauccagacaccggaagaguauuauucgaaugcaaacuccauaaaucuggauacguaacaguagcacauacaggacaacacgacuuaguaauaccaccaaauggauauuucagauuugauucauggguaaaucaauuuuacacauuagcuccaaugggaaacggagcaggaagacgacgauaa

SEQ ID NO: 34109 - RNA, 1617 nt, Artificial Sequence
  derived and/or modified sequence opt6 from VP1__Norovirus_and/or_Norovirus-like__AB303936
augaaaauggcauccaaugaugccacaccaucagacgguucuaccgcaaaucuaguuccagaaguaaauaaugaaguaauggcacuagaaccugucguaggagcagcaauugcagcaccaguagcaggucaacaaaauguaauagauccauggauuagaaauaacuuuguacaagcaccaggcggagaauuuacaguuucaccaagaaaugcaccuggcgaaauauuauggucugcaccauuaggaccugauuuaaauccauacuugucucacuuagcaagaauguauaauggauaugcuggaggauucgaaguacaaguaauauuagcaggaaacgcuuucacagcagguaaaauaauauuugcagcaguaccaccuagcuucccaacagaagguuuaucaccaucacaagucaccauguucccacacauaauaguagaugucagacaacucgaaccuguauuaauaccacuaccagaugucagaaauaacuuuuaucacuacaaucaauccaacgauccuacuauaaaacuaauugcaaugcuauauacaccccuaagagcaaauaacgcuggagaagauguauucacaguuucauguagaguucugacuagaccaaguccagacuuugauuuuauauucuuaguaccaccaacuguagaaucacgcacaaaaccauuuacuguaccaauauuaacaguagaagaaaugaccaauucuagauuuccuauaccauuagaaaaacuauucacaggacccuccggugccuucguuguacaaccacagaacgguagauguacaaccgauggaguacuacuaggaacuacacaauuaucaccaguaaacauauguacauucagaggcgacguuacacauaucgcaggcacacacaauuauacaaugaaccuagccagccaaaauuggaacaauuaugauccaacagaagaaauacccgccccuuuaggaacaccagacuuuguaggaagaauacaaggaauguuaacacaaacuacucgaggagaugguaguaccagaggacauaaagcaacuguaaguaccggagacguucacuucacaccaaaacucggaucaguucaauucgacacagacaccaauucagacuuugaaacaggacaaaacacaaaauuuacaccaguaggaguaguccaagacggaaauggagcacaucaaaaugaaccacaacaauggguacuaccaucauauuccggacguacaggccauaacgcacacuuagcaccagcaguagcuccaacauucccaggagaacaacuucuauucuuccguucuaccaugcccgguuguucaggauaucccaauaugaaucucgacugucuucuaccucaagaauggguacaacauuuuuaucaagaagcagcaccagcacaaucagauguagcacuucuacguuuuguaaauccugauacaggaagaguauuauucgaaugcaaauuacauaaaucaggguacguaacaguagcucauacaggacaacaugauuuaguaauaccuccuaauggauauuuuagauucgauucuuggguaaaucaauuuuauacauuagcuccaaugggaaauggcacaggcaggagacgauaa

SEQ ID NO: 34110 - RNA, 1617 nt, Artificial Sequence
  derived and/or modified sequence opt6 from VP1__Norovirus_and/or_Norovirus-like__AB303935
augaaaauggcuucaaacgacgcuaaccccucagauggaucaacagcaaauuuaguaccagaaguuaacaaugaaguaauggcucuugaaccaguagucggagcagcaauagcugcuccaguagcuggucaacaaaacguuauagauccauggauacgcaauaacuuuguacaagcaccuggaggcgaauuuacuguaucuccucgaaaugcaccaggagaaauauuauggucagcaccauuagguccagaucuuaaucccuaucuaucucaccuagcaagaauguauaauggcuacgcaggaggcuucgaaguccaaguaauacuagcaggaaaugcauuuacugccgguaaaauaauauuugccgcuguacccccaucauuuccaacagaaggacucucacccucacagguuacuauguucccgcauauaauaguagauguacgacaauuagaaccaguauuaauaccucuuccagauguacgcaacaauuucuaucacuacaaccaaucaaaugauccaacuauuaaauuaauagcaauguuauauacucccuuaagagcaaacaaugccggagaagacguuuuuacaguaucaugcagaguauugacaagaccaucaccugacuuugauuuuauauuucuagucccaccaacaguagaaucaagaacaaaaccauucacuguaccaauacuaacuguagaagaaaugacaaauucacgauuccccauuccacuagaaaaacucuuuacaggaccaucuggcgcauuuguaguacaaccacaaaacgguagauguacuacagacggcguacuacuaggaacaacacaauuaucaccaguuaacauauguaccuuccgaggagauguaacacacaucgcaggcacucauaacuauacaaugaauuuagcuagccaaaacuggaauaacuaugauccaacugaagaaauacccgcgccucuaggaacaccugacuuuguaggacgcauacaagguauguuaacacaaaccacaagaggagaugguucaacccgaggacacaaagcgacagugucaacuggagacguucauuuuacuccaaaauuaggaucaauacaauucaauacagauacaaacaacgauuuugaaacaggacaaaauacuaaauuuacucccguaggaguaguacaagacggaaacggaacacaccaaaaugaaccacaacaauggguucuaccaucauauucaggaagaacaggacacaacgugcaucuugcacccgcaguagcaccaacauuuccaggagaacaauuacuauucuuucgaucaaccaugccaggauguucaggauacccuaauaugaacuuagacugccuacuaccucaagaauggguucaacacuuuuaucaagaagcagcaccagcacaaucagacguagcauuacuacgauuuguaaacccagauaccggucgaguacuauucgaaugcaaacuccauaaaucaggauauguuacaguagcacauacaggacaacacgauuuaguaaucccacccaauggcuauuuuagauuugacucauggguaaaccaauuuuacacauuagcaccaaugggaaacggaacuggacgcagacgauaa

SEQ ID NO: 34111 - RNA, 1617 nt, Artificial Sequence
  derived and/or modified sequence opt6 from VP1__Norovirus_and/or_Norovirus-like__AY588018
augaaaauggcaagcaaugacgcaaaccccucagauggauccaccgccaauuuagucccagaagugaacaaugaaguaauggccuuagaaccaguaguaggagcagcaauugcagccccagucgcaggacaacaaaacguaauagacccauggauuagaaauaacuuuguacaagcaccagguggagaauuuacaguaucaccaagaaacgcuccaggugaaauauuauggucagcuccacuuggaccagacuuaaauccauaccuaucucacuuagccagaauguacaacggauacgcaggcggauuugaaguucaaguaauuuuagcaggaaaugcauucacagcaggaaaaauaauuuucgcagcaguaccaccuaacuuccccacugaaggccucucuccuucucaagucacaauguucccacacauaauuguagauguucgccaauuagaaccaguacucauuccauuaccagauguacgaaauaacuuuuaucacuacaaucaaucaaaugauccaacaauuaaacuaauagcuauguuauacacaccccuaagagccaauaaugccggagaagacguauuuacagucuccuguagaguacuaacucgaccaucaccagacuucgacuucauauuucuaguuccaccaacagucgaaaguagaacaaaaccuuuuacaguaccaauauuaacaguagaagaaaugaccaauucaagauucccaauaccucuagaaaaacuauuuacaggaccaucaggagcauuuguaguccaaccccaaaacgguagauguacaacagacgguguuuuacuaggaacuacacaauuauccccuguuaacauuuguacauuuagaggagauguaacacacauagcaggaacacauaauuauacaaugaaccuugcaucucaaaauuggaacaauuaugacccaacugaagaaauaccagcaccuuuaggaacacccgacuuuguaggucgaauacaaggaauguuaacccaaacaaccagaggagauggauccacaagaggacacaaagcaacuguaucaacuggagauguacauuucacucccaaauuaggcucaguccaauuuaauacagacacaaauaacgauuuugaaacaggccaaaauaccaaauuuacaccagucggaguaguacaagacgguaacggagcucaucagaaugaaccucaacaauggguacucccaucauauucuggaagaacaggacacaacguacaccuugccccugcaguagcaccuacuuucccaggagaacaauuacuauucuuuagaucaacaaugcccggaugcagcggauauccuaauaugaaccuggauugcuuauuaccucaagaauggguacaacauuuuuaucaagaagcagcaccagcccaaucagacguagcuuuacuaagauuuguaaauccagauacagguagaguacuuuucgaaugcaaacuacauaaaucaggauauguaacaguagcccacacaggucaacacgaucuaguuauaccaccaaauggauauuuuagauucgauucguggguuaaccaauucuauacgcuagcaccaaugggaaacgguacaggaaggagaagguaa

SEQ ID NO: 34112 - RNA, 1617 nt, Artificial Sequence
  derived and/or modified sequence opt6 from VP1__Norovirus_and/or_Norovirus-like__KU678203
augaaaauggcauccucugaugcuaaucccuccgauggaucagcagcaaacuuaguaccagaaguuaauaaugaaguaauggcacuagaacccguaguuggagcagcaauagcagccccaguagcaggacaacaaaauguaaucgauccuuggauacgaaauaauuucguacaagcaccaggcggagaauuuacaguuucaccaagaaacgcaccgggagaaauucuuugguccgcaccuuuagguccagacuuaaacccauacuuaucccaucuagcaagaauguauaaugguuaugcuggagguuucgaaguacaaguuauacuagcaggaaaugcauucacagcaggaaaaguaauauucgcggcuguaccaccuaauuuuccaaccgaaggccuaucaccaagucaaguaacaauguuuccacauauaguaguagauguaaggcaacuugaaccuguauuaauaccacuaccagaugucagaaauaauuuuuaucauuacaaucaaucuaaugauccuaccauaaaacuaauagcuaugcuauauacaccacucagagccaauaacgcuggagacgauguauucacagucucauguagaguucuaacaagaccaucaccagacuuugauuuuauauuucugguaccaccuacagucgaaucaagaacaaaaccauucucaguccccgucuuaacaguagaagaaaugacaaacucuagauuuccaauaccacuagaaaaacuauuuacaggcccaucuagcgcauucgucguacaaccacaaaacggacgauguacuacagacggaguacuacuaggcacuacccaacucucuccaguuaauauauguacauuuagaggugaugucacacauauaacaggaagucauaauuauacaaugaauuuagcuucacaaaacuggucaaauuaugauccuacugaagaaaucccagcuccccuuggaacaccagauuuuguaggaaaaauucaaggaguacuaacacaaacaaccagaacagauggaucaaccagaggccacaaagcaacaguauauacuggaucagcugacuuugcaccaaaauuaggaagaguacaauuugaaacugauacaaaucacgacuucgaagcaaaucaaaauacaaaauuuacuccaguaggcgucauacaagauggaggaacuacucaucggaaugaaccucaacaauggguuuuacccucauauucaggaagaaauacucccaacguacauuuagcaccagcaguagcuccaacauucccaggagaacaacuauuauucuuuagauccacaaugccaggaugcucuggcuauccaaauauggauuuagauuguuuacuaccucaagaauggguucaauacuucuaucaggaagcagcaccagcacaauccgauguagcauuacuaagauuugucaacccugauaccggccguguauuauucgaauguaaacuccauaaaucaggauauguaacaguagcacauacaggccaacaugauuuaguaauaccacccaacggauauuucagauuugacucuuggguaaaccaauuuuauacacuagcacccaugggaaacggaacuggcagaagaagauaa

SEQ ID NO: 34113 - RNA, 1617 nt, Artificial Sequence
  derived and/or modified sequence opt6 from VP1__Norovirus_and/or_Norovirus-like__KP176410
augaaaauggcaaguagugaugcuaauccuuccgaugguucagccgcuaacuuaguaccugaaguaaacaaugaaguaauggcacuagaaccaguaguaggagcagcaauugcagcaccuguugcaggccaacaaaauguuauagauccauggauaagaaauaacuuuguacaagcaccaggaggagaauuuacagucucaccacgaaacgcaccuggcgaaauuuuauggucugcaccauuaggaccugauuuaaaccccuacuuaucacacuuagcaagaauguauaacggauacgccggugguuuugaaguacaaguaauacuagcuggcaaugccuuuacugcugguaaaguaauauucgcagcaguaccaccaaauuucccaacagaaggccuaucucccucucaaguaacaauguucccgcauauaguaguugacguacgacaacucgaaccaguacuaauuccauuacccgauguaaggaauaauuucuaccauuauaaucaaucaaaugauccaacuauuaaacuaauagcuauguuauauacuccauuaagagccaacaaugcaggcgaugauguauuuacaguaucaugucgagucuuaacaagaccaucaccugacuuugacuucauauuucuuguaccaccuacaguugaaucaagaacaaaaccauucucaguaccaguacuaacagucgaagaaaugacaaacucacgauuccccauaccauuagaaaaacucuucaccgguccuucauccgcauucgucguacaaccacaaaacggucgauguacaacagaugguguauuacuaggaacaacccaacuauccccuguuaacauaugcaccuuuagaggagauguaacacauauaacagguagcagaaauuacacaaugaaucuagccucucaaaacuggucaaauuaugauccaacugaagaaauacccgccccucuaggaacaccagauuucguagguaaaauacaaggaguauuaacacaaacaacucgaacagacggcucaacaagaggacacaaagcaacaguuuacacaggaucagcagauuuugcaccaaaauuaggaagaguacaauuugaaacagauacagauagagacuucgaagcaaaucaaaacacaaaauucaccccuguaggaguuauacaagacgguggaacaacacauagaaacgaaccacaacaauggguacuaccaucauauucaggcagaaauacaccaaauguucauuuggcaccagccguagcuccuacuuuuccaggagaacaacuacuauucuuccgaucaacaaugccaggauguucaggauaucccaauacagaucuagauuguuuacugccucaagaauggguacaauauuuuuaucaagaagcagcaccagcacaaucugacguagcacuacuaagauuuguaaauccagauacaggcagaguauuauucgaaugcaaauuacacaaaucaggcuauguuacaguagcucacacuggucaacaugaucuaguaauaccaccuaacggauacuuuagauucgauucauggguaaaucaauucuacacacuagccccaaugggaaauggcacuggaagaagaagauaa

SEQ ID NO: 34114 - RNA, 1617 nt, Artificial Sequence
  derived and/or modified sequence opt6 from VP1__Norovirus_and/or_Norovirus-like__KX371609
augaaaauggcaucaaacgaugcuaauccuucagauggcagugcagcuaaucuaguacccgaaguaaacaaugaaguaauggcuuuagaaccaguaguaggugcagcaauagcugcaccaguagcaggacaacaaaacguaauagacccauggauaagaaauaauuuuguucaagcaccaggaggagaauuuacaguaucaccaagaaacgccccaggcgaaauacuauggagugcaccuuuaggaccagaccuaaacccauaucuuucccaucuagcacgcauguauaaugguuacgcaggaggauucgaaguacaaguaauacuagcaggcaaugcauucacagcaggaaaaauuauauucgcagcaguaccaccaaacuucccaacagaaggauuaucaccaucucaaguaacaauguucccacauauuauagucgauguaagacaacuugaaccaguauuaauaccauuaccugauguacgaaacaauuucuaucauuauaaccaaucaaacgacagcacaauuaaauuaauagcaauguuauauacaccauuaagagcaaacaaugcaggcgaagauguauuuacaguaucuugucgaguucuuacaagaccuuccccagacuuugacuuuauuuucuuagucccuccaacaguagaaucaagaacuaaaccuuuuacaguaccuauauuaaccguagaagaaaugacaaauucaagauuuccaauuccauuagaaaaacuauucacuggacccucaagugcauucguaguacaaccucaaaacggaagauguacaaccgauggaguacuauuaggcaccacucaacugucaccuguaaacauauguacauucagaggagacgugacacauauagcaggaucccgaaacuacacaaugaacuuagcuucacuaaacuggaacaacuacgauccaacugaagaaauaccugcaccccuaggaacuccagacuuuguagguaaaauacaaggaauguuaacucaaaccacaagaggagauggaaguacccgcggacacaaagcaacaguauauaccggauccgcaccauuuacaccaaaacuuggaucaguacaauucgaaacagauacagaaaacgauuucgaaacacaucaaaauaccaaauucacaccaguuggaguaauacaagaugguggcacaacacacagaaaugaaccucaacaauggguacuaccuucauauucaggaagaaauguaccaaacguucauuuagcacccgcgguagccccuaccuucccuggagaacaacuauuauucuucagaucuacaaugcccggaugcucaggcuauccaaauauggaucuagauugucuccuaccacaagaauggguucaacauuucuaccaagaagcagccccagcacaaucugacguagccuuacuaagauuuguaaauccagauacaggacguguuuuauucgaaugcaaacuccauaaaucaggcuaugucacaguagcccacacaggacaacacgaucucguaaucccaccaaaugguuauuuuagauucgauucauggguaaaccaauucuacacccucgcaccaaugggaaaugguacuggaagaagaagauaa

SEQ ID NO: 34115 - RNA, 1617 nt, Artificial Sequence
  derived and/or modified sequence opt6 from VP1__Norovirus_and/or_Norovirus-like__KX354130
augaaaauggcuucaucagaugcaaacccuuccgacggaucugcagcuaacuuaguaccagaaguaaauaaugaaguaauggcacuagaaccaguaguaggagcagcaauagcagcuccuguagcuggacaacaaaacguaauagacccauggauaagaaauaauuucguacaagcaccagguggagaauuuaccguaucaccaagaaaugcuccaggagaaauucuauggucagcaccacuagguccagauuuaaacccauaccuaucacauuuagcacguauguacaacggauaugcaggaggcuucgaaguacaaguaauacuagcaggcaaugcauuuacagcaggaaaaguaaucuucgccgcaguaccaccaaauuuuccaacagaaggguuaucaccaucccaagucacaauguucccucauauaguaguugauguaagacaauuagaacccguauuaauaccauuaccugauguacgaaauaauuuuuaucacuauaaucaaucuaaugauccaacuauaaaauuaauagcuauguuauacacaccauuacgcgcaaacaaugcaggagaugauguauuuacaguaucaugcagaguauuaacacgacccucaccagacuuugauuuuaucuuccuaguacccccuacagucgaaucucgcaccaaacccuucucaguaccaguacuuacagucgaagagaugacuaacucaagauucccaauucccuuagaaagacuauuuacaggaccaucauccgcuuuuguuguucaaccccaaaauggaagaugcacaaccgacggaguucucuuaggcacuacacaauuaucuccaguaaacauauguacuuucagaggagauauaacacacauaacuggaagccacaauuacacaaugaauuuagcaucacaaaauuggaacaauuacgacccaacagaagaaauaccagcaccauuagguacaccagauuuuguaggaaaaauacaaggaguauuaacacaaacuacaagaacagauggaaguacucgcggacauaaagcuacuguauacacagguucagcugaauuugcccccaaacuaggcagaguacaauucgaaacagauacaaaucacgacuuugaagcuaaucaaaauacaaaauuuacaccaguaggcguaauacaagacgguuccacuacacauagaaacgaaccccaacaauggguauuaccaucauauucaggcagaaauacccauaauguacauuuagcaccagcagucgcacccacauucccaggagaacaacuacuauucuuuagaucaacuaugccaggaugcucaggauaucccaacauggauuuagauugccuauuaccacaagaauggguacaauacuucuaucaagaagcagcaccagcacaaucggauguagcccuuuuaagauucguaaacccagacacaggccgagucuuauuugaaugcaaauuacauaaaucagguuauauuaccgucgcccacacaggacaacaugauuuaguuauaccaccaaacgguuauuucagauuugacuccuggguaaaccaauuuuacacacuugcaccuaugggcaaugguacagguagaaaacgauaa

SEQ ID NO: 34116 - RNA, 1617 nt, Artificial Sequence
  derived and/or modified sequence opt6 from VP1__Norovirus_and/or_Norovirus-like__KX354120
augaaaauggcaucaucugaugcuaacccuucagauggaucagcagcaaacuuaguaccugaaguaaacaacgaaguaauggcauuagaaccuguagucggcgcagcuauugccgcuccaguugcaggucaacaaaacguaauagauccauggauucgcaauaauuuuguacaagcaccaggaggagaauuuaccguuucaccacgaaaugcuccuggcgaaauacuauggucagcaccauuaggaccagaucuaaacccauaucuuucucauuuagcaagaauguauaauggauacgcuggaggauucgaaguacaaguaauucuagccgguaaugcauuuacagcaggaaaaguaauauucgccgccguaccaccaaacuuccccacugaaggauuaaguccaucacaagucacaauguucccccacauugucguugacguacgacaauuagaacccguauuaauuccacuaccugacguaagaaauaauuucuaucacuauaaccaauccaaugacccuacaauaaaacuaauagcuaugcuauacacaccacuaagagccaacaacgcuggagacgacguauuuacaguuucaugccgaguauuaacacguccaucuccagacuuugauuuuauauuucuaguaccaccuacaguagaaucaagaacuaaacccuucucaguaccaguauuaaccguagaagaaaugacaaacucuagauuuccaauaccucuagaaaaacuauuuacuggcccaucaucugcuuucguuguacaaccacaaaacggaagauguacuacugauggaguacuacuagguacaacacaauuaucaccagucaacauauguaccuuucgaggcgacgucacucacauaacaggcagcagaaauuauacaaugaaucuugccucccaaaauuggagcaauuacgauccaacagaagaaauaccagcgccauuagguacaccagauuuuguuggaaaaauacaaggaauguuaacucaaacaacaagaacagauggaagcacacguggacauaaagcaacaguauauacagguucagcagacuuugccccaaaacuaggaagaguacaauuugaaaccgauacugaucaugauuuugaaguuaaucaaaauacaaaauucacacccguuggaguaauacaagauggaaguacaacacauagaaaugaaccacaacaaugggucuuaccuucauauagcggaagaaacacaccuaauguccaccuagcaccagcaguagccccuaccuuuccaggagaacaacuuuuauucuuuagaucaacaaugccaggaugcucuggauacccaaacauggacuuagauugcuuauuaccucaagaauggguucaauauuucuaccaagaagcugcaccagcacaauccgacgucgcauuauuaagauucguaaauccagacacaggaagagucuuauucgaaugcaaacuccauaaauccggcuauguaaccguagcacauacaggacaacaugaucuaguaauaccaccaaauggauacuuuagauucgauucaugggucaaucaauuuuauacacuugccccaaugggaaacggaacuggaagacguagauaa

SEQ ID NO: 34117 - RNA, 1617 nt, Artificial Sequence
  derived and/or modified sequence opt6 from VP1__Norovirus_and/or_Norovirus-like__KX354113
augaaaauggcuucaucugacgcuucacccucagacgggagcgcagcaaacuuaguaccagaagucaauaaugaaguuauggcucuagaaccagucguaggcgcagcaaucgcugcaccagucgccggacaacaaaaugucauugauccauggauacgaaauaacuuuguacaagcuccaggaggcgaguucacaguaucaccuagaaaugcccccggagaaauacuauggucagcaccacuaggcccagaccuaaauccuuaucuaucacaucuugccaggauguauaauggcuacgcaggagguuuugaaguucaagucauacuagcaggaaaugcauuuacagccggaaaaguuauauucgcagcaguuccaccaaacuucccaacagaaggacuaucuccaucccaaguaacaauguuuccacauaucguaguugacguucgacaacuagaaccaguacuuauuccauuacccgauguaagaaauaacuuuuaccauuacaaccaaucaaacgauccuacaauuaaacuaauagcaaugcuauauacuccacuaagagcaaacaacgcuggugaugauguauuuacaguaucuuguagaguacuaacuagaccaucaccugauuucgauuucauauucuuaguaccaccaaccguugaaucacgaacaaaaccauuuucaguacccguucuaacaguagaagaaaugacaaacucaagguuuccaauaccacuugaacgacuuuucaccggcccuaguucagcauuuguuguccaaccccaaaauggacgauguacaacugaugguguauuacuagguacaacucaauuaucaccagucaauauaugcacauuuagaggcgauguuacacauauaacugguucuagaaacuauacuaugaaccucgcaucacaaaauuggagcaauuacgaccccacagaagaaauaccugcuccacucggaacaccugacuuugucggaaaaauacaagguguacuaacacaaacaacuagaacagacggaucuacaagaggccacaaagcaacaguauauacaggauccgccgacuuugcaccaaaauuaggcagaguacaauucgaaacagauaccgaucacgacuuugaagcaaaccaaaauacaaaauuuacaccaguaggaguaauucaagacggaggcaccacacaucguaaugaaccacaacaauggguacuaccaucuuacaguggaagaaauacaccaaauguacaucuugccccagcaguagcaccuaccuuuccaggugaacaacuacuuuucuuuagauccacaaugcccggaugcucuggauaucccaauauggaucuagauuguuuacucccacaagaauggguucaauacuucuaucaagaagcugccccagcacaauccgacguugcucuacuaagauuuguaaacccugacacaggaagaguauuauucgaauguaaacuacauaaauccggauauguuacaguagcucacacaggucaacaugauuuaguaauaccuccaaacggauauuucagguucgauagcuggguaaaucaauuuuacaccuuagcaccaaugggaaaugguacagggagaagacgauaa

SEQ ID NO: 34118 - RNA, 1617 nt, Artificial Sequence
  derived and/or modified sequence opt6 from VP1__Norovirus_and/or_Norovirus-like__KX354105
augaaaauggccucaucagacgcaaauccaucagacggaucagccgcaaacuuagucccugaagugaacaacgaaguaauggcacucgaaccaguagucggagcugcaaucgcagcuccuguugcaggacaacaaaauguuauagacccauggauucgaaacaauuuuguccaagcuccagguggagaauuuacagucucaccaagaaaugcuccuggcgaaauacuuuggucugcuccauuaggaccagauuuaaauccuuauuuaucacauuuagccagaauguauaauggauaugcuggaggauuugaaguacaagucauacucgcuggaaaugcauuuacugcaggaaaagugauauucgcagcuguaccaccaaauuuuccuacagaaggauuaucaccaucucaagucacaauguuuccacacauagucguugauguuagacaauuagaaccuguacuaauuccucuaccagacguuagaaauaacuuuuaucacuauaaucaauccaaugaccccaccauaaaauuaauagccaugcuauauacuccauuaagagcaaauaaugccggagacgaugucuuuacuguaucauguagaguauuaacaagacccucaccagacuuugacuucauauuucuaguaccaccaaccguagaaucaagaacaaaaccuuucuccguuccaguucuuacaguugaagaaaugacaaauaguagauucccaauaccacuagaaaaacuauuuacaggaccaucaucagcauuuguaguacaaccacaaaauggacgauguacaacugauggaguauuauuaggaacaacccaacucucaccuguuaacauauguacauuuagaggagacguaacacacauaacagguucacgaaauuauaccaugaauuuagcaucacaaaauuggucaaacuacgauccaacagaagaaauaccagcaccucucggaacuccugacuuuguuggcaaaauacaaggaguacuaacgcaaacuaccagaaccgacggaucaacacgaggucauaaagcuacgguauauaccgguucagcagauuuugcaccaaaacuaggaagaguacaauucgaaacagauacugauagagauuuugaagcaaaucagaacaccaaauucaccccuguaggagucauacaagacggaucaaccacacaucgaaaugaaccucaacaauggguauuacccucauauagugguagaaacacaccaaauguacaccuagcacccgcuguugcaccuacuuuuccaggagaacaacuacuuuucuuuagaucaacaaugccuggauguucaggauauccaaauauggauuuagauugucuacuaccacaagaauggguacaauacuuuuaucaagaagcagcaccagcucaaagugauguagcacucuuaagauucguuaauccugacacaggaagaguauuauuugaauguaaauuacauaaauccgguuauguaacagucgcacauacuggacaacaugaucuaguuauuccucccaacggcuauuuuagauuugauuccuggguaaaucaauucuacacauuagccccuaugggaaacggaacuggaaggagaagguaa

SEQ ID NO: 34119 - RNA, 1617 nt, Artificial Sequence
  derived and/or modified sequence opt6 from VP1__Norovirus_and/or_Norovirus-like__KX354077
augaaaauggccucuaacgacgcgaauccaagcgacggaucugcagcaaaccuaguaccugaagugaacaacgaagucauggcucuagaaccaguaguaggugcagcaauugccgccccaguagcaggacaacaaaauguaauagacccauggauaagaaauaacuuuguacaagcuccaggaggagaauuuacaguaucaccaagaaaugcaccaggagaaauacuauggucugccccacuagguccagaccuaaacccauaucuaucacacuuagcuagaauguacaauggauacgcuggcggauucgaaguacaaguuauacuagcaggaaaugcauucacagcaggaaaaauaauuuucgcggcaguaccaccaaacuuuccaacagaaggucuuucuccuucucaaguaacuauguuuccacauauaauagucgacguacgacaacuugaacccguacuaauaccacuaccagauguacguaauaauuucuaucauuauaaccaauccaacgacucaacaaucaaauugauagcaaugcucuacacaccacuacgugcaaauaacgcaggagaagacguauuuacaguaucuugcagaguacuaacgagaccaucaccagauuuugacuucauauuucuaguaccuccaaccguagaaucaagaacuaaaccauuuacaguuccaaucuuaacaguugaagaaaugacaaacucccgauucccaauaccacuagaaaaauuauuuacaggccccagcucggcauucgucguacaaccacaaaaugguagaugcacaacagacggcguauuauuaggaacaacucaacuaaguccuguuaacaucugcacuuuucgaggagacguaacccauauagcaggaucuagaaacuacacaaugaauuuagcuagucuaaauuggaauaauuacgauccaacugaagaaauuccugcaccucuaggaacaccagacuuuguaggaaaaauacaagguauguuaacucaaaccacaagaggagacggaucaacaagaggccauaaagcaaccguauauacagguucagcacccuuuacaccaaaauuaggcucaguacaauucgaaacagauacugaaaacgauuuugaaacccaccaaaauacaaaauucacaccaguaggaguaauacaagacgguggaaccacacauagaaaugaaccacaacaauggguacuaccaucauauucaggacgauccguaccaaauguucaucuagccccugcaguugcacccacauucccuggugaacaauuacuauucuucagaucaacaaugccaggauguucgggauaucccaauauggaucuagauuguuuauuaccacaagaauggguacaacacuucuaccaagaagcagcucccgcacagucagauguagcauuauuaagauuuguaaacccagacacaggaagaguauuauucgaaugcaaacuacacaaaucaggcuaugucacaguagcacacacaggacaacacgaccuaguaauuccuccaaacggcuauuuucguuucgauuccuggguuaaucaauuuuauacuuuagcuccaaugggaaauggaaccggaagaagaagauaa

SEQ ID NO: 34120 - RNA, 1617 nt, Artificial Sequence
  derived and/or modified sequence opt6 from VP1__Norovirus_and/or_Norovirus-like__KR131785
augaaaauggcuucuucugaugccaauccuucagaugguucugcagcaaaucuaguucccgaaguuaauaaugaaguuauggcauuagaaccaguagucggagccgcaauagcugcaccaguagcuggacaacaaaauguaauagauccauggauucgaaacaacuucguacaagcaccagguggcgaauuuacaguuucccccagaaacgcacccggagaaauauuaugguccgcaccuuuaggaccagacuuaaauccauaucuaucacauuuagccagaauguacaacggauacgcuggaggauuugaaguucaaguaaucuuagccggaaaugcauuuacugcaggaaaagucauauuugcagcaguacccccaaauuucccaacugaagguuuauccccaagccaaguuacuauguuuccacacauaguaguagacguucgacaacuagaaccuguauuaauuccacuuccagacgucagaaacaauuucuaucauuacaaucaauccaaugacccaacaauuaaauuaaucgcaaugcuauacacaccacuccgcgcaaacaacgcaggagacgauguauucacaguauccuguagaguccuaacuagaccaucaccugauuucgauuuuaucuuuuuaguaccuccaacuguugaaucaagaacaaaaccuuuuucaguuccuguucucacgguagaagaaaugacuaauucaagauuuccaauuccauuagaaaaacuauuuacaggcccaucaucagcauuuguaguacaaccacaaaauggucgcuguacaacagauggaguacuauuaggaacaacucaacuaagcccaguaaauauauguacuuuucgaggagauguaacccacauaaccggaucacauaauuauacaaugaauuuagcaucacaaaacuggaauaauuaugauccaacugaagaaauaccagccccgcuaggaaccccagauuuuguaggaaaaauccaaggaguauuaacacaaacaacacgaacagauggcucuacaagaggacauaaagccacuguauauacaggaucugcugacuuugcaccaaaauuaggcagaguacaauuugaaacugauacaaaccaugacuuugaagcaaaccaaaacacuaaguuuacaccaguuggagucauacaagauggaggaacaacacacagaaaugaaccucaacaauggguacuaccuuccuauucaggacguaauacgcacaauguccaccuagcuccagcaguugccccaaccuuuccaggagaacaauuacucuuuuucagaucuacuaugccaggauguucaggauauccuaacauggaccuagauugucuucuaccacaagaauggguacaauauuucuaucaagaagcagcuccagcacaaagugauguagcucuuuuacgauuuguuaacccagauacaggacgaguucuuuuugaauguaaacuccauaaaaguggauauguaacaguugcucauaccggacaacaugacuuaguaauaccaccuaacggauauuuuagauucgauucauggguaaaucaauucuauacauuagcucccaugggaaacgguacagguagaagaagauaa

SEQ ID NO: 34121 - RNA, 1617 nt, Artificial Sequence
  derived and/or modified sequence opt6 from VP1__Norovirus_and/or_Norovirus-like__AB972530
augaaaauggcuucaucugaugcuaauccauccgauggaucagcagcaaaucuaguaccagaaguaaauaacgaagucauggcacuagaaccaguaguaggugcagcaauagccgcacccguagccggacaacaaaauguaauagauccauggauaagaaauaauuuuguacaagccccaggcggagaauuuaccguaucuccacgaaaugcuccaggugaaauacuauggucagcaccauuaggaccagaccuaaauccauaucuaucucauuuagcacgaauguacaaugguuacgcuggcggcuuugaaguacaaguaauccuagcugguaacgcauuuacagcuggcaaaguaauauuugcagcaguaccaccaaauuuuccaacagaaggauuaucaccaucacaaguaacaauguucccacacauuguaguagacguaagacaauuagaacccguacuuauuccacuaccagacguccguaacaauuuuuaccauuauaaucaaucuaaugacccaacuaucaaacuaauugccauguuauacacacccuuaagagcaaacaaugcaggagaugacgucuucacaguuagcugucgaguuuuaacaagaccuuccccagacuuugacuuuaucuuccuagucccaccuacaguagaaucccgaacaaaaccauucuccguaccaguauuaacaguagaagaaaugacaaauucuagauuuccaauaccauuagaaaaacuauuuacuggaccaucaucagcauuuguaguacaaccacaaaacggaagaugcacaaccgacggaguacuacuuggaacaacucaacucucaccuguaaauauaugcacauucagaggcgacguaacacauauuacaggcucaagaaauuauacaaugaauuuagcaucacaaaacuggaguaacuacgauccuacagaagaaauaccugcaccauuaggaacaccagauuucguaggcaaaauacaaggagucuuaacacaaacaacuagaacagacgguucaacaagaggccacaaagcuacagucuauacaggaucagcagacuucgcacccaaguuaggaagaguccaauuugaaacagauaccgaccaugauuucgaagcaaaccaaaacacaaaauuuaccccaguaggaguuauccaagaugguucaacaacucacagaaacgaaccucaacaauggguuuuaccaucauauuccggacgaaauacacccaacguacacuuagcaccagcagucgcaccaacauuccccggagaacaacuauuauucuucagauccacaaugccugguuguucuggauacccuaacauggaucucgauuguuuacuaccacaagaauggguacaauauuuuuaucaagaagcagcaccagcacaaucugauguugcauuauuaagauuuguaaauccagacacaggaagagucuuauucgaauguaaauuacacaaaucuggguauguaacaguagcccacacaggacaacacgaccuuguaauaccaccaaauggcuauuucagauucgacuccuggguaaaucaauuuuacacucucgcuccaauggguaauggaacaggucgacgacguuga

SEQ ID NO: 34122 - RNA, 1617 nt, Artificial Sequence
  derived and/or modified sequence opt6 from VP1__Norovirus_and/or_Norovirus-like__AB972526
augaaaauggcuucuagugacgccaauccaucagacggcuccgcugcaaacuuagucccagaaguaaauaaugaaguuauggcauuagaaccaguaguaggcgcagcaauagcugcaccaguagcaggacaacaaaauguuauagauccuuggauaagaaauaauuuuguacaagcaccaggcggagaauuuacaguaucaccaagaaaugcuccaggagaaauauuauggucagcaccauuagguccugauuuaaauccauaccuaucacauuuagcucgaauguauaauggcuaugcuggcggcuucgaaguacagguaauauuagccgguaaugccuucacagcugguaaagucauauucgcagccguaccaccaaauuuccccacagaaggcuuaucuccaucacaaguaacaauguuuccucauauaguaguagauguacgccaauuagaaccaguacuaauaccacuaccagauguaagaaauaauuuuuaucauuacaaucaaucaaacgaccccacaauuaaacuaauugcaaugcuauacacaccucuccgagcaaacaaugcaggagaugacgucuuuacaguaucauguagagucuuaaccagacccagcccagauuucgacuucauauuuuuaguaccacccacaguugaaaguagaaccaaacccuucucaguaccaguucuuacaguagaagaaaugacaaauaguagauucccaauaccauuagaaaaacucuuuacugguccaagcagcgcauuugucguucaaccccaaaaugguagauguacaacagacggaguauuacuaggaacaacacaauuauccccugucaauauauguacauuuagaggcgauguaacacauauuacaggcucucacaacuauacaaugaaccuagcaucacaaaauuggaauaacuaugauccaacagaagaaauuccagcuccauuagguacaccagauuucguaggaaaaauacaaggaguacuuacacaaaccacaagaacagauggaagcacaagaggacacaaagcaacaguauauacuggaucagcagacuucgccccaaaauuaggacgcguacaauuugaaacagauacugaucacgacuuugaagcaaaccaaaacacaaaauucacuccagucgguguaauucaagacggaggaacuacacauaggaaugaaccacaacaauggguauuacccucauacucaggaagaaauacucacaacguccauuuagcuccagcaguagcaccaacauuucccggagaacaacuucuauucuuuagaucaacaaugccaggaugcucaggcuacccuaauauggauuuagauuguuuacuuccacaagaauggguacaauauuucuaucaagaagcagcucccgcacaaucagacguagcacuucuaagauuuguaaacccagauacaggaagaguauuauuugaauguaaauuacauaaauccggauauguuacaguagcacauacaggucaacacgaucuuguaauaccaccaaauggauauuuccgcuuugacucauggguaaaccaauucuauacuuuagcacccaugggaaauggaacaggaagacguagauaa

SEQ ID NO: 34123 - RNA, 1617 nt, Artificial Sequence
  derived and/or modified sequence opt6 from VP1__Norovirus_and/or_Norovirus-like__AB972522
augaaaauggcaucaucagaugcaaacccaucagacggaagugcugcuaacuuaguaccugaagucaauaacgaagucauggcucuugaacccguuguaggagccgcaauagcagccccaguagcuggacaacaaaauguaaucgacccauggauaagaaauaauuuuguacaagcaccuggcggcgaauuuacagucucuccaagaaacgcaccaggagaaauauuaugguccgccccucuaggaccagaccuaaauccauacuuaucacaccuagcaagaauguauaacgguuacgcuggaggauuugaaguacaaguaaucuuagcuggcaaugcauucacagcuggaaaaguaauauuugcagcagucccaccaaacuuuccaacagaaggccuuucaccaucacaagucacuauguucccucauauaguuguagauguaagacaauuagaaccaguuuuaauaccacuuccagaugucagaaauaacuucuaccacuauaaucaaucaaaugacccuaccauaaaacuaauagcuauguuauauacaccucuaagagcaaacaacgcaggagaugauguauuuacuguaucauguagaguauuaacuagaccuucaccugacuuugauuuuauauuuuuaguacccccaaccguagaaucccgaaccaaaccauucucaguaccaguauuaaccguagaagaaaugacaaacucacgcuuuccaaucccguuagaaaaacuauuuacaggaccaucuucagcauucgucguacaaccacaaaacgguagauguaccaccgacggaguucuacuagguacaacacaacuaucaccuguaaacauauguacuuucagaggagaugucacacauauaacuggaucuagaaauuauacaaugaauuuagcuagccaaaacuggucuaauuacgauccaacagaagaaaucccagcaccacuaggaacaccugacuuuguaggaaaaauacaaggaguacuuacacaaaccacuagaacagacgguucaacaagaggucauaaagccacaguauauacaggaucagcaaauuucgcaccaaaacuaggcagaauacaauucgaaacagauacagaccaugauuuugaagcuaaucaaaauaccaaauuuacaccuguuggaguaauacaagauggaucaacuacacauagaaaugaaccacaacaauggguauuacccucauauucaggaagaaauacccccaacguacacuuagcuccugcaguugcacccacauucccuggcgaacaacuacuauucuuuagaucaacaaugccagggugcuccggcuauccaaacauggauuuagauugcuuacuaccacaagaauggguacaauacuucuaucaagaagcagcacccgcacaaucagacgucgcucuauuaagauucguaaacccagauacaggacguguauuauuugaauguaaacuacacaagucaggauacguaacaguagcacacacaggacaacacgaucuuguaauaccaccaaacggcuauuucagauuugauucaugggugaaucaauuuuauacuuuagccccaaugggcaacggaacagguagaagaagauaa

SEQ ID NO: 34124 - RNA, 1617 nt, Artificial Sequence
  derived and/or modified sequence opt6 from VP1__Norovirus_and/or_Norovirus-like__AB972514
augaaaauggcaucuaaugaugcuaacccuagugauggcucagcagccaauuuaguacccgaaguaaauaacgaagugauggcauuagaaccaguagucggagcugcaauagccgcaccaguagcuggacaacaaaauguaauagauccauggauuagaaauaauuuuguacaagccccagguggagaauuuaccguaucaccaagaaacgcaccaggagaaauacuuuggucugcaccauuaggaccagauuuaaacccauauuuaucucaucuagcaagaauguauaauggcuacgcugguggauucgaaguccaaguaauauuagcagguaaugcauucacagcuggcaaaauaauauuugcagccgugcccccaaacuuuccaacagaaggacuaucucccucacaagucaccauguucccgcacauaauuguagacguucgacaauuagaaccaguauuaauaccuuuaccagacguaagaaauaauuuuuaucacuauaaucaaucaaacgauucaacaauuaaacuaauagcuauguuauauacaccccuaagagcuaacaaugcaggagaagauguauucacaguuucauguagaguacucacacguccuucuccugauuuugacuuuauauuucuuguaccaccuacuguagaaucaagaacaaaaccauucacaguucccauucuaacuguagaagaaaugacaaauucucgauuuccgauaccacuugaaaaacuauuuacaggaccaucaucagccuuuguaguccaaccacaaaacggaagauguacaacugacggcguacuacuaggcaccacacaacuaucaccaguaaauauuugcacuuuucgcggagaugucacacauauagcaggcaguagaaacuauacaaugaaucucgcuucauuaaauuggaacaacuacgauccaacagaggaaauaccugcaccacuaggaacaccugacuucgucggaaaaauacaagguauguuaacacaaacaacaaaaggcgacggaucaacuagaggucacaaagcaacagucuauaccggaagcgcaccauuuaccccaaaauuagguucaguacaauucgaaacagacacagaaaacgauuucgaaacacaccaaaauaccaaauucacacccguagguguuauucaagauggaggaaccacacauagaaacgaaccacaacaauggguuuuaccaucauauagugggagaaauguacccaauguacaccucgcaccagccguagcacccaccuuuccaggagaacaacuauuauucuucagaucuauaaugccaggcuguucuggauauccaaauauggaucuggacugcuuacuaccucaagaauggguacaacacuuuuaccaagaagcagcacccgcacaaucagaugucgcuuuauuaagguucguaaacccagacacagggagaguucucuuugaauguaaauuacauaaaucaggauacguaacaguugcacacacaggacaacacgaucuagucauaccaccuaacggauauuucagauuugacuccugggucaaucaauucuauacacuagcuccuaugggaaauggaacagguagaagacgauaa

SEQ ID NO: 34125 - RNA, 1617 nt, Artificial Sequence
  derived and/or modified sequence opt6 from VP1__Norovirus_and/or_Norovirus-like__AB972505
augaaaauggccucuucagacgcuaacccaucugauggauccgcagcaaaucuaguaccagaaguaaacaaugaaguaauggcauuagaaccagucguaggugcugcaauagcagcaccaguagcaggacaacaaaacgucauagauccauggauaagaaacaacuuuguucaagcaccaggcggagaauuuaccguuucaccaagaaaugcaccaggugaaauauuauggucugcaccacuaggaccugaucuaaauccauaucucucucacuuagcacgaauguauaauggauacgcaggaggcuucgaaguacaagucauacuagcagguaaugcauuuacagcaggcaaaguaauauucgcugcaguucccccaaacuuuccaacagaaggacuaucaccaucucagguaacaauguuuccacacauuguagucgauguaagacaacuugaaccuguccucauaccauuaccagaugucagaaauaacuucuaucacuacaaccaaucaaacgacccuacuauaaaacuaauagcaaugcuauauacaccauuacgagcaaacaaugccggcgaugauguauuuaccguuucuugucgcguacucacaagaccaucaccugacuucgacuuuauauuucuaguaccaccaaccguugaaucaagaacuaaaccauucucaguacccguacuaacuguagaagaaaugacuaacucacgauuucccauuccauuagaaaaacuauucacaggaccaucaucagcauucguaguacaaccccaaaauggaagaugcaccacugacggaguauuauuaggaacaacacaacuaucuccaguaaacaucuguacauuuagaggcgacguaacacauauaacaggaucaagaaauuacaccaugaaucucgcaucacaaaacugguccaauuacgauccaacagaagaaauaccagcaccccuagguacaccugacuuuguuggaaaaauacaagguguacuuacacaaacaacaagaacagacgguaguacaagaggacauaaagcaacaguuuacacaggaucagcagacuucgcacccaaauuaggacgaguacaauuugaaacagauacagaucacgacuucgaagcaaaccaaaauaccaaauuuacaccaguggguguaauccaagacggcucuacagcacaucgaaaugaaccacaacaauggguccuaccaucauauucaggucgaaauacucccaauguucaucuagcacccgcuguagcaccaacauuuccaggugaacaacuacuuuucuucagaucuacaaugccaggauguucuggauauccaaauauggacuuagacuguuuacuaccacaagaauggguacaauacuucuaucaagaagcugccccagcacaaucagauguagcacuuuuaagauuuguaaacccagacacaggcagggucuuauuugaaugcaaacuacauaaaucaggcuauguaacaguagcucacacaggacaacaugauuuaguaauaccucccaauggcuauuuucgauucgauucauggguaaaucaauuuuacacacuagcuccaaugggaaaugguacuggaagaagacgauag

SEQ ID NO: 34126 - RNA, 1617 nt, Artificial Sequence
  derived and/or modified sequence opt6 from VP1__Norovirus_and/or_Norovirus-like__AB972473
augaaaauggcaucaucagaugcaaacccuucugauggcucagccgcuaacuuaguaccagaaguaaacaaugaagucauggcacuagaaccuguaguaggugcagcaauagcagccccgguagcuggacaacaaaauguaaucgacccauggauuagaaacaacuuuguucaagcaccuggaggcgaauuuacuguuucuccacgaaacgcaccuggagaaauauuaugguccgcuccacuuggaccagacuuaaauccauaucuuucccauuuagcacgaauguauaaugguuacgcaggaggauucgaaguacaaguaauucuagcaggaaaugcauuuacagccggaaaaguaauauucgcagcuguaccuccaaauuuuccaacagaaggacucucaccaucacaagucacaauguucccccacauagucguagaugucagacaacuagaaccaguuuuaauuccacuaccagauguuagaaauaauuuuuaucacuacaaucaaaguaacgauccaacaauaaaauuaauagcaaugcuauauaccccauuacgagcaaacaaugccggugaugauguauucacaguaucuugccgaguucucacuagaccaucuccagacuucgauuuuauauuucuaguuccuccaaccgucgaaucucgaacaaaaccauucucaguuccaguauuaacaguagaagaaaugaccaauucuagauucccuauaccacucgaaaaacucuuuacaggucccucuagugccuucguaguacaaccacaaaaugguagauguacaacugacggaguauuacuagguacaacccaauuaucaccuguaaauauuuguacuuuuagaggagacguaacacauauaacaggcucaagaaauuauacaaugaaucuugcaucacaaaacuggaauaauuacgaccccacagaagaaauuccugcaccuuuaggcacucccgacuuuguugguaaaauacaaggaguuuuaacacaaaccacaagaacagacggaucaaccagaggucacaaagcuaccguauauacaggaucugcagauuucgcuccaaaacuaggacgcguacaauuugaaacagauacagauagagauuucgaagcuaaccaaaacacaaaauucacaccuguaggaguuauccaagauggaagcacaacacaucgaaacgaaccacaacaauggguccucccuagcuauucaggaagaaauacacauaacguacacuuagccccugcaguagcaccaacauuuccaggagaacaacuacuauucuuucgaucuacaaugcccggaugcucaggauacccaaauauggaucucgauugcuuauuaccacaagaauggguccaauauuucuaucaagaagcagcuccagcucaaucagacguagcacuauuacguuucguuaauccagauacaggacgaguccuauuugaaugcaaacuacacaaaucuggauauguaacaguagcacauacaggacaacacgauuuaguuauaccaccaaacggauauuuccgauuugauucauggguaaaccaauucuauacuuuagcccccaugggaaacggcacaggaagaagaagauaa

SEQ ID NO: 34127 - RNA, 1617 nt, Artificial Sequence
  derived and/or modified sequence opt6 from VP1__Norovirus_and/or_Norovirus-like__KT780381
augaaaauggcgucaagugacgcaaauccuucagaugguucagcagcaaacuuaguaccagaaguaaauaaugaaguuauggcgcuugaaccaguuguaggagcagcaauagccgcaccaguagcaggacaacaaaauguuaucgacccauggauucgaaauaauuuuguccaagcaccaggaggcgaauuuacaguuucaccuagaaaugcaccaggagaaauauuauggucugcaccucuaggacccgaucuaaauccauauuuaucucacuuagcuagaauguauaaugguuacgcaggagguuucgaaguacaaguaauauuagcaggcaacgcauucacugcaggaaaaguaauauucgcagcaguacccccaaacuuuccuacugaaggacuuucaccaucacaaguaacaauguucccccacauaguaguagacguacgacaacuagaaccagucuuaauuccacuuccagauguacgaaauaauuucuaccacuauaaccaaucaaaugaucccaccauaaaauuaaucgccauguuauacacaccuuuaagagccaauaacgccggagacgacguauuuaccgucucaugcagaguauuaacgagaccaucaccagauuuugauuucauuuuucuaguaccaccaaccguagaauccagaacaaaaccauucucuguacccgucuuaacaguagaagaaaugacaaacucgagauuuccaaucccucuagaaaaacuauuuacuggacccucuucagcauuuguuguucaaccucaaaaugguagaugcaccacagacggaguacuauuaggaacaacacaauuaucacccguaaauauaugcacauuuagaggagacguuacacauauaacuggaucaagaaauuacacaaugaacuuagcaucacaaaacuggucaaacuacgauccaacugaagauauaccugccccucuaggaacaccagauuucguaggaaaaauacaaggagucuuaacacaaacaacaagaacagacggaucaacaagaggucacaaagccaccguuuauacaggaucagcugauuuugcaccaaaacuuggcagaguccaauuugaaacagauacugaucacgauuucgaagcaaaucaaaauaccaaauucacaccagucgguguaauucaagauggaggaaccacacaccgcaacgaaccccaacaauggguacuuccuuccuacucaggcagaaacacuccaaacguucaccuagcacccgcagucgcaccuacauuuccaggagaacaacuauuauucuuuagaucaacaaugccaggcuguucuggauauccaaacauggaucuagauugccuucuaccacaagaauggguucaauauuuuuaccaagaagcugcuccugcacaaucagacguagcauuauuaagauucguuaauccagacacuggaagaguauuauucgaauguaaacuacacaaaucaggauacguaacaguagcccauacaggacaacaugaucucgucauaccuccaaauggauacuucagauucgauucauggguaaaucaauucuacacccuagcaccuaugggaaaugguacaggcagacgacguuaa

SEQ ID NO: 34128 - RNA, 1617 nt, Artificial Sequence
  derived and/or modified sequence opt6 from VP1__Norovirus_and/or_Norovirus-like__KT780372
augaaaauggcaucauccgaugcuaauccaagugauggaucagcagcaaaucuuguaccagaaguaaauaaugaaguaauggcuuuagaaccuguagucggugcugcuauugcagcaccuguagccggacaacaaaauguaauagauccauggauuagaaauaacuuuguucaagccccaggaggagaauuuacagucucaccacgaaaugcaccaggagaaauacuauggucagcaccauuagguccagauuuaaauccauauuuaucacaucuggccagaauguacaacggauaugcugguggauuugaaguacaaguacuauuagcagguaacgcauuuacugcaggaaaaguaauauuugcagcaguucccccaaauuucccuacagaagguuuaaguccaucacaaguuacaauguucccccauauagucguagauguccgccaacuagaaccuguacuaauaccauuaccagacguaagaaacaauuuuuaucacuauaaccaaucaaaugauccaacaauaaaauuaaucgcaaugcuuuauaccccacuaagagcaaauaaugcaggagacgauguauuuacuguaucauguagaguuuuaacaagaccaaguccagauuuugauuuuauauuucuaguacccccuacaguugaaucaagaacuaaaccauuuuccguaccaguacuaacaguagaagaaaugacuaauagcagauucccaauucccuuagaaaaacuuuuuacaggaccaucuucagcauuuguaguucaaccucaaaacggcagauguacuacagauggaguauuauuaggaacaacacaacuuucacccgucaauauuuguacauuuagaggagauguuacacauauaacgggaucccgcaauuacacaaugaaccuugcaucucaaaauuggucaaauuaugaucccacagaagaaauaccagcuccacuaggaacaccugauuuuguaggcaaaauccaaggaguacuuacacaaacaacaagaacagacgguuccacacgaggccauaaagccaccgucuauacuggcucagcugacuucgcacccaaacuaggcagaguacaauucgaaacagauacagaccacgacuucgaagcaaaccaaaauaccaaauucacaccaguaggugucauacaagacgguucuacaacucaccgcaacgaaccacaacaauggguccuaccuucauauucuggacgaaacaccccaaacguacauuuagcaccagcaguagcaccaacauuucccggugaacaauuauuauucuuucguucaacuaugcccggaugcucaggauauccaaacauggaucuagauuguuuauuaccacaagaauggguacaauacuuuuaccaagaagcugcaccggcacaaagcgacguugccuuauugagauuuguaaauccagacacaggaagaguccuauucgaauguaaauuacauaaaucuggauacguaacaguagcacauacaggacaacaugaucuuguuauuccaccaaacggauauuuucgauuugauucauggguaaaccaauuuuauacauuagcuccuauggguaauggaacaggaagaagaagauga

SEQ ID NO: 34129 - RNA, 1617 nt, Artificial Sequence
  derived and/or modified sequence opt6 from VP1__Norovirus_and/or_Norovirus-like__KT202797
augaaaauggcuucaucagaugcaaacccaucugacgguagugcagcaaaucuuguaccagaaguaaauaaugaaguuauggcccuagaaccaguaguaggagcagcaaucgcagcgccaguagcaggacaacaaaaugucauagaucccuggauccgaaauaauuuuguacaagcaccuggaggagaauuuacaguuucuccacgaaaugcuccaggagaaauauuauggucagccccacucggaccagaccuuaauccauaccuuucacacuuagccagaauguacaauggauaugcaggcggauucgaaguacaaguaauuuuagcaggaaacgcauuuacagcaggaaaaguaauuuucgcagcaguaccaccaaacuucccaacugaaggacuuucacccucacaaguaacaauguuuccucacaucgucguagacguaagacaacuagaaccaguucuaauaccccuaccagacguuagaaacaauuucuaccauuauaaucaaucaaaugauccaacaauuaaacuaauagcaaugcuauacacaccauuacgcgcaaacaaugcuggagaugacguauuuaccguaucaugucgaguacuaacccgaccaucaccugacuuugacuuuaucuuuuuaguaccuccaacuguagaauccagaacgaaaccauucucaguaccuguauuaacuguagaagaaaugacuaauucacgcuuuccaauuccccuagaaaaacucuuuacuggacccucaucagcuuuuguaguucaaccacaaaauggacgcuguacaacagacgguguucuauuagguacuacacaacuaucaccaguaaacauauguacauucagaggagauguuacucauauaacaggaucccacaauuacacuaugaaccuagcaagccaaaauugguccaacuaugacccaacagaagaaauucccgcaccauuagguacaccugauuuuguuggaaaaauucaaggaguucuaacacaaaccacaagaacagacggaagcacuagaggacacaaagcaacaguauacacaggaucagcagauuucgcacccaaacuaggacgaguacaauuugaaacagacacagauagagacuucgaagccaaucaaaacacaaaauucacgccugucggagucauccaagacggaggaacgacucacagaaaugaaccucaacaauggguacuaccaucauauucagguagaucaacaccaaacguacacuuagcaccagcuguagcuccgacauuuccaggggaacagcuacucuuuuucagaucaacaaugccaggaugcucaggauauccaaacauggaucuugauuguuuauuaccucaagaauggguacaauacuuuuaucaagaagcagcaccagcacaaucagaugucgcauuauuaagauucguaaauccagacacagguagaguacuauuugaaugcaaauuacauaaaucaggcuauguuacaguagcacacacaggacaacacgacuuaguaauaccaccaaauggauauuucagauucgauucauggguaaaucaauuuuauacauuagcaccgaugggaaacggcacaggacgacguagauaa

SEQ ID NO: 34130 - RNA, 1617 nt, Artificial Sequence
  derived and/or modified sequence opt6 from VP1__Norovirus_and/or_Norovirus-like__KR904226
augaaaauggcaucaagugacgcaaauccaucugaugguucugccgcaaaccuaguaccagaaguaaauaaugaagucauggccuuagaaccaguaguaggugccgcaauagcagccccuguagcaggacaacaaaauguaauagacccuuggaucaggaacaacuuuguacaagcucccggaggagaauuuacagucucaccuagaaacgcacccggagaaauauuauggucagcuccacuagguccagauuuaaacccauaucuaucacacuuagcucguauguauaacggauacgcaggagguuuugaaguacaaguaauauuagcaggaaacgcauucacagcagguaaaauaauauucgcagcagucccaccaaauuuuccaaccgaaggccuaucacccucacaaguuacuauguucccacacauaauaguagauguaagacaacuagaaccaguacuaauaccauuaccagacguaagaaauaacuucuaucacuacaaccaaucaaaugauccaacuauaaaauuaauagcaauguuauacaccccacuaagagccaacaacgcaggagaugaugucuuuacaguauccugcagagucuuaacucgacccuccccagauuuugauuuuaucuuucucguaccaccaacagucgaaucaagaacaaaaccuuucucaguaccaguuuuaacagucgaagaaaugacaaacucuagauuuccaauaccccuagaaaaacuauuuacaggacccuccucagcuuuuguuguccaaccccaaaacggaagaugcacuacagacggaguauuacuaggaacuacacaacuaucaccaguaaacauaugcacauucagaggugauguaacacacauaacaggaucaagaaauuacacaaugaaucucgcaucgcaaaacuggaauaauuacgauccaacugaagaaauaccugcaccacuaggaacaccugauuuuguuggaaaaauacaaggcaugcuaacacaaacaacuagaacagacggaucuacgagaggccauaaagcaacaguuuauacaggaagugcagauuuugccccuaaauuaggaagaguccaauuugaaacagauacagaccacgacuuugaagcaaaucaaaauacaaaauucacaccaguaggaguuauacaagauggcuccacaacucauagaaaugaaccucaacaauggguacuacccuccuacucaggcagaagugcacacaauguacauuuagcaccagcagucgcaccaacauucccuggugaacaauuacuuuucuuuagauccacaaugccaggaugcucaggauauccaaauauggauuuagauugcuuacuaccucaagaauggguacaauacuuuuaucaagaggcagcacccgcacaaucagacguugcuuuacuucgauuuguaaauccagauacaggacguguucuuuuugaauguaaauuacauaaaucaggauacguaacaguagcccacacaggacaacacgauuuaguaaucccaccaaauggauauuuucgauuugauucauggguuaaccaauuuuacacacuagcuccuaugggcaaugguacugggagaagacguuaa

SEQ ID NO: 34131 - RNA, 1617 nt, Artificial Sequence
  derived and/or modified sequence opt6 from VP1__Norovirus_and/or_Norovirus-like__KR904208
augaaaauggcuucauccgacgcaaaccccuccgauggaucagcagcaaaccuaguaccagaaguaaauaaugaaguuauggcacucgaacccguaguaggagcagccauagcagccccaguagcaggacaacaaaauguaauagacccuuggauuagaaauaauuucguacaagccccaggaggagaguucacaguaucaccuagaaacgcuccuggagaaauauuauggucagcaccacuuggaccagaucucaauccauauuuaucacaucuagcacgaauguacaacgguuacgcaggaggauuugaaguacaaguaauacuagcagguaaugcauuuacagcuggaaaaauaguauuuucagcaguaccaccaaacuuuccuacugaaggucuaucuccaucccaaguaaccauguuuccacacaucauaguugacguaagacaacuagaaccaguucuaauaccauuaccagaugucagaaacaauuucuaucacuauaaccaaaguaaugacccaacaauaaaauuaauagcaauguuauacacaccccuaagagcuaacaaugcaggagacgacguguuuacaguuucuugucguguuuuaacucgaccaucaccagacuuugacuuuauauucuuaguucccccuacaguugaaucuagaacaaaaccauucucuguaccuauauuaacaguagaagaaaugacaaacucuagauuuccaauaccccuagaaaaacuauuuacaggaccaucaucaacauuugugguacaaccacaaaauggucgauguacuacagauggcguacuuuuaggaacaacacaauuaucaccuguaaauauauguacauucagaggcgacguuacacacauagcaggaucuagaaauuacacaaugaaucuagccucucaaaacuggaacuccuacgacccaacagaagaaauuccagcuccacuagguacccccgauuuuguaggaaaaauacaaggaguauuaacucaaacaacacgaacagacggaucuaccagaggccacaaagcaacuguauauacaggaucagccgacuucucaccaaaauuaggaagaguccaauuugcuacagauacagauaaugacuucgaugcaaaccaaaauacaaaauuuacacccguuggcgucauacaggaugguaacacugcacacagaaaugaaccacaacaaugggucuuacccucauauucaggaagaaauacacauaauguucaucuagcccccgcuguagcaccuacauuuccaggagaacaacuuuuauucuuucgcucuacaaugccaggauguucagguuauccaaauauggauuuagauugucuauuaccacaagaauggguacaauauuucuaucaagaagcagcacccgcucaaucugacgucgcacuacuaagauucguaaacccugauacaggaagaguauuauuugaaugcaaacuucacaaaucaggauaugucacuguagcacacacaggacaacacgaccuaguaauaccaccaaacggauacuuuagauucgauucauggguaaaucacuucuauacccuagcaccaguuggaaauggaacuggaagacgaagauaa

SEQ ID NO: 34132 - RNA, 1617 nt, Artificial Sequence
  derived and/or modified sequence opt6 from VP1__Norovirus_and/or_Norovirus-like__AB933709
augaaaauggcuucaucagacgcaaacccaucugaugguucagcagcuaauuuaguaccagaaguaaauaaugaaguaauggcuuuagaacccguaguaggggccgccauagccgcacccguagcaggacaacaaaauguaauagacccauggauaagaaauaacuuuguccaagcuccuggaggagaauuuacaguaagcccaagaaacgcaccaggagaaauccucuggucagccccucuugguccagaucuaaacccauaccuuucccauuuagcaagaauguauaacggauaugcaggcggcuucgaaguacaaguuauacuagcaggaaaugcauuuaccgcaggaaaaaucauuuucgcagccguucccccaaauuucccaacugaaggauuaucaccaucacagguaacaauguucccucacaucauaguagacguuagacaauuagaaccaguauuaauaccacuuccagauguucguaauaauuucuaccauuauaaccaaaguaaugacuccacuauuaaauuaauagcaauguuauauacaccauuaagagcuaauaaugcuggagaagacgucuucacaguaucuuguagaguacuaaccagaccaucaccagacuuugacuucauauuucuaguaccaccuacagucgaaucaagaacaaaaccuuuuacugucccuauacuaacagucgaagaaaugacuaacucaagauuuccuauaccauuagaaaaacuauucacuggacccucaucagcauuuguuguucaaccucaaaacggaagauguacaacagauggaguacuacuaggaacuacucaauuaucaccugucaacauaugcacauuuagaggagacguuacucacauagcaggaucaagaaauuacaccaugaaucuagcaucuuuaaauuggaacaacuacgaccccaccgaagaaauuccagcaccauuagguacuccagacuuuguaggaaaaauacaaggaaugcuaacacaaacaacaaaaggagacggaucuacacgaggacacaaagcaacagucuauacaggaucagcacccuuuacacccaaauuagguucaguacaauucucaacugauacagaaaacgauuuugaaacacaucaaaacacaaaauuuacuccaguaggagucauucaugacggaucaaccacacaccgaaaugaaccccaacaauggguauuaccaucuuauuccgguagaaaugucccaaauguacaucuugcacccgccgucgccccaacauucccaggagaacaauuauuauucuuucguucaacaaugcccggaugcucaggcuauccaaauauggaccuagauugccucuuaccacaagaauggguacaacacuucuaccaagaagcagcaccagcucaaucagacguugcauuacuccgauucguuaacccagacacaggccgaguauuauucgaauguaaacuacauaaauccggauauguaacaguagcacacacaggacaacacgaccuaguuauaccaccaaauggauauuuccguuuugacucauggguuaaucaauucuacacccuagccccaaugggaaauggaacaggaagaagaagauaa

SEQ ID NO: 34133 - RNA, 1617 nt, Artificial Sequence
  derived and/or modified sequence opt6 from VP1__Norovirus_and/or_Norovirus-like__EU921352
augaaaauggcuucuuccgaugcuaauccuuccgauggaucuacagcaaacuugguaccugaaguuaauaacgaagucauggcucuagaaccuguaguaggugcagcaauagccgcaccuguagcuggacaacaaaauguaauagauccauggauuagaaauaacuuuguucaagcaccaggaggagaauuuacaguaucaccacgaaacgcaccaggagaaauacuuuggucagcaccauuaggucccgauuuaaauccuuaucuuagccauuuagcaagaauguauaacggauaugcuggcggauuugaaguccaaguuauauuagcaggaaaugcauuuacagcaggaaaaauaauauucgcagccguaccaccaaacuuuccaacagaaggacuuucuccaucccaaguuaccauguuuccacacauuauaguugauguaagacaacuagaaccaguauuaauaccacuaccagauguaagaaacaacuucuaccacuacaaccaaucaaaugacucaacaauaaaauuaauagccaugcuuuauaccccauuaagagcuaacaacgccggagaugauguauucacaguauccugcagaguauuaacuagaccauccccagacuuugacuucauuuuucuaguaccacccacagucgaaucacgaaccaaaccauuuucuguaccuauucuuacaguugaagaaaugacaaauucucgauucccaauacccuuagaaagguuauuuaccggaccaucaucagcauucgucguacaaccacaaaauggaagaugcacaacagacgguguacuucuaggaacaacacaauuaaguccaguaaauauaugcacauuuagaggugacguaacacauauagcaggaacacaagaauacacaaugaauuuagcaucccaaaacuggaacaauuaugacccuaccgaagaaauaccagccccucuaggaaccccagacuuuguaggaaaaauacaagguguacuaacacagacaacucgacgagauggaucaacuagaggccacaaagcaacaguaucaacagguuccguacacuuuacaccaaaauuaggaagaauacaauucucaacugauacaucaaacgauuuugaaacaggccaaaacaccagauucacaccaguaggaguuguacaagacgguggaaccacccaucaaaaugaaccacaacaaugggucuuaccagauuauucuggacgagauggacacaacguccaucucgcuccagcaguagcaccuucauuuccaggagaacaacuucuauucuuuagaucuacuaugccagguugcucaggauauccuaauaugaaccuagauugcuuacuaccacaagaauggguacaacacuuuuaucaagaagccgcaccagcucaaucagaugucgcacuacuuagguucguaaauccugacacaggaagaguauuauucgaauguaaacuccauaaaucagguuauguuacaguagcacacacaggacaacacgaccuaguaauaccacccaauggauauuucagauucgacuccuggguaaaccaauuuuacacacucgcaccaaugggaaauggcacuggaagaagaagauaa

SEQ ID NO: 34134 - RNA, 1617 nt, Artificial Sequence
  derived and/or modified sequence opt6 from VP1__Norovirus_and/or_Norovirus-like__LC005735
augaaaauggcaucaucagaugccucaccuucagacgguucagcagcaaaucuaguaccagaaguaaauaacgaaguaauggcacuugaaccaguaguaggagcagcaauagcugcaccaguugcaggucaacaaaacguuauagauccauggauacgaaauaauuuuguccaagcaccaggaggugaauuuacuguuucaccaagaaaugcaccuggagaaauauuauggucagcaccuuuaggaccagaucuuaaccccuaucucucacauuuagcccgaauguauaaugguuacgcaggaggauuugaaguacaaguaauauuagcaggaaaugcauucacagcaggcaaaguaauauuugcagccguucccccaaauuuuccaacagaaggauuaucaccuucucaaguaacaauguucccacauauuguaguagacguaagacaacucgaacccguacuaauaccacuaccugauguccgaaauaauuuuuaucacuacaaccaauccaaugauccaaccauaaaacuaauagcaauguuauacacaccauuacgagccaauaaugcaggagacgauguguuuaccguaucaugucgaguuuuaacaagaccaucacccgacuucgauuucauauuucuugucccuccuaccguagaaucacgaaccaaaccauucucaguaccaguccuaaccguagaagaaaugacaaauucccgauuuccgauaccacucgaaaaacuauuuacuggacccuccucagcauucguuguucaaccacaaaauggaagaugcacaaccgacggcguacuauuaggaaccacacaauuaucaccaguaaacauaugcacauuccgaggagauguaacacauauaacugguucaagaaacuauacaaugaaucuagcaucacaaaauugguccaacuaugacccaacugaagaaauaccagcaccucuaggaacacccgacuuuguaggaaaaauacaaggaguacuaacacaaaccaccagaacagauggaucuacuagaggacauaaagcaacagucuacacaggauccgcagauuuugcccccaaauuaggacgaguacaauucgaaacagauacugaucaugauuuugaagcaaaucaaaacacaaaauucacaccagucggaguaauacaagacggaggaacaacccauaggaaugaaccacaacaauggguauuaccuucauacucaggaagaaauacacccaauguucaucuugcacccgccgucgcaccaaccuuuccaggugaacaauuacuguucuuccguucaaccaugccagguuguucaggauauccaaauauggaucuagacugcuuacuaccacaagaauggguucaauacuuuuaccaagaagcagcaccagcacaaucagacgucgcuuuauuaagauuuguuaauccagauacaggacgaguucucuucgaauguaaacuucauaaaucaggcuauguaacuguugcccacacaggacaacaugaucuaguaauaccaccaaacggauauuuccgauucgauucauggguaaaucaauucuauacauuagcaccaaugggaaauggcacgggaagaagaagauaa

SEQ ID NO: 34135 - RNA, 1617 nt, Artificial Sequence
  derived and/or modified sequence opt6 from VP1__Norovirus_and/or_Norovirus-like__KP241909
augaaaauggcuucuucagaugccaaccccucugaugguucugcagcuaacuuaguuccagaaguaaacaaugaaguaauggcuuuagaacccguagucggugcagcaauagcagcuccuguugcaggacaacaaaauguaauagauccauggauacguaauaacuuuguacaagcaccuggaggggaauuuaccguaucacccagaaaugcaccuggagaaaucuuauggucugcuccccuuggaccagaccuaaauccuuaucuaagucaccuagcaagaauguauaacgguuaugccgguggauucgaaguacaaguaauacuagcagguaaugcauuuacagcuggaaaaguaauuuucgcagccguaccaccaaacuuuccaaccgaaggucuauccccuucacaaguuacaauguucccacauauuguuguagacguaagacaauuagaacccguacucauaccucuaccagauguaagaaacaauuucuaucacuacaaucaaucaaaugacccaacuauaaaauuaauagcuaugcucuauacaccauuaagagccaauaacgcaggagacgauguauuuacaguaucauguagaguacuaacaagaccauccccugacuucgacuucauauuucuagucccaccaacuguagaaucaagaacuaaacccuucucaguaccaguauuaacaguagaagaaaugacaaauuccagauuucccauuccauuagaaaaacuauucacaggcccaucuuccgcauucguaguacaaccacaaaacgguagauguacuacugacgguguauuacuagguacaacacaacucucacccguaaacauauguacauuuagaggagacguaacucauaucacaggcucaagaaauuacacaaugaaucuagcaagccaaaacugguccaauuaugaucccacugaagaaaucccagcuccacuaggaacaccugacuuugucggaaaaauacaaggcguauuaacccaaacaacaagaacugauggaucaaccagaggacacaaagcaaccguauauacaggaucagcagacuucgcucccaaauuaggacgaguacaauuugaaacagacacugaucaugauuucgaaacaaaucaaaauacaaaauuuacaccaguuggaguuauacaagacggugguacuacacauagaaaugaaccacaacaauggguacuccccucauauucagggcgaaacacaccuaauguacacuuagcacccgcaguugccccaacauuuccaggagaacaacuacuauucuuuagaucaacaaugccaggauguuccggauauccaaacacagacuuagauugccuuuuaccacaagaauggguucaauauuucuaucaagaagcugcuccagcucaaucagacguagcacuuuuaagauucguaaacccugauacaggccgaguccuauuugaauguaaacuacauaaaucuggauauguaacuguagcucacacaggacaacacgauuuaguaauacccccaaauggauacuucagauucgauucauggguaaaucaauuuuauacauuagcaccaaugggaaacggaacaggacguagaagauaa

SEQ ID NO: 34136 - RNA, 1617 nt, Artificial Sequence
  derived and/or modified sequence opt6 from VP1__Norovirus_and/or_Norovirus-like__KJ533132
augaaaauggcaucuucugaugccaauccuucagauggaagugcugcuaaucuaguuccagaaguaaauaacgaaguaauggcauuagaaccagucguuggagcagcaauagccgcaccagucgcaggccaacaaaauguaauagaccccuggauaagaaauaauuuuguacaagcaccugguggagaauuuacaguaucuccaagaaaugccccaggagaaauauuauggagugcaccauuagguccagaucuuaacccauaucuaucucaccuagcccguauguacaauggcuacgcugguggauucgaaguccaaguaauacuagcaggaaacgcauucaccgcaggcaaagucauauucgcagcaguuccaccaaauuucccuacagaaggacuaucgccaucacaaguaacuauguucccacauaucgucguagacguaagacaacuagaaccaguacuaaucccacucccagauguaagaaauaauuuuuaccacuauaaccaauccaaugauccaacaauuaaacuuauagcaaugcuauauacccccuuacgugcaaacaacgcuggagaugauguauuuaccguaucaugcagaguauuaaccagaccuucuccagacuuugauuuuauauuucuugucccucccacuguagaauccagaaccaaaccauucucaguaccuguauuaacaguagaagagaugacaaacuccagauuuccaauaccauuagaaaaacucuucaccggaccaucuucagcuuucguaguacaaccacaaaauggacgauguacaacagacggaguauuauuaggaacaacacaacuaucucccgucaauauauguacauuuagaggagacguaacucacauaacaggaucaagaaauuauacuaugaauuuagcuucacaaaacuggaauaauuaugauccaacagaagaaaucccagcccccuuagguacaccagacuuuguaggaaaaauccagggaguacuaacacaaacuacaagaacagauggaaguacaagaggacauaaagccaccguuuauacaggaucagcagauuuugcuccaaaacuaggcagaguacaauuugaaacugauacagaucacgauuucgaagccaaucaaaacaccaaauuuacacccguuggcgucauacaagacgguggcacaacucauagaaaugaaccacaacaguggguacuaccaucauauucuggacgaaauacacacaauguccacuuagcacccgcuguagccccaacauuuccaggugaacaacuacuauucuuuagaucaacaaugccaggcugcaguggcuauccaaauauggauuuagauugcuuacuaccccaagaauggguacaauauuuuuaucaagaagcagcaccagcacaaucagacguagcacuacuaagauuuguaaaccccgacacuggacgaguauuauucgaauguaaauuacauaaaucaggauacgucacuguagcacauaccggacaauaugaccuagucauaccaccaaacggauauuucagauucgauucauggguuaaccaauuuuacacauuagcccccaugggaaacggaacagguagacgaagauaa

SEQ ID NO: 34137 - RNA, 1617 nt, Artificial Sequence
  derived and/or modified sequence opt6 from VP1__Norovirus_and/or_Norovirus-like__KP176407
augaaaauggccucuucugacgcaaauccaucagauggaucagccgccaauuuaguaccagaaguaaauaacgaaguaauggcccuugaaccaguaguaggagcagcaauagcagcaccaguugcuggucaacaaaaugucauagauccauggauaagaaauaauuuuguucaagcaccuggaggugaauuuacuguaucucccagaaacgcaccaggagaaaucuuauggucagcucccuuaggaccagaacuuaacccauauuuaucucaucuugccagaauguauaacggauacgcaggaggauuugaaguucaaguaauucuagccggcaaugcuuuuacagcaggcaaaguaauauuugcagcaguaccaccuaacuuucccacagaaggacuuaguccuucacaaguuacaauguucccucacauuguaguagaugugcgacaauuagaaccuguacuaauuccacuacccgacguuagaaacaauuucuaucauuauaaccaaucaaaugauccaacuauaaaauuaauagcaauguuauauacaccauuacgagcaaauaaugcaggagaugauguuuucacuguuucuuguagaguacuaacaagaccaucaccagacuuugauuuuauauucuuaguaccaccaacgguagaaucaagaacaaaacccuuuucaguacccgucuuaacuguagaagaaaugaccaauucacguuucccaauaccacucgaaaaauuauucacaggucccucaagcgcauuuguuguccaaccccaaaacggaagauguacaacugauggaguuuuacuaggaacaacacaauuaucaccaguuaacauauguacauuccguggagauguuacacacauaacagguucaaggaauuauacaaugaaccuagcaucucaaaauuggucaaacuaugauccuacugaagaaauaccagcaccuuuagguaccccagacuucguaggcaaaauacaaggcgucuuaacacaaacaacucgaacagauggcucuacaagaggacauaaagcaacaguguacacaggaagugcagauuucgccccuaaauuaggucgaguacaauuugaaaccgacacagacagagacuuugaagcaaaucaaaauacaaaauucacaccaguaggaguaauucaagauggaucaacgacccauagaaaugaaccacaacaauggguuuuaccuucuuacucagguagaaauacaccaaauguacaucuagcccccgcaguagcaccaaccuuuccaggagaacaauuauuauucuuucguucuacaaugccaggaugcucuggauacccuaauagagaucucgacugcuuacuaccacaagaauggguccaauauuuuuaucaagaagcagcaccagcacaaucagauguagcauuauuaagauuuguaaacccagauacaggaagaguauuauuugaauguaaacuacauaagucaggauacguaaccgucgcacauacaggucaacaugaucuaguaaucccuccuaauggauauuuuagauuugauucauggguuaaucaauuuuacacccucgcacccaugggaaauggaacuggaagacguagauaa

SEQ ID NO: 34138 - RNA, 1617 nt, Artificial Sequence
  derived and/or modified sequence opt6 from VP1__Norovirus_and/or_Norovirus-like__KP176406
augaaaauggccagcucagacgcaaauccauccgaugggucugcugccaacuuaguaccagaaguaaauaaugaagucauggcuuuagaaccaguuguaggagcagccauagcagccccaguagcaggacaacaaaauguaauugaucccuggauuagaaacaauuuuguacaagccccuggaggagaauuuacaguuaguccaagaaacgccccuggugaaauacucuggucagccccacuaggaccagacuuaaauccauaucuuucucacuuagcuagaauguauaacggauacgcaggaggauucgaaguucaaguuauauuagccggaaacgcauucacugccgguaaagucauauucgcagcaguacccccuaauuuuccaacugaaggauuauccccaucacaaguaacaauguucccgcacauugucguagacguuagacaacuagaaccaguauuaauuccacuaccagauguaagaaacaauuuuuaucacuauaaucaaucuaaugauccuacaaucaaacuuauagcaaugcuauauacaccacuucgagcuaauaacgccggugacgaugucuucacaguuagcugccguguacuaacaagaccaucaccagauuuugauuuuauauucuuaguacccccaaccguugaaucacgaacaaaaccuuucucagucccuauccuaacuguagaagaaaugaccaacucuagauuucccauacccuuagaaaaauuauucacaggaccauccucagcuuucguaguacaaccacaaaauggacgauguacaacagaugguguauuacuagguacuacccaacuaucaccaguaaauauauguacauuuagaggagauguaacacauaucacaggaucacguaauuacacaaugaauuuagcuucacaaaacuggucaaauuaugaccccacagaagaaauaccagcaccccuuggaauaccagauuuugucggaaaaauucagggaaugcuaacucaaacaacaagaacagauggcuccacacgaggucauaaagcaacuguauacaccgguucugcugacuuugcaccaaaauuaggaagaguacaauuugaaacagacacugaucaugauuuugaagcaaaccaaaauacuaaauucacaccaguuggaguaauacaagauggaucaacuacacaucguaaugaaccacaacaauggguacuaccaucauauucaggaagaaacacaccuaacguacauuuagcccccgcaguagcaccuacauuuccaggagaacaauuauuauucuuuagaucuacaaugccaggaugcucuggcuauccaaauauggaucuagacugucuucuuccacaagaauggguacaauauuuuuaccaagaagcugcaccagcacaauccgauguugcauuauuaagauucguaaacccugauacaggaagaguauuauuugaauguaaacuucacaaauccggauacguuacaguagcgcauacuggacaacacgacuuaguuauaccaccuaauggauauuuucgcuucgauucauggguaaaucaauuuuacacucuugcaccaaugggaaauggcacaggaagacguagauaa

SEQ ID NO: 34139 - RNA, 1617 nt, Artificial Sequence
  derived and/or modified sequence opt6 from VP1__Norovirus_and/or_Norovirus-like__KP123606
augaaaauggcaucaucagaugcaaacccaucagaugguucagcagcaaaccuaguaccagaaguaaauaaugaaguaauggcauuagaaccaguaguaggagccacuauagcugcaccugucgcuggacaacaaaaugucauagauccuuggauaagaaacaacuucguacaagcaccuggaggagaauuuacagucaguccaaggaaugcaccuggagaaauacuauggucagcaccacucgguccagauuuaaauccauaucuuucucauuuagcacgaauguauaacggauaugcuggcggauuugaaguacaaguaauauuagccggcaacgccuuuacugcaggaaaaguaauuuuugcugcaguaccuccaaacuucccaaccgaaggucuaucuccaucacaaguaacaauguucccucacauagucguugacguuagacaauuagaaccaguacuaauacccuuaccagaugucagaaauaacuucuaucacuauaaucaaucgaaugaccccacaauaaaauuaaucgccauguuauauacccccuuaagggcaaauaacgcaggagacgaugucuuuacaguuucauguagaguauuaacuagaccuucaccugauuuugauuuuauauuuuuaguaccaccuacaguagaaucccguacaaaaccauuuuccguaccaauuuuaacuguagaagaaaugaccaauucaagauuuccaauuccacuugaaaaacuauucacugguccaucaagugcuuucgucguacaaccccaaaacggaagauguacaacagacggaguacuacuagguacuacgcaacuauccccaguuaauauauguacauuucgcggagacguaacacauauaacaggaucacgaaauuacacaaugaaucuagcaucacaaaauuggucaaauuacgauccgacagaagaaauccccgcaccauuaggaaucccugauuuuguaggaaaaauucaaggaaugcuaacacagaccacaagaacagacgguuccacucgaggucauaaagcuacaguauauaccggaucagcagacuucgcaccaaaauuaggaagaguccaauuugaaacugauacagaucaugacuucgaagccaaccaaaauacaaaauucacaccaguaggaguaauccaagaugguucaacaacacauagaaacgaaccacaacaguggguauuaccaaguuauuccgguagaaacacaccaaauguacaucuugcaccagcaguagcaccuacuuuuccaggagaacaacuacuauucuucagaucuacaaugccaggaugcuccggauauccaaacauggaucuagauugcuuacuaccacaagaauggguacaauacuuuuaccaagaagccgcaccagcacaaucagacgucgcacuacuuagauuuguaaacccagacacaggaagaguauuauucgaauguaaacuacacaaaucuggauacgucacaguagcacauacaggucaacacgauuuaguuaucccaccaaacggcuacuuuagauucgauuccuggguaaaucaauucuauacacuagcuccaaugggaaacgguacaggcagacgacguuaa

SEQ ID NO: 34140 - RNA, 1617 nt, Artificial Sequence
  derived and/or modified sequence opt6 from VP1__Norovirus_and/or_Norovirus-like__KP096335
augaaaauggcaucuuccgacgccaacccuuccgacggauccgcagcuaauuuaguaccagaaguuaauaaugaaguaauggcacuagaaccagucgucggcgcagcaauagccgcaccaguagcaggucaacaaaauguaauagauccuuggaucagaaauaacuuuguacaagcacccggaggugaauuuacaguaucaccaagaaaugcaccaggagaaauauuguggucagcaccauuaggacccgacuuaaaucccuaucuaucucaucuagcaagaauguauaauggauacgccgguggauuugaaguucaagucauacuugcaggaaaugcauuuacagcuggaaaaguaauauuugcugcaguaccaccaaauuucccuacagaaggacuuucuccuucucaaguaaccauguuuccacauaucguaguagacguuagacaauuagaaccaguucuaauaccauuaccagauguacgaaacaacuuuuaucacuauaaccaaucaaaugacccuacaauaaaacugauagcuaugcucuacacaccucuaagagcaaauaaugcaggcgaugauguauuuaccguaucaugucgaguuuuaacucguccaucaccagauuuugacuuuauauucuuaguuccgccaacaguagaaucaagaacuaaaccauucucaguaccaguacuaacuguagaagaaaugacuaacucaagauucccuauaccacuugaaaaauuauuuacaggaccaucuucugccuucguaguacaaccgcaaaacggaagauguaccacagacgguguauuauuaggaacaacacaauuaagcccaguuaacaucuguaccuucagaggagacgucacacacauaacaggaucaagaaacuauacaaugaaucucacaagucaaaacuggaguaacuaugaucccacugaagaaauuccagcaccacuuggcacuccagauuuuguaggaaaaauacaagguaugcucacacaaacaacaagaaccgauggaucaaccagaggacauaaagcaacuguauauaccggaucagcagauuuugcaccuaaauuaggaagaguucaauucgaaacugacacagaccacgacuucgaagcaaaucaaaacacuaaauucacaccaguuggaguuauccaagacggaucaacuacucauagaaaugaaccacaacaauggguucuaccaucauauagcggcagaaauaccccaaacguacauuuagcuccagcaguugcgccaacauuucccggcgaacaacuccuauucuuuagauccacaaugccaggaugcaguggauauccaaauauggauuuagauugcuuacucccacaagaauggguucaauacuuuuaccaagaagcagcuccugcacaaucagacguagcauuacuaagauuugucaacccugauacaggaagaguauuauuugaaugcaaacuacacaaaagcggauacguuacaguagcacauacaggacaacacgaucuaguaauaccacccaauggcuauuuuagauucgacucauggguaaaccaauuuuacacucuagcccccaugggaaauggaacaggaagaagaagauaa

SEQ ID NO: 34141 - RNA, 1617 nt, Artificial Sequence
  derived and/or modified sequence opt6 from VP1__Norovirus_and/or_Norovirus-like__KM268095
augaaaauggccucauccgaugcaaauccaucagauggaagcgcugcuaaccuaguaccugaaguuaacaaugaaguuauggcauuagaaccuguuguuggagcagcaauagcugcuccuguagcuggacaacaaaauguaaucgauccauggauaagaaacaacuuuguacaagcccccgguggagaauuuacaguaucaccuagaaaugcucccggagaaauuuuauggucugccccuuuaggacccgauuuaaaucccuauuuaucucaccuugcaaggauguauaacgguuacgcaggaggauucgaaguacaaguaauacuugcaggaaaugcauuuacagcuggaaaaguaaucuucgcggcuguaccaccaaacuuuccaacugaaggucucaguccaucucaaguuaccauguuuccacacauagucguagacguccgccaauuagaaccaguauuaauaccauuaccugauguuagaaacaacuucuaccacuacaaucaaucaaaugacccaaccauaaagcuaauagcaauguuauacaccccacuuagagcuaauaaugcuggagaugauguauuuacaguaucaugccgaguuuuaacaagaccuagcccagacuuugacuucauauuucucguaccaccaaccguagaaucuagaaccaaaccauuuucaguaccaguauuaacaguagaagaaaugacaaauucaagauuucccauuccuuuagaaaaacuauuuacuggaccaucaucugcauucguaguacaaccucaaaauggcagauguaccaccgauggaguccuuuuaggcacaacacaauuaucaccaguaaauauauguaccuucagaggagacguuacacauauuacaggaucaagaaacuacacaaugaauuuagcaagucaaaauuggucaaauuacgacccaacagaagaaauaccagcaccauuaggaacaccagauuuuguaggaaaaauccaaggcguccuuacacaaacaacaagaaccgauggcaguacucgaggccacaaagcaacaguauacacagguuccgcugauuuugcaccaaaacuaggaagaguacaauuugaaacagacacugaucacgauuuugaaacaaaucaaaacacaaaauucacaccaguaggaguaauucaagauggcaguacuacccacaggaaugaaccccaacaauggguucuacccucauauucaggaagaaauacaccaaacguacacuuagcaccagcaguagcaccaacauuuccuggagaacaauuauuauucuuuagaucaacaaugccagguuguucuggcuauccaaacauggaucuagauugucuacuaccucaagaauggguucaauauuucuaucaagaagcagcuccugcacaaucagauguugcacuccucagauuuguaaauccagacaccggcagagucuuauucgaaugcaaauuacauaaaagcggauauguuacaguagcacauacaggacaacaugaucuuguaauuccaccuaacgguuauuucagauucgauucauggguaaaucaauucuauacacuugcaccuaugggaaaugguaccggcagaagaagauaa

SEQ ID NO: 34142 - RNA, 1617 nt, Artificial Sequence
  derived and/or modified sequence opt6 from VP1__Norovirus_and/or_Norovirus-like__KM268094
augaaaauggcaucaucagaugcaaauccaucagauggaucagcugcaaaccuaguuccagaaguuaauaaugaaguaauggcacuugaaccaguaguuggcgcagcaauugcagccccuguagcaggacaacaaaacguuauagaucccuggauacgaaacaauuuuguucaagcaccaggaggugaauuuacaguaagccccagaaaugcuccaggagaaauacuguggucagcaccacuuggacccgaccuaaacccuuaccuaucacaucuagcaagaauguauaacgguuaugcaggcgguuucgaaguacaaguuauauuagcagguaacgcauuuacagcaggaaaaguuauuuuugcagcugucccaccaaacuuucccaccgaaggacuaucuccaagucaaguaacuauguuuccccacauagucguagauguuagacaacucgaaccaguacuaauaccucuaccagauguaagaaacaauuuuuaucauuacaaucaaucuaaugaucccacuauaaaauuaauugcaauguuauacacaccucuaagagccaauaaugcuggagaugauguauuuacuguaucaugcagaguacuuaccaggccuucuccagauuuugauuuuauuuuccuaguaccaccaacaguggaaucuagaacaaaaccauucucaguaccaauacuaacuguagaagaaaugacaaauuccagauuuccuauaccuuuagaaaaauuauuuacuggcccaucauccgcauuuguaguucaaccacaaaauggacguuguacaacagacggaguauuauuaggaacaacucaauuaucacccguaaacauauguacauuuagaggugauguaacacacauaacagguagucgaaacuacacaaugaauuuagcaucucaaaauuggaguaauuacgauccaacagaagaaauaccugcaccacuaggaaccccagacuuuguaggaaaaauacaaggaguauuaacacaaacuacgagaacagauggaucuacacgaggacauaaggcaacaguauauacaggaucugcagauuuugcaccgaaauuagguagaguccaauuugaaacagacacagaccacgauuucgaagcuaaucaaaauacaaaauuuacaccaguaggaguaauacaagacggaucaacaacacacagaaaugaaccacagcaauggguacuaccuucauacuccggacguaacacaccuaauguacaucuagcacccgcuguagcaccaacuuuuccaggagaacaacuccuuuucuuucguucaacuaugccaggauguucaggauauccuaauauggauuuagacuguuuacuaccucaagaauggguacaauauuucuaucaagaagccgccccugcucaauccgauguagcacuuuuacgauuuguaaacccagauacaggcagaguacuuuuugaaugcaaauuacacaaaucaggauauguuacaguagcacacacaggacaacacgaucuuguuauacccccuaacgguuauuuuagauuugauucauggguuaaucaauuuuacacacuagcaccaaugggaaacggaacaggcagaagaagauaa

SEQ ID NO: 34143 - RNA, 1617 nt, Artificial Sequence
  derived and/or modified sequence opt6 from VP1__Norovirus_and/or_Norovirus-like__KM268093
augaaaauggccucaucagaugcaaauccauccgauggauccgcagcaaaucuuguaccagaaguaaauaaugaaguuauggcauuagaacccguaguuggagcagcuauagcagcaccaguagcaggacaacaaaauguuauagauccauggauacguaguaauuucguacaagcaccuggcggagaauuuaccguaagcccaagaaaugcuccaggagaaauauuaugguccgcaccauuaggacccgauuuaaacccauacuuaucccauuuagccagaauguauaauggauaugcaggaggauuugaaguacaaguaauauuagcaggaaacgcauuuacugcaggaaaaguaauauuugcagcaguaccaccuaacuucccaacagaaggacucuccccaucacaaguaacaauguuuccacauauaguaguagauguuagacaauuagaaccaguauuaauaccacuaccagacguaagaaacaacuuuuaucauuacaaccaauccaaugacccuaccauaaaauuaauagcgauguuauauacuccacuaagagcaaauaaugcaggagacgaugucuucacaguuucaugucgaguauuaacacgaccauccccugacuucgacuucauauuuuuaguaccaccaaccguagaaucaagaacaaaaccauucucaguccccguacuaacaguagaagaaaugacaaacuccagauuuccaauuccauuagaaaaauuauuuacaggaccaucaucagccuucguuguacaaccucaaaauggaagauguacaacagauggaguacuauuagguacaacucaauuaagcccuguaaauauauguaccuuuagaggugauguuacacauauaacagguucuagaaauuauaccaugaaccucgcaucacaaaacuggucaaauuacgauccaacagaagaaauaccagcaccacuagguaccccagacuucgucggaaaaauacaaggaguauuaacacaaacuacaagaacugacggaucaaccagaggacauaaagccacuguauauacaggcucagcugauuuugcuccaaaauuaggaagaguacaauucgaaacugauacagaucacgauuucgaagcaaaucaaaacacaaaauucacuccuguugguguaauacaagauggaggaacaacacauagaaaugaaccucaacaauggguacuaccaucauacuccggccguaauacaccuaacguacaccuagcaccagcaguggcaccuaccuuuccaggagaacaacuucuauucuuuagaucaacaaugccagguugcucaggauauccaaacauggaucuagauugcuuacucccccaagaauggguacaauauuuuuaucaagaagcagccccugcacaauccgacguagcauuauuaagauuuguuaauccagacacaggacgaguauuauuugaaugcaaacuucauaaauccggauacguaacuguagcacauacuggccaacacgacuuaguuauaccaccuaaugguuauuuccgauuugauuccuggguaaaccaauucuauaccuuagcuccaaugggaaauggcacaggcagaagaagauaa

SEQ ID NO: 34144 - RNA, 1617 nt, Artificial Sequence
  derived and/or modified sequence opt6 from VP1__Norovirus_and/or_Norovirus-like__KM198591
augaaaauggcauccaaugacgcaaaccccucagaugguucugcugcgaaccuaguaccagaaguuucaaaugaaguaauggcauuagaaccaguaguuggagcagcaauagcagcaccuguagcaggacaacaaaacgucauagauccauggauucgaaauaauuuuguccaagcacccggcggcgaauuuacaguuuccccaagaaaugcaccgggugaaauacucuggucugcuccauuaggaccagaucuaaauccauaucuaagccaccuugcaagaauguauaacggcuacgcaggcggauucgaaguucaaguaauacuagcaggcaaugcauuuacagcaggaaaaauaauauucgcugccguaccaccaaacuucccaacugaaggacuauccccaucccaaguaacgauguucccacauauuauaguagauguaagacaacuagaaccaguacuaauuccauuaccagacguaagaaauaauuucuaucacuacaaucaaacaaacgauucgacaauaaaacuaauagcuaugcuuuacacuccauuacgagcaaacaacgcuggcgaagauguauuuacaguuuccugcagaguacuaaccagaccgucucccgacuuugacuuuauauuccucguaccaccuaccgucgaaucaagaacaaaaccauucaccguuccaauccuaacaguagaagaaaugacaaacaguagauucccaauaccauuagaaaaacuauucacaggaccaucuggagccuucguuguacaaccccaaaacgguagaugcaccacugacggaguauuacuuggaacaacacaauuaucaccaguaaauauauguacauuucgaggagacgucacacauauagcaggaagucgcaauuacaccaugaaucuagcaucacuaaacuggaacaauuacgaucccacugaagaaauaccugcaccacuaggaaccccagacuucguagguaaaauacagggaguacuaacacaaaccacuaaaggagaugguucaacaagaggacacaaagcaacaguguauaccggaucagcccccuucacaccaaaauuaggaucaguucaauuuucaacagauacagaaaaugauuuugaaacucaucaaaauacuaaauucacaccagucggaguaauacaagauggaggaaccacacacagaaacgaaccacaacaaugggucuuacccucauauucagguagagacguccauaacguucacuuagcacccgcaguagcuccuacauuuccaggagaacaacuauuauucuuccgcucaacaaugccaggauguucuggcuauccaaacauggaucuugauugccuacuaccccaagaauggguucaacacuuuuaccaagaagcagcaccagcccaauccgacgucgcauuauuaagauuuguaaacccagauacaggaagaguacuauucgaaugcaaacuacauaaaucuggauauguaacaguagcccauacaggacaacacgaucuagucauaccucccaauggcuauuuccgauuugauucauggguaaaucaauuuuacacacuugcaccaaugggaaauggaaccggccgaagaagauaa

SEQ ID NO: 34145 - RNA, 1617 nt, Artificial Sequence
  derived and/or modified sequence opt6 from VP1__Norovirus_and/or_Norovirus-like__KM198589
augaaaauggcaucaaaugaugcaaauccaucagauggcucagccgcaaacuuaguaccagaaguaagcaacgaaguuauggcacucgaaccuguagucggugcugcaaucgcagcaccagucgcaggacaacaaaacguaauagacccauggauaagaaacaacuuugugcaggcuccaggaggugaauuuacaguaucacccagaaaugcaccuggagaaauccuauggagugcaccacuaggacccgauuuaaacccauaucucucgcaucuggcaagaauguacaacggcuacgcuggugguuucgaaguaagaguaauacuagcaggaaaugccuucacugcagguaaaauaauauucgcugcaguucccccuaacuuuccaacagaaggauuaucaccaucacagguaacaauguucccacauauuauaguagauguucgacaauuagaaccaguuuuaauaccauuaccagaugucagaaauaacuucuaucacuacaaccaaacuaaugauuccacuauuaaauuaauagcuaugcucuacacaccauuaagagcaaacaaugcaggagaagacgucuucaccguauccuguagagucuuaacuagacccucaccagacuuugauuuuauuuuucuaguaccacccacugucgaaucaagaacuaaaccauucacaguaccaauauuaacgguagaagaaaugacaaacucuagauuuccuauaccacuagaaaaacuauuuacaggucccucaggcgccuucguaguacaaccacaaaauggaagaugcacaacugacggaguauuacuagguacaacacaacuaucaccaguuaauauaugcacauuuagaggagacguaacacauauugcaggaucaagaaauuauacaaugaauuuagcuucacuaaauuggaauaauuacgauccaacagaagaaauaccagcaccacuuggaacacccgauuuuguaggaaaaauacaaggcguacuuacucaaacaacuaaaggagacggaagcacaagaggacacaaagcaacagucuauacaggaucagcaccauuuacuccaaaacuaggaucaguacaauuuucaacagauacugaaaaugauuuugaaauacaucaaaacacaaaauucacaccaguagguguuauacaagacggaggaacuacacacagaaaugaaccacaacaauggguauuaccaucauacuccggccgagacguacauaauguacauuuagcccccgcaguagcaccuacauucccaggagaacaauuacuauucuuucgcucuacaaugccaggaugcucaggauaucccaauauggauuuagauugccuuuuaccacaagaauggguacaacauuucuaucaagaagcagcuccugcacaaucagacguagcgcuauuaagauuugucaauccagacacaggaagaguacuauucgaaugcaaauuacaucgcucugguuauguaacaguugcccauacaggacaacaugaucuaguuauaccaccuaauggauacuucagauuugauuccuggguuaaucaauuuuauacauuagcuccaaugggaaauggaaccggaagaaggagauaa

SEQ ID NO: 34146 - RNA, 1617 nt, Artificial Sequence
  derived and/or modified sequence opt6 from VP1__Norovirus_and/or_Norovirus-like__KM198576
augaaaauggcaucuaaugacgcaaaccccucugaugguucugcagcaaaucuagucccagaagucaauaacgaaguuauggcauuagaaccaguuguuggagcugcaauugcugcuccuguagcaggucaacaaaacgucauugauccauggauacgaaauaauuuuguucaagcaccaggaggagaauuuacaguuucaccaagaaacgcaccaggagaaauacucuggagugcgcccuuaggaccagaucucaacccuuacuuaucacaccuagcaagaauguauaacggauacgcaggaggauucgaaguacaagucauacucgccggaaaugcuuuuacagcuggaaaaauaauuuucgcagcaguaccacccaacuuuccaacugaagguuuaucuccaucacaaguaacuauguucccucauauaauaguugacguacgacaacuagaaccuguauuaauuccacuaccagacguaagaaacaauuucuaccacuauaaucaauccaaugauucuacuaucaaauuaauagcaaugcuauacacuccacugagagccaauaacgcuggugaagacguauuuacaguaucuugcagaguccuaacaagaccuucuccagacuucgauuucaucuuucuaguaccaccaacaguagaaucaagaacuaaaccauuuacuguaccaauacuuacaguagaagaaaugacaaauucacgcuuuccaauaccucuagaaaaacuuuucacagguccuagcggagcauucauuguccaaccacaaaacgguagaugcacaacugacggaguucuuuuaggaaccacacaacuaucuccagucaauaucuguacauuuagaggugacguaacacauauagcagguucaagaaacuacacuaugaaucucgcaucucuaaauuggaacaauuaugauccaacagaagaaauuccagcaccucugggaacacccgauuuuguagguaagauccaagguguuuuaacacaaacaacuaaaggagacggcucuacuagaggacacaaagcaaccguauauaccggaagcgcaccauucacaccaaaauuaggaucaguucaauucaguaccgauaccgaaaacgacuucgaagcacaccaaaauacuaaauucacuccaguugguguaauacaagacggaggaacaacacauagaaacgaaccacaacaauggguauuaccauccuauucagguagagacguucauaacguacaucuugcaccagccguagcuccuacauuuccaggcgaacaacuacuauucuuuagaucuacaaugccaggauguagcggauacccaaauauggauuuagauuguuuacuaccacaagaaugggugcaacauuuuuaccaagaagcagcucccgcacaauccgauguagcacuccuacguuuuguaaaucccgacacaggacgaguauuauucgaaugcaaacuacauaaaccaggauauguaacaguagcacauaccggccagcacgacuuagucauaccuccaaauggcuauuucagauucgacucuuggguaaaucaauuuuacacucuugcaccaaugggaaauggaacaggaagacgcagauaa

SEQ ID NO: 34147 - RNA, 1617 nt, Artificial Sequence
  derived and/or modified sequence opt6 from VP1__Norovirus_and/or_Norovirus-like__KM198564
augaaaauggcaucaaaugaugcaaauccaucagauggaucagcagcaaaccuaguaccagaaguaaauaaugaaguaauggcuuuagaaccagucguaggagcagcaauagcugcuccaguagcaggacaacaaaauguaauagauccuuggauuagaaauaauuuuguacaagcuccuggaggagaguucacaguuucaccacgaaacgccccaggagaaauauuauggagugcuccccuuggccccgaccuaaacccauauuuaucacaccuagccagaauguacaacggauaugcaggaggauuugaaguacaaguaauccuagcagguaaugccuuuacagcuggaaaaauuauuuucgcagcaguacccccuaacuuucccacagaaggcuuaucaccaucacaaguuacaauguuuccacacauaauuguagacguaagacaauuagaaccaguuuuaauaccccuucccgauguaagaaacaacuucuaucacuacaaucaaagcaacgacuccacaauaaaauuaauagcaaugcuuuacacaccucuucgcgcaaacaaugcaggagaagauguauuuacaguaucuuguagaguacuaacaagaccaucaccugauuucgauuucauauuuuuaguaccaccaacaguagaauccagaacaaaacccuuuacugucccaauauuaacaguugaagaaaugacaaauucaagauuuccaauuccacuagaaaaacuauuuacuggcccaucaggagcauucauaguacaaccucaaaauggaagauguacaaccgacggaguacuacuagguacaacacaauuauccccuguaaacauauguacauucagaggagacguaacccacaucgcaggaucaagaaauuauacaaugaaucuagcaaguuuaaauuggaauaauuacgauccaacagaagaaaucccugccccauuagguacuccagauuuugucggaaaaauacaaggaguauuaacacaaacaacuaagggagacggaucaacacgcggucacaaagcuacaguauauacagguggcgcaccauuuaccccaaaacucggaucaguccaauucucaacagauacagaaaacgauuucgaagcacaccaaaauacaaaauucacaccaguaggaguuauacaagacggaggaacuacacaucgaaacgaaccacaacaauggguuuuaccuagcuauucaggaagagauguccauaacguacaccuagccccagcugucgcaccaacauucccaggagaacaauuacuauucuuuagaucaacaaugccaggaugcucaggauauccaaacauggacuuagauugccuucucccacaagaauggguucaacacuucuaucaagaagcagcaccagcucaaucugauguagccuuacuacguuuuguuaaucccgacacuggaagagucuuauuugaaugcaaauuacauaaaucaggauacguaacugucgcacacacuggacaacacgaucucguuauaccaccaaauggauacuucagauuugauaguugggucaaucaauuuuacacacuugcuccaaugggaaacggaacaggucgaagaagauaa

SEQ ID NO: 34148 - RNA, 1617 nt, Artificial Sequence
  derived and/or modified sequence opt6 from VP1__Norovirus_and/or_Norovirus-like__KJ716355
augaaaauggcaagcucagacgcuaaccccucugauggcucagccgcaaaccuaguaccugaaguaaacaaugaaguaauggcacucgaacccguuguaggagcagcaauugcagcaccugucgcaggucaacaaaaugucauagacccauggauucgaaauaauuuuguacaagcaccuggaggcgaauuuacaguaucaccaagaaacgcaccaggagaaauacuuuggucagccccauuaggucccgauuuaaacccauauuuaucccaccuagcacguauguauaacggcuacgcaggaggauucgaaguacaaguuauacuagccgguaacgcauuuacagcuggaaaaguaauauucgcagcaguaccaccaaacuuuccaacugaaggacuuucaccaucacaaguaaccauguucccucauauagucguagacguaagacaauuagaaccuguuuuaauaccucuaccagauguaagaaauaauuuuuaucacuauaaucaaucaaaugacccaacaaucaaacuuauagcaauguuauauacaccauuacgagcaaacaaugcuggugacgauguauuuacaguauccuguagaguacuaacaagaccaucaccagauuuugauuuuauauuucuaguuccaccaacuguagaaucuagaacuaaacccuuuucaguaccaauacuaacaguagaagaaaugacaaauuccagauuuccaauaccauuagaaaaauuauuuacaggcccaucaucugcauuuguaguucaaccccaaaacggaagauguacuacagacggugucuuauuaggaacaacucaauuaucaccagucaacauauguacauucaggggagauguaacacauauuacuggaucacgaaacuauacuaugaacuuagcaucccaaaacuggaauaacuaugauccaaccgaagaaauaccugcaccacuaggcacaccugacuucgucgguaaaauucaaggaguauuaacccaaacuacaagaacagauggcucaacccgaggacacaaagcaacagucuauacagguucugcagacuuugccccaaaauuaggacgcguacaauuugaaacugacacagaucaugacuuugaagcaaaucaaaauacaaaauuuacaccaguaggagugauccaagacggaggaacuacacaucgaaaugaaccucaacaauggguauuacccucauacuccggucgaaauacacauaacguacauuuagcaccagcaguugcaccaacauuuccaggagaacaacuucuauucuuuagaucuacaaugcccgguugcucaggauauccaaauauggaucuagauuguuuacuaccucaagaauggguucaauauuuuuaucaagaagcugccccugcacaaucugacgucgcauuacuaagauuuguaaacccagacacuggacgaguacuauucgaauguaaacuucauaaaucaggauauguaacaguagcacacacuggacagcaugaccuaguaauaccaccaaauggauauuuuagauucgauucauggguuaaucaauuuuacacacuagcucccaugggaaauggaaccggucguagaagauaa

SEQ ID NO: 34149 - RNA, 1617 nt, Artificial Sequence
  derived and/or modified sequence opt6 from VP1__Norovirus_and/or_Norovirus-like__KJ685408
augaaaauggcauccucagacgcaaacccaucagaugguuccacagcaaauuuaguaccugaaguaaacaaugaaguaauggcucuagaaccagucguaggcgcagcaauugcagcacccguagcaggacaacaaaacguaauagacccuuggauucgaaauaauuuuguacaagcaccaggaggcgaauuuaccgucucaccacguaaugccccaggugaaauccuauggucagcaccuuugggaccagaccuaaaucccuauuuaucacaucuugcaagaauguauaauggauaugcaggcggauuugaaguacaaacaauauuagcaggaaacgcauucacagcaggaaaaauaaucuucgcagcaguaccacccaacuucccaaccgaaggauuaucaccuucacaaguaacaauguucccucacauaauaguugacgucagacaacuugaaccaguacuaaucccacuaccagauguacgaaacaacuuuuaucacuacaaucaaacaaaugacccaacuauaaaacuaauagcaauguuauacacacccuuaagagccaacaaugcaggagacgauguauuuacaguauccuguagaguuuuaacuagaccuucaccagacuucgacuucauauuucuaguaccaccuaccguagaaucacgaacaaaaccauucucaguccccguauuaaccgucgaagaaaugacaaacuccagauuuccaauaccauuagaaaaacucuuuacaggaccaucaucugcuuuuguaguacaaccccaaaacggucgcuguacaacagacggaguccuauuaggaacaacacaacuaaguccugugaacauaugcacauuucgaggagauguuacucauauauccgguuccagaaauuacacaaugaaucuagccucucaaaacuggaacucauaugauccaacugaagaaauaccagcaccauuagguacaccagauuuugucgguaaaauccaagguguacuaacacaaacaacaagaacagauggaucaacacguggucacaaagcaacaguuuacacaggcucagcagacuuuaguccuaaauuaggaagaguacaauuugcaaccgauacagauaaugauuuugaaacuaaccaaaauacaaaauucacaccuguaggaguaauacaagauggaggaacuacccaccaaaacgaaccacaacaauggguccuaccaucauauagcggucgagauacacauaacguacacuuagccccugcaguagcucccacauuuccaggagaacaacuauuauucuucagaucaaccaugccaggauguuccggauauccuaacauggaucuagauugcuuacuaccccaagaauggguacaauauuucuaucaagaagccgcacccgcucaaucagauguagcacuacuaagauucguaaacccagauacaggaagaguauuauucgaaugcaaauuacauaaaucagguuaugucacuguugcacacacaggacaacaugauuuagucaucccaccaaauggcuacuucagauucgauucauggguaaaucaauuuuauaccuuagcaccaaugggaaacggaacaggaagaagaagauaa

SEQ ID NO: 34150 - RNA, 1617 nt, Artificial Sequence
  derived and/or modified sequence opt6 from VP1__Norovirus_and/or_Norovirus-like__KJ144999
augaaaauggcaucaaacgaugcaaacccuucagacggcucagcugccaacuuaguccccgaaguuaacaacgaaguaauggcacucgaaccaguuguuggagcugcuauugcagcaccaguagccggacaacaaaacguuauagacccauggauaagaaauaacuucguacaagcaccagguggagaauuuacaguuucaccaagaaacgcaccaggagaaauacuauggagugcaccccucggaccagaucuaaauccauacuuaucucauuuagccagaauguauaacggauaugcaggaggauucgaaguacaaguaauacuugcuggcaaugcuuucacagcuggaaaaauaaucuucgcagccguaccaccaaauuucccaacagaaggauuaucaccaucacaaguaacaauguucccacacauuauaguugacguacgacaacuugaaccuguauuaauaccauuaccagacguaagaaauaacuucuaucacuauaaccaaucaaaugauucuacaauaaaauuaauagcuaugcuauauaccccacuuagagcaaacaacgccggugaagaugucuuuacaguaucuuguagaguacuaacaagaccuucaccagauuucgacuuuauauuucuaguaccaccaacaguagaaagccgaaccaaaccauuuacaguaccuauacuaacaguagaagaaaugacaaacucuagauucccaauaccacuagaaaaauuauuuaccgguccaucaggugccuuuguuguucaaccucaaaacggaagauguacaacagacggaguucuacuaggaacuacacaacuaucaccaguaaauauuuguacauuuagaggagacguaacacauauugcaggaagcagaaacuacacaaugaauuuagcaucauuaaacuggaacaauuacgaucccacagaagaaaucccagcaccuuuaggaacuccagauuuuguaggaaaaauucaaggaguauuaacacaaacaacaaaaggugauggauccacaagaggacacaaagccaccguuuauacugguggagcacccuucacaccuaaacuugguucaguacaauuuuccacagauacagaaaacgacuuugaaacacaccaaaauaccaaauuuacaccuguaggcguaauacaagaugguaguaccacccauagaaaugaaccgcaacaauggguccuccccaacuauucagguagaaacguacauaacguacaccuugcaccagcaguugcaccaacauucccaggcgaacaacuacuauucuuuagauccacuaugcccggaugcucuggcuacccaaacauggaucuugacuguuuacuaccucaagaauggguacaacacuuuuaucaagaagccgccccugcacaaucagauguagcauuacucagauucguuaaccccgacacuggaagaguauuauucgaaugcaaauuacauaagucuggauauguaacuguagcucauacaggacaacaugauuuaguaauaccaccaaauggauauuuuagauuugacucauggguuaaucaauucuauacauuagcaccaaugggaaauggagcuggaagacgacgauaa

SEQ ID NO: 34151 - RNA, 1617 nt, Artificial Sequence
  derived and/or modified sequence opt6 from VP1__Norovirus_and/or_Norovirus-like__KF060016
augaaaauggcaucauccgacgcaaacccaucagacggcucaacagcaaaccuaguaccagaaguuaauaaugaaguaauggcauuagaaccaguaguuggagcagcuauagccgcaccaguagcuggucaacaaaauguaauugacccauggauaagaaauaauuucguacaagcaccuggaggagaauuuacaguaucaccuagaaaugcuccaggugaaaucuuauggucugcaccacuuggcccugauuuaaauccauaucucucccacuuagccagaauguauaacggauacgcaggaggcuucgaaguucaaguaauucuagcuggcaacgcauucacagccggcaaaauuaucuucgcugcaguaccaccuaacuucccaacagaaggauuaucuccaucacaaguaacuauguucccccauaucauaguagacguuagacaacuagaaccugucuuaauacccuuaccagacguacguaauaacuucuaccacuauaaccaaucuaaugauccaacuauaaaacucauagcaaugcuauacacaccacuuagagcuaacaaugcuggugaugauguuuucacaguaucaugcagaguauuaacaagaccguccccagacuuugacuuuaucuucuuaguaccaccaacuguugaaagcagaacaaaaccauucucaguaccaguacuuacugucgaagaaaugacaaacucaagauucccaguaccacucgaaaaauuauuuaccgguccaucuucagcauucguaguacaaccacaaaacggaagaugcacaaccgauggcguacuacuaggaacaacacaacuuucaccaguaaacauauguacauuuagaggcgacguaacucacauaacuggaucuagaaauuacacaaugaaucuagcuucccaaaacuggaacucauaugauccaacagaagaaauaccagcuccucuuggaaccccagauuuuguaggaaaaauucaagguguacucacccaaacaacaagaacuaauggcucuacaagaggccacaaagccacuguauacacuggaucagcugacuuuucaccaaaacucggaagaguacaauucgcaacagauaccgacaacgacuucgaaacaaaccaaaauacaaaauucaccccagugggaguaauacaagacggauccacaacaccacgaaacgaaccacaacaguggguauuaccaucauauuccggaagaaacauacauaauguacaccuagcuccugcaguugcaccaaccuuuccaggugaacaacuauuauucuuccgaucaacaaugcccggaugcucaggauaccccaacauggaucuagacuguuuacucccucaagaauggguacaauauuucuaucaagaagccgcaccagcacaaucugacguagcauuacuaagauucguaaacccugacacaggaagaguauuauuugaaugcaaauuacacaaaucaggauauguaacaguagcccauacaggacaacacgauuuaguaauaccuccaaacggcuacuucagauucgauaguugggucaaucaauucuacacucuagcaccaaugggcaauggcaccggaagaagaagauaa

SEQ ID NO: 34152 - RNA, 1617 nt, Artificial Sequence
  derived and/or modified sequence opt6 from VP1__Norovirus_and/or_Norovirus-like__KC517367
augaaaauggcaucuaaugacgcaaacccgucugauggaucugcagccaauuuaguaccagaaguaaauaacgaaguaauggcucuagaacccguuguaggagccgcaauagcagccccaguagcuggacaacaaaauguaauugacccauggauaagaaauaacuucguccaagcaccaggaggagaauuuacuguuucaccacgaaacgcaccuggagaaauauuauggucagcgccccuagguccagaccuaaaucccuacuuaucacacuuagcacgcauguauaacggcuaugcaggaggauucgaaguacaaguaauacuagcaggaaacgcauuuacagcuggaaaaauaauuuucgcagccguuccaccaaauuuuccaacugaaggacuaucaccaucacaaguaacaauguucccacacauaauaguugauguaagacaauuagaacccguacucauuccauuaccagauguaagaaauaacuucuaucacuacaaccaaucaaaugauucaacaauaaaacuaauagcaauguuauauacaccacuacgagcuaacaaugcuggugaagauguauuuacagcaaguuguagaguucuaacacgaccaagcccagacuuugacuuuauauuccuaguaccaccaaccguagaaucaagaaccaaaccauucacugugccaauauuaacaguagaagaaaugacaaacaguagauucccgauacccuuagaaaaacuauuuacaggaccaucuucagcauuuguagugcaaccacaaaauggaagauguacaacagauggaguauuacuaggcacaacucaacuaucacccguaaauauauguacauuccgaggugacguaacucacauagcagguucaagaaacuacacuaugaauuuagcaucucuaaacuggaacaauuacgauccaacugaagaaauaccggcacccuuaggaacaccugacuuuguuggcaaaauacaaggaauguuaacacaaacaaccaaaggcgacggaucaaccagaggacacaaagcaacaguauauacugguagcgcaccauucacaccaaaacuaggaagcguacaauuugaaacagauacugaaaacgacuuugaaacccaccaaaauacaaaauucacuccuguaggaguuauacaagacgguggaacagcacauagaaaugaaccacaacaauggguacuaccaucauacucaggacgaaauguaccaaacguacacuuagcacccgcaguagcucccacauuuccaggagaacaauuacuauucuuuagauccaccaugccaggaugcucaggauacccaaauauggaucuagacugccuauuaccacaagaauggguacaacacuuuuaucaagaagcagcaccagcccaaucugacguugcacuacuaagauucguaaauccagauacaggaagagucuuauucgaaugcaaacuacauaaaagcggauaugucacaguugcgcauacaggucaacacgacuuaguuauuccaccaaauggcuauuuccgauuugauucauggguaaaucaguuuuacacuuuagcacccaugggaaacggaacaggaaggagacguuaa

SEQ ID NO: 34153 - RNA, 1617 nt, Artificial Sequence
  derived and/or modified sequence opt6 from VP1__Norovirus_and/or_Norovirus-like__KC517366
augaaaauggcaucaaaugaugcaaacccaucagauggaucagcagcaaaccuuguaccagaaguaaacaacgaaguaauggcacuugaaccagucguaggagcagcaauagcugcaccaguagcaggccaacaaaacguaauagacccauggauuagaaacaacuucguacaagcaccaggaggcgaauuuacaguuuccccaagaaaugcaccaggagaaauacuuuggucugcacccuuaggccccgauuuaaauccauaucuuucacacuuagcucgaauguauaacggauacgcaggaggauucgaaguacaaguaauacucgccgguaaugcauuuacagcaggaaaaauaauauucgcagcaguaccaccuaauuuuccaacagaaggucuuucuccaucacaagucacuauguuuccucacaucauaguugacguuagacaauuagaaccuguacuaauuccauuaccagauguucgaaacaauuucuaccauuauaaccaaagcaaugauuccacaauaaaauuaaucgcuaugcuuuacacaccauuacgagcaaacaaugcaggagaagauguauuuacaguuaguuguagaguucuaacaagaccaagcccagacuuugauuucaucuuucuaguaccaccuacaguagaaucaagaacuaaaccauuuacugucccuauucuuacuguagaagaaaugacaaacagucgauucccuaucccauuagaaaaauuauucacuggaccauccagugcauuuguaguacaaccacaaaauggccgaugcacaacagacggaguauuacuagguacaacacaacuaagccccguaaauauaugcacauuccgcggagaugucacacacauagcaggcucaagaaauuacacaaugaacuccgcaucauuaaauuggaauaauuacgaucccacagaagaaauaccugcuccacuaggaacaccagauuucguuggaaaaauacaaggaauguuaacacaaacaacaaaaggagacggaucaacacgaggacauaaagcaacugucuacacagguucugcacccuuuacuccaaaacuaggaucaguacaauucgaaaccgauacagaaaaugacuucgaaacacaucaaaacaccaaauuuacaccagucggaguuauacaggacggaggaacuacccaucgaaaugaaccacaacaauggguccuaccaucauauucaggaagaaacguuccaaauguucacuuagcaccagcaguagcaccaacauuuccaggagaacaauuacuauuuuuccgaucaacaaugccaggcugcucuggauauccuaauauggacuuagauugcuuauuaccacaagaauggguccaacauuucuaucaagaagcagcuccagcacaaagcgacguagccuuacuuagauucguuaauccagacacaggcagaguacuauuugaaugcaaacuucauaaauccggauaugucacaguagcacauacuggacaacacgaucuaguaauaccuccaaaugguuauuuuagguuugauuccuggguaaaucaauuuuauacauuagccccuauggguaaugguacaggaagaagaagauaa

SEQ ID NO: 34154 - RNA, 1617 nt, Artificial Sequence
  derived and/or modified sequence opt6 from VP1__Norovirus_and/or_Norovirus-like__KC517359
augaaaauggccucaaacgacgccucaccaucugauggcucugcugccaaccuagucccugaaguuaacaaugaaguaauggcauuagaaccaguaguaggagccgcaauagcagccccuguugcaggucaacaaaaugucauagacccauggauacguaacaauuuuguccaagcaccaggcggagaauuuacuguaucuccacgaaacgcaccaggagaaauauuauggucugcaccacuaggaccugaccuaaauccauauuuaucucacuuagcaagaauguauaauggauacgcaggcggauucgaaguucaaguaauauuagcagguaaugcuuucacagcugguaaaauaauauucgcagcaguaccaccaaauuuuccaacugaaggacuaucaccaucacaagucacaauguucccacauauaauuguugaugucagaagacuagaacccguauuaaucccacuaccagauguaaggaauaacuucuaucacuauaaucaaucaaaugauucaacaauaaaauuaauagcaaugcuauacacacccuuaagagcaaauaacgcaggagaagauguauuuaccguaucaugcagaguacuuacaagaccaucaccagacuucgacuucauauuuuuaguaccacccacaguagaaagucgcacaaaaccauucacuguaccaauauuaacuguugaagaaaugacuuacucccgauuucccauaccacuagaaaaauuauuuacagguccaucauccgcuuucguuguucaaccacaaaauggcagauguaccacagauggcguacuacuaggcaccacacaacuaucaccaguaaauauauguacuuuuagaggugauguuacucauauugcaggaucuagaaauuacaccaugaaccucgcaucacucaauuggaacaauuaugaccccacagaagaaauuccagcaccuuuaggaacaccugacuucgugggaaaaauacaagguaugcuaacucaaacaaccaaaggagacgguucaacacgcggucauaaagcaaccguauacacaggaucugcaccauuuacaccaaaauuaggaucgguacaauucgaaacagauaccgaaaacgauuucgaaacacaucaaaacauaaaauuuacaccaguaggaguaauacaagauggaggaacaacacaccgcaacgaaccacaacaauggguacuaccaucauacucagguagaaacguaccaaauguacaucucgcacccgcaguagcaccaacauuucccggagaacaauuauuauucuuucgaucaacaaugccaggaugcuccggauacccaaauauggaucuagauugcuuauuaccucaagaauggguacaacauuucuaucaagaagcagcacccgcacaaucagacguagcacuauuaagauuuguaaauccagacacuggaagaguauuauuugaauguaaauuacauaaaucaggauauguaacugucgcacauacaggacaacaugaccuaauaaucccaccaaauggauauuuccgauucgacucauggguaaaucaauuuuauacacuugcucccaugggaaauggaaccggcagaagaagauaa

SEQ ID NO: 34155 - RNA, 1617 nt, Artificial Sequence
  derived and/or modified sequence opt6 from VP1__Norovirus_and/or_Norovirus-like__KC409303
augaaaauggcauccucggacgccaauccuucagauggaucuacagcaaauuuaguaccagaaguuaacaacgaaguaauggcacucgagcccguuguaggagcugcuauagcagcgccagucgcuggucaacaaaacguaauagauccauggauaagaaauaauuucguacaagcaccaggcggagaauuuacaguaucaccucguaaugccccaggagaaauauuaugguccgcuccccuaggcccagaccuuaacccauaucuaucacaccuagcaagaauguauaacggauaugcaggaggauucgaaguccaaguaauacuagcuggaaaugcauuuacagccggaaaaauaauauucgcggcaguuccaccuaacuuuccaacagaaggacuaaguccaucacaaguaacaauguuuccacacauaauagucgauguacgacaauuagaaccaguauuaauacccuuaccagacguacgaaacaacuuuuaucacuauaaccaaucaaaugauccuacaauaaaauuaauagcaaugcuuuauacaccacuacgagcaaacaacgccggagaugacguuuucaccguuucauguagaguuuuaacaagaccaucaccugauuuugacuuuauauuucuuguaccaccaacaguagaaucacgcaccaaacccuucucuguaccaguacuuacaguugaagaaaugacuaacucucgcuucccaauaccacuugaaaaacuauuuacaggacccuccucagcauuuguuguacaaccacaaaacggacgaugcacaacagacggaguauuacuaggaacaacacaacucucacccguaaacauauguacauuuagaggagacguaacacauauuaguggaucaagaaacuacacaaugaauuuagcaagucaaaauuggaacucuuacgauccaacugaagaaauaccagcuccauuagguacaccugacuucguaggaaaaauacaaggaguacuaacacaaacaacuagaacagacggauccacaagaggacauaaagccaccguauauacaggaucagcagacuuuucaccaaaacucggucgaguccaauucgccacagacacagauaaugauuucgaaacaaaucaaaauacaaaauuuacaccuguuggaguaauacaagauggaggaacaacacauagaaaugaaccacaacaauggguauuaccuucauauuccggaagaaacauccauaacguucaccuugcacccgcagucgcuccaacauucccaggugaacaacuacuauucuuuagauccacuaugccaggauguuccgguuauccaaauauggaucuagauugucuccuaccucaagaauggguacaauauuuuuaucaagaagcagccccagcccaaucugacguagcacuucuacgauuuguuaauccagacacaggaagaguauuauucgaauguaaauuacauaaaucaggcuauguaacuguagcacacaccggucaacacgaucucguuauaccuccaaauggauauuucagauuugauucauggguaaaucaauuuuacacacuugcacccaugggaaauggcaccggaagaagacgauaa

SEQ ID NO: 34156 - RNA, 1617 nt, Artificial Sequence
  derived and/or modified sequence opt6 from VP1__Norovirus_and/or_Norovirus-like__JX459608
augaaaauggcaagcaaugacgcaaauccaucagauggaucagcagcgaaccuaguaccagaaguaaacaaugaaguaauggcuuuagaaccaguaguuggagcugcaauagccgcaccaguagcaggucaacaaaauguaauagauccauggauuagaaauaacuuuguacaagcaccaggcggcgaauuuacaguuucaccaagaaacgcaccuggagaaauauuauggucagccccacuagguccugaucuaaauccauaucuaucacauuuagcaagaauguacaacggauacgcaggaggauucgaaguacaaguaauauuagcuggaaaugccuuuacugcaggaaaaauaauauucgcagcaguaccaccaaauuucccaacugaaggauuaucuccaucacaaguaacaauguucccucauauaauuguagauguaagacaacuagaacccguacuuauaccauuaccagacguacguaacaauuucuaucacuauaaccaaagcaaugacucaacaauaaaacuaauagcaauguuauauacacccuugagagcaaacaacgccggagaagacguauucacaguauccuguagaguacuaacacgaccaucaccugacuuugacuucauauuucucgucccaccaacaguagaaucacgcacaaaaccuuuuacagucccuauacuaacagucgaagaaaugacuaacucaagauucccaauaccucuugaaaaauuauuuacaggcccauccggugccuucguaguucaaccacaaaauggacgauguaccacagacggaguccuucuaggaacaacccagcucuccccaguaaauauauguacauucagaggugacguaacccacauagccggcagcaggaauuauacuaugaaccuagcaucccuaaacuggaacaacuaugaucccacugaagaaacaccagcaccacuaggaacaccagacuuuguaggaaaaauacaagguguacuaacacaaacaacuaaaggagacggaucuaccagaggacauaaagcaacaguauacacagguucugcaccauuuacaccuaaacuaggaaguguacaauuuucaacagauacagaaaacgacuucgaaacacaucaaaauacaaaauucacaccaguaggugucauacaagacggcggcacaacccacagaaacgaaccucaacaauggguacuaccuucauacucaggaagaaacguccacaauguacaucuugcaccagcaguugccccaacauucccuggcgaacaacuacuuuucuuuagaucuacaaugcccgguugcucaggauacccaaauauggauuuagauugccuacuaccacaagaauggguacaacauuucuaccaagaagcagcaccagcacaaucagacguagcauuacuaagauucguaaacccagacacuggaagagucuuauucgaauguaaacuccauaaaucaggcuacguaacaguagcacacacuggacaacacgaucucguaauaccacccaauggauauuucagauucgauucauggguaaaucaauucuauacauuagcgcccaugggaaauggcacaggcagacgcagauaa

SEQ ID NO: 34157 - RNA, 1617 nt, Artificial Sequence
  derived and/or modified sequence opt6 from VP1__Norovirus_and/or_Norovirus-like__JQ320073
augaaaauggcaucuaaugaugcaaauccaucagauggaucaaccgcuaauuuagucccugaagucaauaaugaaguaauggcucuugaaccaguuguaggagcugcaauagcagcaccagucgcaggccaacaaaacgucaucgauccuuggauacguaacaacuucguacaagcaccaggaggagaauuuaccguaucaccacgaaaugcaccaggagaaauauuauggucugcuccuuuaggaccagauuuaaauccuuaucuaagucaccuagcucguauguauaauggcuacgcaggagguuucgaaguucaaguaauccuagcaggaaacgcauucaccgcuggaaaaguuauauucgcagccguaccaccaaauuucccaacagaaggauuaucaccuagucaaguaacaauguuuccccauauaguaguagauguacgacaauuagaacccguucuaauaccuuuaccagauguccguaacaauuuuuaucauuauaaccaaaguaacgauccaacaauaaaacuaauugccaugcuauauacaccacuacgugcuaauaaugcaggagaagauguuuuuaccguaucauguagaguacuaacccgaccuucaccagacuuugauuuuauauuucuagucccacccacaguagaaaguagaacaaaacccuuuaccguaccaauacuaacuguagaagaaaugacuaacagucgauucccaauaccacuagaaaaauuauuuacaggaccgucaggagcauucguaguucaaccacaaaauggacgaugcaccacagauggaguauuauuaggcacuacucaacuaucaccuguaaauauuuguacauuuagaggugacguaacacauaucgcaggaacucauaacuacacaaugaauuuagcuucacaaaacuggaacaacuaugauccaacagaagaaauaccagcaccauuggguacgcccgauuucguuggacguauucaaggcaugcuaacacaaacaacacgaggagauggcucaacuagaggucauaaagcaacaguaucaacaggcgauguacauuucacaccuaaguuaggauccauacaauucaacacagauacgaauaacgauuucgaaaccggucaaaauacaaaauuuacaccaguaggugucguacaagacgguaacggaacacaucaaaaugaaccacaacaauggguccuaccaucauacucaggacgaacaggacauaauguucauuuagcuccugcaguagccccaacauuuccuggagaacaauuauuauucuuuagaucuaccaugcccggauguagcggauauccuaauaugaauuuagacuguuuauuaccccaagaauggguacaacacuuuuaccaagaagcagcaccagcucaaucugauguagcacuauuaagauuuguuaauccagacacaggacgcguauuauucgaauguaaacuucauaaaucaggauacguaacaguagcacauacaggacaacaugaccuaguaauaccaccaaacgguuauuucagauucgacucauggguaaaucaauuuuauacuuuagcaccaauggguaacggaacaggaagacgaagauaa

SEQ ID NO: 34158 - RNA, 1617 nt, Artificial Sequence
  derived and/or modified sequence opt6 from VP1__Norovirus_and/or_Norovirus-like__HM802552
augaaaauggcaucaaaugacgcaucaccaagugauggaucuacagcaaacuuaguaccugaaguaaauaaugaaguaauggcacuagaaccaguaguaggagccgcaauagcagcaccaguagccggacaacaaaauguaaucgacccauggauaagaaauaacuuuguacaagcuccaggaggagaauuuacaguauccccaagaaacgcaccaggugaaauacuauggucugcaccauuaggaccagaccuaaauccauaccuaucacauuuagcaagaauguauaacggauacgcaggaggauuugaaguacaagucauacuagcaggaaacgcauuuacagcaggaaaaauaauauucgcagcagucccacccaauuucccaaccgaaggcuuaucacccucacaaguuacaauguuuccacauaucauuguagacguaagacaacuagaaccaguauuaauaccauuaccagauguuagaaacaauuucuaccacuauaaucaaagcaaugauucuacaauaaaauuaauagcaaugcucuauacaccacuacgugcuaauaaugccggagaugacguauuuacaguaucuugcagagucuuaacaagaccuagucccgacuuugauuucauauucuuaguucccccuacaguagaaucacgaacaaaaccauucacagucccaauacuaaccguagaagaaaugaccaauucaagauuuccaaucccauuagaaaaauuauuuacagguccaucauccgcauucguuguucaaccucaaaacgguagauguacuacagauggcguuuuauuaggaaccacacaacuaucaccuguaaauaucuguacauuuagaggagacguuacacauauaccuggaacucgaacauaccgaaugaaccuagcaucacaaaauuggaacaacuaugaucccacagaagaaaucccagcaccucuagguacaccagauuuuguaggaaagauacaaggaaugcuaacucaaaccacaaaaggugacggcucuaccagaggucauaaagcaacaguuucuacaggauccgucgauuuuacaccaaaauuaggaucuguacaauuugcaacugauacugauaacgauuuugaaacaggacaaaauacuagauuuacaccaguaggaguaauacaagauggaucaucuacacauagaaaugaaccacaacaauggguauuaccagacuauaguggcagaacaguacacaacguacacuuagcaccagccguagcaccaacauuuccaggugaacaacuacuauuuuucagaucaaccaugccaggaugcaguggauauccaaacauggaucuugauuguuuacucccccaagaauggguacaacacuuuuaucaagaagccgcuccaucucaaucagacguagcacuacuaagauuuguaaacccagauacaggaagaguauuauuugaaugcaaacuucacaaagcaggauauguaacuguagcacauacuggucaacaugaucuagucauaccaccuaauggauauuuuagauuugauucauggguaaaccaauuuuauacacuugccccaauggguaacggagcaggaagaagaagauaa

SEQ ID NO: 34159 - RNA, 1617 nt, Artificial Sequence
  derived and/or modified sequence opt6 from VP1__Norovirus_and/or_Norovirus-like__AB541320
augaaaauggcaucaagugacgccaauccaucagauggaucaacagcuaacuuaguaccugaaguaaauaaugaaguaauggcauuagaaccaguaguaggugcagcaauagcugcacccguagcaggacaacaaaauguaauagacccauggauuagaaacaacuucguucaagcaccuggaggagaauuuacaguuuccccuagaaacgcaccaggcgaaauacuauggucagcaccauuaggacccgaucuuaauccauaucuaagucauuuagcacgaauguauaauggguacgcaggaggcuucgaaguacaaguaauauuagccgguaaugccuuuacagcugguaaaauaauuuucgcagcaguaccucccaacuucccaacugaagguuuauccccuucgcaaguaacuauguuuccacacauuauaguagacguucgacaacuagaaccaguguuaauuccacuaccagauguaagaaauaauuucuaccacuauaaccaaucaaaugauccaacaauuaaacuaauagccauguuauauacaccccuuagagcaaauaacgcaggagacgauguuuuuacaguaucuuguagaguauuaaccagaccaucaccugauuucgacuuuauauuuuuaguaccacccacaguugcaucuagaacaaaaccauucuccguuccauccguuacaguagaagaaaugacuaacucaagauuuccaauuccacuagaaaaauuauuuacaggacccucaucagccuuuguuguccaaccacaaaauggcagauguaccaccgaugguguauuacucggaacaacacaauuauccccuguaaacaucuguacauuucgaggugacguaacacauauaaccggaucaagaaacuacacaaugaauuuagcaacacaaaacuggaacucauacgauccaacugaagaaauaccugcacccuuagguacaccagacuuuguaggcaaaauacaagguguauuaacacaaacuacacgcgcagacggaucaacccgcggucauaaagcaaccgucuauacaggaucagcagacuucgcaccaaaauuaggaagaguacaguucgcaaccgauacagauaacgauuucgaugccaaccaaaauacaaaauuuacaccaguaggcguaauacaagacggagauacagcacauagaaaugaaccacaacaauggguauuaccaucauauuccgguagaaacucccauaacguacauuuagcaccaacaguugccccaacauuucccggagaacaacucuuauucuuuagaucuacaaugccagguugcucaggauauccaaacauggaucuagacuguuuauuaccacaagaauggguacaauauuucuaucaagaagcugcacccgcacaaucagacguagcauuauuacgauucguuaaccccgacacaggucgugucuuauucgaauguaaacuucauaaaucuggauacgugacaguagcacacacaggacaacaugauuuaguaauacccccaaacggauauuuucgauuugacagcuggguaaaccaauucuacacauuagcucccaugggaaauggaacaggcagaagaagauaa

SEQ ID NO: 34160 - RNA, 1617 nt, Artificial Sequence
  derived and/or modified sequence opt6 from VP1__Norovirus_and/or_Norovirus-like__AB541227
augaaaauggcauccaaugaugcuaauccaagcgacgguucagcugcuaacuuaguaccugaaguuucuaacgaagucauggcacuagaaccuguaguaggagcagccaucgcagccccaguugcuggacaacaaaauguuauugacccauggauaagaaacaacuucguacaagccccaggaggugaauuuacgguuucaccacgaaaugcuccaggagaaauacuuuggucagcaccccuuggcccagacuuaaauccauaucuuucacaccuagcaagaauguauaauggauaugcaggcggauucgaaguccaaguaauacuagcaggaaaugcauuuacagccggcaaaauaauauuugcagcuguaccaccaaacuucccaaccgaaggucucucuccaagucaagucacaauguucccucacauaaucguagacguuagacaacuagaacccguacuaauaccacucccagacgucagaaacaacuuuuaccauuacaaucaaagcaacgacucaacaaucaaacuaauagcaauguuauacacuccucuaagagcaaacaaugcaggagaagauguauuuaccguaucauguagaguacuaacaagaccaucaccagacuuugacuucauauuucuaguaccaccuacaguagaaucacguacuaaaccuuucacuguuccuauacuuacaguugaagaaaugaccaacucuagauuuccaauaccucucgaaaaacuauucacaggcccaucaggagcauucguuguccaaccacaaaacggaagaugcaccacugacgguguucuucuaggcacaacucaacuaucuccaguaaauauaugcacuuuccguggagacguaacacauauagccggaucaagaaacuacacaaugaaccuagcaucacuaaacuggaauaacuacgauccaacagaagaaauaccugcaccuuuaggaacaccagauuucgucggaaaaauacaaggaguuuuaacacaaacaacaaaaggagacggaucaacaagaggucacaaagcaacaguuuauacaggaucugcaccauuuacaccuaaacuaggaucaguacaauucucaacagacacagaaaacgacuucgaaacacaucaaaacacaaaauuuacuccuguaggaguaauacaagaugguggaacaacacauagaaaugaaccucaacaauggguacucccaucauauucaggaagagauguacauaacguacauuuagcacccgcaguagcuccuacauucccaggagaacaauuacuauucuucagaucuacaaugccaggauguucaggauaccccaauauggaucuugacugccuauuaccccaagaauggguucaacauuucuaccaagaagcagcuccagcacaauccgacguugcccuucucagauucguaaacccagacacaggacguguauuauucgaaugcaaacuccacaaaucaggcuauguaacaguagcucauacaggacaacacgaucuuguaauaccaccaaauggcuacuuucgauuugacucauggguaaaucaauuuuauacucuugcaccaaugggaaacgguacaggacguagaagauaa

SEQ ID NO: 34161 - RNA, 1617 nt, Artificial Sequence
  derived and/or modified sequence opt6 from VP1__Norovirus_and/or_Norovirus-like__AB504318
augaaaauggccagcaacgaugccaauccuucagacggauccgcagcaaacuuaguaccagaaguaaacaacgaaguaauggcauuagaacccguaguaggagcagcaauagcagcaccagucgcuggacaacaaaauguaauugaccccuggauuagaaauaacuuuguacaagcaccaggaggagaauuuacaguuucuccaagaaacgcaccaggagaaauacucuggucagcaccacuaggaccagaccuaaauccauauuuaagucaccuagcucgcauguauaauggcuacgcuggagguuucgaaguucaaguaauacuagcaggaaacgccuucacagcaggaaaaauaauauucgccgcaguaccaccaaacuucccuacagaaggacucucgcccucucaagucacuauguucccucacauuauuguagauguaagacaauuagaaccaguauuaauuccuuuacccgauguaagaaauaauuuuuaucauuacaaccaaucuaaugacucuacuauaaaauuaauagcaaugcuauacacaccauuacgagccaauaaugcuggugaagauguauucacaguaucauguagaguacucacaagaccaucuccagacuuugauuuuauauucuuaguaccaccaacagucgaaucacgcacuaaaccuuuuacaguaccuauauuaacaguugaagaaaugacaaauucaagauucccaauuccuuuggaaaaguuauuuacaggaccaucaggcgcauuuguaguacaaccacaaaacggacgauguaccacagauggaguacucuuaggcacaacacaauuaucaccagucaauauauguacauuucgaggagacguaacacauauagcuggcucaagaaacuacacuaugaaucuugcaucauuaaacuggaauaacuaugaucccacugaagaaauucccgcacccuuagguacaccagauuuuguaggaaaaauacaaggccuauuaacccaaacaacaaaaggagauggaucaacacguggucacaaagcaacuguauauacuggaagugcuccauuuaccccuaaacuugguggaguccaauucucaacagauacagaaaacgauuuugaaacacaccaaaauacaaaauucacuccaguaggaguuauacaagauggaucaacaacacaucguaaugaaccucaacaauggguauuaccaucauauucaggacgaaacguacauaacguacauuuagcuccagcuguugcgccaacauuuccaggagaacaauuauuauucuuuagaucaacuaugccaggaugcucagguuaucccaacauggauuuagauugcuuauuaccacaagaauggguccaacacuucuaucaagaagccgcaccagcacaaucagacguagcguuauuaagauuuguaaacccagauacuggacggguauuauuugaauguaaacuacauaaaucagguuacguaacaguagcacauacuggacaacaugaccuuguaauacccccaaauggauauuuuagauucgacaguuggguaaaucaauuuuacacacuagcucccauggguaauggaacuggaagaagaagauaa

SEQ ID NO: 34162 - RNA, 1617 nt, Artificial Sequence
  derived and/or modified sequence opt6 from VP1__Norovirus_and/or_Norovirus-like__AB504311
augaaaauggcaucaaaugaugcaacaccauccgauggaucaacagcaaacuuaguaccugaaguaaauaaugaaguuauggcauuagaaccaguaguuggagccgcaauagcagcaccaguagcuggucaacaaaauguaauugauccauggauacgcaacaauuuuguccaggcaccaggaggugaauuuacaguuagcccaagaaacgcacccggagaaauacuauggucagcaccacuuggaccagaccuaaauccuuaucuaucucacuuagcacgaaccuauaacggauacgccggaggauuugaaguacaaguaauacucgcaggaaaugcauucacagcaggaaaaauaauauucgcagccguaccaccgaauuuuccgacagaaggccuuucacccucccaagucacaauguucccacauauuaucguagacguaagacaauuagaaccaguuuuaauaccucuaccagauguacgaaacaauuuuuaucauuauaaccaaucaaaugacucaacaauaaaauuaauagcaaugcuauauacaccucuaagagcaaacaacgcuggagaugauguauuuacaguuucaugucgcguccuaacuagaccaucaccagacuuugacuuuauauuuuuaguaccaccaacaguagaaucaagaaccaaacccuucucagucccuauacuaacaguagaagaaaugaccaacucaagauuucccauacccuuagaaaaauuauuuacaggaccaucaagcgcuuuuguaguacaaccacaaaauggaagauguacaacagauggaguauuauuaggaacaacccaacuaucaccaguaaacaucugcacauuccgcggagacguaacacauauagcuggaacacaaaacuacaccaugaaucuagcaucacaaaauuggaacaacuacgacccgacugaagaaauaccugcaccauuaggaacaccugacuuuguaggaaaaauucaaggcguacuuacacaaaccacacgaagagauggaucaacaagaggucacaaagcaacaguauccacaggauccguucauuuuacaccaaaauuaggcuccguacaauuuucuacagacacaucaaacgauuuugaaacaggacaaaauacccgauuuaccccuguuggaguaguacaagacggaucuacaacucaccaaaaugaaccucaacaauggguauuaccaaacuauucaggacgugacucacauaauguucaccuagcucccgccguugcaccuacuuucccaggcgaacaacuacuuuucuucagaaguaccaugccagguugcucuggcuaucccaauaugaaucuagauugccuauuaccccaagaauggguacaacauuuuuaucaagaaucagcacccgcacaauccgauguagcauuauuacgauucguuaacccagauacaggaagaguuuuauucgagugcaaauuacauaaaucaggcuauguaacuguagcccauacuggacaacacgaucuuguuauuccaccaaauggauacuucagauucgauucaugggucaaucaauucuacacauuagcacccauggguaauggagcaggcagaagaagauaa

SEQ ID NO: 34163 - RNA, 1617 nt, Artificial Sequence
  derived and/or modified sequence opt6 from VP1__Norovirus_and/or_Norovirus-like__FJ537135
augaaaauggcaucaagugaugcaaacccuucagaugguuccacagcaaaucuaguuccugaaguuaacaaugaaguaauggcauuagaaccaguaguuggagccgcuauagccgcaccaguagcaggacaacaaaacauaaucgaccccuggauaagaaauaauuuuguucaagcuccaggaggagaauuuacuguuucuccuagaaacgcaccuggagaaauauuauggucagcaccuuuaucuccagauuuaaauccauaucuaucacacuuaucaagaauguauaauggcuacgcaggagguuucgaaguacaagucaucuuagccggcaaugcauucacugcaggaaaaauaauauucgcagcaauaccaccaaacuucccaacagaaggauuaaguccaucccaagucaccauguucccacacauaaucguugacguaagacaauuagaaccaguacuaauacccuuaccagauguacguaauaacuucuaccacuacaaucaagcccacgacuccacacuaaaauuaaucgcuaugcucuacacaccucuacgagcaaauaaugccggcgaugauguauuuacaguaucaugcagagucuuaaccagaccaucaccagauuuugauuuuauuuuccuagucccuccaacaguagaaucacgaacaaaaccauuuaccguaccuauuuuaacaguagaagaaaugucuaauucccguuuuccuaucccgcuagaaaaacuauauacaggaccaucaucagcuuucgucguacaaccacaaaacggccgauguacaaccgaugguguacuauuagguacaacacaacuuucugccgucaauaucuguaauuuccgcggugauguuacaagaguuggaauuucacacgacuauacuaugaauuuaguaucacaaaacuggaauaauuaugaccccacugaagaaauaccugcuccccuaggaacaccagacuucguaggaaaaauacaagguuuacuaacacaaacaacuagagccgauggaucaacaagagcacacaaagcaaccguaucaacaggaucaguacacuucacaccaaaauuaggcuccguucaauucacaacagauacaaacaacgauuuucaaaccggccaaaauacaaaauucacaccaguaggcguaauucaagacggagaccaucaccaaaacgaaccucaacaauggguuuugccuaauuacucugguaccucaggacacaacguacaccuagcucccgccguagcccccacauuucccggagaacaauuacuauuuuucagaagcacaaugccaggaugcucuggauauccaaacaugaacuuagacugcuuauuaccacaagaauggguuucacauuucuaucaagaagcagccccagcacaaucagacguagcccuccuucgauucguaaauccagauacaggaagaguacuauuugaauguaaacuacauaaaucaggcuacauaacuguagcacauacaggacccuaugacuuaguuauaccuccuaauggauacuuuagauuugacuccugggucaaccaauuuuacacccuagcaccaaugggaaacggaucuggaagaaaaagagucuaa

SEQ ID NO: 34164 - RNA, 1617 nt, Artificial Sequence
  derived and/or modified sequence opt6 from VP1__Norovirus_and/or_Norovirus-like__GQ413969
augaaaauggcaucaaaugaugcuaacccaucagauggaucaacugcuaacuuaguaccagaaguuaauaacgaaguuauggcauuagaaccuguaguaggagcugcaauugcagcaccuguagcaggucaacaaaauguaauagacccuuggauacgaaauaacuuuguacaagcaccaggaggagaauuuacaguuaguccuagaaaugcaccaggcgaaauacucuggucugccccauuaggccccgaucuaaauccauauuuaucccauuuagcuagaauguacaauggauaugcaggagguuucgaaguacaaguaauacuugccgguaaugcuuuuacagcugguaaaaucauauucgccgcaguaccaccaaauuucccuaccgaaggucucucacccucucaaguaaccauguuuccacacauaauaguugacguaagacaacuagaaccuguauuaauaccccuaccagauguacgaaauaauuucuaucauuauaaccaaucuaacgauccaacaauaaaacucauagccauguuauacacaccacuacgcgcaaauaaugcaggagaugauguuuuuacuguaucuugucguguauuaacacguccaucaccagauuuugacuuuaucuuuuuaguaccacccaccgucgaaagucgaacuaaaccauuuacaguaccaauacuaacaguugaagaaaugacaaauucucgauuuccaauucccuuagaaagauuauauacgggaccaucaucugcuuuuguaguccaaccacaaaauggaagaugcacuacagacgguguacuccuaggaacaacacaacuaucugcaguaaauauauguacuuuucgaggagacguuacccauauagccggaucaagaaauuauacuaugaaucucgcuucccaaaacuggucaaacuaugauccaacagaagaaauacccgcgccauuaggaaccccagauuucgucggaaaaauacaaggaaugcugacacaaacaacaggacgcgauggaucaacucgagggcacaaagcaacaguauuaacaggaucagcagauuuugcaccaaaauuaggaagaguucaauuugcaacagacacagauaaugauuucgaaucuggagaaaauacaaaauuuacacccguaggcguaauucaagaugguucaacaacacacagaaaugaaccacaacaauggguauuaccaaauuauucuggaagaacaggacacaauguucauuuagcaccagcuguugcacccacauauccaggagaacaauuacuuuucuucagaucuacaaugccaggauguucaggauacccaaacauggaccucgauugucuauuaccacaagaauggguacgacauuuuuaucaagaagcagcuccagcucaaucagauguagcucuauuacgauuuguaaacccagauacaggacgaguccuauucgaauguaaauuacacaaaccaggcuauguaacaguagcacauacaggucaacaugaucuaguuauaccuccaaauggauacuucagauuugauucaugggucaaucaauucuauacacuagcucccaugggaaaugguacaggaagacguagauaa

SEQ ID NO: 34165 - RNA, 1617 nt, Artificial Sequence
  derived and/or modified sequence opt6 from VP1__Norovirus_and/or_Norovirus-like__EU839592
augaaaauggcuucaaaugaugccaauccaucagacggaucagcagcaaaccuaguaccagaaguaaauaaugaaguaauggcauuagaaccaguaguuggagcagcgauagcagcaccuguagcaggucaacaaaauguuauagacccauggauuagaaacaauuuuguacaagcacccggaggugaauuuacaguaucaccuagaaaugccccaggagaaauuuuauggucagcaccuuuaggaccagaucuuaauccauaucuuucacaccuagcaaggauguauaauggauacgcaggaggcuuugaaguacaaguuauauuagcaggaaaugcuuucacagcuggaaaaauaauauucgcagcuguaccuccaaauuuuccaacagaaggcuuaucaccaucccaaguaacaauguucccacacauaauaguagacguacgacaacuagaaccaguauuaauaccauuaccugacguaagaaauaauuucuaucauuauaaucaaucaaacgacucaacaauaaaauuaauagcaaugcuauauacaccauuacgcgcuaauaacgcuggugaagauguauucacaguaucaugucgagucuuaacacgcccuucacccgacuucgacuucaucuucuuaguuccgccaacagucgaaucaagaacaaaacccuucacaguaccaauauuaacuguagaagagaugacaaauucuagauuucccauaccauuagaaaaauuauuuacgggaccauccucagcauuuguaguacaaccccaaaacggaagaugcaccacagacggaguauuacuuggcaccacucaauuaagcccagucaauauauguacauuuagaggagacguaacacacauagcaggaucacgaaacuauacuaugaauuuagcaucauuaaacuggaauaauuaugauccaacagaagaaauuccagcuccuuuaggaacaccagacuucgucggaaaaauccaaggaguauuaacucagacuacuaaaggagacgguucaacuagaggucauaaagcaacagcauacacagguucagcuccauuuaccccaaaauuaggaucuguccaauucucaacagacacagagaaugauuuugaaacacaccaaaauacaaaauucgcaccagucggaguaauccaagaugguggaacaacacauagaaaugaaccucaacaauggguacuaccaucuuauagcggacgaaacguacccaauguacaccuugccccagcaguagcaccaacuuucccuggugaacaacuacuauucuucagaucuacaaugccaggaugcuccggcuauccaaauauggaucuagacugccuccuaccccaagaauggguacaacauuucuaucaagaagcagccccagcacaauccgacguugcauuauuaagauucguaaacccugacacaggacgcguauuauucgaaugcaaauuacauaaaucaggauaugugaccgucgcucacacaggccaacacgauuuaguaauuccacccaacggauacuucagauucgauuccuggguuaaucaauucuacacacuagcaccaaugggaaacggaacaggacgaagaagauaa

SEQ ID NO: 34166 - RNA, 1617 nt, Artificial Sequence
  derived and/or modified sequence opt6 from VP1__Norovirus_and/or_Norovirus-like__EU839587
augaaaauggcuucaaaugacgcaucacccucagacgguagcacagcaaaucuaguacccgaaguaaauaacgaaguuauggcauuagaaccaguugucggugccgcuauagcagcaccaguagcaggacaacaaaauguaauugacccauggauucgaaauaacuuuguucaagcaccuggaggagaauuuaccguaucaccacgcaacgcaccaggagaaauacuuuggucagcaccacuaggaccggacuuaaauccauacuuaucacacuuagcaagaauguauaauggauacgcaggagguuucgaaguccaaguaauauuagcuggaaaugcauuuacagcaggaaaaauaauuuuugccgcaguaccaccaaacuucccaacagaaggauugucuccuucucaaguaacaauguucccucacauaauaguagauguaagacaacuagaaccaguccuaauaccacuuccagauguaagaaauaauuucuaccacuacaaucaaucuaaugauaguacaauaaaacuaauugcaauguuauacaccccauuaagagcaaauaaugccggagaugauguuuuuacaguaucauguagaguucuaacucgaccaucccccgacuuugauuuuauauuccuaguaccaccaacuguagaaagucgaacuaaacccuucacaguccccauacuuacaguagaagaaaugacaaauuccagauucccaauaccacuagaaaaacuauuuacaggcccuucaagcgcauucguaguacaaccacaaaacggaagauguaccacagacggcguacuuuuaggcacaacacaacuuucaccaguaaauauuugcacauuuagaggagacguaacucauauuccuggaacaagagcauacagaaugaaccuagcaucacaaaauuggaacaauuaugauccuacagaagaaauaccagcuccucuaggaacaccagacuucguaggaaaaauacaaggaaugcuaacacaaaccacaaaaggagacggcucaaccagaggacauaaagcaacaguaucaacaggauccguagacuucacaccaaaauuaggaucaguacaauuugcaacugauacagauaacgauuucgaaacaggccaaaacacaagauucacaccugucggaguaauacaagauggaucuucaacacauagaaaugaaccacaacaauggguuuuaccugauuacagcggccgaacaguacacaacguacaucuugccccugcaguagcaccuacauuuccuggagaacaauuauuauucuucagaucaaccaugccaggauguuccgguuauccaaauauggaucucgauugccuuuuaccucaagaguggguacaacauuucuaucaagaagcagcaccuagucaaucagauguagcauuauuaagauuuguuaaccccgacaccggacguguucuauucgaaugcaaauuacauaaagcaggauauguaacagucgcacacacaggacaacaugaccuaguuauaccaccaaaugguuauuuuagauuugacaguuggguaaaucaauucuacacuuuagccccaaugggcaauggagcaggacgaagacguuaa

SEQ ID NO: 34167 - RNA, 1617 nt, Artificial Sequence
  derived and/or modified sequence opt6 from VP1__Norovirus_and/or_Norovirus-like__EU839583
augaaaauggcaucuaaugaugcaucaccauccgacggaucaacagcuaaccuaguacccgaaguaaacaaugaaguaauggcucuagaaccaguuguaggugcagcaauagccgccccaguagcuggacaacaaaacguaauagaucccuggauuagaaauaacuuuguacaagcacccggaggugaauuuacaguaucaccaagaaacgcaccuggagaaauacuauggucugcuccacuagguccagaccuuaauccauaucuaucacacuuagcaagaauguauaacggauaugcuggaggauucgaaguacaaguaaucuuagcaggcaaugcauucaccgcagguaaaauuauuuucgcagcuguuccaccaaacuucccuacagaaggucuauccccaucccaagucacaauguucccucacauuaucguagacguacgacaacucgaacccguuuuaaucccauuaccagauguacgaaacaauuucuaucacuauaaccaaucaaacgacucuacuauaaaacuaauagcaaugcuauauacaccucuaagagcuaacaaugcaggagacgauguuuucacaguaucauguagaguauuaacaagacccaguccagacuucgacuuuauuuuccuaguaccaccuacugucgagucuagaacaaaaccuuucacaguaccaauccuaacuguagaagaaaugacaaauucaagauuuccuauuccacuagaaaaacuauucaccggcccaucaucagccuuugucguacaaccacaaaacggaagauguacaacagauggaguacuccucggaaccacacaacuaucacccguaaauauaugcacauuuagaggugacguaacucacauaccuggaacuagaacauacagaaugaaccuagcaucacaaaacuggaacaacuaugauccaacugaagaaauaccagcaccauuagguacaccugacuuuguaggcaaaauacaaggaaugcuaacacaaacaacaaaaggagaugguuccacaagaggucacaaagcuacaguaucuacaggaucaguugacuucaccccaaaauuaggaucaguacaauucgcaacagauacugauaaugacuucgaaacaggacaaaauacacgauucacucccgucggaguuauacaagacggauccucagcacacagaaaugaaccucaacaauggguauuaccagauuacucaggaagaacaguacauaacguacaccuagcaccagccguagcacccacauucccaggagaacaauuauuauucuuucgaucaacaaugcccggaugcucaggcuaucccaauauggaucuagauugccuauuaccucaagaauggguacaacacuucuaccaagaagcugcaccaucccaaucagacguagcacuauuacguuucguaaauccagacacagguagaguucuauucgaaugcaaauuacauaaagcuggauacguaacaguagcucacacaggccaacacgaucuuguaauuccaccuaacggauauuuuagauucgauuccuggguuaaccaauucuacacacucgccccaaugggaaacggagcaggacggagaagauaa

SEQ ID NO: 34168 - RNA, 1617 nt, Artificial Sequence
  derived and/or modified sequence opt6 from VP1__Norovirus_and/or_Norovirus-like__AB303931
augaaaauggcaucuaacgaugcaaauccaucagacgguucugcugcaaaucuaguaccagaagucaacaacgagguaauggccuuagaaccaguaguaggcgcagcaaucgcagcaccuguagcaggacaacaaaauguaauagauccauggauacguaauaacuucguucaagcccccggcggugaauuuacaguauccccaagaaaugcaccuggagaaauauuauggucagcaccauuaggaccagauuuaaacccauacuuaucucaccuugcaagaauguacaauggauacgccggugguuuugaaguccaaguaaucuuagcaggaaacgccuuuacagcaggaaaaauaauauucgcagcaguuccacccaacuucccaacagaaggacuaucucccucacaaguuacaauguuuccacacauaauaguagacguacgacaacuagaaccuguauuaauaccacuaccagaugucagaaacaacuucuaccacuauaaccaaucuaaugacaguacuauaaaacuuauagccauguuauacacacccuuaagggcaaacaaugcaggagaagauguauuuacaguauccugucgaguuuuaacuagaccuucaccugacuucgacuuuaucuuuuuaguuccaccaaccguagaauccagaacaaaaccauuuacuguaccaauauuaacuguagaagaaaugacaaacaguagauuuccuauaccacucgaaaaacucuuuacagguccaucaggcgcauucguaguucaaccacaaaaugguagauguacaacugauggcguuuuauuaggcaccacacaacuaaguccaguaaacauaugcacauuuagaggagaugucacacacauagcaggaacacauaauuacacaaugaaucuagcuucacaaaacuggaauaauuaugacccaacagaagaaaucccugcaccacuagguacaccagacuuuguuggucguauucaaggaauguuaacacaaacaacaagaggcgacggcuccacuagaggucauaaagcaacaguaucaaccggagauguacacuucacacccaaauuaggaucaauacaauucaauacagauacaaacaaugacuucgaaacaggacaaaauaccaaauuuacaccaguaggcguuguacaagacggcaauggagcccaucaaaaugaaccacaacaauggguauuaccuucauauucaggaagaacaggccauaacguucacuuagccccagcuguagcaccaaccuucccuggagaacaacuauuauucuuuagaucaaccaugccagguugcuccggauauccaaauaugaaucuagauugccuccucccacaagaauggguacaacauuuuuaucaagaagcagcaccagcacaaucugacgucgcucuacucagauucguaaauccagacacaggaagaguccuauuugaauguaaacuucauaaaucaggauacgugacaguagcacauacuggacaacaugaccuaguaauaccuccaaauggauauuucagauucgauaguuggguaaaucaauuuuauacacuagcaccaaugggcaauggaacuggaagaagaagauaa

SEQ ID NO: 34169 - RNA, 1617 nt, Artificial Sequence
  derived and/or modified sequence opt6 from VP1__Norovirus_and/or_Norovirus-like__KY341923
augaaaauggcaucuuccgacgccaauccaucugacggaucagcagcaaaucuaguaccagaagucaacaaugaaguuauggcauuagaaccaguaguaggagcagcaauugccgcccccguagcuggccaacaaaauguaauagacccguggauaagaaauaauuucguacaagccccaggcggugaauuuacaguaucaccaagaaaugcuccuggugaaauauuauggucagcaccauuaggaccugauuuaaauccuuacuugucacaccuagcaagaauguauaauggauacgcaggaggauucgaaguacaaguuauucuagcagguaaugcauuuacagcaggaaaaguuauuuucgcagcaguuccacccaauuuccccacugaaggacuuucaccaucacaagucacaauguucccacacauaguagucgacguacgacaacuugaacccguauuaauaccacuacccgauguaagaaacaacuuuuaucacuacaaucaaucaaacgaccccaccauaaaacuaauagcaauguuauacacuccacuaagagcaaacaaugcuggugacgauguauucacaguaucuuguagaguuuuaacacguccuucaccagacuucgacuucauauuucuaguaccaccaacaguagaauccagaacaaaaccuuucuccuuuccaguucuaacaguagaagaaaugacaaacucuagauuccccauaccacuagaaaaacuauuuacaggacccucaagugcauuugucguucaaccacaaaauggaagaugcacaacagacggaguauuacucggaaccacacaauuaaguccuguaaauauaugcacauuccgaggagacguaacacauauaacaggaucacgaaauuauacaaugaacuuagcaucacaaaauuggaauaacuacgaucccacagaagaaauaccagcaccacuaggaacaccagacuucgucggaaaaauacaaggaguacuuacacaaacaacaagaacagaugguucaacccguggacacaaagcaacaguuuauacaggaagugcagacuucgcaccaaaauuagguagaguacaauuugaaacagauacagaucacgauuuugaagcuaaucaaaauacaaaauucacaccaguuggaguaauacaagacggaucaacaacacaucgaaaugaaccucaacaauggguacuaccaucauauucuggucgaaacacgccaaacguacaucucgcaccagccguugccccaacauuuccaggagaacaauuacuauucuuucgaucaacaaugccaggaugcucaggauacccaaauauggaucucgacugccuauuaccacaagaauggguucaauauuucuaucaagaagcugcacccgcacaaagugacguagccuuacuuagauuuguaaacccugauaccggaagaguuuuauuugaaugcaaauuacauaaaucuggauacgucacaguugcacauaccggacaacaugauuuaguuauaccaccuaauggauauuuuagauuugauuccuggguaaaccaauuuuauacacuugcuccaaugggaaauggcacaggaagaagaagauaa

SEQ ID NO: 34170 - RNA, 1617 nt, Artificial Sequence
  derived and/or modified sequence opt6 from VP1__Norovirus_and/or_Norovirus-like__KX514317
augaaaauggcaucuucagaugcaaaccccagugacggaucaacagcaaaucuaguacccgaaguaaacaaugagguaauggcacuagaacccguaguaggagcugcaauagcugcaccuguugccggccaacaaaacguaauagacccauggauaagaaauaauuuuguacaagccccuggaggagaauuuacaguaucuccucgaaaugcucccggagaaauacuauggucagcaccauuaggccccgacuuaaauccauacuuaucacauuuagcaagaauguauaacggauaugcaggaggauucgaaguacaaguuauacuugcagguaacgcauucacagcaggaaagaucauauucgcagcaguaccacccacauuuccaacagaaggacuuucaccaucacaaguaacaauguuuccucauauaauaguagaugucagacaauuagaaccuguacuaauuccccuucccgaugucagaaacaauuucuaucauuauaaucaaucaaaugauucaacaauaaaacuaauagcaaugcucuacacaccacuacgugcaaauaaugccggagaugacguauuuacaguaucuugccguguacuaacaagaccaucacccgacuucgauuuuauauuucuagucccaccaacaguagaaucuagaucaaaaccauucaguguaccaguacuaacuguagaagaaaugacaaacucaagguuucccgcaacuuuagauaaauuauuuacaggaccaucaucuacauucguaguacaaccucaaaacggaagguguacaauugauggcgaacuauuagguacaacacaauuaucaucuguaaauauaugcacuuuccgaggagauguaacacauccaagagauucuaaaauauauacaaugaauuuagccucacccaauuggaauaacuaugauccaacagaagaaauuccugccccauuaggaacaccugacuucguaggcaaaauacaagguauguuaacucaaacaacgaaaggcgaaggaucuacaagaggucauagagcaacagucuacguaggaucugcaaauuacgcaccaaaauuaggaagaguacaauuugaaacugacacaaccgaugaucuagaugcacaucaaaacacaaaauuuacaccagucggaguuguucaagguggagaaucccccaaaggaucagaaccacaacaauggguauuaccaaacuauucuggagcaaacacuuuuaauguucaucuagcuccagcaguagcacccaacuucccuggagaacaauuacuguucuuccgaucuacucuuccuggauguggaggacacccaaauauggaccuagacuguuuacuaccacaagaauggguacaacacuucuaccaagaagcagcaccagcacaauccgauguagcauuacuacgauuuguuaauccagacacaagcagaguccuauucgaauguaaacuccauaaaucaggauauguaacaguagcccauacuggacaguacgaucuaguacucccaucaaacgguuauuuucgauuugauucuuggguaaaucaauuuuacacauuagcaccuaugggcaauggaaccggaagaagaagauaa

SEQ ID NO: 34171 - RNA, 1617 nt, Artificial Sequence
  derived and/or modified sequence opt6 from VP1__Norovirus_and/or_Norovirus-like__KU678204
augaaaauggcaucauccgaugccaauccuucagauggauccgcugcaaaucuaguaccagaaguuaacaaugaaguaauggcacucgaaccuguaguaggagcagccaucgcagcaccaguugccggacaacaaaauguaaucgauccauggauaagauccaauuucguccaagccccuggaggagaauuuacagucucaccacgcaacgccccaggugaaauacuauggucugcaccacuaggaccagacuuaaauccauacuugagccaccuugcaaggauguauaauggauaugcaggaggauuugaaguacaaguaauuuuagcugguaaugcauuuacagcaggcaaaguuauauuugccgcaguacccccaaauuucccaacagaaggacuauccccaucacaaguaacaauguucccucacaucguaguagaugucagacaauuagaacccguacuaaucccccuuccugauguaagaaauaauuucuaucauuauaaccaauccaacgauccaaccauuaaacuaauagcaauguuauacacaccuuuacgcgcuaauaaugcuggugaugauguuuuuaccgucucuugucgaguucuaaccagaccuucaccagacuuugauuucauauuucuaguuccaccaacaguugaaucaagaaccaaacccuucucaguuccaguacuaacuguagaagaaaugacaaacucucgauuuccaauacccuuagaaaaauuauuuacagguccauccucugcauucguaguucaaccacaaaacggaagauguacaacagaugguguacuucuuggaaccacucaauuaucaccaguaaauauauguacauuuagaggagaugucacacacauaacaggauccagaaacuauacaaugaaucuugcaucacaaaauugguccaauuacgauccaacagaagaaauaccugcaccuuuaggcaccccagauuuuguagguaaaauacaaggaaugcuaacucaaacaacaagaacagacggaucaacgagaggucacaaagcaacuguauacacagguucugccgacuucgcaccaaaauuaggaagaguacaauuugaaacagauacagaucaugacuucgaagcaaaccaaaauaccaaauuuacaccaguaggaguaauacaagauggaucaacaacacacagaaacgaaccucaacaauggguucuaccaagcuauucaggcagaaauacaccaaacguucaccuugcaccagcaguagcaccuacauuuccaggagaacaauuacuauuuuucagaucaaccaugccaggaugcucaggauauccaaauauggaucuugauugcuuauuaccacaagaauggguacaauauuucuaucaagaagcagcuccagcucaaucagacguagcacuacuaagauuugucaaucccgauacaggaagagucuuauuugaauguaaauuacacaaaaguggauauguuacaguagcacacacuggccaacacgaucuaguaaucccaccaaauggcuacuucagauucgacucauggguuaaccaauucuauaccuuggcuccaaugggcaacggcacuggacgaaggagauaa

SEQ ID NO: 34172 - RNA, 1617 nt, Artificial Sequence
  derived and/or modified sequence opt6 from VP1__Norovirus_and/or_Norovirus-like__KX158283
augaaaauggcaagcucugaugcuaacccaucagauggaucagcagcaaauuuaguaccagaaguaaauaaugaaguaauggcauuagaaccgguaguaggagcagccauagcggcaccaguagcaggucaacaaaauguaauagauccauggauaagaaacaacuuuguccaagcccccgguggugaauuuacaguuuccccaagaaacgcccccggagaaauauuauggagugcaccucuaggaccagauuuaaacccuuaccuaucacaccuagcaagaauguacaauggauacgcgggaggauucgaaguacaaguaauacuagcuggaaaugcauucacagcaggaaaaguaauauuugcagcaguaccuccaaacuucccaacagaaggauuaagccccucacaaguuaccauguucccacauauagucgucgaugucagacaauuagaaccaguacuaauaccacuaccagaugucagaaacaauuucuaccacuacaaccaaucaaacgaucccacaauaaaacugauagcaaugcucuauacaccucuaagagcaaauaaugcuggagacgauguauucacaguuucauguagaguccugacaagaccaucacccgacuuugacuucauuuucuuaguacccccaaccgucgaaucaagaacuaaaccauucagcgucccuguauuaacagucgaagagaugacuaacucuagauuaccuauaccacuugaacguuuauuuaccggccccucuagcgcauuuguuguacaaccacaaaauggaagauguacaacagauggaguucuucuaggcacaacacaacuaucaccaguaaacauuuguacauucagaggagacguaacacauauaacaggcucucauaacuauacaaugaaccuagcaagccaaaauuggaacaauuacgacccaacagaagaaauacccgcuccacuaggaacacccgacuuuguagguaaaauucaagguguacuuacacaaacaacaagaacugauggauccacucgaggucauaaagccaccguauacaccggcucagcagaauuugcaccaaaacuaggaagaguacaauuugaaacagauaccaaucacgauuucgaagcaaaccaaaauacuaaauucacaccaguaggagucauacaagacggaucaacaacacacagaaaugaaccucaacaaugggucuuaccauccuauagcgguagaaauacccauaacguacacuuagcuccagcaguagcacccacauucccaggugaacaacuccuuuucuuuagaucaacaaugccaggauguucuggauauccaaauauggauuuagauugcuuacuaccacaagaauggguacaauacuuuuaucaagaagcugcuccagcccaaucagacguugcauuacuaagauucguaaacccagacacaggaagaguauuauucgaaugcaaacuacacaaaucaggauauauaacagucgcucauacaggacaacaugacuuaguaauaccacccaauggcuacuuuagauuugacucauggguaaaucaauucuauacauuagcuccaaugggaaauggaacuggaagacgaagauaa

SEQ ID NO: 34173 - RNA, 1617 nt, Artificial Sequence
  derived and/or modified sequence opt6 from VP1__Norovirus_and/or_Norovirus-like__KX354088
augaaaauggcuucaaaugaugccaacccuucagacggaucagcagcuaacuuaguaccagaaguaaacaaugaagucauggcacuagaaccuguaguaggagcagccaucgcagcuccaguagccggacaacaaaacguaauagacccauggauaagaaauaacuuuguacaagcccccggcggugaauuuaccgucucaccaagaaaugcaccaggagaaauacuauggucagcaccacuaggcccagaccuaaacccuuaucuaucacaccuagcaagaauguauaaugguuaugcuggagguuucgaaguacaagucauauuagcugguaacgcauuuacagcaggaaaaauaauuuucgcagccguaccaccaaacuuuccgacagaaggucuuucacccucacaaguuacuauguucccacacauaaucguugauguaagacaacuagaaccaguccuaauaccccuaccugacguuagaaacaauuuuuaucauuauaaccaaucaaaugauucaacaauaaaacuuauagcuauguuauacacuccccuaagggccaacaacgcuggagacgauguauucacaguaucauguagaguauuaacaagaccaucccccgauuuugacuuuaucuuccuaguaccacccaccgucgagucuagaacaaaauuauuuacagucccaauucuaacaguagaagaaaugacaaacucacguuuuccuauaccauuagaaaaauuauuuacaggaccaucuucagccuuuguuguacaaccacaaaauggaagauguacaacagacggaguauuacuaggcaccacacaacuaucuccagucaauaucuguacauuucgaggagauguaacacauaucgcaggcucgcgcaacuauacaaugaauuuagcaucauuaaauuggaauaauuacgauccaaccgaagaaauaccugcaccuuuaggaaccccagauuuuguagguaaaauacaaggaguacuuacucaaacaacaaaaggcgacggauccacucgcggacauaaagcaacuguauauaccggaucagcagacuucacaccaaaacuuggaucaguacaauucgcaacagauacagaaaacgacuuugaaacucaucaaaauaccagauucacuccaguaggaguaauucaagacggcggaaccacucacagaaaugaaccacaacaauggguauuaccaagcuacucaggacgaaauguacacaacguccaucuagcucccgcuguagcacccaacuuuccaggagaacaacuauuauucuuuagaucaacaaugccagguuguucugguuauccaaauauggaucuagacugccuacuaccacaagaauggguacaacacuuuuaccaagaagcagcacccgcccaaucugacguagcuuuauuaagauucguaaacccagacacaggaagaguauuauuugaaugcaaacuacacaaaucaggauauguaacaguagcacauaccggacaauacgauuuaguaauaccaccaaauggauacuucagauuugauucuuggguaaaccaauucuacacauuagcuccaaugggaaauggaacuggcagaagacgauaa

SEQ ID NO: 34174 - RNA, 1617 nt, Artificial Sequence
  derived and/or modified sequence opt6 from VP1__Norovirus_and/or_Norovirus-like__KX354032
augaaaauggcaucuucagaugcaucaccuucugaugguuccgcagcuaauuuaguacccgaaguaaauaaugaaguaauggcacuagaaccaguaguaggagcugcaauagcagccccaguagcaggccaacaaaauguaauagauccauggauucgcaauaacuucguacaagccccaggcggagaauuuacaguaaguccaagaaaugcaccaggagaaaucuuauggucugccccauuaggaccagaucuaaauccauaccuaucucaucuagcacgaauguacaacggauaugccggcggauuugaaguacaagucaucuuagcaggaaaugcauuuacugcuggaaaagucauauuugccgcaguaccaccaaauuucccaacagaaggacuaucaccaucccaaguaacaauguuuccccacauuguagucgacguaagacaauuagaaccuguauuaauaccacuaccagauguaagaaacaauuucuaucauuauaaucaaagcaaugaucccacaauaaaauuaauagcuauguuauacacaccccuucgcgcuaauaauguaggagacgauguuuucacaguuucuuguagaguuuuaacaagaccaucaccagauuucgauuucauauuuuuaguaccacccacaguugagucaaggacuaaaccauucucuguuccgguucuaacaguagaagagaugacaaauucaagauuuccaauaccacuagaaaaauuauuuaccggaccaucaucugcuuucguaguacaaccacagaauggaagauguacaacagauggaguucuauuaggaacaacucaauuaucacccguuaacauauguacauucagaggagacguaacacacauaacagguuccagaaauuacacaaugaaucuagccucacaaaacuggaauaauuaugauccaacugaagaaauacccgcuccauuaggaaccccugacuucguaggcaaaauacaaggaguacuuacacaaacaacaagaacugacggaucaacaagaggacauaaagcaacaguauacacuggaucagcagacuucgcaccaaaauuaggaagaguacaauucgaaacagauacagaucaugauuuugaagcaaaccaaaacacuaaauuuacucccguaggcguuauacaagacgguucaacaacacauagaaacgaaccacaacaauggguacuaccaaguuauuccggacgaaacacacauaacguacauuuagccccugcagucgccccaacauuuccuggagaacaacuacuauucuuuagauccacaaugccaggauguucuggauauccaaauauggaucuugauugcuuacucccccaagaauggguacaguacuuuuaucaagaagcugcaccagcccaaucugacguagcauuacuacguuucgucaauccagauacuggaagaguucuuuucgaaugcaaacuacacaaaucuggauauguaacuguagcacauacaggacaacacgauuuaguaauaccuccaaauggauauuuucgauucgauucauggguuaaucaauucuacacauuagcaccaaugggcaauggagccggcagaagaagauaa

SEQ ID NO: 34175 - RNA, 1617 nt, Artificial Sequence
  derived and/or modified sequence opt6 from VP1__Norovirus_and/or_Norovirus-like__KX354015
augaaaauggcaucaucagacgcaucaccauccgauggaucagcagcaaaccuagucccagaaguaaauaaugaaguaauggcacuugaaccaguaguaggagcagcaaucgcagcaccuguagcaggacaacaaaauguaauagauccauggauaagaaacaacuucguacaagcaccaggcggagaauuuacuguuucaccacgcaaugcaccaggagaaauauuauggucagccccacucggaccagauuuaaauccauauuuaagucaccuugcucgaauguacaaugguuaugcuggaggauuugaaguacaaguaauauuagccggaaaugcauuuaccgcaggcaaaguaauauucgcagcaguuccaccuaauuucccaacagaaggucuaucaccaucucaaguuacaauguuuccccacauuguaguagauguuagacaauuagaaccaguacuaauuccacuucccgacguuagaaacaacuucuaucacuacaaucaaucuaacgauccaacaaucaaauuaauagcaauguuauacacaccauuaagagccaauaaugcgggugacgacguuuuuaccguaucaugcagaguuuuaacacgaccaucuccagacuucgacuucauauuuuuaguaccaccaaccguagaaucccguacaaaaccauuuuccguaccugucuuaacagucgaagaaaugacaaauuccagauuuccuauaccacuagaaaaacuauuuacagguccaucaucggcauuuguaguacaaccacaaaacggaagauguacuacagacggcguauuacuaggaacaacacaacugucacccgucaauaucugcaccuuuagaggagauguaacacauaucacuggaagcagaaauuacacuaugaauuuagcuucucaaaacuggaauaauuacgauccuaccgaagaaauaccagcaccucuaggaacuccugacuuuguaggaaaaauucaaggaguacuuacccaaacuacacgaacagauggaucgacacgaggacauaaagcuacaguauacacaggauccgcagacuuugcaccaaaacuaggaagaguccaauuugaaaccgauacugaucacgauuuugaggccaaucaaaauaccaaauucacaccaguaggaguaauacaagauggaucaacaacacauagaaaugaaccucaacaauggguuuuaccaucauauucuggaagaaacacacauaacguacaucuagcaccagcagucgcaccaaccuuuccaggagaacaauuacuauucuuuagaucaacaaugccaggaugcucaggauauccaaauauggauuuagacugcuuauuaccacaagacuggguacaauacuuuuaucaagaagcugcaccagcacaaucagacguagcauuacuacgauuuguaaauccugacaccggcagaguacuauuugaaugcaaacuacauaaaaguggguauguaacaguagcacauacaggacaacacgauuuaguaauuccaccaaauggauauuuccgcuucgacagcuggguaaaccaauuuuauacuuuagcacccaugggaaauggcgcagguagaagaagauaa

SEQ ID NO: 34176 - RNA, 1617 nt, Artificial Sequence
  derived and/or modified sequence opt6 from VP1__Norovirus_and/or_Norovirus-like__KX353999
augaaaauggcauccucugacgcaaauccaucagauggaucaacagcaaacuuaguaccagaaguuaauaaugaaguuauggcacuagaaccagucgucggagcagccauagcagcuccaguagccggccaacaaaaugucauugacccauggauaagaaauaacuuuguccaagcacccggaggugaauuuacaguuucaccaagaaaugccccaggagaaauauuauggucagcaccccuuggaccagauuuaaauccauaucuaucacaccucgcacgaauguauaacggauacgccgguggauuugaaguacaaguaauuuuagcagguaaugcauuuacagcaggaaaaaucauauuugcagcaguucccccuaauuuucccacugaaggcuuauccccuagucaaguuacuauguucccccacauaauaguagauguacgacaacuagaaccaguauuaaucccacuuccagacguaagaaacaauuucuaucauuauaaccaaagcaaugacccaaccauuaaauuaauagcaauguuauacacaccuuuaagagcaaacaacgcaggagaugauguuuucacaguauccuguagaguacuaacucgucccuccccagauuuugauuuuauauuucuaguacccccaacaguagaaucaagaacaaaaccauucucuguuccaauuuuaaccgucgaagaaaugacaaauucucgcuuuccuauaccccuagaaaaacuauuuaccggccccucaucugcuuucguuguacaaccacaaaauggccgauguacaacagacggaguauuauuagguacaacacaauuaagcccaguaaauauaugcacauuuagaggagauguaacacauauaucuggcucaagaaacuauacaaugaaucuagcuucacaaaacuggaacucauacgaccccacagaagaaauaccagcaccucuugguacaccagacuuuguaggaaaaauacaaggcguauuaacacaaacaacaucaacagacggcaguacaagaggucacaaagccacuguauauacuggcucggcagacuuuucacccaaauuaggaagaguacaauuugcaacagauaccgauaacgauuucgaaacaaaucaaaauacaaaauuuacacccguuggaguaauacaagacgguggcacuacacaccguaacgaaccacaacaguggguacuaccaucauacucaggucgaaauauacauaacguacacuuagcaccagcaguagcacccacauuuccaggagaacaauuauuauucuucagaucaacaaugccaggaugcucagguuauccuaacauggauuuagauugcuuguuaccacaagaauggguacaauacuucuaucaagaagccgcaccagcucaaucagacguagcccuacuaagauucguaaacccagacacaggaagaguacuuuucgaaugcaaauuacacaaaucagguuacgucacagucgcacacaccggacaacacgaccuagucaucccaccaaauggauacuuucguuuugauucauggguaaaccaauucuauacuuuagcuccaaugggaaauggaaccggacgaagacgauaa

SEQ ID NO: 34177 - RNA, 1617 nt, Artificial Sequence
  derived and/or modified sequence opt6 from VP1__Norovirus_and/or_Norovirus-like__KX353987
augaaaauggcauccucugacgcaaauccuuccgauggaagcacagcaaacuuaguaccagaaguaaacaaugaaguuauggcacuagaaccaguaguuggagcugccauagcagcaccaguagcaggacaacaaaaugugaucgauccauggauacgaucaaacuuuguccaagcaccugguggagaauuuacuguuagcccaagaaaugcacccggagaaauauuauggucagcaccacucgguccagaccuaaaccccuaccuaucacacuuagccagaauguauaauggauacgcaggaggauucgaaguacaaguaauauuagccggaaacgccuuuacagccggaaaaauaaucuuugcagccguaccucccaauuuuccaacagaaggauuauccccaucucaaguuacaauguucccacacauaaucguugauguuagacaacuagaacccguacuuauaccacuaccugacgucagaaauaauuucuaucauuauaaccaauccaaugacucaacaauaaaauuaauagcaauguuauauacaccacuaagagcaaauaacgccggagacgaugucuuuacaguuucaugccgaguacuuacaagaccaucaccagauuuugacuuuauauuucuaguaccaccaacaguagaaucacgcacuaaaccuuuuaguguaccagucuuaacaguugaagaaaugacaaacucaagauucccaauaccauuagaaaaacuauuuaccggaccaucaagugcauucguaguacaaccacaaaauggaagauguacuacagacggaguucuacuagguaccacucaauuaucaccaguaaauaucuguacauuccgaggagacguuacucacauaucaggcagccauaauuauacaaugaaucuagcaucacaaaauuggaacucauacgauccaaccgaagaaauaccugcaccccuaggaacaccagauuucguagguaaaauucaagguguauuaacacaaacaacuaaaacaaauggauccacuagaggucacaaagcuacuguauauaccgguucagcagauuuuucaccuaaacuaggucgaguccaauucgcaacugauacagacaaugacuucgaaacaaaccaaaacacuaaauucaccccaguagguguaauacaagacgguucaacaacuccacgaaaugaaccucaacaauggguauuaccaagcuauucagguagaaacacacauaacguacacuuagcccccgcuguagcaccuacauuuccaggcgaacaauuacuauucuuccgaucaacuaugccaggaugcucaggauacccaaacauggacuuagauugccuacuaccucaagaauggguucaauauuucuaucaagaagcugcaccagcacaaucagacguagcacuauuaagauuuguuaacccugacacaggacgaguuuuauuugaaugcaaacuacacaaaucaggauauguaacuguugcacacacaggacaacaugauuuaguuaucccucccaacggcuacuuccgauuugauucuuggguaaaccaauuuuauacacuugcaccaaugggaaauggaacaggucgaagaagauaa

SEQ ID NO: 34178 - RNA, 1617 nt, Artificial Sequence
  derived and/or modified sequence opt6 from VP1__Norovirus_and/or_Norovirus-like__KX353970
augaaaauggcaaguucagacgcuaauccaucagacggaucaacagcuaaccuagucccagaaguuaauaaugaaguaauggcauuagaaccuguaguaggagccgcaaucgcagccccagucgcaggacaacaaaacguaauagauccauggauucgcaacaauuuuguacaagcaccuggaggagaauuuacaguaagcccaagaaaugcaccaggagaaauacucuggucagcaccacuaggaccagauuuaaacccauacuuaucacaucuugcaagaauguacaacggcuacgccggaggauucgaaguacaaguaauacuagcaggaaaugcauuuaccgccggcaaaauaauauucgcagcaguacccccaaacuuuccaacugaagguuuaucaccaucacaaguaacuauguucccucacauaauaguagacguaagacaauuagaaccaguucuaauaccacuaccagauguuagaaacaacuucuaucauuauaaucaaucaaaugaucccacaauaaaacuaauagcaaugcuauauacaccacuaagagcaaacaacgcaggagacgauguauuuaccgucucaugucgaguauuaacacgaccaucaccugauuuugacuuuaucuuucuaguacccccaacaguagaaucacgaacaaaaccuuucucagucccuguauuaacaguagaagaaaugacaaacuccagauucccuauuccauuagaaaaacucuuuacaggacccucuucagcauucguuguacaaccucaaaacggaagauguacaacugauggaguacuacuaggcaccacacaacuaucaccuguaaacaucuguacuuuucgaggugauguuacccacaucucaggcucacgaaauuauacuaugaaucuagccagucaaaacuggaacucauacgauccaacagaagaaaucccagcaccacuaggaacuccagauuuuguaggaaaaauacaaggaguacuaacucaaacaacaagaacaaacggaagcacaagaggacacaaagcaacuguauacacaggaucagcagacuuuuccccaaaacucgguagaguacaauucgcaacagacacagacaacgauuucgaaacuaaucaaaauacaaaauucacaccaguugguguaauacaagacggaagcaccacaccuagaaaugaaccacaacaauggguauuaccuucauauucaggaagaaacacacauaauguucaccuagccccugcaguugcacccacauuuccuggagaacagcuccuauucuuuagaucuacaaugccaggaugcucaggauaucccaauauggauuuagacugccuacucccacaagaauggguacaauauuucuaucaagaagcagcaccagcacagucagauguugccuuauuaagauucguuaacccggacaccggaagaguacuauucgaauguaaacuacauaaauccggauaugucacaguagcacacacaggucaauaugacuuaguaauaccacccaacggauauuucagauucgauucuuggguaaaucaauuuuauacauuagccccaaugggaaauggcacuggccgaagaagguaa

SEQ ID NO: 34179 - RNA, 1617 nt, Artificial Sequence
  derived and/or modified sequence opt6 from VP1__Norovirus_and/or_Norovirus-like__KU985156
augaaaauggcaagcucagacgcaaauccuuccgaugguuccgcagcaaauuuaguaccagaaguaaauaaugaaguaauggcauuagaaccaguaguaggagcagcaaucgcugcaccaguugccggucaacaaaauguuauagauccauggauaagaaauaacuuuguacaagcuccaggaggagaauuuacugugucaccacgaaaugcaccaggagaaauccuauggucagcuccacucgguccugaucuuaacccauauuuaucccaucuagcacgaauguauaauggauacgcaggaggauuugaaguacaaguuauccuagcagguaaugcauuuacagcaggaaaaguaauauucgcagcuguaccaccaaacuuuccaacagaaggacuuucuccaucucaagugaccauguuuccacauauuguaguagacguaagacaauuagaaccggucuuaauaccauuaccagaugucagaaauaacuuuuaucacuauaaucaaucaaacgacccaacaauaaaacuaauagcaaugcucuacacaccauuaagagccaauaaugccggagacgaugucuuuacaguaucauguagaguucuaacacgaccaucacccgacuuugacuuuauuuucuuaguaccuccaacaguagaaucuagaacaaaaccauuuucaguaccuguauuaacuguagaagaaaugacaaauucccgauuuccuauaccucuugaaaaauuguuuacaggacccucuucagcuuucgucguacaaccacaaaacggacguugcacuaccgaugguguccuacuagguacaacacaauuaucaccaguaaauauauguacauuucgaggagaugucacacauauuacaggaucaagaaauuauacaaugaaccuagcaucacaaaauuggaauaacuaugacccaacagaagaaauaccagcgccgcuagguacaccagauuucgugggaaaaauacaagguguucuaacacaaacuacacgaacagauggcucaaccagaggacacaaagcaaccguauauacaggaucagcagauuuugcaccgaaacuugguagaguucaauuugaaacagauacagaucaugacuuugaagccaaccaaaauaccaaauucacaccaguuggugucauucaagacggaggaaccacucauagaaaugaaccacaacaauggguacuaccaucauauucuggaaggaauacccauaacguacauuuagcaccagcagucgcaccaacauucccaggagaacaauuacuauucuuccgaucaacaaugccaggaugcucugguuacccuaauauggaccucgauugcuuauuaccacaagaauggguacaauacuuuuaucaagaagccgcaccagcacaaucagauguugcacuauuaagauuugucaacccagauacaggacgaguguuauuugaauguaaacuacauaaaucaggauacguaacaguagcacauacaggacaacacgauuuaguuaucccaccuaauggauauuuuagauuugacaguuggguaaaucaauuuuacacucuagcaccaaugggaaauggaacuggaagaagaagauaa

SEQ ID NO: 34180 - RNA, 1617 nt, Artificial Sequence
  derived and/or modified sequence opt6 from VP1__Norovirus_and/or_Norovirus-like__KU985155
augaaaauggccucuucagaugcaaauccaucagaugguagcgcagccaaccuaguaccagaaguuaauaaugaaguaauggcucuagaaccaguuguaggagcagcaaucgccgccccagucgccggccaacaaaauguuauagacccauggauaagaaacaacuuuguacaagcaccaggaggcgaauuuaccguaucaccaagaaaugccccaggagaaauacuauggucagcaccucuaggaccagaccuaaacccuuacuuaagucacuuagcaagaauguauaauggauacgcaggaggauucgaaguucaaguaauacuugcaggaaacgcauuuaccgcagguaaagucauauuugcagcaguuccaccuaacuuuccaacagaaggacuaucaccaucccaaguaacaauguuuccccacauuguagucgacgucagacaacuagaaccuguacuaaucccuuuaccugauguacgcaauaauuucuaucauuauaaucaaucaaaugaccccacaauuaaauuaauagcaaugcuauacacuccauuacgagcaaauaaugcuggcgacgauguauuuacagucucaugcagaguccuuacuagacccucaccagauuuugacuuuauauuucuaguaccaccaacaguagaaucacgcacuaaaccauuuucuguacccguacuaaccguagaagaaaugacaaauucacgauucccaauaccgcuugaaaaauuauuuacaggcccaucauccgcuuucguaguacaaccccaaaacggcagaugcacaacugacggaguacuauuaggaacaacacaauuaucaccaguaaauauauguacauuucgcggagacguuacacacauaacaggcucccgaaauuauacaaugaaccucgcaucucaaaauuggaacaauuaugauccaacugaagaaaucccagcaccuuuaggcacuccagauuuuguaggaaaaauucaaggaguauuaacacaaaccacacgaacagaugguucaacacgaggacauaaagccacuguauauacugguucugcugauuuugcacccaaacuaggcagaguacaauuugaaaccgauacugaucacgacuucgaaguuaaccaaaauacaaaauuuacaccaguaggaguuauacaagaugguggcacaacacauagaaaugaaccccaacaauggguuuuaccaucauacucuggaagaaacacccauaacguacaucucgccccugcaguagcaccgacauuuccaggcgaacaauuauuauucuucagaucaacaaugccaggauguucaggauauccaaauauggaucuagacugccuauuaccacaagaauggguacaauacuucuaucaagaagcagcaccagcacaauccgauguugcauuauuaagauuuguaaauccugauacuggccguguacuauuugaaugcaaauuacacaaaccaggauauguuacagucgcgcacacaggacaacaugauuuaguuauaccaccaaauggauacuuucgauucgauucauggguaaaucaauucuauacacuagcaccaaugggcaacggaaccggaagaagacgauaa

SEQ ID NO: 34181 - RNA, 1617 nt, Artificial Sequence
  derived and/or modified sequence opt6 from VP1__Norovirus_and/or_Norovirus-like__KM514075
augaaaauggcaucaucagacgcaaauccauccgauggauccgcagcaaacuuaguacccgaaguaaacaacgaaguaauggcauuagaaccaguaguaggugcagcaaucgcugcaccaguagcuggccaacaaaauguaauagauccuuggauccgaaauaacuuuguacaagccccaggaggugaauuuacaguaagucccagaaaugcaccaggagaaaucuuauggucagcaccauuaggaccugauuuaaauccauaucuaucucaucuagcaagaauguauaacggauacgccggaggauucgaaguacaagucauacuugcuggaaaugcguuuacagccggaaaaguaauuuuugcagcaguuccaccuaacuuuccuacagaagggcuaucaccaucacaaguaacaauguucccucauauaguaguagacguacgacaauuagaaccuguccuaaucccauuaccagauguccgcaacaauuuuuaucacuauaaucaaucaaaugauccaacuaucaaacuaauagcaaugcuauauacaccuuuaagagcaaauaaugcaggcgaugacguauuuacaguaucauguagaguauuaaccagaccuucuccagacuucgauuuuauauuuuuaguuccaccuacaguugaaaguagaacaaaaccauucucagucccaguucuaacuguagaagaaaugacaaauucacgauucccaauaccuuuagaaaaacuauuuacagguccauccucagcauuuguaguacaaccacaaaacggacgauguacaaccgauggaguuuuacuaggaacaacacaauuauccccaguaaauauaugcacuuucagaggcgauguuacacauaucacaggaagucacaacuacacaaugaauuuagcaucacaaaauuggucaaauuacgauccaacagaagaaauaccugcuccguuaggaacaccagauuuuguuggaaaaauacaaggaguacuaacucaaaccacacgaacagacggaucuacaagaggucacaaagcaacuguuuauacaggaucagcagauuuugcaccaaaauuaggacguguucaauuugaaacagauacagauagagauuuugaagcaaaucaaaauacaaaauuuacaccuguuggcguaauccaggacggagguacuacccauagaaaugaaccacaacaauggguauuaccuucauauucuggacgcaauacuccaaauguccaccuugcaccagccguagcaccaacuuuucccggugaacaauuacuauucuuuagaucaacaaugccaggaugcucaggauaucccaauauggaccuugauugccuucuaccacaagaauggguacaauauuuuuaucaagaagcugcaccagcacaaucagauguugcauuauuaagauuuguaaauccagacacaggacgaguacuauucgaauguaaauuacauaagucaggauauguaacaguagcacacaccggacaacacgaccuuguaauuccaccaaauggauauuuucgauuugauucauggguaaaucaauuuuauacucuugccccaaugggcaacggaacagguagaaggcgcuga

SEQ ID NO: 34182 - RNA, 1617 nt, Artificial Sequence
  derived and/or modified sequence opt6 from VP1__Norovirus_and/or_Norovirus-like__AB972484
augaaaauggcaucaucagaugccaauccaucugacggaucugcagcaaaccuaguaccagaaguaaauaaugaaguaauggcacuagaaccagucguuggugccgccauagcagcacccguagcuggacaacaaaauguaauugauccuuggauacgaaauaauuuuguacaagcaccaggcggagaauuuacaguaucucccaggaacgcacccggagaaauacuuuggucugcaccacuaggcccagauuuaaauccauauuuaagccaucuagcacgaauguacaauggauaugcaggaggauuugaaguacaaguuauacuagcaggcaaugcauuuacagcaggaaaaguaauauucgcagcaguaccaccaaauuuuccuacugaaggauuaucucccucacaaguaacaauguucccucauauugucguagauguucgucaauuagaaccuguucuuauaccacuacccgauguaagaaauaauuucuaucauuacaaccaaagcaaugaucccacaauaaaauuaauugcaauguuauauacuccauuaagagccaacaaugcaggcgaugauguauucacaguaucaugcagaguucuaacaagaccauccccagacuuugauuuuauuuuucuuguaccaccaacaguagaaucaagaacuaaaccauuuucugucccaguauuaaccguugaagaaaugacaaacucucgauuuccaauaccucuugaaaaacuauuuacugguccaucaucagcauuugugguacaaccacaaaacggcagauguaccacagacgguguauuacuaggaaccacucaacuuucaccagucaauaucugcaccuuucgcggagacguaacacauaucacugguucaagaaauuauacaaugaauuuagcaucacaaaauuggaauaauuacgaccccacagaagaaauaccagcaccauuagguacuccagacuucguaggcaaaauacaaggaguauuaacacaaacaacaagaacugacggcucaacuagaggacauaaagccaccgucuauacagguucagcagacuucgccccaaaacuaggaagaguucaauucgaaacagacaccgaucaugacuuugaagccaaccaaaauacaaaauucaccccaguagguguaauucaagacggaggaacaacccauagaaaugaaccgcaacaauggguucuaccaaguuacuccggaagagauacacauaauguacaccuagcaccagccgucgcaccaacauuuccaggagaacaacuacuauuuuucagauccacaaugccaggcugcagugguuacccaaauauggauuuagacugucuacuaccacaagaguggguacaauauuuuuaucaagaagccgcaccagcacaauccgacguagccuuacuaagauuuguaaaucccgacacuggacgcguauuauucgaauguaaacuucauaaaucaggauauguuacaguagcacacacuggucaacaugaccuaguaauacccccaaaugguuauuuuagauucgauagcuggguaaaucaauucuacacauuagcaccaaugggaaacgguacaggacgcagacgauaa

SEQ ID NO: 34183 - RNA, 1617 nt, Artificial Sequence
  derived and/or modified sequence opt6 from VP1__Norovirus_and/or_Norovirus-like__KT780391
augaagauggcaucaagugacgcaaacccuucagauggaucagccgcuaauuuaguuccugaaguuaacaacgaaguaauggcuuuagaaccaguaguuggagcagcaauagcagcaccagucgcuggacaacaaaauguaaucgauccauggauuagaaauaauuuuguccaagcaccaggaggugaguucacuguuucaccaagaaaugcaccuggagaaauacuauggucugcaccuuuaggaccugaucuaaauccauauuuaucacaucuugcaagaauguauaacggcuacgcaggaggauuugaaguucaaguaauacuagcaggaaacgccuucacagccggaaaaguaauauucgcagcagugccaccaaacuuccccacagaaggauuaucaccaucacaaguaacuauguucccucauauaguaguagacguccgacaacuagaaccaguacuaauaccauuaccugauguaagaaacaacuucuaucacuauaaccaauccaacgauccaacaauuaaauuaauagcaaugcuauacacuccauuacgagcaaacaacgcuggugacgaugucuuuacuguaucaugcagaguauuaacacgaccuucuccagauuuugacuucauauuccuaguacccccaacagucgaaucaagaacuaaaccauuuucaguaccuguacuaacaguagaagaaaugacaaauucaagauuuccaauuccccuagaaaaacuauuuacaggucccucuucagcauucgucguacaaccacaaaacggaagauguacaaccgauggaguauuauuaggaacaacacaacuuaguccaguaaacauuuguacauuuagaggcgacgucacucauauaaccggaaguagaaauuacaccaugaaucuagcaucacaaaauuggaacaauuaugacccuacagaagaaaucccagcaccacucgguacaccagauuucguaggaaaaauacaaggaguucuaacacaaacaacucgaacagacgguucaacgagaggucauaaagcaacuguuuauacaggcucagccgauuuuucaccaaaacucggcagaguacaauucgaaacagacacugaucaugacuucgaagcaaaucaaaauaccaaauucacaccaguaggaguaauacaagacggagguacaacacaccguaaugaaccacaacaauggguuuuaccuaguuauuccggacgaaacacacccaauguacaucuugcaccagcaguagcaccaacauuucccggugaacaauuacuauucuucagauccacuaugccuggaugcucaggauauccaaacauggacuuagauugcuuacucccacaagaauggguucaauauuucuaucaagaagcagcaccagcgcaaagugauguagcacuauuaagauucguaaauccugacacuggaagaguauuauuugaaugcaaauuacauaaaucaggcuacguaacaguagcacacacaggacaacacgauuuaguaauaccuccaaauggauacuucagauucgacucauggguaaaccaauuuuacacacuugcuccaaugggaaaugguacaggaagacgcagauaa

SEQ ID NO: 34184 - RNA, 1617 nt, Artificial Sequence
  derived and/or modified sequence opt6 from VP1__Norovirus_and/or_Norovirus-like__KT780390
augaaaauggccaguucagacgcaaauccaagugauggaucagcagccaauuuaguaccagaaguuaauaaugaaguaauggcacuugaaccuguuguaggagccgcaauagcagccccaguagccggacaacaaaacguaauugauccauggauaagaaauaacuucguacaagcaccuggcggagaguucaccguaucgccccgcaacgcaccuggcgaaauauuaugguccgcaccucuagguccagaucuaaauccauaccuaucacaccuagcaagaauguacaacggauacgccggugguuucgaaguacaagucauucuagcaggaaaugcauucacagcagguaaaguaaucuucgcugcaguaccucccaacuuuccaacagaagguuuaagcccaucgcaaguaacaauguucccacauauaguaguagacguuagacaauuagaaccaguacuaauaccucuaccagaugucagaaacaauuucuaucauuauaaucaauccaaugaucccacaauaaaauuaauugccaugcuauacacuccacuaagagcaaacaacgcaggagacgaugucuuuacaguaucaugccgaguauuaacacgaccaucaccagauuuugauuuuauauuucuagucccacccacaguagaaucaagaacaaaacccuuuuccguaccaguacuaacaguagaagaaaugacaaacucacgcuuuccaauaccacuugaaaaacuauucacaggaccaucaucagcauuugucguacaaccacaaaacgguagauguaccacagaugguguacuacucgguacaacacaauuaucaccuguaaauaucuguacauucagaggugacguuacacauaccacaggaucucauaauuacacaaugaaccuagcuucacaaaauuggucaaauuacgacccaacagaagaaauaccagcuccauuaggaacaccagacuucguaggaaaaauacaaggaguauuaacacaaaccacaagaacagacgguucaaccagaggacacaaagcaacaguauauaccggaucagcagauuuugcuccuaaauuaggaagaguacaauucgaaacagauacagaucacgacuuagaagccaaucaaaacacaaaauucacacccguaggaguaauccaagacgguggagcaacacaucgcaaugaaccacaacaauggguauuaccaucauauuccggacgaaacacaccaaauguccacuuagcuccugcaguagccccgacauucccaggugaacaacuauuauucuuccgaucaaccaugccaggaugcucuggauauccaaauauggaucuagauugcuuacuaccucaagaauggguacaauacuucuaucaagaagcugcccccgcacaaucagacguagcauuacuaagauucguaaauccagacacugguagaguacuauucgaaugcaaauuacauaaaucuggauauguaacuguagcucauacaggacaacacgaucuaguuauaccuccaaacggauauuuuagauuugauuccuggguaaaucaauuuuacacauuagcuccaaugggaaauggcacuggaaggagacgauaa

SEQ ID NO: 34185 - RNA, 1617 nt, Artificial Sequence
  derived and/or modified sequence opt6 from VP1__Norovirus_and/or_Norovirus-like__KT780376
augaaaauggcaucauccgaugcaaauccaucagauggaucagcagcuaacuuaguccccgaaguaaacaaugaaguacuagcauuagaaccuguaguaggugcugcaaucgcagcaccaguagccggacaacaaaauguaauagacccauggauuagaaacaauuuuguccaagcaccuggaggagaauuuaccguuucaccaagaaacgcaccuggggaaauacuauggucugcaccucuaggaccugauuuaaaucccuacuuaucccaccuagcaagaauguacaacggauaugcaggagguuucgaaguacaaguaauauuagcaggaaacgcauucacagcaggaaaaguaauauuugccgcagucccaccaaacuuuccaacugaaggauuaucuccuucacaaguaacaauguucccacacauugucgucgacgucagacaauuagaaccaguacuaauaccacucccagauguucguaauaauuucuaucauuacaaucaaucaaacgauccaacaauaaaauuaauagcaauguuauauacaccacuuagagcaaacaaugcaggagaugacguauuuacagucucuuguagaguacuaaccagaccaucaccagauuucgacuuuaucuuucuaguaccaccaacaguugaaucucgaacaaaaccauuuagcgucccuguacuaacaguugaagaaaugacaaauucacgauuuccaauuccacuugaaaaacuauuuaccgguccauccucagcauucguuguacaaccacaaaacggcagauguacaacagacggaguccuguuagggacaacacaacuuucaccuguaaauauauguacauuucgaggcgacguuacccauauaacagguucacacaacuauaccaugaauuuagcuucacaaaacuggagcaacuacgauccaacugaagaaauuccagcuccacuaggaacaccagauuucguaggaaaaauucaaggcguacuaacacaaacaacucgaacugauggauccacaagaggacauaaagccacaguauacaccggaucagcagacuuugcaccaaaacuaggaagaguacaauucgaaacagauacaaaccacgauuuugaagccaaucaaaauacuaaauuuacaccaguaggaguuauccaagacggaaguacaacccaccgaaacgaaccucaacaauggguacucccaucauauagcggaagaaacaccccaaauguccaucuugcccccgcaguagcaccaacauucccaggagaacaacuauuauucuuuagaucaacaaugcccggauguucaggauauccuaauauggaucuagauuguuuacuaccucaggaauggguacaauauuucuaucaagaagcagccccagcucaaucugacguagcccuucucagauucguuaauccagacacuggacgaguccucuucgaaugcaaacuacauaaaucaggauacguaacagucgcacauacaggucaacacgaccuaguaauuccaccaaauggauauuuuagauuugauucauggguaaaucaauuuuacacucuagcaccaaugggcaacggaacaggaagacgaagauaa

SEQ ID NO: 34186 - RNA, 1617 nt, Artificial Sequence
  derived and/or modified sequence opt6 from VP1__Norovirus_and/or_Norovirus-like__KT780375
augaaaauggcauccucagacgcaaacccuucagauggaucagcagccaacuuaguacccgaaguuaacaacgaaguaauggccuuagaaccaguagucggagcagcaauagcagcuccaguagcaggccaacaaaacguaaucgaucccuggauacgaaacaauuuuguucaagcaccaggaggagaauuuaccguuagucccagaaaugcaccaggagaaauacuuuggucugcaccacuuggaccagaucuaaaucccuauuuaucccacuuagcuagaauguacaacggauacgcaggaggauuugaaguacaaguaauacuagcaggaaaugcauuuacagcaggaaaaguaauuuucgcagcuguaccaccaaacuucccaacagaaggauugucaccaucacaaguaacaauguucccacauauuguaguugauguaagacaacuagaaccaguucuaauuccuuuaccagacguccgcaacaacuuuuaucauuauaaccaaucaaaugauccaacaauaaaguuaauugcuaugcuauacacaccccuaagagccaacaaugcaggagaugauguauuuacaguuucauguagaguauuaacuagaccaucacccgauuuugauuucauuuuucuuguaccuccuaccguagaaucaagaacaaaaccuuuuucaguccccauucucacaguagaagaaaugaccaacucucgauucccaauaccuuuagaaaaauuauuuacaggcccauccucagcuuuuguuguacaaccacaaaauggaagauguacaaccgacgguguacuacucggaacaacacaauuaucuccagucaacauauguaccuuuagaggugauaucacacacauaacuggaucaagaaauuacacuaugaaucucgcaucacaaaacugguccaauuacgaucccacagaagaaauacccgcacccuuaggaaccccugacuuuguaggaaaaauacaagguguacuaacccaaacaacaagaacugauggcuccacuagaggucacaaagccacaguauauacaggcucagcagauuucgcacccaaacuaggaagaguacaauuugaaacagacacugaucaugacuuugaagcaaaucaaaauacuaaauuuacuccagucggcgugauccaagacggcuccacuacacauagaaaugaaccacaacaauggguacuaccaucauauucaggcagaaauaccccaaacguacaccuagcacccgcaguagccccaacauuuccuggagaacaauuauuauucuucagaucaacaaugcccggauguucuggauacccuaauauggacuuagauugccuacucccacaagaauggguacaauacuucuaucaagaagccgcaccagcacaaucagacgucgcccuacuacguuuuguaaauccugauacaggaagaguccuuuuugaaugcaaauuacacaaaucaggauacguaacaguagcacauaccggccaacacgaccuuguaaucccaccaaauggauacuucagauuugacucauggguaaaucaauuuuauacacuagcaccaauggguaacggaacuggacgaagacgauaa

SEQ ID NO: 34187 - RNA, 1617 nt, Artificial Sequence
  derived and/or modified sequence opt6 from VP1__Norovirus_and/or_Norovirus-like__LC016607
augaaaauggcuucaaaugacgccucaccaucagauggcucaacagcaaauuuaguaccagaaguuaauaaugaaguaauggcccuagaaccaguaguuggagcagcaauagcugcaccaguagcaggacaacaaaauguaauagacccuuggauaagaaacaauuuuguucaagcacccggcggagaauuuacaguaagcccuagaaaugcuccaggagaaauacuauggucugcaccacuaggccccgaucuaaaucccuaucuaucucacuuagccagaauguauaacggauaugcuggaggauucgaaguccaaguaauauuagcugguaacgcauucaccgcaggaaaaauaauauucgcagcaguaccucccaauuucccuacagaaggauuaaguccaucacaaguuacaauguuuccucauauaauaguugaugucagacaacuagaaccaguuuuaauaccauuacccgauguccgaaauaauuucuaccauuauaaccaauccaaugacucaacaauuaaauuaauagcaaugcuauacacaccacuccgagcaaacaacgcuggugaugauguauuuacaguaagcuguagaguucuaaccagaccuucaccagacuuugacuucauauuuuuagucccaccaacuguagaauccagaacaaaaccauuuaccgucccaauauuaacaguagaagaaaugacaaauucuagauucccaauaccacuugaaaaacuauucacaggaccaagcucagcauuuguaguacaaccucaaaacggcagaugcaccacugacggaguacuacucgggacaacacaacuaucuccaguuaacauaugcacauuuagaggcgacgucacacacauaccaaauacacacacauacagaaugaaucuagcaucacaaaauuggaacaacuaugauccaacugaagaaauaccagcaccacuaggaaccccagauuuuguaggaaaaauacaaggaaugcuaacacaaacaacaaaaggagacggaucuacaagaggacauaaagccacuguaucaacagguaguguagacuucaccccgaaacuaggcucaguacaauucacgacagacacugacaacgauuucgaaacaggacaaaauacaagauuuacaccaguaggcguuauacaagacggaaacggcgcacaucgaaaugaaccccaacaauggguauuaccagacuauucuggaggaacaguacauaauguacaucuagcccccgcaguugccccaacauuuccaggugaacaacuauuauuuuucagaucaacaaugccagguuguucuggauauccaaacauggauuuagauuguuuacuaccucaagaauggguucaacauuuuuaccaagaagcagcacccgcucaaucagacguagcacuuuuaagauuuguuaacccagacaccggacgaguauuauucgaauguaaacuacauaaaacaggcuauguaacaguagcacauacuggacaacacgaccuaguuauaccaccaaauggauacuucagauucgacucauggguaaaucaauuuuacacauuagcaccaaugggcaacggcgcaggaagaagaagauaa

SEQ ID NO: 34188 - RNA, 1617 nt, Artificial Sequence
  derived and/or modified sequence opt6 from VP1__Norovirus_and/or_Norovirus-like__KP241915
augaaaauggcuucaagugacgccaauccaucugauggaucagcugcaaauuuaguaccugaaguaaauaaugaaguaauggcacuugaaccaguuguaggugcagccauagcagcuccaguagcaggacaacaaaacguuauugaccccuggauaagaaauaauuuuguucaagcuccaggaggagaauuuacaguaaguccccgaaaugcacccggugaaauacuauggucagccccuuuaggaccagaccucaauccauauuuaucacaccuagcaagaauguauaauggauacgcaggaggauuugaaguacaaguuauacuagccgguaaugcauucacagcuggcaagguaauauuugcagcagucccaccaaauuuuccaaccgaaggccuaucaccaucucaaguaaccauguuuccacauaucguaguugauguaagacaauuagaaccaguucucaucccacuaccugauguuagaaauaauuucuaccacuauaaccaauccaaugacccaacuauaaaauuaauagcaauguuauacacuccacuaagagcaaauaaugccggagacgauguauucacaguaucauguagaguuuuaacaagaccuucaccugacuuugauuucaucuuucuuguuccuccaacaguagaaucaagaaccaaaccauucucaguuccaguguuaacuguagaagaaaugacaaauucaagauuuccuauaccacuugaaaaacuauucacuggaccauccucugcauucguaguccaaccacaaaacggcagauguacaacagaugguguauuauuaggaaccacacaauuaucgcccguaaacauauguacauuuagaggagauguaacucauauaacaggaagucauaauuauacaaugaaccuagcaucacaaaacuggucaaauuaugauccaacagaagaaauuccugcaccacucgguacaccggacuucguagguaaaauacaaggcguauuaacacaaacaacaagagcagacgguaguacacggggacacaaagcuacuguauacacaggaucugcagacuuugcaccaaaauuaggaagaguccaauucgaaacagacacaaaucacgauuuugaagcaaaucaaaauacuaaauuuacaccuguaggugucauucaagacggaggcacaacacaucgaaacgaaccacaacaaugggucuuacccucauacucuggaagaaauacaccaaacguucaccuagcaccagcaguagcaccaaccuuuccaggagaacaauuauuauucuuuagaucuacaaugccuggauguucaggauauccaaauauggaucuugauugccuauuaccacaagaauggguccaauacuuuuaucaagaagcagcaccagcacaaucagaugucgcacuauuacguuuuguaaauccagauacaggaagaguacuuuuugaguguaaauuacauaaaucagguuauguaacgguugcccacacuggacaacaugaucuaguuauaccaccaaacggcuauuuuagauuugauucaugggucaaucaauuuuauacauuagcaccaaugggaaaugguacaggucgacguagauaa

SEQ ID NO: 34189 - RNA, 1617 nt, Artificial Sequence
  derived and/or modified sequence opt6 from VP1__Norovirus_and/or_Norovirus-like__KM514065
augaaaauggcuagcucugacgcgaacccaucagacgguucagccgcaaauuuagucccagaaguaaacaacgaaguuauggcauuggaaccagucguaggcgcagcaauagcagcaccuguagcaggccaacaaaacguaauagauccauggauaagaaauaauuuuguacaagcacccggaggagaguucacaguaucaccuagaaacgcacccggcgaaauacuauggucagcaccacuuggaccagaucuaaaccccuauuuaucacauuuagcacgaauguauaacggauaugcuggaggauuugaaguacaaguaauacuugcaggaaaugcauuuacagcaggaaaaguaauauuugcugccguaccaccaaacuucccaaccgaaggacuaucaccaucucaagucacaauguucccacacauaguaguugauguacgccaacucgaaccuguauuaauaccacucccagacguccgaaacaauuucuaccacuauaaccaaucaaaugacccaacuauaaaacuuauagcaauguuauauacuccacuacgcgcaaacaaugcaggagacgaugucuucacaguuucaugcagaguauuaacacgaccauccccagauuuugauuuuauauuccuuguuccaccuacaguagaaucaagaacaaaaccauucucaguaccaguauuaacuguugaagaaaugacaaauucacgauuuccaauaccccuugaaaaacuuuuuacagguccaucaucugcauuuguaguacaaccacaaaaugguagauguacuacugacggaguacuauuagguacaacacaacuaucaccagucaauaucugcacauuucgcggagauguaacacauauaacaggaucaagaaacuacacaaugaaucuagccucacaaaacuggucuaauuaugaucccacugaagaaauuccagcuccacuaggcacacccgacuuugucgguaaaauacaaggaguauuaacacaaaccacaagaacagauggaucaacacgaggucacaaagcuacaguauauacuggaagugcugguuucgcacccaaauuagguagagugcaauucgaaacugacacugaccacgauuuugaagcaaaccaaaauacaaaauuuacacccguaggcgucauacaagauggauccacuacacauagaaacgaaccccaacaaugggucuuaccaucauauucaggucgaaacaccccaaacguacaccuagcuccugcaguagccccaacguuuccaggagaacaacuacucuucuuuagaucaacaaugccaggauguucagguuauccaaauauggauuuagacugucuauuaccacaagaauggguacaauauuucuaucaagaagcagcaccagcacaaucagauguugcucuauuaagauuuguaaauccagauacaggaagaguacuauucgaaugcaaauuacauaaaucaggcuauguaacaguagcccauacaggacaacacgacuuaguaauaccuccaaacggauauuucagauuugauucauggguaaaucaauucuacaccuuagcuccaaugggaaacgguacaggcagaagaagauaa

SEQ ID NO: 34190 - RNA, 1617 nt, Artificial Sequence
  derived and/or modified sequence opt6 from VP1__Norovirus_and/or_Norovirus-like__KM268097
augaaaauggccucaucagaugcaaaccccucugauggcucugcagcaaaccuagucccagaagucaauaacgaaguaauggcucucgaacccguaguaggagcagcaauagcugcaccuguagcuggacaacaaaaugucauagauccauggauaagaaacaauuucguacaagcaccaggaggagaauuuacaguaucgccccgaaaugccccaggcgaaauauuauggucagcuccacuagguccagaucucaauccauacuuaucacacuuagcaagaauguauaauggauacgcaggagguuucgaaguacaaguaauacuugcaggaaaugcuuuuacagcaggaaaagucauuuuugcugcuguuccaccaaauuucccaacggaaggucuaucuccaucacaaguaacuauguuuccacacauuguaguagacguccgacaacuagaaccaguacuaauuccuuuaccagauguaagaaacaauuucuaucacuacaaccaaucaaaugacccgacaauaaaauuaauagccauguuauacacuccacuucgagcaaacaaugccggagacgauguuuuuacaguaucauguagaguucucacaagaccaucaccugacuuugacuucaucuucuuaguaccaccaacaguagaaucacgaacaaaaccauucucaguaccaguauuaaccguugaagaaaugacaaacucaagauuuccaauuccacuagaaaaacuauuuacaggucccucaucagcauucguuguacaaccccaaaauggaagauguacuacugauggcguauuacuaggaaccacacaauuaucaccaguuaauaucuguacuuucagaggcgacguuacacauauaacuggcucacacaauuacacuaugaaucuagcaucacaaaauuggaauaauuacgauccaacugaagaaauaccugccccucuaggaacaccagacuuuguuggcaaaauucaaggagucuuaacacaaacaacucgcacagacggcucaacaagaggacacaaagcaacaguauauacaggaucagcagacuuugcaccaaaacuuggaagaguacaauucgaaacagauacaaaucaugauuucgaagcaaaucaaaauacaaaauucaccccaguaggaguaauacaagaugguggaaccacacacagaaaugaaccacaacaauggguucucccaaguuacagcgguagaaacacuccaaacguacacuuagccccagcaguugcaccuacuuucccuggcgaacaacuuuuauucuuuagaucaacaaugccaggaugcucaggauaucccaacauggaucuagauugcuuacuaccacaagaauggguucaauauuuuuaucaagaagccgcacccgcacaaucugacguagcuuuauuacgauuuguaaacccugacacuggaagaguccuauuugaauguaaacuacauaaaucaggauauguaacaguagcacacacuggacaacaugaucuaguuaucccaccaaauggauauuucagauuugacucuuggguaaaucaauuuuacaccuuagcaccaaugggaaauggaacaggaagaagaagauaa

SEQ ID NO: 34191 - RNA, 1617 nt, Artificial Sequence
  derived and/or modified sequence opt6 from VP1__Norovirus_and/or_Norovirus-like__KM268084
augaaaauggcaucaucagacgcaaauccauccgauggaucagcagcaaaccuaguaccagaaguuaacaaugaaguaauggcacuugaaccagucgucggagccgcaauugcagccccuguugcaggacaacaaaauguuaucgauccauggauacgaaauaauuuuguacaagcaccaggaggagaauuuacaguaagcccaagaaacgcaccaggagaaauauuauggucagcaccacuugguccagaucuaaauccauaccuaucacauuuagcacguauguauaaugguuaugcaggaggcuucgaaguacaaguaauacuagccgguaacgcuuuuacagcaggaaaagucauuuucgcugcaguaccaccuaauuuuccaacagaaggcuuaucaccaucucaaguaacaauguucccucacauaguaguagacguacgacaacuagaaccuguauuaauaccucugccugauguaagaaacaauuuuuaucauuacaaucaaucaaaugauccaacaaucaaauuaauagcaauguuauauacuccacuaagagcaaacaaugcaggcgaugauguauucacaguuuccugucgaguauuagcuagaccauccccagacuuugacuuuauauuucuaguaccaccuacaguugaaucacgaaccaaaccauuuucaguacccgucuuaacugucgaagaaaugacaaacucacgauuuccaauaccacuugaaaaauuauuuacaggacccucuucagcauucgucguccagccucaaaauggaagauguacaacagauggaguuuuauuaggaacaacacaauuaucaccaguuaauauaugcacauucagaggagauguaacacauauuacaggaucucgaaauuacacaaugaauuuagcuucacaaaacuggucaaacuaugauccaacagaagaaaucccagcaccacuaggaacaccagauuucgucggaaaaauacaaggaguauuaacacaaacaacaaaaacagauggcucaacuagaggacacaaagccacaguauauacuggauccgcugauuuugcaccaaaacuaggacgaguacaauucgaaacagauacagaucacgacuucgaagcaaaucaaaacacaaaauucaccccuguagguguaauccaagacgguucaacaacacauagaaaugaaccacaacaauggguucugccaucauauucaggcagaaauacaccuaauguacaccuagccccagcaguagcaccaaccuucccaggcgaacaacuucuauucuuucgauccacuaugcccggaugcucaggauauccuaauauggaucuagauugcuuacuaccacaagaauggguucaauauuuuuaucaagaagcagcaccagcacaaagugacgucgcauuacuacgauucguaaacccagauacaggcagaguucuauucgaaugcaaacuacacaaaucaggauauguaacaguagcucauacuggccaacacgauuuaguaauaccaccaaauggauauuucagauucgauuccuggguaaaccaauuuuacacauuagcaccaaugggaaauggaacaggccgaagaagguaa

SEQ ID NO: 34192 - RNA, 1617 nt, Artificial Sequence
  derived and/or modified sequence opt6 from VP1__Norovirus_and/or_Norovirus-like__KJ649704
augaaaauggccucaucagacgcaaauccuucagauggaucagccgcaaacuuaguuccagaaguuaacaaugaaguauuagcuuuagaaccaguuguuggugcagcuauagcugcaccaguugccggccaacaaaacgucauagauccauggauacgcaauaauuuuguacaagcaccuggaggcgaauuuacaguaucaccaagaaaugcacccggagaaauacuuugguccgcaccucuaggaccagauuuaaacccauaccuaucccaccuagcuagaauguauaauggauaugccggcgguuuugaaguacaaguaauauuagcaggaaaugccuuuacugcaggaaaagucaucuucgcugcagucccaccuaauuuuccaacagaaggacuaucacccucucaaguaacaauguucccucauauuguuguagacgucagacaauuagaaccuguacuaauaccauuaccugauguaagaaacaauuucuaucacuauaaucaaucaaaugaucccacaauaaaacuaaucgcaauguuauauacuccauuacgugcaaacaaugcaggagaugacguauucaccguaucauguagaguauuaacaagaccaucaccagacuuugauuuuaucuucuuggucccuccaacaguagaaucucgcacaaaaccauuuucaguuccaguacuuacaguugaagaaaugacuaauucaagauucccuauaccacuugaaaaauuauuuacaggaccuuccuccgccuuugucguacaaccacaaaacggaagauguacuacagauggaguacuucucgguaccacucaauuaucaccaguaaacauauguacauuucgaggagacgucacacauauaaccggaucccacaauuauacuaugaaucuagcaucacaaaacuggaacaauuaugauccuacagaagaaauaccagcaccccuagguacaccagauuucguagguaaaauccaaggaguauuaacacaaacaacaagaacagacgguucaacuagaggacacaaagcuacaguuuauacuggcucagcagauuuuuccccaaaacuaggaagaauccaauucgaaaccgauacaaaucacgacuucgaagccaaucagaauacaaaauuuacaccuguaggaguaauacaagacggaggaaccacacaccgcaacgaaccacaacaauggguauuaccaucauauucuggucgaaauacacccaacguacacuuagcuccugcaguugcaccaacauuuccaggagaacaauuacuuuucuuuagaucaacaaugccaggaugcucaggauauccuaacauggaccucgauugccuuuuaccacaagaauggguacaauauuucuaucaagaagcagcaccagcucaaucugacguagcacuauuaagauuuguaaacccugacacaggcagaguacuuuuugaauguaaacuacauaaauccggauauguaacagucgcucacacaggucaacacgaucuagugauaccaccaaauggauauuucagauuugauagcuggguaaaucaauuuuauacuuuagcuccaauggguaauggaacuggccgaagaagauaa

SEQ ID NO: 34193 - RNA, 1617 nt, Artificial Sequence
  derived and/or modified sequence opt6 from VP1__Norovirus_and/or_Norovirus-like__KC577174
augaaaauggcuucuuccgaugcaaauccaucagauggaucaacugcgaaccuaguaccugaaguuaauaacgaaguaauggcacuagaaccgguuguuggugcagccaucgccgcaccaguugcuggacaacaaaauguaaucgacccauggauaagaaauaacuuuguacaagccccaggaggagaauuuacaguuaguccucgaaaugcacccggagaaauauuauggagcgcuccauugggucccgacuuaaacccauacuuaucacacuuggccagaauguauaauggauaugcuggaggauucgaaguccaaguuauacuagcagguaaugccuuuacagcagguaaaaucauuuucgcagcaguucccccaaauuuuccuacagaaggauuaucaccaucucaaguuacuauguucccucacauaauagucgacguucgacaacuagaaccagucuuaauuccacuaccugauguuagaaauaacuucuaucacuauaaccaauccaacgauucuacaauaaaauuaaucgcuaugcuauauacucccuuacgcgcaaacaacgcaggagaugacguauuuacaguuucauguagaguauuaaccagaccuucaccagauuuugauuucaucuuuuuaguacccccaaccguagaaucuagaacuaaaccauucucuguaccaguacuuacaguugaagaaaugacuaacucacgauuucccauaccauuagaaaaacuuuuuacaggaccuucauccgccuuuguaguacagccacaaaacggaagauguacaacagacggaguacuccuaggcacaacacaauuaucccccguaaauauauguacauucagaggagacguaacacacauaucaggaucaucaaauuacacaaugaauuuagcaucacaaaacuggaacucauaugacccuacagaagaaauacccgccccauuaggaacaccagauuuuguaggaaagauacaaggaguacuuacucaaacuacaagaacagauggaucuacaagaggccacaaagcaacuguauacaccggaucagccgacuuuucaccaaaacuaggaagaguacaauuugcaacagauacagacaaugacuucgaaacaaaucaaaacacaaaauucacuccaguugguguaauacaagauggcgccacuacacacagaaaugaaccacaacaauggguacuaccauccuacuccggaagaaauacacauaacguacacuuagccccagccguagcaccaacauucccaggagaacaauuacuauucuuuagaucaacaaugccaggauguucaggcuaucccaacauggaccuagauugcuuauuaccacaagaauggguucaauauuuuuaucaagaagcagcuccugcacaaucagacguagcauuacuaagauucguuaacccagacacaggaagagucuuauucgaauguaaacuacauaaaucaggcuauguaacuguagcucacacaggccaacaugaucucgugauaccaccaaaugguuauuucagauuugacucauggguaaaccaauuuuauacauuagcuccaaugggaaauggaacaggucgaagaagauaa

SEQ ID NO: 34194 - RNA, 1617 nt, Artificial Sequence
  derived and/or modified sequence opt6 from VP1__Norovirus_and/or_Norovirus-like__KF177451
augaaaauggcaucaucagaugcaaauccaucagaugguucugcagcaaauuuaguaccagaaguaaauaacgaaguaauggcccuagaacccguugucggagcagcaaucgcagcaccagucgcaggacaacaaaaugucauagaucccuggauucgcaauaauuuuguacaagcaccaggaggagaguucacuguaucuccccgaaaugccccaggggaaauucuauggucagcaccauuaggaccagacuuaaauccauaccuaucacacuuagcaagaauguauaaugguuaugcuggcggauucgaaguacaaguaauauuagcaggaaaugcauucacugcaggaaaagucaucuucgcagcaguaccacccaacuuuccaacugaaggacuaaguccaucucaaguaacuauguuuccacacauagucgucgacguaagacaacuagaaccaguccuaauuccauuaccugauguacgaaacaacuuuuaccacuacaaucaaucaaaugacccuacaauaaaauuaaucgcuaugcuauauacaccacuuagagcaaauaaugcaggagacgauguauuuacaguuucaugcagaguacuaacaagacccucaccagauuucgauuuuaucuuccucgucccaccuacaguagaaucaagaaccaaacccuucucuguaccaguauuaacuguugaagaaaugacaaacucaagauuucccauaccacucgaaaaacuauucacuggaccaucaagcgcauucguaguacaaccacaaaacggucgauguacaacugacggaguucuacucggaacaacccaauuaucuccagucaauauauguacuuuuagaggugauguuacccauauaacaggaagucgaaauuauacuaugaaucucgcuucacaaaacuggaauaacuacgaucccaccgaagaaaucccagcaccucuuggaacaccagauuucguaggaaaaauucaaggcguacucacucaaacaacacgaacagacggcucuacucgaggacacaaagccacaguauauaccgguucagccgauuucgcaccaaaacucggaagaguacaauuugaaacagauacagauaacgacuuugaagcaaaccaaaauaccaaauuuacuccaguaggaguaauacaagauggaggaacaacacauagaaaugaaccacaacaauggguacuaccaaguuacucaggcagaaauacacacaacguucacuuagcuccugcaguugcaccaacuuuucccggugagcaacuucuauucuuuagaucaacaaugccuggaugcucuggauauccaaacauggauuuagauugcuuaauaccacaagaauggguacaauacuucuaucaagaagcagcuccugcacaaucagacguagcacuucuuagauucguuaauccagacacuggucgaguacuauuugaauguaaauuacauaaaucaggcuacguaacaguagcacacaccggacaacacgauuuaguaaucccaccaaauggauacuucagauuugacucaugggucaaccaauuuuauacauuagcaccaaugggaaacgguacaggaagaagaagauaa

SEQ ID NO: 34195 - RNA, 1617 nt, Artificial Sequence
  derived and/or modified sequence opt6 from VP1__Norovirus_and/or_Norovirus-like__KF177429
augaaaauggcuuccucagacgccaauccauccgauggcucugcagcaaaucuagucccugaaguaaauaaugaaguaauggcacucgaaccaguaguaggagcagccauagcagcuccuguagccggacagcaaaauguaauagacccauggauacgaaauaacuuuguucaagcacccggaggagaauuuacaguuucaccaaggaacgcaccaggagaaauauuauggucagcaccucugggaccagauuuaaauccuuaucuaucccaccuugccagaauguauaacggcuaugcaggaggauuugaaguacaaguuauacuagcaggaaacgcuuuuaccgccggaaaaguaauuuuugcagcaguacccccaaauuucccaacagaaggacuaucuccaucacaaguaacaauguucccccauauaguuguagauguaagacaacucgaaccaguucuaauaccacuuccugauguaagaaacaauuucuaucacuauaaucaaucaaacgacccuaccauuaaauuaauagcaauguuauacacuccccuuagagcaaacaacgcaggagaugaugucuuuacaguuucauguagaguuuuaacuagaccauccccagauuuugacuucauauuuuuaguaccaccaaccguagaaucccgcacaaaaccauuuucugucccuguacuaacaguagaagaaaugacaaauuccagauuuccaaucccacuugaaaaauuauucacaggaccuuccuccgcauucguaguacaaccacaaaauggacgauguacaacugauggaguauuauuaggaaccacgcaacuuucaccaguaaauaucugcacauucagaggagacguuacucacauaaccggcucuagaaauuauacaaugaaccuugcaucacaaaauuggaacaacuacgauccuacagaagaaauaccagcaccauuaggaacuccugacuuuguaggaaaaauccaaggaguucuaacacaaacaacaagaacagacggaucaacaagaggucauaaagcaacaguauauacaggaucugcagacuuugcaccaaaauuaggacgaguccaauucgaaaccgacacagaucacgauuuugaagccaaucaaaauacaaaauuuacuccagucggcguaauucaagauggugguacaacacauagaaacgaaccacaacaauggguccuacccucauauagugguagaaacacccccaacguccacuuagcuccagcaguagcaccaacauucccuggagaacaacuauuauuuuucagaucaacaaugccaggaugcucaggauauccuaacauggauuuagauugccuccuuccucaagaauggguacaauauuucuaccaagaagcugcaccagcccaaucagacguagcucuauuacguuucgucaacccagacacuggacgaguacuauucgaaugcaaacuacacaaaucaggauauguaacuguagcacacucgggccaacaugauuuaguaauaccaccaaauggauacuuccgauucgacuccuggguaaaucaauuuuacacacuagcucccauggguaauggaacaggaagaagaagauga

SEQ ID NO: 34196 - RNA, 1617 nt, Artificial Sequence
  derived and/or modified sequence opt6 from VP1__Norovirus_and/or_Norovirus-like__KF060005
augaaaauggcuucaucggaugcaaacccuagugauggcuccacagcuaaccuuguuccagaaguaaauaaugaaguuauggcauuagaaccuguaguaggagcagcuauugcagccccaguagcaggacaacaaaaugucauagauccauggauacgaaacaacuucguccaagcaccuggcggugaauuuacuguaaguccaagaaaugccccaggagaaauauuauggucagcaccuuuaggcccagauuuaaauccuuaucuaucacaccuagcacguauguauaacggauacgcaggagguuucgaaguacaaguuauucuagcaggcaacgcauucacagcaggaaaaauuauauucgcagcaguucccccaaacuuuccaacagaaggacuaaguccuucacaaguaacaauguucccacauauaauaguagauguaagacaacuagaaccaguauuaauuccauuaccagacguaagaaauaacuucuaucacuauaaccaauccaaugauccuacaauaaaauuaauagcaauguuauacacuccccuaagagcuaacaaugcaggagacgauguauuuaccguaucuugcagaguauuaacacgaccuucaccagacuuugacuucauauucuuaguaccaccaacaguagaaucacgaacuaaaccauucucuguaccaguacuuacuguagaagaaaugacuaauucacgcuuucccauaccauuagaaaaauuauuuacaggucccucuucagcauuuguaguacaaccccaaaauggacgcuguacaacagauggaguacuacuaggaaccacacaauuauccccaguaaauaucuguaccuuuagaggcgaugucacccauauaucaggaucaagaaauuacaccaugaauuuagcaucacaaaauuggaacaguuacgauccaaccgaagaaauaccagcaccccuaggaacuccugauuuuguuggaaaaauacaaggaguauuaacccaaacuacaagaacagauggcucaacaagaggucauaaagcaacuguuuauacaggaucagccgacuucacaccuaaauuaggacguguccaauucgcaacagacacagacaacgauuuuguaacaaaccaaaauacaaaauucacacccguaggaguuauacaagacggaucaacaacuccaagaaaugaaccacaacaauggguacuaccuucauauaguggacguaacacacacaauguacaccuagccccagcaguagcaccaacauuuccuggagaacaauuacucuuuuuccgaucaacaaugcccggaugcucaggcuauccuaauauggaccuagauugccuccucccucaagaauggguacaauacuuuuaccaagaagcagcuccagcucaaucagacguugcauuauuaagauuuguuaacccagauacaggacgcguacucuuugaaugcaaauuacacaaaucaggauauguaacagucgcacauacaggacaacaugauuuaguuauaccaccaaauggauauuuucgauuugauuccuggguaaaccaauuuuacacuuuagcaccuaugggaaacggaacaggaagaagacguuag

SEQ ID NO: 34197 - RNA, 1617 nt, Artificial Sequence
  derived and/or modified sequence opt6 from VP1__Norovirus_and/or_Norovirus-like__JX439821
augaaaauggcaucaucagaugcaaacccaagugaugguucaacugcaaaucuuguuccagaaguaaacaaugaagucauggcacuagaaccaguaguaggagcugccauagcagcaccugucgccggacaacaaaauguaaucgauccuuggauaagaaauaauuucguacaagcacccggaggugaauuuaccguaaguccuagaaaugcaccaggagaaauauuauggucugcaccauuaggaccagaucuuaauccauaucuaucccacuuagcaagaauguauaauggauacgcaggaggauucgaaguacaaguaauauuagcuggaaaugcauucacagcuggaaaaauaaucuuugcggcagucccaccaaauuucccaacagaaggauuaucaccaucacaaguuaccauguuuccacacauuauagucgauguucgacaacuagaaccaguauuaaucccacuucccgauguccgcaacaauuucuaccacuauaaccaaucaaacgacccaacaauaaaacuaaucgcaaugcuauacaccccauuaagagcaaacaaugcaggagaugauguauucacuguuucauguagaguacucacacgaccauccccagacuuugacuuuaucuuucuaguaccaccaaccguagaauccaggacuaaaccuuuuucagucccaguuuuaacagucgaagaaaugacaaauucuagauucccaauaccauuagaaaaacuauuuacuggcccuuccagcgcuuucguuguccaaccacaaaacggaagauguacuacagauggcguacuauuaggaaccacacaauuaagcccaguuaacauauguacauuuagaggugacgucacacauauaucaucaucaagaaauuacacaaugaaucuagcaucccaaaacuggucaucauacgauccuacagaagaaauacccgccccacuaggaacuccagacuucguaggaaaaauucaaggaguccuaacucaaacuacacgaacagacggaagcacaagaggacacaaagcaacaguauauacaggaucggcagacuucucaccuaaacuaggacgcguacaauuugauacagauacagauaacgauuucgaaacaaaccaaaacacuaaauuuacaccaguaggaguaauacaagacggaucaacuaccuaucguaaugaaccacaacaauggguacucccaucuuauucuggaagaaauacacauaacguacaucuagcacccgcaguagcuccaaccuucccaggagaacaacuccuauucuuuagaucaacaaugccuggaugcucaggauaccccaacauggaccuagauugcuuauuaccccaagaauggguacaauauuuuuaccaagaagcagcuccugcacaauccgauguagcauuacuacgauuuguuaauccugauacuggaagaguauuauucgaauguaaacuacacaaaaguggauaugucacagucgcacauacuggucaacaugauuuaguaauaccaccaaauggguacuucagauuugauucauggguaaaccaauuuuacacucuagcucccauggguaauggaacaggaagacgcagauaa

SEQ ID NO: 34198 - RNA, 1617 nt, Artificial Sequence
  derived and/or modified sequence opt6 from VP1__Norovirus_and/or_Norovirus-like__KC517361
augaaaauggcaucaagugaugcaaauccauccgauggaucagcagcaaauuuaguaccagaaguaaacaaugaaguaauggcacuagaaccaguaguaggugcagcaauagcugcaccuguagcaggccaacaaaaugucauagauccuuggauucgaaacaauuucguacaggcaccaggaggagaauuuacaguaucaccuagaaaugcaccaggagaaauacuuuggucagcaccccuaggaccugacuuaaauccauaucuaucacaucuagcaagaauguauaaugguuacgcuggaggauuugaaguacaaguuaucuuagcaggaaaugccuuuacagccggaaaaguaauauuugcugccguuccaccaaauuuuccaacagaagguuuaucacccagccaaguaacuauguucccacauaucguuguagauguaagacaauuagaaccaguacuaauaccacucccagauguacgaaauaacuucuaucauuacaaucaaucaaacgacccuacaauaaagcuaauagcaaugcuauauacaccguuaagagccaauaaugccggugacgauguuuucaccguaucuuguagaguauuaacaagaccaucacccgacuuugacuucauuuuucuaguacccccaacuguagaaucacgaacaaaaccauuuucuguaccaguccuaacaguagaagaaaugaccaauucaagauucccaauuccuuuagaaaaauuauucacaggaccaucaucagcauucguaguacaaccccaaaauggaagauguacaacagauggaguacuacuuggaacuacccaauuauccccuguaaauauaugcacauuucgaggagauauuacacauauuacuggaucaagaaauuacacuaugaacuuagcaucacaaaacuggaauaauuacgauccaacagaagaaauaccugcaccccuaggaaccccagacuuuguugguaaaauucaaggaguacuaacccaaacaacacgaacugacggaucaacaagaggacacaaagcaaccguacauacuggaucagcagauuucgcaccaaaacucggccgcguacaauucgaaacagauacagaccaugacuuugaagcaaaucaaaacacaaaauuuacacccguaggaguaauacaagauggagguaccacccaucgaaaugaaccucaacaauggguguuaccaucuuacucuggcagaaauacacauaauguucaccucgccccugcaguagcaccuacauuucccggagaacaacuauuauucuuuagaucuacaaugccugguugcucuggauauccaaacauggaucuagauugcuuacucccacaagaauggguucaauauuuuuaccaagaagcagcaccagcacaaucagacguugcauuauuaagauucguuaauccagacacaggaagaguuuuauucgaauguaaauuacauaaaucuggauauguaacuguagcccacacaggacaacacgauuuaguuauaccaccaaacggauauuuuagauucgauucaugggucaaucaauucuacacacuagcuccuaugggaaauggaacuggacgaagaagauag

SEQ ID NO: 34199 - RNA, 1617 nt, Artificial Sequence
  derived and/or modified sequence opt6 from VP1__Norovirus_and/or_Norovirus-like__KC175378
augaaaauggcaucuaaugacgcaaacccaucagauggcucagccgcaaacuuaguaccagaaguuucaaaugaagucauggcauuagaaccaguuguaggagcugccauagccgcaccaguagcaggccagcaaaauguaauagacccauggaucagaaacaauuuuguccaggcaccaggaggugaauuuacuguuucaccuagaaaugcaccaggagaaauccuuuggucugcaccacuuggaccagaucuaaauccauaccuaucacacuuagcaagaauguacaacggauacgcaggcggcuucgaaguacaaguuauauuagcaggaaaugcauucacagcaggaaaaauaaucuuugccgcaguacccccaaacuuuccaacagaaggacuaucaccaucucaaguaacaauguuuccccacauuauaguugacguuagacaauuagaacccguucuaauaccauuaccagacguaagaaacaacuucuaccacuauaaucaaacaaaugacucaacaauaaaauuaauagcaauguuauauacaccacuucgcgcaaauaaugcuggugaagauguuuuuaccguaagcuguagaguucuaacaagaccauccccagacuuugacuuuauauuucuaguaccuccaacuguagaaagucgaacuaaaccauucacaguuccaauauuaacuguugaagaaaugacuaacucuagauuucccauaccauuagaaaaacuauucacaggaccaucaggagcuuucguaguacaaccacaaaacgguagaugcacaacagauggaguauuacucggaacaacacaacucucaccaguaaauaucuguaccuucagaggagauguaacacauauagcaggaucaagaaauuacacaauguccuuagcaucauuaaacuggaacaauuaugauccaaccgaagaaauaccagccccacuaggaacaccagacuuuguaggaaaaauacaaggaguacuuacacaaacaacaaaaggugacgguucaacaagaggacauaaagcaacaguauauacaggauccgcaccuuuuacaccaaaacuaggaucaguccaauuuucaacugauacagaaaacgacuuugaaacacaucaaaauacaaaguucacaccaguaggaguuauacaagauggaggaacaacccaccguaacgaaccacaacaauggguucuaccaucauauucaggacgagaugugcauaauguacauuuagccccugcaguagcaccaaccuuuccuggagaacaauuacuauucuuuagaucaacaaugccuggcugcuccggauacccuaauauggaccuagauugucuacuaccacaagaauggguacaacacuuuuaucaagaagcagcuccugcacaaucagaugucgcacuuuuacguuuuguaaacccagacacaggcagagugcuauucgaaugcaaacuucauaaaagcggauaugugacaguagcacauacaggacaacaugacuuagucauaccaccuaacggauacuuuagauuugacucauggguaaaucaauuuuacacacucgcuccaauggguaauggaacaggaagacggagauaa

SEQ ID NO: 34200 - RNA, 1617 nt, Artificial Sequence
  derived and/or modified sequence opt6 from VP1__Norovirus_and/or_Norovirus-like__JX459648
augaaaauggcuucuaaugacgcaaauccauccgaaggaucagcagccaaucuuguaccagaagucaauaacgaagucauggcucuugaaccuguagucggagcagcaaucgcagcucccgucgccggccaacaaaauguaauagauccauggauaagaaauaacuuuguccaagcaccaggaggugaauuuaccgugagucccagaaaugccccaggaaccauuagaugguccgcaccacucggucccgaucucaauccauaucucucccaccuagcaagaauguauaauggauaugcugguggauuugaaguacaagucauacuagcagguaaugcauucacugcaggaaaaauaauauucgcagcaguaccaccuaauuucccaacugaaggauuaucuccaucacaaguaacaauguuuccacacauaauaguagacguucgacaauuagaaccaguacuaauaccauuaccagacgucagaaauaacuucuaccacuauaaccaaucaaaugauucaacaauaaaauuaauagcaaugcuauacaccccauuaagagcaaauaaugcaggcgaagaugucuuuaccguaucuuguagaguuuuaacaagaccaucuccagauuuugauuuuauauuucuugucccaccuaccguagaaucucguacaaagccauucacaguaccaauucuaacaguagaagaaaugaccaacagccgauuuuccaucccacuagaaaaacuauuuacagguccauccggagcuuucgucguacaaccacaaaacggacgcugcacaacugaugguguuuuacuaggaacaacccaauuaucaccugucaauauauguacauuccguggagacgucacucacauagcaggcucaagaaacuauacuaugaaucuagcagcauuaaacuggaacaauuacgacccaacagaagaaauaccugcaccacuaggaacaccugacuuugucggaaaaauacaaggugucuuaacacaaacaacaaaaggugacggaucaacaagaggacacaaagccacaguauauacaggaucagcugacuuuacaccuaaacuugguaguguucaauuuuccacagacacagaaaacgacuuugaaucccaucaaaacacuaaauucacaccaguaggaguaauucaagacgguucaacaacucacagaaacgaaccacaacaauggguacuaccaucauacaguggacguaauguacauaauguucaccuugccccugcaguagcacccacauucccaggagaacaacuacuauucuucagaucaacaaugccaggauguucaggauacccaaacauggauuuagacuguuuaauaccacaagaauggguccaacacuucuaucaagaagcagcaccagcacaaagugauguugcacuauuaagauucguuaacccagacacaggacgaguacuuuucgaauguaaacuacauaaaucuggauaugucacaguagcacacacaggacaacaugauuuaguaauaccacccaacggauauuucagauucgacucauggguuaaucaauucuauacucucgcaccaaugggaaauggcgcaggaagaagaagauaa

SEQ ID NO: 34201 - RNA, 1617 nt, Artificial Sequence
  derived and/or modified sequence opt6 from VP1__Norovirus_and/or_Norovirus-like__JX459635
augaaaauggcaucaaaugacgcuaaccccuccgauggaucagcagcaaauuuggucccagaaguaaauaaugaaguaauggcacuugaacccguuguaggagcugccauagcugcuccuguagcaggacaacaaaauguaauagacccauggauaagaaacaacuuuguacaagcaccaggaggagaguucacaguuucaccaagaaacgcaccaggagaaauuuuauggucagcaccacuaggacccgaucuaaacccauaucucucucaucuagccagaauguauaacggauaugcaggcggauucgaaguacaaguuauacuagccggaaacgcuuuuacagcuggaaaaauaauauuugcugccguuccuccaaacuuuccaacagaaggcuuaucaccaucccaagucacaauguuuccacacauaauacuugacguaagacaacuugaaccaguacuaauaccacuaccagauguuagaaacaauuucuaucacuauaaccaaucaaacgacucaacaauuaaacuaauagcaauguuauacacaccauuacgagcuaacaaugcaggagaagacguuuuuacaguaucaugucgcguauuaacucgaccaucaccagauuuugacuuuauauuucuaguacccccaacaguagaaucuagaacuaaaccauucacuguuccaauauuaacaguagaagaaaugaccaacucccguuuuccaauaccacuagaaaaacuauuuacagguccaucaggagcauucgucguacaaccacagaacggccgauguacaacagacgguguacuacuaggaaccacacaacucucccccguaaauauauguacauucagaggugacguaacacauaucgcagguucuagaaacuauacaaugaacuuagccucucuaaacuggaacaauuaugacccaacagaagaaauuccagcaccacuaggcacaccagauuucguugguaaaauacaaggcguacuaacacaaacaacaaagggugacggaucaacaagaggacacaaagcaacagucuauacaggauccgcuccauuuacacccaaacuaggcucaguacaguucucaacagauacagaaaaugauuucgaaacacaccaaaauacaaaauucacaccagugggcguaauccaagauggaucaacaacuagaagaaaugaaccacaacaaugggucuuaccaucauacucaggaagaaaugcccauaacguacaucuugccccagcaguagcaccaacuuuucccggagaacaacuuuuauucuuucgaucaaccaugccuggcugcucaggauacccaaauauggaccuugacugccuuuuaccucaagaauggguucaacauuuuuaccaagaagcagccccugcucaaucagauguagcacuuuuaagauuuguaaacccugauacaggaagaguauuauuugaauguaaacuacacaaaucaggauacguaacaguagcacauaccggacaacacgacuuagucauaccaccaaacggauauuuuagauucgauuccuggguaaaccaauuuuacacacuagcaccaaugggaaauggaacaggacgccgaagauaa

SEQ ID NO: 34202 - RNA, 1617 nt, Artificial Sequence
  derived and/or modified sequence opt6 from VP1__Norovirus_and/or_Norovirus-like__JX459624
augaaaauggcuucaaaugaugcucacccaucugacggaucagcagcaaauuuaguaccugaaguaaacaaugaaguaauggcacuagaaccaguaguaggagcagcaauagcagcuccaguagccggacaacaaaauguaauagacccauggauacgaaauaacuucguacaagcaccaggcggggaauuuacaguaucaccacgaaaugcuccuggagaaauuuuauggagugcaccuuuagguccagaucucaauccauauuuaucacaccuagcacgcauguauaacgguuacgcugguggauuugaaguacaagucauacuagcaggaaaugcauuuacugcaggaaaaauaauauucgcugcaguacccccaaauuuuccaacagaaggacuaucaccuucucaaguuaccauguuuccacauaucauuguagacguucgacaacuagaaccaguacuaauaccuuuaccagauguccgaaacaacuuuuaucauuauaaccaaucaaaugacucaacaaucaaacucauugcaaugcuuuacacaccauuaagagcuaacaaugcaggagaagauguauuuacuguaucaugcagaguacuaacacgaccgucacccgauuucgacuuuauauuucuaguaccacccacaguugaaucaagaacaaaaccauuuacaguucccauccuuacugucgaagaaaugacuaacucacgauuuccaauuccacucgaaaaacuauucacagguccaucaggcgccuuuguuguccaaccccaaaacggaagaugcacaacagacggaguauuacuaggcacaacacaauuaucaccaguaaauaucugcacauuucgcggagacguuacccauaucgccggaacccgaaauuauacuaugaaucucgccucacuaaacuggaacaauuacgauccaacagaagaaauuccagcuccauuaggcccaccugacuuuguaggaaaaauacaaggaguacuaacacaaacaacuaaaggagacggaucaacaagaggucacaaggcuacaguuuacaccggaucugcaccauuuacaccaaaauuaggaucaguucaauuuagcacagacacagaaaacgacuucgaaacacaccaaaauacaaaauucacuccaguaggaguuauacaagaugguggaacaacccauagaaaugaaccacaacaaugggucuuaccauccuacucuggaaggaauguucacaauguacauuuagcacccgcaguagcuccaacauucccaggagaacaacucuuauucuuucguuccacaaugccaggaugcucagguuaucccaauauggacuuagacugucuacuaccacaagaauggguacaacauuuuuaucaagaagcugcuccagcucaaucagacguugcucuaaugagauucguaaaccccgacacaggaagaguauuauucgaauguaaauuacauaaaucuggauacguuaccguagcacauacaggacaacacgauuuaguaauacccccaaacggauacuuccgauucgauucauggguuaaucaauuuuacacguuagcccccaugggaaacggaacaggacgaagacgauaa

SEQ ID NO: 34203 - RNA, 1617 nt, Artificial Sequence
  derived and/or modified sequence opt6 from VP1__Norovirus_and/or_Norovirus-like__JX459614
augaaaauggcaucuaacgaugcuaacccaucagaugguucagcagcaaauuuaguccccgaaguaaacaacgaaguaauggcucuagaaccggucguaggagcugcaauagcagcaccagucgcuggacaacaaaauguaauugacccuuggauaagaaacaauuuuguacaagcuccaggaggugaauuuacaguaucaccaagaaaugcacccggcgaaaucuuauggucagcaccacuagguccagauuuaaacccauaccucucacaucuagcaagaauguacaacggcuaugcaggaggcuucgaaguacaaguaauuuuagcaggaaacgcuuucacagcuggaaaaauaauuuucgcagccguuccaccuaauuuuccaacugaaggauuaucaccaucacaaguuacaauguucccacacauaauaguugauguaagacaacuugaacccguacuuauaccauuacccgaugucagaaacaacuuuuaucacuauaaccaaucaaacgauucuacaauaaaacuaauagcaaugcuauauaccccacuaagagccaauaaugcaggcgaagauguauuuacaguaucauguagaguauuaacacgaccaucaccugacuuugauuuuauauuucuaguacccccaacaguagaaucaagaacaaaaccuuucacaguaccuauauuaacuguagaagaaaugacaaacucaagauuccccauaccauuagaaaaauuauuuacaggaccaucaggagcuuuuguaguacaaccacaaaacggacgaugcacaacugauggaguauuacuaggaaccacacaauuaucaccaguaaauauauguacuuucagaggagaugucacacauauagcaggaucaagaaauuauacaaugaauuuagccucuuuaaacuggaacaauuacgaccccacagaagaaauaccagcaccacuagguacacccgauuucguaggaaaaauacaagguguccuaacacaaaccacaaaaggcgacgguucaacuagaggacauaaagcaacugucuauacaggaagcgcaccauucacaccaaaauuaggaaguguacaauuuagcacagacacagaaaaugauuucgaaacucaccaaaacacaaaauuuacaccaguaggaguuauacaagacggaggaaccacacauaggaaugaaccacaacaauggguauuacccuccuauucaggaagaaauguccauaacguacacuuagcuccagcagucgcaccaacauuuccaggagaacaauuacuauucuuuagauccacaaugcccggguguucaggcuauccaaacauggaccuagauugccuacuaccacaagaauggguccaacauuuuuaucaagaagcugccccagcacaauacgacguugcauuacuacgauuugucaaccccgacacaggcagaguacuuuucgaauguaaacuccacaaaagcggauauguaacaguagcacacacaggacaacaugacuuaguaauacccccaaauggguauuuuagauuugacucuuggguaaaucaauuuuacacauuagcuccuaugggaaacggcacaggaagaagaagauaa

SEQ ID NO: 34204 - RNA, 1617 nt, Artificial Sequence
  derived and/or modified sequence opt6 from VP1__Norovirus_and/or_Norovirus-like__HM635103
augaaaauggcauccucugaugcaaauccaucagauggcucaacagcuaacuuaguuccagaaguaaauaacgaagucauggcccuagaaccaguugucggagccgcaauagcugcaccagucgccggacaacaaaauguaaucgacccauggauaagaaauaacuuuguccaagcaccagggggagaauuuacuguauccccaagaaaugcaccaggagaaaucuuauggucagcuccacuuggaccagaucuaaauccuuaccuuucacaccuagcucgaauguacaacggauaugcaggagguuuugaaguccaaguaauucuagccggaaaugcauuuacagcaggaaaaauaaucuucgcagcaguaccaccaaauuuuccaacagaaggacuaucaccaucucaaguaacaauguuuccccauauaauaguagacguuagacaacuugaaccaguacucauaccauuaccagacguaagaaauaacuucuaucacuauaaccaaucuaacgacccaacaauaaaacuaauagcuaugcuuuacacuccacuaagagcuaacaaugcaggagacgauguuuucacaguuucauguagaguauuaacaagaccaaguccagauuuugacuuuauauuucucguuccaccuacaguagaaucucgaacaaaaccauucuccguaccuguccuaacaguagaagaaaugacaaauucacgauuuccaauuccgcuugaaaaacuauuuacaggaccauccucagcauucgucguacaaccacaaaacggaagauguacaacagacggaguuuuacuaggaacaacacaauuaaguccagucaauaucuguacauuccguggagacguaacacauauaccuggcucaagaaauuacacuaugaaucuugccucacaaaauuggaacuccuaugauccaaccgaagaaaucccagcaccauuaggaacaccagacuuuguuggaaaaauacaaggaguauuaacacaaacaacaagaacuaacggaucuaccagaggucauaaagcaacagucuauacuggaucagcagauuucucaccaaaauuaggaagaguacaauuugcaacagacacugacaacgaccuagaaacaaaucaaaauacaaaauucacaccaguaggaguaauccaagauggauccacuacacccagaaaugaaccacaacaauggguacuaccaucauauucaggcagaaacauacauaauguucacuuagcaccagcaguugcacccacauuuccaggcgaacaacuacucuuuuuccgaucaaccaugccaggaugcagcggauauccaaauauggauuuagauuguuuacuaccacaagaauggguacaauauuuuuaucaagaagcagcuccagcacaauccgacguagcccuacucagauucguaaacccagacacaggaagaguauuauucgaaugcaaacuacacaaauccgguuaugucacaguugcucacacaggccaacacgaucuaguaauacccccaaauggcuacuuuagauucgauuccuggguaaaucaauuuuacacauuagcaccuaugggcaauggaacaggaagacgcagauaa

SEQ ID NO: 34205 - RNA, 1617 nt, Artificial Sequence
  derived and/or modified sequence opt6 from VP1__Norovirus_and/or_Norovirus-like__JQ613522
augaaaauggcuuccaaugacgcaaauccuucagaugguucugcagcaaacuuaguaccagaaguaucuaacgaaguaauggcccuagagccuguuguaggugcagcaauagcagcaccagucgcuggacaacaaaaugucauagacccauggauucgcaauaacuucguucaagcuccugguggagaauuuacagugucacccagaaaugccccaggagaaauauuauggagugcuccauuaggaccagaucuaaauccauaucuaucucauuuagccagaauguacaauggauacgcaggcggauuugaaguacaaguaauacuagccgguaaugccuuuaccgcagguaaaauaauuuucgcugcaguuccaccuaacuuuccaacagaaggacuaucaccuucacaaguuacaauguucccacacauaauaguagauguacgucaauuagaaccuguacucauccccuuacccgacguaagaaacaauuuuuaucacuauaaucaaucaaaugacucaacaauaaaauuaauugcaaugcuuuauacaccccuaagagcaaacaacgcaggcgaagaugucuucacaguaucaugccgaguauuaacaagaccaucaccagauuucgauuuuaucuuucuaguaccuccaacagucgaaucaagaacuaaacccuuuacuguuccaauacuuacaguagaagaaaugacaaauucaagauuuccuauaccacuugaaaaacucuuuacuggcccaucaggagcauucguaguacaaccacaaaacggaagaugcacaacugaugggguccuacuaggaacaacacaacuaucacccguaaauauuuguacauucagaggagacguaacacauauagcuggaucucgagacuacacaaugaaccuugcaucacucaauuggaauaacuaugauccaacagaagaaauaccugcaccacucggaacaccagacuuuguaggaaaaauacaaggaaugcuaacccaaacaaccaaaggugacggaucaacucgaggacauaaagcuacaguuuauacagguucugcucccuuuacaccaaaauuaggauccguaagauucucaaccgauacugaaaacgauuucgaaacacaccaaaacaccaaauucacuccaguaggaguuauacaagacgguucaacaacacauagaaaugaaccacaacaauggguacuaccaucauauucuggucgagauguacacaacguacaucucgcaccagccgucgcaccaacauucccuggcgaacaacucuuauucuuucgaucaaccaugccaggaugcuccggauaucccaauauggaccucgacugccuucuaccacaagaauggguccaacauuucuaucaagaagcagcaccagcacaaucagauguagcccuacuacguuuuguaaacccagacacaggaagaguauuauucgaauguaaauuacacaaaucaggcuacguaacaguagcccauacaggacaacacgaucuuguaaucccaccaaacggcuauuucagauucgauucauggguaaaucaauuuuauacacuugcaccaaugggaaauggaacuggacgaagaagauaa

SEQ ID NO: 34206 - RNA, 1617 nt, Artificial Sequence
  derived and/or modified sequence opt6 from VP1__Norovirus_and/or_Norovirus-like__AB629942
augaaaauggccaguaaugacgcaaaucccuccgaugguagcgcagccaaccuaguaccugaaguaaauaaugaaguaauggcacuagaaccaguugucggagccgcaaucgcugcaccagucgcaggacaacaaaauguaaucgauccauggauacguaauaauuucguccaggcaccagguggugaauuuacaguaucaccucgcaaugcaccaggugaaauauuauggucagcaccacuagguccagaccucaaccccuacuuaagucaccuagcacgaauguauaacgguuacgcaggcggauucgaaguacaaguaauuuuagcuggaaaugcauucacagcuggaaaaauuauauucgcagccguaccaccaaacuucccaacagaaggacuaucuccaucccaaguuacaauguucccucacauaauaguagauguuagacaacuagaaccaguauuaauaccacucccagauguaaggaacaauuucuaccauuauaaccaaucaaaugacucaacaauaaaauuaauagccauguuauacaccccacuaagagcaaauaacgcaggcgaagacguauuuacaguaucaugucgaguacucacaagaccaucaccagauuuugacuuuauauuucuagucccaccaaccguagaauccagaacuaaacccuucacuguaccaauauuaaccguagaagaaaugacaaacucaagauuuccaauaccauuagaaaaauuauucaccggaccaucaucagccuuuguaguacaaccacaaaacggcagauguacaacagacggaguauuauuaggaacaacacaauuauccccuguaaauaucugcacuuuuagaggcgauguaacgcauauugccggaucaagaaauuacacaaugaacuuagcauccuuaaacuggaacaauuaugauccaacagaagaaauacccgcaccauuaggaacaccagacuuuguaggcaaaauacaaggcguauuaacacaaacaaccaaaggugacggauccacaagaggacacaaagcaaccguguauaccggaucagcuccauuuacaccuaaauuaggaucaguacaauucucuacagauacacaaaacgauuuugaaacucaucaaaauacaaaauuuacccccguagguguaauacaagacggaggaacuacccacagaaacgaaccccaacaauggguacuaccaucauacucaggaagaaauguaccuaauguucaucuugcaccagcaguagcaccaacauuccccggugaacaauuauuauucuuuagaucaacaaugccagguugcucaggauauccgaauauggaucuagacugcuuauuaccacaagaauggguccaacacuuuuaucaagaagcagcaccagcccaaucagauguagcauuacuacgauuuguaaacccugauacagguagaguuuuauucgaauguaaacuacauaaaucuagauauguaacuguagcacacacaggacaacacgacuuagucauaccaccaaacggauauuucagauuugacucauggguaaaucaauuuuacacacuagcacccaugggaaacggaacaggaagaagaagauaa

SEQ ID NO: 34207 - RNA, 1617 nt, Artificial Sequence
  derived and/or modified sequence opt6 from VP1__Norovirus_and/or_Norovirus-like__GQ856457
augaaaauggcaucaaacgacgcaaauccaucagaugguccagcagccaauuuaguaccagaaguaaacaaugaaguaauggcauuagagccaguuguaggagccgcaauagcagcaccaguagcaggacaacaaaauguuauagacccauggauaagaaacaacuuuguacaagcaccaggaggagaauuuacaguuaguccacgaaaugcacccggagaaauacuauggagugcaccacuaggaccagaucuaaauccauaucuaagccauuuagccagaauguacaacgguuacgcaggaggcuucgaaguccaaguaauucuagcuggaaaugcauucacugccggaaaaauuaucuucgcugcaguaccaccuaacuuuccaacagaaggacuaucuccaucucaaguaacuauguucccacacaucaucguagaugucagacaauuagaaccaguucuaauaccauuaccugauguacgaaacaauuuuuaucacuauaaucaaucuaaugauucaacaauaaaacuaaucgccaugcuauacacaccacuaagagcuaauaaugcaggagaagauguauuuaccguaucaugucgaguacuaacccgaccaucaccugacuuugacuuuauauucuuaguaccaccaacaguagaaucccgcacaaaaccauucaccguaccaauauuaacaguagaagaaaugacuaacagcagauuuccuaucccucuagaaaaacuauuuacuggacccucauccgcauuuguaguacaaccucaaaacgguagauguacuacagauggaguacuccuuggaaccacacaauuauccccagucaacauaugcacuuuucgaggagacguaacccauaucgcaggauccagcaacuacacuaugaauuuagcuucacuaaacuggaacaauuaugauccaacagaagaaauaccagcaccacuaggaacaccagacuuuguagggaaaauucaaggaguacuaacacaaacaacaaaaggagauggaucaacuagaggccacaaagcaacaguauauacaggauccgcaccauucaccccuaaacuuggauccguucaauuuucaacagauacccaaaaugacuucgaaacccaccaaaauacaaaauucacaccaguaggaguaauucaggacggugguacaacccaucguaacgaaccacaacaauggguacuaccauccuauucaggacgaaauguucaaaauguacaccuagcacccgcuguagccccuacauuuccaggagaacaacuacuuuucuuuagaucaaccaugccaggauguuccggauauccaaauauggaucuagacugucuauuaccucaagaguggguccaacacuuuuaucaagaagcagccccugcacaaucagauguagcuuuauuaagauucguuaacccagauacaggaagaguauuauucgaauguaaacuccacaaaucuagguauguaacaguagcucauacuggccaacaugauuuaguaauaccaccaaacggcuacuuuagauucgauaguugggucaaccaauucuacacuuuagcccccaugggaaauggaacaggacguagaagauaa

SEQ ID NO: 34208 - RNA, 1617 nt, Artificial Sequence
  derived and/or modified sequence opt6 from VP1__Norovirus_and/or_Norovirus-like__EU876883
augaaaauggcauccucagaugcuaauccaucugacggcucaacagcaaaccuuguaccagaaguaaacaaugaaguaauggcauuagaaccaguagucggagcagcaauagcagccccaguugcaggacaacaaaacguaauagaucccuggauucgaaauaauuucguucaagcaccaggcggagaauuuaccguaucaccccgaaaugcaccaggcgaaauacuaugguccgccccacuagguccagauuuaaacccauaucuaucccaucucgcuagaauguauaauggauaugcuggaggcuucgaaguccaaguaauacuagcuggaaaugcauuuacagcaggcaaaaucauauuugcagcaguaccaccaaacuuuccaacagaagguuuaucaccaucacaaguaacuaugucaccacauauaauaguagacguaagacaauuagaaccaguacuaauuccccuaccagacguaagaaacaauuucuaccacuauaaccaaucaaaugaccccaccauaaaauuaauagcaaugcuauacacaccccucagagcaaacaaugccggcgacgauguauuuaccguuucaugcagaguauuaacaagaccaaguccagacuuugacuuuauauuucuaguaccaccaaccguagaaucaagaacaaaacccuucucaguaccaauccuaacuguagaagaaaugacuaacagcagguucccaauaccauuagaaagacuuuuuacuggaccaucaucagcauuuguaguacaaccccaaaacggaagauguacaacugaugguguccuacuaggaacaacgcaacuaucaccaguaaauauauguaccuuccgaggagacguaacucauauagcaggaacccaagaauacacuaugaaccuugcaagucaaaacuggaacaauuacgauccaacugaagaaauuccagcuccauuagguaccccagauuuuguaggaaaaauacaagggguauugacacaaacuacaagacgugaugguucaacacgaggacacaaggcaaccguauccacaggaucaguacacuuuacuccaaaacuaggacgaauacaauuuucaacagacacaucaaaugauuucgaaacaggacaaaauaccagauucacaccaguuggaguaguacaagaugguggcacaacacaccaaaaugaaccccaacaauggguccuaccaaauuauucugggagagacggacacaauguacaucuagcaccagcaguagcaccuagcuuuccaggugaacaauuacucuucuucagaucuacaaugccaggaugcucaggauauccaaauaugaauuuagauugcuuacuaccucaagaauggguacaacacuuuuaucaagaagcagcacccgcacaaucagacguugcccuacuuagauucgucaauccagacaccggaagaguauuauuugaauguaaacuacauaaaaguggauacguaacagucgcacauacaggacaacaugaucuuguuauuccuccaaauggauacuuuagauucgauagcuggguaaaucaauuuuauacauuagccccaaugggaaacggaaccgguagaagaagauaa

SEQ ID NO: 34209 - RNA, 1617 nt, Artificial Sequence
  derived and/or modified sequence opt6 from VP1__Norovirus_and/or_Norovirus-like__AB447455
augaaaauggcaucuaacgacgcuaacccuucugaugguucagcugcaaauuuaguuccggaaguaaauaacgaaguaauggcauuagaaccaguuguaggagcagcaauagcugcaccagucgcaggacaacaaaauguaauagauccauggauccgaaacaacuuuguucaagcaccaggaggagaauuuacaguaucacccagaaaugcaccuggagaaauauuauggucagcuccauuaggaccagauuuaaauccuuauuuaucacauuuagcaagaauguacaauggauaugcaggcgguuucgaaguacaaguaauacuagcuggaaaugcauuuacagcaggaaaaauaauuuucgcagccguaccacccaacuuuccuacagaaggacuauccccaucccaaguaacaauguucccacauauuauaguagauguacgccaguuagaaccuguucucauuccacuuccagauguacgaaauaacuucuaccacuauaaccaaucaaacgacucaaccaucaaacuaauagcaauguuauacacaccauuaagagcaaacaaugcaggagaagauguauuuacuguaucauguagaguucucacuagacccucuccagauuucgauuuuauauuucuaguaccuccuacuguagaaucacgaacuaaaccauucacaguuccuaucuuaacaguagaagaaaugaccaacucacgauuuccaauacccuuagaaaaauuauuuacaggaccaaguggugcauuuguaguacaaccacaaaacgguagauguacuacugauggaguacuccuaggaacaacacaacuaaguccuguaaacauauguacauuccgaggagacguaacacacauagcaggcacacgaaauuacacaaugaaccucgcaucacucucuuggaacaauuaugauccaacugaagaaauaccagcuccacuaggaacaccagauuuugucggaaaaauacaaggaguauuaacccaaacuacaaaaggagacggaucaacgagaggacauaaagcaacaguauacacugguucugcucccuucacucccaaacuaggaucuguacaauucucuacagacacagaaaacgauuucgaaacacaccaaaauacaaaauucacucccguaggcguaauacaagaugguggaacaacccauagaaacgaaccucaacaauggguucucccauccuacucaggacgaaacguccauaacguacaucuagcccccgcaguugcaccuacauuuccaggugaacaauuacuauucuuuagaucaaccaugccaggauguucaggcuacccaaacauggauuuagacugcuuauuaccucaagaauggguacaacauuuuuaucaagaagccgcaccagcacaaucagacguagcacuaaugagauuuguuaauccagacacaggacgaguucuuuucgaaugcaaacuucacaaaucuggauaugucacagucgcucauacaggccaacacgaucuagucauaccaccaaacggauauuuuagauucgauucauggguaaaucaauuuuauacccuagcuccaaugggaaauggcacuggacgcagaagauaa

SEQ ID NO: 34210 - RNA, 1617 nt, Artificial Sequence
  derived and/or modified sequence opt6 from VP1__Norovirus_and/or_Norovirus-like__EU078409
augaaaauggcaucaaaugacgccaacccauccgauggaucaaccgcaaauuuaguaccagaaguuaacaacgaaguaauggcauuagaaccaguagucggugcagcaauagcagcaccugucgcaggacaacaaaauguaauugauccauggauuagaaauaacuuuguacaagcaccaggcggugaauuuacaguuagccccagaaacgcaccaggcgaaauauuauggucugccccacuagguccagauuuaaauccuuaucuuucacacuuagcccgcauguauaacggauaugcaggcggauuugaaguacaaguaauauuagcagguaaugccuucacagcaggaaagauaauauuugcugcagucccuccuaacuuuccuacugaaggacuuucaccaucacaaguaacaauguucccacauauaauaguagauguuagacaacucgaaccaguacucaucccacuaccagacguacgaaacaacuucuaucacuauaaucaaucaaacgacccaacaauaaaacucauagcaaugcuauauacuccuuuaagagcaaacaacgcaggggaagacguauucaccguuucguguagaguacuaacccguccaucaccagacuuugauuucauauuucuaguaccaccaacaguagaaucuagaacaaaaccauucacaguaccuauauuaacuguagaagaaaugacaaauucgagauuuccaauaccucuagaaaaacucuucacaggaccuucuggagcauucguaguacaaccacaaaacggaagaugcacaaccgacgguguacuacuugguaccacacaacuaucaccaguuaauauuugcacauuuagaggagacgucacccauauagcuggaacacauaauuauacuaugaaucuagcaucacaaaacuggaacaauuaugauccaacugaagaaauuccagcaccacuaggaacuccagauuuuguaggacgaauacaagguaugcuaacacaaaccacuagaggagacggaucaaccagaggacacaaagcaacaguuucaacaggugacguacauuuuacaccuaaacuuggauccauacaauuuaacacagauacuaacaacgacuuugaaacuggacaaaacacaagauucacaccaguaggaguaguacaagaugggaaugguacacaucaaaaugaaccacaacaauggguauuaccaaguuauucaggacguacaggccacaacguacauuuagcacccgccguagccccuacuuuuccaggagaacaacuacuuuucuuuagaaguacaaugccaggauguucaggauauccaaauaugaaucuagacugccuacuaccacaagaauggguacaacacuucuaccaagaagccgccccugcacaaucagauguagcacuacuaagauuuguaaacccagacacagguagaguauuauucgaaugcaaacuacauaaaucaggcuacguaaccguagcacacacaggacaacaugacuuaguaauaccaccaaauggauauuucagauuugacucauggguaaaccaauucuacacuuuagcaccuaugggaaaugguacaggacgaagaagauaa

SEQ ID NO: 34211 - RNA, 1617 nt, Artificial Sequence
  derived and/or modified sequence opt6 from VP1__Norovirus_and/or_Norovirus-like__AB303928
augaaaauggcaucaaaugacgcaaacccaagugacggaucaaccgccaaucuaguacccgaaguuaacaaugaaguaauggcacuugaaccaguaguaggugccgcaauagcugcccccgucgcaggccaacaaaauguaauagauccauggauaagaaauaacuuuguacaagcccccggaggugaauuuacagucuccccuagaaacgccccaggagaaauacuauggucagcaccuuuagguccagaucuaaauccauauuuaucacacuuagcaagaauguauaauggauaugcaggaggauucgaaguacaaguaauauuagcaggaaaugcauucaccgccgguaaaauaaucuucgcagcaguaccaccaaacuuuccaacagaaggccuaucaccaucacaagucacaauguuuccacauauuauaguagauguaagacaauuagaaccuguccucaucccacuaccagauguucgaaacaauuuuuaucauuauaaucaaucaaaugacccaacuauaaaauuaauugcaaugcuauacacaccauuaagagcaaauaaugcaggagaagacgucuuuacaguaucauguagaguauuaacaagaccuucaccugacuuugacuucauauuuuuaguaccaccuaccguugaaucuagaacuaaaccuuuuacaguacccauauuaacaguagaagaaaugacaaacaguagauucccaauaccauuagaaaaacuauuuacaggaccaucaggagcauuuguaguacaaccacaaaauggcagauguacaacugacggaguccuucuagguaccacacaacucuccccaguaaauauauguacauuacgaggugauguaacacauauagcaggcacacauaauuauacaaugaacuuagcaucccaaaacuggaacaacuacgacccaacagaagagauaccagcaccacuaggaacaccagacuuuguaggaagaauacaaggaguauuaacacaaacaaccagaggggacgguucaaccagaggacacaaagcgacggucucaacaggagauguucacuucacaccaaaacuagguucaguacaauuuaauacugauacgaacaacgauuucgagauuggacaaaacacaagauuuacaccaguaggaguaguccaagaugguaacggcacacaucaaaaugaaccacaacaauggguacuaccauccuacucaggaagaacaggacacaacguccaccuagcaccagcaguugcaccaaccuuuccaggugaacaauuauuauucuuuagauccacaaugccaggauguucuggauauccaaacaugaaccuagacuguuuacucccacaagaauggguucaacacuuuuaucaagaagcagcuccugcacaaucugacgucgcauuacucagauucguaaauccagauacugguagaguuuuauuugaauguaaacuacacaaaucaggauauguuaccguagcacacacaggccaacaugaucuaguuauaccuccaaacggauacuuccgauucgauuccuggguaaaucaauuuuacacuuuagcaccaaugggaaacgguaccggcagacgaagauaa

SEQ ID NO: 34212 - RNA, 1617 nt, Artificial Sequence
  derived and/or modified sequence opt6 from VP1__Norovirus_and/or_Norovirus-like__AY502023
augaaaauggcauccaaugacgcuaacccaagcgacggaucuaccgcaaacuuaguacccgaaguaaacaacgaaguuauggcauuagaaccuguaguaggugcagccauagcagccccagucgcaggacaacaaaauguaauagacccuuggauaagaaacaauuuuguacaagcaccuggaggagaauuuacaguaagcccaagaaaugccccuggagaaauacuauggucagcaccacuaggaccugacuuaaauccauaccucagccacuuggcucgaauguauaacggcuaugcaggagguuucgaaguccaagucauccuagcuggaaacgcuuuuacagcaggaaaaauaauauucgccgcaguuccaccaaacuucccaacagaaggacuuucaccaucucaaguaacaauguucccacacauuaucguagacguuagacaauuagaaccaguauuaauaccacuaccagauguucguaacaauuuuuaccacuacaaccaacuaaaugauccaacuauaaaacuaauugccauguuauacacaccacuuagagcuaauaaugcuggugaagacguuuuuaccguuucauguagaguauuaacaagaccaucuccagacuuugauuuuauauucuuaguuccaccaaccguagaaucaagaacaaaaccauuuacaguacccauacuuacaguagaagaaaugacuaacuccagauuuccuauaccccuagaaaaauuauuuacaggaccaucuggagcauucgucguccaaccacaaaauggaagauguacaaccgacgguguauuauuaggcacaacacaauuaucaccaguaaauauaugcacauuccgaggagacguaacucauauagcaggaacacacaauuauacuaugaaccuagcaagccaaaacuggaauaacuacgauccaacugaagaaauacccgcaccauuagguacuccagauuucguagguagaauccaagguauguuaacacaaacaacucgaggagacggaucgacucgaggccauaaagcaacaguaucaacaggugacguucacuuuacaccaaaacuaggcucuauacaauucaacacagauacaaacaaugacuucgaaaccggacaaaacacaaaauucacacccguaggaguaguacaagacgguaauggaacacaucaaaaugaaccacaacaauggguauuaccaucauauucaggaagaacaggacauaacguacaccuugccccagccguagcaccaacauuuccaggagaacaacuuuuauuuuucagaucaacuaugcccggcugcucaggauauccaaauaugaaccuagacugcuuauuaccacaggaauggguacaacacuuuuaccaagaagcagcaccagcccaaucagacguagcacuauuaagauucguuaauccagauacaggaagaguucuauucgaaugcaaacuccacaaaucaggauacguaacaguagcacauacuggacaacacgaucucguuauaccaccaaaugguuacuucagauuugauucauggguaaaucaauuuuacacauuagcaccaauggguaacggcacaggaagacgacgauaa

SEQ ID NO: 34213 - RNA, 1617 nt, Artificial Sequence
  derived and/or modified sequence opt6 from VP1__Norovirus_and/or_Norovirus-like__KU678202
augaaaauggccucaucagacgcuaauccgucugauggaagcgcugcaaaccuaguaccagaaguaaauaaugaaguuauggcacuugaaccuguagucggcgcugcaaucgcugcaccaguugcaggacaacaaaaugucauugauccuuggauacgaaacaacuucguucaagcaccaggaggagaauuuacaguaucaccaagaaaugcuccaggagaaauacuaugguccgcuccacuuggaccagaucuaaacccuuaucuuucacaucuugcacgaauguauaauggguaugcaggaggauuugaaguacaagucauacuagcaggaaacgcauuuacagcaggaaaaguuauauuugcagcagucccaccaaauuuuccaacagaaggacucucaccgucucaaguuacaauguucccacacauaguuguugauguaagacaauuagaaccaguuuuaauaccauuacccgauguaagaaauaacuucuaucacuacaaucaaucaaaugauccaacuauaaaacuaauagcuauguuauacacaccauuaagagcuaacaacgcaggcgaugauguauucacuguaucuugcagaguacuaacaagaccuucuccagauuuugauuuuaucuuuuuagucccaccaacaguagaaucaagaacaaaaccauucucaguaccuguuuuaaccguagaagaaaugacaaauucccguuuucccauaccauuagaaaaauuauuuacaggaccuucuucagcauucguaguacaaccucaaaauggacgauguacaaccgacggcguccuauuaggaaccacacaacuuuccccaguaaauaucugcacauuuagaggcgauguaacacauauaacaggaucacacaauuauacaaugaaccuugcuucacaaaauuggucaaacuaugacccaacagaagaaauuccagcaccauuagguacaccagauuuuguaggaaaaauacaaggcaugcucacacaaaccacaagaacugauggaucaacuagaggacauaaagcuacagucuauaccggaucagcagacuuugcaccaaaauuaggucgaguucaauucgaaaccgacacuaauaaugauuucgaagcuaaccaaaauacaaaauuuacacccguaggaguaauacaagauggaggcacaacacaucgaaaugaaccacaacaauggguuuuaccuucauauucaggcagaaauacaccaaauguacaucuagcaccagcaguagccccuacuuucccaggagaacaauuauuauucuuuagaucaaccaugccaggauguagugguuauccuaauauggacuuagauugucuccuuccccaagaauggguacaauauuuuuaccaagaagcagcuccugcacaaucagauguagcauuacuaagauuuguuaacccagauacaggaagaguacuauuugaauguaaauuacauaaaucaggauauguaacaguugcacauacaggucaacacgaucuuguuauacccccaaacggauauuuuagauuugacucauggguuaaucaauuuuauacauuagcaccaaugggaaauggugcuggaagaagaagauaa

SEQ ID NO: 34214 - RNA, 1617 nt, Artificial Sequence
  derived and/or modified sequence opt6 from VP1__Norovirus_and/or_Norovirus-like__KX371607
augaaaauggcuucaucagacgcaaauccaucagaugguuccgcagcuaaccuaguaccagaaguaaacaaugaaguaauggcccucgaaccuguaguaggagcagcuauagcugcaccaguagccggccaacaaaauguaauagacccuuggauuagaaacaauuucguccaagcaccagguggagaauuuacaguuuccccaagaaaugcaccaggagaaauauuaugguccgcaccauuaggaccagacuuaaauccauaccuaucacaucuagcaagaauguauaauggauaugcaggaggauuugaaguccaaguuauacuagcagguaaugcauuuaccgcagguaaagucauuuuugcagccguaccaccaaauuucccuacagaagguuuaucaccaucacaaguaacaauguucccacacauaguaguagacgucagacaacuagaaccuguacuaauuccuuuaccagaugugcgcaacaauuuuuaucacuauaaucaaucaaaugauccuacuauaaaauuaauagcaauguuauacacaccacuacgagcaaauaacgccggagaugaugucuucacaguuaguuguagaguuuuaacaagacccucaccagacuucgacuuuauauucuuaguaccaccaacaguugaaucucgaacaaaaccauucucaguaccuguauuaacaguagaagaaaugacuaacucacgauucccuauaccauuagaaaaacuauuuacaggaccaucaucagccuucguaguacaaccacaaaauggucgaugcacaacugauggaguauuacuuggaaccacccaacuaaguccaguuaauauauguacauuucgaggagacguaacucauauaacaggcucacgaaauuacacaaugaaucuagcaucacaaaauuggucaaauuacgauccaaccgaagaaauaccagcaccccuuggaacaccagauuuuguagguaaaauacaaggaguauuaacacaaacaacacgcacugaugguaguacacgaggacacaaagcuacugucuauacagguucugcugauuucgcaccaaaacuaggaagaguacaauucgaaacugauacagauagagauuucgaagcuaaccaaaauacaaaauucacucccguaggcguaauacaagaugguggaacaacacacagaaaugaaccacaacaauggguacuaccaucauauucaggaagaaauacaccaaauguacaccuugccccagcuguagccccuacauuuccaggggaacaacuacuauuuuucagaucaacuaugccaggauguucagguuauccuaauauggaucuugauugcuuauuaccacaagaauggguucaauauuuuuaccaagaggccgcuccagcacaaucagauguagcauuacuaagauucguuaauccggauacaggcagaguacuauuugaauguaaacuacauaaaucaggauacgugacaguagcacacacaggacaacacgauuuaguaauaccaccuaauggcuauuucagauucgacucuuggguuaaucaauuuuauacacuugcaccuaugggaaaugguacaggacgaagacgauaa

SEQ ID NO: 34215 - RNA, 1617 nt, Artificial Sequence
  derived and/or modified sequence opt6 from VP1__Norovirus_and/or_Norovirus-like__KX354112
augaaaauggccucuuccgacgcuaacccaucagauggaucagccgcuaauuuagucccagaaguaaacaacgaaguaauggcuuuagaaccaguaguaggagcagcuauagccgcaccaguagcuggacaacaaaacguaauagaucccuggauaagaaacaauuuuguccaagcaccaggaggagaauuuacaguaagcccaagaaaugcaccaggagaaauauuauggucagcaccauuaggaccugaucuaaauccauaccuaucacaccuagcaagaauguacaacgguuacgcaggaggauucgaaguccaaguuauacucgcuggaaacgcauuuacagcuggaaaaguaauauuugcagcaguucccccaaauuuucccacagaggguuuaucaccaucucaaguuacaauguucccucacauaguaguagacguaagacaguuagaaccaguccuuauaccauuacccgacguuagaaauaauuuuuaucacuacaaucaaucaaaugaccccacaaucaaacuaauagcaaugcuauauacaccauuaagagcaaacaaugccggugaugauguauuuaccguaucaugucguguacuaacacgacccucaccugacuuugauuucauauuuuuaguaccuccaacaguagaaucacgcacaaaaccauucuccgucccaguacuaacagucgaagaaaugacaaauaguagauuuccuauaccacuugaaaaacuauucaccggacccucuucugcauucguaguacaaccacaaaauggaagauguacaacagauggaguacuacuaggaacaacacaauuauccccaguaaacauaugcaccuuucgaggagacguaacacacauaacaggcucaagaaauuacacaaugaaucuugcaagccaaaacuggaacaacuaugacccaacugaagaaauaccagcaccauuagguacaccagauuuuguaggaaaaauucaaggaguucuaacacaaacaacaagaacugacggcagcacacguggacacaaagcaacaguauauacagguagugcagacuuugcaccaaaauuagguagaguucaauucgaaacagauacagaucacgacuuugaagcaaaccaaaauacuaaauucacuccaguuggcguaauccaagacggaucuacuacacacagaaaugaaccacaacaauggguacuaccuucauacucaggaagaaacacacauaauguacaccuugcacccgcaguagcaccuaccuucccaggagaacaauuacuauucuuccgaucaacaaugccaggaugcucaggcuauccaaauauggauuuagacugcuuguuaccccaagaauggguucaauacuuuuaucaagaagcagcaccagcacaaucagauguggcauuauuaagauucguaaacccugauacaggccgaguauuauuugaaugcaaacuucauaaaucaggauauguaacugucgcacauaucggacaacaugaccuagucauuccaccaaacggauacuucagauucgauucuuggguaaaucaauuuuauacacuagcaccuaugggaaacggaacaggaagaagaagauaa

SEQ ID NO: 34216 - RNA, 1617 nt, Artificial Sequence
  derived and/or modified sequence opt6 from VP1__Norovirus_and/or_Norovirus-like__KX353993
augaaaauggcuaguucggacgcaaauccaucagauggaucaacagcuaaucuaguaccugaaguaaacaaugaaguaauggcucuagaaccaguaguaggagcagccaucgcugccccaguagcuggccaacaaaauguaauagacccauggauacgauccaacuuuguacaagcaccaggaggagaauuuacagucagcccaagaaacgcaccaggagaaauacuauggucagcaccacuaggaccagaucuaaauccauauuuaucacaucucgcaagaauguauaacggcuacgcuggaggauucgaaguacaaguaguucuagcaggaaacgcauuuacagcuggaaaaauaaucuuugcagcaguaccaccaaacuuuccaaccgaaggacuaucaccaagucaaguuacaauguucccacauauaaucguugacguuagacaauuagaacccguucuuauaccauuaccagauguaagaaauaauuuuuaucacuauaaucaaucuaacgacccaacaauaaaacuaauagcuauguuauauaccccauuacgagcuaacaacgccggugacgauguauuuacaguuucaugucgaguauuaacucguccaucaccagauuucgauuuuauauuucuaguucccccaacuguagaaagcagaacuaaaccauuuuccguaccaguacuuaccguagaagaaaugacuaauucaagauuuccaauaccauuagaaaaacuuuucacagguccaucaucagcauuuguuguccaaccacaaaacgguagauguaccacagacggcguccuuuuaggaacaacacaauuauccccuguuaauauaugcacauuucgaggagacguuacccacaucccaggaucaagaaacuauacaaugaaccuagcaucccaaaauuggaacucauacgauccaacagaagaaauaccugcaccauuagguacaccugacuucguaggaaaaauacaaggagucuuaacacaaacaacaagaacaaacggaucaacacgaggccauaaagcaacaguauacacaggcucagcagacuuuucccccaaauuaggucgaguucaauucgccacagauacugauaacgauuucgaaaccaaucaaaauaccaaauuuacacccguuggggucauacaagacggagccacaacaccacgaaaugaaccucaacaauggguacuaccaucauauucaggccguaauauacacaauguacaccuggcaccagcaguagcaccaaccuuuccaggugaacaacuauuauucuuccgaucuaccaugccaggaugcuccggcuauccaaauauggacuuagacugccuacuuccccaagaguggguccaauacuucuaccaagaagcugccccagcucaaucagauguagcacuauuacgcuucguuaauccagauacaggucguguccuauucgaaugcaaauuacauaaaucaggauauguaacuguagcacacacaggccaacaugaucuaguaaucccaccuaauggcuauuuccguuucgauuccuggguaaaucaauuuuacacacuagcaccgaugggaaaugguacaggaagacgcagauaa

SEQ ID NO: 34217 - RNA, 1617 nt, Artificial Sequence
  derived and/or modified sequence opt6 from VP1__Norovirus_and/or_Norovirus-like__KR131762
augaaaauggcauccuccgaugcaaauccaucagacgguagugcagcuaauuuaguaccagagguuaauaaugaaguaauggcacuugaaccagucguaggagcagcaaucgcagcaccugucgccggacaacaaaacguaauagacccauggauccgaaauaauuuuguucaagcuccaggcggagaauuuacuguaucaccaagaaaugcaccaggcgaaauacuauggucugcucccuuaggaccagaccuaaaucccuaccuuucccaucuagcuagaauguacaauggcuaugcugguggauuugaaguacaaguaauacuugcaggaaacgcauuuacugcagguaagauaauauuugcagcaguacccccaaauuucccaacagaagguuuaucacccucucaagucacaauguuuccgcacauaauaguugauguaagacaauuagaaccaguauuaauaccccuacccgacguacgaaauaacuucuaucauuacaaccaauccaaugacucaacuaucaaacuuaucgcaaugcuauacaccccacuacgagcuaacaaugccggcgaagaugucuuuacaguaucaugucgaguucuaacuagacccucuccugauuuugauuucauauuucuuguuccaccaacagucgaaucaaggacaaaaccauucacaguaccaauauuaacaguugaagaaaugacaaacucuagauuuccaauuccauuagaaaaacuguuuacugguccaucaggugcauucguaguacaaccacaaaauggaagauguacuacugaugguguucucuuaggaacaacucaauuaucaccagucaauauuuguacauuuagaggagacguaacacauauagcaggaucaagaaauuacacaaugaaucuugcuucauuaaacuggaauaauuacgaucccacagaagaaauacccgcaccacuaggaacaccagauuucguagguaaaauucaagguauguuaacccaaaccacuaaaggugauggaucuaccagaggacacaaagcaacuguauacacagguucagcuccauuuacaccaaaauuagggucaguccaauucucuacagauaccgaaaaugauuuugaaacccaucaaaauacaaaauucacacccgucggaguaauacaagacggaucaacaacacauagaaacgaaccccaacaauggguauuaccuucauacucagguagagauguucauaauguacauuuagcacccgcaguagcaccuaccuuuccaggagaacaauuauuauuuuuccgcucaacaaugccaggaugcucuggcuacccaaauauggaccuagauuguuuauuaccacaagaauggguacaacauuuuuaucaagaagcagcuccugcacaaucugacguugcucuauuaagauuuguaaacccagacaccggacgagucuuauuugaaugcaaacuacacaaaucaggauauguaacuguugcucacacaggucaacacgaucuaguaauaccaccuaauggauauuucagauuugauucuuggguuaaucaauuuuacacccuagcaccuaugggcaaugguacagguagaagacgauaa

SEQ ID NO: 34218 - RNA, 1617 nt, Artificial Sequence
  derived and/or modified sequence opt6 from VP1__Norovirus_and/or_Norovirus-like__AB972519
augaaaauggcaucaucugacgcaaacccgucugacggcucagcagcaaauuuaguaccugaaguaaacaacgaaguaauggcauuagaaccaguuguaggagcagcaauagcugcaccaguagcaggccaacaaaacguaauagacccauggauacgaaacaacuuuguccaagcaccagguggagaauuuacaguaucaccuagaaaugccccaggagaaauauuauggucagcaccacuaggcccagauuuaaaucccuaucuuucacaccuugcaagaauguauaaugguuacgccgguggcuuugaaguccaagugauacucgcaggaaaugcuuucacugcaggaaaagucauuuuugcagccguaccaccaaacuuuccaacagaaggauuauccccaucucaaguaacaauguucccccacaucguaguagauguaagacaauuagaaccaguuuuaauaccucuaccugauguacgcaauaauuuuuaccauuauaaccaaucaaaugacccaacaauuaaacuaauagcaaugcuuuauacaccacuacgagcaaacaaugcaggagaugacguauuuacuguuucuuguagaguccuaacacgcccaucuccugauuuugauuuuauauuucuuguaccaccgacaguugaaucaagaacaaaaccauucucagucccaguucuaaccguagaagaaaugacuaauucuagauucccaauaccuuuagaaaaauuauucacuggcccuucaucagcauucguaguacaaccacaaaacggaagaugcacaacagaugguguacuacuugguacuacucaauuaucaccaguaaacauauguaccuucagaggugauguaacacacauuacaggaucaagaaauuauacaaugaaccucgccagccaaaacuggaacaauuaugauccaacagaagaaauaccagcuccuuuaggaacaccagacuucgucgguaaaauacaaggaguacuaacccaaacaacaagaacagacgguucuaccagaggacauaaagcaacaguauacacaggguccgcagacuuugcuccaaaauuaggaagaguacaauuugaaacagauacagaucacgauuuugaagccaaucaaaauacaaaauuuacaccaguaggaguaauacaagauggagguacaacccauagaaaugaaccucaacaauggguacuacccaguuauuccgguagaaauaccccuaauguacacuuagcaccagcuguagcaccaacauuuccaggagaacaacuacuauuuuuccgcucaacuaugccaggauguucuggauaccccaacauggaccuugauugcuuacuaccucaagaauggguacaauauuucuaucaagaagcagcacccgcucaaucagacgucgcuuuauugagauuuguaaauccagauaccggcagaguauuauuugaauguaaacuacauaaaucagguuauguaacaguagcacacacuggccaacaugaccuaguaauaccaccaaauggauauuucagauucgauucuuggguaaaucaauuuuacacacuagccccaaugggcaaugguacaggucgacgaagauaa

SEQ ID NO: 34219 - RNA, 1617 nt, Artificial Sequence
  derived and/or modified sequence opt6 from VP1__Norovirus_and/or_Norovirus-like__AB972498
augaaaauggcaucaucagaugcaaacccauccgacggcucagcagcuaaucuugucccagaaguaaacaaugaaguuauggcuuuagaacccguaguaggugccgcaauagcagcaccaguagcaggacaacaaaauguaauugauccuuggauuagaaauaauuuuguacaagcaccuggcggcgaauuuacaguaaguccuagaaaugcaccaggagaaauacuauggucugcaccacuaggaccagauuuaaacccauaucuaucucacuuagcaagaauguauaacggauaugcaggaggauucgaaguucaagucauauuagcaggcaaugcauucacagcugguaaaguuauauucgcagcaguacccccaaauuuucccacugaagguuuaucucccagucaagucacuauguuuccacacauagucguugacguaagacaauuagaaccaguauuaauaccacuccccgacguaagaaacaauuuuuaucacuacaaucaauccaaugacccaaccauaaaauuaauagccauguuauauacaccacuuagagccaacaacgcaggagacgaugucuuuacaguauccuguagaguauuaaccagaccaucuccagauuuugacuuuauauuuuuagucccuccaacaguagaaucucgaaccaaaccauucucuguaccaguauuaacaguagaagaaaugacaaacucaagauuucccauaccacuugaaaaauuauuuacaggcccaucuucagcauuuguaguacaaccucaaaacgguagauguacuacagacgguguacuauuaggcaccacacaacuaucaccaguaaauauaugcacuuucagaggagauguaacacauaucacuggaucaagaaacuauacaaugaacuuagccucacaaaacuggucaaauuacgacccaacagaagaaauaccagcaccacuaggaacacccgacuuuguaggaaaaauacaaggaguuuuaacacaaacaacacgcacagacggaucaacuagaggacauaaagccacagucuacacaggaucagcugauuuugcaccuaaacuuggcagaguacaauuugaaacagacacagaucaugacuucgaagccaaccaaaauacaaaauucaccccaguaggaguaauacaagacggagguacaacacacagaaaugaaccccaacaauggguauuaccaucauauucaggccguaauacaccaaacguacaucucgcaccagcaguagcaccuacuuucccaggagaacaauuauuauucuuuagaucaacaaugccaggcugcucuggcuauccaaacauggaacuagacugcuuacuaccucaagaauggguacaauauuuuuaucaagaagcagcacccgcacaaucagauguugcuuuacucagauuuguaaauccugacacaggaagaguauuauuugaaugcaaauuacauaaaucaggauacguaacaguagcacauacaggacaacacgaucuuguaauaccaccaaauggauacuuuagauuugauucauggguaaaucaauuuuacacccuggcuccaauggguaacggaaccggcagacgaagauaa

SEQ ID NO: 34220 - RNA, 1617 nt, Artificial Sequence
  derived and/or modified sequence opt6 from VP1__Norovirus_and/or_Norovirus-like__AB972488
augaaaauggcaucaucugacgcaaacccaucagauggaucagcagccaacuuagucccagaaguaaacaacgaaguaauggcacuagaaccaguaguaggugcugcaauugcagccccuguagcuggacaacaaaauguuauagaucccuggauaagaaacaacuucguacaagcaccagguggagaauuuacaguuucaccaagaaacgcaccaggagaaauacucuggucugccccacuugguccagacuuaaacccauaucucucccaccucgcaagaauguauaaugguuaugcugguggauucgaaguucaagucauacuugcaggaaaugcauuuacagcagguaaaguuauauucgcagcaguaccucccaauuuuccaaccgaagguuuaaguccaagucaaguaacaauguuuccacauauaguaguagacguaaggcaacuagaaccuguacuaauaccacuacccgacguuagaaacaacuucuaucauuauaaccaaucaaaugauccaacaauaaaacuaauagcaaugcuauauacaccacuucgcgcaaacaaugcaggagacgauguauucacaguaucaugucgaguuuuaacaagaccauccccugacuuugacuuuauauuucuaguaccuccgacuguagaaucaagaacaaaaccauuuucuguaccaguacuuacaguagaagaaaugacaaacucaagauucccaauacccuuagaaaaauuauucacagguccauccuccgcauuuguaguacaaccacaaaacggcagauguaccacagauggaguauuacuagguacaacacaauuaucaccagucaauaucuguacauuuagaggagaugucacacauaucacaggaucaagaaauuauacaaugaaucuagcaucacaaaauuggucaaacuaugauccaacagaagaaauacccgcaccacuaggaacaccugauuuuguaggaaaaauucaaggaguacuaacacaaacaacacgaacagauggaucaacuagaggccacaaagcaacaguauauaccggaucugcagauuuuguuccaaaauuaggaagaguacaauucgaaacagacacagaucaugauuuugaagcaaaucaaaacacaaaauuuacaccuguaggaguaauacaagacggaucaacuacccaccgaaaugaaccacaacaauggguauuaccaucuuacaguggccgaaauacacccaauguacaccuagcaccagcuguagcaccaacauuucccggagaacaacuauuauucuucagaagcacaaugccaggaugcuccgguuauccaaauauggacuuagauugccuauuaccacaagaauggguucaauauuuuuaucaagaagcagcuccagcucaaucugacguagcacuauuaagauucgucaauccagacacuggaagaguauuauuugaaugcaaauuacacaaaagcggauauguaacaguagcacauacaggacaacacgaucuaguaauuccaccaaacggauauuuucguuucgacucauggguaaaccaauuuuauacucuugcuccuauggguaauggaacagggcgcagaagauaa

SEQ ID NO: 34221 - RNA, 1617 nt, Artificial Sequence
  derived and/or modified sequence opt6 from VP1__Norovirus_and/or_Norovirus-like__AB972483
augaaaauggcaaguucagaugcaaauccaucagaugguucugcugcaaacuuaguuccagaaguuaacaacgaaguaauggcucuagaaccaguuguaggagccgcaauagcagcaccaguagccggccaacaaaacguaauugacccauggauacgcaacaauuucgugcaagcaccaggaggugaauuuacuguaaguccacgaaacgcaccuggagaaauccuauggucagcaccacuaggcccagaccuaaauccuuacuuaucccauuuagcuagaauguauaacggauaugcugguggauucgaaguacaaguaauacuagcagguaaugcauuuaccgcagguaaaguaauauuugcugcaguaccaccuaauuucccaacagaaggauuaucaccuucucaaguuacaauguucccucauauaguaguagauguucgacaacuagaaccaguucuaauaccauuaccagacguaagaaauaauuuuuaucauuauaaccaaucaaacgacccaacaauuaaauuaauugcaauguuauauacaccucuuagagcaaauaaugccggugacgacguauuuacagucucaugucgaguuuuaacucgaccgagcccugauuuugacuuuauuuuccuaguaccaccaacaguugaaucccgaacaaaaccauucucuguccccguauuaacuguagaagaaaugaccaacucaagauucccaauaccccuugaaaagcucuuuacaggaccuucaucagcauuuguaguacaaccacaaaauggaagauguaccaccgauggaguacucuuaggaacuacacaauuaucaccaguaaauauauguaccuuuagaggagacguuacucauauaacaggcucuagaaauuauacaaugaaucucgcaucacaaaacuggaacaauuacgauccaacagaagaaauaccugcaccacuaggaacaccugacuuugucggaaaaauucaaggaguauuaacacaaacaacccgcaccgacggaucaacaagaggacacaaagcaacuguauacacagguucagcggacuuugcaccaaaauuaggacgaguccaauucgaaacagacacagaucacgauuucgaaacaaaucaaaauacaaaauucacuccuguaggagucauacaagaugguggcacuacacauagaaaugaaccacaacaauggguacucccuaguuauuccggacgcaauacaccaaauguucacuuagcaccagcagucgcaccaacauuuccuggagaacaacuuuuauucuuucguucuaccaugccuggauguucaggcuauccaaauauggaucuagacugccuauuaccucaagaauggguacaauauuucuaccaagaagcagcacccgcucaaucagacguagcauuauuaagauuuguaaacccagacacuggaagaguacuauuugaauguaaauuacauaaaucaggauauguaacaguagcacauacaggccaacaugaucuaguuauaccaccaaauggauauuuucgauucgauuccuggguaaaucaauuuuauacauuagcucccaugggaaacggcacaggcagaagaagauaa

SEQ ID NO: 34222 - RNA, 1617 nt, Artificial Sequence
  derived and/or modified sequence opt6 from VP1__Norovirus_and/or_Norovirus-like__KP864106
augaaaauggcaucaucagaugcaaaccccuccgauggcucagcagcaaauuuaguaccugaagucaauaacgaaguaauggcacuagaaccuguuguuggugcagcaauagcugcaccuguagcaggucaacaaaauguaauagacccauggaucagaaacaacuuuguucaagcaccuggaggugaauuuacuguuucaccuagaaaugccccaggagaaauacuuuggucugcaccauuagguccagaucuaaaccccuaucuaucacacuuagcacgaauguacaacgguuaugcugguggauucgaaguucaaguaauauuagcaggaaaugcauuuacagcaggcaaaguaauuuucgcagcaguuccaccuaauuucccaacagaaggacuuucacccucacaaguuacuauguucccacacauaguaguagacguaagacagcucgaaccaguacuaauaccauuaccugauguacgaaauaauuuuuaccacuauaaccaaucuaacgaucccacaauaaaacuaauagcaauguuauacacuccauuaagagcaaacaacgcuggugaugaugucuuuaccguauccugcagaguacuaaccagaccaucuccugauuuugacuuuauauuuuuaguacccccaacagucgaauccagaacaaaaccuuucucaguacccgucuuaacuguagaagaaaugacaaauucaagauuuccaauaccucuugaaaaauuauucacaggaccaucaucugcauucguaguacaaccacaaaacggaagauguacaacagaugguguacucuuaggaacuacacaacuuaguccuguaaauauuuguaccuuuagaggagacguaacacacauaacaggaucacauaauuauacuaugaaucuugcaucacaaaacuggucaaacuaugauccaacugaagaaauacccgcaccucuaggaacccccgauuucgucgguaaaauacaaggaguuuuaacacaaacuacacgaacagacgguaguacccgaggacauaaagcaacaguauauacaggaucagcagacuuugcaccuaaauuaggccgaguacaauuugaaacagauaccgaccacgauuucgaagccaaucaaaauacaaaauucacaccagucggaguaauacaagauggugguacaacacacagaaaugaaccacaacaauggguacuccccucuuacucaggaagaaacaccccaaauguacacuuagcuccagcuguagcaccaacauucccuggagaacaauuacucuucuucagaucaacaaugccagguugcucuggauacccaaauauggaccuugauuguuuacuuccacaagaauggguacaauauuucuaucaagaagccgcaccagcacaaucagacguugcucuauuaagauuuguaaacccagauacuggaagagucuuauuugaaugcaaacuucacaaaucaggcuacguaacuguugcacacaccggacaacacgauuuagucauaccaccuaauggcuauuucagauucgauucauggguaaaucaauucuauacauuagcuccaaugggaaauggaacagguagaagaagauaa

SEQ ID NO: 34223 - RNA, 1617 nt, Artificial Sequence
  derived and/or modified sequence opt6 from VP1__Norovirus_and/or_Norovirus-like__KR904216
augaaaauggcaucaagcgaugcaaacccaucagauggaucuacagcuaaucucgcaccagaaguaaauaaugaaguaauggcacuagaaccagucguuggagcagcaauagcagcaccagucgcaggacaaaagaauguaaucgauccauggauaagaaauaacuuuguacaagcaccaggaggcgaauuuacaguuagucccagaaaugcaccaggagaaauauuaugguccgccccauuaggacccgaucuuaauccauaucuuucucacuuagcaagaauguauaacggauaugcaggaggauucgaaguccaaguaauccuagcuggaaacgccuuuacagcuggaaaaauaauauucgcagcagugccaccaaacuuucccaccgaaggacuaucaccaucucaaguaacaauguuuccacacauaauaguagauguaagacaauuagaacccguacuaauuccauuaccugauguacgaaacaacuuuuaucacuauaaccaaucaaacgacccaaccauuaaauuaauagcaaugcuauacacuccguuacgagcaaauaaugcaggagaugaugucuuuacaguuuccuguagaguuuuaacacgaccaucuccagauuuugacuucaucuuucuaguacccccaaccguagaaucacgaaccaaaccuuucucagcuccaguauuaacuguagaagaaaugacaaacucacgauuuccaauaccacuugaaaaacuauucacaggaccaucuucagcauuuguuguacaaccucaaaauggacgaugcacaacugacggcguauuacucgguacaacgcaauuaagcccaguuaauauauguacauuuagaggcgauguaacucacauaucaggaucaagaaacuacacaaugaacuuagcuucacaaaacuggaacucauacgauccaaccgaagaaauaccagcaccauuagguacaccagacuuuguaggaaaaauacaagguguauuaacccaaaccacaagaacuaaugguucaacacgaggacauaaagcaacagucuauacaggaagcgcagacuucucaccuaaauuaggacgcguccaauuugcaaccgauacagauaacgacuucgaaacaaaucaaaauacaaaauuuacacccguaggcgucauccaagaugggaguacaaccccacgaaaugaaccacaacaauggguauuaccaucauauucaggacgaaauacucauaauguucauuuagcaccagcaguugcaccaaccuucccaggagaacaacuucuauucuuuagaucaacaaugcccggaugcucagguuacccuaauauggauuuagauuguuuacuaccacaagaauggguacaauacuucuaccaagaagcagcacccgcacaaucagacguugcccuacuaagauucguaaacccugauaccggccgaguucuauucgaauguaaacuucacaaaucaggauauguaacuguugcacauacaggacaaagagaucuaguaauucccccaaauggauauuuccgauucgacucauggguaaaucaauuuuacucacuagcuccaaugggaaauggaacaggaagacgaagauaa

SEQ ID NO: 34224 - RNA, 1617 nt, Artificial Sequence
  derived and/or modified sequence opt6 from VP1__Norovirus_and/or_Norovirus-like__AB933771
augaagauggcaagcagugacgcuaacccaucagauggcucaaccgcaaaccuaguaccagaagugaauaaugaagucauggcacuagaaccaguaguaggagccgccaucgccgcaccaguagcuggucaacaaaauguaauagauccauggauaagaaauaacuucguacaagcaccaggaggagaauuuacaguaucaccaagaaaugcaccaggagaaauacuauggucugcaccuuuagguccugaucuuaaucccuaucuaucucacuuagcaagaauguacaacggcuacgcaggaggauuugaaguacaagucauacuagcaggaaaugcuuuuacagcaggaaaaauaauauucgcagccgucccaccuaauuuuccaacagaaggauuaucuccaucacaaguaacaauguuuccacacauaaucguugacguacgacaacuagaaccaguauuaauaccauuaccagauguaagaaacaauuucuaccauuauaaucaaucaaaugacccaacaauaaaacucauugcuaugcuauauacaccccuuagagcaaacaacgccggagacgaugucuucacaguaucauguagaguacuaacaagaccuaguccagacuucgacuucauauuccuaguuccaccaaccguugaaucaagaaccaaacccuucucaguaccaguuuuaaccguagaagaaaugaccaauuccagauuucccauaccuuuagaaaaacuauuuaccggaccauccagugcuuucguaguucaaccucaaaauggaagauguacaacagacggaguuuuguuaggaacaacucaacuaucuccaguaaauauauguacauuccgaggagacguaacacacauaacaggaucacgaaauuacaccaugaacuuagccucccaaaauuggaauaguuacgacccaacagaagaaauaccagcuccucuuggaacuccagauuucguaggaaaaauacaagguguauuaacccaaacaacuagaacaaacggaucaacuagaggacacaaagcuacaguuuauacagguucugcagauuuuucgccaaaauuaggacgcguacaauuugcaacugacacagauaacgauuuugaagccaaucaaaacacaaaauucacucccguaggaguaauacaagacggaucaacaaccccaagaaaugaaccacaacaauggguucucccaucuuauucaggcagaaauauacauaauguacacuuagcaccagccguagcaccaacauuuccaggagaacaauuacuauucuuuagaucaacaaugccaggauguuccggguaucccaauauggauuuagauuguuuacuaccucaagaauggguucaauauuucuaccaagaagccgcaccagcucaaucagacguagcuuuacuaagauucguaaauccagacacuggaagagucuuauucgaauguaaacuucauaaaucaggauauguaacuguagcacacacaggucaacaugaucuuguaauacccccaaauggauauuuucgauuugacucauggguaaaccaauuuuauacgcuagcaccaaugggaaauggaacuggaagaagacgguaa

SEQ ID NO: 34225 - RNA, 1617 nt, Artificial Sequence
  derived and/or modified sequence opt6 from VP1__Norovirus_and/or_Norovirus-like__LC005732
augaaaauggcuucaucagaugcuaauccaucagauggaucagcagccaacuuaguuccagaaguaaacaacgaaguuauggcauuagaaccaguaguaggagcagccauagcagcaccuguagccggacaacaaaaugucauagauccauggauacgaaauaacuuuguacaagcacccgguggugaauuuacaguaucucccagaaacgcaccaggagaaauuuuauggucagcaccacuaggaccagaucuaaauccauaucuaucacaccuugcaagaauguacaacggauacgcaggcggauucgaaguccaaguaauacuagcaggaaaugcauucacagcugguaaaguaauauucgcugcaguaccaccuaauuucccaacagaaggacucucuccuucccaaguaaccauguucccucacaucguaguagacguucgacaacuagaaccaguacuaauaccauuacccgacguacgaaauaauuuuuaucacuauaaccaaagcaaugauccuaccauuaaacuaauagcaaugcuauacaccccacuaagagccaacaacgcaggagacgacguuuucacaguaucauguagaguauuaacaagaccuagcccagauuuugacuuuaucuuuuuaguuccucccacaguagaaucaagaacaaaacccuucucaguaccaguauuaacuguagaagaaaugacaaacuccagauuuccaauuccauuagaaaaacucuuuacaggaccaucuagugcuuucgucguacaaccacaaaacggaagauguacaacugacggcgucuuauuaggaacaacacaauuaucuccuguaaacauauguacauuuagaggagacgucacacauauaacuggaucaagaaauuauacaaugaauuuagcaagucaaaacuggaauaauuaugacccaacagaagaaauuccugcaccucuaggaacaccugacuuuguuggaaaaauucaagguguauuaacacaaacaacaagaacagacggaucaacaagaggacacaaagcaacaguauacacaggaucagcagauuuugcacccaaacuaggacggguacaauuugaaacugacacagaucgugacuucgaggcuaaucaaaacacaaaauucacacccguaggaguuauacaagacggaggaacaacacaucguaaugaaccacaacaauggguacuaccaucuuauucaggacgaaauacaccaaacguucacuuagcucccgcaguagcccccacauuuccaggugaacaacucuuauucuucagauccacaaugccuggaugcucuggauauccaaacauggaccuagacugccucuuaccucaagaauggguacaauauuuuuaucaagaagcagcaccagcccaaucagacgucgcccuucuaagauuuguaaaucccgacacaggacgaguauuauuugaauguaaacuacacaaaucaggcuaugcaacuguagcacacaccggacaacacgauuuaguaauaccaccaaauggauacuuuagauuugacucauggguaaaucaauucuacaccuuagcccccaugggcaaugguacaggacgacggcgauaa

SEQ ID NO: 34226 - RNA, 1617 nt, Artificial Sequence
  derived and/or modified sequence opt6 from VP1__Norovirus_and/or_Norovirus-like__KP293591
augaaaauggcaucaucugaugcuaaucccagugauggauccgcagcaaauuuggucccagaaguaaacaaugaaguaauggcacuagaacccguaguaggagccgcaauagcugcaccaguagcaggccaacaaaaugucauagacccauggauucgaaauaauuuuguacaagcaccuggaggagaauuuacagucucaccaagaaaugccccaggcgaaauuuuauggucugcccccuuaggcccagaccuuaaccccuauuuaucucaccuagcucguauguauaacggauacgcugguggauucgaaguacaagucauacuagcaggcaaugcauuuacagccggaaaaguaaucuuugcagcuguuccaccaaauuucccgacagaaggcuuaucuccaucacaaguaacaauguucccacacauagucguagacguaagacaauuagaaccaguucuuauuccccuuccagauguaagaaauaacuucuaucauuauaaucaaucaaaugacccaacaauaaaauuaauugcaaugcuauacacaccauuacgagcuaauaaugccggugaugauguauuuaccguaucauguagaguauuaacccgaccaucuccagauuuugacuucauauuccuaguuccaccaacugucgaaucucgaacaaaacccuucucagucccaguauuaacaguugaagaaaugacaaauucaagauuuccaauuccauuagagaaauuauuuacaggucccucaucagcuuuuguaguacaaccccaaaauggaagaugcacaacagauggagucuuacucggcacaacccaacuuucaccaguaaauauauguacuuuuagaggcgauguaacucacauaacuggaucacgaaauuacacaaugaacuuagcaucacaaaacuggaauaauuacgauccaacagaagaaauacccgcuccuuuaggaaccccagacuuuguaggaaaaauacaagguaugcucacacaaacaacaagagccgauggaucaacaagaggacauaaagcaacagucuacaccggcucagcuaacuuugcuccaaaacuuggaagaguacaauuugaaacagacacagaucaugauuuugaagcaaaccaaaauaccaaauucacaccagucgguguaauacaagacgguucuacaacacaccgaaaugaaccacaacaauggguccucccaucuuauuccggaagaaacacaccaaauguacacuuagcaccagcaguagcaccaacuuuuccaggagaacaauuauuauucuuuagaagcaccaugccaggaugcucaggcuauccaaacauggaucucgacugccuucucccacaagaauggguucaauacuucuaccaagaagccgcaccagcacaaagcgauguagcacuacuaagauucguaaauccagauacaggaagaguacuauucgaaugcaaauuacacaaaucaggauauguaacugucgcucauacaggacaacacgaucuaguuauuccacccaaugguuauuucagauucgacucauggguaaaccaauucuacacacuagcgcccaugggcaauggcacaggcagaagacgauaa

SEQ ID NO: 34227 - RNA, 1617 nt, Artificial Sequence
  derived and/or modified sequence opt6 from VP1__Norovirus_and/or_Norovirus-like__KP176396
augaaaauggcaucguccgacgcaaacccaucagacggaagugccgcuaaucuaguaccugaaguaaauaacgaaguaauggcauuagaaccaguagucggugcugcaauagcagccccuguagccggacaacaaaacguaaucgacccauggauucgaaauaauuuuguacaagcaccaggaggagaauuuacugucucaccuagaaacgcuccaggagaaauauuauggucagcuccauuaggacccgaucuaaauccauauuuaucacacuuagcacgaauguacaacggauaugcaggaggauucgaaguacaaguaauacuagcaggaaaugcauuuacagcuggcaaaguaauauuugcagcuguaccacccaacuuuccaaccgaaggucuauccccaucacagguaacaauguuuccucacauuguuguagacguaaggcaacucgaaccaguacuaauuccuuuaccagaugucagaaauaauuuuuaucauuauaaucaaucaaaugauccaacaauaaaauuaauugcaaugcuuuauacaccacuucgagcaaauaaugcaggagacgacguauuuacaguuucuuguagaguauuaacuagaccaucaccugauuuugauuucaucuuuuuaguacccccuaccaucgaaucaagaaccaaacccuucucagucccaguauuaacaguagaagaaaugaccaacucaagauucccaauuccauuagaaaaacuauuuacaggaccaucaucagcuuuuguaguccaaccacaaaacggacgaugcacaacagaugguguacuauuaggaacaacacaauuaucaccaguuaacauauguacuuucagaggugacgucacacauaucacagguucuagaaacuacacaaugaacuuagcaucucaaaacuggaauaauuacgaucccacagaagaaauacccgccccacuaggaacaccagacuucguaggaaaaauacaaggaguacuaacacaaacuacaaggacugacgguucaacaagaggucacaaagcaacugucuauacaggaagcgcugacuucuccccuaaauuagguagaguacaauuugaaacugacacagaccaugauuucgaagcaaaucaaaauacuaaauucacuccaguaggaguuauccaagacggcggaacaacacauagaaacgaaccucaacaauggguauuaccuucauauuccggaagaaauacccccaacguacacuuagcuccugcaguagcaccuacauuuccaggagaacaacuacuguuuuucagaucuacuaugccaggaugcucuggauacccaaauauggacuuagauugcuuauuaccacaagaauggguacaauauuucuaucaagaagcagcaccagcacaaucagauguagcauuacuacguuuuguaaacccagauacaggacguguucuauuugaaugcaaauuacacaaaucuggauacguaaccguagcccacacaggacaacaugauuuaguuauaccaccaaacgguuacuuccgauuugauuccuggguaaaucaauuuuacacacuagcuccaauggguaauggaacagguagaagaagauaa

SEQ ID NO: 34228 - RNA, 1617 nt, Artificial Sequence
  derived and/or modified sequence opt6 from VP1__Norovirus_and/or_Norovirus-like__KP176394
augaaaauggcaagcuccgaugcaaacccuucagauggaagcgcagcaaaccuuguacccgaaguuaacaaugaagucauggcuuuagaaccaguaguaggcgcagcaauagcagcuccaguagccggacaacaaaauguaauugauccauggauaagaaauaauuuuguccaagcaccaggaggagaauuuaccgugucaccaagaaaugcaccaggugaaauacuuuggucagcaccauuaggaccagaucuaaauccauaucuaucccauuuagcuagaauguauaaugguuaugcaggagguuucgaaguacaaguaauacuagcaggcaaugccuuuacagcuggaaaaguaauuuucgcagcaguacccccaaacuuccccacugaaggacuaucuccaucucaaguaacaauguucccacacauaguaguagacgucagacaacuagaaccaguauuaauaccacuuccagauguccgaaauaauuucuaccauuacaaucaaaguaaugauccaacaauaaaauuaaucgcuauguuauacacuccccuuagagcuaacaaugccggugaugauguauucacaguaucaugucgaguucuaacacgaccauccccagacuucgacuucauauuucuaguuccuccaaccguagaaagcagaacuaaaccauucucaguaccuguauuaacagucgaagaaaugacaaacucaagauuuccuaucccacuugaaaaacuauucaccggcccaucuucugcuuucgucguacaaccucaaaaugguagaugcacaacugacggaguauuauuagguacaacucaauuaucaccugucaacauauguacauucagaggagacgucacacauauaacaggcucucacaauuacaccaugaaccuagcaagucaaaacuggucuaauuacgauccagcagaagaaaucccagcaccauuaggcacaccagacuuugucggaaaaauacaaggagucuuaacacaaacaacaagaacagacgguucaacacgaggacacaaagcuacuguuuacacugguucagcagauuuugcaccaaaauuaggaagaguccaauuugaaacugacaccgacagagauuuugaagcaaaucaaaacacaaaauuuacaccaguaggaguaauccaagacggaggaaccacccaucgaaacgaaccacaacaauggguauuaccuucauauucaggccguaauacaccaaauguacacuuagcuccagccguagcuccaaccuuuccuggagaacaauuacuuuucuuuagaucaaccaugcccgguuguucaggcuaucccaacauggaccuagauugcuuauuaccacaagaauggguacaauauuuuuaucaagaagcagcaccagcacaaucagauguugcacucuuacgcuucguaaacccagacacuggacgaguauuauucgaauguaaacuacacaaaagcggauauguaacaguagcacacacaggacaacacgaucuaguaauaccaccuaaugguuauuucagauuugacuccuggguaaaucaauuuuacacauuagccccaaugggaaacgguacaggacgaagacgauaa

SEQ ID NO: 34229 - RNA, 1617 nt, Artificial Sequence
  derived and/or modified sequence opt6 from VP1__Norovirus_and/or_Norovirus-like__KP096348
augaaaauggcauccucagaugcaaauccuucagauggauccgcagcaaauuuaguaccagaaguaaauaaugaaguaauggcacuagaacccguaguaggcgcagcaauugcugcaccaguagcaggacaacaaaauguaauagaucccuggauuagaaauaauuuuguacaagcaccaggaggcgaauuuacuguuucaccaagaaaugcaccaggagaaauauuauggucugcuccauuaggaccagaucuaaauccauaccuaagucaucuagcaagaauguauaacggauacgcaggaggauuugaaguacaaguuauacuagcuggaaacgcuuucacagcaggaaaaguaauauucgcagcaguaccaccaaacuuuccaacagaaggacuaucucccagucaagucaccauguuuccacauauuguaguagauguacgucaauuagaaccagucuuaauaccauuaccagacguacgaaauaauuucuaccauuacaaucaaucuaacgacccaacaauaaaacuaauagcuaugcucuauacuccauuaagagcaaacaaugcuggcgaugauguuuuuacaguuucuugcagaguucuaacaagacccucuccagacuucgauuuuauauuucuaguaccaccuacuguagaaucacgaaccaaaccauuuucaguacccguuuuaaccguagaagaaaugacaaauaguagauuuccaauaccacuugaaaaacuauuuacaggaccaucaagugcuuucguaguacaaccacaaaauggaagauguacaaccgacggaguauuauuaggaacgacucaacuaucaccaguaaauauuuguaccuuucgaggagauguaacccauauaacaggaucacauaacuauaccaugaaucuagcuucacaaaauuggucaaauuaugauccaacagaagagauaccagcacccuuaggaacaccagauuucguaggcaaaauacaaggaguauuaacucaaacaacaagaacugauggaucaacaagaggacauaaagcaacaguauacacagguagcgcugacuuugcuccaaaauuaggaagaguacaauuugaaacagauacaaaccaugauuuugaugcaaaccaaaacacgaaauuuacaccagucggaguaauacaagacggaggaacaacacaccgaaaugaaccccaacaauggguauuaccauccuauagcggcagaaauacaccuaacguccaucucgccccugcaguagcaccaacuuucccuggugaacaacuccucuucuuuagaucaacuaugccaggauguucuggcuauccuaacauggaucuugauugccuacuaccccaagaauggguucaauauuuuuaucaagaagcagcacccgcacaaagcgauguugcauuauugcgauuuguuaaucccgauacaggaagaguacuuuuugaaugcaaauuacauaaauccggcuauguaacagucgcacacacaggacaacacgacuuaguuauuccaccaaacggauauuuucgauucgauucuugggucaaucaauuuuacacuuuagcacccaugggaaauggaacaggacgacgcagauaa

SEQ ID NO: 34230 - RNA, 1617 nt, Artificial Sequence
  derived and/or modified sequence opt6 from VP1__Norovirus_and/or_Norovirus-like__KP096344
augaaaauggcaaguucagacgcaaauccaucugauggaucagcagcuaaccuaguaccagaaguaaacaacgaaguaauggcuuuagaacccguuguaggagcagcaauagcagcaccagucgcuggucagcaaaauguaauagauccauggauuagaaauaauuuuguacaagcaccaggaggagaauuuacaguaucaccaagaaacgcaccaggcgaaauacuuuggucagcaccacuaggacccgaucuaaauccuuauuuaucacaccuugcaagaauguacaacggauacgcaggcggauuugaaguccaaguaauauuagcaggaaacgcguuuacggcaggaaaaguaauauuugcagccguacccccuaacuucccaacagaaggacuauccccaucacaaguuacaauguucccacacauagucgucgacguacgccaauuagaaccaguucuaauaccccuacccgauguccgaaacaauuucuaucacuauaaucaaucuaaugacccaacaauuaaacuaauagccaugcuauauacaccauuaagagcaaacaaugcaggcgacgauguuuucacaguuucaugucgaguacuaacucgaccaucaccagacuucgauuuuauauuccuaguaccaccaacuguagaaucaagaaccaaaccuuucucagucccaguauuaacaguugaagaaaugacaaauucucgauuuccaaucccuuuagaaaaauuauuuacaggaccaucaucagcuuuuguaguccaaccacaaaacggacgaugcacaacagacggaguauuauuaggaacaacacaacuuucccccguaaacauauguacauuuagaggagauguaacacauauaacaggcucgagaaauuacacaaugaauuuagcaucacaaaauuggucauccuacgauccaacagaagaaauaccugcaccauuagguacacccgacuucguaggaaaaauacaagguauguuaacacaaaccacuaggacugauggcucaacaagaggacacaaagcaacagucuauacagguucagcagauuucgccccaaaacucggacgaguucaauucgagacagacacugaucaugauuucgaagcaaaucaaaauacaaaauuuaccccaguaggaguaauacaagauggaucaacaacacauagaaaugaaccacaacaauggguacuuccaucauauucaggaagaaacacacccaauguacacuuagccccugcaguagcaccaaccuuuccaggagaacaauuauuauucuuuagaaguacaaugccaggaugcucaggcuauccaaauauggaucuagauugccuacucccacaagaauggguacaauacuuuuaucaagaagcagcaccagcacaaucagacguagcucuccuucgauuuguaaacccagauacuggacguguacuauuugaaugcaaacuacauaaaucuggcuaugucacaguagcccacacaggacaacacgaucuaguaauaccaccaaauggauacuucagauucgacucauggguuaaucaauuuuacacucuugcaccaaugggaaauggcacaggaagaagaagauaa

SEQ ID NO: 34231 - RNA, 1617 nt, Artificial Sequence
  derived and/or modified sequence opt6 from VP1__Norovirus_and/or_Norovirus-like__KM982946
augaaaauggcaucaucagaugcaaauccuucagauggaagugccgcaaaccuugucccagaaguaaacaaugaaguuauggccuuagaaccaguugucggagcagcuauagcagcaccaguagcaggccaacaaaauguaauagaucccuggauuagaaauaacuucguacaagcaccuggaggcgaauuuacaguuucaccaagaaacgcuccaggcgaaauuuuauggucugcuccucuuggaccagauuuaaauccauaucuaucacaccuugcaagaauguacaacgguuaugccgguggcuucgaaguacaaguaauauuagcaggcaaugcauucacagcaggaaaaguaaucuucgcagcaguaccaccuaauuuuccaacagaaggacuaucucccucacaaguaacaauguuuccacacauaguugucgacguaagacaauuagaaccaguacucauucccuuaccagacguccgaaauaacuucuaccauuauaaucaaucaaaugauccuacaauaaaacuaauagcaauguuauauacuccauuacgggcaaauaaugcaggagaugauguuuuuacaguaucauguagaguucuuacaagaccaaguccagacuuugacuucauauuuuuaguaccaccaacaguagaaaguagaacaaaaccauucucaguuccugucuuaaccguugaagaaaugacaaauucaagauuucccauuccacuagaaaaacucuuuacuggcccauccucagcuuucguaguacaaccacaaaacggaagauguacaacagacggaguauuauuaggcacaacucaacuaucaccuguaaauauaugcaccuuuagaggugacguaacacauauaacuggcuccagaaauuacacaaugaaucuugccucacaaaacuggucaaauuacgacccaacugaagaaauacccgcaccucucggaacaccugacuuuguaggcaaaauacaaggagucuuaacacaaacaaccagaacggacgguagcacacguggacacaaagcaacaguauauacuggcucagcagauuucgcaccaaaacuaggcagaguucaauuugaaacugauaccgacagagauuucgaaacaaaucaaaauacaaaauuuaccccaguaggaguaauacaagacggcggaacuacacauagaaaugaaccacaacaauggguuuuaccuuccuauucuggacgaaauacuccaaacguacaucuagcaccagcaguagcuccuacuuuuccaggcgaacaacuacuauuuuuccgaucaaccaugccaggaugcucaggauauccaaauauggaucuagacugucuacuaccucaagaauggguacaauauuucuaucaagaagccgccccugcacaaucagacguagcauuauuaagauucguaaacccugauacuggaagaguacucuuugaauguaaauuacauaaauccggauacguaacuguagcacauacaggccaacacgauuuaguuauuccaccuaauggauacuucagauucgauucauggguaaaucaauuuuauacauuagcuccaaugggaaauggaacuggacgaagacgguaa

SEQ ID NO: 34232 - RNA, 1617 nt, Artificial Sequence
  derived and/or modified sequence opt6 from VP1__Norovirus_and/or_Norovirus-like__KM514070
augaaaauggcaucaucagaugcuaacccauccgauggaucagcugcuaauuugguaccagaaguaaacaacgaaguaauggcacuugaaccaguagugggagcagcuauagcugcaccaguagcaggacaacaaaaugucauagauccauggauacgaaauaauuucguccaagcaccaggcggagaauuuacaguaucaccccgaaacgcaccuggagaaauacuuuggagugcaccauuaggaccugaucuuaacccauaccuaucacaucuagcaagaauguauaacggauaugcaggaggauuugaaguucaaguaauacuagcaggcaaugcauuuacagcaggaaaaguaauuuuugcagccgucccaccaaacuucccaacagaaggacucagcccaucucaaguuacaauguuuccacauauaguaguagacgucagacaauuagaaccuguacuuauaccuuuaccagauguaagaaacaauuuuuaucauuauaaccaaagcaaugauccuacaauaaaacuuaucgcaaugcucuacacaccccuacgagcaaauaaugcaggagacgacguauucacaguaaguugccgagucuuaacgcguccaagucccgacuuugauuuuauauuuuuaguuccacccacaguagaaaguagaacaaaaccauucucaguaccaguauuaacaguugaagaaaugacaaacucacgauuuccuauacccuuagaaaaguuauuuacaggaccaucaucagcuuuuguuguacaaccccaaaauggaagaugcacuacagauggagugcuauuaggcacaacacaacuaucaccaguuaacauauguacuuucagaggugauguaacucauguaacaggaagucgaaauuauacuaugaaucuagcaucacaaaauuggucaaauuacgacccuacugaagaaauuccugcaccacuagggacacccgauuucguaggaaaaauacaaggaguuuuaacucaaacaacucguacagacggaucuacacgaggacauaaagccacaguuuauacaggaucagccaacuucgcacccaaacucgguagaguacaauuugaaacagauacagaucaugauuuugaagcuaaucaaaacaccaaauuuacuccugucggcguaauacaagacggagguacaacacauagaaaugaaccacaacaauggguauuaccuucauauagugguagaaauacaccuaauguacaccucgcaccagcaguagcuccaacauuccccggagaacaauuauuauucuuuagaucaaccaugccaggauguucaggauauccuaauauggaucuagauugucuauuaccucaagaauggguucaauacuucuaccaagaagccgccccugcacaauccgauguugcacuucuaagauuuguaaaccccgacacaggaagagucuuauucgaauguaaauuacauaaaucuggauauguaacaguagcacauacaggacaacaugauuuagucauaccaccaaaugguuauuuccguuuugauuccuggguaaaucaauuuuauacacuagcaccaaugggaaacggaacuggaagaagaagauaa

SEQ ID NO: 34233 - RNA, 1617 nt, Artificial Sequence
  derived and/or modified sequence opt6 from VP1__Norovirus_and/or_Norovirus-like__KM514061
augaaaauggcauccagugaugcaaauccaucagauggaucagcagcuaaccuaguaccagaagucaauaaugaaguaauggcacuagaaccaguugucggugcagcaauagcugcacccguagcuggacaacaaaauguaauugauccauggauccguaauaauuuuguacaagccccagguggagaauuuaccgucucccccagaaaugcaccuggcgaaauacuauggucugcaccacugggaccagaucuaaauccauaucuaucacacuuagcacguauguauaauggauacgccgguggguucgaaguacaaauaauacuagcaggaaaugcauucacagcaggcaaaguaauuuucgcagcaguaccacccaacuuuccuacugaaggucuauccccuucucaaguuacaauguucccccacauaguaguagauguccgacaacucgaaccuguauuaaucccccuccccgauguuagaaauaacuuuuaucauuauaaccaaucaaacgacccaacaauaaaacucauagccaugcuauacacaccauuaagagcaaauaaugccggugacgacguauuuacagucucuugccgaguauuaacaagaccaucaccagacuuugacuuuauauuuuuagucccaccuaccguagaaagccgaacaaaaccauucucagucccaguacucacaguagaagaaaugacaaacucucguuuuccaauaccacuagaaaaauuauucacaggaccaaguucagcauuuguaguacaaccacaaaacggccgauguacaaccgacggcgucuuacuuggaacaacucagcuuucaccaguaaauauauguacauucagaggagacguaacacauauaaccggaucacauaauuacacaaugaauuuagcaucucaaaauuggucaaauuaugauccaacagaagaaauaccagcaccacucggaacccccgacuucguaggaaaaauucaaggcguauuaacacaaacaacacgaacagacggcucaacaagaggccauaaagcaacaguauacacaggaucagcagacuuugcaccuaaacuaggacgaguacaauucgaaaccgauacagauagagauuucgaagcuaaucaaaauacaaaauuuacaccagucgguguaauacaagacggaggaacaacccaucgaaaugaaccccaacaauggguuuuaccauccuauucaggcagaaauacaccaaauguacauuuagcccccgcaguagcaccaacauucccaggugaacaauuacuauucuuuagaucaaccaugccaggauguucaggcuauccaaauauggaccuagacugucuuuuaccucaagaauggguccaauacuucuaucaagaagcugcuccugcacaaucagacguagcauuauuacgauucguuaacccagacaccggacgaguauuauucgaauguaaauuacauaaaucaggauauguaacaguagcacacacaggacaacacgaucuaguuauaccaccaaauggguauuuuagauucgacagcuggguaaaccaauuuuacacacuugcaccaaugggcaauggaacaggacgacgaagauaa

SEQ ID NO: 34234 - RNA, 1617 nt, Artificial Sequence
  derived and/or modified sequence opt6 from VP1__Norovirus_and/or_Norovirus-like__KM514060
augaaaauggcaucaucugacgcuaauccaucagauggauccgcagcuaacuuaguaccagaaguaaauaaugaaguuauggcucucgaaccuguaguaggagcagcuauagcagcaccaguagcaggacaacaaaauguaauugauccuuggauaagaaauaauuuuguccaagcuccaggaggugaauuuacaguaucaccuagaaaugcaccaggagaaauacuauggucagcaccacuaggacccgaucuaaaucccuauuuaucacaccuagcacgcauguacaacggauaugccggaggauucgaaguccaaguaauacuagcaggaaaugccuucacagcuggaaaaguaauuuucgccgcuguuccaccaaacuuuccaacugaaggacuauccccaucacaaguaacaauguuuccucacauaguaguagacgucagacaauuagaaccaguacuaauaccauuaccagauguacguaauaauuucuaccauuacaaccaauccaacgauccaacuaucaaacuaauagcuauguuauauacaccuuuacgagcuaacaacgcaggagaugauguauuuacaguuucaugcagaguauuaacaagaccauccccagauuucgacuuuauauuuuuaguaccaccaacagucgaaucaagaacuaaaccauucucaguuccaguauuaacaguagaagaaaugacaaauucccguuuuccuauuccacucgaaaaacuauuuacaggaccuucaucagcuuucguaguacaaccucaaaacggucgcuguacaacugacgggguacuuuuagguacaacacaauuauccccaguaaacauauguaccuuuagaggagacguaacccacauaacaggaagucgaaauuauacaaugaaucuagcaucucaaaacuggaacaauuacgauccaacagaagaaauaccagcuccucuaggcacaccugacuuugucggcaaaauucaaggcguauuaacacaaacaacaagaacagacggaucaaccagaggucauaaagcaacugucuauacaggaucagcagacuuuucaccaaaauuaggcagaguacaauucgaaacagauacugaucacgauuucgaagcaaaucaaaauacaaaauuuacaccaguuggcguuauccaagacggagguacuacucaccgcaacgaaccacaacaauggguacuaccuucuuacucaggucguaacaccccaaacguacaucuagcacccgcaguagcaccaacauuuccaggagaacaauuacuauucuuuagaucaacaaugccaggaugcucuggauauccaaauauggaccuagauugucuucuaccccaagaauggguucaauauuuuuaucaagaagcagcuccugcucaaucagauguagcuuuacuccgauucguaaauccagauacagguagaguauuauucgaauguaaacuacacaaaucaggcuauguaacuguagcucauaccggacaacacgaucuaguaauaccaccaaauggauauuucagauucgauuccuggguaaaucaauuuuacacgcuagcaccuaugggaaauggagcuggaagaagaagauaa

SEQ ID NO: 34235 - RNA, 1617 nt, Artificial Sequence
  derived and/or modified sequence opt6 from VP1__Norovirus_and/or_Norovirus-like__KM268079
augaaaauggcuucuucugaugcaaaucccucagacggcucugccgcaaaucugguaccagaaguuaauaaugaaguaauggcucuagaaccaguuguaggagccgcaaucgcagcaccagucgcaggacaacaaaacguaauagacccauggauaagaaacaacuuuguacaagcaccaggaggcgaauuuacaguaagcccucgcaacgcuccaggagaaauuuuauggucggcaccacucggcccagauuuaaacccauacuuaucucaccuagcaagaauguauaacggauaugcuggaggcuucgaaguacaaguaauccucgcaggcaaugccuuuacagcaggaaaaauaauauuugcagcuguaccuccaaauuuuccaacagaaggauuaucaccaucacaaguaacaauguucccccacauaguaguagacguacgacaacuagaaccaguacucauuccauuaccagauguucgaaauaauuucuaccacuauaaucaaucuaacgacccuaccauuaaacuuaucgccaugcucuauacaccauuaagagcuaauaaugccggugaugaugucuuuacagucuccugcagaguuuuaacacgaccaucaccagauuuugauuuuauauuucuagucccaccaacagucgaaucaagaacaaaaccauucaguguccccguuuuaacaguagaagaaaugacuaauaguagauuuccaauuccauuagaaaaauuauucaccgguccaucaucagcauuuguuguucaaccucaaaacggacgauguacaacugaugguguacuacuagguacuacacaacuaucuccaguuaauauauguacauuuagaggagauguuacacauauuacugguucaagaaacuauacaaugaaucuagcaucacaaaauuggucaaauuaugaucccacagaagaaauaccagcaccuuuaggaacaccagacuuugucggcaaaauacaaggaguucuaacccaaacaaccagaacagaugguucaacaagaggucauaaagccacaguuuauacugguucagcagacuuugcuccaaaauuaggccgaguacaauucgaaaccgacacagaucacgauuuugaagcaaaucaaaacacaaaauuuacaccuguaggaguaauucaagacggugguacuacacacagaaaugaaccacaacaauggguacuaccaucuuauucugguagaaacacaccuaacguucacuuagcuccagccguagcaccaacauuuccaggagaacaacuuuuauucuuuagaucaacaaugccaggcuguucagguuacccaaauauggaucuugauugucuacuaccacaagaauggguucaauauuucuaccaagaagcagcacccgcacaaucagauguagcauuacuacguuucguaaauccagacacaggcagaguacuuuuugagugcaaacuucauaaaucuggauauguuacuguagcccacaccggacaacacgacuuaguuauaccucccaaugguuacuuuagauucgacaguuggguaaaucaauuuuacacucucgcaccaauggguaauggaacaggacgcagaagauaa

SEQ ID NO: 34236 - RNA, 1617 nt, Artificial Sequence
  derived and/or modified sequence opt6 from VP1__Norovirus_and/or_Norovirus-like__KJ710247
augaaaauggcaagcaaugaugcaaacccaucagauggaagcgccgcuaacuuagucccugaaguaaacaacgaaguaauggcauuagaaccagucguaggcgcagcuauagcugcaccaguagcaggacaacaaaauguaauagacccauggauuagaaacaauuuuguacaagcuccaggaggugaauuuacaguaucuccuagaaacgcaccaggagaaauacuauggucagcaccacuaggaccugaucucaauccauaucugucacacuuagcccguauguauaauggauaugcaggaggauuugaaguacaaguaauacuagcaggcaaugcauucacagcuggaaaaauaauauucgcugccguaccaccaaauuuuccgaccgaaggacuaucaccaucccagguaacaauguucccucacauaauuguagacguucgacaacuugaaccaguauuaauaccacuuccagauguaagaaauaauuuuuaucacuauaaucaaagcaaugauucaaccauaaaauuaauagcaauguuauacacuccauuaagagcuaauaaugccggugaugauguauuuacaguaaguuguagaguauuaacaagaccauccccagauuucgacuucauauuccucguaccacccacuguagaaucaagaacaaaacccuucucagucccaguucuaacaauagaagaaaugacuaacucaagauucccaauaccacucgaaaaacuauuuacaggaccauccucagcauuuguaguucaaccccaaaaugguagauguacaacagauggaguauuacuagguaccacacaauuaucuccuguaaauauauguacauuuagaggcgauguaacacauauaaccgguucuagaaacuauacaaugaaucuagcaagccaaaauuggaauaauuaugauccaacagaagaaauaccagcacccuuaggaacaccagacuucguaggaaaaauacaaggaauguuaacucaaacaacuagaacugauggaagcaccagaggacacaaagcaacugucuauacagguuccgcagauuuugccccuaaauuaggaagaguacaauucgaaacugacacagaccaugauuucgaagcaaaucaaaauacaaaauucacaccaauugguguaauccaagacgguucaacaacacauagaaaugaaccccaacaauggguucucccaucauauaguggcagaaauacccauaacguacacuuagcaccagcaguagcaccaacauuccccggcgaacaauuacuuuucuuuagaucaacaaugccugguugcucaggauacccaaauauggaucuagauugucuacuaccccaagaauggguacaauauuucuaucaggaagccgcgccagcacaaucagacguagcccuucuccgauuugucaacccagacacaggaagaguacuuuucgaauguaaacuucauaaaaguggauacguaacaguugcacauacaggacaacacgaucuaguuauaccucccaaugguuacuucagauucgauucauggguaaaucaauuuuacacucuagcaccaaugggcaaugguacaggacgaagaagauaa

SEQ ID NO: 34237 - RNA, 1617 nt, Artificial Sequence
  derived and/or modified sequence opt6 from VP1__Norovirus_and/or_Norovirus-like__KJ685405
augaaaauggcuuccucagaugcaaauccaucagacggaagcacagcaaauuuaguaccagaaguaaacaaugaagucauggcccuagaaccaguaguuggagccgcaauagcagcaccuguagcuggacaacaaaauguaaucgacccuuggaucagaaacaacuuuguucaagcaccagguggagaauuuaccgucuccccuagaaacgcaccuggagaaauauuauggucagcaccauuaggaccagauuuaaaucccuacuuaucccacuuagcaagaauguauaacggauacgcaggaggauucgaaguacaaacaauauuagcuggcaacgccuucacagcaggaaaaauaauauucgcagcaguacccccuaauuucccaacagaaggauuaucaccaucgcaaguaacaauguuuccccacauaaucguagauguacgacaacuagaaccuguuuuaauuccucuuccagauguaagaaauaauuucuaccauuauaaucaaacaaacgacccaacaauaaaauuaaucgcaaugcuuuacacaccauuaagagcaaacaaugccggugacgauguauuuacuguaucaugucgcguacucacaagaccuucuccagacuuugacuuuauauuccuuguacccccaaccguagaaucccgaacaaaaccuuuuucaguaccagucuuaaccguagaagaaaugacaaacucaagauuuccaauaccacuagaaaaauuauuuacagguccauccuccgcauuuguaguccaaccacaaaacggcagauguacaacagacggaguauuacuaggaacaacacaacucucaccaguaaauauuugcacauuuagaggagacguuacucauauaaguggaucccgaaauuauacaaugaaccuagcaucccaaaacuggaacucuuaugauccaaccgaagaaauaccagcaccacucgguacaccagacuuuguagguaaaauacaaggcguucuaacacaaacaacaagaacagauggaucaacaagaggccauaaagcaacaguauacacaggcucagcagacuuuucuccuaaauuaggccgaguacaauucgcaacagauacagacaaugauuucgaaacaaaccaaaauacuaaauucacaccaguuggaguaauacaagacggaggcacuacacauaggaaugaaccacaacaauggguucugccauccuauucuggcagaaacacacauaauguucaccucgcacccgcaguagcaccuaccuucccaggagaacaacuucuauucuucagaucaaccaugccagguugcaguggauacccaaauauggaccucgacugccuacucccacaagaauggguacaauacuuuuaccaagaagccgcacccgcucaauccgauguagcauuacuaagauucgucaauccagacacuggaagagucuuauucgaaugcaaacuccauaaaaguggauauguaacuguagcucacacuggccaacaugauuuaguaaucccaccaaaugguuauuuccgauucgauucauggguaaaucaauuuuauacacuagcuccuaugggaaauggaacaggccgcagaagauaa

SEQ ID NO: 34238 - RNA, 1617 nt, Artificial Sequence
  derived and/or modified sequence opt6 from VP1__Norovirus_and/or_Norovirus-like__KF429766
augaaaauggcuucauccgaugcaaacccuucagauggcucaacugcaaaccuaguaccugaaguaaacaaugaaguaauggcauuagaaccagucguaggagcagcaauagcagccccaguagcaggucaacaaaauguaaucgacccauggauaagaaacaacuucguacaagcaccaggaggugaauuuaccgucucaccaagaaaugccccaggagaaauccuauggucagcaccucuaggaccagauuuaaauccauaucuaagucauuuagcuagaauguacaauggauaugcaggaggauucgaaguacaaguaauauuagccggaaaugcuuuuaccgcuggaaaaaucauauucgcugcaguuccaccaaacuuuccuacugaaggucuaucacccucacaaguuacaauguuuccacacauaauaguugacguucgacaauuagaaccaguacuuauaccuuuaccugauguaagaaauaauuuuuaucauuauaaccaaucuaaugacccuacaauaaaauuaauagccauguuauacacaccccuaagagcaaauaaugcaggagacgacguauucacaguaucauguagaguauuaaccagacccucaccagauuucgacuuuauauuuuuaguaccaccaacaguagaaucacgaacaaaaccauuuuccguaccuguacuaacaguagaagaaaugacaaacucaagauucccaauaccacuagaaaaacuauucacaggaccaucaucagcauucguaguacaaccacaaaacggccgauguacaacagauggaguauuacuaggaaccacacaauuaucaccuguaaauauaugcacauucagaggagauguuacacauaucucaggaucuagaaacuauacaaugaacuuagcaucacaaaacuggaacucauacgauccaacagaagaaauacccgcaccucuaggaacaccagacuuuguaggaaaaauccaaggaguccuuacucaaacaacaagaaccgauggaucaacucgaggacauaaagcaacaguauauacaggaucagccgauuuuucacccaaacuagggagaguacaauucgcaacagauacagauaacgacuuuguaauaaaucaaaacacaaaauuuacaccaguuggaguuauacaagauggcuccacuacuccaagaaaugaaccacaacaaugggucuuaccaucauacucaggacgcaauacacacaacguacaucuagcaccagcaguggcuccgaccuuccccggugaacaacuccucuucuuucgaucuacaaugccaggaugcuccggauauccaaacauggaucucgauugcuuauuaccacaagaauggguucaauacuuuuaucaagaagcugcuccagcacaaucagacguagcauuacuaagauuuguaaaccccgacacaggaagaguauuauucgaauguaaauuacauaaaucaggauauguaacaguagcucauacaggacaacaugaucuaguuauuccacccaauggauacuucagauucgauagcuggguaaaucaauuuuacacacuugcacccaugggaaauggaacaggaagacgaagauaa

SEQ ID NO: 34239 - RNA, 1617 nt, Artificial Sequence
  derived and/or modified sequence opt6 from VP1__Norovirus_and/or_Norovirus-like__KF060009
augaaaauggcaucuucagacgcuaauccuucagauggaucagcagcuaacuugguucccgaaguaaacaaugagguaauggcccuagaacccguaguaggcgcagcaauagcagcaccaguagcaggacaacaaaauguaauagauccauggaucagaaauaacuucguccaagccccuggcggagaauuuacuguauccccaagaaacgcaccaggcgaaauacuuuggucagcaccucuaggaccugaccucaauccauaccuaucacauuuagccagaauguacaacggauaugcaggaggauuugaaguacaaguaauauuagcaggaaaugcauucacagcaggaaaaguuauauucgcagcaguacccccaaauuucccaacagaaggccuaucaccuucacaagugacaauguucccccauauaguaguagacguaagacaauuagaaccaguccuaauacccuuaccagauguacgaaacaauuucuaccacuauaaccaaucuaaugauccaacaauuaaacuaauagcaauguuauacacaccccuaagagcaaauaaugccggugacgauguauuuacaguaucauguagaguacuaacucgaccuagcccagacuuugacuucauuuuccuaguaccaccuacaguagaaucuaggacaaaaccauuuuccguaccaguuuuaacugucgaagaaaugacaaauucuagauuuccaauaccuuuagaaaaauuauucacaggacccucaucugcauucguaguacaaccucaaaaugguagauguacuacugacgguguacuacucgguacaacacaauuaucuccaguuaauauaugcacuuuuagaggcgauguuacccauauaacuggaucuagaaauuacacaaugaaucuagcaucacaaaacuggaauaauuacgauccuacugaagaaauacccgcaccauuaggcaccccugauuucgucggaaaaauacaaggaguauugacacaaacaacaagaacugacggaucaacuagaggacacaaagcaacaguuuacacaggaucagcagauuuugcacccaaacucggacgaguacaauucgaaacagauacagaccacgauuucgacgcuaaucaaaacacuaaauucacaccuguuggaguaauucaagacggaggaacaacacauagaaacgaaccacaacaauggguacuacccucauauucaggaagaaauacacauaauguacacuuagcaccagcaguagccccaacauucccuggugaacaauuacuauucuuucgaucaacuaugccaggauguagcggauaucccaauauggauuuagauugcuuacuaccacaagaauggguacaauauuucuaucaagaagcagcaccagcccaaucugacgucgcacuauuaagauuuguaaauccagauacaggcagaguacuauuugaauguaaacuacacaaaucuggauacguaacuguagcacacacuggacaacaugaccuuguaauaccacccaacggauauuucagauucgauucauggguaaaucaauucuauacacuagcccccaugggaaauggaacaggacgaagaagauaa

SEQ ID NO: 34240 - RNA, 1617 nt, Artificial Sequence
  derived and/or modified sequence opt6 from VP1__Norovirus_and/or_Norovirus-like__KF059996
augaaaauggcuucaucagacgcaaaucccucugacggaucaacagcuaauuuaguaccugaaguaaauaaugaaguaauggcauuagaaccaguaguaggagcagcaaucgcagccccaguugcaggacaacaaaaugucauugacccauggauaagaaacaauuuuguacaggcuccaggaggagaauuuaccguaucaccuagaaaugcaccaggugaaauauuauggucagcacccuuaggaccugaucuaaauccauaucuaucucacuuagccagaauguauaacggguaugcaggaggauuugaaguucaagucauacucgcuggaaaugcauuuacugccggaaaaauuauauuugcugcaguaccacccaauuuucccacugaaggacuauccccaucucaaguaacaauguucccccauauaauagucgauguacgacaacuagaaccuguccucauuccauuaccagauguaagaaacaauuuuuaccacuauaaccaaucuaaugaccccacuaucaaacuaauagccaugcuuuauacaccauuaagagcuaauaaugcaggagacgacguauuuacaguaucauguaggguucucacaagaccaucaccagacuuugacuuuauauuucuaguaccuccuacaguugaaaguagaacuaaaccauuuucagucccagucuuaacaguagaagaaaugacuaauucacgauuuccaauaccauuagaaaaacuuuucacuggucccucuucagcauucguaguacaaccccaaaauggacgauguacaacagacggaguacuacuaggaaccacacaauugucaccaguuaacauuuguaccuuuagaggugacguaacacauaucccagggucuagaaauuacacaaugaaucuagcaucacaaaacuggaacucauacgacccaacugaagaaauaccagccccucucggaacaccagacuuuguagguaaaauccaaggaguccuaacacagacuacuaaaacuaauggaucaacacgaggccacaaagcaacaguauauacaggaucugcagauuuuucaccaaaauuaggaagaguucaauucgcuacagauacagacaacgacuuugaaacaaaucaaaacacaaaauucaccccaguaggaguuauacaagacgguucaacaacaccaagaaacgaaccacaacaauggguauuaccaucauauucaggaagaaauauacacaacguucaucuagcaccagcaguagcacccaccuuucccggagaacaacuauuauuuuucagaaguacaaugccaggaugcucagguuaucccaauauggauuuagacugucuauuaccacaagaauggguacaauacuucuaucaagaagcagcaccagcacaaucugacguagccuuacuacgauuugucaaucccgauacaggccgaguauuauuugaaugcaaacuacacaaaucaggcuaugucacaguugcucauacuggacaacacgaccuaguaauaccacccaauggauauuuuagauucgauucauggguaaaucaauuuuauacacuagcacccaugggaaacggcaccggccgcagaagauga

SEQ ID NO: 34241 - RNA, 1617 nt, Artificial Sequence
  derived and/or modified sequence opt6 from VP1__Norovirus_and/or_Norovirus-like__HF952130
augaaaauggcaucaucugacgcaaacccaucagaugguaguacagcaaaccuuguaccagaagucaacaacgaagucauggcuuuagaaccaguugucggugcagcuauagcagcaccggucgccggucaacaaaacguaauugacccauggauaagaucaaacuuuguacaagcaccaggaggagaguucacaguuuccccucgaaaugcaccuggcgaaauacuuugguccgcuccacuagguccagaccuaaacccauaucuaucucacuuagcaagaauguacaaugguuaugcuggugguuucgaaguacaagucauacuagcaggaaacgcauuuacagcaggaaaaauaauauucgcagcaguaccuccuaauuuuccaacugaaggauuaucucccucucaaguaacaauguucccucauauaauaguagacgucagacaacuagaaccaguacucauacccuuaccagauguaagaaacaacuucuaucauuacaaucaaagcaaugauucaacaauaaaauuaauagcaaugcucuauacuccacuacgagcaaacaacgccggugacgaugucuucacaguuucauguaggguccuaacacguccaucaccagacuuugacuuuauauucuuaguuccaccaacaguagaaucaagaacaaaaccauuuucaguacccguauuaacaguugaagaaaugacaaacucaagauucccaauaccauuagaaaaacuauuuacugguccguccucagcuuucguaguacaaccccaaaauggcagauguacaacagaugggguauuacuaggaacaacccaacucucaccagucaacauauguacauuucgcggagacguaacacauauaucaggcucacgaaacuacacaaugaacuuagcaucucaaaacuggaacucauaugauccaacagaagaaauaccagcaccacuaggaacaccagacuuuguaggaaaaauacaaggaguauuaacccaaaccacaaaaacaaauggaucaacuagaggacacaaagccacuguauauacaggcuccgcggauuuuucacccaaauuaggaagaguacaauuugccacagauaccgacaacgauuucgaaaccaaccaaaauacaaaauucacaccagucggaguaauacaagauggaaguacaacaccaagaaaugaaccacaacaauggguuuuaccuucauauuccgguagaaauacccauaacguacaucuugcuccugcaguagcaccaaccuuuccuggagaacaacuauuauucuucagaucuacaaugccaggaugcaguggauacccaaauauggaucuagauugcuuauuaccacaagaauggguacaauacuucuaucaagaagcagcaccagcacaaucagacgucgcauuauuaagauucguuaacccugauacaggaagaguauuauucgaaugcaaacuacacaaaucaggauacgucacaguagcacacacaggccaacacgaucuaguuauaccaccaaacgguuauuuuagauuugauucaugggucaaccaauuuuacacucuagcaccaaugggaaauggaaccggaagaagaagauaa

SEQ ID NO: 34242 - RNA, 1617 nt, Artificial Sequence
  derived and/or modified sequence opt6 from VP1__Norovirus_and/or_Norovirus-like__KC409302
augaaaauggcaucaucugaugcaaacccuucagauggcucaacagcaaaucuuguccccgaaguaaacaaugaaguuauggcacuagaaccaguagucggagcagccaucgcagcaccaguagcaggacaacaaaaugucauugaucccuggauaagaaauaacuuuguacaagccccaggaggugaauuuacuguaucaccacguaaugcacccggagaaauacuuuggucagcuccuuuagguccagauuuaaacccauaucuaucacacuuagcccgcauguauaauggauacgcugguggauucgaaguacaaguaauauuagcuggcaacgcauuuaccgcuggcaaaauaauuuuugcagcaguaccuccaaauuucccaacugaaggacuaucacccucacaaguaacaauguucccacacauaauaguagauguaagacaacuagaaccagucuuaaucccauuacccgauguacguaacaauuucuaucauuauaaccaaucaaaugacccaacuauaaaacuaauagcaauguuauauacuccuuuaagagcuaauaaugccggcgacgauguauucacaguauccuguagaguauuaacuagaccuucaccagacuuugauuuuauauuuuuaguuccucccaccguugaaagucgaacuaaaccauucuccgucccaguauuaacaguagaagaaaugacaaacucuagauuucccauaccucuagaaaaacuauucacaggaccaucaucagccuucguuguacaaccacaaaacggaagaugcacaacagacggaguuuuacuaggaacaacucaacuuaguccaguaaauauauguacauuuagaggagacguuacacacaucccagguucaagaaauuacacaaugaacuuagcaagccaaaacuggaacucauacgaucccacugaagaaaucccagccccucuaggcacaccagacuuuguaggaaaaauacaaggaguacuuacucaaacuacaagaacaaacgguucuacuagaggccacaaagcaacaguauauacagguucagcagacuuuucuccuaaacuuggaagaguacaauuugcaacugauacagauaacgacuuugaaauaaaccaaaauacaaaauucacaccagucggaguuauacaagauggaucaacaacaccucgcaaugaaccacaacaauggguacuccccucauauucaggaagaaauauacauaacguccaccuugcuccugcaguugcaccuacauuuccaggagaacaauuacuauucuuuagaucuacaaugccagguuguuccggauacccaaauauggaucuagauugucuccucccacaagaauggguacaauauuuuuaucaagaagcagcaccagcacaaucugacguagcacuacuacgcuucguaaacccugacacaggcagagugcuauucgaauguaaauuacauaaaucaggauacguaacaguagcacacacaggacaacaugaucuugucauacccccaaauggauacuuucgauuugauucuuggguaaaccaauucuauacauuagcaccaaugggaaacggaacaggaagaagacgcuaa

SEQ ID NO: 34243 - RNA, 1617 nt, Artificial Sequence
  derived and/or modified sequence opt6 from VP1__Norovirus_and/or_Norovirus-like__JX459908
augaaaauggcuucuucagaugcaaauccauccgacgguucagcagcaaauuuaguccccgaaguaaauaacgaaguaauggcuuuagaaccaguagucggcgcagcaauagccgcaccugucgcaggccaacaaaacguaauugauccguggauaagaaauaauuuuguccaagcaccugguggagaauuuacaguaucaccaagaaaugcaccaggagaaauauuauggucagcuccacuaggaccugaucuaaauccauaucuaucucauuuagccagaauguauaauggauacgcaggagguuucgaaguucaaguuaucuuagcaggaaaugcauucacagcaggaaaaguaauauucgcagcaguaccaccuaacuucccaacagaaggacuaucaccaucacaagucaccauguucccacauauugucguagacguuagacaacucgaaccuguucuaauaccucuaccagacgucagaaauaauuucuaucauuacaaccaaucaaaugaucccacaaucaaacuaauagcgauguuauacacuccauuacgcgcaaauaacgcuggagacgacguauucacugucucaugcagaguucuaacaagaccauccccagacuuugacuuuauauuucuagucccaccaacaguagaaucaagaacaaaacccuuuagcguuccaguacuaacaguagaagaaaugacuaauucaagauuuccuauaccauuagaaaaacuauucaccggucccucaucagcauucguaguucaaccucaaaauggaagauguacaacagacggaguacuuuuaggaaccacacaacuauccccaguaaauauaugcacauuuagaggcgacguaacacacauuacaggcucaagaaauuacacuaugaaccuagcaucacaaaauuggaaugauuaugauccuacagaagaaauaccugccccacuugguacaccagacuuugucggaaaaauacaagguguauuaacacaaacaacaagaacagacgguucaacucgaggacacaaagcaacaguauauaccggaucagcagacuuugcaccaaaauuaggaagaguacaauucgaaacagauacagaccgggauuuugaagcaaaccaaaauacaaaauuuacuccugucggcgucauucaagacggaggaacaacacacagaaaugaaccccaacaauggguacucccaucauacuccggucguaauacacauaauguacacuuagcacccgcaguagcaccuaccuuuccaggagaacaacuacuauucuucagaucaacuaugccaggaugcucuggcuacccaaauauggauuuagacugucuauuaccacaagaauggguacaauacuuuuaucaagaagcagcuccagcacaaucagauguagcauuacuucguuucguaaaucccgauacaggaagagucuuauucgaaugcaaauuacacaagucuggauaugucacagucgcacacacaggacaacacgacuuaguaauaccuccuaacggauauuuucgauuugauucauggguaaaucaauuuuauacccuagcaccaaugggaaaugguaccggacgacgaagauaa

SEQ ID NO: 34244 - RNA, 1617 nt, Artificial Sequence
  derived and/or modified sequence opt6 from VP1__Norovirus_and/or_Norovirus-like__JX445166
augaaaauggcaucaucagaugcaaauccuuccgacggaucaaccgcaaauuuaguacccgaaguaaauaaugaagucauggcacuagaaccaguaguaggagccgcaauagcggcaccuguagcaggucaacaaaauguaauagauccauggauuagaaauaacuuuguucaagcaccaggaggugaauuuacagucucuccaagaaaugccccaggagaaauauuauggucggcuccucucggaccagaucuaaauccauaucuaucacaucucgcaagaauguauaaugguuaugcaggaggauucgaaguacaaguaauauuagcaggaaaugcauucacagcaggaaaaauaauauuugcagccguaccaccaaauuuuccaacagaaggacuuucaccaucacaaguaaccauguucccacauaucauaguagacguucgacaauuagaaccaguucuaauaccacuuccagacguacgaaacaauuucuaucacuauaaucaauccaaugauccaacuauaaaauugaucgcaaugcuauacacccccuuaagagcaaacaaugcaggagacgauguauucacaguaagcuguagaguauuaacacgaccuucuccagacuucgacuuuauauuccuuguaccaccuacaguagaaucacgcacuaaaccauucucaguaccuguauuaacagucgaagaaaugacaaauuccagauuccccaucccacuagaaaaacuauuuaccgguccaucaucugcauucguuguacaaccccaaaacggacgauguacaaccgacggugucuuacuagguacaacacaacucucuccaguaaauaucugcacauuccgaggagauguaacacauauaccuggcucacacaacuacacaaugaauuuagccucacaaaacuggaauaguuaugacccaacagaagaaauuccagcuccauuaggaacaccugacuuuguaggaaaaauacaaggaguauuaacgcaaacuacaagaacuaauggaucaacucgaggacauaaagcaacuguauauacaggcucagcagacuucucaccaaaacuaggacgaguacaauucgcuacagacacaaacaacgacuucgaaaccaaucaaaacacaaaauucacuccaguuggaguaauacaagacggaucuacuacaccacgaaacgaaccccaacaauggguuuuaccuuccuauucaggaagaaacacacauaauguccacuuagcaccagcaguagccccuacauucccaggcgaacaauuauuauuuuuccguuccacgaugccaggcuguucuggauauccuaauauggauuuagauugucuacuaccacaagaauggguacaauacuucuaucaagaagcagcaccggcccaaucugacguagcacuacucagauucguaaacccagacacaggacgaguacuauucgaaugcaaauuacauaaaucaggauauguuaccguagcccauacuggacaacacgaucugguuauacccccaaauggauauuucagauuugauucaugggucaaucaauuuuauacacuagcaccaauggguaauggaacaggaagaagaagauaa

SEQ ID NO: 34245 - RNA, 1617 nt, Artificial Sequence
  derived and/or modified sequence opt6 from VP1__Norovirus_and/or_Norovirus-like__HQ693090
augaaaauggcaucgaaugacgccaauccuuccgacggaucagcagcuaaccuaguaccagaaguaaacaaugaaguaauggcauuagaaccaguuguuggugcagcuauagcugcaccaguagccggacaacaaaacguaauagauccauggauaagaaauaacuuuguucaagcaccaggaggggaauuugccguuuccccucgaaaugcaccaggagaaauacuauggucagccccacuagguccagaucuaaauccuuaucuaucacacuuagcaagaauguauaacgguuacgcugguggauucgaaguacaaguaauacuagcaggaaacgcauucacagcuggaaaaauaauuuucgcagcaguaccaccuaacuuuccaacagaaggauuaucucccucacaaguuacuauguuuccucacauaauagucgacguacgucaacuagaacccguauuaaucccauuaccagacguaagaaacaauuuuuaccauuacaaucaauccaacgauuccaccauuaaacuuauagcuaugcuuuacacaccacuaagagcaaauaacgcaggagaagacgucuuuacaguaucuuguagaguauuaacaagaccaagcccagacuuugacuuuauauuuuuaguaccaccaacaguagaaagucguacuaaaccauuuacuguaccaauacucacaguagaagaaaugacaaauuccagauuuccaauaccauuagaaaaacuauucaccggaccaucaggagcauucguaguccaaccacaaaauggaagaugcacaacagacggaguacuauuaggaacaacacaauuaucaccaguaaauauuugcacauuuagaggagacguaacacauauagcaggaucaaggaauuauacaaugaauuuagcaucacuuaauuggaauaacuacgauccaacagaagaaauaccagccccauuagguaccccugacuuuguaggaaaaauacaagguguauuaacacaaacaacuaaaggagauggaaguacuagaggucauaaagcaacuguauacacaggaucagcuccauucacaccaaaauuaggaucaguucaauucucaacugauacagaaaacgauuuugaaacucaccaaaauaccaaauuugcaccuguagguguaauacaagauggcaguacaacacauagaaacgaaccucaacaauggguauuaccaucauauagcgguggaaauguccacaacguccauuuagcaccagcagucgcaccuacauucccaggcgaacaacuuuuauuuuucagaucaacuaugcccggcuguucuggauauccaaauauggaucucgauugcuuauuaccacaagaauggguacaacauuuuuaccaagaagcagccccagcacaaucagacgucgcacuauuaagauucguaaauccagacaccgguagaguauuauucgaaugcaaauuacauaaaucgggcuaugugacaguugcacacaccggacaacacgaucuaguaaucccaccaaauggauauuucagauuugauucauggguaaaucaauuuuacacccucgccccaauggguaacggaacugggcgcagacguuaa

SEQ ID NO: 34246 - RNA, 1617 nt, Artificial Sequence
  derived and/or modified sequence opt6 from VP1__Norovirus_and/or_Norovirus-like__JN400611
augaaaauggcaucaaaugacgcuaacccaucagauggaucagcagcaaaccuaguaccagaaguuaacaacgaaguaauggcauuagaaccaguaguaggugcugcaaucgccgcuccggucgcaggacaacaaaauguaauagauccuuggauuagaaacaacuuuguacaagcuccaggaggagaauuuacagucucuccaagaaaugcaccaggugaaaucuuauggucagccccacuaggaccagacuuaaauccuuaccuaucacacuuagcaagaauguacaaugguuacgcaggagguuuugaaguucaaguuauuuuagcaggaaacgcauucacagcaggaaaaauaauauuugcagcaguaccaccuaacuuuccaacagaaggacuaucacccucacaaguuacaauguuuccacacauaauaguagauguaagacaacuagaaccaguacuuauuccacuucccgauguaagaaauaacuucuaucacuacaaccaaucaaaugacagcacaauaaaauuaauagcaauguuauauacaccacuaagagccaauaaugcaggagaagaugucuuuacaguaucauguagaguauuaacaagaccaaguccugauuuugacuuaaucuuuuuagucccaccuacaguagaaucacgaaccaaaccuuucacaguuccaauuuuaacuguugaagaaaugaccaacuccagauuuccaauaccccuugaaaaacuauuuacaggaccaucaggagcauucguaguccaaccgcaaaacggaagauguacaacugacgguguacuacuaggaacaacacaacuaucaccaguaaauaucuguacauucagaggagacguaacacacauagcaggaucacgaaauuacacuaugaacuuagcauccuuaaauuggaacaacuacgacccaacagaagaaaucccagcaccauuagguacuccagauuucguagguaaaauacaaggaguccuaacacaaacaacuaaaggcgacgguucaaccagaggacacaaagcaacuguauauacuggcggagcaccuuuuacaccuaaacuaggaucaguacaauuuucaacagacacagaaaaugauuuugaaacucaucaaaacaccaaauuuacuccaguagguguaauacaagauggaucaacuacucauagaaaugaaccacaacaauggguauuaccaagcuauucaggacgaaauguccauaauguccaccuagcaccagcaguagcaccaacuuucccuggagaacaacuucuauucuuucgaucaacaaugccuggauguaguggauacccaaacauggacuuagauugccuacuaccacaagaauggguucaacauuucuaccaagaagcagcacccgcucaaucagauguagcacuacuaagauucguaaacccagacacaggcagaguauuauuugaaugcaaacuacacaaaucaggauauguaacaguugcacacacuggccaacacgacuuaguaauaccaccaaauggcuacuuuagauuugacucauggguuaaucaauuuuacacccuagcaccaaugggaaauggaacuggaagaagacguuaa

SEQ ID NO: 34247 - RNA, 1617 nt, Artificial Sequence
  derived and/or modified sequence opt6 from VP1__Norovirus_and/or_Norovirus-like__JN400609
augaaaauggcuucuaaugaugccaaccccucagaugguucugcagcaaaccuaguaccagaaguuaacaaugaagucauggcucuagaaccagucguaggugcagccauagcagcucccguagccggacaacaaaaugucauagacccauggaucagaaauaacuuuguacaagcaccaggaggugaguucaccguaucuccaagaaacgcaccaggcgaaauauuauggagugcaccauuaggaccagaccuuaacccuuaccuaucucauuuagcacgcauguauaacggauacgccggaggauucgaaguacaagugauacuggccggaaaugcauuuaccgcaggaaaaauaauauuugccgcaguaccaccuaauuuuccuaccgaaggacuaggcccaucacaaguaacaauguucccacauauaaucguagacguacgacaauuagaaccaguauuaauuccacuuccugaugucagaaauaauuuuuaucauuauaaccaaagcaaugacucaacaauaaaacuaauagcaaugcuuuacacaccucuacgagcaaauaaugcaggagaagacguauuuacaguaucuuguagagucuuaacccgaccaaguccagauuucgacuuuauauuucuagucccaccaacaguugaaucuagaaccaaaccauuuacaguacccaucuuaaccguugaagaaaugacaaacucaagauuuccaauaccauuagaaaaauuauuuaccggaccaucaggugcuuuugucguacaaccacaaaacggaagauguaccacagacgguguacuacuuggaacaacucaacuaucaccuguaaauauauguacauuuagaggagauguuacacauauagcuggauccagaaauuacacaaugaaucuagcaucacugaacuggaauaauuacgacccaacagaagaaauaccagcaccguuaggaacaccugacuuugucggaaaaauacaaggugucuuaacacaaaccaccaaaggagauggaucaacaagaggucacaaggcaaccguauauaccggaggcgcuccuuuuacaccaaaauuaggaaguguacaauucucuaccgacacagaaaaugacuuugaaacacaccaaaauacaaaauucacaccaguaggagucauacaagacggaucaacuacacacagaaaugaaccacaacaauggguacuuccaucauauucaggacguaacguccauaauguccauuuagcaccagcaguugcaccaacauuuccaggugaacaacucuuauucuuucgaaguacaaugccaggauguagcggauauccuaacauggaucuagacugucuacuaccccaagaauggguacaacauuucuaucaagaagcagcacccgcacaaucagacguagcauuauuaagauucgucaauccagacacaggaagaguauuauucgaaugcaaauuacauaaaucaggauauguuacaguagcacacacaggccaacaugaccuuguaaucccaccaaauggauacuucagauuugauucuuggguuaaucaauuuuacacccuugcacccaugggaaaugguaccggaagaaggagauaa

SEQ ID NO: 34248 - RNA, 1617 nt, Artificial Sequence
  derived and/or modified sequence opt6 from VP1__Norovirus_and/or_Norovirus-like__JQ613517
augaaaauggcuucaagugacgccaauccaagcgauggaucuacagccaacuuaguuccugaaguuaauaaugaaguaauggcauuagaacccguugucggcgcugcaauagcagcaccaguagcaggacaacaaaauguuauagacccauggauaagaaauaacuuuguucaagcaccaggaggugaauuuacagucucaccacgaaaugcaccaggcgaaauauuaugguccgccccauuagguccagaucuaaaccccuacuuaucccauuuagcaagaauguacaauucuuacgccgguggauucgaaguucaaguaauacuagcaggaaaugcauuuacagcagguaaaauaauauucgccgcaguaccacccaacuuuccaacagaaggacuauccccaucacaagucacaauguuuccacacauaauaguagauguucgacaacuagaccccguucugauaccauuaccagacguaagaaauaacuucuaccauuacaaucaaaguaacgacccaacaauaaaauuaauagcuauguuauacacgccacuaagagcaaacaaugcaggagaugauguauuuaccguuucguguagaguauuaacaagaccaucaccagauuucgacuucaucuuccuuguaccaccaacuguagaaucacgaacuaaacccuucaguguacccauauuaaccguagaagaaaugacgaacuccagauuuccaauaccacuagaaaaacuauucacaggaccaucuucagcauuuguaguacaaccccaaaacgguagauguacaacagacggaguacuauuaggaacaacucaauuaaguccaguaaauauauguaccuucagaggagauguuacacauauagcaggaacacaagaauacacaaugaaucuugcuucucaaaacuggaacaauuaugauccaacagaagaaauaccagcaccucuaggcacaccagacuucguaggaaaaauacaaggugucuuaacacaaacaacuagaggcgauggaucaacuagaggccacaaagcaacaguaucaacaggauccgugcacuuuacaccaaaacuaggaagaauacaauucuccacagauacauccaacgacuuugaaacaggccaaaacacaagauuuacaccagucggcguaguacaagauggauccacaacacaucaaaacgaaccacaacaauggguuuuaccuaauuacuccggacgugacucacauaacguacauuuagccccagcagucgcaccaucauuuccaggagaacaauuacuauucuuuagaucuacaaugcccggcuguucaggcuauccuaacaugaaucuugauugccucuuaccucaagaauggguacagcauuuuuaucaagaagcagcaccagcucaaucagacguugcauuacuacgauuuguaaacccagacacaggcagaguauuauucgaauguaaacuacauaaaucaggauauguaacaguagcacauacaggucaacacgaucuagucauaccaccaaauggcuauuuuagauuugauucauggguaaaucaauuuuacacauuagccccaaugggaaacggaacaggaagaagaagauaa

SEQ ID NO: 34249 - RNA, 1617 nt, Artificial Sequence
  derived and/or modified sequence opt6 from VP1__Norovirus_and/or_Norovirus-like__JQ478409
augaaaauggcuucaaacgacgcaaacccaagugauggaucagcagcaaaccuaguaccagaaguaaauaaugaaguaauggcacuugaaccuguagucggagcagcaaucgcagcaccaguugcaggacaacaaaauguaauugacccauggauaagaaauaauuucguacaagcaccaggaggcgaauuuacaguaucaccaagaaacgcaccaggcgaaauacuauggucagcaccacuaggaccagaucuaaacccauauuuaucccaucuagcuagaauguacaauggauaugccggaggauucgaaguacaaguuauacuagcagguaaugcauuuacagcaggaaaaauaauauuugcagccguacccccaaacuuccccacagaaggccucucuccuucacaaguuacaauguucccacauaucauaguagacguaagacaacuagaaccaguacuuaucccauuaccugauguuagaaauaauuucuaucacuauaaccaauccaaugauucaaccauaaaauuaauugcuaugcuuuacacaccacuacgagcaaacaacgcaggagaagauguauuuacaguaucaugcagaguucuaacaagaccuucaccagauuuugacuucauauuuuuaguacccccuacugucgaaucaagaacaaaacccuucacuguccccauacuaacaguugaagaaaugacuaacucaagauuucccaucccuuuagaaaaacuauuuacaggaccaucaggugcauucguuguacaaccacaaaacggcagaugcacaacagauggagucuuacuaggcacaacacaauuaucuccaguaaauauaugcacauuuagaggcgacguaacacauauagcuggaucuagaaauuauacuaugaaccuagcaucacuaaacuggaauaacuaugauccaacugaagaaauaccagcacccuugggaaccccagacuuuguuggaaaaauacaaggaguacuaacacaaaccacaaaaggugacgguaguacuagaggucauaaagccacagucuauaccggaucggcaccuuuuacaccaaaacuaggaucaguacaauucucaacagauaccgaaaacgacuuugaaacacaccaaaauacaaaguuuacaccaguaggaguaauacaagacggcucaacuacacauagaaaugaaccacaacaauggguucuaccuucauacucaggacgcaauguacauaacguacacuuagcuccagccguagcaccaaccuuuccaggcgaacaauuacuauucuuuagaucaacaaugcccggauguucuggauaucccaauauggaucuagauuguuuacuaccacaagaauggguacaacauuucuaucaagaagccgcuccugcacagagcgacguagcauuauuacgauuuguaaacccagauacuggaagaguacuauucgaaugcaaacuacauaaaucaggcuauguaacaguagcacauacaggacaacaugaucucguaauacccccaaauggauacuuucgauuugauucuugggucaaucaauuuuauacauuagcaccaaugggcaauggaacaggaggaagaagauga

SEQ ID NO: 34250 - RNA, 1617 nt, Artificial Sequence
  derived and/or modified sequence opt6 from VP1__Norovirus_and/or_Norovirus-like__GQ856460
augaaaauggcaucuaaugaugcaaacccaucagaugguucggccgcaaauuuaguacccgaaguuaauaaugaagucauggcucuagaacccguagucggugcagcaauagcagcaccaguagcaggacaacaaaauguaauagacccuuggauaagaaauaauuuuguacaagcaccaggcggagaauuuacaguaucaccacgaaaugcaccuggcgaaauccuauggucagcaccacuagguccugacuuaaauccauacuuaucacaucuagcacgaauguauaacggauacgcaggcggauucgaaguccaagucauauuagcuggaaaugcauucaccgcuggaaaaauaauauucgcagcaguaccaccaaacuuuccaacugaaggacuaucuccaucacaaguaacaauguuuccacacauaauaguugauguaagacaacuagaaccaguucuaauuccauuaccagacguaagaaacaacuucuaucacuauaaccaaucuaaugacucaacaauaaaacuaaucgcaaugcucuacacaccauuaagagcaaacaacgcuggagaagacguauuuacaguuucaugccgaguacuaacaagaccuucaccagacuucgacuuuauauuuuuaguaccgccaacuguagaaucacgaacuaaaccauuuaccguaccuauccuuacagucgaagaaaugaccaauucaagauucccuauaccauuagaaaaacuauucacagauccaucauccgcuuuuguaguacaaccacaaaacggaagauguacaaccgacggcguacuucuuggaacaacacaauuaucaccuguaaacauaugcacauuuagaggagacguaacacacauagcaggaucaagaaauuacaccaugaaucucgcuagcuuaaauuggaauaauuacgauccuacugaagaaauaccagcaccucuagguaccccagacuuugucgguaaaauacaaggaguacuaacacaaacaacaaaaggagauggaucaacaagaggacacaaagcaaccguauauacaggaucagcaccauuuaccccaaaauuaggcucaguucaauucuccacugauaccgaaaacgauuucgaaacccaccaaaauacaaaauuuacaccaguaggaguuauccaagacggaggcacaacacacagaaaugaaccacaacaauggguauuaccaaguuacaguggaagaaauguaccaaacguacauuuagcaccagcagucgcaccuacauuccccggugaacaacuauuguucuuuagaucuacuaugccaggauguucagguuauccaaacauggauuuagacugcccacuuccccaagaauggguccaacacuucuaucaagaagcagccccugcacaaucagacguagcacucuuacgauuugucaaucccgacacaggaagaguauuauucgaauguaaacuacauaaaucaggauacguaacaguagcacauacaggacaacaugaccuaguuauaccaccaaauggauauuuuagauucgauucuuggguaaaucaauucuacacacuagcaccaaugggaaacgguacaggaagacgcagauaa

SEQ ID NO: 34251 - RNA, 1617 nt, Artificial Sequence
  derived and/or modified sequence opt6 from VP1__Norovirus_and/or_Norovirus-like__GQ856449
augaaaauggcaucaaaugacgcaaauccuucugauggauccgcagcaaaccuaguuccagaaguuaauaacgaaguaauggcauuagaaccaguugucggcgcagcaauugcugcaccaguagcaggacaacaaaacguaauugacccauggauaagaaacaauuuuguacaagccccgggcggagaauuuaccguaucaccaagaaaugcaccaggagaaaucuuauggucagcaccucuagguccagacuuaaauccauaucuaucacaccuagcaagaauguacaauggauacgcuggagguuuugaaguacaaguaauacuagcuggaaaugcauuuacagcaggaaaaaucaucuuugcagcuguaccaccgaauuuuccaacagaaggauuaucaccaucacaagugacaauguuuccccacauuauaguagauguuagacaacuagaaccuguuuuaauacccuuacccgauguacgaaauaauuucuaucauuauaaccaaucuaaugacucaaccauaaaacuuauagccaugcuauacacaccacucagagccaacaaugcaggcgaagauguauuuacaguaucauguagaguucuuaccagaccaucuccagacuucgauuuuauauuuuuaguaccaccaacuguagaaucaagaacaaaaccauuuacagucccaauauuaaccgucgaagaaaugacaaauucaagauuucccauaccucuagaaaaacuauuuacagguccaucaagcgcauuuguuguacaaccacaaaauggaagauguacgacagauggaguccuauuagguacaacacaacuuucaccaguaaauauaugcacuuuucgaggagauguaacacauaucgcaggaacacacaauuacacuaugaaucuagcaucucuaaacuggaauaauuacgauccaacagaagaaauacccgcuccucuaggaacuccagacuucguaggaaaaauacaagguguauuaacucaaacaacaaaaggagacggaucaaccagaggacauaaagccacaguauauaccggaagcgcaccauucacaccaaaacuaggaucaguucaauucucaacagauacagaaaacgacuucgaaacacaucaaaauacaaaauucacgccaguagguguaauccaagacggaucaacaacacacagaaaugaaccccaacaauggguucuuccaagcuauagcgguggaaauguacaaaacguacacuuagcuccagcaguagcaccaacuuucccaggagaacaacuacuauucuuuagaucaacaaugccaggcugcaguggauauccgaauauggauuuagacuguuuauuaccccaagaauggguccaacauuuuuaucaagaagcagcuccagcucaaucagauguagcacuucucagauuuguuaacccagauacuggaagaguacuuuuugaaugcaaguuacacaaaaguggauacgucacaguagcucacacuggacaacaugauuuaguaauaccaccaaacgguuauucacgcuucgacccauggguaaaucaauucuauacccuagcaccaaugggaaauggaacaggaagacgacgauaa

SEQ ID NO: 34252 - RNA, 1617 nt, Artificial Sequence
  derived and/or modified sequence opt6 from VP1__Norovirus_and/or_Norovirus-like__EU921344
augaaaauggccucaucagaugcaacuccaucugaugguaguacagcaaacuuaguaccugaaguaaauaaugaaguaauggcacuagaaccaguaguaggagcagccauagcugcaccuguugcaggacaacaaaacguuauagauccuuggauucgcaauaauuuuguccaagcaccaggcggagaguucacugucucaccacgaaaugccccaggagaaauccuuuggucugccccacucggaccugaccuaaacccauaucuaucacaucuagcccgaauguacaauggauaugcaggaggauuugaaguacaaguaauauuagcaggaaaugcauuuacagcaggaaaaauaauauuugcugcaguacccccaaauuuuccuacagaaggccuaucaccaucacaaguuacaauguuuccucacauuauaguagauguacgacaacuagaaccaguacuuaucccauuaccagauguuagaaauaauuucuaucacuauaaucaauccaaugauccaacaauuaaauuaauagcaauguuauauacaccauuacgagcaaauaacgcaggagaugaugucuucacaguaucaugcagaguacuuacaagacccuccccagacuuugacuuuauauuccucguuccaccaaccguagaaucaagaacaaaaccauuuucagucccaauacucacuguagaagaaaugaccaacucaagauuccccauaccauuggaaaaauuauuuacaggaccaucaucagcauucguaguacaaccccaaaauggaagaugcacuacugacgguguauuacucggaacaacacaacuaaguccaguaaauauaugcaccuuucguggagacguaacacacauagcagggacucaaaacuacacaaugaaucucgcaucacaaaacuggaacaauuacgacccuacagaagaaauaccagcaccccuaggaacuccagacuuuguugguaaaauacaaggaaugccaacucaaacuacacgaggagacggaucaacaagaggucauaaagcaaccgucucaacuggaagcguacauuuuacacccaaacuaggaucaguacaauuuuccaccgacacaaguaaugauuucgaaaccggucaaaauacacgauuuacaccugucggagucguacaagauggcuccacaacacaucaaaaugaaccucaacaauggguuuuacccaacuacagcggaagagacucacauaacguacaccuagcacccgcaguagcaccaacauucccaggcgaacaacuacuauucuuucgaucuacaaugccaggauguucuggauauccaaauaugaaucuagacugcuuacuaccacaagaauggguucaacauuuuuaucaagaaucugcaccagcacaaucagauguagccuuacuacgauuuguaaauccagacacuggcagaguacucuucgaauguaaauuacauaaaaguggauacguaacaguagcacauacuggacaacacgauuuagucauaccaccaaacgguuacuucagauucgauucauggguaaaucaauuuuauacacuugcuccuauggguaauggugcaggcagaagaagauaa

SEQ ID NO: 34253 - RNA, 1617 nt, Artificial Sequence
  derived and/or modified sequence opt6 from VP1__Norovirus_and/or_Norovirus-like__AB541290
augaaaauggcaucaaaugaugcaaauccauccgacggauccgccgcaaaucuuguuccugaaguaaacaacgaagucauggcauuagaaccaguaguaggugcagccaucgcugcacccguagcaggacaacaaaauguaauugauccuuggauaagaaacaacuuuguacaagcaccuggaggagaauuuaccgucucaccuagaaacgcaccuggagaaauauuauggucugcaccauuaggaccagauuuaaacccauauuuaagccaccuagcaagaauguacaacggauaugcaggcggauuugaaguacaagucguauuagcaggaaaugcauucacagcuggaaaaauaauauuugcagcaguaccaccaaauuuuccaaccgaaggacuauccccaucacaagucacaauguuuccccacauaauaguugacguuagacaacuugaaccaguauuaauuccauuaccagauguuagaaacaauuucuaccauuacaaccaauccaaugacucaacaauuaaacucauagcaauguuauacacaccccuccgagcaaacaacgccggugaagacguauucacagucagcuguagaguacuaacuagaccguccccagacuucgacuucauauuucuaguaccaccaaccguagaaucacgaaccaaaccauuuacaguuccaauauuaacaguagaagaaaugaccaacucacgauuuccaauaccacuagaaaaauuauuuacuggcccaucaggugcauucgucguacaaccccaaaauggccgaugcaccacagacggaguauuauuagguaccacacaauuaucuccagucaauauaugcacuuuucgaggagauguuacacauauagcaggaucuagaaauuacacuaugaacuuagcuagcuuaaacuggaacaauuaugaucccacagaagaaauaccagcaccacuaggaacaccagacuuuguagguaaaauacaaggaguacucacacaaacaacaaaaggagauggauccacaagaggacacaaagcaacaguauauaccggaucaacaccauuuacaccuaaguuaggaucuguacaguuuagcacagauacggaaaaugacuucgaaaaucaucaaaauacuaaauucacaccaguugguguaauacaagaugguggcacuacacauagaaacgaaccccaacaauggguuuuaccaucauauagugguagaaauguacaaaacguucauuuagcaccagcaguagcaccaaccuuuccuggcgaacaacuauuauucuuuagaucuacaaugccaggaugcucuggauacccaaauauggauuuagauuguuuauuaccucaagaauggguucaacauuuuuaucaggaagcagcuccugcccaaucagacguugcacuacucagauuugucaaucccgacacaggaagaguacuauuugaauguaaacuacauaaauccggauauguaacaguagcucauacaggccaacacgaucuaguaauaccaccaaauggauauuucagauucgacucauggguaaaucaauuuuauacuuuagcuccaaugggaaauggaaccggaagaagaagauaa

SEQ ID NO: 34254 - RNA, 1617 nt, Artificial Sequence
  derived and/or modified sequence opt6 from VP1__Norovirus_and/or_Norovirus-like__GQ845322
augaaaauggcaucuaaugacgccaauccuucagauggauccgcagcaaaucuuguaccagaaguauccaaugaaguaauggccuuagaaccaguaguuggugcagcuauagccgcaccagucgcaggacaacaaaauguuauagacccauggauaagaaauaacuuuguacaagcaccuggaggagaauuuacaguaucaccacgaaaugccccaggcgaaauccuauggucagcacccuuaggaccagaccuaaacccauaccuaucucaucuagcaagaauguauaauggauaugcaggcggcuuugaaguacaagucauacuagcaggaaaugcauuuacagcaggaaaaauuauuuuugcagcuguaccaccaaacuuucccacagaaggucuaagcccaucacaaguuacaauguucccacauauaauaguugacguccgacaauuagaaccaguucuaauuccccuaccagauguacgaaauaacuuuuaucauuacaaccaauccaacgacucuacuauaaaacuaauugcuauguuauacacacccuuaagagcuaauaacgcaggagaagacguauuuacaguaagcuguagagugcuaacuagacccuccccagacuucgauuuuauauuccuaguacccccaacaguagaaucaagaacaaaaccauuuacuguacccauacuaacaguagaagaaaugacaaauucaagauuuccaauaccuuuagaaaaauuauuuacaggcccaucaggagcauuuguaguacaaccacaaaacggccgaugcacaacagacgggguacuacuaggcacaacucaauuaucccccguaaauauauguacuuuuaggggagauguaacacauauagcaggaucuagaaauuacacuaugaacuuagcaucacuaaacuggaauaauuaugaucccacagaagaaauaccugcacccuuagggacaccagacuuuguuggaaaaauacaaggaguacuaacacaaacaacaaaaggugacggaucuaccagaggacauaaagccacaguauauacaggaucaaccccauucacaccuaaauuaggaucaguacaauucagcacagauacagaaaacgacuucgaaacacaucaaaauacuaaauuuaccccagucggagucauccaagacggaucaacaacacauagaaacgaaccccaacaauggguauuacccagcuauucaggaagagacguacauaauguacaccuagcaccagccguagcgccaacauucccaggagaacaacuauuauucuuuagaucaacaaugcccggaugcucaggauauccaaauauggaccuagauuguuuacuaccucaagaauggguucaacauuuuuaucaagaagccgcaccagcacaauccgauguagcacuacuaagauuuguuaacccugacacaggucgcguauuauucgaauguaaacuacauaaaucaggauacguuacuguagcacacacuggacaacacgaccuagucauaccuccaaauggauauuucagauuugacucauggguaaaucaauuuuacaccuuagcuccaaugggaaauggaacaggacgaagacgcuaa

SEQ ID NO: 34255 - RNA, 1617 nt, Artificial Sequence
  derived and/or modified sequence opt6 from VP1__Norovirus_and/or_Norovirus-like__AB220921
augaaaauggcauccaaugacgcaagcccuucggauggaucuacagcaaaucuaguacccgaaguaaacaacgaagucauggcacuugaaccaguaguaggagcugcaaucgcugccccaguagccggacaacaaaauguaauagacccauggauucgcacaaacuuuguacaagcaccaggaggagaauuuacagucucccccagaaaugcaccaggagaaauacucuggucagccccauuaggaccagaucuaaauccauacuuaucacaccuagcaagaauguauaacggauacgcaggaggcuuugaaguacaaguaauauuagcaggaaaugcuuucacagcaggcaaaauaauauuugccgcaguaccaccaaauuuucccacagaaggcuuaucaccaucacaaguaaccauguuuccacauauuauaguagauguaagacaauuagaaccaguucuuauaccucuaccugauguacggaacaacuucuaucauuauaaccaaaguaaugauucaacaauuaaauuaauagcuauguuauacacaccauuaagagcaaauaacgcaggagacgauguauucacuguaucaugucgaguacucacuagaccauccccagacuuugacuuuaucuuucuaguaccaccaacaguagaaucuagaacaaaaccauuuacaguaccuauacuaaccguagaagaaaugacaaauagucgauuuccaauaccauuagaaaaauuauuuacaggcccaucaucagcuuucguaguccaaccacaaaacgguagaugcacaacugauggaguucuauuaggaaccacacaacuaucaccagucaauauuugcacauuucguggagacguaauacacauaccugguacaagaacuuauagaaugaauuuagcuucucaaaauuggaauaacuacgauccaacagaagaaauuccagcaccauuaggcacaccugacuuuguuggaaaaauacaaggcauguuaacccaaacaacaaaaggagaugguucaacacguggacacaaagcaaccguaaguacuggaucuguagauuuuacaccaaaacuaggaucaguucaauucgccacagacacagauaaugacuucgaaacuggacaaaauacaagauuuacaccaguaggagucauccaagacggaucaucagcacaccguaaugaaccucaacaauggguacuaccagauuauagcgguagaaccguacauaacguacaccuagcaccagcuguagcaccaacauuuccaggagaacaauuacuauucuuuagauccaccaugccaggauguucagguuacccaaauauggaucuugacuguuuacuaccccaagaauggguacaacauuuuuaucaagaagcagcaccaucacaaucugacguagcauuacuaagauuuguaaauccagacaccggaagaguauuauuugaauguaaacuacauaaagcuggauacgucacagucgcucauacaggacaacacgauuuaguaauuccaccuaauggauauuuuagauucgacucauggguaaaucaauuuuacacauuagcaccuaugggaaauggugcaggucgacgacguuaa

SEQ ID NO: 34256 - RNA, 1617 nt, Artificial Sequence
  derived and/or modified sequence opt6 from VP1__Norovirus_and/or_Norovirus-like__KX514221
augaaaauggcaucaaaugacgccaauccaucagacggcagugcugcaaaucuaguaccagaaguaaauaaugaaguaauggcacuugaaccuguaguuggagcugcuauagcagcaccugucgcuggacaacaaaauguuauagaccccuggauuagaaacaacuucguacaagcaccagggggagaauuuacaguaucaccucgaaaugccccaggagaaauauuaugguccgcaccacuaggcccagaucuaaacccauauuuaucucauuuagcacguauguauaacggcuaugcuggaggauucgaaguacaagucauucuagcaggaaacgcauuuaccgcaggaaaaauaauauuugcugcaguaccuccuaacuuuccaacugaagguuuaucaccaucucaagucacaauguuuccccacaucauaguagacguaagacaacuagaaccaguuuuaauuccuuugccagaugucagaaacaauuuuuaucauuauaaucaaucaaaugacucaacaaucaaauuaauagcuauguuauacacaccauuaagagcaaauaauccaggcgacgauguuuuuacaguaucauguagaguacuuaccagaccaucaccugacuuugacuuuauuuuccucguaccaccuaccguugaaagcagaacaaaaccauucuccgucccaauacuaacuguaggagaaaugacuaacucuagauuuccaguaaauuuagaaagacuauucaccggaccuucaucagcuaacguaguacaaccccaaaauggaagaugcacaauugauggcgaacuacuaggaacaacucaacuuucauccguaaacauauguacuuuuagaggagauguuacccacaucggcuccacacaucauuggacuaugaaccuagcaucaccaaacuggaacaauuacgauccaacagaggaaauuccugccccuuuagguacuccagacuuuguaggaaaaauacaagguauguuaacacaaacaacuaaaggcgaaggaucaacuagaggacacagagccacaguauacguaggaucagcaaacuacgcaccuaaacucggcagaguucaauuugaaacagauacaacuaaugaucuagaugcacaucaaaacacaaaauucacaccaguaggagucguacaaggaggagaaucuccacaaagaucagaaccucaacaauggguuuuaccaucuuacagcggacgagacacacccaacguacauuuagcaccagcaguagcaccaacauuuccuggagaacaacucuuauucuuuagaaguaccauaccagguugugguggucauccaaauaugaauuuagauugcuuauuaccacaagaauggguucaacauuuuuaucaagaagcugcaccagcacaaucagauguagcacuacuacgauuugucaacccagacacuucuagaguacuauucgaaugcaaauuacauaaaucaggcuauguaacuguagcucauacaggucaacacgaccuuguuauaccaccuaauggcuauuuccgauucgacucaugggucaaucaauuuuauacacuagcaccaaugggcaauggcacaggacggaaaagauaa

SEQ ID NO: 34257 - RNA, 1617 nt, Artificial Sequence
  derived and/or modified sequence opt6 from VP1__Norovirus_and/or_Norovirus-like__KY486271
augaaaauggcuaguucagaugcaaacccuucagauggaucagcugcaaaucucguaccagaaguaaacaaugaaguaauggccuuggaaccagucguaggcgcagcaauagcagcaccaguagcaggacaacaaaauguaaucgauccauggauacgaaauaauuucguacaagcaccaggcggagaauuuacaguaucaccacgaaaugcaccuggugaaauauuauggucugcuccccuugguccugaucuaaacccauaucuuucacaucucgcacgaauguauaauggauacgcaggaggauucgaaguccaaguaauacuagcaggaaaugcauuuaccgcagguaaagucauauucgcagcaguacccccaaauuuuccuaccgaaggacuaucacccucacaagucacaauguucccccauaucguaguugacguaagacaacucgaacccguacucaucccacuaccggacguaagaaauaauuucuaccauuacaaucaauccaacgaccccacaauaaaacuuauagcaauguuauauacaccacuacgagcaaauaaugcaggggacgauguauuuacaguuaguuguagaguacuaacaagaccauccccagacuucgauuuuauauuuuuaguuccaccaaccguagaaucaagaacaaaacccuuuucaguuccuguauuaacaguagaagaaaugacaaauucacguuuuccuauaccacuagaaaaacuauuuacaggaccaucuucagcauucguuguacaaccacaaaacggacgauguacaacugacgguguacucuuaggaacaacacaauuaaguccaguaaauauauguaccuuucgaggagaugucacacauaucacuggcucacguaauuacacaaugaauuuagcuucucagaacuggaacaacuacgauccuaccgaagaaauaccugccccauuagguacaccagacuuuguagguaaaauacaagguaugcuaacacaaacaacacgcgcugacggcucaacacgaggucacaaagcaacaguauacaccgguucagcagacuuugcaccaaaauuaggacgaguacaauucgaaacagauaccgaccacgauuucgaagcaaaucaaaauacaaaauucacuccuguuggaguaauacaagacggaucuacaacacacagaaaugaaccacaacaauggguacucccuucauacagcggccguaauacacacaacguucacuuagcacccgcaguugccccuaccuucccgggagaacaacuucuauucuuccgcucaaccaugccaggcugcuccggauauccaaauauggaccuagauugcuuauuaccucaagaauggguacaauauuucuaucaagaagcagcucccgcacaaucagauguagcccuucuacgauucguuaacccagacacaggacgaguacuuuuugaauguaaacuacacaaaucuggauacguaacugucgcacauacaggacaacacgauuuaguuauaccaccaaauggauacuuccgauuugacucauggguaaaucaauuuuacacacuagcaccuauggguaauggaacaggacgaagaagauaa

SEQ ID NO: 34258 - RNA, 1617 nt, Artificial Sequence
  derived and/or modified sequence opt6 from VP1__Norovirus_and/or_Norovirus-like__KP784692
augaaaauggcuuccucagacgcaaauccauccgacggcagcacagcuaaucuagucccagaagucaauaaugaaguaauggcauuagaaccaguaguaggcgcagcucucgccgcaccaguagcaggucaacaaaauguuauagacccauggauuagaucaaacuucguucaagcaccaggcggugaauuuacaguuucaccuaggaacgcuccaggcgaaauccuuuggucugcaccuuuaggacccgaucuaaauccuuaucuaucucauuuagcucgaauguauaaugguuaugcugguggauucgaaguacagguaauacuagcaggaaacgcauucacagcaggaaaaguaaucuuugcugcaguaccaccaaauuuuccaacagaaggucucaguccaucacaaguaacaauguucccacacauaaucguagauguuagacaacuagaaccaguacuaauucccuuaccagacguaagaaauaauuuuuaucacuauaaccagucuaaugaaucaacaauuaaauuaauagcaauguuauacacaccauuacgagccaacaaugcaggagaugauguauuuacaguaucaugucgaguauuaacaagaccaucaccagacuucgacuuuauauuucuaguaccaccaacgguagaaucaagaaccaaacccuucucuguaccuauauuaacuguagaagaaaugacaaauucaagauuuccaauaccacuugaaagauuauuuacuggacccucaagugcauucguaguacaaccacaaaacggaagaugcaccacagauggaguacuucuaggcacaacccaauuaucaccaguaaauauauguacauucagaggagacguuacacacacaaccgggucucauaauuauacaaugaaucucgcuucacaaaauuggucaaauuaugauccuacagaagaaaucccagcaccacuaggaacaccagacuuuguaggcaaaauccaagguguacucacucaaacaacacgagcagauggaucaacaagaggacauaaagcaacaguauauacagguucagcugacuuuaccccgaaauuaggucguguacaauucgcaacagacacagaccacgacuuugacacaaaucaaaauacaaaauucacaccaguagguguaauacaagacggaucaacuacacacagaaaugaaccacaacaauggguucuaccauccuauucugguagaaauacacauaacguacacuuagccccagcuguagcaccaacauuuccaggcgaacaacuucuauucuuucgaucaacuaugcccggauguucagguuauccaaauauggauuuagauugccuacuaccacaagaauggguugcacacuucuaccaagaagcagcacccgcacaaucagauguagcauuacuacgauuuguuaacccugacaccggaagaguacuauuugaaugcaaauuacacaaaucaggauauguaacaguagcccauacaggacaacaugaucuaguaauuccaccaaacggcuauuuuagauucgauucaugggucaaucaauuuuauacacuagcaccaaugggcaauggaacaggcagaagacgauaa

SEQ ID NO: 34259 - RNA, 1617 nt, Artificial Sequence
  derived and/or modified sequence opt6 from VP1__Norovirus_and/or_Norovirus-like__KX371604
augaaaauggcuucaucagacgcuaacccuucagacggcucaacagcaaacuugguaccagaaguaaauaaugaaguaauggcacucgaacccguagucggagcagcaauagcugcaccgguagcaggucaacaaaauguaauugacccauggauacgcaauaauuucguacaagcaccuggaggagaauuuacagucuccccacgaaaugccccuggagaaauauuauggucagccccacuuggaccagaucucaauccauacuuaucacauuuagcacgaauguauaacgguuacgcuggaggauuugaaguucaaguaauauuagcaggaaacgcauucacagcaggaaaaauaguauucgcagcaguaccacccaacuuccccacagaaggauuaucuccuucucaagucaccauguucccacacauaauaguugacguuagacaacuagaacccguccuuauaccauuacccgaugucagaaauaauuucuaccauuacaaucaaucaaaugauccuacaauaaaauuaauagcuaugcuauacacaccauuaagagcaaacaacgccggugacgauguauuuacaguuuccuguagaguuuuaacacgaccaucuccagacuuugacuucaucuuuuuaguaccuccaacaguugaaucucgaaccaaaccauuuucaguaccuguauuaacaguagaagaaaugaccaauucgcgauuucccauaccauuagaaaaacuauucacaggaccuucauccgcauuuguaguccaaccucaaaacggaagauguacaacagauggaguacuauuaggaacaacucaauuaucaccuguuaacauauguaccuuucgaggagacguuacacauauaucaggauccagaaauuacacuaugaaccuagcaucucaaaacuggaacucauacgauccaaccgaagaaauaccagcaccauuaggaacaccagacuucguaggaaaaauacaaggaguauuaacacaaaccacacguacuaacggaucaacaagaggacacaaagcaacagucuacaccggcucagcagauuucuccccaaaauuaggaagaguacaauucgcaacagauacagauaaugacuuugaaacaaaucaaaauaccaaauuuacuccagucggcguaauacaagacggaucuacaacuccacgaaaugaaccccaacaauggguacucccaagcuauucaggaagaaauauucauaacguccacuuagcaccagcaauagcaccaacauuuccaggagaacaauuacuuuucuuuagaucaacaaugccaggaugcucuggauaucccaauauggaucucgauugcuuacuaccccaagaauggguccaauacuuuuaucaagaagccgcaccagcacaauccgauguagcauuacucagauuuguuaacccagauacaggaagaguacuauucgaauguaaauuacauaaaucaggauacgucacaguugcacauacaggccaacaugaccuuguuauaccaccaaauggcuauuucagauucgauucuuggguuaaucaauuuuauacuuuagcuccaaugggaaauggaaccggucguagacgauaa

SEQ ID NO: 34260 - RNA, 1617 nt, Artificial Sequence
  derived and/or modified sequence opt6 from VP1__Norovirus_and/or_Norovirus-like__KX354079
augaaaauggcuucaucagacgcaaacccaucugacggaucaacagcaaacuuaguuccagaaguaaauaacgaaguuauggcacuugaaccaguaguaggagccgcuaucgcagccccagucgcuggacaacaaaauguaauagauccauggauuagaaauaacuuuguacaagcacccggaggugaauuuacaguaagcccaagaaacgcaccaggcgaaauauuauggucagcaccauuagguccagauuuaaauccuuaucuaucacacuuagcacgaauguacaauggauaugcaggagguuuugagguacaagucauuuuagcaggaaaugcauuuacagcaggaaaaauaauauucgccgcaguacccccaaauuuuccaacagaaggacuaucaccaucccaaguaacuauguuuccacauauaaucguagauguuagacaacuagaaccaguacuaauacccuuacccgauguacgaaacaacuucuaccacuauaaccaaagcaaugacccaacaauuaaacuaaucgcaaugcuauauacaccacucagagccaauaacgccggagacgauguguuuacaguaagcugccgaguauuaacuagaccuaguccugacuucgacuuuauauuucuaguuccaccgacaguagaaucaagaacuaaaccuuuuucaguaccaguauuaaccgucgaagaaaugacaaacuccagauuuccaauaccauuagaaaaauuauuuacagguccaucauccgcauucgucguacaaccacaaaauggaagaugcaccacagacggaguucuccucggaacaacucaauuauccccaguaaacauaugcacauuccgaggagacguaacacacauaucaggaucaagaaauuacaccaugaaucucgcaucucaaaacuggaacucauaugaucccacagaagaaguaccagcacccuuaggcacaccagauuuuguaggaaaaauacaaggaguauuaacacaaacaacaagaaccgauggcuccacacgaggacacaaggcaacuguauacacaggaucagcagacuuuucaccaaaauuaggaagaguacaauucgcuaccgauaccgauaacgauuucguugcaaaucaaaauacaaaauucacaccaguuggaguaauacaagauggaucuaccacuccacgaaaugaaccacaacaauggguacucccauccuacucaggaagaaacacacauaacguacaucuagcaccagccguugcaccaacauuuccaggcgaacaacuacuauucuuucguucuacaaugccaggaugcuccggauaucccaauauggaucuugauugccuacuuccgcaagaauggguucaauauuucuaccaagaagccgccccugcucagucugauguagcacuacuaagauucguaaauccggacacaggaagagucuuauucgaaugcaaacuacacaaaaguggauauguaacaguagcacauacaggacaacaugauuuaguuauaccaccaaacgguuacuucagguucgauucaugggucaaucaauuuuacacucuagcaccaauggguucaggcacaggaagacguagauag

SEQ ID NO: 34261 - RNA, 1617 nt, Artificial Sequence
  derived and/or modified sequence opt6 from VP1__Norovirus_and/or_Norovirus-like__KX354028
augaaaauggcaucaucagaugcuaacccaucugauggaucagcagcuaacuuaguucccgaaguaaacaaugaaguaauggcacuagaaccagucgucggagcagcuauagcugcuccaguagccggacaacaaaauguuauagacccauggauaagaaauaauuucguccaagccccagguggcgaauuuacaguaucacccagaaaugccccaggcgaaauacuuuggucagcuccauuaggaccagaucuaaacccauauuuaagccaucuagcacgaauguauaauggauacgcaggaggauuugaaguucaaguaauccuagcaggaaaugcauucacagcaggcaaagucauuuuugcugcaguuccaccuaauuucccuacagaaggacuaaguccaucccaaguaacaauguuuccucacauuguaguagauguccgacaacucgaaccaguccuaauuccuuuaccagauguucgaaacaauuucuaucacuauaaucaaucuaacgauccaacaauaaaauuaauugcaauguuauauacaccacuaagagcuaauaaugcaggagacgauguauuuacuguaucaugucgaguccuuacacgaccaucaccagauuucgauuuuauauuuuuaguaccucccacaguagagucuagaacuaaacccuuuucuguacccguauuaacaguagaagaaaugacuaauucaagauucccaauaccacucgaaaaacuguuuacaggaccaucaagcgcauucguaguacaaccacaaaacggaagauguacuacugauggcguacuauuaggaacaacacaacuaucaccaguaaauauauguacuuuuagaggugauguuacacacauuacaggaucaagaaauuacaccaugaaccuagcuucacaaaacuggaauaauuaugauccaacugaagaaacaccagcaccauuagguacaccugacuuugucggaaaaauccaaggaguauuaacacaaacaacaagaacagauggcagcacacgaggacacaaagcuacaguauauacaggaagcgcagauuuugcuccuaaauuaggaagaguacaauucgaaacagauacggaucacgauuuugaagcaaaucaaaauacaaaauuuacacccguuggaguaauucaagacggauccacaacacaucgaaaugaaccacaacaauggguacuucccucauauucuggacgaaauacacauaauguccauuuagcacccgcagucgccccuaccuuuccaggagaacaauuauuauucuuuagaucuacaaugccaggauguucaggauauccuaacauggacuuagauugucuacuuccucaagaauggguccaauauuuuuaucaagaagcagcuccagcacaaagcgacguugcccuacuuagauuuguaaacccagacacuggaagaguacuauuugaauguaaacuacauaaaagcgguuacgucacuguagcacacaccggacaacaugaucuaguaauaccacccaauggauacuuuagauuugauaguuggguaaaucaauuuuauacacuugcaccaaugggaaauggaaccggccguagaagauag

SEQ ID NO: 34262 - RNA, 1617 nt, Artificial Sequence
  derived and/or modified sequence opt6 from VP1__Norovirus_and/or_Norovirus-like__KX353983
augaaaauggcuuccucugaugcuaauccgucagacggaucaacagccaauuuagucccugaaguaaacaaugaagucauggcuuuagaacccguaguaggagccgcaauugcagccccuguugcaggacaacaaaauguaauugacccauggauaagaaauaacuuuguacaagcaccaggaggagaauuuacaguaucuccaagaaacgcaccaggagaaauacuauggucugcaccauuagguccagacuuaaauccauauuuaagucacuuagcaagaauguauaauggauaugcaggcgguuucgaaguacaaguaauucuagcaggaaaugcauuuacagcaggaaaaauaguauucgcagcaguuccaccaaacuuuccuacagaaggauuaucacccucccaaguaacaauguuuccucauauaauaguagacguuagacaacuagaaccagucuuaauaccacuuccagauguaagaaacaacuuuuaucacuauaaccaaucgaaugacccaacaauaaaauuaauagcaaugcuauauacaccacuaagagcaaacaacgcaggagacgauguauuuacaguaucuuguagaguacuaacaagaccaucaccagacuuugauuuuauauucuuaguaccaccaacaguagaaucacggacgaaaccauuuaguguaccaguacuuaccguagaagaaaugacaaacucacguuuuccaauaccccuugaaaaacuauuuacuggcccaucaucagcauucguaguacaaccccaaaacggaagauguacaacugacggaguacuucucgguaccacucaacuaucaccuguaaauaucuguacauucagaggagacguuacccacauauccggaucaagaaauuauacaaugaauuuagcaucccaaaauuggaacucauacgacccgacugaggaaauaccagcuccauuaggaacaccagauuucguaggaaaaauacaaggaguucuaacacaaacaacaagaaccgacgguucaacaagaggacacaaagcaacaguuuacacaggaucagcagauuuuucaccaaaacucggaagaguccaauucgcaaccgauacugacaacgacuucguaacaaaucaaaauacaaaauucacaccuguuggcguaauucaagacggcuccacuacacccagaaaugaaccacaacaauggguacuaccaucauauucagguagaaauacacacaauguacaccuugcuccugcaguagcaccaacauuuccaggugaacaauuauuauucuuccgaucaacuaugcccggaugcucagguuaucccaacauggaccuagacugcuugcucccccaagaauggguacaauauuucuaucaagaagcagcuccugcacaaucugacguagcacuacuaagauucguuaacccagauacaggaagaguacuauucgaauguaaauuacauaaaucuggcuacguaacaguagcccauacaggccaacacgaucucguaauacccccaaauggauauuuccgauucgauuccuggguaaaccaauuuuauacucuagcaccuaugggaaaugguacaggucguagaagauaa

SEQ ID NO: 34263 - RNA, 1617 nt, Artificial Sequence
  derived and/or modified sequence opt6 from VP1__Norovirus_and/or_Norovirus-like__AB972511
augaaaauggcaaguaaugacgcuaaccccucagaugguccagccgcuaaccuugucccugaaguuaacaaugaagucauggcacuagaaccaguaguaggcgcagcaauagcagcaccaguagcuggacaacaaaauguaauagacccuuggauacgaaacaauuuuguacaagccccuggaggugaauuuacaguuuccccaagaaaugcacccggagaaauacuauggucagcaccauuagguccagauuuaaauccauacuuaucacacuuagcaagaauguauaacggauaugcuggaggcuucgaaguacaaguaauucuagcaggaaacgcauuuaccgcaggaaaaauaauauucgccgccguaccaccaaauuucccaacugaagguuuaucaccaucacaaguaacaauguucccucauauuauuguagacguucgacaauuagagccaguacuaauaccauuacccgacguuagaaauaacuuuuaucacuauaaucaaucaaacgauucaacaaucaaacuaaucgcaaugcucuauacaccccuuagagcaaacaaugccggugaggacguuuuuacaguaucuugcagaguacuaacucgaccaagcccagacuuugacuucauauuccuaguuccaccgacaguugaaucaagaacuaaaccauuuacuguaccuauacuaacaguagaagaaaugacuaauucaagauuucccauaccauuagaaaaacuuuuuacuggaccaucaucagcauucgucguccaaccacaaaacggacguuguacaacugauggaguccuccuaggaacaacacaauuaucacccguaaauauaugcacauucagaggagacguaacacauauagcaggaucucgaaauuacacaaugaauuuagccaguuuaaauuggaacaacuaugacccaacagaagaaauaccagcaccauuaggaacacccgacuuuguaggaaaaauacaaggaaugcuaacccaaaccacaaaaggugacgguuccacaagaggacacaaagcaacaguuuacacaggaucagcaccauucacaccaaaauuagguucuguucaauuugaaacagauacagaaaacgacuucgaaacacaucaaaacacuaaauuuacaccaguaggaguuauccaagacggaggaacaacacaucgaaacgaaccucaacaauggguuuuaccaucauauagugggcgaaacguaccuaauguucacuuagcacccgcaguagcaccaaccuuccccggagaacaauuauuauucuuuagaucaauaaugccaggaugcucaggauauccaaacauggaccuugauuguuuauuaccccaagaauggguacaacauuucuaucaagaagcagcaccagcucaauccgacguagcacuacuacgauucguaaacccagacacagguagaguacuauuugaaugcaaacuacauaaaucagguuauguaacaguagcacauacaggacaacacgaucucgucauuccaccaaauggauacuuccgauucgacagcugggucaaucaauucuacacacuugcuccaaugggcaaugguacuggacgaagaagauaa

SEQ ID NO: 34264 - RNA, 1617 nt, Artificial Sequence
  derived and/or modified sequence opt6 from VP1__Norovirus_and/or_Norovirus-like__AB972478
augaaaauggcaagcagcgacgcaaacccaacugacggaucugcagcaaauuuaguuccagaaguaaauaaugaaguaauggcauuagaacccguaguaggagccgcaauugcugcuccaguagccggacaacaaaauguaauugacccauggauaagaaauaacuucguacaagcaccagguggagaguuuacagucucucccagaaaugcaccaggagaaauauuauggucugcccccuuaggaccagauuuaaauccauaucuuucacauuuagcuagaauguacaauggcuaugcuggaggauuugaaguacaaguaauacuagcuggaaaugcauucacagcaggaaaaguaauuuucgcugcaguaccaccaaauuucccaaccgaaggauuauccccaagucaaguaacaauguucccucauaucguaguagauguuagacaacuugaaccaguucuaauaccauuaccugacgucagaaacaacuucuaucacuacaaccaaaguaacgacccuacaauaaaauuaauagcaaugcuauacacaccauuaagagcaaacaaugccggcgacgauguauuuacagucucuuguagaguccuaacccgcccuucuccagacuuugacuucauauuucuuguaccaccaacagucgaaucacgcacaaaaccuuucucaguaccuguacuuacagucgaagaaaugacuaacucaagauucccuauuccuuuagaaaaacucuuuacaggcccaucauccgccuuuguuguucaaccacaaaacggaagauguacaacagacgguguacuacuaggaacaacucaacuaucuccuguaaauauauguacauuuagaggagauguaacacacauaacaggaucuagaaauuacacaaugaaucuagcaucccaaaauuggucaaauuaugauccaacugaagaaauaccagcuccacucggaacaccugacuuuguuggaaaaauucaaggaguucuuacucaaacgacaagaacagacggaucaacucguggacauaaagcaaccguuuauacaggaucagcagacuuugcaccgaaacuagguagaguacaauucgaaacugauacagaucaugauuucgaagcaaaucaaaauacuaaauuuacuccagucggcguaauacaagaugguucaacaacucacagaaaugaaccacaacaauggguacuaccaaguuauucagggagaaauacacccaacguacaccuagcaccagcaguagcacccacuuuuccaggagaacaacuauuauucuuuagauccacaaugccaggcuguucaggcuauccaaauauggaccuagauuguuuacucccucaagaauggguccaauauuucuaucaagaggcagcuccagcacaaagugacguagcacuucuaagauuuguaaaccccgacacaggccgaguacuauucgaaugcaaacuacauaaguccggcuauguuacaguagcccauaccggacaacaugaucuaguuauaccaccaaacggauauuuccgauucgacuccuggguuaaucaauuuuauacacuagcuccaaugggaaauggaacaggccgaagaagauaa

SEQ ID NO: 34265 - RNA, 1617 nt, Artificial Sequence
  derived and/or modified sequence opt6 from VP1__Norovirus_and/or_Norovirus-like__KT780382
augaaaauggccucuucagacgcaaauccaucugauggcucagcagcuaaucuaguaccugaaguaaacaacgaaguaauggcuuuagagccgguugucggagcagcuauugcugcaccaguagcaggccaacaaaacguaauagaccccuggauaagaaauaacuuuguacaagcaccaggcggugaauuuacaguuucaccuagaaaugcaccuggagaaauucuauggucagcaccauuaggaccagauuuaaauccauauuuaagccauuuagcccgcauguacaacgguuacgcuggcggauucgaaguacaaguuauucuugcagguaacgcauuuacagcuggcaaagucauauucgcagcaguacccccaaauuuucccacagaaggauuaaguccaucacaaguaacaauguuuccacauauaguagucgacguacgacaauuagaaccaguuuuaauaccauuaccagauguacgaaauaauuuuuaucacuauaaccaauccaaugacccaacaauaaaauuaauagcaauguuauauacaccacuaagagcuaauaaugcaggagaugauguauuuacugucucaugccgaguacuaacaagaccaucuccugacuuugacuuuauauucuuaguaccaccaacaguagaauccagaacaaaaccauucucaguaccaguacuaacaguagaagaaaugacuaauucaagauuuccaauaccacuugaaaaauuauucaccggaccaucaagcgcuuuuguaguacaaccacaaaauggaagaugcacaaccgaugguguacuacuagguacaacacaacuauccccaguaaauauauguacauuuagaggugacguaacacauauaacuggaucaagaaauuacaccaugaaccuugcaucucaaaauugguccaauuacgaccccaccgaagaaauaccagcuccucuaggaacaccugacuuugucggcaaaauacaaggaguacuaacacaaacaacaagaacugauggcucuacuagaggacacaaagcaacaguauauaccggaucugcagacuuugccccaaaauuagguagaguccaauuugaaaccgauacagaucacgauuucgaagcaaaucaaaauacaaaauuuaccccaguaggaguaauacaagacggcggcacaacacacagaaaugaaccacaacaaugggucuuaccuucauauucuggaagaaauacaccuaacguacacuuagcaccagcuguugcaccaacauuccccggcgaacaauuauuauuuuucagaucaacuaugccagguuguucaggauacccaaauauggaccuugacuguuuauuaccucaagaauggguucaauauuucuaccaagaagcagcuccugcacaaucagauguugcauuacucagauucguaaacccagacacaggacgaguacuuuuugaaugcaaauuacacaaaucaggcuauguaaccguagcucauacaggccaacacgacuuaguuauaccaccaaauggcuacuucagguucgauuccuggguuaaucaauuuuauacuuuagcaccaauggguaacggaacaggaaggagacgauaa

SEQ ID NO: 34266 - RNA, 1617 nt, Artificial Sequence
  derived and/or modified sequence opt6 from VP1__Norovirus_and/or_Norovirus-like__KT033905
augaaaauggcaucuaaugacgcaaacccaucagacggaucagcugccaacuuaguaccaaaaguaaacaaugaaguaauggcucuagaacccguaguaggagcugcaauagcugcacccguagcuggccagcaaaacguaauagaccccuggauaagaaauaacuucguccaagcaccuggaggaaaauuuacaguaucuccaagaaacgcaccaggagaaaucuuauggucugcuccacuuggaccagaccuaaauccauaccuaucacacuuagcaagaauguauaauggauaugcaggaggauuugaaguacaaguaauauuagcaggaaaugccuuuacagcuggcaagauaauuuucgcugcaguaccaccuaacuuuccaaccgaaggucuaucccccucacaaguuacaauguucccucacauaaucguagauguaagacaauuagagccaguguuaauacccuuaccagauguaagaaacaauuucuaucacuauaaccaaaguaacgacucaacaauaaaacuuauagcuauguuauacaccccacuacgagcuaauaaugcaggagaagaugucuuuacagucucauguagaguauuaacacgcccaucaccagauuuugacuuuauauuucuagucccuccaacaguagaaucaagaaccaaaccuuucacaguaccaauacuaacuguagaagaaaugacaaacucuagauuuccaauuccacuagaaaaauuauuuacaggaccaaguggagcauucgucguacaaccacaaaauggaagaugcacaaccgacggaguauuacuagguacaacacaacucucuccaguaaauauauguacauuucgaggugacguaacacauauagcaggaaguagaaauuacacaaugaauuuagcaucacuaaauuggaacaauuacgaucccacagaagaaauaccagcuccauuaggcacacccgauuuuguagguaaaauacaaggaguauuaacacaaacaacuaaaggugacggauccacaagaggacacaaagcaacaguauauaccggaucagcaccauuuacaccuaaacuaggaucaguacaauucucaacagauacagaaaacgauuucgaaacacaucaaaauacaaaauucacuccaguuggaguuauacaagauggaggaacuacucauagaaaugaaccacaacaauggguuuugccuagcuauuccggaagaaacguacauaacguacacuuagcacccgcuguugcaccaacuuucccaggagaacaauuauuauucuuucguucaacuaugccaggaugcucaggauauccuaacauggacuuagauuguuuauuaccacaagaauggguacaacacuuuuaccaagaagcugcaccagcucaaucugacguagcauuauuaagauuuguaaacccagauacuggaagaguauuauucgaaugcaaacuacauaaaucaggauauguuacaguugcacacacaggacaacacgauuuaguaauaccuccaaacgguuacuucagauucgauucauggguuaaccaauuuuacacuuuagcaccaaugggcaauggaacaggaagacgcagauaa

SEQ ID NO: 34267 - RNA, 1617 nt, Artificial Sequence
  derived and/or modified sequence opt6 from VP1__Norovirus_and/or_Norovirus-like__KR904207
augaaaauggcaucaucagaugcaaauccaagugacggaucuacagcaaaucuaguuccggaaguaaacaaugaaguaauggcacuagaacccguuguaggagcggcaauagcagcaccaguagcaggacaacaaaauguuauugauccauggauacgcaauaauuuuguacaagcuccaggaggagaauuuacagucuccccaagaaaugcaccaggagaaauauuauggucagccccucuaggaccagaccuaaacccuuaccuaucacauuuagcaagaauguauaaugguuaugcuggcggauucgaaguucaaguaauucuagcaggaaaugcauuuacugcaggcaaaauaauuuuugcagcaguaccacccaacuuuccaaccgaaggauuauccccuucccaaguaacaauguuuccacauauaauagucgacguccgacaacuugaaccaguucuaauaccccuaccagauguuagaaauaauuuuuaccauuauaaccaaucaaacgacccuacaaucaaacugauagccauguuauauacaccacuucgagcuaacaaugcaggagaugauguauucacaguaucuugcagaguauuaacacgcccaucuccagacuuugauuuuauuuucuuaguaccuccaacaguagaaucaagaacuaaaccauuuucuguuccaauacuaaccguugaagaaaugacaaauagcagguuuccaauaccucuagaaaaauuauuuacuggacccucaagcacauucguaguacaaccucaaaauggaagauguacaacagauggaguuuuauuaggcacuacacaauuaucuccuguaaauauaugcacuuucagaggcgauguaacacacauagcaggcucacauaauuauacaaugaauuuagcaagucaaaauuggaacucguaugaucccacugaagaaauaccugcaccacuuggcacaccugauuucgucggaaaaauacaaggaguacuaacucaaacaacuagaacagacggaucaacaagaggacauaaagcaacaguauauacugguucugcagauucaucaccuaaacuaggaaggguccaauucgccacagauacagauaaugacuucguagccaaucaaaauacaaaauucaccccaguaggaguuauacaagauggaggaacagcucauagaaaugaaccacaacaauggguuuuacccucauacucaggaagaaauacucauaauguacauuuagcuccagcaguugcuccaacauuuccaggagaacaauuauuauuuuuccgaucuaccaugccaggaugcucuggauacccaaauauggaccuagauugccucuuaccacaggaauggguacaauauuuuuaccaagaagcugcuccugcucaaucagacguagcacuacuuagauuugucaauccagauacaggccgcguauuauucgaaugcaaauuacacaaaucaggauauguuacacaagcacauacaggccaacaugaucuuguaauacccccgaauggauauuuucgauucgauucauggguaaaccaauuuuacacacuagcaccaaugggcaacggaacaggaagacguagauaa

SEQ ID NO: 34268 - RNA, 1617 nt, Artificial Sequence
  derived and/or modified sequence opt6 from VP1__Norovirus_and/or_Norovirus-like__KJ678151
augaaaauggcaagcucagacgcaaauccaucugacgguucagcugcaaauuuaguaccagagguaaauaacgaaguaauggcauuagaaccaguagucggagcugcaauugcagcaccagucgcuggccaacaaaauguaauugacccauggauaagaaauaacuucguacaagcaccaggaggagaauuuacaguaucaccaagaaaugcaccaggagaaauucuauggucagccccauugggaccagauuuaaauccauaccuaagccauuuagcaagaauguacaacggauaugcaggcggauuugaaguacaaguaauacucgcaggaaaugcauuuacagccggaaaaguaauauuugcagcuguaccaccaaauuuuccaacugaaggauuaucaccuucccaaguaacaauguuuccucauauuguaguugacguccgucaacuagaaccaguauuaauaccauuaccagauguacgaaacaauuucuaccacuauaaucaaucaaacgaccccacaauuaaacuaauagcaauguuauauacuccgcuacgagcaaauaaugccggugacgaugucuuuacaguaucuugccgaguacuaacaagaccaucaccugauuuugauuuuauauuuuuaguuccucccacugucgaaucaagaacaaaaccuuuuucagugccaguucuaacaguugaagaaaugacaaauucaagauuuccuacaccacuagaaaaauuauucacaggaccaucaucagcauucguaguacaaccacaaaauggccggugcacaacagacggaguccuacuuggaacaacucaacuaagcccaguaaauauaugcacauuucguggagaugucacacauauaacagguucaaggaauuauacaaugaauuuagcaucacaaaauuggucaaauuaugacccaacagaagaaauuccagcaccauuaggaacacccgacuuuguaggaaaaauucaaggaguauuaacacaaacuacaagaacagaugguagcacacgaggacauaaagcaacagucuauacaggcucugcagauuuugcaccaaaacuaggaagaguucaauuugaaacagacaccgaucaugacuucgaaacaaaucaaaacacuaaauuuacaccuguaggaguaauucaagauggaucuaccacccaucgaaacgaaccacaacaauggguacuaccaucuuauucaggacgaaauacacccaauguacaucuagcaccagcaguggcccccacauucccuggagaacaauuacuauucuuucguucaacaaugccaggcuguucaggauacccaaauauggacuuagacugucuacuaccucaagaauggguucaauacuucuaucaagaagcagcaccagcacaaagugaugucgcauugcuaagauucguaaacccagacacuggaagaguauuauuugaaugcaaauuacauaaaucaggauacguuacaguugcucacacaggucaacaugaccuaguaauuccuccaaacggauauuuccgauuugacucaugggucaaccaauucuacacacuagcaccaaugggaaauggcacaggacgaagacgcuaa

SEQ ID NO: 34269 - RNA, 1617 nt, Artificial Sequence
  derived and/or modified sequence opt6 from VP1__Norovirus_and/or_Norovirus-like__KJ678143
augaaaauggcauccucagacgcaaauccuucagauggaucagcagcaaauuuagucccugaaguaaacaacgaaguaauggcccuagaacccguaguaggagcagcaauagcagcaccaguagcaggacaacaaaauguaaucgacccauggauaagaaauaacuuuguacaagcuccagguggcgaauuuaccguaucuccacgaaaugcaccaggagaaauacuauggucagcaccccuaggcccugaccuaaauccauauuuaucacaccucgccagaauguauaacggauaugcaggaggauucgaaguacaagucauacuagcaggaaacgcauuuacagcaggaaaaguaauauuugcagcugucccuccuaacuucccaacagaaggucuaucuccaagucaaguaacaauguuuccacacauaguugucgacguaagacaauuagaaccaguacuaauuccacuaccagauguaagaaacaauuuuuaucauuacaaucaaucuaaugauccaacaauaaaacuaauagcaauguuauacacuccccuaagagcuaacaacgcaggagacgauguauuuacuguauccuguagaguacucaccagaccuagcccagauuuugacuucauauuucuaguacccccaacaguugaaucaagaacuaaaccuuucucuguaccaguacuaacuguugaagaaaugacuaauuccagauucccaacuccauuagaaaaauuauucacagguccuucauccgcuuuuguaguacaaccccaaaauggcagauguacuacagaugguguauuacuaggaaccacacaacuaucuccaguaaauaucuguaccuuucgaggcgacguaacacauauaaccgggagcagaaacuauacaaugaauuuagcaucacagaacuggucaaauuaugauccaacugaagaaauaccugcccccuuaggaaccccagacuuuguagguaaaauacaagguguccuaacacaaacaacuagaacagacggcaguacaagaggacauaaagcaacaguauauaccggaucugccgacuuugccccaaaauuaggacguguacaauuugaaacugauacagaucacgauuucgaagcaaaucaaaacaccaaauucacuccaguaggaguuauccaagacggaaguaccacacaucgaaaugaaccacaacaauggguucuaccaucuuauucaggaagaaauacacccaacguucaccucgcaccagcuguagccccaaccuuuccaggcgaacaacuacuauucuuucgaucaacuaugcccggcuguucuggauacccaaauauggaccuagauugccuauuaccacaagaauggguacaauacuuuuaucaagaagcagcaccagcucaaucagauguagcccuacuuagauuuguaaacccagauacaggaagaguucuauucgaauguaaacuacauaaaucaggauacguaaccguagcacauacaggacaacacgaucuaguuauaccgcccaauggcuauuuuagauucgacaguugggucaaucaauuuuacacacucgcaccaaugggaaacgguacaggcagaagaagauaa

SEQ ID NO: 34270 - RNA, 1617 nt, Artificial Sequence
  derived and/or modified sequence opt6 from VP1__Norovirus_and/or_Norovirus-like__KP698927
augaaaauggcaaguucagaugccaacccaucagaugguucugcagcuaauuuaguacccgaaguaaacaaugaaguaauggcauuagaaccagugguaggcgcagcuauagcagcaccaguagcaggacaacaaaaugucauagauccauggauaagaaacaauuucguacaagcaccaggaggagaguucacuguaucuccaagaaaugcacccggcgaaauauuauggucugccccacuuggaccugacuuaaaucccuaucuaucccaccuagccagaauguauaacggauacgcaggagguuucgaaguacaaguuauccucgcaggaaaugcauuuacagcaggaaaaguaauuuucgcagcaguacccccuaauuuuccuacagaaggauuaucucccucacaagucacaauguuuccucacauaguaguagacguaagacaacuagaaccaguacucauaccauuacccgauguaagaaacaauuucuaucacuauaaccaaucaaaugacccaacaauaaaacuaauagccaugcuuuauaccccucuacgagcaaauaaugccggagacgauguauuuacaguaucauguagaguccucacacgaccaucuccagacuuugacuucauauuucucguacccccaacaguagaaucaagaaccaaaccauucucggucccuguauuaacuguugaagaaaugacaaacucaagauucccaauuccauuagaaaaacuuuucacugguccuucaucagcuuuuguaguucaaccacaaaacgguagaugcacaacagauggaguauuacuagguacaacccaauuaucaccaguaaacauauguacauuucgaggagacguaacacauauaacaggcucuagaaauuacacuaugaacuuagccagccaaaauuggucuaacuacgaucccacagaagaaauaccagcccccuuaggcacuccugacuucguaggaaaaauucaaggaguccuaacacaaacaacaagaacggauggcucaacccgaggacacaaagcaacaguauauacaggcuccgcagauuuugcaccaaaauuagguagaguccaauuugaaacagauacugaucacgauuucggaacaaaucaaaacacaaaauuuacacccgucggaguuauccaagaugguuccacaacacaccgaaaugaaccacaacaauggguauuacccucauauuccggaagaaacacuccuaauguacaccuagcacccgcaguugccccuacauuuccaggugaacaacuccuuuucuuuagaagcacaaugccaggcugcuccgguuacccaaauauggacuuagacuguuuacuaccucaagaauggguacaauauuuuuaucaagaagcagccccagcccaaucagauguagcacuauuaagauuuguaaauccagacaccgguagaguauuauuugaauguaaacuucacaaaaguggauauguuacaguagcacauacaggucaacacgacuuaguaauaccacccaauggauacuucagauucgauucauggguuaaucaauuuuacacccuagcaccaauggguaauggaacaggcagaagacgcuaa

SEQ ID NO: 34271 - RNA, 1617 nt, Artificial Sequence
  derived and/or modified sequence opt6 from VP1__Norovirus_and/or_Norovirus-like__LC005730
augaaaauggcaucaucagaugcaaauccaucugauggcucggcagcaaaucuaguaccugaaguaaacaaugaaguaauggcauuagaaccaguaguuggagccgcaauagcagcaccaguugcaggacaacaaaacgucauagauccuuggauaagaaauaacuuuguacaagcuccaggaggagaauuuacaguaucuccaagaaacgcuccaggagaaauauuauggucagcuccacuuggcccugaucuaaacccuuauuuaucacaucuagcaagaauguauaauggauaugcaggaggauucgaaguucaaguuauauuagcaggaaaugcauucacagcuggaaaaguuauuuuugcagcuguaccaccaaacuucccaacugaaggucuuucacccagccaaguaacaauguucccacauauagucguagauguaagacaacuagaaccuguucugauaccuuuaccagauguacgaaacaauuucuaccacuauaaucaaaguaaugauccgacuauaaaacucauugcaauguuauacacaccauuaagagccaauaaugcaggagaugacguauuuaccguuaguugcagaguacuaacuagaccaucaccagacuuugacuuuauauuccuaguaccaccaacaguagaaucaagaacuaaacccuucucaguaccaguauuaacaguagaagaaaugacuaauucaagauucccuauaccauuagaaaaacucuuuacaggaccaucaucagcauuuguaguccaaccacaaaauggacgauguacaacugaugguguauuacuaggaacaacacaauuaucaccaguaaauauuugcacauucagaggcgauguaacacacauaacaggcucuagaaacuauacaaugaaucuagcaucacaaaacuggucaaauuacgauccaacagaagaaauaccagcaccauuaggaacaccagacuuugucggaaaaauacaaggagugcucacucaaacaacuagaacugacggauccacaagaggacauaaagccacuguuuauacggguagugcugacuuugcaccuaaacugggacgaguccaauuugaaaccgacacagaucaugauuucgaagcaaaucaaaacacaaaauuuacuccaguaggaguaauccaagauggcggaacaacacaccgaaacgaaccacaacaauggguauuacccucauauucaggacgaaacacacauaauguacauuuagcaccagcaguugcaccaacauuuccaggagaacaacuccuauucuuuagaucaacaaugccugguuguucagguuauccaaacauggacuuagauugccuacucccucaagaauggguacaauacuucuaucaagaagcagcgccugcacaaucagauguagcacuacuucgauuuguuaacccagauacagguagaguucuauucgaauguaaacuacacaaaagugguuauguuacagucgcacauacaggucagcacgacuuagugauaccaccaaacggcuauuuuagauuugauucaugggucaaucaauuuuauacucuagcaccaaugggaaaugguacugguagacgacguuaa

SEQ ID NO: 34272 - RNA, 1617 nt, Artificial Sequence
  derived and/or modified sequence opt6 from VP1__Norovirus_and/or_Norovirus-like__LC005714
augaaaauggccucaucagaugcgaacccaagcgauggaucagcagccaaccuaguaccugaagucaauaaugaaguuauggcacuagaaccaguaguaggagcugcaauugcugcaccaguagcaggacaacaaaauguaauagacccauggauccgaaauaauuuuguacaagcuccuggaggagaauuuacaguauccccucgaaaugcaccaggugaaauacuuuggucagcuccacuuggaccugaucuaaacccauaucuaucacauuuagcaagaauguacaacggauacgcuggaggcuucgaaguacaaguaauucuagcaggcaaugcuuuuacugcaggaaaaauaauauucgcugcaguuccaccaaacuuucccacagaaggauuauccccaucacaaguuacaauguucccacacauaauaguagacguacgacaacuagaaccaguacuaauaccccucccagauguuagaaauaacuuuuaucauuauaaucaaucuaacgacucuacaauaaaauuaauagccaugcuuuacacaccacuaagagcaaacaacgcaggcgaagaugucuuuacaguauccuguagaguacucacaagaccaucaccagauuuugacuuuauauuccuaguaccuccuacuguagaaucacgaaccaaaccauucacaguaccaauccuaacaguugaagaaaugacaaauuccagauuucccauuccacuagaaaaauuauucaccggacccucuuccgcauuuguaguacaaccccaaaacggacgaugcaccacagauggaguauuacucggaacaacacaacuaucaccaguuaauauauguacauuuagaggcgaugucacccacauagcugguucuagaaacuacacaaugaaccuagcaucacucaacuggaauaauuaugacccuacagaagaaauacccgccccacuaggaacacccgauuuugucggaaaaauacaaggaauguuaacacaaacaacaaaaggagacggaucaacaagaggucauaaagcaacaguauauacaggaucaacaccauuuacaccaaaauuaggaucaguacaauucucaaccgauacagaaaacgauuuugaaacucaucaaaauacuaaauuuacaccuguuggcguaauucaagacggaucaacaacacauagaaacgaaccccaacaauggguacuaccaucauauucaggacguaauguaccaaacguacacuuagccccagcugucgcaccaacauucccaggcgaacaacuacucuucuuuagaucuacaaugcccggaugcucaggauauccaaacauggauuuagacugcuuacucccccaagaauggguacaacacuucuaccaagaagccgcaccagcacaaucugacguagcacucuuacgauuugucaacccugacacaggucgaguucuauucgaaugcaaauuacauaaaucgggcuacguuacagucgcucacacaggucaacaugaucucguaauuccacccaauggauauuucagauucgacucauggguaaaucaauucuacacacuagcuccaauggguaacggcaccgguagaagaagauaa

SEQ ID NO: 34273 - RNA, 1617 nt, Artificial Sequence
  derived and/or modified sequence opt6 from VP1__Norovirus_and/or_Norovirus-like__KP241906
augaaaauggcaucaagcgacgcaaacccaucagacgguucagcagcaaacuuaguacccgaaguuaauaaugaaguuauggcacuagaacccguaguuggagcagcaauagcagcaccagucgcaggucaacaaaacguaauugacccauggauaagaaauaauuuuguacaagcaccaggaggugaauuuacaguaucaccacguaacgcaccaggagaaauacuauggucagcaccauuagguccagauuuaaaccccuaccuaucucaucuagcaagaauguacaacggauaugccggaggauucgaaguacaaguaauacuagcuggaaaugcauucaccgcaggaaaaguaauauuugccgcuguaccaccaaauuuuccaacagaaggauuaucaccuagucaaguaaccauguucccccauauaguaguagacguaagacaacuagaacccguauuaauaccuuuaccagauguaagaaauaauuuuuaucauuacaaccaaucaaaugacccaacuauaaaacuuauugcaaugcucuauacaccauuacgagcgaacaaugccggagacgauguauuuacaguaucaugucgaguauuaacuagaccuucuccugauuuugacuuuauauuuuuaguuccaccaacaguagaaucacguaccaaaccauuuucaguucccguacuaacaguugaagaaaugacaaauucaagauuuccaauaccauuagaaaaacuuuuuacagguccaucaagcgcauucguaguccaaccucaaaacggaaggugcacaacagacggcguauuauuaggaaccacacaauuaaguccaguaaauauauguacauuccgaggugauguaacacacauuacuggcucccgaaacuacacuaugaaucuagcaucacaaaacuggucaaauuacgacccuacagaagaaauaccagcaccacuaggaacaccagauuuuguagggaaaauacaaggcguacuaacacaaacaacacgaacugaugguucaacuagaggucacaaagcaacuguauauaccggcucugcuaacuuugcuccaaaauuaggaagaguacaauucgaaacagauacugaccaugauuuugaagcuaaucaaaacacaaaauuuacaccaguagguguaauacaagacggcggaacaacacauagaaacgaaccacaacaauggguccuaccauccuauucaggaagaaauaccccaaacguacaccuugccccagcaguagcaccaaccuuuccaggagaacaacuauuauucuuuagaucaaccaugccaggcuguucugguuacccaaauauggauuuagauugccuccuaccacaagaauggguucaauauuucuaucaagaagcagcuccugcacaaagugacguagcauuacuacgcuucgucaauccagauacuggacgaguauuauucgaauguaaauuacacaaaucagguuauguaacaguagcacauacuggacaacaugaucuuguaauaccaccuaacggauauuucagauucgauucauggguaaaucaauuuuauacccuagcaccaaugggaaacggcacaggacgucgaagauaa

SEQ ID NO: 34274 - RNA, 1617 nt, Artificial Sequence
  derived and/or modified sequence opt6 from VP1__Norovirus_and/or_Norovirus-like__KM982938
augaaaauggcauccuccgacgcaaacccgucugaugguucagcugccaauuuaguaccugaaguaaacaacgaaguaauggcacucgaaccuguuguaggagcagcaauagccgcacccguagcaggacaacaaaaugucauagacccauggauuagaaauaacuuuguacaagcaccaggaggagaauuuacaguuagcccuagaaacgcaccaggagaaauauuauggucagcaccucuagguccagauuuaaacccauaccucagucaccuagcuagaauguauaauggauacgcaggagguuuugaaguacaagucauacuagcaggaaaugcguuuacagcaggaaaaguaauauuugcagcaguacccccuaacuuuccaaccgaaggacuaucuccaagucaaguuacaauguucccacacauagucguagacguaagacaacuagaaccaguacucauaccacuaccugacguucguaauaacuuuuaucauuauaaccaaagcaaugacccuaccauaaaauuaauagcuauguuauauacaccauuacgagcaaauaaugcaggagaugacguauuuacaguaucauguagaguacuaacaagaccaucaccagauuuugauuuuauauuuuuaguuccaccaacaguugaaucaagaacaaaaccuuucucaguacccguucuaacuguagaagaaaugacaaacucaagauuuccaauuccccuagaaaaauuauuuacagguccaucaucagccuuuguuguacaaccacaaaacggcagaugcacaacagacgguuuacuauuaggcacaacacaauuaucaccaguuaauauauguacauuuagaggagauguaacacauauaacaggaucacgaaacuacacuaugaacuuagcaucucaaaauuggucaaacuacgacccaacugaagaaauaccagcaccauuagguacaccagauuucguaggaaaaauacaaggaguacucacacaaacuacacgaacagauggaucuacaagaggacauaaagcaacaguauauaccggaucugcagacuuugccccaaaacuaggacguguucaauuugagaccgauacagaccacgauuucgaagccaaucaaaauaccaaauucacaccuguaggaguaauacaagacggagguacaacacacagaaaugaaccacaacaauggguucuaccaucauauuccggaagaaauacaccaaacguacacuuagcacccgcaguagccccaaccuuuccaggagaacaauuauuauucuuuagauccaccaugccagguugcucagguuaucccaacauggauuuagauugcuuacuaccacaagaauggguacaauauuucuaucaagaagcagccccagcucaaagugacguagcccuacuacgauuuguaaacccagacacaggcagaguacuauuugaauguaaacuacauaaaucaggauauguaacagucgcacacaccggucaacaugaccuagucauaccaccaaacggauauuuccgauuugacucauggguaaaucaauuuuauacuuuagcaccaaugggaaacggaacaggaagaagacguuaa

SEQ ID NO: 34275 - RNA, 1617 nt, Artificial Sequence
  derived and/or modified sequence opt6 from VP1__Norovirus_and/or_Norovirus-like__KM514058
augaaaauggcaucaucagaugcaaaccccagugacggaucagcagcaaauuugguacccgaaguaaacaaugaaguuauggcacuagaaccaguuguaggagccgcuauagcagcacccguugccggacagcaaaauguaauagacccauggauaagaaauaacuuuguacaagcaccuggaggagaauuuaccguaucaccaagaaaugccccaggggaaauauuauggucagcaccauuaggaccugauuuaaaccccuaucuaucucaucuagcccgaauguauaaugguuaugcaggcgguuuugaaguacaaguuauucuagcuggaaaugcauucacagcuggaaaaguaauauuugcagcgguuccaccuaauuuuccuacagaaggacuaucaccaucacaaguaaccauguucccccauauaguagucgauguaagacaauuagaaccaguacuaauaccucuaccagaugucagaaacaauuucuaucauuauaaucagucaaaugauccuaccauaaaacuaauagcaaugcuauacacaccucuacgcgcaaacaaugcaggagacgacgucuucacaguaucaugucgaguuuugacucguccaucaccugauuuugacuuuauauuccuaguaccuccaacuguagaaucacgaacaaaaccauuuucagucccuguucuuacaguugaagaaaugacaaacagcagauuuccuauaccacuagaaaaacuauuuacuggaccaagcucagcauucguaguacaaccacaaaauggaagaugcacaaccgacggucuauuacuaggaacaacccaauuaaguccaguuaauauauguacauuucgaggagauguuacacauauaacuggcucaagaaauuauacaaugaaucuugcaucacaaaacuggucaaacuaugacccaacugaagaaauaccugcaccacuuggaacuccagauuucguaggaaaaauacaaggaguacuuacacaaacuaccagaaccgauggaucaacaagaggacauaaagcaacuguauauacaggaucagcagacuuugcuccaaaauuaggacgcguacaauuugaaacagacacugauagagauuuugaagcaaaccaaaauacaaaauucacaccuguaggaguaauacaagauggagguaccacucaucgaaacgaaccacaacaauggguuuuaccaucauauucaggaagaaauacaccgaacguucaucuagccccagcuguagcuccaacauucccuggagaacaacuauuauucuuuagaucaacaaugccaggauguucuggauauccaaauauggaucuagacugccuacuaccucaagaauggguccaauauuuuuaccaagaagcagccccagcacaaucagauguagcacuacuaagauuuguaaacccagauacuggaagaguauuauuugaaugcaaauugcauaaaagugguuauguaacagucgcucauacuggacaacacgaccucguuauaccaccuaacggcuauuucagauucgauucauggguaaaccaauuuuacacacucgcacccauggguaauggaacaggucguagaagauaa

SEQ ID NO: 34276 - RNA, 1617 nt, Artificial Sequence
  derived and/or modified sequence opt6 from VP1__Norovirus_and/or_Norovirus-like__KM198580
augaaaauggcuuccaaugacgcuaacccaacagacggcucagcagcaaaucuaguaccagaaguuuccaacgaaguuauggcauuagaaccaguaguuggugcagccauagccgcaccaguagcaggucaacaaaacguaaucgauccuuggauaagaaauaauuuuguacaagccccaggaggagaauuuacaguaucaccucgaaaugcuccgggagaaauccuauggucugccccauuaggaccagaucuaaacccauaucuaucacacuuagccagaauguauaauggauacgcuggcggauucgaaguacaaguuauacucgcaggcaacgcauuuaccgcaggaaaaauaauauucgcagcaguaccaccaaacuuuccaacagaaggucucucaccuucucaaguaaccauguucccacacauaauaguagacgucagacaauuagaaccaguacuaauaccacuacccgauguaagaaauaacuucuaccacuauaaucaaacaaacgacucaacgauaaaauuaauagcuaugcucuauacaccacuacgcgcaaauaaugcaggcgaagacguauuuaccguauccuguagaguacuaaccagaccaucccccgauuucgacuuuauauuucuaguaccaccaacaguugaaucuagaacaaaaccauucacugucccaauuuuaaccgucgaagaaaugacaaauucaagauuucccauaccuuuagaaaaauuauucaccggaccaucaggcgcauuuguuguacaaccacagaauggaagaugcacaacagauggcguacuauuaggaacaacacaacuauccccaguaaauauauguacauucagaggagacguuacacauauagcaggcucaagaaauuacacaaugaauuuagcaucauuaaacuggaacaauuacgacccaacagaggaaauuccagccccauuaggcacaccugacuuuguuggaaaaauacaaggaguacuuacacaaacaacuaaaggugacggaucaacuagaggucacaaagcaacugucuauacaggcucagcaccauuuacaccaaaacuaggcucaguacaauucucaacagacacagaaaacgauuucgaaacucaccaaaauacaaaauucacaccuguaggcguaauccaagacggcggaacaacacauagaaaugaaccacaacaauggguauuaccaucuuauaguggaagagauguacauaauguacauuuagccccugcaguagcaccuacauuuccaggagaacaacuacuuuucuuucgaucaaccaugccuggaugcucaggauacccaaacauggaucuugacugccuauuaccacaagaauggguacaacauuuuuaccaagaagcagcaccagcacaaucugacguagcucuauuaagauucguaaacccagacaccggaagaguacuauuugaauguaaacugcacaaaucaggcuacguaacaguagcucauacuggacaacacgauuuaguaauaccaccaaauggauauuuucgauuugacaguugggucaaucaauuuuauacacuagcaccaaugggaaacggaacugguagaagacgauaa

SEQ ID NO: 34277 - RNA, 1617 nt, Artificial Sequence
  derived and/or modified sequence opt6 from VP1__Norovirus_and/or_Norovirus-like__KM198537
augaaaauggcucccaaugacgcaaacccaucagauggaucagcagcaaaccuaguaccugaaguaucaaaugaagucauggcacuagaacccgucguaggcgcagcaaucgcagcaccagucgcaggucaacaaaaugucauagauccauggauaagaaauaauuucguacaagcaccaggaggugaauuuacaguuucuccaagaaacgcaccaggugaaauucucuggggagcaccuuuaggcccagauuuaaauccauauuuaucacaccuagccagaauguauaacgguuacgcaggaggauuugaaguacaaguaauacuagcagguaacgccuuuacagcaggaaaaauaauauuugcagcaguuccuccaaauuuuccuacagaaggacuaucacccucacaaguaacaauguuuccacauauaauaguugauguaagacaacuugaaccaguuuuaauacccuuaccagaugucagaaacaauuuuuaucacuacaaucaaaccaaugauucaacaauaaaauuaauagcuaugcuuuauacaccuuuacgcgcgaacaacgcuggugaagauguuuuuacuguaagcugcagaguauuaaccagaccaucaccagacuuugacuuuauauucuuaguuccaccaaccguugaaucaagaacaaaaccauuuacaguaccaauauuaacaguagaagaaaugacaaauuccagauuuccuauaccauuagaaaaauuauucacaggaccaucaggagcauucguaguacaaccacaaaacggcagaugcacuacugacggaguacuucuaggaacuacacaauuaucaccagucaauauaugcacauuuagaggcgacguaacacacauagcuggcucaagaaauuauaccaugaaucucgccaguuuaaacuggaacaacuacgauccaaccgaagaaauaccagcacccuuaggaaccccagacuuuguuggaaaaauacaagguguacucacacaaacaacgaaaggagauggaagcacaaggggacauaaagcaacaguauacacaggaucagcaccauuuacaccuaaacuaggaucgguucaauucucuacagauacagaaaacgacuucgaaacacaucaaaacacaaaauucacaccaguaggaguaauacaagacggagguacaacccauagaaaugaaccccaacaauggguauuaccaucauauucuggaagagauguacauaauguacacuuagcuccagcgguugcaccaacauucccuggagaacaauuauuauucuuuagaucuacaaugccaggauguucuggauacccaaauauggaucuggacugccuacuaccacaagaauggguacaacauuuuuaucaagaagcagccccugcacaaucagacguagcuuuacuaagauuuguaaacccagacacaggcagaguacuauuugaauguaaacuacauaaaucaggcuauguaacaguagcacacaacggacaacacgaucuuguaauuccaccaaauggauacuuucguuuugauuccuggguuaaucaauuuuacacacuagcaccaaugggaaaugguacaggcagaagaagauaa

SEQ ID NO: 34278 - RNA, 1617 nt, Artificial Sequence
  derived and/or modified sequence opt6 from VP1__Norovirus_and/or_Norovirus-like__KF177450
augaaaauggcaucaagugacgccaacccauccgacggaucagcagcaaauuuaguuccugaaguaaacaacgaaguaauggcacuagaaccugucguaggugccgcaauagcagccccaguugcaggacaacaaaauguaauagauccauggauaagaaauaacuuuguacaagcaccuggcggugaauuuacaguuucaccaagaaaugcaccaggggaaauauuauggucugcaccucuagguccagauuuaaacccauaucuuucacauuuagcaagaauguauaacgguuaugccggagguuucgaaguacaaguaauucuagcaggaaaugcauuuacagcugguaaaguuauauucgcagcaguaccaccaaacuuuccuacagaaggucuaaguccuucacaaguuacuauguucccccauauuguaguagacguaagacaacuagaaccaguauuaauuccauuaccugacguaagaaauaacuucuaucauuauaaucagagcaaugacccaacaauaaaacuaaucgcuauguuauacacaccccuuagagcuaauaacgcuggagacgauguauucacaguaucaugcagaguucuaacuagaccaucucccgauuuugauuuuaucuuuuuaguaccaccaacagucgaaagcagaacuaaaccauuuucuguacccguacuaacagucgaagaaaugacuaacucccguuuuccaauaccauuagagaaauuauuuacaggacccuccucugcuuucguaguacaaccccaaaacggaagauguacaaccgaugguguacuacuaggaacaacucaauuaucaccuguaaacauauguacuuuuagaggagaugucacacacauaacuggaaguagaaauuauacaaugaaccuagcuucucaaaacuggaauaauuacgauccaacagaagaaauaccagcuccucucggaacaccagauuuuguaggaaaaauacaaggaguauuaacacaaacaacaagaacagacggaucaacacgaggacauaaagcuacagucuauacaggaagugcagacuuugcaccaaaauuaggaagaguucaauucgaaacugauacagaucacgauuucgaagcaaaucaaaauacaaaauuuacacccguuggaguuauacaagacggaggaacuacucauagaaacgaaccacaacaauggguucuaccaucauauucaggaagaaauacacauaacguccauuuagccccugcaguagccccaaccuuuccaggugaacaauuacuauucuuuagaucuacaaugccaggauguucaggauauccaaauauggauuuagauuguuuaauaccucaagaauggguccaauauuuuuaucaagaagcagcacccgcucaaucagacguagcacuacuacgauuuguaaacccagauacagguagaguacuuuucgaauguaaacuccauaaauccggauauguaacaguagcucacacuggacaacaugacuuaguuauaccuccaaaugguuacuuuagauucgauagcugggucaaccaauuuuauacucucgcaccaaugggaaauggaacaggucguagaagauaa

SEQ ID NO: 34279 - RNA, 1617 nt, Artificial Sequence
  derived and/or modified sequence opt6 from VP1__Norovirus_and/or_Norovirus-like__KF008243
augaaaauggcaagcucagacgccaacccuucugauggaucagcagcaaaucuaguuccagaaguaaacaaugaaguaauggcuuuagaaccuguaguaggugcagcaauagcagcaccugucgcuggacaacaaaacguaaucgauccuuggauuagaaauaacuuuguccaagcacccgguggagaauuuacaguuucacccagaaaugcacccggugaaauauuauggagcgcaccacuagguccagaccuaaacccauaucucucacacuuagcaagaauguacaacggauaugcuggugguuuugaaguucaaguaauacuagcaggaaacgcauucacagccggaaaaguaauauuugcagcuguaccacccaacuuuccaacagaaggucuaaguccaucacaaguaaccauguucccacauauagucguagacguaagacaauuagaaccaguacuaauaccauuaccagaugucagaaacaauuuuuaucacuauaaucagucaaacgacccaacaauuaaacuuauagcuauguuauauacaccacuaagagcaaacaaugcaggagacgauguauucacaguaucuugcagaguacuaacaagaccaucaccagacuucgauuucauauuccuaguuccaccaacaguagaaucaagaaccaaaccauuuucaguacccguauuaaccguagaagaaaugaccaauucaagguucccaaucccauuagaaaaacuauuuacaggaccaucaucagcuuuuguuguacaaccacaaaacgguagaugcacaacagacggaguacuccuugguaccacucaacuuaguccaguaaacauauguacauuuagaggagauguaacacacauuacuggauccagaaacuacacuaugaauuuagcaucacaaaacuggaauaauuacgaucccacagaagagaucccagcaccacuaggaacaccagauuuuguugguaaaauacaaggcguauuaacacaaacaacaagaacagacggaaguacacgcggacauaaagcaacuguauacaccggauccacugacuuugcaccaaaacuaggacgaguacaauuugaaacagacacagaucacgauuuugaagcaaaucaaaauacaaaauucacaccuguuggcguaauucaggacgguuccacaacccauagaaaugaaccacaacaaugggugcuaccaucauauucugguagaaauacccacaauguacacuuagcccccgcagucgcaccaacauuuccaggcgaacaacuauuauuuuucagaucaacaaugccaggcugcucuggauauccaaauauggaccuugauugucuacuaccacaagaauggguacaauacuuuuaucaagaagcagcaccagcacaaucggacguagcccuauuaagauucguaaauccagacacaggacgaguacuauucgaaugcaaacuccauaaauccggauacguuacuguagcacacacaggacaacaugaucuagugauaccuccaaauggauauuucagauuugauuccuggguaaaucaauuuuauacuuuagcaccaaugggaaacggaacaggaagaagacgauaa

SEQ ID NO: 34280 - RNA, 1617 nt, Artificial Sequence
  derived and/or modified sequence opt6 from VP1__Norovirus_and/or_Norovirus-like__KF429782
augaaaauggcaucaucagaugcuaauccaucugauggcagcaccgcuaaccuuguucccgaaguuaacaaugaaguaauggcauuagaaccaguaguaggcgcagcaauagcagcuccaguagcaggacaacaaaacguaauugacccuuggauuagaaacaacuuuguacaagccccaggaggugaauuuacaguaucacccagaaaugcaccuggugaaauucuauggucugcaccauuaggaccagauuuaaaccccuaucuaagccaucuagcacgaauguauaacggauaugcaggaggauuugaaguacaaguaauacuagcuggaaaugcauuuacagccggaaaaauaauauucgcagcaguucccccaaacuuuccaacugaaggauuaucacccucacaaguuacaauguucccacacaucauaguagaugucaggcaacuagaaccuuuacucauaccucuaccagauguaagaaauaauuucuaccacuauaaccaauccaaugacccaacaauaaaauuaaucgcaaugcuuuacacaccacucagagcaaacaacgcuggugacgacguauuuacaguuuccugucgaguacuaacaagacccucaccagacuuugacuucauauuucuaguaccuccaaccguugaaucaagaacaaaaccuuucucaguccccaucuuaacaaucgaagaaaugacuaacucaagauuuccaaucccacuagaaaaauuauuuacaggcccauccucagcauuuguaguacaaccacaaaacggacgauguacaacagacggaguucuacuaggcacuacucaacuaucaccaguuaauauauguacuuuucguggagauguaacccacauaaccggaacccacaauuaugcaaugaaccuagccgcccaaaacuggaacucauaugauccaacugaagaaauaccagcaccuuuaggaacuccagauuuuguaggaaaaauacaaggaguauuaacacaaacaacuagagcagauggaucaacaagagcacauaaagcuaccguauacaccggaucagcugaauuugcuccaaaacuaggacgaguacaauucgcuacagauacagauucagauuucgauacuaaucaaaauaccaaauucacucccguaggugucauacaagaugguaauacagcccaucaaaaugaaccacaacaauggguacuaccuucauauucaggacggaauaaucauaauguacaccuugcaccagcaguagcuccaacauuucccggugaacaacuauuauuuuuccgaucaacaaugccuggaugcucuggauaucccaauaugaauuuagacugccuucuaccacaagaauggguucaauacuucuaccaagaagccgcaccagcacaaucagauguagcacuucuaagauuuguuaacccagacacaggaagaguauuauucgaaugcaaacuacauaaauccggauacguaacagucgcccauacuggccaacacgaucuaguuaucccaccaaauggauauuuuagauuugauucuuggguuucuccauuuuacaccuuagcaccuaugggcaauggcacuggaagaagacgauaa

SEQ ID NO: 34281 - RNA, 1617 nt, Artificial Sequence
  derived and/or modified sequence opt6 from VP1__Norovirus_and/or_Norovirus-like__KF060101
augaaaauggcuucaucagacgcaaauccgucagacggaucaacagcaaacuuaguacccgaaguaaacaacgagguaauggcucuagaaccaguaguaggugcagcuauagcagcacccguagccggacaacaaaauguaauugacccuuggauaagaaauaauuucguccaagcaccagguggagaauuuacaguaucuccaagaaaugcaccaggugaaauacucuggucagcaccacuaggaccagauuuaaaucccuauuuaucacaccuugccagaauguauaacggauacgcuggaggauucgaaguacaaguaauauuagccggaaaugcauuuaccgcaggaaaaauaauauucgcugcaguaccaccaaacuuuccaacagaaggacuauccccaucucaaguaaccauguucccacacauuauuguagacguaagacaauuagaacccguccuuauaccacuaccagacguaagaaauaacuuuuaucauuauaaucaauccaacgauccaacuauaaaacuaauugcuaugcucuacacuccacuacgagccaauaaugcaggagaugauguauucaccgucuccuguagaguauuaacaagaccuucacccgacuucgacuucauauuucuaguaccucccaccguagaaucucgaacuaaaccauucaguguacccguacuaacaguagaagaaaugacaaauucaagauuuccaauaccucuugaaaaauuauucacaggaccaucaucagcauucgucguucaaccacaaaacggaagauguaccacagacggaguucuacuaggaacaacacaacuaucaccaguaaauauauguacauuuagaggcgacguaacacacauaucaggaucuagaaauuacacuaugaaucuagcaucacaaaauuggaacucauaugauccaaccgaggaaauaccagcaccauuaggaacaccagacuucguuggaaaaauucaaggaguacuuacacaaacaacaagagccgauggaucuacacgaggacauaaagcaacugucuauacaggaucugcagacuucuccccaaaacuaggaagaguacaauucgcuaccgacacagacaacgacuucguagcaaaccaaaacaccaaauucacaccaguuggaguaauacaagacggaucuaccaccccaagaaaugaaccacaacaauggguacuaccaucauauaguggucgaaacacacauaacguacaucuagcaccagcaguugcacccacauuuccaggagaacaacuacuauucuuuagguccacaaugccaggaugcaguggauauccaaacauggacuuagauugcuuacucccacaagaauggguucaauauuuuuaucaagaagcagcacccgcacaauccgacguagcuuuacuacguuuuguuaacccagacacuggaagagucuuauuugaaugcaaauuacauaaaaguggcuauguaacuguagcacacacaggacaacaugaucuaguuauaccuccaaauggauacuuccguuucgacucaugggucaaucaauuuuacacucuugccccuaugggaaacgguaccgguagaagaagauaa

SEQ ID NO: 34282 - RNA, 1617 nt, Artificial Sequence
  derived and/or modified sequence opt6 from VP1__Norovirus_and/or_Norovirus-like__KF060096
augaaaauggcaucaucagacgcuaacccaucugauggaucagcugcaaacuuaguuccagaaguaaacaaugaaguaauggcacuagaaccagucguaggagccgcaauagcagcacccguagccggccaacaaaauguaauagacccauggauuagaaauaauuuuguucaagcaccaggcggagaauuuacaguuucaccaagaaaugccccaggagaaaucuuauggucagcaccucuagguccagaucuaaauccauacuuaucacacuuagcaagaauguauaacggauaugcugguggauucgaaguccaaguaauauuagcaggaaacgcauuuacagcaggaaaaguaauauuugccgcaguaccacccaacuucccaacagaaggccuaucaccaucucaaguaacaauguucccccauauugucguagacguaagacaacuagaaccaguucuaaucccuuuaccagauguucgaaauaauuuuuaucacuauaaucaauccaaugacccaacaauaaaauuaauagcaaugcuuuauacaccacuaagagcaaacaaugcaggagacgauguuuucaccguaucaugucgcguacuaacacgcccaucuccugauuuugacuuuauauuuuuaguuccaccgaccguagaaucuagaacaaaaccauucucaguaccaguauuaaccguagaagaaaugacuaacucacgauuuccaauaccacuagaaaaacuauuuacaggcccaucuagcgccuucgucguucaaccccaaaacggaagaugcacaacagauggaguauuacucggaacaacccaacuuucaccuguaaacauaugcacauuuagaggugauguaacucauauaacaggaucaagaaauuauacuaugaaucuagcaagucaaaacuggucaaauuaugacccaacagaagaaauacccgcaccacuaggcacaccagacuucgucgguaaaauucaaggaguacuuacacaaaccacaagaacugaugguucaacuagaggucauaaagcaacaguauauacaggaagcgccguauucgcaccaaaacuaggacguguucaauuugaaacugauacagaccaugauuuugaagcuaaccaaaauaccaaauuuaccccagucggaguuauccaagacgguaguacaacacauagaaacgaaccacaacaauggguucuacccagcuauuccggaagaaauacaccaaacguccacuuagccccagcaguagcuccaacauucccaggagaacagcuauuauucuuuagauccaccaugccaggaugcucaggauacccaaauauggaccuagauugucuacuaccucaagaauggguucaguacuucuaccaagaagcagcccccgcacaaucagacguugcacuacuaagauucguaaacccagauacaggacgaguacuuuucgaauguaaacuucauaaaucaggauauguaacuguagcacacacaggccaacaugauuuaguaauaccaccaaacggauauuucagauuugacucaugggucaaccaauuuuauacacuagcaccaaugggaaauggaaccggaagacgacgauaa

SEQ ID NO: 34283 - RNA, 1617 nt, Artificial Sequence
  derived and/or modified sequence opt6 from VP1__Norovirus_and/or_Norovirus-like__KF060071
augaaaauggcaucauccgacgcaaacccaucagauggcucaacagcaaauuuaguacccgaaguaaacaacgaaguaauggcacuagaaccaguaguaggagcagcaauagcagcaccaguagcaggacaacaaaauguaauagacccuuggauaagaaauaauuuuguacaagcaccaggaggagaauuuacaguuucucccagaaaugcuccaggagaaauccuuuggucugccccucuaggaccagaccugaacccauacuuaucgcacuuagcuagaauguauaacgguuaugcugguggauucgaaguccaagucauacuagccggaaaugcauuuacagccggaaaaauaauuuucgcugccguuccacccaacuucccaacagaaggccucucaccaucacaaguaacaauguuuccacacauuaucgucgaugugagacaauuagaaccaguauuaauuccuuuacccgauguacgaaacaauuuuuaccacuauaaucaaucaaaugacccaacaauuaaauuaauagcuaugcucuacacaccauugagagccaacaaugcuggugaugauguauucacaguuucauguagaguacuaacaagaccaucaccagauuucgacuucaucuuccuuguaccaccaacuguagaaucucgaacaaaaccuuucucaguacccguauuaaccguagaagaaaugacaaacucaagauucccaaucccauuagaaaaacuauuuacaggaccuucauccgcauucguaguccaaccacaaaacggccgauguacaaccgacggaguccuacuuggaacaacacaacuuucaccaguaaauauaugcacauuuagaggagacguuacacauaucucugguucaagaaauuacacaaugaaucuaguaucacaaaacuggaacucuuacgauccaacagaagagauaccagcaccacugggaacaccagauuuuguuggaaaaauacaaggaguucuaacacaaaccacacgaacaaauggaucaacccgaggacacaaagcaacuguuuacacagguucugcagauuucucaccaaaacuaggccgaguacaauuugcuacagauacagacaacgacuucgaaacaaaccaaaauacuaaauuuacacccguaggaguaauccaagacggaucaacaacaccaagaaacgaaccacaacaauggguacuaccaagcuacucagguagaaacauacauaacguacaucucgcuccugcaguagcaccaacauucccuggagaacaauuacuauucuucagauccacaaugccagguuguaguggcuauccaaacauggaccuagauugccuacuaccacaagaauggguccaauauuucuaucaagaagcagcccccgcccaaucugacgucgcucuacuacgauuuguaaacccagauacgggaagaguacuuuucgaaugcaaauuacauaaaucaggauaugucacuguagcacacacaggacaacacgacuuaguaauaccacccaaugguuacuuucgauuugacaguuggguaaaucaauuuuauacucuagcaccaaugggaaauggaacuggacguagacguuaa

SEQ ID NO: 34284 - RNA, 1617 nt, Artificial Sequence
  derived and/or modified sequence opt6 from VP1__Norovirus_and/or_Norovirus-like__KF060056
augaaaauggcaucauccgaugcaaaucccagcgauggaucagcugcaaaccuaguuccagaaguaaacaaugaaguuauggcauuagaaccuguaguuggagccgccauagcagccccaguagcaggacaacaaaauguaauagaccccuggauuagaaauaauuuuguacaagcaccuggaggagaauuuacaguaucuccuagaaacgcaccaggagaaauacuauggucugcaccacuaggccccgauuuaaauccauaccuaucccauuuagcuagaauguacaacgguuacgcaggaggauucgaaguacaaguaauauuagcaggaaaugcauuuacagcaggaaaaguuauuuuugcagcaguaccacccaacuuccccacagaaggauuaucaccaucucaagucacaauguuuccccauaucguaguugauguucgacaacuagaaccaguacucauuccauuaccugauguucgaaacaauuuuuaccacuauaaucaaucuaaugauccaacaauuaaacucauagcaauguuauacacuccauuaagagcaaacaacgccggugaugauguuuucacaguauccugucgaguucuuacaagaccaucucccgacuuugacuuuauauucuuaguaccuccaacaguagaaucucgcaccaaaccuuucucaguaccaguauuaacaguugaagaaaugacaaauucaagauuuccaauaccccuagaaaaauuauuuacaggaccaucuagcgcauuuguaguccaaccacaaaacggaagauguacuacagauggaguacuucuaggcacaacucaacuaucaccaguaaauauauguacauucagaggagacguuacucauaucacaggaucacgaaacuacacaaugaauuuagcuucacaaaauuggaacaauuacgacccaacagaagaaauaccugcaccucuaggcacaccugauuucguaggaaaaauacaaggagucuuaacccaaacaacuagaacagaugguaguacaagaggacacaaagcaacaguguacacagguucagcagauuucgcaccuaaauuaggucgaguacaauucgaaacagacacagaucacgacuucgaagcaaaucaaaauacaaaauuuacuccaguaggaguaauacaagacggaggaacaacacauagaaacgaaccucaacaauggguuuuaccaucuuacucaggaagaaacacccauaauguacacuuagccccagcaguugcaccaacauucccaggugaacaacucuuauucuuucgaucuacaaugccaggguguucaggauacccaaauauggaucuagauuguuuauuaccacaagaauggguucaauauuucuaucaagaagcagcaccagcccaaucagacguugcauuacuacgauuuguaaauccagauacaggacgaguauuauuugaauguaaacuacauaaaucugguuaugcaaccguagcacauacaggucaacaugaucucguuaucccaccaaauggauauuuccgauucgauucauggguaaaccaauuuuauacauuagcaccaaugggaaacgguacuggacgacgucgauaa

SEQ ID NO: 34285 - RNA, 1617 nt, Artificial Sequence
  derived and/or modified sequence opt6 from VP1__Norovirus_and/or_Norovirus-like__JX439836
augaaaauggcuucuucagaugccaacccuucagauggcuccacagcaaacuuaguaccagaaguaaacaaugaagucauggcuuuagaaccaguagucggagcagcaauagcagcacccguagcaggacaacaaaauguuauagaucccuggauaagaaauaauuucguacaagccccaggaggagaauuuacagucucuccaagaaacgccccaggagaaauacuuuggucugccucucuaggaccagaucuaaauccauaucuaucacauuuagcacgaauguauaauggauacgcaggcggcuucgaaguacaagucauacuagcaggaaaugcauucacagcaggaaaaauaauuuucgcugcaguaccaccuaacuuucccacagaagguuuaucaccaucacaaguuacaauguucccucacauaauaguagauguaagacaauuagaaccaguucuaauaccacuuccugauguaagaaauaacuuuuaucacuacaaccaauccaaugacccaacaaucaaauuaauagcaauguuauacacaccauuacgcgcaaacaaugcaggagacgacgucuuuacagucuccuguagaguacuaacucgaccaucaccagacuucgacuucauauuuuuaguaccaccuacaguagaauccagaacaaaaccauucucuguuccagugcuaacuguugaagaaaugaccaacagcagauuuccaauuccacuagaaaaauuauuuacaggaccaucaucagccuuuguuguacaaccacaaaauggaagauguacaacagacggaguauuacuaggaaccacacaauuaucaccaguaaauauauguacuuuuagaggagauguuacccauauaccaggauccagaaauuacacaaugaaucucgccucacaaaauuggaacuccuaugacccaacugaagaaauaccagcaccacuagguacaccugacuuuguuggaaaaauacaaggaguauuaacucaaaccacacgaacuaauggaucaacaagaggacacaaagccacaguauauaccggauccgcagacuucucuccaaaacuagguagaguccaauuugcaacagauaccgacaaugauuuugaaacuaaucaaaauaccaaauuuacuccaguaggaguuauucaagauggaucaacaacuccuagaaaugaaccacaacaauggguacuaccaucauacucaggccgaaauauacauaacguacaccuagccccagccguagccccuacauucccaggcgaacaacuauuguucuuuagaucaaccaugccaggaugcucaggcuauccaaauauggaucuagacugcuuacuaccccaagaauggguucaauauuucuaucaagaagcagcuccugcacaaucugauguugcauuauugcgauuuguuaacccagauacaggaagaguccuauucgaaugcaaacuacauaaauccgguuauguaacagucgcacacacaggccaacaugaucuaguaauaccaccaaauggauauuuucgauucgacaguuggguaaaucaauuuuacacauuagcaccaaugggcaauggaacaggaagaagaagauaa

SEQ ID NO: 34286 - RNA, 1617 nt, Artificial Sequence
  derived and/or modified sequence opt6 from VP1__Norovirus_and/or_Norovirus-like__HF952129
augaaaauggcuaguucagaugcaaacccaucugauggcucaacugcuaauuuagucccagaaguaaauaaugaaguaauggcacuagaaccaguaguaggagcugcgauagcagcaccagucgcaggccaacaaaauguaaucgacccauggauaagaaauaacuuuguacaagcccccggaggagaguucacaguuucaccacguaaugcuccuggagaaauacuuuggucagcuccacuaggcccagaccuaaauccauaucuaucacaccuagcucgaauguauaacggauaugcaggaggauucgaaguacaaguuauacuagcaggaaaugcauuuacagcuggaaaaauaauuuucgcagcuguaccacccaacuuuccaacagaaggauuauccccaagccaaguuacaauguucccacacauaauaguggauguaagacaauuagaaccaguucucauaccuuuaccagauguacgaaacaauuucuaccauuauaaccagucaaacgacccaacaauaaaacuaauagcaauguuauauacaccauuaagagcuaacaaugcaggagacgaugucuuuacaguuucauguagaguacuaacacgaccauccccugacuuugauuuuaucuuccucguuccaccaacaguagaaucaagaacaaaaccauucucuguaccuauacucacaguagaagaaaugaccaauucaagauucccaauaccauuagaaaaacuuuuuaccggacccucuucagcauucguaguacaaccacaaaauggaagauguacaacagacggaguacuacucggaacaacacaauuaucaccuguaaacauuugcacauuuagaggagacguaacacacauaccaggcagucacaauuacacaaugaaccuagcaucacaaaacuggaacucguaugauccgacagaagaaauaccagcgccauuagguacaccugacuucguagguaaaauucaaggagucuuaacacaaacaacaagaacaaauggaucaacuagaggucauaaagcaacuguauauacaggcucagcagacuuuucaccaaaacuaggacgcguacaauucgcaacagacacagauaaugauuuugaaaccaaucaaaauacaaaauucacuccaguaggaguaauucaagacggaucuacuacaccaagaaaugaaccucaacaaugggucuuaccguccuacucagguagaaauauacauaauguucacuuagccccugcaguagcaccaacauuuccaggagaacaauuacucuuuuuccgaucuacuaugccaggauguuccggauaucccaauauggaucuugacugucuacuaccccaagaauggguucaauacuucuaccaagaagcagcacccgcacaaucagacguugcccuacuaagauucgucaauccugacacaggccguguacuauuugaauguaaauuacacaaaucagguuacguaacuguagcacacacaggacaacaugaucuuguuaucccaccaaacggauacuucagauuugacucuugggucaaccaauuuuacaccuuagcaccaauggguaacggaacaggaagaagaagauaa

SEQ ID NO: 34287 - RNA, 1617 nt, Artificial Sequence
  derived and/or modified sequence opt6 from VP1__Norovirus_and/or_Norovirus-like__KC409273
augaaaauggcaagcaacgaugcuaauccaucugauggaucagcagcaucuuuaguacccgaagucucuaacgaagucauggcucuagaaccaguaguaggagcagcaauagcagcaccagucgcuggacagcaaaacguaauagacccuuggauaagaaauaacuucguacaagcaccaggaggagaauuuacuguaucuccaagaaacgcaccaggagaaaucuuauggucagcaccacuaggaccugacuuaaauccauacuuaucucaucuagcaagaauguauaacgguuacgcaggaggauucgaagugcaaguaauacuagcaggaaaugcauucacagcuggaaaaauaauauuugcugcaguaccuccaaacuuucccacagaagguuuaucaccaucacaaguuacaauguuuccacauauuauaguagacguaagacaacucgaaccaguacuuauaccacuaccagacguaagaaacaauuuuuaccauuauaaucaaacuaacgauagcaccauaaaauuaauagcaauguuauacacaccucuuagagccaacaaugcaggagaagauguauuuaccguaucauguagaguacuaacaagaccaucacccgacuucgauuuuauauuccuaguaccaccaacaguugagucaagaacuaaaccauucacaguaccuauauuaacaguugaagaaaugacaaauucaagauuccccauccccuuagaaaaauuauuuacagguccaaguggagcauucguaguacaaccacaaaauggcagaugcaccacagauggaguauuacuagguacaacacaacuaucaccuguaaauauauguacauucagaggagauguuacacauauagcaggaucaagaaacuauacuaugaaucuugcaucccuaaacuggaacaacuaugacccaacagaagaaauaccagcuccacuagguacaccugacuuuguaggcaaaauacaaggaguucucacacaaacaacuaaaggugacgguaguacacgcggucacaaagccacaguauauaccggaucagccccauucaccccuaaauuaggaucaguacaauuuucuacagauacagaaaacgauuucgaaacacaccaaaacaccaaauucacaccaguaggaguaauucaagacggaggcacaacacacagaaacgaaccccaacaauggguuuuaccauccuauucaggcagagacguacacaauguacacuuagcuccugcaguagcaccaacauuuccaggagaacaacuccuauucuuccguucaacaaugccuggaugcucaggauauccaaauauggacuuagauugccuccucccacaagaauggguacaacauuucuaucaagaagcagcaccagcccaaucugaugcagccuuacuaagauucguaaauccagacacugguagaguccuauucgaaugcaaauuacauaaaucaggauauguaacuguugcucauacaggucaacacgacuuaguaauaccaccaaacggauauuuuagauucgacucaugggucaaccaauuuuacacacuugcuccaaugggcaauggcacaggccgcagacgauaa

SEQ ID NO: 34288 - RNA, 1617 nt, Artificial Sequence
  derived and/or modified sequence opt6 from VP1__Norovirus_and/or_Norovirus-like__KC409242
augaaaauggcaucaucagaugcaaauccaucagauggaucaacagcaaaccuaguuccugaaguaaacaaugaaguaauggcauuagaaccaguaguaggagcagcaauagcagcuccuguagcaggucaacaaaacguaauagacccauggauucgaucuaauuuuguacaagcaccagguggagaauuuaccguaucacccagaaacgcaccaggagaaauacuauggucagcaccacuagguccagauuuaaacccuuaucuaucacaccuugcacguauguauaauggcuaugcuggaggauucgaaguccaaguaauacuagccgguaaugcauucacagcaggaaaaauaauuuucgcagcaguaccaccuaauuucccuaccgaaggacuuucuccaucucaaguaacaauguuuccccacauaaucguugacguaagacaacuggaaccugucuuaauacccuuaccagaugucagaaacaauuucuaucauuacaaccaaucaaaugaucccacaauaaaauuaauagccauguuauauacaccacuccgagcaaacaaugcaggagacgauguuuuuacagucucauguagaguccuaacacgccccuccccagauuuugauuuuauauuucuaguuccaccaacaguagaaucaagaacuaaaccauucucagucccaguauuaaccguagaagaaaugacaaacagccgcuuuccaauaccauuagaaaaauuauuuacugguccaucaucagcuuuuguaguacaaccacaaaacgguagaugcacaacagauggaguauuacuaggaacuacacaauuauccccagucaauauauguacauucagaggcgauguuacccauauaccaggaucuagaaauuacacaaugaaucuagcuagccaaaauuggaacaguuacgauccaacugaagaaauaccagcuccacuaggaacucccgauuucguagguaaaauacaaggaguauuaacacaaacaacaagaacuaaugguucuacuagaggucauaaagcaacagucuauaccgguucagcagacuucucaccaaaacuuggcagaguacaauucgcuacugacacugauaaugacuuugaaacaaaucaaaacacaaaauucacacccguaggaguuauucaagauggaucaaccacaccgagaaaugaaccucaacaauggguacuuccaucauauucaggaagaaauauacauaacguucaucuagcacccgcuguugcuccaaccuuuccaggagaacaacuauuauucuuccgaucaacuaugccuggaugcucuggauauccaaauauggaccuagauugucuauuaccccaagaauggguccaauauuuuuaucaagaagcagccccugcacaaucagacguagcauuacuaagauucguaaauccagacacuggaagaguauuauucgaauguaaacuacacaaaucaggauacguaacaguagcacauacuggccaacacgauuuaguuauaccuccaaauggauauuucagauuugauucuuggguaaaucaauuuuacacccuagcaccaaugggcaacggaacaggaagaagacguuaa

SEQ ID NO: 34289 - RNA, 1617 nt, Artificial Sequence
  derived and/or modified sequence opt6 from VP1__Norovirus_and/or_Norovirus-like__JX445167
augaaaauggcaucaucagacgcaaacccaucagacggaucuacugcuaauuuaguaccagaaguaaauaacgaaguaauggcucucgaaccaguagucggcgcagcaauagcugcaccugucgcaggccaacaaaauguaauagacccuuggauucgaaacaacuucguucaagcgcccgguggugaauuuacaguuucaccccgaaacgcaccuggagaaauacuauggucagcaccucuaggaccagauuuaaacccauacuuaucacacuuagcaagaauguauaacgguuaugcuggcggauucgaaguacaaguaauuuuagcaggaaacgcauuuacagcaggcaaaauaauuuucgcagcaguaccuccaaacuuuccaacagaaggacuauccccaucacaagucacaauguuuccucauauuauaguagauguacgacaacuagaaccaguacuaauaccccuaccagauguaagaaacaauuucuaucacuauaaccaaucaaaugacccuacaauuaaacuaauagcuaugcuuuauaccccauuacgagcaaacaacgcaggagacgacgucuuuacaguuucaugcaggguacuuacaagaccaucaccagacuucgacuucauauuuuuaguaccaccaacaguagaaucacgcaccaaacccuucucaguccccguauuaacaguagaagagaugaccaauuccagauuuccaaucccauuagaaaaacuauuuaccggaccaucauccgcuuucguuguccaaccacaaaacggucgcugcacuacagauggcguccuacucggaacaacacaauuaagcccaguaaauauauguacauuuagaggugacguaacucauauaccaggcucacauaauuacacaaugaaucuagcaagucaaaauuggaacucauacgauccaacagaagaaguaccagccccacuagguacaccugauuucguuggaaaaauucaaggaguacuaacacaaacaacacgcacaaauggaucaacgagaggacacaaagcaacaguauauacaggaucagcugauuucuccccaaaauuaggaagaguucaauucgcaacagauacaaauaaugacuucgaaacaaaucaaaauacaaaauuuacacccguaggugucauacaagacggauccacuacaccaagaaaugaaccacaacaauggguacucccaaguuacaguggaagaaacacacauaacguacaccuagcaccagcaguugcaccaacauuucccggggaacaacuacuauucuuucgaucaacaaugcccggauguucuggauauccuaauauggaucuagauugccuucuaccacaagaauggguacaauauuuuuaucaagaagcggcacccgcucaaagcgacgucgccuuauuaagauucguaaauccugacacaggacgaguccuauucgaaugcaaauuacauaaaucaggauauguaacaguagcacacacuggacaacacgaucuaguaauaccucccaauggauauuucagauucgauaguuggguaaaucaauuuuacacauuagcaccaaugggcaauggcacaggacgcagacgauaa

SEQ ID NO: 34290 - RNA, 1617 nt, Artificial Sequence
  derived and/or modified sequence opt6 from VP1__Norovirus_and/or_Norovirus-like__JX445156
augaaaauggcaagcucagacgcaaauccuucugauggaucaacagcaaacuuagucccagaaguaaauaaugaggucauggcacuagaaccaguaguaggagccgcuauagccgcaccgguagcagggcaacaaaauguaauugacccuuggauuagaaacaacuuuguacaagcaccaggaggugaauuuacgguaucaccuagaaaugcaccaggagaaauauuauggucagcaccccuuggaccagaucucaaccccuacuuaucucaccuagcaagaauguacaacucauacgccggaggauuugaaguucaaguaauauuagccggaaaugcauuuacagcaggcaaaauaauauuugcagcagucccaccuaacuuuccaacagaaggucuaucaccaucacaaguaacuauguucccacacauuauaguagauguacgucaacuagaaccaguacuaaucccauuacccgauguucguaacaauuucuaccauuauaaucaaucaaaugacccuacuauaaaauuaauagccaugcuguauacaccacuaggagcuaauaaugccggagaugauguuuucacaguaucuuguagaguauuaacaagacccucaccagacuuugacuuuauauuccuuguaccaccuaccguagaaucuagaacuaaaccuuucagcguuccuauuuuaacaguugaagaaaugacuaacucaagauucccaauacccuuagaaaaacuuuucacaggacccucaucagcauuuguaguccaaccccaaaaugguagauguaccacagacggaguacuacuaggcaccacccaacuaucaccuguuaauauauguacauuucgaggagacguaacacauauagcuggaacucaagaauacacuaugaaucuagcuucucaaaacuggaacaacuaugauccaacagaagaaauaccagcaccgcuaggaaccccagacuuuguaggaaaaauacaaggaguauuaacacaaacaacuagaagagacggauccacuagaggucauaaagccacagucucuacaggaagcguccauuucaccccaaaacuagguagaauacaauuuucaaccgauacuucaaacgauuucgaaacuggucaaaauacaagauucacaccaguaggaguuguacaagauggaucaacaacacaucaaaaugaaccccaacaauggguauuaccuaauuauucaggacgagauucccauaauguacacuuagcacccgcaguagcaccgucauucccaggagaacaauuacuauuuuucagauccaccaugccaggauguucaggauauccaaacaugaaccuugacuguuuacuaccacaagaauggguucaacauuucuaucaagaagcagcuccagcacaaucagacguagcauuacuaagauucguaaacccagacacaggcagaguauuauucgaaugcaaacuccacaaaucaggauauguaacaguagcccauacaggacaacaugauuuaguaauaccaccuaauggauacuuccgauuugacucauggguaaaucaauuuuauacacuagcaccuauggguaauggaaccggaagacgacgauaa

SEQ ID NO: 34291 - RNA, 1617 nt, Artificial Sequence
  derived and/or modified sequence opt6 from VP1__Norovirus_and/or_Norovirus-like__GQ856458
augaaaauggcaagcaaugacgccaacccuucugauggaucagcagcaaaucuuguaccagaaguuaauaacgaagucauggcacuagaacccguagucggagcagcuauugcagcaccuguagccggacaacaaaauguaauagauccauggauaagaaacaacuuuguacaagcuccuggaggugaauuuacuguuucuccacguaaugcuccaggcgaaauccuuuggucagccccuuuaggaccagaucuaaaccccuaccuuucucaccucgcacgaauguauaacggcuaugcaggcgguuucgaaguccaaguaauucuugcuggaaaugcuuuaacagcaggcaaaauaauauuugcugcaguaccaccuaacuucccaacugaaggauuauccccaucgcaaguaacaauguuuccacacauuauuguagauguaagacaacuugaaccuguacuaauuccccuaccugacguaagaaacaauuucuaucauuauaaucaaucaaacgacucuacuauaaaauuaauagcaaugcuauauacaccauuaagagcaaauaaugcuggugaagauguauuuacaguaaguugucgaguacuaacucgucccucacccgacuucgauuucauauuucuaguuccaccaacaguggaaaguagaacaaaaccuuucacuguaccuauacuaaccguagaagagaugacuaacaguagauuuccuauaccauuagaaaaacuauucacaggucccuccucagcauucguaguacaaccucaaaauggaagauguacuacagauggugucuuacucgguacaacccaacucucuccaguaaacauauguacauuuagaggugauguuacacacauugcaggcucucgaaauuacacaaugaauuuagcaucuuuaaacuggaacaauuaugaccccaccgaagaaauaccagcaccauuaggaacaccagacuuuguaggaaaaauacaaggaguaccaacacaaaccacaaaaggugauggcuccacaagaggacauaaagcaaccguauauacaggaucugcaccauucacaccaaaauugggaucaguacaauucucuacugauacagaaaacgauuucgaggcacaccaaaauacaaaauucacaccagucggcguaauacaagauggaggaacaacacacagaaaugaaccucaacaauggguacuacccucuuauucaggaagaaauguaccaaauguacaccuagcaccagcaguagccccaacauuuccaggagaacaacuacuauucuuuagaucuacaaugccuggauguucugguuaucccaacauggauuuagacuguuuacuuccacaagaauggguacaacauuucuaucaagaagccgcaccagcacaauccgauguagcacuacuacgauuugucaauccagauacuggucgagucuuauuugaauguaaauuacauaaaucaggauaugucacaguagcucacacaggccaacacgaucuaguaauacccccaaacggcuauuucagauuugacucauggguaaaucaauuuuauacucuagcaccaaugggaaauggaacugggagacgaagauaa

SEQ ID NO: 34292 - RNA, 1617 nt, Artificial Sequence
  derived and/or modified sequence opt6 from VP1__Norovirus_and/or_Norovirus-like__AB541299
augaaaauggcaucaaaugaugcaaauccaucugacgguucugcagcuaaucuugucccagaaguuaacaaugaaguuauggcauuagaaccaguugucggagccgcaauagcagccccaguagcaggacaacaaaauguuauagaucccuggauaagaaacaacuuuguccaagcccccggaggagaauuuacagucucuccacguaaugccccaggagaaauccuauggucagcaccacucgguccagauuuaaauccuuaccuaucacacuuagcuagaauguauaaugguuaugcaggaggauuugaaguucaaguaauauuagcgggaaaugcuuuuaccgcaggaaaaauaauauucgcagcaguaccacccaacuuuccaaccgaaggauuaucaccaucacaaguaacaauguucccacacauaaucguagauguaagacaauuagaaccuguacuaauaccacuaccagacguaagaaauaacuucuaucauuauaaccaaucuaaugauucuaccauaaaauuaauagcuauguuauacaccccuuuaagagcaaacaaugcaggagaagauguuuucacaguaucauguaggguacuaacuagaccaucaccugauuucgacuuuauauuccuaguuccaccaacaguagaaucacgaacuaaaccauucaccguaccaauauuaacagucgaagaaaugacaaauucacgauuuccaauaccuuuagaaaaauuauuuacaggaccauccucagcuuucguuguacaaccacaaaauggacgauguacaacugacgguguuuuacucggaaccacacaauuaucuccuguaaacaucuguacuuuccgcggcgacguaacccacaucgcagguucucgaaauuauaccaugaauuuagcaucauuaaacuggaauaauuacgauccaacagaagaaaucccagccccucucggaacaccagauuuuguuggcaaaauccaaggagucuuaacccagacaacgaaaggagauggauccacccgaggccauaaagcaacagucuauacaggaucugcaccauuuaccccaaaacuuggaucaguacaauucucuaccgauacagaaaacgauuucgaaacacaucaaaauacaaaauuuacucccguaggcguuauccaagacgguggaacaacucaucguaacgaaccacaacaauggguacuaccaaguuauucaggucgaaauguuccaaauguacacuuagcaccagcaguagcaccaacauuuccaggagaacauucauuauacuuuagaucaacaaugccaggaugcucuggauauccuaacauggacuuagacugccuauuaccacaagaauggguucaacacuucuaucaagaagcagcuccagcacaaucugacguagcauuacuaagauucguaaacccagacacaggccgagucuuauuugaauguaaauuacauaaaucagguuaugucacaguagcacacacaggacaacacgauuuagugauucccccaaacggauauuuucgauuugacuccuggguaaaucaauuuuacacacuagcaccaaugggaaaugguacaggaagaagaagauaa

SEQ ID NO: 34293 - RNA, 1617 nt, Artificial Sequence
  derived and/or modified sequence opt6 from VP1__Norovirus_and/or_Norovirus-like__AB541195
augaaaauggcaucaucugaugcuaacccaucugacggcuccgcagccaaucuuguuccagagguaaauaacgaagucauggcgcuagaaccaguaguaggugcugccauagcagcacccguugcuggccaacaaaauguaauagacccuuggaucagaaauaacuuuguacaagcaccaggaggagaauuuacaguaucaccuagaaaugcaccaggugaaauauuauggucugcaccucuuggaccagacuuaaacccauaccuaucacauuuagcaagaauguauaacgguuacgcaggagguuucgaaguucaaguaauacuagcaggaaacgcauucacagcuggcaaaauaauauucgcagcaguaccaccaaauuucccuacagaaggacuaucuccuucacaaguaacaauguucccccauauaauaguagacguuagacaacuagaaccaguacuuauaccccucccagauguacguaacaacuucuaccacuauaaucaaucaaaugacucaacaauaaaacuaauagcaauguuauacacaccacuaagagcaaacaaugccggagaagacguauuuacuguauccuguagaguuuuaacuagaccaucaccagauuuugauuucaucuuucuaguaccaccaacaguagaaucacgaacaaaaccauucacaguacccauauuaacaguagaagaaaugaccaacuccagauuuccaauaccacuagaaaaacuauuuacaggacccucuggagcuuucguuguccaaccccaaaacggcagauguacaacugacggaguacuauuaggaacaacccaacuaucacccgucaauauauguacauuuagaggcgacgucacccauaucgcuggaucuagaaauuacaccaugaaccuagcuucauuaaacuggaacaacuaugauccaacagaagaaauaccagcaccccuaggaacaccagauuuugucggaaaaauacaagguauguuaacacaaacaacaaaaggugacggaucuacaagaggccauaaagcaacagucuauacaggcucagccccuuucacaccuaaauuaggaaacguacaauuuucaaccgauaccgaaaaugauuuugaaacacaucaaaauacaaaauucacaccaguagguguaauacaagacggaucaaccacacaucgcaaugaaccacaacaauggguacuaccaucauauucaggaagagauguccauaacguacacuuagcaccagcagucgcaccuacauuuccaggcgaacaacuacucuucuuuaggucuacaaugcccggaugcuccggauauccaaauauggacuuagauugccuccuaccacaagaauggguacaacauuuuuaccaagaagcagcaccagcccaaucagacguagcacuacuaagauucguuaacccagauacaggaagaguucuauucgaaugcaaauuacauaaaagcggauaugugacuguagcucacacaggacaacacgaucuaguaauaccaccaaauggauauuuccguuuugacucaugggucaaccaauuuuauacucuagcaccaaugggcaauggaacaggucgaagaagauaa

SEQ ID NO: 34294 - RNA, 1617 nt, Artificial Sequence
  derived and/or modified sequence opt6 from VP1__Norovirus_and/or_Norovirus-like__AB504322
augaaaauggcuaguaaugacgcaaacccaucagauggaucugcagcuaacuuaguaccagaaguaaacaaugaaguaauggcacuagaaccagucguaggugcagcaaucgcggcuccagucgccggccaacaaaaugucauagauccuuggauuagaaauaauuuuguacaagcaccaggaggugaauuuacuguaucaccaagaaaugcaccuggagaaauucucuggucagccccucuaggaccagaccuaaauccauauuuaucacaccuagcacgcauguauaacgguuaugcaggaggauuugaaguacaaguaauuuuagcaggaaaugcauuuacagccggaaaaauuauuuucgcagccguaccaccuaauuuccccaccgaaggauuauccccaucacaaguaacaauguuuccacauauuauaguagacguucgacaacuagaaccaguucuaauaccacuuccagauguccgcaacaacuucuaucacuauaaucaauuaaaugacucaaccauaaaacuaauagcaauguuauacacacccuuaagagcaaauaaugccggagaagauguuuuuacuguuucuuguagaguacuaacacguccaucaccagacuucgacuuuaucuuuuuaguacccccaacagucgaaucucguacaaaaccuuucacuguaccaauccuuacuguagaagaaaugacaaacuccagauuccccauuccacuagaaaaauuauucaccggucccucaggagcauuuguaguacaaccacaaaacggaagaugcacuacagauggagucuuauuaggaacuacccaauuaucaccugucaauauaugcacuuuuagaggagauguaacacauauagcuggaucacguaauuacacaaugaauuuagcaucccucaacuggaauaauuaugaccccacagaagaaauaccagcaccacuagguacaccaggcuuuguagguaaaauucaaggaguucuaacucaaacaacuaaaggagaugggucuacaagaggucauaaagcaacaguuuauacaggaagcgcaccauucacaccuaaauuaggcucuguucaauucaguacugauacagaaaacgauuucgaaacccaccaaaacacaaaauucacaccaguaggagugauacaagauggauccacuacccaucgaaacgaaccacaacaauggguauuaccaucauauucaggaagaaauguacauaacguacaccuagcaccagccguggcaccaacauuuccaggagaacaacuacuauucuuucguucaacaaugccaggauguucuggcuaucccaauauggauuuagauugucuacucccacaagaauggguacaacauuuuuaucaagaagcagcaccagcacaaucagaugucgccuuauuaagauuuguaaauccagauacaggaagaguacuauucgaaugcaaacuacauaaauccggauauguaacaguagcacauacuggacaacaugauuuaguaauacccccaaauggauauuucagauucgacucauggguaaaucaauuuuacacucucgcaccaaugggaaauggaacugguagaagaagauaa

SEQ ID NO: 34295 - RNA, 1617 nt, Artificial Sequence
  derived and/or modified sequence opt6 from VP1__Norovirus_and/or_Norovirus-like__EU876892
augaaaauggcuucaaacgacgcaaacccaucagauggaucagcagccaauuuaguauuagaaguuaacaaugaaguuauggcguuagaacccguagucggagcugcaauagcagcaccaguagccggucaacaaaaugucauagacccauggauaagaaacaacuucguacaagccccaggcggugaauuuacaguuucaccaagaaaugcaccaggcgaaauuuuauggucagcaccccuaggaccugacuuaaaucccuaucucagucacuuagcaagaauguacaaugguuaugcugguggauucgaaguacaaguaauacuagcaggaaaugcuuuuacagcuggaaaaauaauuuuugcugcaguuccaccuaauuucccaacugaaggacuaucaccaucucaaguuaccauguuuccacacauaauaguagauguacgucaacuagaaccaguccuaaucccccuuccagauguaagaaauaacuucuaucacuacaaccaauccaaugacucaacaaucaaacucaucgcaauguuauauacaccauuaagagcaaacaaugcaggagaagauguauucacaguaucuugucgaguucuaacacgaccaucaccagauuuugacuucauauuccuaguuccacccacaguagaaagcagaacaaaacccuuuacuguaccaauauuaacaguugaagaaaugacuaacucaagauuuccaauccccuuagaaaaauuguucacaggaccaucuggagcauucguaguacaaccacaaaacggucgauguacaaccgacggcguacuacuaggcacaacucaauuaucaccuguuaacauauguaccuuuagaggagacguaacacauauagcuggaucacgaaauuacacaaugaaucuagcuucacuaaacuggaacaacuacgauccaacagaagaaauaccagccccauuagguacacccgacuuuguaggaaaaauucaaggaguuuuaacacaaaccacaaaaggcgauggcucaacuagaggucauaaagcuacaguauauacaggcucagcacccuuuacacccaaacuagguucaguccaauuuucaacagauaccgaaaaugauuuugaaacacaucaaaauacaaaauucacucccguugguguaauacaagacggcucuacaacacacagaaaugaaccucaacaauggguccuaccauccuacucaggucgcaauguacauaacguacaccuugccccagcagucgcaccaacauuuccaggugaacaauuacucuucuuuagauccaccaugccaggaugcucaggcuaccccaauauggaucuagauugcuuguuaccacaagaauggguacaacauuuuuaucaagaagcagcaccagcacaaagcgauguugcucucuuaagauucguuaacccugacacaggaagaguauuauuugaauguaaacuacauaaaucuggauauguuacaguagcacacacuggacaacacgaucuaguuaucccaccaaacggcuacuucagauucgacucauggguaaaccaauucuacacacuagcaccaaugggaaacgguacaggaagaagacgcuaa

SEQ ID NO: 34296 - RNA, 1617 nt, Artificial Sequence
  derived and/or modified sequence opt6 from VP1__Norovirus_and/or_Norovirus-like__EU876891
augaaaauggcaucaaaugacgcuaacccuagcgauggaucugcagcuaauuuaguucccgaaguuucaaacgaaguaauggcauuggaaccaguuguaggagcagcaaucgcugcaccaguagcaggacaacaaaauguaauagacccuuggauaagaaauaacuuuguacaagcacccgguggugaauuuacaguaaguccaagaaaugcgccuggagaaauacuuugguccgcaccccucggaccagaucuaaauccauauuuaucucaucuagcacguauguauaacggauaugcaggaggauucgaaguacaaguuauacuagccggaaaugcauucacagcaggcaaaauaauuuuugcugcaguaccaccaaacuucccaacagaagguuuaucaccaucgcaaguaacaauguucccccacauaauaguugacguacgccaauuagaaccaguacuaauuccacucccagauguaagaaacaauuuuuaucacuauaaucaaucaaaugauucuacaauuaaacucauagcaaugcuuuauaccccauuaagagcaaacaacgcgggugaagaugucuuuacuguaucuugccgaguacuaacaagaccaucuccagacuuugacuucaucuuucuuguucccccuacaguagaaucaagaacaaaaccauuuacaguaccaauucuaacaguagagaaaaugaccaacucacgauuuccaauaccacuugaaaaacuauucacaggaccaucuggagcauucguaguucaaccccaaaacgguagauguacaacagaugguguacuauuggguacuacucaacuuucaccaguaaacaucugcacauuuagaggcgacguaacacacauagcuggcucuagaaauuacacaaugaaucuagcaucauuaaauuggaacaacuacgauccaacagaagaaauacccgccccacuaggcacuccagauuucguaggaaaaauacaaggaguacuaacacaaacaacaaaaggagauggaucaaccagaggacacaaagcaacuguauauacaggaagugccccauuuacccccaaauuaggaucaguacaauuuucaacagacacagaaaacgauuucgaaacacaucaaaacaccaaauucaccccaguaggaguaauccaagauggaucaacuacacaucgaaaugaaccacaacaauggguucuaccuucauauucaggaagaaacguucauaauguacauuuagcaccagcuguagcaccaaccuucccaggagaacaacuacuauucuuuagauccacuaugcccgguugcucuggauauccaaacauggacuuagauugcuuauuaccacaagaauggguucaacacuucuaucaagaagcagcaccagcucaaucagacguagcauuacuaagauuuguaaaucccgacaccggccgaguccuauuugaauguaaauuacauaaaaguggauaugucacuguagcacauacaggacaacacgaucuagucauaccaccaaacggauauuucagauuugauucuugggucaaucaauuuuauacccuagccccaaugggcaauggcacuggaagaagaagauaa

SEQ ID NO: 34297 - RNA, 1617 nt, Artificial Sequence
  derived and/or modified sequence opt6 from VP1__Norovirus_and/or_Norovirus-like__AB294792
augaaaauggcaucaaaugacgcuucucccucagaugguuccacugcaaaccuugucccugaaguaaacaaugaaguaauggcuuuagaaccuguuguaggagccgcuauagcagcaccaguagcuggccaacaaaauguaauagacccuuggaucagaaacaacuuuguucaagcaccaggcggcgaauuuacaguuuccccaagaaaugcaccaggagaaauuuuauggucugcaccacuuggaccagaccuaaaucccuauuuaucccaccuugcaagaauguacaacggauacgcaggagguuuugauguacaaguuaucuuagcuggaaacgcauuuacagcaggaaaaauaauauucgcugccguaccuccaaauuuuccaacagaaggucuauccccaucucaaguuacaauguucccacacaucauuguagauguuagacaauuagaacccguauuaauaccauuacccgacguaagaaacaauuucuaccauuauaaccaaucuaaugauucaacuaucaaacuuauagcaaugcuauacacaccucuuagagcaaauaacgccggagacgaugucuuuacaguuucaugcagaguacucacaagaccaucaccagauuucgacuucauuuuccuaguuccaccaacuguagaaucaagaacaaaaccauuuacaguuccaauacuaacaguugaagaaaugacuaacucacgauucccaauaccucuugaaaaacuauuuacaggaccaucaucagcuuucguaguacaaccacaaaacggaagauguacaacugauggagucuuacuugguacuacacaauuaucaccagucaauauauguacauuuagaggagauguaacacacauaccuggaacuagaacauacagaaugaacuuagccucccaaaacuggaacaacuaugauccaacagaagaaauaccagcaccucucggaacaccugacuuuguuggaaaaauacaaggaauguuaacacaaaccacaaaaggugacggauccacuagaggacauaaagcaacaguaaguacuggaucaguagacuuuacaccaaaacuaggaucaguacaauuugcaaccgacacagauaacgauuucgaaacaggacaaaauaccagauucacaccaguaggaguuauacaagauggauccucaacccaucgaaaugaaccacaacaauggguauuaccugacuauucaggcagaaccguacauaacguucaucuugcuccagcaguagccccuaccuuuccaggagaacaacuacuauuuuucagaagcacaaugccaggauguucuggauauccgaacauggaucuagauuguuuauuaccacaagaauggguacaacauuuuuaucaagaggcagcaccaucacaaucagacgucgcacuuuuacgguuuguuaacccagauacuggaagaguccuauuugaaugcaaacuacacaaagcaggauacguaacaguagcacauacuggacaacacgauuuaguaaucccaccaaauggcuauuuccgcuucgacucuugggucaaucaauuuuacacauuagcuccaaugggcaauggagcaggaagaagaagauaa

SEQ ID NO: 34298 - RNA, 1617 nt, Artificial Sequence
  derived and/or modified sequence opt6 from VP1__Norovirus_and/or_Norovirus-like__AB303932
augaaaauggccagcaaugacgcaaacccaucagauggcucuacagcuaaccuugucccugaaguuaacaacgaaguaauggcacuugaaccaguaguaggagcugcgauagcagcaccaguagcgggacaacaaaacguaauugacccauggauacgcaauaacuucguacaagcucccggcggagaauuuacaguaucaccaagaaaugcacccggggaaauacuauggucagcaccacuaggaccugaucuaaauccauaccuuucucaucuugcacguauguauaaugguuacgcaggaggauuugaaguacaaguuauacuagcgggaaaugcauucacagcaggaaaaaucauauucgcagcaguaccacccaacuuuccaacagaagguuuaucccccucacaaguuacaauguuuccacauauaauaguagacguaagacaauuagaaccaguucuaauaccauuaccagauguaagaaauaauuucuaccacuauaaccaaucgaaugauccaacaauaaaauuaauagcaaugcuauacacaccuuuaagagcaaacaaugcuggugaagacguauuuacaguauccugcagaguccuuacuagaccuucaccugauuucgacuuuauauuucuaguaccaccaacaguagaaucaagaacuaaaccuuucacaguaccaauacuuaccgucgaagaaaugacaaacucacgcuuuccuauuccucuagaaaaauuauucacuggaccaucaggagcauucguuguacaaccacaaaauggaagauguacaacagauggcguauuauuagguacaacacaauuaucuccagucaauaucugcacauuuagaggcgacguaacccauauagcaggaacucauaacuacacaaugaauuuagcaucccaaaacuggaacaacuaugacccuacagaagaaauaccagcaccauuaggaacaccagauuuuguaggacgaauccaaggaaugcuaacccaaaccacacgaggagauggaucaacuagaggacacaaagccacaguaucaacaggcgauguacacuuuacaccaaaauuaggaucaguccaauucaacaccgauacaaacaaugauuucgaaacaggacaaaauacaagauucacaccaguaggaguagugcaagaugguaauggaacacaccaaaaugaaccccaacaauggguacuacccucuuacucagguagaacaggacauaacguucauuuagccccagcuguugccccaacauucccaggagaacaacuacucuucuucagaucuacaaugccaggaugcucuggauaucccaauaugaaccuugauugcuuacuaccacaagaauggguucaacauuucuaucaagaagccgcacccgcacaaucagauguagcuuuacuaagauucgucaacccagacacuggaagaguacuauucgaauguaaacuacacaaaucaggcuauguaacagucgcacacaccggucaacacgaucuaguuauaccacccaauggauacuuuagauuugauuccuggguaaaucaauuuuauacauuagcaccaaugggaaauggaacaggacgaagacguuaa

SEQ ID NO: 34299 - RNA, 1617 nt, Artificial Sequence
  derived and/or modified sequence opt6 from VP1__Norovirus_and/or_Norovirus-like__LC177660
augaaaauggcaucaucugaugccaacccuucagaugguucugccgcaaaucuuguaccagaaguaaauaaugaaguaauggcucuagaacccguaguuggagcagcaauugcagcaccaguagcaggacaacaaaacgucauagauccuuggauacguaauaacuuuguacaagccccugguggagaguucacaguuuccccaagaaacgcaccaggagaaauacuaugguccgcaccauuagguccagaucuaaauccauacuuaucucauuuagcaagaauguacaaugguuaugcaggaggauucgaaguacaaguaauauuagcaggaaacgcauuuacagcaggaaaaguaauauucgcagcaguaccacccaacuuuccaacagaaggacuaucaccaucacaaguaacaauguuuccucacauuguagucgauguaagacaauuagaacccguacuaauuccguuaccugauguacgaaacaauuucuaccacuacaaccaaagcaaugacccaacuauaaaacuuauagcaauguuauacacaccuuuaagagcuaacaaugccggcgacgauguauucacuguaucaugcagaguauuaacuagaccaagcccagauuuugauuuuauauuucucguuccaccuacuguagaaucucgaacaaaaccauuuuccgucccugucuuaacaguagaagaaaugacaaauucaagauuuccaauaccacuagaaaaacucuuuacaggaccaucauccgcauucguaguccaaccacaaaacggacgaugcacaacagaugguguccuauuaggaaccacacaacuuucaccaguaaauauaugcacauuuagaggagacguuacacauauaacaggauccagaaacuauacuaugaacuuagcaucccaaaacuggaacaacuaugauccaaccgaagaaauuccagccccuuuaggcacaccugauuuugucggcaaaauacaaggaauguuaacucaaacaaccagaacugaugguucaacuagaggccacaaagcaacaguauauacugguucagcagacuuugcaccaaaauuaggaagaguucaauuugaaaccgacacagaccaugacuuugaagcgaaucaaaauaccaaauucacaccaguuggagucauacaagacggaucaacuacacauagaaaugaaccccaacaauggguacuaccuucauacucaggaagaaauacaccaaauguacaucucgcacccgcagucgcaccuacuuuucccggcgaacaacuucuuuucuuuagaaguacaaugcccggcugcucaggauacccaaauauggauuuagauugccuuuuaccucaagaauggguacaauauuucuaucaagaagccgcaccagcacaaucagauguagcacuacuacgauuuguuaaccccgacacaggccguguuuuauucgaaugcaaacuacauaaacucgguuacguaaccgucgcucacacuggacaacaugaucuaguaauaccaccaaauggauauuuccgauucgauaguuggguaaaucaauucuauacucuagcaccaaugggaaauggaacaggaagaagacgauaa

SEQ ID NO: 34300 - RNA, 1617 nt, Artificial Sequence
  derived and/or modified sequence opt6 from VP1__Norovirus_and/or_Norovirus-like__KX608866
augaaaauggcaaguucagacgcuaacccaucagauggaucaaccgcuaacuuaguuccagaaguaaauaaugaagucauggcccuagaaccaguaguaggagcagcaaucgcagcuccaguagcaggacaacaaaauguaaucgacccauggaucagaaauaacuuuguacaagcaccaggcggagaauuuaccguauccccaagaaaugcaccaggcgaaauacuuuggagugcuccacucgguccagaccuaaacccauaucuaucacacuuagcaagaauguauaacggauaugcaggaggcuuugaaguacaaguaauacucgcaggaaacgcauucacagcaggaaaaauaaucuuugccgcaguacccccaaacuuuccaacagaaggccuaucuccaucacaaguaacuauguuuccccauauuauaguagauguaagacaauuagaaccaguacuaauuccccuuccagacguucgaaacaacuuuuaccacuauaaccaaucaaaugauccaacaaucaaauuaauagccaugcuguauacaccauuaagagcuaauaaugcaggagacgaugucuuuacuguaucauguagaguauuaacuagaccauccccagacuucgauuuuaucuuccuaguaccaccaacuguugaaagcagaacaaaaccauuuucaguaccagucuuaacuguugaagaaaugacaaauuccagauuuccgauuccacucgaaaaacuauuuacaggcccuuccagcgcauucguuguccaaccacaaaacggaagauguacaacagauggcguacuauuaggaacaacacaauuaucaccuguaaauauauguacauuuagaggagauguaacacauauaucagguucacgcaauuauacuaugaaucucgcaagucaaaacuggaacucauacgaucccacugaagaaauaccagccccacuagguacacccgauuuuguaggaaaaauucaaggaguuuuaacacaaacaacucguacagacggaucuacacgaggccacaaagcaacagucuauacagguagugcugacuuuucaccuaaauuaggcagaguacaguucgcaacagauacagauaaugauuucguugccaaucaaaacacaaaguucacaccagucggaguaauucaagacggcucaacaacuccucgcaaugaaccacaacaauggguuuuaccaucauacucuggccgaaauacccauaauguacauuuagcaccagcuguagcaccaacauucccaggagaacagcucuuauucuuucgcuccacaaugcccggaugcucaggauauccaaauauggaucuagauugccuauuaccacaagaauggguacaauauuucuaccaagaagccgcuccagcucaaucugacguagcacuauuaagguucguaaauccagacacuggaagaguauuauuugaaugcaaacuacauaaaucaggauauguuacaguagcacauacaggacaacacgauuuaguaauuccaccaaauggauauuucagauucgauucaugggucaaucaauuuuauacauuagcacccaugggcaauggaacaggucgaagacguuaa

SEQ ID NO: 34301 - RNA, 1617 nt, Artificial Sequence
  derived and/or modified sequence opt6 from VP1__Norovirus_and/or_Norovirus-like__KX371603
augaaaauggcauccucugacgcaaauccuucagauggaucaacagcaaaccuaguaccagagguuaacaacgaaguaauggcucuagaaccaguaguaggugcagcaauagcugcaccagucgcaggacaacaaaacguaauagacccuuggauacgaaauaacuuuguccaagcaccagguggagaauuuacaguuuccccaagaaaugcaccaggcgaaauauuauggucggcuccccuaggaccagauuuaaacccauauuuaucacaccuugccagaauguauaacggauacgcaggagguuuugaaguacaaguaauacucgcaggaaaugccuucacagcaggcaaaauaauauuugcugcaguaccaccaaacuuuccaacagaagguuuaucuccuucucaaguaacaauguucccacacauaauuguagacguaagacaacucgaaccaguccuaaucccauuaccagacguacgcaauaauuuuuaccacuacaaccaauccaaugacccaacaauaaaauuaauagcgaugcuuuauacaccauuacgcgcaaacaacgcaggagacgauguauucacuguuuccugcagaguauuaacucguccaucaccagauuuugauuuuauauuucuaguaccaccaacugucgaaucucgaacaaaaccauucucaguaccagucuuaacaguagaagaaaugacaaauaguagauuuccaauaccacuugaaaaacuuuucacaggaccaucaagcgcauucguaguacaaccacaaaauggcagaugcacaacagauggcguuuuacucggaacuacacaacuuuccccuguuaacauauguacauuucgaggagacguaacucacauaccuggaucccgaaauuauacuaugaaucuagcaucccaaaacuggaacucauacgaucccacugaagaaauaccagcaccacuuggaaccccagacuuugucggaaaaauucaagguguucuaacacaaacuacacgcaccaacggaucaacuagaggacacaaagcaacaguauauacagguuccgcugacuucucaccaaaauuaggcagaguacaauucgcuacagauacagauaacgauuuugaaacaaaccaaaacacaaaauucacaccugucggaguaauacaagacggaucuacuacaccucgcaaugaaccacagcaauggguacuaccaucauacagcggaagaaauauacacaacguacaccuagcuccugccguagcaccaacuuuucccggugaacaauuacuguucuuucgaucaacaaugccaggaugcucagguuauccaaacauggaucuagauuguuuauuaccacaagaauggguacaauacuuuuaccaagaagcagcacccgcacaaucagauguugcacuacuaagauucguaaauccugacacuggcagaguacuuuuugaauguaaacuccauaaaucaggcuaugucacugucgcucacacaggucaacacgaccuaguuauuccaccaaacgguuacuucagauucgauaguuggguuaaucaauuuuauacacuagcaccuaugggaaaugguacugguagacgaagauaa

SEQ ID NO: 34302 - RNA, 1617 nt, Artificial Sequence
  derived and/or modified sequence opt6 from VP1__Norovirus_and/or_Norovirus-like__KX354086
augaaaauggccuccucagacgcaaacccuucagacggcucaaccgcaaacuuaguuccagaaguaaacaacgaaguaauggcauuagaaccagucguuggagcagcuauagcagcaccugucgccggccaacaaaauguaauagauccauggauaagaaauaacuuuguacaagcacccggaggagaauuuacaguuuccccaagaaaugcaccaggagaaauacuuuggucggcaccacuaggaccagaucucaaucccuacuuaucucaucuagcaagaauguauaauggauaugcaggagguuuugaaguacaaguaauucucgcuggaaacgcauuuacagcaggaaaaauaauuuuugcagcaguuccaccaaacuuucccacagaaggcuuaucaccuucccaaguaacaauguucccucauauaaucguagauguaagacaacuagaaccaguauuaauaccauuacccgauguaagaaacaacuucuaucacuauaaucaauccaacgauuccacaauuaaacuaauagcaaugcuauauacaccacuccgcgcaaacaacgcuggugaugacguauuuacaguauccuguagaguucuaacacgaccauccccggacuuugacuuuauauuuuuaguaccacccacaguagaaagucgcacuaaaccauuuucaguaccaauauuaacaguagaagaaaugacuaacucacguuucccaauaccauuagaaaaauuauuuaccggaccaucuagcgcauucguuguacaaccacaaaacgguagaugcacaacagacggaguacuccuaggaaccacgcaauuauccccaguaaacauauguacauuucgaggcgauguuacacauauaccaggaucucauaauuacacuaugaaucuagcaucucaaaacuggaacucauaugauccaacugaagaaauaccagcaccacuaggaacaccagacuuuguaggaaaaauccaagguguccuaacacaaacaacuucaacaaacggaucuacacguggccacaaagcaacaguauauaccggaucugccgauuucucaccuaaacuagguagaguccaauuugcaacagauacaaaugacgauuucgaaacaaaccaaaauacaaaauucacuccaguaggcguaauacaagauggaucuacuacaccacgaaacgaaccucaacaauggguccuucccuccuauucaggaagaaacacacauaacguacauuuagccccugcaguagcacccaccuuuccaggagaacaauuacuauuuuucagaucaacaaugcccggaugcucaggauaccccaacauggaucuagacugcuuauuaccccaagaauggguacaauacuucuaucaagaagcagcucccgcucaaagugacguugcccuuuuaagauucguuaacccagauacaggccguguacuuuucgaauguaaacuacacaaaucaggauaugugacaguagcacacacaggucaacacgacuuaguuauaccaccaaacggauacuuucguuuugauucauggguaaaucaauuuuauacacuagcccccaugggaaauggaacaggacgccgaagauaa

SEQ ID NO: 34303 - RNA, 1617 nt, Artificial Sequence
  derived and/or modified sequence opt6 from VP1__Norovirus_and/or_Norovirus-like__KX354080
augaaaauggcaucuuccgaugccaacccaucagaugguucaacagcaaaccuugucccagaaguaaacaaugaaguaauggcuuuagaaccaguaguuggagcagcuauagcagccccaguagcgggacagcaaaauguaauagacccuuggauaagaaacaauuuuguacaagcaccaggaggagaauuuacaguaucaccaagaaaugcuccaggagaaauacuauggucagcaccacuuggaccagaucuuaauccuuacuuaagucaucuagcaagaauguauaauggauacgcaggaggauucgaaguacaagucauccuagcaggaaacgccuucacagcaggaaaaauaauauucgcugcuguaccaccaaacuuuccaacagaaggcuuaucaccaucucaaguaacaauguucccacauauaaucguagauguacgacaacuagaaccagucuuaauaccauuaccagacguaagaaacaauuuuuaucacuauaaccaguccaaugauccaacaauaaaacuuaucgcaauguuauacacaccauuacgugcaaacaaugccggugaugauguauuuacaguaucaugccgaguauuaacaaggccauccccagacuuugauuuuauauuuuuagucccaccaacuguagaaucaagaacaaaaccuuucagcguuccuguccucacaguagaagaaaugacaaacucucgauucccaauuccacucgaaaaauuauucacaggaccuaguucagcuuuuguaguacaaccacaaaauggucgauguacaacugacggagucuuacuugguacuacucaacuuuccccaguaaauauauguacuuucagaggcgaugucacucauaucagcggaucaagaaauuauacaaugaaccuugcaucacaaaauuggaacucauacgaucccaccgaagaaauaccugcaccacuaggcaccccagauuuuguaggaaaaauacaaggaguacuaacccaaacaacaagaacugauggauccacaagaggacauaaagccacagucuauacagguucagccgauuuuucaccaaaacuagguagaguacaauuugcaacagauacagauaaugauuucguaacaaaucaaaauacuaaauucacaccaguaggaguaauacaagacggaucaacaacaccaagaaaugaaccucaacaauggguucuaccauccuacuccggacgaaauacacauaacguacaucuagccccagcagucgcaccaacauuuccuggagaacagcuauuauucuuucgauccacuaugccaggaugcuccggauacccaaauauggacuuagacugcuuauuaccucaagaauggguacaauauuuuuaccaagaagcagcaccagcucaaucagauguugcauuacuccgauucguaaacccagacacuggaagagucuuauuugaauguaaauuacauaaauccggauauguaacaguugcacauacaggccaacacgaccuaguaauuccaccaaacggcuauuuccguuuugauuccuggguaaaccaauuuuacacauuagcaccaauggguaacggcacaggccgcagaagauga

SEQ ID NO: 34304 - RNA, 1617 nt, Artificial Sequence
  derived and/or modified sequence opt6 from VP1__Norovirus_and/or_Norovirus-like__KX354054
augaaaauggcaaguucagacgcaaacccaucagauggaucaacagcaaacuuaguaccagaaguuaauaaugaaguaauggcacuagagccaguaguaggagcagccauagcagcaccaguagccggacaacaaaauguaauagaccccuggauaagaaacaacuuuguacaagccccaggaggagaauuuacaguauccccacgaaaugcucccggagaaauacuuuggucagcaccucuaggacccgauuuaaaccccuaucucucacacuuagcaagaauguacaaugguuacgcaggaggauucgaaguacaagucauucuagcuggaaaugcauucaccgcaggcaaaaucauuuucgcagcaguaccaccaaacuuuccaacugaaggacuaucuccaucacaagucaccauguuuccccacauaauagucgacguuagacaacuagaaccuguacuaauacccuuaccagacguuagaaauaauuucuaccauuauaaucaaagcaacgauccaacaauaaaacuuaucgcaaugcucuacacaccccuuagagccaauaaugcuggugacgauguuuucacaguaagcugucgaguacuaacaagaccaucaccugacuucgauuucauauucuuaguaccaccaacaguagaaucccguaccaaaccauuuucaguaccaguauugacaguagaagagaugacaaauucaagauuuccaauaccacuagaaaaacuuuuuacagguccaucaagcgcauucguaguccaaccacaaaauggaagauguacaaccgauggaguauuauuaggaacaacucaacuaucaccaguaaauaucuguaccuucagaggagaugucacacauauaucaggaucaagaaauuacacaaugaaucucgcaucacaaaacuggaacuccuacgauccaaccgaagaaauacccgcaccacuaggaaccccagauuuuguaggaaaaauccaaggaguacucacucaaaccacacgaacuaauggaucuacaagaggacauaaagccacuguauacaccggaucagcagauuuuucaccaaaacuaggaagaguacaauuugcaacugacacagauaaugauuucgaaacaaaccaaaacacaaaauuuacaccagucgguguaauacaagauggaucaacgacaccaagaaaugaaccccaacaauggguacuacccucauauucaggaagaaacauacauaacguccaccucgcaccagcaguagcucccacauuuccaggugaacaacuauuauucuuucguucuacaaugccaggauguucaggauacccuaauauggauuuagauugucuucuuccacaagaauggguacaauauuucuaccaagaagcagcaccagcacaaucagauguagcauuauuacgauucguuaacccagauacaggcagaguucuauucgaauguaaacuacauaaaucaggauacguaacagucgcacacacuggacaacaugauuuaguaauaccaccaaacggauauuuuagauucgacucauggguaaaccaauuuuauacauuagcaccaaugggaaaugguacaggacgaagacguuaa

SEQ ID NO: 34305 - RNA, 1617 nt, Artificial Sequence
  derived and/or modified sequence opt6 from VP1__Norovirus_and/or_Norovirus-like__KX354041
augaaaauggcaucaucagaugcaaauccauccgaugguucuacagcaaacuuaguucccgaaguaaacaaugaagucauggcccuagaacccguaguaggugcugcuaucgcagcaccuguagcaggacaacaaaauguuauagacccauggauacgaaauaacuucguacaagccccaggaggagaauuuacaguuucaccaagaaaugccccuggugaaauacuauggucagcaccacuagguccugaucucaauccauaucuaagccaucucgcacgaauguacaacggauacgcaggaggauucgaaguccaaguaauacuagcaggaaaugcauucacagccggaaaaauaaucuucgcugcaguaccaccaaauuucccaacagaaggacucucaccaucucaaguaacaauguuuccacacauaauaguagauguucgacaauuagaaccaguauuaauaccacuaccagauguaagaaauaacuuuuaucacuacaaucaaucuaacgauccaacaaucaaauuaauagcaaugcuauacacaccauuaagagcuaacaacgcaggagacgauguauucacaguauccugucgaguacucacacgaccuucaccagacuucgauuucauauuucuaguacccccaaccgucgaaaguagaacuaaaccuuuuucacucccaguacucacaguugaagaaaugacuaacucaagauuuccuaucccauuagaaaaacuauuuacuggacccuccucagcauucguaguacaaccacaaaacggacgaugcacaacagacggcguacucuuaggaacaacacaacucucaccaguaaacauaugcacuuucagaggugacguaacacauauuucagguucccgaaauuauacaaugaauuuagcaucccaaaauuggaacucauacgauccaacagaagaaauaccagcuccacuuggaacaccugauuuuguuggaaaaauacaagguguuuuaacacaaacuacuagaaccaauggaucaacaagaggacacaaagcaacaguauacacaggaucaguagacuuuucaccuaaauuaggaagaguacaauucgcuacagauacagauaacgauuucgaaaccaaccaaaauacuaaauucacuccaguaggugucauacaagacggaucaaccacaccaagaaaugaaccacaacaauggguauuaccaucuuauagcggccgaaacauucacaauguucaccuagcuccagcaguugcaccaacauuucccggcgaacaauuacuauuuuuccgaucaacaaugccaggcugcucaggauacccaaauauggauuuagauugccuauuaccacaagaauggguucaauauuucuaucaagaagcagcuccagcacaaucagaugucgcauuacuacgauuuguaaacccugacacaggaagaguauuauucgaaugcaaacuacauaaauccgguuaugucacaguagcacauacaggccaacaugacuuaguaaucccacccaacggauauuucagauuugacucaugggugaaucaauucuacacauuagcaccaaugggaaacggcacaggaagaagaagauaa

SEQ ID NO: 34306 - RNA, 1617 nt, Artificial Sequence
  derived and/or modified sequence opt6 from VP1__Norovirus_and/or_Norovirus-like__KX354029
augaaaauggccuccucagaugcuaacccaagugauggaucagcagcaaacuuaguaccagaaguaaauaacgaaguaauggcacuagaaccaguaguuggagccgcuauagcagcaccaguagcaggucaacaaaacguaauugacccuuggauacgaaauaauuuuguacaagcuccuggaggagaauuuaccguaagcccaagaaaugcuccaggagaaauucuauggucugcaccacuaggaccagaucuaaauccauaucuaucucaccuagcaagaauguauaacggauaugcaggaggauucgaaguacaaguaauacuugcaggaaaugccuucacagcagguaaaguaauauucgcugcaguuccaccaaacuucccaacagaaggacuuucaccaucccaaguaacuauguuuccacauaucguaguagauguucgacaauuagaaccagucuuaauaccacuaccagauguacgcaauaauuucuaucauuauaaucaaaguaaugauccaacuauaaaauuaauagcaauguuauauacuccgcucagagcaaacaaugcaggagaugauguauucacuguaucaugcagaguacuaacuagaccaucuccagacuuugacuuuauauuuuuaguaccuccuaccgucgaaucuagaacaaaaccauucucaguaccuguauuaaccguagaagaaaugaccaacaguagauuuccaaucccccucgaaaaacuauuuacaggucccucaucagccuuuguaguccaaccacaaaaugguagauguacaacagauggaguauuauuagggaccacccaacuaucuccaguuaauauauguacauucagaggagacgugacacauauaacgggaucucgaaauuauacuaugaacuuagccucacaaaacuggaacaauuacgauccaacugaagaaacuccagcuccuuuaggaacuccagauuuuguuggaaaaauacaagguguacuaacacaaacuacaagaacugauggaucaacaagaggccacaaagcaaccguauauacaggaucagcugauuuugcuccaaaacuaggaagaguucaauucgaaacagauacugaucaugacuucgaagcaaaucaaaauacaaaauucacaccaguaggagucauccaagacggcaguacaacacaucgaaacgaaccacaacaauggguucuaccaucguacucagguagaaauacacacaacguacacuuagccccugcuguagccccuacauuuccaggagaacaauuauuauucuucagaucuacaaugccaggaugcagcggauacccaaacauggaucuagauugccuguuaccccaagaauggguacaauauuucuaucaagaagcagcuccugcucaaagcgacguagcauuauuaagauucguaaauccagacacaggcagaguacucuucgaaugcaaacuccauaagucaggcuauguaacaguagccuauacaggacaacaugaucuaguaauaccacccaauggauacuuuagauucgacagcuggguaaaucaauuuuacacauuagcaccaaugggaaaugguacuggaagacgacgauaa

SEQ ID NO: 34307 - RNA, 1617 nt, Artificial Sequence
  derived and/or modified sequence opt6 from VP1__Norovirus_and/or_Norovirus-like__KX353977
augaaaauggcaucaucagaugcaaauccaucugaugguucaacugcaaaccuaguacccgaagucaauaacgaaguaauggcauuagaaccaguagucggcgcagcaauagcagcaccaguagcaggacaacagaacguaauagauccauggauacgaaauaauuuuguucaagcaccaggcggagaauuuacaguauccccacgaaaugcacccggcgaaauuuuauggagugcaccacuaggaccagaucuaaauccauaucuaucacacuuagcuagaauguauaauggauaugcugguggcuucgaaguccaaguuauauuagcaggaaacgcauucaccgcagguaaaauaauuuuugcugcagucccuccaaacuucccuaccgaaggcuuaucacccucacaggugacaauguucccacacauaauaguagauguucgacaacuagaaccaguauuaauaccuuuaccagaugucagaaauaacuuuuaucauuauaaucaauccaaugacccaacaauaaaauuaauugcaauguuauauacaccacuaagagcaaacaacgcaggagaugacgucuuuaccguaucaugccgcguccuaacaagaccaucaccagauuucgauuuuauauuuuuaguaccaccuacaguagaaucaagaacuaaaccauucucuguuccaguuuuaacaguagaagaaaugacaaacucacgauucccaauuccauuagaaaaauuauucacuggucccucuucugcuuucguaguacaaccucaaaauggccgaugcacuacugaugguguacuauuagguacuacacaauuaucaccuguaaauauuuguacuuucagaggcgacguaacucauauaucaggaucaagaaauuauacuaugaaccuagcaucacaaaacuggaacucauacgauccaacagaagaaauaccagcuccuuuaggaaccccagacuuuguaggcaaaauacaagggguauuaacacaaacaacacgaacaaaugguucaacuagaggucacaaagcaacagucuauacagguuccgcagauuuuucacccaaauuggguagaguacaauuugcaacagacacagauaaugauuuugaaacuaaucaaaacacaaaauucacuccaguuggaguaauacaagaugguggaacuacaccucgaaacgaaccacaacaauggguacuaccauccuauucaggaagaaacauacauaauguacaucuagccccugcaguugcaccuacuuucccaggugaacaauugcuuuucuuucguucuacuaugccaggaugcucaggauaccccaacauggauuuagacugcuuauuaccacaagaauggguacaauacuucuaucaagaagcagcaccagcacaaagcgacguagcacuauuacguuuuguuaacccagacacuggaagaguuuuauuugaauguaaacuucauaaaucaggauauguaacaguagcacacacaggucaacacgauuuagucauuccaccaaacggauacuucagauuugauucauggguaaaucaauucuacacauuagcaccuaugggaaacggaacaggacgacgaagauaa

SEQ ID NO: 34308 - RNA, 1617 nt, Artificial Sequence
  derived and/or modified sequence opt6 from VP1__Norovirus_and/or_Norovirus-like__KX353965
augaaaauggcaucaucugaugcuaacccuucagacggcucaacagcaaacuuaguuccagaaguuaacaaugaaguuauggcuuuagaacccguaguuggcgcagcaauagcugcaccaguagcaggacaacaaaauguaauagaucccuggauaagaaacaauuucguucaagcaccaggaggagaauuuaccguuucaccccgaaaugcaccaggcgaaauauuauggucagcuccccuagguccagacuuaaaccccuaucuaucccaucuagcccgcauguacaacggauacgcaggaggauucgaaguacaagucauauuagcagguaaugcuuucacagcugguaaaauaauauuugcugcaguuccaccaaacuucccaaccgaaggacuaucaccaagucaagucaccauguucccucauauaauaguugacguaagacaacuagaaccaguccuuauaccuuuaccagauguuagaaacaauuucuaucacuauaaccaauccaaugauccuacaauaaaauuaauagcaauguuauacacaccauuaagagcaaauaacgcaggagaugauguauuuacaguaucuugucgaguauuaacucgaccaucaccugauuucgacuuuauauuucuuguaccaccaacaguagaaucacgcacaaaaccguucucuguuccagucuuaacagucgaagaaaugacaaacucuagauuuccuauaccacuagaaaaacuauuuaccggaccaucauccgcauucguaguacaaccccaaaacggucgauguacaacagaugguguccuacuaggaaccacacaauuaucuccaguaaauauauguacauuuagaggagacguuacacauaccccagguucucacaauuauacuaugaauuuagcaucacaaaacuggaacucauaugauccaacagaagaaauacccgcuccucuuggaacaccagacuucguuggaaaaauacaaggaguacuaacucagacaacacgaacaaacggaaguacaagaggacacaaagcaaccgucuacaccggaucagcagacuucucaccuaaacuaggacguguacaauucgcaacagauaccgauaaugauuucgaaaccaaucaaaauacaaaauuuacaccuguaggaguaauccaagauggaucuacaaccccacgaaaugaaccucaacaaugggucuuacccaguuauucaggaagaaauauacauaacguacaucuagccccagcagucgcaccaacauuucccggugaacaauuauuauucuuccguucaacaaugccagguugcuccgguuauccaaacauggaucucgauugcuuauuaccucaagaauggguacaauauuuuuaucaagaagcagcaccagcccaaucagaugucgccuuacuaagauuuguaaacccagacaccggcagaguacuuuuugaauguaaauuacauaaaucuggauacguaacugucgcacacacaggccaacaugacuuaguuauaccuccaaaugguuauuuuagauuugauuccuggguaaaucaauuuuacaccuuagcaccuaugggaaacgguacaggacgacgaagauaa

SEQ ID NO: 34309 - RNA, 1617 nt, Artificial Sequence
  derived and/or modified sequence opt6 from VP1__Norovirus_and/or_Norovirus-like__KU311158
augaaaauggcaucaucagaugccaauccaucagauggaagcgcagcaaacuuaguuccugaagucaauaaugaaguaauggcacuagaacccgucgucggagcagcaaucgcagcuccugucgcaggacaacaaaacguaauagacccauggauacgaaauaacuuuguucaagcuccaggaggugaauuuacuguaucaccaagaaacgcuccaggagaaauauuauggucagcuccacuaggaccagacuuaaaccccuaucuuucucauuuagccagaauguacaauggauaugcaggaggauucgaaguacaaguaauucuagccggaaaugcauuuacagcuggaaaaguaauauucgcagcaguuccaccaaacuuuccaacagaaggacuaucaccaucacaaguuacuauguuuccacauauaguuguagacguacgacaacuagaaccuguuuuaauuccauuaccugauguaagaaauaauuucuaucacuauaaucaaagcaaugaccccacaauaaaauuaauugcaaugcucuauacuccuuuaagagcuaauaaugcaggagacgacguauuuacuguaucaugucgcguacuaaccagaccaucucccgacuucgauuuuauauuuuuaguaccaccaacuguugaaucaagaacaaaaccuuucucaguccccguauuaaccguugaagaaaugaccaauagucgauuuccaauuccuuuagaaaaauuauuuacuggaccaucaucagcauucguuguacaaccacaaaacgguagaugcacuacugacggaguacuauuagguacaacacaauuaucaccaguaaauauauguacuuuucgaggagacgugacucauauaacagguuccagaaauuacacaaugaaucuagcuucacaaaauuggucaaauuaugauccaacagaagaaauuccagcacccuuaggaacaccagauuuugucgguaaaauucaaggaguacuaacccaaaccacaagagcagacggauccacucguggacauaaagcaacagucuauacagguucugcagacuuugcucccaaacucgguagaguacaauucgaaacagauacagaucacgauuucgaagcaaaucaaaauacuaaauucacaccuguagguguaauacaagauggcggcaccacacaucgaaaugaaccacaacaauggguauuaccuucauacucaggucgcaauacuccaaacguacaucuagcaccagcaguugcaccaacauuuccaggagaacaauuauuauucuuucgaucaaccaugccaggauguucaggauacccaaauauggaucucgacugcuuauuaccacaagaauggguccaauauuuuuaucaagaagcagcuccagcacaaucagacguagcacuacuaagauuugucaauccugauacugguagaguccuauucgaaugcaaauuacacaaaucagguuacguaacaguagcacauacaggacaacacgaucuaguuauacccccaaauggauacuucagauucgacucauggguaaaucaauuuuauacauuagcacccaugggaaacggcacaggaagaagacgauaa

SEQ ID NO: 34310 - RNA, 1617 nt, Artificial Sequence
  derived and/or modified sequence opt6 from VP1__Norovirus_and/or_Norovirus-like__AB974408
augaaaauggcaucaagugaugcaaacccuucugacggauccgcagcaaaccuaguacccgaaguaaauaaugaaguaauggcauuagaaccaguaguaggugcagcaauagcugccccagucgcaggacaacaaaauguaauagacccauggauaagaaacaacuuuguccaagcaccaggaggggaauuuacaguaucuccaagaaaugcacccggagaaauauuauggucagccccucuaggcccagaucuaaauccauaccuaucacaccuagcgagaauguauaacggauacgcaggcggauucgagguacaaguaaucuuagcaggaaaugccuucaccgcaggaaaaauaauauuugcagccguaccaccaaacuucccaacagaaggucuaucaccaucccaaguaacuauguucccccacauaauuguagacguacgacaauuagaaccaguauuaauaccauuaccagacguaagaaacaauuuuuaucacuauaaucaaucaaacgacucaacaauaaaauuaauagcaaugcuauacacaccauuaagagcaaacaaugcaggagaagauguauucacaguuucaugcagaguauuaacaacaccaucaccagacuucgauuuuauauucuuaguaccaccuacagucgaauccagaacuaaaccuuucacuguaccuauacuaacaguagaagaaaugacuaacucacgcuuuccaauuccacuugaaaaauuauucacuggaccuucaucagccuucguaguccaaccccaaaacggaagauguacaacagacggaguccuacuaggaacaacacaauugucaccaguaaauauaugcaccuuuagaggagacguaacacacauagccggcaguagaaauuauaccaugaauuuagcaucauuaaacuggaacaacuacgacccaacagaagaaauaccugcccccuuaggcaccccagauuucguagguaaaauacaaggaauguuaacccaaacaaccaaaggagauggaucuacuagaggacacaaagcaaccguauauacaggauccgcaccauucacaccaaaauuagguucaguacaauuuucuacagauacagaaaacgauuucgaaacacaucaaaauacaaaauucacaccagucggaguaauacaagaugguaacacuacacauagaaaugagccccaacaauggguacuaccauccuauucaggacgaaauguaccuaacguacacuuagcaccagcuguugcaccaacauuuccuggagaacaacuauuauuuuucagaucaaccaugcccggaugcucaggauauccaaacauggaccuugauuguuugcuaccacaagaauggguacaacacuucuaucaagaagcugccccugcacaaucagauguagcacuauuacgauucguaaauccagacacaggacgaguccucuuugaaugcaaacuacauaaaaguggauacguuacaguagcacauaccggacaacaugaucuaguaaucccaccaaacggcuauuuccgauuugacucauggguaaaucaauuuuacacucucgcaccaaugggaaauggaacaggaagaagacgcuaa

SEQ ID NO: 34311 - RNA, 1617 nt, Artificial Sequence
  derived and/or modified sequence opt6 from VP1__Norovirus_and/or_Norovirus-like__KR904221
augaaaauggccucaucagacgcaaauccaucagauggaagcgcagccaaucuaguaccagaaguaaacaacgaagugauggcccuagaaccaguuguuggagcagcaauagcagcacccgucgccggacaacaaaauguaauagacccuuggauacguaauaacuucguacaagcaccuggaggagaauuuacaguaucaccuagaaaugcaccuggagagauauuauggagcgccccacucgguccagaucucaacccauauuuaucacaccuagcaagaauguacaacggauaugccggaggauucgaaguacaagucauucuagcaggaaaugcuuuuacagcuggcaaaguaaucuucgccgcaguuccacccaacuuucccacagaagguuuaucaccaucacaaguaaccauguucccccacauuguaguagauguacgacaacucgaaccaguucucauaccauuacccgauguaagaaauaauuucuaccacuauaaccaaucaaaugaccccacaauuaaacuaauagcaaugcuauacacaccauuaagagcaaauaacgcaggagacgacgucuuuacaguuucauguagaguauuaacuagacccucaccagacuucgauuuuauauuuuuaguaccacccacaguugaaucuagaacaaaacccuucagcgucccaguacuaacuguagaagaaaugacaaacuccagauuuccaauuccauuagaaaagcuauucacuggaccauccagcgcauucguaguacaaccccaaaauggaagaugcacaacagacgguguccuauuagguacaacacaacuaagcccaguaaacauauguacauucagaggagacguaacacauauaacaggaucaagaaauuacacuaugaauuuagcaucacaaaacuggaacaauuacgauccaacagaagaaauaccagccccucuaggagcaccagauuuuguaggaaaaauacaaggaaugcuuacacaaacaacaagagcagauggauccacaagaggacacaaagcaacuguuuacacagguucagcagacuuugcaccaaaauuaggaagaguacaauucgaaacagauacagaucacgauuucgaagcuaaucaaaauacuaaauuuacuccaguaggaguaauacaagacgguucuaccacacauagaaaugaaccccaacaauggguacucccauccuauucaggacgcaacacacauaacguucaucuagcaccagcuguugcaccaacauuuccaggagaacaacuacucuucuuuagaucaacaaugccagguugcucaggauauccaaacauggaccuagacugucuucucccacaagaauggguucaauacuuuuaccaagaagcugcuccagcacaaucugauguagcauuauugagauucguaaacccagauacaggaagaguacuauucgaauguaaacuacauaaaucaggauaugucacaguagcucacaccggccaacacgaucuaguaauaccacccaauggauacuuucgauucgauucauggguaaaucaauuuuacacacuugccccuaugggaaacggagccggaagacgacgauaa

SEQ ID NO: 34312 - RNA, 1617 nt, Artificial Sequence
  derived and/or modified sequence opt6 from VP1__Norovirus_and/or_Norovirus-like__AB933765
augaaaauggccuccuccgacgcaaaucccagugauggaucaacagcaaacuuaguuccagaaguaaacaaugaaguaauggcacuagaacccguaguuggugccgcuauagcagcaccaguagcaggacaacaaaauguaauagacccauggauacgaaauaacuucguacaagcaccuggcggagaauuuacugucuccccacgaaaugcaccuggagaaauacuauggucagaaccucuagguccugaccuuaaucccuaccuaucccacuuagcacgcauguauaacggauacgcuggagguuucgaaguacaaguaauucuagcaggcaaugccuucacagcaggaaaaauaauuuuugcagccguucccccaaacuuucccacugaaggauuaucuccaucacaaguaacaauguucccacacauaaucgucgauguaagacaauuagaaccaguacuaauaccauuaccagacguaagaaauaauuucuaucauuacaaccaauccaacgauaguacuauuaaauuaauagcuaugcuuuauacaccccuaagagcaaauaacgcaggagacgacguauucacaguauccugucguguacuaacuagaccaucaccagacuuugauuucauauuucuaguuccaccaacagucgaauccagaacuaaaccauuuucaguuccaguauuaacuguagaagaaaugacaaacucacgauucccuauuccauuagaaaagcuauuuacugguccgucaucugcauucguaguacaaccacaaaacggaagauguaccaccgaugguguauuauuaggaaccacccaauuaucaccaguaaauauauguaccuuccgaggugacgucacacauauuccgggaucaagaaacuacacaaugaauuuagcaucacaaaacuggaacucauacgauccaacagaagaaauaccagcaccccuaggaacucccgacuuuguagguaaaauacaaggaguauuaacacaaacaacaagaacaaauggaucuacuagaggacauaaagccacuguuuauacagguuccgcagacuuuucaccaaaauuaggccgaguacaauuugcaacagacacagauaacgauuucgaaacaaaucaaaauacaaaauucacaccaguagguguuauacaagacgguggaacaacucacagaaacgaaccacaacaauggguauugccauccuacuccggacgaaauauacacaacguacauuuagcuccagcaguagcaccuaccuucccaggagaacaacuauuauucuuuagaucuacuaugcccgguuguucaggauauccuaacauggaucuagauuguuuacuaccacaagaauggguacaauauuucuaucaagaagccgcaccagcacaaucagacguugccuuauuaagauuuguaaacccagacacaggacgaguccuauucgaauguaaauuacauaaaagcggauauguaacagucgcacauacuggucaacacgaucuaguaauaccacccaacggauacuucagauucgauucuugggucaaucaauuuuacacacucgcaccuaugggaaaugguacagguagaagaagauaa

SEQ ID NO: 34313 - RNA, 1617 nt, Artificial Sequence
  derived and/or modified sequence opt6 from VP1__Norovirus_and/or_Norovirus-like__AB933761
augaaaauggcaucuuccgaugcuaacccaucugacggaucaacagcuaaccuuguaccagaaguaaacaaugaaguaauggcauuagaacccguuguaggagcagcaauagcagccccaguagcaggacaacaaaauguaauugaccccuggauacgaauaaacuuuguacaagcacccggaggagaauuuacaguaucaccaagaaacgcaccaggagaaauacuuuggucagccccacuugguccagauuuaaauccauaccuaucccacuuagcacgaauguauaacggauacgcugguggauucgaaguucaaguaauauuagcaggaaaugcuuuuaccgcugguaaaauaaucuuugcagccguaccacccaacuucccaacugaaggacuaucuccaagucaaguuacaauguuuccacacaucauaguugauguacgacaauuagaaccaguacuaauaccacucccagacguaagaaacaauuucuaucacuauaaucaaucuaacgacccaacaauuaaauuaauagcaaugcuauacacaccacuacgagcaaacaaugcaggagaugacgucuuuaccguaucaugccgcguacuaacaagaccuucuccagauuucgauuuuauauuucuaguucccccaacugucgaaagucgaacaaaaccauuuucaguaccaguauuaacaguagaagaaaugacaaauucccgauuccccauaccacuagaaaaauuauuuacagguccaucaagugcauucguaguccaaccucaaaauggaagauguacaacagacggaguucuauuaggaacaacacaacuaucaccaguaaauaucuguacauucagaggagacguaacacauauaccugguucacgaaauuacacaaugaaucuagcaucacaaaacuggaacuccuaugauccaacugaagaaaucccagcaccucuaggaaccccagacuuuguaggaaaaauacaaggaguuuuaacacagacaacccgaacaaauggaucaacacgaggucacaaagcaaccguuuauaccggauccgcagauuuuagcccaaaauuaggaagaguccaguucgcaacagauacagauaaugacuucgaaacuaaucaaaauacaaaauucacaccaguaggaguaauacaagacggaucaacuaccccaagaaaugaaccacaacaauggguacuaccauccuauucaggaagaaauauacacaacguacacuuagcuccagcuguagcaccaacauuuccaggugaacaacuguuauucuuuagaucgacaaugccuggaugcucuggcuauccaaauauggaucuagauugucuccuaccacaagaauggguacaauauuuuuaucaagaagcagcaccagcgcaaucugauguagcacuacuccguuuuguuaacccagauacaggaagaguauuauucgaauguaaacuacacaaaucaggauauguaacuguugcacacacaggacaacaugauuuaguuauaccaccgaauggcuauuuuagauucgauuccuggguaaaccaauucuauacacucgcaccaaugggaaauggaacuggaagacgaagauaa

SEQ ID NO: 34314 - RNA, 1617 nt, Artificial Sequence
  derived and/or modified sequence opt6 from VP1__Norovirus_and/or_Norovirus-like__AB933748
augaagauggcaucaucagacgcaaauccaucagacggaucaaccgcuaaccuaguaccugaaguaaacaaugaaguaauggcacuagaaccaguaguaggagcugccauagcugcccccguagcaggacaacaaaacguaauagacccauggauucgaaauaacuuuguccaagcuccaggaggagaauuuacagucucaccaagaaaugcaccaggcgaaauauuauggagcggaacauuaggaccagaucucaaucccuaucuaucucacuuagcacgaauguauaaugguuacgccggaggauucgaaguacaaguaauacuagcuggaaaugcauuuacagcaggaaaaaucauauucgcagcaguuccaccaaacuuuccaacagaaggacuauccccaucucaaguuacuauguuuccacacaucauaguagacguaagacaauuagaaccaguauuaauuccuuuaccagacguccgaaacaauuuuuaccacuauaaucaaaguaaugacccaacaauaaaauuaauagcaauguuauacacaccauuaagagcaaacaacgcaggcgaugauguauuuacaguaucaugccgaguucuaacucgaccaagcccagacuuugacuuuauauuucucgucccaccaaccgucgaauccagaacaaaaccauuuucaguaccaguuuuaacugucgaagaaaugaccaauucaagauuuccuauucccuuagaaaaacuauuuacaggaccuucaagcgccuucguaguacaaccacaaaacggacgaugcacaacagacggcguuuuacuaggaacuacacaauuauccccuguuaauaucuguacauucagaggagacguaacacauauaccaggaucccguaauuauacaaugaaucuagcaucccaaaauuggaacucauaugauccaacugaagaaauuccagcaccccucgguaccccagacuuuguaggaaaaauucaaggagucuuaacacaaacaacuagaacaaaugguucaacaagaggacacaaagcaacuguuuauacaggaucagcagauuuuuccccaaaauuaggacgaguccaauucgcaacagacacagauaaugauuuugaaacaaaucaaaauacaaaauucaccccaguaggagucauacaagacgguucaacuacaccaagaaaugaaccucaacaauggguuuuaccaucauacucaggcagaaauauucauaacguucacuuagcccccgcaguugcaccuacauuuccaggugaacaauuacuauucuuccgaucuacuaugccagguugcucuggauacccuaauauggauuuagauuguuuauuaccacaagaauggguucaauacuuuuaucaagaagcagcccccgcucaaucagacguugcacuauuaagauuuguaaacccagacaccgguagaguacuuuucgaaugcaaacuacauaaaagcggauacguuacaguagcucacacaggacaacaugaccuagucaucccaccaaacggauauuuuagauucgacuccuggguaaaccaauucuacacauuagccccaaugggaaacggaacaggaagaagaagauaa

SEQ ID NO: 34315 - RNA, 1617 nt, Artificial Sequence
  derived and/or modified sequence opt6 from VP1__Norovirus_and/or_Norovirus-like__EU921386
augaaaauggcaucaaaugaugcaaauccaucagauggauccgcagccaacuuaguaccagaagucagcaaugaaguuauggcauuagaaccaguaguaggagccgccaucgcugcaccaguagccggccaacaaaauguaauugacccauggauaagaaauaacuuuguucaagcaccagguggagaauuuacaguaucaccacgaaaugcaccaggugaaauacuuuggucagccccacuaggaccagaucuaaaccccuaccuaagucaccuagcucgaauguacaauggauacgcaggcgguuuugaaguacaagucauacuagcaggaaaugcauuuacagcaggaaaaauaauauuugcagcaguaccaccaaacuuuccaacugaaggcuuauccccaucacaaguaacaauguucccacacauuauaguagacguaagacaauuagaaccaguauuaauuccacuaccagauguacgaaauaauuuuuaccauuacaaucaaucaaacgacucaacaauuaaacuuauagcuaugcuauacacacccuuaagagccaauaaugcaggcgaagauguauuuacaguaucuuguagaguacuaacuagaccuucacccgauuuugacuucauauuccuaguuccaccaacagucgaaagucgcaccaaacccuuuacaguaccaauucuuaccguugaagaaaugacaaacucaagauucccaauuccguuagaaaaacuauuuaccggaccauccggagcauuuguuguacaaccccaaaacgguagaugcacaacugacggaguauuauuagguacuacacaacuaagcccaguaaauauaugcacauuuagaggagauguaauacauauagcaggaucaagaaauuacacaaugaaucuagcaucccuaaauuggaacaauuacgacccaacagaagaaauaccugcaccacuagguacaccagacuuuguuggaaaaauacaaggaguauuaacacaaacaacaaaaggagacgguucaacucgcggucauaaagcaacuguauauacaggcucagcaccauuuacacccaaacuaggcucuguccaauuuucuacagauacagaaaaugacuucgaagcacaccaaaacacaaaguuuacaccagucggagucauucaagacggaggaaccacacauagaaaugaaccccaacaauggguauuaccaucuuauaguggaagaaacguccacaauguacacuuagccccagcaguagcacccacauuuccaggagaacaauuacuauucuuucgcucuacaaugccuggaugcagcggcuacccaaauauggaccuagauugcuuacuaccucaagaauggguacaacauuucuaucaagaagcagcucccgcccaaucugaugucgcauuguuaagauucguuaacccugacacuggacgaguacuauucgaaugcaaacuacacaaaucaggauaugucacuguagcacauacaggacaacaugacuuaguaauaccuccaaacggauacuuuagauucgauucauggguaaaccaauuuuacacuuuagccccuaugggcaauggaacaggaagacgucgauga

SEQ ID NO: 34316 - RNA, 1617 nt, Artificial Sequence
  derived and/or modified sequence opt6 from VP1__Norovirus_and/or_Norovirus-like__KP244321
augaaaauggcaucuucagaugcaaaucccuccgacgguucaacagcaaacuuaguuccagaaguuaauaaugaagucauggcauuagaaccuguaguuggugcagcuaucgcugcccccguagcaggucaacaaaacgucauugacccauggauaagaaauaacuuuguacaagcuccuggcggagaauuuaccguuucaccacguaaugcaccaggugaaauauuauggucagcaccacuaggacccgacuuaaacccauaucuaucacauuuagccagaauguacaauggauaugcuggcggauuugaaguccaaguaauauuagcuggcaacgccuuuacagcuggcaaaauaauauuugccgcagucccaccuaacuucccaacagaaggccuaucuccaucacaaguaacaauguuuccacauauaauagucgauguccgucaacuugaaccaguauuaauaccacuucccgauguaagaaacaacuucuaucauuauaaccaauccaaugaccccacaauaaaauuaauagcaaugcucuauacaccucuccgagcaaauaaugcaggcgaugauguauuuacuguaucauguagaguacuuacaagaccuuccccagauuuugacuuuauuuuucuaguaccaccuacaguagaaucuagaacaaaaccauucucaguaccaguacuaacgguagaagaaaugacaaauucaagguuuccaauaccauuagaaaaauuauuuacuggaccauccagcgcauuuguaguacaaccccaaaacgguagauguacaacagacggaguauuauuaggcacaacacaauuaucaccaguaaauaucuguacauuuagaggagacguuacacacauaucagguucaagaaauuauacuaugaauuuagcaucacaaaacuggaacucauacgauccaacagaagaaauaccugcaccuuuaggcacaccagacuucguagguaaaauacaaggaguccucacacaaacaacuagaaccaauggaucaacaagaggacauaaagcaacuguauauacaggaucugcagauuuuucaccaaaacuuggaagaguacaauucgcuacagauacagauaaugauuuugaaacuaaucaaaauacaaaauucaccccaguuggaguaauacaagacgguucaacaacaccacguaaugaaccgcaacaauggaugcucccaucuuauucagguagaaacacacauaacguacauuuagccccugcaguagccccaacauuuccaggcgaacaacuacuauucuuuagaucuacaaugcccggaugcucaggcuaucccaauauggaucuagauugucucuuaccucaagaauggguacaauauuucuaucaagaagcagcacccgcucaaucagacguagcauuauuacgauucgucaauccugacacuggaagaguacuauucgaauguaaacuacauaaaucaggcuacguaacaguagcucacacaggucaacacgaucucguaauaccgccuaauggauauuuucgauucgauucauggguaaaucaauuuuacacccuagcaccaaugggaaauggaacaggaagaagaagauaa

SEQ ID NO: 34317 - RNA, 1617 nt, Artificial Sequence
  derived and/or modified sequence opt6 from VP1__Norovirus_and/or_Norovirus-like__KP698923
augaaaauggcuucuagcgaugcaaacccaagugacggaucagccgcaaaucuagucccagaaguaaacaaugaaguuauggcacuagaaccaguugucggagcugcuaucgcagcaccuguagcaggucaacaaaacguaauagacccauggauaagaaauaauuucguacaagcaccaggaggagaauuuacuguaucuccccgcaaugcuccaggcgaaaucuuauggucagcuccuuuaggacccgauuuaaauccuuauuuaucacaucuagcacgaauguacaauggauaugcaggagguuuugaaguccaaguaauacuagcaggcaaugcauuuaccgcaggcaaaguuauauuugcugcaguaccaccaaauuuuccaaccgaaggucucucuccaucacaaguaaccauguuuccccauauaguaguagacguaagacaauuagaaccagucuuaaucccuuuaccagauguaagaaacaacuuuuaccauuacaaucaaucuaaugaccccacaauaaaacucauugccauguuauacacaccccuacgagcaaauaaugccggagaugauguauuuacaguaucuugcagaguacucacaagaccaagcccagacuucgacuuuauauuuuuaguuccaccaacaguagaaucacgaacaaaaccauuuucaguacccguucuuacaguugaagaaaugacaaauucaagauuuccaauaccacucgaaaaacuauucacaggcccaucuagugccuuuguuguucaaccacaaaacggccguugcacaaccgacggcguacuacucggcacaacacaacuaucccccguuaauauaugcaccuuucgaggagacguaacucacauaacaggaucacauaacuacacuaugaaccuagcuucacaaaacuggaguaauuaugaucccaccgaagaaauacccgccccauuaggaacaccagacuucguaggaaaaauacaaggcguuuuaacacaaacuacacguacagaugguagcacacggggacacaaagcaacaguauauacaggaucugcagauuuugcaccaaaauuaggcagaguacaguuugaaacugacacaaaccaugauuucgaagcaaaccaaaacacuaaauuuaccccuguaggaguuauacaagauggaggaacuacucauagaaaugaaccacaacaauggguauuaccaucauauucaggaagaaauaccccuaauguacacuuagcuccagcagcggcaccaacuuuuccuggagaacaacuccuauucuuuagaucaacaaugccaggcuguucaggauauccaaacauggauuuagauugucuauuaccacaagaauggguacaauacuuuuaccaagaggcugcaccagcucaaagugauguagcauuacuaagauucguuaauccugauacaggaagaguacuauucgaauguaaacuucauaaauccggauauguaacaguugcccauacaggacaacaugauuuaguaauaccuccaaacggauacuuucguuucgauaguuggguaaaccaauuuuacacacuagcaccaaugggcaaugguacaggaagaagacgauaa

SEQ ID NO: 34318 - RNA, 1617 nt, Artificial Sequence
  derived and/or modified sequence opt6 from VP1__Norovirus_and/or_Norovirus-like__KP241905
augaaaauggccaguucagacgcaaauccaucagauggaagugcagcaaaucuugugccagaaguaaacaaugaaguaauggcauuagaaccuguaguaggagcagcuauagcagcacccguagcaggacaacaaaacguaauagaccccuggauacguaauaauuuuguacaagcaccaggcggugaguucacaguuucaccacgaaaugccccaggagaaauucucuggucagcaccauuagguccagaucucaacccuuaccuaucucaccuagcacgcauguauaauggauacgcuggaggauucgaaguacgaguuauacuagcaggaaaugcauuuacugcagguaaaguaauauuugcagcuguaccuccaaauuuuccaacagaaggauuaucaccuagucaaguaacaauguucccacacauaguaguagacgucagacaauuagaacccguauuaaucccuuuaccagauguaagaaauaauuuuuaccauuauaaucaaucaaaugacccaaccauaaaacuaauugcaauguuauauacaccuuuacgcgcaaauaacgcgggcgacgacgucuucacaguuucauguagaguccuuacaagaccaucuccagacuuugacuuuauauuucucguaccaccaacaguugaaucacgaacaaaaccauuuucaguaccaauauuaacaguugaagaaaugacaaacucaagauucccaauaccacucgaaaaauuguuuacagguccaagcuccgcuuucguaguacaaccacaaaauggccgauguacaacagauggaguuuuauuaggaacuacacaacuaucuccaguaaacauaugcacauuucgaggagauguaacacacauaacaggaucaagaaauuauacgaugaaccuagcaucacaaaauuggucaaauuacgauccuacagaagaaaucccagcaccacugggcaucccagauuuuguuggaaaaauacaaggaaugcuaacacaaacuacaagaacagauggaucaacaagaggucauaaagccaccguuuauacagguagugcagauuuugcaccaaaauuggguagaguccaauucgaaacugauacagaucacgauuuugaagcaaaccaaaacacaaaauucacuccuguaggagucauucaagauggauccacuacacauagaaaugaaccucaacaauggguacuacccucauauucagguagaaacacccccaacguacauuuagccccugcuguugcacccacauucccaggagaacaacuauuauucuuuagaucaacaaugccaggauguucuggauauccaaacauggacuuagauugcuuauuaccacaagaauggguacaauacuucuaccaagaagcggcuccugcacaaucagauguagcacuauuaagauuuguaaauccagacacaggacgcguacucuucgaauguaaacuacacaaaucaggcuauguaacuguugcucauacaggucaacaugauuuaguaauaccaccaaauggauacuuuagauuugauucauggguaaaccaauuuuacacuuuagcuccaaugggaaauggaacuggaagaagaagauaa

SEQ ID NO: 34319 - RNA, 1617 nt, Artificial Sequence
  derived and/or modified sequence opt6 from VP1__Norovirus_and/or_Norovirus-like__KP176393
augaaaauggcaucaucagaugcuaauccaucagauggauccgcagccaaccuaguaccugaaguaaauaaugaaguuauggcacuagaaccaguagucggugcagccauugcagcaccugucgcaggacaacaaaacguuauagacccauggaucagaaacaauuuuguacaagcuccaggaggagaauuuaccguaucacccagaaaugcacccggugaaauacuauggagcgcucccuuagguccugacuuaaacccauaucuaucccaucucgcaagaauguauaauggguaugcaggaggcuucgaaguccaaguaauuuuagcaggaaaugccuucacagcaggaaaaguaauuuuugcagcaguucccccuaacuucccaacagaaggucuuuccccaucccaaguuacuauguuuccacauauaguaguugauguaagacaauuagaaccuguacuaaucccuuuaccagauguaagaaacaauuucuaucauuauaaccaauccaaugacccaacaauaaaacuaauagcaaugcuauauacaccucuacgcgcuaauaacgcaggagacgacguauucacaguaagcuguagaguacuaacacgacccucaccagacuuugauuuuauuuuucuaguuccaccaacuguagaaucaagaaccaaaccauucagcguuccaguccuaacuguugaagaaaugacaaauucaagguuuccaauaccauuagaaaaauuauucacaggaccuucaucugcauucguuguucaaccacaaaauggucgcuguacaacugacggaguauuacucgguacaacacaacucucaccaguaaauauauguacauucagaggagauguuacacauauaacaggauccagaaauuauacaaugaaucuggcaucacaaaacuggucuaacuacgauccaacagaagaaauaccagcaccacuagguacaccagauuucguaggcaaaauacaaggaguauuaacacaaaccacaagaacagaugguucaaccagaggacacaaagcaacaguuuauacuggaucagcugacuuugcuccaaaguuaggacgaguacaauuugaaacagacacagaucaugauuucgaagcaaaucaaaauacuaaauucacuccuguugguguaauacaagauggaucaacaacacauagaaaugaaccccaacaauggguauuacccucauauagcggaagaaacacaccuaacguucaucuagcuccugcaguugcacccaccuuuccaggagaacaacuauuauucuuccgcucaacuaugccaggauguucaggauauccaagcauggacuuagacugccuauuaccacaagaauggguucaauauuucuaccaagaagcagcuccagcacaaucugauguugcauuauuaagauuuguaaauccagauacaggaagaguccuauucgaaugcaaauuacacaaaucagguuauguaacaguagcacacacaggacaacaugauuuaguaauaccuccaaauggauauuuucgauuugauuccuggguaaaucaauuuuauacucuugcaccaauggguaauggaacaggaagaagacgcuaa

SEQ ID NO: 34320 - RNA, 1617 nt, Artificial Sequence
  derived and/or modified sequence opt6 from VP1__Norovirus_and/or_Norovirus-like__KP096330
augaaaauggcuucaucagacgcuaaucccucagacggaucagcagcaaaucuaguaccagaaguaaauaacgaaguaauggcacuagaaccuguaguaggagcagcuauagccgcaccaguagcuggccaacaaaauguaauagacccauggauaagaaauaacuuuguacaagcaccaggaggagaauuuaccguaucaccaagaaacgcuccaggagaaauauuauggucugcuccauuaggaccagaucuaaauccuuaucuuucacauuuagccaggauguauaacggauacgcaggcgguuuugaaguacaaguaauucucgccggaaaugcauuuaccgccggaaaaguaauauucgcugcaguaccaccaaacuucccuacagaaggccuaucacccucucaaguaaccauguuuccucacauaguaguagacguaagacaacuagaaccaguauuaauaccauuaccugauguacguaauaauuuuuaccacuacaaucaaucaaaugacccuaccauaaaauuaauugccauguuauacacaccacuacgugccaauaacgcaggagacgauguuuucaccguuucaugucgaguacuaacaagaccuuccccagauuuugacuuuauauucuuaguaccaccaacaguagaaucaagaacuaaacccuucucaguaccaguauuaacaguagaagaaaugacaaauucuagauuuccuauaccucuagaaaaauuauuuacaggaccaucauccgcuuucguaguccaaccacaaaacgguagaugcacaacagauggaguucuucuaggaacuacacaauuaaguccagucaacauaugcaccuucagaggugauguaacucauaucacaggcucaagaaacuacacaaugaaucuagcaucucaaaauuggucaaauuaugacccaacugaagaaauaccagcuccacuagguaccccagauuuuguagguaaaauacaaggagucuuaacacaaacaacaagaacagacgguucuacucggggacauaaagcaacaguauacacuggaucagcagacuuugccccaaaauuagguagaguacaauucgaaacagauacagaucacgauuucgaagccaaucaaaauacuaaauuuacaccaguaggaguaauacaagacggggguacuacucacagaaaugaaccacaacaaugggucuuaccaucauauucaggaagaaauacaccaaacguacacuuagcuccagcaguagcaccaacauuucccggagaacaacuccuauucuuuagaucaacaaugccaggauguucaggauauccaaauauggaucuagauugcuuacuaccucaagaauggguccaauauuucuaccaagaagcagccccugcacaaucagauguagcauuauuaagauucgucaacccagacacaggaagaguauuauucgaaugcaaacuccauaaaacaggauauguaacaguagcacauacaggucaacacgauuuagucaucccaccuaacggauauuuucguuuugauucaugggucaaucaauuuuauacacuagcccccaugggaaacgguaccggcagaagaagauaa

SEQ ID NO: 34321 - RNA, 1617 nt, Artificial Sequence
  derived and/or modified sequence opt6 from VP1__Norovirus_and/or_Norovirus-like__KM982953
augaaaauggcaucuucagacgcaaauccuucagacggaucugcagcaaaucuaguaccugaaguaaauaaugaaguaauggcacuagaaccuguagucggagcagcaauagcugcaccuguagcuggccaacaaaacguuauagacccauggauucgaaauaacuuuguucaagcaccaggaggagaauuuacaguaagcccuagaaaugcaccuggagaaauuuuauggagugcacccuuagguccagaccuuaaccccuacuuaucacacuuagcacguauguacaacgguuaugccggaggauuugaaguacaaguaauauuagcaggaaaugcauuuacagcaggaaaaguaaucuucgcagcuguaccaccuaacuuuccuacagaaggucuuucaccaagucaaguaacgauguuuccucacauaguaguagacguaagacaacuagaaccaguacuaauaccauuacccgacguacgaaacaacuucuaucauuauaaucaaacaaacgaucccacuauaaaacuuauagcaaugcuauacacuccucuacgagcaaacaaugcaggagacgauguauucacaguaaguugucgaguacuuacccgcccaagcccagauuuugacuuuauauuuuuaguaccaccuacaguagaaucaagaacaaaaccauuuucuguaccuguauuaaccguugaagaaaugacuaauucuagauuuccaaucccacuagaaaaauuauuuacugguccaucuuccgcuuuuguuguacaaccacaaaacggacgaugcacaaccgacggaguuuuauuagguacaacacaauuaucacccguaaacauauguacauucagaggcgauguaacccauauuacaggcucaagaaauuauacuaugaauuuagcuucucaaaacuggaauaauuacgaccccacugaagaaauaccagcaccauuaggaauacccgacuuuguagguaaaauacaaggaauguuaacucaaacaacaagaacugacggaucaacaagaggacacaaagcaacaguauauaccggaucuguugauuuugcaccaaaacuuggucgaguccaauuugaaaccgacacugaucaugauuuugaagcaaaucaaaauaccaaauuuacaccaguaggcguaauacaagauggaucuacaacacaucgaaaugaaccucaacaauggguacuaccaagcuacucaggaagaaacacaccaaauguucauuuagccccagcaguagcuccaacauuucccggagaacaauuacuuuucuuuagaucaaccaugcccggaugcucuggauaccccaauauggacuuagacuguuuauuaccacaagaauggguacaauacuuuuaucaagaagccgccccugcacagucugauguagcacuucuacgauuuguaaauccugauacaggacgaguucucuuugaauguaaacuacauaagucaggcuaugucacggucgcacauacuggacaacaugauuuaguaauaccuccaaauggauacuucagauuugauuccugggucaaucaauuuuacacauuagcaccaaugggaaaugguacagguagacgaagauaa

SEQ ID NO: 34322 - RNA, 1617 nt, Artificial Sequence
  derived and/or modified sequence opt6 from VP1__Norovirus_and/or_Norovirus-like__KM982936
augaaaauggcuucaagcgaugcaaacccaucagacggaagugccgccaaccuuguaccagaagucaauaaugaaguauuagcacuggaacccguaguaggugcugcaauagcagcaccaguugcaggucagcaaaauguaauagauccauggauccgaaauaauuuuguacaagcaccaggaggagaauuuacuguaucaccaagaaaugcacccggagaaauacuauggagugcaccccuaggaccagauuuaaaucccuaucuaucccauuuagcuagaauguacaacggauacgcaggaggauuugaaguacaggucauccuugcaggaaaugccuuuacagcaggaaaagucauauucgcagcaguaccaccuaacuuccccacugaaggauuauccccaucacaagucacaauguuuccucacauaguaguagauguaagacaacuagaaccaguuuuaauacccuuaccagauguacggaauaauuucuaccacuauaaccaaucaaacgauccaaccauaaaacucauagcuaugcuauacacaccauuacgagccaacaacgcaggcgacgacguauucaccgucucaugcagaguauuaaccagaccuucaccagauuuugacuuuauauuucuaguaccaccaaccguagaaagcagaacuaaaccuuuuuccguaccuauucuaacaguagaagaaaugacuaauucaagauuuccaauuccauuggaaaaauuauuuacagguccaucauccgccuucguaguccaaccccaaaacggaagauguacaacagauggcguacuacuagguacuacucaauuaucaccaguuaauauuuguacuuuuagaggcgauguaacccauauaacuggaucucacaauuacacaaugaaucuagcaucccaaaauugguccaauuaugauccuacagaagaaauaccagcaccuuuaggcacuccugauuuuguaggaaaaauccagggugucuuaacucaaacaacaagaacagauggaucaacuagaggacacaaagcaacaguauauacaggaucugcagacuucgcaccaaaacuaggacgaguucaauucgaaacagacacagauagagauuuugaagcaaaucaaaauacaaaauuuacuccaguaggaguaauacaagacggagguacuacacaucguaaugaaccucaacaauggguacuaccaucauauagcggacgcaauacaccaaacguacauuuagccccagcaguagcacccacauucccaggugaacaacuauuauucuuuagaucuacaaugccaggaugcucaggauauccuaacauggaucuugauuguuuacuaccucaagaauggguacaauacuuuuaucaagaagcagcaccagcccaaucagacguugcucuacuacgauuuguaaacccagacacaggacgcguauuauucgaaugcaaauuacauaaaucaggcuacguaacuguugcacauacaggacaacacgaucucgucauaccacccaacggauauuuccguuucgauucaugggucaaccaguuuuacacacuagcuccaaugggaaacggaacaggaagacgccgauaa

SEQ ID NO: 34323 - RNA, 1617 nt, Artificial Sequence
  derived and/or modified sequence opt6 from VP1__Norovirus_and/or_Norovirus-like__KM514073
augaaaauggcuagcucagaugcaaacccaagugacggauccgcagcuaaccuuguaccagaaguaaacaaugaaguaauggcccuagaaccaguaguaggagcagcaauugcagcaccuguagcaggacaacaaaauguuaucgauccauggauucguaauaauuuuguacaagcaccaggcggagaauuuacaguaucaccacgaaacgcaccaggcgaaauuuuaugguccgccccacuaggacccgacuuaaauccuuaucuaucucauuuagccagaauguacaauggauaugcaggaggauucgaaguacaaguauuauuagcaggcaacgccuuuaccgccggcaaaguaauauucgcugcaguaccuccaaauuucccaacugaaggauuaucaccaucacaaguaacuauguucccacacauaguaguagauguaagacaacuagaaccaguauuaauaccucuaccagauguaagaaauaauuuuuaucacuauaaccaauccaaugauccaacaaucaaauuaaucgcaauguuauacacaccauuaagagcaaauaaugcuggugacgauguguuuacaguuuccugcagaguauuaacaagaccaagcccagauuuugacuucaucuuucuaguaccaccaacuguagaaucaagaacaaaaccauucaguguaccuguacuaacaguugaagaaaugacaaacuccagauuuccuauaccccucgaaaaacuauucacaggaccaucaucugcauuugucguacaaccacaaaacggccgaugcacaacugacgguguauuauuagguacuacucaacuaaguccaguaaauaucuguacauucagaggagaugucacacacauaacaggcuccagaaauuacacuaugaauuuagcaucacaaaacuggucuaauuacgauccaaccgaagaaauacccgcaccacuaggaaccccagacuuuguagguaaaauacaagguauguuaacacaaacuacaagaacugacggaucaacacgaggacauaaagccaccgucuauacagguucagcagacuuugcaccaaaacuagguagaguacaauuugaaacagauacugaucacgauuucgaagcaaaccaaaacaccaaauucacacccguagguguuauacaagacggaucaacaacacaucgcaaugaaccacaacaauggguccuacccucuuauucagguagaaacacaccuaacguccacuuagcaccagcuguagcaccaacuuuuccaggagaacaacuucuuuucuuucgaucaacuaugccaggauguucuggauacccaaauauggaucuagauuguuuacuuccacaagaauggguacaauauuuuuaccaagaagcagccccagcucaaucagacguagcacuccuacgauuuguaaaucccgauacagguagaguacuuuucgaauguaaacuacauaaauccggauacguuacaguugcccacacuggacaacacgaucuaguuauaccacccaauggauauuuucgcuucgauucauggguaaaucaauucuacacucuagcacccaugggaaauggaacaggacgacgaagauaa

SEQ ID NO: 34324 - RNA, 1617 nt, Artificial Sequence
  derived and/or modified sequence opt6 from VP1__Norovirus_and/or_Norovirus-like__KM268086
augaaaauggcaaguucugaugcaaaccccagugacgguucugcugccaaccuugucccagaaguaaauaaugaaguaauggcauuagaaccaguagucggugcagcuauagcagccccagucgcaggucaacagaauguaauagacccauggaucagaaauaacuuuguucaagcaccaggaggagaauuuacaguuucaccaagaaacgcaccuggagaaauacuuuggucugccccauuaggaccugaccuaaacccuuaucuaucucauuuagcaagaauguauaauggauacgcaggagguuuugaaguacaaguaauuuuagcuggaaaugcauuuacagcuggaaaagucauauuugcugcaguaccaccuaauuuuccaacugaaggauuaaguccaucacaaguaacuauguucccacacauaguaguugacguaagacaacuagaaccaguucuaauuccauuaccagauguuagaaacaacuuuuaucauuauaaccaaucuaaugauccaacaauaaaauuaaucgcaauguuauacacucccuuaagagcuaauaacgcaggagacgauguauuuaccguaucauguagaguccuagccagaccaucaccagauuucgacuucauauuucuaguaccaccuacaguagaaucacgaacaaaaccuuuuucuguacccguacuaacaguugaagaaaugaccaauucacgauucccaaucccauuagaaaaauuauuuacuggaccaucaucugcguucguaguacaaccucaaaauggaagauguaccacugauggaguauuauuaggaacuacacaauuaaguccaguaaauauauguacauuuagaggagauguuacucauauaacaggaagucgcaacuauacaaugaauuuagcaucacaaaacuggucaaauuaugauccaacagaagaaauaccugccccauuaggaacaccugauuuuguaggaaaaauucaaggagucuuaacacaaacaaccagaaccgauggaucuacaagaggacacaaagcaacagucuacacaggaucugcugacuuugcaccaaaacucgguagaguacaauucgaaaccgacacagaucacgauuucgaagcaaaucaaaauacaaaauucacaccaguaggaguaauucaagacggcucaacgacacaucgaaacgaaccucaacaauggguacuuccuucuuauucagguagaaacacaccaaauguucaccuagcaccagcaguagcaccaacuuuuccaggagaacaacuacuauucuuuagaucaacaaugcccggauguaguggauaucccaauauggaucuagacugcuuauuaccucaagaauggguacaauacuuuuaucaagaagcagccccagcacaaucagacguagcccuacuacgauuuguuaauccagacacugggagaguauuauuugaauguaaauuacauaaaucaggauacgucacaguagcacauacaggucaacaugaucuaguaaucccaccaaacggauauuuccgauuugauucuuggguaaaucaauuuuacacacuagcaccaaugggaaauggaacaggaagaagaagauaa

SEQ ID NO: 34325 - RNA, 1617 nt, Artificial Sequence
  derived and/or modified sequence opt6 from VP1__Norovirus_and/or_Norovirus-like__KM198552
augaaaauggcaucuaaugacgcgaacccuucagauggaagcgcagccaacuuaguaccagaaguaucaaaugaaguuauggcacuagaaccaguuguaggagcagcuauagcagcaccaguagcaggucaacaaaaugucauagacccauggauaaggaauaacuucguacaagcaccaggcggcgaauuuacaguaagcccaagaaaugcucccggagaaauacuauggucagccccuuuaggaccagaucuaaacccauaccuaucacacuuagcacguauguauaauggauaugcaggaggauucgaaguacaaguaauauuagcaggaaaugcauuuacagcuggaaaaauaaucuucgccgcuguaccaccaaacuuuccaacagaaggacuaucaccaucacaaguuacaauguuuccucacauuauaguagacguaagacaacuagaaccaguuuuaauaccauuacccgauguccgaaauaauuucuaccauuacaaccaaacaaaugauucaacaauaaaacuaauagccaugcuauauacaccacuuagagcaaacaaugcaggagaagacguauuuacaguaucauguagaguauuaacacgccccucaccagauuuugacuucauuuuucuagugccacccacaguagaaucacgaacaaaaccauucacugucccaauccucacuguagaagaaaugacuaauucaagauuucccauacccuuagaaaaacucuuuacaggaccaucaggagcuuuuguaguacaaccacaaaacggaagauguacaacagacggaguacuauuaggcacaacucaauuaucaccuguaaauauuuguacauuuagaggagacguaacacauauagcagguucuagaaacuauacaaugaaucuagcaucaauaaacuggaacaauuaugauccuaccgaagaaauaccagcaccacuaggaacaccagacuuuguuggaaaaauacaagguguacuuacacaaacaacaaaaggugauggcucuacacgaggacauaaagcaacagucuauacaggauccgccccauuuacaccaaaacuagguucaguucaauucucaacagauacugaaaacgauuucgaaacacaucaaaacaccaaauucacaccuguaggcguaauccaagauggugguacuacacauagaaaugaaccucaacaguggguauuaccuucuuauucaggacgagacguacauaacguacaccuagcaccagcaguagcuccaacauuucccggcgaacaacuauuauuuuucagaucuacaaugccaggauguuccggauauccuaacauggaucuagauugccuauuaccacaagaauggguacaacauuucuaucaagaagccgcacccgcacaauccgaugcagcauuacucagauuuguuaacccugacacaggaagaguccuauucgaaugcaaacuacacaaaucuggcuauguaacagucgcccacacaggacaacaugacuuagucaucccuccaaacggauauuucagauucgauuccuggguaaaucaauucuacaccuuagcaccaaugggaaaugguacuggaaggagacgcuaa

SEQ ID NO: 34326 - RNA, 1617 nt, Artificial Sequence
  derived and/or modified sequence opt6 from VP1__Norovirus_and/or_Norovirus-like__KJ716358
augaaaauggcaucauccgacgcaaauccaucagaugguucagcagccaaucuaguaccagaaguaaauaacgagguaauggcauuagaaccaguaguaggugcagcaauagcagcaccaguagccggacaacaaaauguaauagauccauggauaagaaacaacuuuguucaagcuccaggcggagaauuuacaguaucaccacgaaacgcaccaggagaaauauuauggagcgcaccauuaggaccugaucuuaauccauaccuuucacaucuagcaagaauguauaacggauacgcuggaggauuugaaguacaagucauacuugcaggaaaugcauucaccgcaggaaaaguaauauucgcugcaguuccaccgaauuucccaacagaaggauuaucaccaagucaaguaaccauguucccacauauaguuguugacguccgacaacuagaaccaguauuaauaccacuaccagacgucagaaauaauuucuaucacuacaaccaaucaaaugacccaacaauaaaauuaauagcaaugcuguauacaccauuaagagcaaauaaugcaggcgaugacguauuuacaguaucauguagagucuuaacacguccaucaccagacuuugauuucauauuucuuguuccaccaacaguugagucaagaaccaaaccauuuuccguuccaguacuaacaguagaagaaaugaccaacucaagauuuccaauuccauuagaaaaacuauuuacaggaccuucaucagcauuuguaguucaaccacaaaacgguagauguacaacagauggaguacuccuaggaacaacucaacuaaguccaguuaauauauguacuuuucgaggagcaguuacccauauaacaggcucuagaaauuauacaaugaaucuagcaucacaaaacuggucaaauuaugauccuaccgaagaaauaccagcaccacuaggaacacccgacuuuguugguaaaauacaagguguucuaacacaaaccacccgaacagacggaucaacaagaggacacaaagcaacuguauauacaggaucagcugauuuugcaccaaaacucggcagaguacaauuugaaaccgauacagauagagacuuugaagcaaaucaaaauacaaaauucacaccaguagguguuauacaagauggaucaacaacacacagaaaugaaccacaacaauggguauuaccaucauacagcgguagaaacacaccuaauguucaccuggcuccugcaguagcaccuacauuuccaggagaacaacuauuauucuuuagaucaauaaugccgggcuguagcggauaccccaacauggaccuugauugccuauuaccccaagaauggguccaauauuuuuaccaagaagcggcaccagcucaauccgauguugcacuacuacgauuuguaaacccagauacaggaagaguauuauuugaauguaaauuacacaaaucaggauauguaacaguagcccacacuggucaacacgauuuaguaauaccaccaaacgguuauuuuagauuugacuccuggguaaaucaauuuuacacccuagcaccuaugggcaaugggacuggaagaagaagauaa

SEQ ID NO: 34327 - RNA, 1617 nt, Artificial Sequence
  derived and/or modified sequence opt6 from VP1__Norovirus_and/or_Norovirus-like__KJ649702
augaaaauggcaucaucagaugcaaauccaagugacggaucagccgcaaaccuaguaccugaaguaaacaaugaaguaauggcacuagaaccaguaguaggagcagcaauugcugcaccaguagcaggacaacaaaauguaauagauccauggauucgaaauaacuucguacaagcaccaggcggugaauuuaccguaucaccccgaaaugcaccaggugaaauacuuuggucagcaccauuaggccccgauuuaaauccauaccuaucacaucuagcaagaauguauaacggauacgccgguggauucgaaguacaaguaauacuagcaggaaacgcauuuacagcaggaaaaguaaucuucgcugcaguaccacccaacuuccccaccgaaggacuuucuccaucacaagucacaauguucccacacauaguaguagacguuagacaauuagaaccaguucuaaucccauuacccgauguaagaaacaauuucuaucacuauaaccaauccaacgauccaacaauaaaacuaauagcaauguuauacacaccacuucgagcaaauaaugcaggcgacgauguauucacaguaucauguagaguucuaacuagaccuuccccagauuuugacuuuauauuuuuagucccaccaacaguagaaagccgaacaaaaccuuucucaguaccaguacuaacaguugaagaaaugacaaacucaagauuuccaauaccacucgaaaaauuauuuacaggaccaucauccgccuucguaguccaaccacaaaauggaagauguacaaccgauggaguccucuuaggaacaacccaauuaucccccguaaauauuugcacauuuagaggugacguaacacauauaacuggaucuagaaauuacacaaugaacuuagcaucacaaaacuggucuaauuaugaccccacagaagaaauaccagcaccauuagguacccccgauuuuguaggaaaaauacaagguaugcuuacacaaacaacacgcacugacggaucaacaaggggccacaaagcaacuguauauacaggaucagcagacuuugcaccuaaacuaggacgaguacaauucgaaacagauaccgauagagacuucgaagcuaaucaaaauacaaaauucaccccaguaggaguaauacaagauggaucaacaacacaucguaacgaaccucaacaauggguccuaccaucauauuccggaagaaauacacccaauguccacuuagcuccugcaguagcaccaacauuuccaggagaacaauuacuauucuuuaggucaacaaugcccggauguuccggauacccaaacauggauuuagauuguuuauuaccccaagaauggguacaauacuuuuaucaagaggccgcucccgcacaaucugacguugcacuacuacguuucgucaauccagacacaggcagaguauuauucgaaugcaaauuacacaaaucaggcuacguuacaguagcccauacuggacagcaugaucuaguuauaccaccaaacggauauuuccgauucgauuccugggucaaucaauucuauacacuggcaccaaugggaaaugggaccggacgucgacgauaa

SEQ ID NO: 34328 - RNA, 1617 nt, Artificial Sequence
  derived and/or modified sequence opt6 from VP1__Norovirus_and/or_Norovirus-like__KF429778
augaaaauggcauccagcgaugcaaacccaucagauggcucaacugcaaacuuaguaccugaaguaaacaacgaaguaauggcauuagaaccaguagucggagccgcaauagcugccccaguagcaggacaacaaaauguaauagauccuuggauaagaaauaacuuuguucaagcccccggaggcgaauuuacaguaucaccuagaaacgccccaggagaaauauuauggucagcaccccuagguccagauuuaaacccauaucuaucacauuuagcaaggauguacaacgguuaugcaggaggauucgaaguccagguaauauuagcuggaaacgcuuucacagcuggcaaaauaauauucgcagcaguucccccaaauuuuccaaccgaaggacuuuccccaucucaaguaacaauguucccacauauaauuguagauguaagacaauuagaaccaguucuuauaccacuuccagauguucgcaauaauuucuaucacuacaaccaaucaaacgacccaacaauaaaacuaauagcaauguuauacaccccucuacgagcaaacaacgcaggcgaugaugucuuuacaguuucauguagaguacucacucgcccaucaccagacuuugacuuuauauuuuuaguaccaccaacaguagaaucaaggacaaaaccauucucaguaccaguacuuacaguagaagaaaugacaaauucacgauuuccuauacccuuagaaaaauuauucaccggaccaucaucugccuuuguaguacaaccacaaaauggacgauguacaaccgaugguguacuacuagguacuacucaauuaucuccaguaaacauuuguacauuuagaggcgacguuacacauauagccggaucaagaaacuauacaaugaaucuagcaucacaaaacuggaacucuuacgauccaacagaagaaauaccagcaccuuuaggaaccccagauuucguaggaaaaauucaaggaguacucacacagacaacuagaaccgacggauccacucguggacacaaagcaacaguauauaccggauccgccgacuuuucaccaaaauuaggaagaguccaauuugcaacagauacagauaaugauuucguaacaaaucaaaauacaaaauuuacaccagucggcguuauacaagacggaggaaccacaccaagaaaugaaccucaacaauggguccuacccucauacucaggaagaaacacacauaauguacaccuagcaccagccguagcaccaacauuuccaggugaacaacuacuuuucuucagaucaacaaugccaggaugcucaggauauccuaauauggauuuagacugcuuauuaccacaagaauggguacaauauuucuaccaagaagcagcuccugcacaaucagacguagcauuacuaagauucguuaacccagauacgggaagaguauuauucgaauguaaacuucauaaaagcgguuauguaacaguagcacauacaggacaacacgacuuaguuauaccuccaaauggauauuucagauucgauucuuggguuaaucaauuuuacacucuugcaccaaugggaaauggcacaggaagacgacgauaa

SEQ ID NO: 34329 - RNA, 1617 nt, Artificial Sequence
  derived and/or modified sequence opt6 from VP1__Norovirus_and/or_Norovirus-like__KF060113
augaaaauggcaucaucagaugcaaaccccucagauggaucugcagcuaacuuagucccugaaguuaacaaugaaguaauggcucuagaaccaguaguaggagcugcaauagcagcacccgucgcuggccaacaaaauguaauagauccauggauaagaaauaacuuuguacaagcaccuggaggagaauuuacaguauccccaagaaaugccccuggagaaauacucugguccgcaccacuaggaccagaucuuaacccauaucuaucucaucuagcccgaauguauaacggauaugcaggaggauucgagguucaaguaauuuuagcaggaaaugcauucacagcaggaaaaguaauuuuugcugcaguaccaccuaacuucccaacugaaggacuaucaccaucacaaguuacaauguucccacacauaguaguagauguacgacaacuagaaccaguucuaauaccauuaccagauguuagaaacaauuuuuaucacuauaaccaaucaaaugauccaacaauuaaacuaauagcaaugcucuauacuccacuaagagcaaacaaugccggagaugacguauucacaguuuccuguagaguacucacacgaccaucaccagacuucgacuucauauucuuaguuccaccaacaguagaaucucgagcaaaaccauucucagucccugucuuaaccgucgaagaaaugacuaauucacgauucccaauaccacuagaaaaauuauuuacagguccaucauccgccuucguaguacaaccucaaaauggcagauguacuaccgauggcguauuauuagguacuacccaacuauccccagucaauauauguacauucagaggagacguaacacauauaacuggaucacgaaauuacacaaugaaccuagcuucacaaaacuggagcaauuaugauccaacugaagaaaucccagcaccacuaggaacaccagauuucguaggaaaaauacaaggaguacuaacacaaacuacucgaacagauggcucuacaagaggucacaaagcaacaguauauacuggauccgcagauuucgcuccaaaauuaggaagaguacaauucgaaaccgacacagaucacgauuuugaagcuaaucagaauacaaaauucacaccaguuggaguaauccaagacggaucuacaacacacagaaaugaaccacaacaauggguucuaccaucauacagugguagaaauacaccaaauguucaucucgcaccagcaguagcaccuacauucccaggugaacaacugcuauuuuucagaucuacuaugccaggcuguucugguuauccaaacauggaccuagacuguuuauuaccacaagaauggguccaauauuucuaucaagaagcugcaccagcacaauccgacguagcauuacuaagauuuguaaacccugauacaggcaggguacuuuucgaaugcaaacuacauaaaucugguuauguaacuguagcucacacaggucaacacgaucucguaauaccacccaauggauacuuuagauucgacucauggguaaaccaauucuauacacuagcacccaugggcaacggaacuggaagaagacguuaa

SEQ ID NO: 34330 - RNA, 1617 nt, Artificial Sequence
  derived and/or modified sequence opt6 from VP1__Norovirus_and/or_Norovirus-like__KF060106
augaaaauggcaucaucagacgccaacccauccgacgguucuaccgcuaacuuaguaccugaaguaaacaaugaaguaauggcacuagaaccaguaguaggcgcugccauagcagccccuguagcaggacaacaaaauguaauagauccuuggauacgcaacaacuucguucaagccccaggaggagaauuuacaguuucuccaagaaaugccccaggagaaauauuauggucugcaccauuaggaccagauuuaaaucccuaucuaucccaccuagcgagaauguacaaugguuacgcaggaggcuucgaaguacaaguaguuuuagcaggaaaugcauucacagcuggaaaaauaauuuucgcagcagugcccccuaauuuucccacugaaggauuaucuccaucucaaguaaccauguucccacacauaauaguugacguuagacaacucgaacccguacucauaccacuaccagacguucgaaacaauuucuaccauuauaaucaaucaaaugauccaacuauaaaacucauagcaauguuauacaccccauuacgugccaacaaugcaggagacgacgucuucacuguuuccugucgaguacuaacaagaccaagcccagauuuugauuucauauuucuaguuccaccaacaguagaaucaagaacaaaaccuuucucuguaccuguacuaacaguagaagaaaugacuaauucccgauucccaauaccccuagaaaaauuauucacuggcccuuccucagcuuucgucguacaaccccaaaacggaagaugcacaacagacggaguacuauuaggaacaacacaacucuccccaguuaauauaugcacauuccgaggagacguaacacauauaucaggaucaagaaauuauaccaugaaucuagccucacaaaauuggaauaguuacgaccccacagaagaaaucccugccccauuaggaaccccagacuuuguuggaaaaauucaaggaguacucacccaaacuaccagaaccgauggaucaacuagaggacacaaagcuacuguuuauacaggaucagcagacuuuucaccaaaauuagguagaguacaauuugcaacagauacagauaacgauuuuguuacaaaucaaaauaccaaauucacaccuguaggaguaauccaagauggcucuacaacaccacguaacgaaccacaacaauggguacuaccaucauacucuggcagaaacacacauaauguacaccuagcaccagccguagcuccaacguucccaggcgaacaacuacuauucuuucgaagcacaaugccaggaugcucaggauauccaaauauggaucuagacugcuuacucccacaagaauggguacaauauuucuaccaagaagcagcuccagcccaaucugacgucgcacuacuaagauuuguaaauccagauacuggaagaguacuauucgaauguaaauuacauaaaucagguuacguaacugucgcucauacaggacaacaugaucuaguaauaccaccaaacggcuacuuuagauuugauucuuggguaaaucaauuuuauacacuagcaccaaugggaaacggcacaggaagaagacgcuaa

SEQ ID NO: 34331 - RNA, 1617 nt, Artificial Sequence
  derived and/or modified sequence opt6 from VP1__Norovirus_and/or_Norovirus-like__KF060100
augaaaauggcaucaucagaugcaaauccaucagauggcaguacagccaacuuaguuccagaaguaaacaaugaaguaauggcacuagaaccaguaguaggcgcagcaauagcugcaccuguagcaggacagcaaaauguaauagaccccuggauaagaaauaauuucguacaagcaccaggcggagaauuuacaguauccccacguaaugcaccaggagaaauccuauggucugcuccguuagguccugauuuaaauccauauuuaucacacuuagcacguauguacaauggauacgcaggaggauuugaaguacaaguaauauuagcaggcaaugcauucaccgcaggcaaaaucauauucgcagcaguaccaccaaauuucccaacagaaggacuaucaccaucccaaguaacaauguucccacauaucaucguagacguaagacaacucgaaccaguacuaauuccauuaccagauguaagaaauaauuuuuaccacuauaaucaauccaaugauccaacaauuaaacuaaucgcaauguuauauaccccacugagagcaaauaacgcaggagacgauguauucaccguaucuugucgaguacuaacaagaccaaguccagacuucgauuuuauauuuuuaguaccaccaacuguagaaucaagaacuaaacccuuuucuguaccaguacuaacaguagaagaaaugacaaacaguagauuuccaauacccuuagaaaaacuauuuacugguccaucaucagcauucguaguacaaccccaaaauggaagauguacaacagauggcguauuacuagguaccacccaauuaucaccagucaauauauguacauucagaggcgaugugacacauauauccggcucacacaauuacacaaugaaccuagcaucacaaaauuggaacuccuaugauccaaccgaagaaauaccugccccacuuggaacaccugacuuuguagguaaaauacaaggaaugcucacacaaacaacaagaacugacggaucuacaagaggucacaaagcaacaguauauacaggcucaguugacuuuucaccaaaauuaggccgaguacaauuuacaacugauacagauaaugauuuugaaacaaaucaaaauacgaaauucacaccuguuggcguaauacaagacggaagcacgacacauagaaaugaaccucaacaauggguacuccccucauauuccggacgaaauacacauaauguccacuuagccccugcaguagcaccuacauuccccggugaacaacuuuuauucuuuagaucaacuaugcccggauguucaggauauccaaauauggaucuagauugcuuacuaccacaagaauggguccaauauuuuuaucaagaagcugcaccagcucaaucagauguagcauuacuacgauuuguuaacccagacacaggccguguacuauucgaaugcaaacuacacaaaagcggcuacguaacuguagcacacacaggacaacacgauuuagucauaccaccaaacggcuauuucagauucgauucuuggguaaaucaauuuuacacacuagcaccaaugggaaauggaacaggacgaagaagauaa

SEQ ID NO: 34332 - RNA, 1617 nt, Artificial Sequence
  derived and/or modified sequence opt6 from VP1__Norovirus_and/or_Norovirus-like__KF060069
augaaaauggcaagcucagacgcuaaccccuccgauggaucaaccgcaaauuuaguuccugaaguuaauaacgaaguaauggcacuagaaccaguaguaggcgcagcuauagcagcaccaguagcuggacaacaaaaugucaucgaucccuggauaagaaauaacuuuguacaagcaccaggaggcgaauuuacagucagcccaagaaacgccccaggagaaauuuuauggucagcuccauuaggacccgaucuaaaucccuauuuaucacauuuagcaagaauguauaacggauacgcaggaggauucgaaguacaaguaauucuagccggaaaugcauuuacagcaggaaaaauaaucuuugcagcuguuccaccaaacuuuccaacagaaggcuuaucaccaucucaaguuacaauguuuccacauauuauugucgauguacgacaauuagaaccaguucuaauaccauuaccagauguaagaaacaauuucuaucacuacaaccaaucaaacgauccaacaauaaaacuuauagcuaugcuauacacaccauuaagagcaaacaacgccggugacgacguauuuacuguuucaugcagaguccucaccagaccuucaccagacuuugauuuuauauuucuaguuccacccacagucgaaucaagaacaaaaccauucucaguaccagucuuaacaguagaagaaaugacaaacucaagauuucccauuccauuagaaaaauuauuuacaggcccaucuuccgcauucgucguacaaccacaaaacggaagauguacuacagacggaguauuauuaggcacaacucaauuaucaccaguaaauauauguacauuuagaggugauguaacccauauaucagguucacacaauuauacaaugaaucuagcaucacaaaacuggaacucauacgauccaacugaagaaauaccagcaccacuagguacaccugauuuuguaggaaaaauacaaggaguacuaacucaaaccacacgaaccgacggaucaacaagaggucacaaagcaacaguauacacagguuccgcugacuuuucaccaaaauuaggcagaguccaauucgccacagacaccgacaaugauuucguaacaaaucaaaacacaaaauucacucccguuggaguaauacaagaugguucaacaacaccaaggaacgaaccacaacaauggguauuacccucauacucaggucgaaauacacauaauguacauuuagccccugcagucgcaccaaccuucccaggagaacaacuauuauucuuuagaucaacaaugccaggauguaguggcuauccuaauauggaccuagauugucuacuaccacaagaauggguacaauauuucuaucaagaagcagcaccagcacaaucugauguagccuuauuaagauucgucaacccagauacaggcagaguccuauuugaaugcaaacuacauaaaucaggauauguaacaguagcacauacaggacaacaugauuuaguaauaccuccaaauggauauuucagauuugauucauggguuaaucaauucuacacacuagcuccaaugggaaacggaacuggacguagacgauaa

SEQ ID NO: 34333 - RNA, 1617 nt, Artificial Sequence
  derived and/or modified sequence opt6 from VP1__Norovirus_and/or_Norovirus-like__KF060055
augaaaauggcuucuucagacgccaauccaucagaugguucuaccgcaaaccuaguaccugaaguaaacaaugaagucauggcacuagaaccaguaguaggugcugcaauagcagcuccaguagcuggacaacaaaacguaauagacccauggauuagaaauaauuuuguacaagcaccuggaggagaauuuacaguuagucccagaaaugcuccaggagaaauacuauggagcgcuccucuaggacccgaucuuaauccauaccuaucacacuuagcaagaauguacaacggauaugcuggagguuucgaaguacaaguaauacuagcaggaaacgcauuuacagccggaaaaauaauauuugcagcaguucccccaaauuuuccaacagaagguuuaucaccaucacaaguaaccauguucccacacauaauaguagacguucgacaacucgaaccuguauuaauuccacuuccagauguucgaaacaauuuuuaucauuauaaucaaagcuacgaucccacaauaaaacuaauagcuaugcuauacacaccucuccgagcaaacaaugcuggagacgacguauuuaccguaucauguagaguacucacaagaccaucaccggacuuugacuucauauuuuuaguaccgccaacuguagaauccagaacaaaaccuuucaguguaccuguacuaacaguagaagaaaugacaaacucaagauuccccauaccccuagaaaaacuauucacaggaccaucaagugcauuugucguacaaccccaaaacggacguuguacaacagacggaguccuauuaggaacaacacaacuaucaccuguuaacauauguaccuuuagaggagauguaacacauaucccaggcucccauaauuacacuaugaacuuagcaagccaaaauuggaacucuuaugauccuaccgaagaaauacccgcaccuuuaggaacacccgacuucguagguaaaauacaaggaguucuaacacaaacuacaaaaacaaacggaucuacaagaggacauaaagccacuguauauacaggaucagcagacuuuuccccaaaauuaggcaggguacaauucgcaaccgauacaaauaacgauuucgaaacaaaucaaaacacaaaauuuacuccaguagguguaauacaagauggcucaacaacaccaagaaacgaaccacaacaauggguucuuccaucuuauagcggaagaaacauacauaacguacauuuagccccugcaguagccccuacauuccccggagaacaacuacuauucuuuagaucaacaaugccaggauguuccgguuauccaaacauggaccuugacugccuacuaccacaagaauggguacaauauuucuaucaagaggcagcuccagcucaaucagacguagcauuacuacgcuucgucaaccccgauacaggaagaguauuauucgaaugcaaauuacauaaaaguggcuacguaacagucgcuuacacaggccaacaugaucuaguaauacccccaaauggcuauuuucgauuugacucauggguaaaccaguucuacacucuagcaccaauggguaaugguacaggccgaagacgauaa

SEQ ID NO: 34334 - RNA, 1617 nt, Artificial Sequence
  derived and/or modified sequence opt6 from VP1__Norovirus_and/or_Norovirus-like__KF060028
augaaaauggccuccucugacgcacauccaucagacggaaguacagccaaucuuguccccgaaguaaauaaugaaguaauggcucucgaaccaguaguuggagcagcaauugcagccccaguggcaggacaacaaaauguaauagacccauggauacgaaauaacuucguccaagccccuggaggagaauuuaccguaucaccuagaaaugcaccaggagaaauauuaugguccgcaccccuagggccagaucuuaauccauaucuaucacaucuugcaagaauguauaacgguuacgcaggaggauucgaaguacaaguaaucuuagcuggaaaugcauucacagcaggcaaaaucauauuugcagccguuccaccaaauuuucccacugaaggacuuucaccaucacaagucacaauguucccacacauaauuguagauguccgucaacucgaacccguauuaaucccacuaccagauguacguaauaacuuuuaucacuauaaucaaucaaaugacccaacaauuaaauuaauagcaauguuauacacaccacuaagagcaaacaaugccggagaugaugucuuuacaguuaguuguagaguucuaacacgacccucaccagacuuugacuuuauauuucuagucccaccaacaguagaaaguagaacaaaaccuuucucuguaccuguuuuaacaguagaagaaaugacaaauuccagauuuccuauuccccuugaaaaauuauucacagguccuucaucagcauuuguaguacaaccacaaaacggaagauguacaacagacggaguacuccuaggaacaacacaacugucaccaguaaauaucuguacauucagaggagauguuacucacaucucaggauccagaaauuacacaaugaaccuagcuucacaaaauuggaacucuuaugauccaacagaagaaauaccagccccucuaggaacaccugacuucguagggaaaauacaaggagucuuaacacaaacaacaagagcagacgguuccacaagaggacauaaagccacaguauauacuggaucagcagauuuuucaccaaaacuuggaagaguacaauucgcaacugauacugacaacgauuuuguugcaaaucaaaauacuaaauuuaccccagucggcguaauacaagacggcuccacaacaccaagaaacgaaccacaacaauggguacucccaucuuauucaggaagaaauacacauaacguacaccuagcuccugcaguagcaccaacauucccaggagaacaacuauuauucuuuagaucuaccaugccaggauguucaggauaucccaauauggaccuagauugcuuauuaccccaagaauggguccaauacuuuuaucaagaagcagcuccugcacaauccgacgucgcacucuuaagauucguaaaucccgauacaggaagaguacucuuugaaugcaaacuacauaaauccggauauguuacaguagcgcauacaggccaacacgaucuaguaauaccaccaaacggauacuuccgauuugauucauggguaaaucaauucuauacuuuagccccaauggguaauggaacuggaagaagacgauga

SEQ ID NO: 34335 - RNA, 1617 nt, Artificial Sequence
  derived and/or modified sequence opt6 from VP1__Norovirus_and/or_Norovirus-like__KF060022
augaaaauggcaucuucagacgcaaaccccucagacggaucaacagcaaacuuaguuccugaaguuaacaaugaaguaauggcguuagaacccguagucggugcugcaaucgcagcaccaguagcaggucaacaaaauguaauagauccauggauuagaaauaacuucguacaagcaccugguggcgaauuuacaguuucaccaagaaaugcaccuggugaaauauuauggucagcaccauuaggaccagaccuuaacccauauuuaucucauuuagcucguauguauaacggauacgcuggaggauuugaaguacaaguaauucucgcaggaaaugcauucacagcaggaaaaauaauuuuugcagcaguuccaccaaacuuuccaacugaaggucuaucaccuucucaaguaacuauguucccucacauuauaguagauguuagacaauuagaaccugucuuaauaccauuacccgacguuaggaauaauuucuaucacuacaaucaaaguaacgacccaacaauuaaacuuauagcuauguuauauacacccuuacgcgcaaacaacgcaggcgacgauguauuuaccguuucaugccguguucuaacacgaccaucaccagacuuugacuuuauauuucuuguaccacccacaguagaaucucgcacuaaaccauucucggucccaguauuaaccguugaagaaaugacaaacucuagauuuccaauacccuuagaaaaacuauuuacagguccaucauccgccuucguaguucaaccacaaaauggcagauguacaacagauggaguucuacuaggaacgacacaacuauccccuguaaauauuugugcauuuagaggagacguaacacacauaucuggaucaagaaacuacacaaugaacuuagccucccaaaauuggaacuccuacgacccuacagaagaaauaccagcuccacuaggaacaccagacuucguaggaaaaauacaaggaaugcuuacacaaacuacuagaacagauggaucaacccgaggacauaaagccacaguauauacuggaagcgccgauuucuccccuaaacuaggcagaguacaauucgcaaccgauacugacaacgauuucguaacaaaucaaaauacaaaauuuacuccaguuggaguaauacaagaugguucaacaacaccaagaaaugaaccucaacaauggguucuacccagcuauuccgguagaaacacucauaacguacaccuagccccagcuguagccccaacauuucccggagaacaacuauuauucuuuagauccacaaugccagguugcucuggauauccaaauauggaccuugacugucuauuaccacaagaauggguacaauauuucuaucaagaagccgcaccagcacaauccgauguagccuuacucagauuuguuaacccggauacuggaagaguacuauucgaauguaaacuacacaaaucuggauacguaacagucgcgcacacuggccaacaugaucuaguuauaccaccaaauggauauuucagauuugacagcuggguaaaucaauucuacacauuagcaccaaugggaaauggaaccggacgaagaagauaa

SEQ ID NO: 34336 - RNA, 1617 nt, Artificial Sequence
  derived and/or modified sequence opt6 from VP1__Norovirus_and/or_Norovirus-like__KC517376
augaaaauggcgucaucagacgccaacccaagcgauggaucagcagcaaacuuagugccugaaguaaacaacgaaguaauggcucuagagccaguaguaggugccgcaauagcagccccaguagcuggacaacaaaacgucauagauccauggauaagaaacaacuuuguacaagcaccagguggggaauuuacaguaucaccaagaaaugcaccaggagaaauacuuuggucggcaccauuagguccagaucuaaauccauaucuaucacauuuagccagaauguauaacggauacgcaggaggauuugaaguacaaguaauucuagcuggaaaugcauuuaccgcaggcaaaguaauuuucgcugcaguuccaccuaauuuuccaacugaaggacuaucaccaucacaaguaacaauguuuccacacauuguuguagacgucagacaauuagaaccaguauuaaucccuuuaccagauguaagaaauaauuuuuaccacuauaaucaaucaaaugaucccacaauuaaauuaauagcuauguuauacaccccucuacgagcaaauaaugcaggagacgauguauuuaccguaucuuguagaguacuaacacgaccaucaccagauuucgacuuuaucuuccuuguuccaccaacaguugaaaguagaacaaaaccauucucaguucccguauugacagucgaagaaaugacaaauucucguuuuccaauaccacuagaaaaacuuucuacaggaccauccagcgcauucgucguacaaccccaaaauggaagauguacaacagacggaguacuacuagguacaacacaacucucacccguaaauaucuguacauuuagaggagauguaacacacaucacuggaucuagaaacuauacaaugaauuuagcuucucaaaauuggaacaacuacgauccaacagaagaaauaccagcuccucuagguacaccugacuucguaggcaaaauccaaggaguauuaacacaaacaacucgaaccgacggauccaccagaggacauaaagcaacuguauacacaggcucagccgauuuugccccuaaacuaggacgaguucaauucgaaaccgauacagaucacgauuucgaagcaaaucaaaauacuaaauuuacaccaguagggguuauacaagacggcggaaccacacauagaaaugaaccacaacaauggguauuaccaucauacucaggaagaaauacacauaauguacaccuagcacccgcuguugcaccaacauucccaggagaacaguuauuauucuuuagaucaacaaugccuggauguaguggcuaucccaauauggauuuagauugccuauuaccacaagaauggguacaauacuucuaccaagaagcagcaccagcacaaucagauguagcauuacuucgauuuguuaauccagacacaggacgagucuuauucgaaugcaaacuucacaaauccgguuacguaacuguagcccacacaggacaacacgaucuaguaauaccaccaaauggcuauuuucguuucgacucauggguaaaucaauuuuauacacuagcaccaaugggaaauggaacuggccgccgaagauaa

SEQ ID NO: 34337 - RNA, 1617 nt, Artificial Sequence
  derived and/or modified sequence opt6 from VP1__Norovirus_and/or_Norovirus-like__KC517374
augaaaauggcaucaucagaugcaaacccaucagauggcucagccgcuaacuuaguaccggaaguaaauaaugaaguaauggccuuagaacccguaguaggagcugcuauugcagcaccaguagcaggucaacaaaacgucauagacccauggaucagaaauaacuuuguacaagcaccaggaggugaauuuacuguaucacccagaaaugcgccaggcgaaauauuauggucagcaccucuagguccagacuuaaauccauaucuaagucacuuagcaagaauguauaacggauacgcaggagguuuugaaguacaaguaauucuagcaggaaaugcauuuacagcaggcaaaguaauauucgcugcaguuccaccaaauuuccccacugaaggacuaucacccucacaaguaacaauguuuccacacauaguaguugacguaagacaauuagaaccaguacuaauaccucuaccagacguaagaaauaauuuuuaucauuacaaucaaucaaacgacccaaccauaaaacuaauagcaauguuauauacaccauuaagagcaaauaaugcaggagacgauguauuuaccguaaguuguagagucuuaacaagaccaucacccgacuuugauuuuauauuucuaguuccaccaacaguagaaucuaggacuaagcccuucucuguacccguacuuacagucgaagaaaugacaaauucuagauuuccaauuccccuugaaaaacuauucacaggaccauccucugcuuucguaguacaaccacaaaacggucguuguacaacagauggaguacuuuuagguacuacucaauuaucaccaguaaauauauguacuuuccgaggagacguaacucauaucacaggcucaagaaauuacacaaugaaucuagcuucucaaaauuggaauaacuacgauccaacagaagaaaccccugcuccauuaggaacaccagauuuugucggaaagauccaaggaguauuaacacaaacaacaagaacagauggauccacacgagggcacaaagcaacagucuacacaggcucugcagacuuugcacccaaacuagguagaguucaauuugaaacugauacagaucacgacuucgaagcaaaucaaaauaccaaauucacuccaguaggaguuauacaagacggaggaacaacucaucgaaaugagccacaacaaugggucuuaccaucauauucaggaagaaauacacacaauguacacuuagcaccagcuguugcaccaacauuuccaggagaacaacuacuauucuuucguucuacaaugccagguugcucuggauacccaaauauggauuuagauugcuuacuuccacaagaauggguacaauauuucuaucaagaagcagcaccagcucauucagauguagcacuacucagauucguaaauccggacacuggaaggguacuauucgaauguaaacuacauaaaucaggauauguaacaguagcacauacaggacaacacgaccuagucaucccaccaaacggcuauuucagauucgauucauggguaaaucaauuuuauacacuagcacccaugggaucagguacaggaagacgccgauaa

SEQ ID NO: 34338 - RNA, 1617 nt, Artificial Sequence
  derived and/or modified sequence opt6 from VP1__Norovirus_and/or_Norovirus-like__KC409308
augaaaauggcauccaaugaugcaaauccaucagauggcuccgcagcaaaccuaguaccagaaguuucuaaugaaguuauggcauuagaaccaguaguaggagcagcaauagcugcaccuguagcaggccaacaaaauguaauagaucccuggauaagaaauaauuuuguccaggcaccaggaggugaauuuacaguaucaccuagaaaugccccaggugaaauccuuuggucagcuccauuaggaccagacuuaaauccuuaucuaucucacuuagcaagaauguauaacggauaugccgguggauucgaaguccaagucauauuagcaggaaacgcauuuacagccggcaaaauaauauucgcagcaguaccaccuaauuuuccaacagaaggcuuaucaccaucacaaguaaccauguuuccucacauaaucguugacguaagacaacucgaaccaguacucauuccacuuccugauguacgcaauaauuucuaucacuauaaccaaacaaacgacucuaccaucaaacuaauagcaauguuauacacaccauuacgagcaaauaaugcaggagaagauguauuuacaguaucaugcagaguacuaacaagaccaucaccagauuuugacuuuaucuuucuaguuccaccuacaguugaaaguagaacuaaaccuuucacaguacccauauuaacaguugaagaaaugacuaacucaagauuuccaauaccauuagaaaaacuauuuacaggaccaagcggagcauuuguaguccaaccacaaaacggcagauguacaacagauggaguauuacuaggcacaacucaacuauccccaguuaacauaugcacauuuagaggagauguuacccauauagcuggaucacgaaauuauaccaugaacuuagcaucauuaaacuggaacaauuaugaucccacugaagaaauaccugcuccucugggaacaccagacuucguaggaaaaauacaaggaguauuaacccaaacaacaaaaggagauggcucaacucguggccauaaagcaacaguauacacaggaucagcaccauuuacaccuaaauuaggaagcguacaauucucaacagacaccgaaaacgacuucgaaacacaucaaaauacaaaauucacuccaguaggaguaauccaagacggaggaacaacucaucguaacgaaccacaacaauggaugcuaccaaguuauuccgguagagauguacacaacguucacuuagcaccagcagucgccccuacauuuccaggagaacaauuacuauucuuuagaucuacaaugccuggaugcuccggauauccaaauauggaucuagauugccuacuaccacaagaauggguacaacauuucuaucaagaagcugcgccugcucaaucugacguagcauuauuaagauucguaaacccagacacaggaagaguauuauuugaaugcaaacuacauaaaucuggauauguaacuguagcacacacaggccaacaugaucuuguaauaccacccaauggcuauuuuagauuugauuccuggguaaaucaauuuuacacacuugcaccaaugggcaauggaaccggacgaagaagauaa

SEQ ID NO: 34339 - RNA, 1617 nt, Artificial Sequence
  derived and/or modified sequence opt6 from VP1__Norovirus_and/or_Norovirus-like__KC175393
augaaaauggcaucuaacgacgcaaacccaucagauggaucagcagcaaaccuaguaccagaaguaucuaaugaagucauggcuuuggaaccgguaguaggagcagcaauagcagcaccuguagcgggacaacaaaacguuauagauccauggaucagaaauaacuuuguucaagcaccaggaggugaauuuaccguuucaccaagaaaugcaccaggcgaaauacuguggucagcaccauuagggccagacuuaaacccauaucuaucccauuuagcaagaauguauaacggcuaugcuggagguuucgaagucagaguaauauuagccggaaaugcauuuacugcuggaaaaaucauauucgcugccguaccaccaaacuuuccaacagaaggucuaucaccaucacaaguuacaauguuuccacacauuauuguugacguaagacaacuagaaccaguacuaauaccacucccagacguucguaacaauuucuaucacuauaaucaaacaaaugauucaacaauaaaauuaauagccaugcucuauacaccauuaagagccaauaaugcuggagaagaugucuuuaccguaucaugcagaguauuaacaagaccauccccugacuuugauuucauauuucucgucccaccuacaguagaaucccgaacaaaaccauucacugucccaauacucacagucgaagaaaugacaaauucaagauuuccuauuccauuagaaaaauuauuuacaggaccaucaggcgcauucguaguccaaccacaaaacgguagaugcacgacagaugguguauuauuagguacaacacaacuuucaccagucuccauauguacauuuagaggagauguaacacauauagccggaucaagaaauuauacaaugaauuuagcaucuuuaaauuggaauaauuacgauccuacugaagaaauaccagcuccacuaggcacaccugauuuuguagguaaaauucaaggaguccuaacacaaacaacaaaaggagacgguucaacaagaggccauaaagcaacaguauauacugguucagcuccauucacaccuaaacuuggaucaguacaauucucaaccgacacagaaaaugacuucgaaacucaucaaaauaccaaauucaccccagucggaguuauccaagauggagggacaacccaucgaaaugaaccacagcaauggguucuaccauccuauucaggaagagacguacauaacguucaucuagcaccagccguagcaccaacauucccaggagaacaauuacuuuucuuuagaagcaccaugccagguugcucagguuacccaaauauggaucucgacugcuuacuaccacaagaauggguacaacauuuuuaccaagaagcagccccugcacaaucagauguagcauuacuaagauuuguaaaucccgacacaggaagaguucuauucgaaugcaaacuacauaaguccgguuauguaacaguagcacacacaggacaacacgauuuaguaauuccaccaaauggcuauuuucgcuucgauucuuggguaaaucaauuuuacacacuugcaccaaugggcaauggaacaggaagacgcagauaa

SEQ ID NO: 34340 - RNA, 1617 nt, Artificial Sequence
  derived and/or modified sequence opt6 from VP1__Norovirus_and/or_Norovirus-like__JX459623
augaaaauggcaucaaaugacccuaacccauccgauggaucagcagcaaaucucguaccggaaguaaacaaugaaguaauggcccuagaaccaguuguaggagccgcaauagcagcaccaguagccggacaacaaaacguaauagacccauggauuagaaauaauuuuguucaagcaccuggaggugaauuuaccguauccccuagaaacgcaccaggcgaaauauuauggucagcuccacuaggaccugauuuaaauccauaucuaucccaucuagccagaauguacaacggauacgcaggaggauuugaaguccaaguaauauuagcugggaaugcauuuacagcgggaaaaauaauauuugcagccguaccaccaaacuuucccacugaaggauuaucaccaucacaaguaacaauguucccccauauaauaguagauguaagacaacuagaacccguuuuaauaccacuacccgacguaagaaacaacuucuaucauuauaaccaaucuaacgauuccacaauaaaacuuaucgcuaugcuguacacaccacuaagagcuaacaaugcaggagaagacguauuuacuguaucauguagaguauuaacaagaccauccccagacuuugacuuuauauuuuuaguaccaccuacuguagaaucaagaacuaaaccuuucaccguaccaauauuaaccguugaagaaaugacaaauucaagauuccccauaccacuagaaaaacuauucacaggacccucaggcgcauucguaguucaaccccaaaacgguagauguacaacagauggaguauuauuagguacaacucaacuaucacccguaaacauauguacauuuagaggagauguaacacacauagcuggcacacgaaauuauacuaugaaucuagcaucauuaaacuggaacaauuaugauccaacagaagaaauaccagcaccauuaggaacaccagacuuugucggaaaaauucaaggaguuuugacacaaacaacaaaaggagauggaucaacaagaggacauaaagcaacuguuuacacaggcagugccccauucacacccaaauuaggaagcguucaauuuagcacugacacagaaaaugauuuugaaacacaucaaaauaccaaauucacaccagucggaguuauacaagauggaggaacaacccaucgaaaugaaccacaacaauggguucuacccuccuauuccggaagaaauguacacaacguacauuuagccccugcaguagcaccaacauuuccaggagaacagcuauuauucuuucgauccacaaugccaggaugcuccggauauccuaauauggaucuagacugucuguuaccacaagaauggguacaacacuuuuaucaagaagccgcaccagcucaaucagaugucgcauuaaugagauuuguuaacccagauacuggacgcguauuauucgaaugcaaauuacacaaaucaggauauguuacaguagcacauacaggacaacaugaucuaguuauaccuccuaacgguuacuuuagauucgacagcugggucaaucaauucuacacacuugcuccaaugggaaaugguacaggacgaagacgauaa

SEQ ID NO: 34341 - RNA, 1617 nt, Artificial Sequence
  derived and/or modified sequence opt6 from VP1__Norovirus_and/or_Norovirus-like__JQ798158
augaaaauggcuucaaaugaugcuaacccuagugauggaucuaccgcgaauuuaguaccagaaguuaauaacgaaguuauggcauuagaaccaguuguaggcgcagcaaucgcagcaccagucgcaggacaacaaaacguaauagauccuuggauaagaaacaacuuuguccaggcaccuggaggagaauuuacaguaucaccaagaaaugccccaggcgaaauuuuauggucagcaccauuaggaccagauuuaaacccuuaccuagcucacuuagcuagaauguauaacggauaugccggaggauucgaaguacaaguuauacuggcaggcaaugcauuuacagcaggaaaaauaauuuuugcugcaguaccaccuaacuuucccacagaaggauuaucaccaucccaaguuacuauguucccacacauaguaguagaugucagacaauuagaacccguucuaaucccauuaccagacguaggaaacaacuucuaccacuacaaccaaaguaaugacccuacaauaaaauuaauagccauguuauauacuccauuaagagcaaacaacgcaggagaagacgucuuuacagucucaugcagaguacuaacaagaccaucaccagacuuugauuuuauauuuuuaguaccaccaacaguagaaucaagaacaaaaccauucaccguaccaauauuaacaguagaagaaaugacaaacucuagauucccaauaccauuagaaaaacuauuuacaggaccaucaggagcuuuugucguacaaccacaaaacggaagaugcacaacugaugguguacuauuaggaacuacacaauuaucacccguaaauauauguacauucagaggagacguuacacauauagcagguacacacaauuacacaaugaaucuugcaucacaaaauuggaauaauuacgaucccacagaagaaauaccagcaccucuaggaacaccagauuuuguaggaagaauacaagguauguuaacacaaacaacacgaggagauggaaguacaagaggacacaaagcaacaguaucaacaggcgauguucacuuuacaccaaaacuuggaucaauucaauuuaauacagacacuaacaacgauuucgaaacaggacaaaauaccaaauuuacaccaguuggaguaguacaagauggaaauggggcacaucaaaacgaaccacaacaauggguacuaccuucauauucagguagaacaggacacaacguacaucuagcaccagcaguagcaccuacauuuccaggagaacaacuauuauucuuuagaucaacaaugccaggaugcucagguuauccgaauaugaaccuagacuguuuacuaccacaagaauggguacaacauuucuaucaagaagcagcaccagcacaaucugauguagcacuauuaagauuuguaaacccagacaccggaagaguacuauucgaaugcaaauuacauaaaucuggcuacguaacugucgcacauacuggacaacaugaucuaguaaucccaccaaauggcuauuucagauuugacucuugggucaaucaauucuauaccuuagcucccauggguaauggaacuggaaggagaagauaa

SEQ ID NO: 34342 - RNA, 1617 nt, Artificial Sequence
  derived and/or modified sequence opt6 from VP1__Norovirus_and/or_Norovirus-like__JQ613566
augaaaauggcaucauccgacgcuaacccaucagauggcucaaccgcuaauuuaguaccagaaguaaauaaugaaguaauggcacuagaaccaguaguaggugcagcuauagcagcaccaguagcaggccaacaaaacguaauugaucccuggauacgcaacaauuuuguccaagcaccaggaggagaauuuacuguaucaccacguaaugccccaggagaaauauuauggucugcaccucucggaccagaucuaaaccccuauuuaucacaccuagcaagaauguacaaugguuaugccggagguuucgagguccaaguaauauuagcaggcaaugccuuuacagcaggcaaaauaauauuugcagcagucccaccaaauuuuccaacagaaggccuaucaccaucucaaguaacaauguucccacauauaauaguugacgucagacaacucgaaccuguucuaauaccauuaccagacguaagaaauaauuucuaucacuacaaccaaucaaaugauccaacaauuaaauuaauagcaaugcuuuauacaccucuaagagcuaacaacgccggugacgauguauuuacaguaagcugccgaguacuaacacgcccaagccccgacuuugacuuuauauuucuaguaccaccuacaguagaaucacguacaaaaccauucaguguacccguauuaacuguugaagaaaugacuaauuccagauuccccguaccacuagaaaaacuauuuacaggaccaucuucagcauucguaguccaaccucaaaauggucgaugcacuacagauggaguuuuauuagguaccacccaauuauccccagucaauauuuguaccuucagaggcgacguaacacauauaccaggauccagaaacuauacuaugaaucuagcaucucaaaauuggaauaguuaugauccuacagaagaaauaccagcaccucuaggcacaccagauuuuguagguaaaauucaaggaguauuaacacaaacaacccgaacuaacggaucaaccagaggccacaaagcaacuguuuauaccggaucagcagauuuuucaccaaaacuaggaagaguacaauuugcaacugauacugauaacgauuuugaaacaaaucaaaauacaaaauuuacuccaguaggcguaauacaagacggaucaacaacaccacgcaaugaaccccaacaauggguacuaccuucauacucaggaagaaauauacauaacguacauuuagcaccagcaguagcaccuacauuuccuggagaacaauuauuauuuuucagaucaacaaugccaggcugcucaggauauccaaauauggaccucgacugccuacuaccacaagaauggguacaauauuucuaucaagaagcagcuccagcacaauccgaugucgcucuacucagauuugucaauccagauacaggaagaguccucuuugaaugcaaacuucauaaaucaggauauguuacagucgcacauacaggacaacaugaccuaguuauacccccaaauggauauuuuagauucgacucaugggucaaucaauucuacacacuugcaccaaugggaaacggaacaggacgucgacgauaa

SEQ ID NO: 34343 - RNA, 1617 nt, Artificial Sequence
  derived and/or modified sequence opt6 from VP1__Norovirus_and/or_Norovirus-like__AB541287
augaaaauggcaucaaaugaugcaaaucccucugauggaucagcagcaaacuuaguaccagaagucaacaaugaaguuauggcauuagaaccaguuguaggugcugcuauagcagcacccguagcaggacaacaaaauguaauagacccauggauucguaauaauuuuguccaggcaccaggaggagaguucacaguaucaccaagaaaugcaccaggcgaaauauuauggucagcaccuuuaggaccugaucuaaacccauaucuaucacacuuagcaagaauguauaauggauacgcaggaggcuuugaaguacaagucguauuagcuggaaaugcauucacagccggaaaaguaaucuucgcagccguaccacccaacuuuccaacugaaggcuuaucaccuucacaaguaacaauguuuccucauauaauaguagacguuagacaacuagaaccaguacuaauaccauuacccgauguaagaaacaauuucuaccacuauaaucaaucaaaugacucuacaauaaaacuuauagcaauguuauacacuccacuacgugcaaacaaugcaggagaagauguauuuaccgucucaugccgaguauuaacacgacccucaccagacuuugacuucauauuucuaguaccaccuaccguagaaucaagaacaaaaccauucacuguacccauauuaacaguugaagaaaugacaaacucacgcuuuccaauuccacucgaaaaauuauuuaccggaccaucuggagcauucgucguccaaccacaaaacggaagauguacaacugacgguguauuauuaggaacaacucaauuaucuccaguaaacauaugcacauucagaggugauguaacacacaucgccggaucaagaaauuacacaaugaaucuugccucauuaaacuggaauaauuaugauccuacugaagaaauaccagcaccacucggaacuccagauuucguaggaaaaauacaagguguacuaacacaaacaacuaaaggcgacggaucuacaagaggucauaaagcaacuguauauacaggcagcacccccuuuacaccuaaacucggaucaguacaauuuucaacagauacagaaaaugauuucgaaaaucaucaaaauacaaaauucacuccaguaggagucauacaagauggaggaacaacacacagaaaugaaccucaacaauggguacucccgaguuauucaggacgaaacguccaaaacguacaucuagcuccagcuguugcuccuacauucccaggagaacaacuauuauucuuuagaucgaccaugccaggauguagcgguuauccuaauauggaccuagauugccuacuaccacaagaauggguacaacauuucuaccaagaagccgcacccgcacaauccgacguggcacuacucagauucguuaacccagacacuggaaggguucuauuugaauguaaacuacacaaaucaggauacgucacaguagcacacacaggacaacacgaucuaguaauaccucccaauggauacuuuagauuugauaguuggguaaaucaauuuuacacucuagcacccaugggcaauggaacuggccgaagaagauaa

SEQ ID NO: 34344 - RNA, 1617 nt, Artificial Sequence
  derived and/or modified sequence opt6 from VP1__Norovirus_and/or_Norovirus-like__AB504320
augaaaauggcuuccaaugaugcuaacccuucagacggcagcgccgcaaacuuaguacccgagguuaauaaugagguaauggccuuagaaccagucgcaggcgcagcaauagcagcaccagucgcaggacaacaaaauguaauagacccauggauaagaaauaauuuuguucaagcaccaggaggugaauuuacaguuucaccaagaaaugcaccaggagaaauccuauggucagcacccuuaggaccugauuuaaacccauaucuaucccacuuagcaagaauguauaacgguuacgccggaggcuuugaaguacaaguaauucuagcuggaaaugccuucaccgcaggaaaaauaauauuugcagccguacccccuaauuucccaacagaaggauuaucaccaucacaaguaacuauguucccacauauuauaguugacguaagacaacuagaaccaguucuaauaccacuuccagacguacguaauaauuuuuaucauuacaaccaaucaaaugacucaacaauaaaacucauagccauguuauauacaccauuacgagcaaauaacgccggugaagauguauucacaguaagcugcaggguacuaacaagaccaucaccagacuucgauuuuaucuuccuuguacccccaacaguggaaucacgcacgaaaccauucacuguaccaauucuaacaguagaagaaaugacuaauucuagauucccaauaccucuagaaaaauuauuuacuggaccgucaggagcauuugucguacaaccucaaaacggaagaugcacaacugacggaguauuacuaggaacgacucaacuaucacccguuaauauaugcacauuucgcggagacguaacacauauugcaggaacaagaaacuacacuaugaacuuagcaucacuaaauuggaauaacuaugacccgacagaagaaauaccugcaccauuaggaacgccagauuucgugggaaaaauacaaggaguauuaacacaaacuacuaaaggagacggaucaacuaggggacauaaagccacaguauauacaggaucugccccuuucacuccaaaauuaggaucaguacaauuuaguaccgacaccgaaaaugauuuugaaacucaucaaaacacaaaauuuacaccaguaggaguaauacaagauggaggaacaacacaccgcaacgaaccacaacaauggguauuaccuagcuauaguggaagaaauguacauaacguacaccucgcaccagcaguagcaccaacauuuccaggugaacaacuauuauucuuuagaagcaccaugcccggauguaguggauacccaaauauggaucuagauugccucuuaccacaagaauggguacaacacuucuaucaagaagcagcaccagcccaaucagauguugcauuaaugagauuuguaaaucccgacacuggaagaguucuauuugagugcaaacuacauaaaucuggcuauguaacaguugcacacaccggacaacacgacuuaguaauaccaccaaauggauacuucagauuugauucaugggucaaucaauuuuauacacuagcccccaugggcaacggcacaggaagaagaagauaa

SEQ ID NO: 34345 - RNA, 1617 nt, Artificial Sequence
  derived and/or modified sequence opt6 from VP1__Norovirus_and/or_Norovirus-like__KU683739
augaagauggcaucaagcgaugcaaauccaucagauggaucagcagcaaauuuaguaccagaaguaaauaaugaaguuauggcacuagaacccguaguaggugcagcaauagcugcaccaguugcaggacaacaaaauguaauagauccauggauuagaaauaacuuuguacaagcaccaggaggcgaguucacaguauccccacgaaaugcuccaggugaaaucuuauggucagcuccacuaggaccagauuuaaauccauaccuaucccaucucgcaagaauguauaacggcuacgcagggggauucgaaguacaaguaauccuagcuggaaaugcauucaccgcagguaaagucauuuucgcugccguaccuccaaauuucccuacugaaggacuuucaccaucucaaguaacuauguucccucacauuguaguugacguuagacaacuagaaccagucuuaauaccuuuaccagacgugagaaauaauuuuuaucacuauaaccaaucaaacgacccaacaauaaaacuuauagcaaugcuuuacacuccauuaagagcaaacaaugcaggagacgauguauuuacuguauccuguagaguacuaacaagaccaucaccagacuuugauuuuauuuuucuagucccaccaacaguagaaucccgaacaaaaccuuuuucuguaccaguauuaacagucgaagaaaugacaaacucaagauucccuauaccauuagaaaaauuauucacuggaccaucaucagcuuucgucguacaaccacaaaaugguagauguacaacugacgguguauuacuaggaacuacccaauuaucuccaguaaauauuuguacauuucgaggagauguuacacauaucacaggaucaagaaauuauacaaugaaucuugcaucacaaaacuggucuaacuaugacccaacagaagaaauaccugcaccccuaggaacacccgacuucguaggcaaaauacaaggaaugcuuacacaaaccacacgaacugauggaaguaccagaggucauaaggccaccguauauacaggaucugcagacuuugccccuaaauuaggcagaguacaauucgaaacagauaccgaccacgauuucgaagcaaaccaaaauacaaaauuuacaccugucggcguuauacaagacggaucaaccacacacagaaacgaaccucaacaauggguucuaccuucauauucaggaagaaacaccccaaauguacaucuugcaccagcugucgcaccaaccuuuccaggagaacaacuucuauucuuucguucuacaaugccaggauguucaggauacccaaacauggaccuugauugccuacuuccacaagaauggguacaauauuuuuaucaagaagccgcacccgcacaaucagacguagcacuacuaagauuugucaauccugacaccggaagaguacuauucgaauguaaacuacauaaaucuggauacguaacaguagcacacacaggucaacacgaccuuguuauaccaccaaacggcuauuuuagauuugacucauggguaaaucaauuuuauacauuagcccccaugggaaaugguacaggaagaagaagauaa

SEQ ID NO: 34346 - RNA, 1617 nt, Artificial Sequence
  derived and/or modified sequence opt6 from VP1__Norovirus_and/or_Norovirus-like__KX354146
augaaaauggcaucaucugacgcuaacccaucugauggauccgcugcaaaccuuguacccgaagucaacaaugaaguaauggcauuagaaccaguagucggugcagcaauagcagcuccagucgcuggacaacaaaauguaauagacccauggauaagaaauaacuucguacaagcacccggaggugaguucacaguauccccaagaaacgccccuggagaaaucuuauggucagcaccacuagguccagaccuuaacccauaucuaucccacuuagcaagaauguauaaugguuacgcugguggauucgaaguacaaguaaucuuagcaggcaaugcauuuacagcaggaaaaauaauauuugcugccgucccaccaaauuuuccaacagaaggauuaucuccaucacaaguaaccauguucccacacauaauuguugauguuagacaacuagaaccaguucuaauuccccucccagauguaagaaacaauuuuuaucauuauaaccaaucaaaugaccccacaauaaaacucauagcuaugcuuuacacaccacucagagcaaauaaugcaggagacgaugucuuuaccgucucauguagaguauuaacaagaccauccccagacuuugauuucauauuuuuaguaccaccaacaguagaauccagaacaaaaccauucucagucccaguauuaacaguagaagaaaugacaaacucacgacucccaauuccauuagaaaaauuauuuacuggaccaucaucagccuuugugguucaaccacaaaauggacgaugcacaacagacggaguauuacuaggcacaacucaauuauccccaguaaauauaugcacauuuagaggcgauguaacacauauaacaggcucucgaaauuacacaaugaaucuagcuucacaaaacuggaacaacuacgacccuacagaagaaauacccgccccucucggaacuccagauuucguaggcaaaauacagggaaugcuuacacaaacuacuagaacagacggauccacacgaggacacaaagcaacaguauacacaggaucagcagacuuugcaccaaaauuaggaagaguacaauucgaaacagauacagaccaugacuucgaagcuaaucaaaauacaaaauuuacaccaguaggagugauucaagacggaucaaccacacacagaaacgaaccucaacaauggguucugccauccuacucaggacgaaacacucauaauguacaccuugcuccagcugucgcuccaacauuuccaggagaacaauuacuauuuuucagauccacaaugccaggaugcucuggauacccaaacauggaccuagauugucuacuaccacaagaauggguacaauauuucuaucaagaagcagcccccgcacaaucagacguugcccuauuaagauuuguaaaccccgacacuggacguguccuauucgaaugcaaacuacauaaauccggauauguaacagucgcccacacaggacaacaugauuuaguaauaccaccaaacggauauuuuagauucgacucaugggucaaccaauuuuauacuuuagcuccaauggguaauggaacuggaagaagaagauaa

SEQ ID NO: 34347 - RNA, 1617 nt, Artificial Sequence
  derived and/or modified sequence opt6 from VP1__Norovirus_and/or_Norovirus-like__KX354075
augaaaauggcuucaucagaugccaauccauccgacggcucaacagcaaacuuaguaccagaaguaaacaaugaaguaauggcucuagaaccaguagucggagcagcgauagcagcacccguagcuggacaacaaaacguaauugacccauggauucgaaacaacuuuguacaagcaccaggcggugaauuuacaguuucaccaagaaaugcaccaggagaaauauuauggucugcaccacuaggaccagaccuaaauccuuaucucucucaucuagcacgaauguauaacgguuacgccggagguuucgaaguacaaguaauauuagcaggaaaugcauuuaccgccggcaaaauaauauucgcagcuguuccaccaaacuuucccaccgaaggccuaucuccaucucaaguaacaauguucccacauauuauagucgauguaagacaauuagaacccguauuaauuccauuacccgauguaagaaacaacuuuuaccacuauaaccaaucaaacgauccaaccaucaaacuaauagcaauguuauacacaccacuaagagcaaauaacgcaggagaugaugucuuuacgguuucaugccgaguacucacacgacccucaccagacuucgauuucauauuucuagucccaccuacaguagaaucaagaacuaaaccauucuccguaccaguacuaaccguagaagaaaugaccaauucaagauuuccaauaccacuagaaaaacuuuuuacaggaccaucaucagccuucguaguccaaccucaaaacggaagauguacuacagacggagucuuacucggaacaacacaguuauccccagucaacauauguaccuuuagaggggauguaacacauauaucaggaucccgcaauuauacaaugaaucuagcaucacaaaacuggaacucauacgaucccacagaagaaauaccagccccacucggaacaccagauuuugucggaaaaauacaaggaguacuuacacaaacaacaagaacggacggaucaacacgaggacacaaagcaacaguauauacaggcucagcagauuucucaccaaaguuaggacguguacaauucgcaacugacacagauaacgacuucguaacaaaucaaaauaccaaauuuacacccguaggagucauccaagaugguucaacuacaccaagaaacgaaccucaacaauggguacuaccauccuacucaggaagaaacgcacauaacguacauuuagcaccagcgguagcaccaacauuuccaggagaacaacuccuauucuuuagaucuacaaugccaggaugcucaggauauccaaacauggauuuagacugucuauuaccacaagaauggguccaauauuucuaucaagaagcagcaccagcacaaucugacguagcacuauuaagauucguaaauccugauacaggacgaguauuauucgaaugcaaauuacauaaaucaggauacguaacaguagcacauaccggucaacacgaucuaguaauaccuccaaauggauauuuccguuucgauaguuggguaaaccaauuuuauacccuugcuccgaugggaaacggaacaggacgaagacgauaa

SEQ ID NO: 34348 - RNA, 1617 nt, Artificial Sequence
  derived and/or modified sequence opt6 from VP1__Norovirus_and/or_Norovirus-like__KX354072
augaagauggcauccaaugacgcuaauccuucagacggaucagcagcaaaccucguaccagaaguaaacaaugaaguaauggcauuagaaccagucgucggugcagcuauagcugcaccaguagcaggacaacaaaaugucauugacccauggauaagaaauaauuuuguccaagcaccaggaggagaauuuacaguaucuccuagaaacgcccccggagaaaucuuauggucagcaccucuaggaccagauuuaaacccuuaucuaagccacuuagcucguauguacaaaggauacgcaggaggauucgaaguacaaguaauucuagcuggaaacgcauuuacagcuggaaaaauaauauucgcugcuguaccaccaaauuuuccaacagaagguuuaucacccucucaaguaaccauguuuccccauauaauuguagacguaagacaauuagaaccuguacuaauaccauuaccagauguuagaaauaauuuuuaucauuacaaccaaucgaaugacucaacaauaaaacuaauagcaauguuauauacuccaccaagagcuaacaaugcaggagacgauguauuuaccgucucaugucgcguacuaacacgaccaucaccagacuucgauuuuaucuuuuuaguacccccaacugucgaaucuagaacuaaaccauuuacagucccaauacuaacaguugaagaaaugacaaacucuagauucccaauaccacuagaaaaacuauuuacagguccaucaagugcuuuuguaguacaaccccaaaacggacgauguaccacagacggaguauuauuagguacaacacaacuauccccuguaaauauauguacauucagaggcgacguuacacacauagcaggaucuagaaacuauacaaugaaucucgcaucucuaaacuggaacaauuacgacccaacagaagaaauaccugcaccacucggaacaccugauuuuguaggaaaaauacaaggggucuuaacacaaacaacaaagggugacggcagcaccagaggacauaaagcuacaguuuauacaggaagugccgacuuuacuccaaaauuaggaucuguacaauucgcuacagauacagaaaacgauuuugaaacucaucaaaauacaagauucacaccaguaggaguaauccaagacggaucuacaacacaccgcaaugaaccacaacaauggguacuaccuucuuauucaggaagaaauguacauaauguacacuuagcaccagccguagcaccuaacuuuccuggagaacaguuauuauucuuucguucaacuaugccagguuguucaggauauccaaauauggacuuagauugccuucuaccacaagaauggguacaacauuucuaucaagaagcagcuccugcacaaucugacguugcacuucucagauuuguaaacccagacacuggccgaguauuauuugaaugcaaacuacauaaaucaggauauguaacuguagcacacacaggacaacacgaucuaguaaucccaccuaacggauacuucagauuugauucauggguuaaucaauuuuauacacuagcacccaugggaaacggaaccggaagaagaagauag

SEQ ID NO: 34349 - RNA, 1617 nt, Artificial Sequence
  derived and/or modified sequence opt6 from VP1__Norovirus_and/or_Norovirus-like__KX354060
augaaaauggcaucaucugaugcaaaccccucagacggaucaaccgcaaaccuugucccagaaguaaauaacgaaguaauggcccuagaaccaguugucggugcagcuaucgcagcaccuguagcaggacaacaaaauguaauugacccauggauaagaaacaauuuuguacaagcaccuggcggagaauuuacaguaucuccacgcaaugcaccaggagaaauauuauggucagcaccauuaggcccagaccuaaauccauauuuaucacacuuagcaagaauguauaacggauacgcuggcggauuugaaguucaagucauauuagcuggaaaugcauuuacagcaggaaaaaucauauuugcagcagucccaccuaauuuuccaacagaaggucuaucacccucacaaguaacuauguucccacacauaauaguugacguacgacaauuagaaccaguuuuaauuccacuaccagauguaagaaauaauuucuaucacuauaaucaaucuaaugacucuacuauuaaacuuauugccaugcuauacacacccuuaagagcuaauaaugcaggagaugauguauuuacaguuuccugucgcguauuaacuagaccaucaccugacuucgacuuuauuuuccuaguaccuccaaccguugaaucaagaacaaaaccuuucucuguaccaauuuuaacaguagaagaaaugacaaacucacgauucccaauaccacuagaaaaguuauuuacaggaccauccuccgcauucguuguacaaccucaaaacggaagauguacaacagaugggguucuauuaggcacaacacaauuaucacccguaaauauauguacauuuagaggagacgucacacacauucccgguagucacaauuauaccaugaaucuagcaucucaaaauuggaacucauaugauccaacagaagaaauaccagcuccauuaggaacaccugacuuuguaggaaaaauacaagguguacuaacacaaaccacuucaacuaauggaucaacaagaggccacaaagcuacaguauauacagguagugcugacuuuucaccaaaauuaggacguguacaauucgcaacagauacaaauaacgacuucgaaacaaaucaaaauacaaaauucacaccaguaggaguaauucaagauggcaguacaacaccaagaaaugaaccacaacaauggguacuacccuccuacucaggcagaaauauccauaacguacaccuagccccugcaguagcaccuaccuuuccaggagaacaauuauuauucuuucgaucaacuaugccagguugcucaggauacccaaauauggauuuagauugucucuuaccacaagaauggguacaacacuucuaucaagaagcugccccugcacaauccgacguagcauuacuaagauucguaaauccagauacaggucgaguacuauucgaaugcaaacuacauaaaucaggauauguuacuguagcacacacuggacaacaugaucuuguaauaccaccaaauggauauuuuagauuugauucuuggguuaaccaauucuauacccuugcaccaauggguaauggaaccggacgaagaagauaa

SEQ ID NO: 34350 - RNA, 1617 nt, Artificial Sequence
  derived and/or modified sequence opt6 from VP1__Norovirus_and/or_Norovirus-like__KX353959
augaaaauggcaagcucagacgcuaacccaucagauggauccaccgcuaaucuaguuccagaaguaaacaaugaaguuauggcauuagaaccaguaguaggugcugcaauagcagcaccagucgccggacaacaaaauguaauugacccauggauaagaaauaacuuuguucaagcuccaggcggugaauuuaccguuucaccaagaaaugcaccaggugaaauuuuauggucugccccacucgguccagaucuaaacccauaucucagucaccuagccagaauguauaaugguuacgcugguggauucgaaguucaaguaauauuagcaggaaaugcauuuaccgcuggaaaaauaauauuugcugcaguacccccaaacuucccaacagaaggccuauccccaucacaaguaacuauguuuccacacauaauaguagaugucagacaauuagaaccaguuuuaauacccuuacccgacguaaggaacaacuuuuaucauuauaaccaaucaaaugacccaaccauuaaacuaauugcaauguuauauacaccauuacgagcuaauaaugccggugacgauguauuuacaguaucauguagaguuuuaacaagaccaucuccagauuuugauuuuauauucuuaguuccuccaaccguagaaucaagaacaaaaccauucucaguaccugugcuaacaguagaagaaaugacaaacucuagauuuccaauaccuuuagaaaaacucuucacuggucccucuagugcauucguaguucaaccucaaaacggucgauguacaacagacggaguauuacuaggaacaacacaacuaucuccaguaaauauuuguacauuuagaggagacguaacacacauaccuggaucuagaaauuauacaaugaaucuagcaucacaaaauuggaacucauacgaucccacagaagaaaucccugcacccuuaggaacaccggauuuuguaggaaaaauucaaggaguacuaacacaaacaacuagaaccaauggaucuacucgcggacacaaagcaacaguauauacaggaucagcugacuuuucaccaaaauuaggcagaguacaauuugccacagauacagauaacgacuuugaaacaaaucaaaacacaaaauucaccccuguaggaguuauccaagacggaucagcaacaccacgcaacgaaccucaacaauggguccuaccuucauauucuggccgaaauauucauaauguacaccuagccccugcaguagcacccaccuucccaggagaacaacuacuuuucuuuagaucuacaaugccaggaugcucagguuacccaaauauggaucuagauugccuacugccacaagaauggguucaauauuucuaucaagaagcagcaccagcacaaucagauguagcauuacuaagauuuguaaauccugauacaggaagaguacuauuugaauguaaauuacauaaauccgguuauguuacuguagcacacacuggacaacaugauuuagucauaccucccaaugguuauuucagauuugauucaugggucaaucaauuuuacacacuugccccaaugggaaacgguacuggucgacgaagauaa

SEQ ID NO: 34351 - RNA, 1617 nt, Artificial Sequence
  derived and/or modified sequence opt6 from VP1__Norovirus_and/or_Norovirus-like__KX353954
augaaaauggcuaguucagacgcaaauccuuccgaugguuccaccgcaaacuuaguucccgaagucaacaaugaagucauggcauuagaaccugucguaggugcagcaauagcagccccaguagccggacaacaaaacguaauagacccuuggauaagaaauaauuuuguucaagcaccaggaggagaauuuacaguaucuccaagaaaugccccuggagaaauauuauggucagcaccccuuggcccagaccuuaacccauauuuaucucaccuagcucgcauguacaacgguuacgcaggcggauucgaaguacaaguaauccuagccggaaaugccuuuacagcagguaaaauaauauuugcugcaguuccuccaaacuuuccaacugaaggacuaucaccaagucaaguaacaauguucccacacauuaucguggacguaagacaacuugaaccuguauuaauaccacuaccagacguacguaacaacuucuaucauuauaaccaauccaacgaucccacaauaaaauuaauagcaaugcucuacaccccacuaagagcaaacaaugcaggcgacgauguauucaccguuucuugccgaguauuaacucgaccuagcccagacuuugauuucauauuccuuguuccaccuacaguagaaucccgaacaaaaccauucucaguacccguacuaacagucgaagaaaugaccaacucgagauuuccuauuccuuuagaaaaacuauuuaccgguccaucaucagcauuuguaguacaaccacaaaacggacguugcacaacugacgguguacuucuaggcacuacacaacuauccccuguuaacauuuguacuuuuagaggagauguaacacauauaccuggaucuagaaacuauacaaugaacuuagcaagccaaaacuggaacucauacgauccaacagaagaaauaccagcaccacuaggcacaccugacuuugucggaaaaauccaaggaguucuaacacaaacaacuagaacaaauggaucaacuagaggacacaaagcaacaguauauacaggaagcgccgacuuuucucccaaacuaggaagaguccaauucgcaacagacacagacaacgauuucgaaacuaaucaaaauacaaaauuuacaccagucggaguaauacaagacggaucaaccacaccaagaaaugaaccccaacaauggguccuaccuucauauucaggucguucaauacacaacguacacuuagcuccugcaguagcaccaacuuuuccuggagaacaauuauuauucuuucgaucaacaaugccaggaugcucaggcuacccaaauauggaucuagauugucuacuaccucaagaauggguacaauacuuuuaccaagaagcagcaccagcucaauccgauguagcacuauugagauucguaaacccagacaccggaagaguauuauucgaauguaaacuccacaagaguggauacguuaccguagcacauacaggccaacacgaucucguaauaccaccaaacggauauuuucgauuugauucaugggucaaucaauucuacacacuagcaccaauggguaacggaacuggaagaagaagauaa

SEQ ID NO: 34352 - RNA, 1617 nt, Artificial Sequence
  derived and/or modified sequence opt6 from VP1__Norovirus_and/or_Norovirus-like__AB972529
augaaaauggccucuucagacgcuaacccuagugauggcucagccgcuaauuuaguaccagaaguaucaaacgaaguaauggcuuuagaaccaguaguaggagcagcaauugcagcaccagucgccggacaacaaaauguaauagauccauggauaagaaauaauuucguacaagcaccagguggagaauuuacaguuucaccaagaaacgcaccuggagaaauacucuggucagccccguuaggaccagaucuuaacccauacuuaucacaccuagcaagaauguacaacggauacgccggaggcuuugaaguccaaguaauacuagccggaaaugccuucacagccggaaaaguaauauuugcagccgucccaccuaacuucccaacagaaggacuaucaccaagucaagugacuauguuuccccacauuguaguagauguaagacaauuagaaccaguauuaauaccacuaccagauguacgcaauaauuuuuaucacuauaaccaauccaacgacccuacaauaaaauuaauagcaauguuauauacuccauuaagagcaaacaaugccggugaugacguauucacaguaucauguagaguccuaaccagaccaucgccugauuuugauuuuaucuuucuaguaccacccacaguagaaaguagaacuaaaccuuuuucagucccagucuuaacaguugaggaaaugaccaacucaagauuuccaauaccauuagaaaaauuauuuacugguccaucaagugcauucguaguucaaccacaaaauggacgauguacaacagacggcguuuuacucggaaccacucaauuaagccccguaaauauuuguacauucagaggcgacguaacacauauaacaggaucacgaaauuacacaaugaauuuagcaucucaaaacuggagcaauuaugauccaacagaagaaauacccgcaccacuuggaacaccagacuucguagguaaaauucaagguguacuuacgcaaacaacuagaacagauggaucaacuagaggucauaaagcaacaguauauacuggaucugcagacuucgcaccuaaauuaggacgaguacaauuugaaacagauacagauagagacuucgaagcaaaccaaaacacuaaauucacacccguaggcgucauacaagauggcuccaccacacacagaaaugaaccacaacaauggguacuaccauccuauucaggaagaaauacaccuaacguucaucuugcaccagccguagcuccaacuuuuccuggugaacaauuacuuuucuuucgaucaacaaugccugguugcucaggauaucccaacauggaucuagauugucuccuaccacaagaauggguacaauauuuuuaccaagaagcagcaccagcacaauccgacgucgcauuauuaagauuuguaaaucccgauacaggcagaguauuauucgaauguaaacuucacaaaaguggcuacguaacaguagcacacacuggacaacaugaucuaguaauaccaccaaaugguuauuuuagauucgacucauggguuaaccaauucuacacauuggcacccaugggaaauggcaccggaagacgaagauaa

SEQ ID NO: 34353 - RNA, 1617 nt, Artificial Sequence
  derived and/or modified sequence opt6 from VP1__Norovirus_and/or_Norovirus-like__AB972504
augaaaauggccucaucugacgcaaauccaucagacggcagcgcagcaaaccuuguaccagaaguuaacaaugaaguaauggccuuagaaccaguaguaggagccgcaauagcagcuccagucgcaggacaacagaacguuauagaccccuggauuagaaauaacuuuguacaagcaccaggaggugaauuuacaguuucaccuagaaaugcaccuggcgaaauauuauggucugcccccuuaggacccgauuuaaauccauaccuaucacacuuagcaagaauguauaaugguuacgcggguggauucgaaguacaaguaauauuagcagguaaugcauuuacugcagguaaaguaauauuugcagccguaccaccaaacuucccaacugaaggcuuaucaccaucacaagucacaauguucccacacauaguaguagauguaagacaacuagaaccaguacuuauaccacuccccgauguccgaaauaacuuuuaccauuauaaucaauccaacgauccaacaauuaaauuaauagcaaugcuuuacacuccauuaagagcaaacaaugccggagacgacguauuuacaguaucuugcagaguacuaaccagaccaaguccagauuucgauuucaucuuccuaguaccaccaacaguagaaucaagaacaaaaccauuuucagucccaguauuaacagucgaagaaaugacaaauucaagauuuccaaucccgcuagaaaaauuauuuacugguccaucauccgcauuuguaguacaaccccaaaauggcagauguacaacagacggcgugcuucuaggaacaacucaauuaucaccaguaaacauuuguacuuuuagaggagacgucacccacaucacaggaucaagaaacuacacaaugaaucucgcaucacaaaauuggucaaacuaugacccaacagaagaaacucccgcuccauuaggcacuccugauuuuguaggaaaaauacaaggaguccuaacacaaacuacuagaacagauggaaguaccagaggacacaaagcaacaguauauacaggaagcgccgacuuugcaccaaaacuaggaagaguacaauuugaaacagacaccgaccaugauuucgaagccaaccaaaauaccaaauucacaccaguaggaguaauacaagacggaagcacaacacacagaaaugaaccacaacaauggguacuaccaucuuauucaggccgaaauacaccaaacguacacuuagcuccagcagucgcaccuacauuuccuggugaacaacuauuauucuuuagaucuacuaugccaggaugcucuggauauccaaauauggauuuagauugccuauuaccacaagaauggguacaauauuucuaccaagaagcagcaccagcucaaucagacguugcacuauuacgauucguaaacccagacacuggacgugucuuauuugaaugcaaacuccauaaaucaggauauguaacagucgcacauacuggacaacaugaucuaguaauaccaccuaauggauauuucagauucgauuccugggucaaucaauucuauacauuagcuccaaugggaaauggaaccggaagaagaagauaa

SEQ ID NO: 34354 - RNA, 1617 nt, Artificial Sequence
  derived and/or modified sequence opt6 from VP1__Norovirus_and/or_Norovirus-like__AB972503
augaaaauggcuucaucagaugcaaacccuagcgauggaucugcagcuaacuuaguaccagaaguaaauaaugaaguaauggcauuagaacccguaguuggugccgcaauagcagccccaguagcaggacaacaaaaugucauagauccauggauucgaaauaauuuuguacaagcaccaggcggcgaauuuaccguuucaccacgaaaugcaccaggugaaauuuuauggucagccccauuaggaccugauuuaaacccuuaucuaucucaccuugcucgcauguauaauggauaugcaggagguuucgaaguacaaguaauacuagcaggaaaugcguuuacagcaggaaaaguaauauuugcagccguuccuccuaacuuuccaacugaaggacuuaguccaucacaaguaacaauguuuccucacauaguaguagauguaagacaacuagaaccaguacucauaccacuaccagauguacgaaauaauuuuuaccauuacaaucaaucaaaugauccaacgauaaaacuaauagccaugcuauauaccccuuuaagagcuaacaacgcaggagaugacguauuuacuguaucaugucgcgugcuaacacgcccaucaccugauuuugauuuuauuuuucuaguaccuccaacaguagaaucuagaacaaaaccguuuucagucccaguccuuacaguagaagaaaugacaaauucaagauuuccaauuccauuagaaaaauuauuuacaggaccaucaucugcuuuuguaguacaaccacaaaaugguagauguacuaccgacggaguuuuauugggaacaacucaauuaucaccuguaaauauuuguaccuuucgaggagacgucacacauauaacuggaucgcgaaacuacaccaugaacuuagcaucacaaaacuggagcaauuacgauccaacagaagaaacuccugcaccacugggcacaccagacuuuguaggaaaaauacaagguguucuaacacaaacaacaagaacagauggaucuacuagaggacacaaagccacuguuuauacaggaucagcagauuuugcaccuaaacuaggcagaguacaauucgaaaccgacacugaucgugacuucgaagcaaaucaaaacacaaaauuuacaccuguaggaguaauucaagauggaucaacuacacauagaaaugaaccccaacaauggguccuaccaucuuauucaggacguaauacaccaaacguacaccucgcacccgcaguagcacccacuuuuccaggugaacaauuauuauucuuucgcucuaccaugcccggauguucaggcuauccaaauauggacuuagauugucuauuaccccaagaauggguacaauacuuuuaccaagaagcagcaccagcacaaucagauguagcauuauuaagauucguaaacccagauacugguagaguccuauucgaaugcaaauuacauaaauccgguuacguaacaguagcucauacaggacaacaugaucuaguuauacccccaaaugguuauuuuagauucgacagcuggguuaaucaauuuuauacccuugccccaaugggaaaugguacuggacgaagaagauaa

SEQ ID NO: 34355 - RNA, 1617 nt, Artificial Sequence
  derived and/or modified sequence opt6 from VP1__Norovirus_and/or_Norovirus-like__KP244322
augaaaauggccucaucugaugcaaaccccucagacggaaguacagcaaacuuaguaccagaaguaaacaaugaaguaauggcuuuagaaccagucguaggugcagcaaucgccgcacccgucgcaggucaacaaaacguaauagauccauggauaagaaauaauuuuguacaagccccaggcggagaauuuacaguuucaccaagaaaugcaccaggagaaauauuauggucagcaccgcucgguccagaucuaaauccauauuuaucacaccuugcaagaauguacaauggauacgcaggaggauucgaaguucagguaauucuagcaggaaaugccuucaccgcaggaaaaaucauauucgcagcaguuccaccaaacuuuccaacagaaggauuauccccaucgcaagucacaauguucccucacauuauaguagauguacgccaacuagaaccuguacuuauaccauuacccgauguuagaaacaacuucuaccacuauaaccaaucaaaugauccaaccauaaaacuuauugcaaugcucuauacacccuuacgugcuaacaaugcacgagaugauguuuuuacaguuucaugccgaguacuaacaagacccucaccagauuuugacuucauauuucuaguuccaccaacaguagaaucacgaacuaaaccauucucuguaccuguacuuacagucgaagaaaugacaaacucuagauuuccaauaccuuuagaaaaacuauuuacagguccaucaucagcauucguaguucaaccacaaaauggacgauguacuacagaugguguacuucuuggaacaacucaacuuucaccaguaaacauauguacauuucguggagacguaacacauauauccggaucaagaaauuauacaaugaauuuagcaucccaaaacuggaacucauaugauccaacugaagaaauaccugcaccacuagguacaccagauuuuguagguaaaauucaaggcguucucacccaaaccacacgaacugacggcucaacuagaggacacaaagcaacaguuuauacaggcucugcagauuuuucuccaaaauuaggaagaguacaauuugcuaccgauacugauaaugauuucgagaccaaucaaaacaccaaauucacaccaguuggagucauacaagacggcggcacaacacauagaaaugaaccacaacaauggguauuaccaaauuauagcggcagaaacacacacaacguccaccuagccccugcaguagcaccaacauucccaggagaacaacuacuauucuucagaucaacaaugccuggcugcucaggauaucccaacauggauuuagacugccuucuaccccaagaauggguacaauauuucuaucaagaagcagcaccagcacaaucugacguugcucuacucagauuuguuaauccagacacaggacgaguccucuuugaaugcaaauuacauaaaucaggauacguaacaguagcucauacuggacaacacgaucuaguaauaccaccaaauggcuauuuccguuuugauucauggguuaaucaauuuuacacacuagcaccaauggguaauggaacagguagaagacgauaa

SEQ ID NO: 34356 - RNA, 1617 nt, Artificial Sequence
  derived and/or modified sequence opt6 from VP1__Norovirus_and/or_Norovirus-like__LC018706
augaaaauggcaucaucagacgcaaauccauccgauggauccgcagcaaaccuaguuccagaaguaaacaaugaagauauggcuuuagaaccagucguaggugcagccauagcagcaccaguagcuggacaacaaaauguaauagauccuuggauuagaaauaauuuuguacaagcaccuggaggagaauuuacagucucaccacgcaaugcuccuggagaaauucucuggagcgcaccacuagguccagacuuaaauccauauuuaucucaccuugcccgaauguacaaugguuaugcaggagguuuugaaguacaaguuauauuagcugguaaugccuuuacugcuggaaaaguuauuuucgcugcaguaccuccaaacuuuccaacagaaggauuauccccaagccaaguaacuauguuuccccacauuguaguagauguucgacaauuagaaccagucuuaauuccacuaccugaugucagaaacaacuucuaucacuacaaucaaucaaaugacccaacaauuaaacuuauagccaugcuuuacacaccauuaagagcaaauaaugcaggagacgacguauucacaguaucauguagaguuuuaacuagaccaucaccagacuuugacuuuauauuccuaguaccaccuacaguagaaucacgaacaaaaccauuuucuguaccuguacuaacaguagaagaaaugacaaauucacgcuuucccauaccauuagaaaaauuauucaccggaccaucuucagcauuuguaguacaaccacaaaacggcagaugcacaacagauggaguacucuuagguacaacacaacuaucaccaguaaauauaugcacauuuagaggagauguaacccauauuacaggauccagaaauuacacaaugaacuuagcuucacaaaacuggaacaauuacgauccaacugaagagauaccagcaccauuagguacuccagauuucguaggaaaaauacaaggaguauuaacacaaaccacuagaacagacggaucaacaagaggccauaaagccacaguauauacaggaucagcaaacuucucccccaaacuagguagaguccaauuugaaacagacacugaccaugauuucgaaguaaaucaaaauacaaaauucacaccaguuggcguaauucaagaugguggaacaacacaccggaacgaaccacaacaauggguacuuccuaguuauucaggaagaaauaccccuaauguacauuuagcuccagcuguagccccaacauucccaggcgaacaauuacuauucuuucgaucaacuaugccagguuguucugguuaucccaauauggaccuagacuguuuauuaccacaagaauggguucaauacuucuaccaggaagcagcaccagcucaauccgacguagcauuacugcgauucguaaacccugacacuggaagaguccuuuuugaauguaaauuacauaaaaguggcuauguaacagucgcacauacaggccaacacgaucuaguaauaccuccaaaugguuacuuuagauuugacuccuggguaaaucaauuuuacacacucgcaccaaugggcaacggaacagguagaagaagauaa

SEQ ID NO: 34357 - RNA, 1617 nt, Artificial Sequence
  derived and/or modified sequence opt6 from VP1__Norovirus_and/or_Norovirus-like__KP096345
augaaaauggccucaucagacgcaaacccaucagacggauccgcagcuaaucuaguaccagaaguaaauaaugaaguaauggcacuagaaccuguaguaggugcagcaauagcugcaccugucgcaggacaacaaaauguaauagauccauggauuagaaauaauuuuguucaagcuccaggaggagaauuuacaguuucaccaagaaaugcaccuggagaaauacucuggagugcaccacuaggaccagauuuaaacccauaucuaucucaucuagcaagaauguauaacggauaugcaggaggauucgaaguacaagucauauuagcaggaaaugcuuuuacugcaggaaaaguaauauucgccgcaguaccacccaacuuuccaaccgaagguuuaagcccaucacaagucacaauguuuccacacauaguagucgacguaagacaacuagaaccagucuuaauaccacucccagauguaagaaauaauuucuaucauuauaaccaaucaaaugauccaacaauuaaauuaauagcaauguuauauacaccacuccgcgcaaacaaugcaggagacgauguauucacuguaucaugccguguacuaacacgaccauccccugacuuugacuuuauauuccuaguacccccuaccguagaaucaagaacuaaaccuuuuucaguaccaguacuaacuguugaagaaaugaccaauucaagauuuccaauaccuuuagaaaaacuauuuacaggcccaucaucagcuuucguaguacaaccacaaaauggcagauguacaacagacggaguauuacuaggaacaacccaacuuucaccaguaaauauauguacauuuagaggugacgucacccauauaacgggaucaagaaauuacacuaugaauuuagccagccaaaacuggggaaauuacgauccaacagaagaaauaccagccccauuaggaacaccagacuucguagguaaaauacaaggaguauuaacacaaacaacacgaacagauggaucuacaagaggacauaaagcaacaguauauacagguuccgcagauuuugcuccuaaauuagguagaguacaauuugaaacagauacagaucaugacuuugaagcaaaccaaaacaccaaauuuacccccguaggaguuauccaagauggaucaacaacgcauagaaacgaaccacaacaauggguauuaccaucauauucaggacgaaauacacccaauguacauuuagcuccagcaguugccccaacauuuccaggugaacaacuuuuauucuuuagaucaacuaugccaggauguucuggauaucccaauauggacuuagacugucuacuaccacaagaauggguacaauauuuuuaucaagaagcagcuccagcacaaagcgacguagcacuauuaagauucgucaauccugauacaggacgaguauuauucgaauguaaacuacauaaaucaggauacguaaccguagcacauacaggacaacaugauuuaguaaucccuccgaaugguuacuuuagauucgauucuuggguaaaucaauuuuauacauuagcuccuaugggcaauggaacaggaagacguagauaa

SEQ ID NO: 34358 - RNA, 1617 nt, Artificial Sequence
  derived and/or modified sequence opt6 from VP1__Norovirus_and/or_Norovirus-like__KM982939
augaaaauggcaucaucagacgcaaauccuucggauggaucagcagcuaaccuaguacccgaaguaaacaacgaaguuauggcauuagaaccaguaguaggagcagcaauagccgcuccuguugcaggacaacagaacgucauagaucccuggauaagaaauaauuuuguacaagcaccagggggagaauuuaccguaucaccaagaaaugcaccaggagaaauacuauggucagccccacuaggacccgaucuaaauccauacuuaucacacuuagcucguauguacaacgguuacgcaggaggauucgaaguacaaguaauacuagcaggcaaugcauuuaccgcuggaaaaguaauauuugcagcaguaccucccaauuuuccaacagaaggacuuucaccuucacaaguaacaauguucccacauauagucguugacguaagacaacuagaacccgucuuaauaccuuuacccgauguaagaaauaacuuuuaccauuauaaccaauccaaugauccaacaauaaaacuaauagcaauguuauauacaccacuaagagcaaacaaugcuggugacgauguauuuacaguuucuugcagaguacuuacaagaccaucuccugacuucgauuucauauuucuagucccaccuacaguugaaucaagaacaaaacccuuuaguguacccguacuaacagucgaagaaaugacaaauucaagauuccccauaccucuugaaaaauuauuuacaggacccucaucagcauucguaguacaaccccaaaaugguagaugcacuacagauggagucuuacuuggaacaacacaauuaucaccgguaaauaucuguacauucagaggugacgucacucauauuacaggauccagaaacuacacuaugaauuuagcaagccaaaacuggucaaacuacgacccaacagaagaaauaccagcaccauuaggaacaccagacuuuguaggcaaaauucaaggaauguuaacacaaaccacaagaacugauggaucaacaagaggacauaaagcaacaguauacacagguuccgcagacuuugcaccuaaacucggccgaguacaauuugaaacagauacagaucacgauuucgaagcaaaccaaaauaccaaauucacaccaguuggcguaauccaagacggcucaacaacacauagaaaugaaccccaacaauggguauuaccuucauauucaggacggaauacaccuaauguucaccuagcacccgcugucgcaccuaccuuuccuggcgaacaacuacuauucuuuagaaguacaaugccagguugcucagguuacccaaauauggaucuagauugcuuacucccacaagaauggguacaauauuuuuaucaagaagcugcccccgcacagucugacgucgcauuauuaagauuuguuaauccagacacaggacgcguauuauucgaaugcaaacuacacaaaucaggauauguaacuguagcauacacaggacaacaugacuuaguaauaccaccaaauggauacuuccguuuugacucauggguaaaucaauuuuauacuuuagcuccaauggguaacgguacuggaagaagaagauaa

SEQ ID NO: 34359 - RNA, 1617 nt, Artificial Sequence
  derived and/or modified sequence opt6 from VP1__Norovirus_and/or_Norovirus-like__KM198588
augaagauggcuucaaacgaugcaaauccaucagauggaucugcugcaaauuuaguaccagaaguaucaaaugaaguaauggcccuagaacccguaguaggagcagcaauagcagcaccaguugcaggacaacaaaacguaauagacccauggauaagaaauaauuucguucaagcacccgguggagaauuuacaguuucaccaagaaacgcaccaggagaaauauuauggucugcaccucuaggcccugaucuaaauccguaucuaucacacuuagcaagaauguacaacggcuacgcaggaggcuucgaaguccaaguaauacuagcaggaaaugcauuuacagcugguaaaaucauauucgcagcagucccaccuaauuuuccaacagaagguuuaucaccuagccaaguaaccauguucccucacauuauaguugacguaagacaacuagaaccaguacuaauaccauuaccagaugucagaaauaauuuuuaccacuauaaccaaacaaaugacucaacaauaaaacuaauagcgaugcuauauacaccacuacgagcaaacaaugccggagaagauguauuuacaguaucaugucgcguucuaacacguccuucaccagacuuugauuucauauuucuaguuccaccaacaguagaaucaagaacuaaaccauuuacaguacccauauuaacaguagaagaaaugaccaauucgcgauuuccaaucccccucgaaaaauuauucacggguccaucaggagcauucgucguacaaccacaaaaugguagauguacaacagacggaguuuuauugggaacaacacaauuauccccaguuaauauauguacuuucagaggcgauguuacacauauagcaggaucaagaaauuauacaaugaaucuagccucacuuaacuggaacaauuacgacccaacagaagaaauaccagcaccucuaggaacaccugauuuuguaggcaaaauacaaggaguucuuacacaaacaacuaaaggagacggaucuacaagaggacacaaagccaccguauauacagguucagccccauuuaccccaaaauuaggaaguguacaauucucgaccgauacagaaaacgauuucgaaacacaucaaaacacaaaauucaccccaguaggagucauacaagacggaggaacuacacauagaaacgaaccacaacagugggcacuaccaucuuauucaggaagagauguacacaacguacaccuagcaccagcaguugcuccaacauuccccggcgaacaacuauuauucuuuagauccaccaugccaggaugcuccggauaucccaacauggauuuagacugcuuacuaccccaagaauggguccaacacuuuuaccaagaagcagcaccagcucaaucagacgucgcauuauuaagauucguaaacccagauacaggaagaguccuauucgaauguaaacuacauaaaucaggcuauguaacaguagcccauacaggacaacacgaccuagucauaccaccaaauggauacuucagauucgacaguuggguuaaucaauuuuacacucuagcuccaauggguaacggcacaggaagacgccgcuaa

SEQ ID NO: 34360 - RNA, 1617 nt, Artificial Sequence
  derived and/or modified sequence opt6 from VP1__Norovirus_and/or_Norovirus-like__KM198544
augaaaauggccaguucagaugcaaauccaucagacgguuccacggccaaucuaguaccggaaguuaacaaugaaguaauggcacuagaaccaguagucggagcugcaauagcugccccaguagcuggccaacaaaauguaauagauccauggauucguaauaauuuuguacaagcaccaggaggcgaauuuaccguaucaccaagaaaugcaccaggugaaauacuaugguccgccccacuuggaccugauuuaaauccauacuuaagccaucuagcaagaauguauaacggauacgcuggaggcuucgaaguacaaguaauuuuagcaggaaaugcauuuacagcuggaaaaauuauauuugcugcaguaccuccaaauuucccuacagaaggacucucucccucacagguaacaauguucccacacuuaauaguagacguaagacaacuagaaccagucuuaauaccauuaccagacguuagaaacaauuucuaucacuauaaucaaucaaaugauccaacuauaaaacuaauagcaaugcuauacacaccacuaagagcaaacaacgcuggcgaugauguauuuacaguaucguguagaguacuaacaagaccaucaccagacuuugauuucauauuccuaguacccccaacaguugaauccagaacaaaaccauucuccgucccaguacucacaguagaagaaaugacaaacucacgauuuccuauaccauuagaaaaacuauuuaccggaccaucuucagcauucguaguacaaccacaaaauggacgauguacaacagacggaguucuacuaggaaccacucaacuaucccccgucaacauaugcaccuuuagaggugaugucacacauauuaguggaagcagaaacuauacaaugaaccucgcuucccaaaacuggaacucauacgaucccacagaagaaauaccagccccacucggaaccccugacuucguaggaaaaauacaaggaguccuaacccaaaccacaagaacaaauggaucaacaagaggacacaaagcaaccguauacaccggaucagcagauuucuccccuaaauuaggaagaguucaauuugcaaccgacacugauaaugauuucgaaacuaaucaaaauacaaaauucacccccguuggaguaauacaagauggauccacaacuccaagaaacgaaccacaacaauggguacuaccaucuuauucaggaagaaauauccauaauguccaccuagcuccugcaguugccccaacuuucccaggagaacaauuacuauuuuuccgcucaacaaugccaggaugcucaggauacccaaauauggaccucgacugccuuuuaccacaagaauggguucaauauuucuaucaagaagcagcaccagcacaaucugacgucgccuuauuaagauucgucaauccagacaccggcagaguauuauuugaauguaaacuacacaaaucaggauacgucacaguagcacacacaggucaacaugauuuaguaauaccacccaauggauacuuccgauucgauuccugggucaaucaauuuuacacauuagcuccuaugggaaacggcacaggacguagaagauaa

SEQ ID NO: 34361 - RNA, 1617 nt, Artificial Sequence
  derived and/or modified sequence opt6 from VP1__Norovirus_and/or_Norovirus-like__KM198522
augaaaauggccaguaaugacgcaaacccauccgaugguucagccgccaaccuaguaccagaaguuucaaaugaaguuauggcauuagaaccaguagucggagcagcaauagcagcaccaguagcaggucaacaaaaugucauagacccuuggauaagaaauaacuucguucaagccccaggcggagaauuuaccgucucaccuagaaaugcaccaggcgaaauacuauggucagcuccauuaggaccugauuuaaauccauauuuaucacaucuagcucgcauguauaacggauaugcaggagguuucgaaguacgaguaauauuagcaggcaaugcauuuacagcaggaaaaauaauauucgcagcagugccuccaaacuuuccaacugaaggauuaucaccaucucaaguaaccauguucccucacaucauaguugacguacgacaacuagaaccuguucuaauaccacuacccgauguaagaaacaacuucuaucauuauaaccaaacaaaugacucuacuauaaaacuaauugccauguuauauacaccccuaagagcaaauaacgcuggugaagacguauucaccguuaguuguagaguauuaacaagaccuucaccugauuuugacuucauauucuuaguucccccuaccguagaaucacgcacaaaaccauucacaguuccaauauuaacaguagaagaaaugacaaacucaagauucccaauuccacuagaaaaacuauuuacaggaccaucuggugcauucguaguucaaccccaaaauggcagauguaccacagaugguguacuacuaggaacaacacaacuaucaccagucaauauauguaccuuucgaggggacguaacacauauagcaggaucucgaaauuacacaaugaaucuugccucuuuaaauuggaauaacuacgauccaacagaagaaaucccagcaccgcucggaacaccagacuuuguagguaaaauacaaggaguacuaacacaaacaacaaaaggagacggaucaacccgaggucauaaagcaacagucuauacagguuccgcaccauuuacaccaaaacuaggauccguacaauuuucaacagauacugaaaacgauuuugaaacccaccaaaauacgaaauuuaccccaguaggaguaauacaagacggugguacaacccauagaaaugaaccacaacaauggguacucccuuccuauucaggacgagacguacauaacguacacuuagccccagcaguugcuccaacauuuccaggagaacaacuacucuucuuuagaucaacaaugccaggcugcucaggauaucccaauauggaucuagacugucuuuuaccacaagaauggguacaacauuuuuaccaagaagcagccccagcucaaucugauguugcauuacucagauuuguaaauccagacaccggaagagucuuauucgaauguaaacuacauaaaucaggcuaugucacuguagcacacacuggacaacacgaccuugucauaccaccuaauggauauuuuagauuugauucauggguaaaucaauuuuauacccuugcaccaaugggaaacggaacuggaagaagaagauaa

SEQ ID NO: 34362 - RNA, 1617 nt, Artificial Sequence
  derived and/or modified sequence opt6 from VP1__Norovirus_and/or_Norovirus-like__KM198508
augaaaauggcaucuaacgaugcaaauccaagcgaugguucagcagcuaauuuaguaccugaaguuagcaaugaaguaauggcauuagaaccuguagucggagcagcaauugcagcaccagucgccggccaacaaaacguaauagacccauggauaagaaacaacuuuguccaagcaccaggaggagaauuuacaguaagcccuagaaaugcaccaggagaaauacuuuggucagcaccacuuggaccggaucucaauccauauuugucacaccucgcaagaauguauaauggcuaugcaggaggauucgaaguacaaguaauacuagcaggaaaugcauuuacagcaggaaaaauaauauucgcugcaguaccaccaaauuuuccaacagaaggucuaucaccaucacaaguaacaauguucccucauauaauaguagauguacgacaacuagaaccuguacucauuccauuaccagauguaagaaauaauuucuaccauuauaaucaaacaaaugauucaacaaucaaacuaauagcaauguuauacacaccauuacgagcaaauaaugcaggggaagauguauuuacuguaucauguagaguauuaacaagaccuucgccugacuucgacuucauauuuuuaguaccaccaacuguagaaucaagaacaaaaccauucaccguaccuauacucacaguagaagaaaugacaaacucccgauuuccaauaccacucgaaaaacuauuuacaggaccaucuggcgcuuucguaguacaaccccaaaauggaagauguacaacugauggagucuuauuaggaacaacucaauuauccccaguaaauauuuguacauucagaggagacguuacacacauagcaggcucaagaaauuauacaaugaacuuagcaucauuaaauuggaacaacuaugauccaacagaagaaauaccagccccacuaggaaccccagauuuuguugguaaaauucaaggcguacuaacucaaacuacaaaaggagacggauccacacguggucacaaagcaaccguauacacagggagugcaccauucacuccaaaacuaggaucaguacaauuuucaacagacaccgaaaaugauuuugaaacacaucaaaauaccaaauucacaccaguaggaguuauacaagacggaggaacaacacaucgaaacgaaccccaacaauggguuuuacccucauacagcggucgagacguacauaacguucaccuggccccagcaguugccccaacauuuccaggagaacaacucuuauucuuuagaucaacaaugccaggcugcucuggauacccaaauauggauuuagauugccuacuaccacaagaauggguacaacauuuuuaucaagaagcagcaccagcacaaucagacgcagcacuauuaagauucguuaaccccgacacaggaagaguacuauucgaaugcaaacuucauaaaagcggcuauguaacaguagcucauaccggucaacacgaucuaguaauacccccaaauggauauuucagguuugauucauggguuaaccaauuuuacacucuagcacccaugggaaacgguacaggacguagaagauaa

SEQ ID NO: 34363 - RNA, 1617 nt, Artificial Sequence
  derived and/or modified sequence opt6 from VP1__Norovirus_and/or_Norovirus-like__KJ716367
augaaaauggcaucaucugacgcaaacccaucagauggaucagcagcaaaccuaguaccagaaguaaacaacgaaguaauggcacuagaaccuguuguaggagcagcuauagcagcaccaguagcaggucaacaaaauguaauagauccuuggauaagaaacaacuuuguacaagccccaggaggagaguucaccguaucaccacguaaugcacccggugaaauauuauggucagcaccccuugguccugauuuaaauccauaucuaucucacuuagcaagaauguacaacggcuaugcaggaggauuugaaguacaaguaauucucgccggaaaugcauucacagcaggaaaaguaauuuucgccgccguaccaccuaacuuuccaacagaaggucuaucaccuucccaaguaaccauguucccacacauaguaguagacguaagacaauuagaaccaguauuaaucccauuaccagaugucagaaacaacuucuaucacuauaaucaaucaaaugauccaacaauuaaacuaauagcuauguuauacacaccguuacgagcaaacaaugccggugacgauguuuuuacaguaucauguagaguacuaacaagaccaucucccgauuucgacuuuaucuuucuaguacccccaacaguagaauccagaacaaaaccauuuaguguaccaguacuuacaguagaagaaaugacuaacucccgauuuccaaucccacuagaaaaacuauuuacagguccauccucagcauuuguaguccaaccccaaaauggacgaugcacaacagauggaguacuccuagguacuacucaauuaucaccagucaauauuuguacuuucagaggagauguaacacauauaacaggcuccagaaauuacacaaugaaucuagcuucacaaaacuggagcaacuacgauccaacagaagaaauucccgcaccauuaggaacaccagauuuuguaggaaaaauacaaggaguuuuaacacaaacaacaagaacugacggauccacaagaggacauaaagcaacuguauacacaggaucagcagacuuugcuccaaaacuaggaauaguccaauucgaaacagauacagaucaugacuucgaagcaaaucaaaauacuaaauuuacuccuguaggaguuauucaagacggaucaacaacacaucgaaaugaaccacaacaauggguucuaccuaguuauucaggaagaaauacaccaaacguucaucuugcaccagcaguugcaccaacauucccgggagaacaauuauuauucuuuagaucaaccaugccaggaugcucuggauacccuaauauggaucuagauugccucuuaccucaagaauggguacaauauuucuaccaagaagccgcuccagcacaaucugauguagcacuucuacguuuuguuaauccagacacagguagaguauuauucgaaugcaaacuacauaaaucuggauauguuacaguagcacacaccggacaacaugaucuuguaauaccaccaaauggcuauuucagauucgacucauggguaaaccaauucuauacauuagcuccaaugggaaacgguacaggaagaagaagauaa

SEQ ID NO: 34364 - RNA, 1617 nt, Artificial Sequence
  derived and/or modified sequence opt6 from VP1__Norovirus_and/or_Norovirus-like__KF177440
augaaaauggcuaguucagacgccaaccccucagauggaucagcagcaaaccucguaccagaaguaaauaaugaaguaauggcacuugaacccguaguuggugcagcaauagcugcaccuguagcaggacaacaaaacgucauagacccauggauaagaaauaauuucguacaagcaccaggaggagaguucacaguaucaccaagaaaugcaccaggagaaauucuuuggucagcaccauuagguccagacuuaaaucccuaucuaucacaucucgcccguauguauaaugguuacgcaggaggauuugaaguacaaguaauacuagcuggaaaugcauuuacagcuggaaaaguaauauuugcagcaguaccacccaauuuucccaccgaaggauuaucaccuucacaaguaacaauguuuccacauauaguaguagacguaagacaacuagaaccuguauuaauaccauuacccgauguaagaaacaauuucuaucacuauaaucaauccaaugacccuacaauaaaacuuauagcaauguuauacacuccccuuagagcaaauaacgcuggagacgauguuuucacaguaucuuguagaguacuaacucgaccaagucccgacuucgacuucauauuucuaguaccuccaacaguagaaucucgaacaaaaccauucucaguaccaguauuaacuguagaagaaaugacaaauucaagauuuccaauacccuuagaaaaacuauucacagguccaucuuccgcuuucgugguacaaccucaaaacggacgcugcacaacagaugguguacuauuagguacaacccaauuauccccuguuaauauuuguacauuuagaggagauguaacacauauaacaggaucacgaaauuacacaaugaacuuagcaucucaaaacuggaacaauuacgaucccacugaagaaauaccagccccucuaggaacaccagauuuuguuggaaaaauacaaggcguacuuacccaaacaacuagaacagacggauccacacgaggacacaaagcaaccguauacacaggcucagcugacuucgcuccuaaacuaggacgaguucaauucgaaacagauacagaucaugauuucgaagcaaaucaaaauacaaaauucacaccuguaggaguuauacaagacgguggaacaacacaucguaacgaaccacaacaauggguucuaccaucuuauucaggacgaaacacaccuaauguacaccuggcuccagcuguagcaccuaccuuuccuggugaacaacuauuguucuuuagaucuaccaugccagguugcaguggauaucccucaauggaucuagauuguuuacucccacaagaauggguucaauauuucuaucaagaagcagcuccagcccaaucagacguagcacuauuacgauuuguaaaccccgacacaggaagaguacuauucgaaugcaaacuacauaaaucaggauauguaacuguagcucacacuggacaacaugaucuaguuauaccucccaaugguuauuucagauuugauucuuggguuaaucaauuuuauacacuagcaccuaugggaaacggaacaggaagaagaagauaa

SEQ ID NO: 34365 - RNA, 1617 nt, Artificial Sequence
  derived and/or modified sequence opt6 from VP1__Norovirus_and/or_Norovirus-like__KF060117
augaaaauggcauccagugaugcacacccaucagacggaucuaccgcaaauuuaguaccugaaguuaauaaugaaguaauggcucuagaaccaguuguaggagcugcaauagcagcaccagucgcaggccaacaaaacgucauagaccccuggauuagaaauaacuuuguucaagcaccaggaggagaauuuacaguuuccccaagaaacgcaccuggagaaauacucuggucugcaccucuaggaccugauuuaaauccuuauuuaucacacuuagcaagaauguauaauggauaugcaggaggauucgaaguacaagucauacuagcaggaaaugcauucacagcaggaaaaauaauauucgcagcagucccacccaacuuuccaacagaagguuuaucaccaucacaaguaaccauguucccucacauaauaguagacguaagacaauuagaaccaguccucauaccacuaccagauguaagaaacaacuuuuaucacuacaaccaaucaaaugacccaacaauaaaacucauagcaaugcucuacacuccauuacgagccaacaaugcaggagacgauguauuuacaguuucauguagaguuuuaacuagaccaucccccgacuuugauuuuauauuucuuguuccaccaaccguugaaucacgaacaaaaccuuucucaguuccuguauuaacaguagaagaaaugacaaacuccagauuuccuauacccuuagaaaaauuauuuacaggaccauccagugcauuuguuguucaaccacaaaacggcagauguacuacagacgguguauuauuaggaacuacacaauuaucacccguaaacauuuguacauucagaggcgacguaacacauauuucaggaaguaggaacuacacaaugaaucuagcuucccaaaauuggaacucauacgauccuacagaagaaauuccagcuccacucggaacaccugacuuugucgguaaaauacaaggaguccuaacccaaacaacucgaacagauggaucuacaagaggacacaaagcaacaguauauacaggaucagcagauuuuucaccuaaauuaggaagaguacaauucgcaacugauacagauaacgauuuuguaacaaaucaaaauacaaaauuuacaccaguaggaguaauacaagauggauccacuaccccaagaaaugaaccacaacaauggguucuacccucauauuccggcagaaacacacacaauguacauuuagcccccgcuguagccccaacauuuccuggagaacaauuauuauucuuuagaucaacaaugcccgguugcucaggcuaucccaacauggacuuagauugcuuacuaccucaagaauggguucaauacuuuuaccaagaagccgcaccagcccaaucagauguagcauuacuaagauucguaaauccagauacaggccguguucuauucgaaugcaaauuacauaaaaguggauauguaacaguagcccacacuggacaacaugacuuaguuauaccaccaaauggauauuuuagauuugacaguuggguuaaccaauuuuacacacuugcaccaaugggaaacggcacaggacguagaagguaa

SEQ ID NO: 34366 - RNA, 1617 nt, Artificial Sequence
  derived and/or modified sequence opt6 from VP1__Norovirus_and/or_Norovirus-like__KF060104
augaaaauggccucuucagaugcuaauccaucagauggcucaacagcuaaccuaguaccagaaguuaacaacgaaguaauggcacuagaaccaguagucggagcagcaauagccgccccugucgcaggacaacaaaauguuauugacccauggauaagaaauaauuuuguacaagcaccuggaggagaauuuacaguuucaccccgaaaugccccuggagaaaucuuauggucagcaccacuaggaccagaccuaaacccuuaucuuucucaccucgcccguauguacaacggauacgcaggcggcuucgaaguccaaguuauauuagcagguaaugcauuuaccgcugguaaaaucauuuucgcagcaguaccaccaucauuuccaacagaaggacuaucuccaagccaaguaacaauguuuccacacauaauuguagaugucagacaauuagaaccaguuuuaauucccuuaccagauguacgcaacaacuucuaucauuauaaccaauccaacgauccaacaauaaaacuaaucgcuauguuauauacaccacuuagagcaaacaaugcgggagaugacguuuuuacaguaucauguagaguacuaacaagaccaucgccagacuuugauuuuauuuuccuagucccaccuacaguagaaucaagaacuaaacccuucucaguaccaguauuaacaguagaagaaaugacaaauucuagauuuccaauaccccuagaaaaacucuucacaggaccaucuucagcuuuuguaguacaaccacaaaacggcagaugcaccacugacggagucuuauuaggcacuacucaacuuagcccaguaaauauaugcacauuucguggugacguaacacauauaucaggaucacguaauuacacaaugaauuuagcuucucaaaacuggaacuccuacgauccaacugaagaaauaccagcaccucucggaacaccagacuuugucggcaaaauacaaggaguacuaacacaaacaacuagaacagacggaucaacuagaggacacaaagccacuguauauacagguucagcagauuuuucaccaaaauuagguagaguacaauuugcaaccgauacagacaacgauuucguaacaaaucaaaauacaaaauuuacaccaguaggaguaauacaagaugguucuacaacaccaagaaacgaaccucaacaauggguucuaccuuccuacucaggaagaaacacacauaauguucaccuagcaccagcaguagcaccaacauuucccggugaacaacucuuauucuuccguucuacuaugccaggcugcucaggauacccaaacauggauuuagauuguuuauuaccacaagaauggguacaauacuuuuaucaagaagcagcuccagcacaaucagacguagcccuacucagauucguaaauccugacacuggaagaguacuauucgaaugcaaauuacauaaaucaggauauguaacaguagcacauacuggacaacacgauuuaguaauaccacccaauggauacuucagauuugacucauggguuaaccaauuuuauaccuuagcucccaugggaaacggcacaggaagacgaagauaa

SEQ ID NO: 34367 - RNA, 1617 nt, Artificial Sequence
  derived and/or modified sequence opt6 from VP1__Norovirus_and/or_Norovirus-like__KF060095
augaaaauggcuucaucugacgcaaauccuucagacgguucuacagccaauuuaguuccugaaguuaauaaugaaguaauggcauuagaaccuguaguaggagcagcaauagcugcuccgguagcaggacaacaaaauguaauagacccauggauuagaaauaauuuuguccaagcuccaggaggagaauuuacaguaucuccaagaaaugcacccggagaaauccucuggucugcaccucuaggaccugaccuuaauccauaucuaucacauuuagccagaauguacaacggauacgcuggaggauuugaaguucaagucauucuagcaggaaacgcuuuuaccgcaggaaaaauaaucuuugcagcaguaccuccaaacuucccaacagaaggauuaucaccaucacaaguaacaauguuuccucauauaauaguagacguaaggcaacuagaaccaguacuaauaccccuaccagauguuagaaacaacuuuuaucauuacaaccaaucaaaugacccaacuauaaaauugauagcaauguuauacacaccuuuaagagcaaauaaugcuggugacgauguauucacaguuucuuguagaguuuuaacccgaccuagcccagacuuugauuucauauucuuaguacccccaacaguagaaucuagaacaaaaccauucucaguacccguuuuaacaguugaagagaugacaaacucaagauucccuauaccccuagaaaaacuuuucacaggaccaucaggagcauucguuguccaaccacaaaacggucgaugcacaacugacggaguauuauuaggaaccacacaauuauccccaguuaacauauguacauucagaggugacguaacacauauaucaggaucaagaaauuacacaaugaaucuugcaucacagaacuggaacucuuaugauccuacagaagaaauaccagcaccacucggcacacccgauuuuguaggcaaaauacaagguguauuaacacaaaccacacgcacagacggaucaacuagaggacauaaagcuacaguauauacagggagugcagauuucucgccuaaauuaggaagaguacaauucgccacugauacagauucagacuucguaacaaaucaaaacacaaaauuuacaccaguaggcgugauccaagauggauccacaacuccaagaaaugaaccacaacaauggguauuaccuucauacuccggaagaucaacucauaacguacacuuagcuccagcaguagcuccaacauuuccaggagaacaacuauuauucuuuagaucaacuaugcccggauguucaggauaucccaauauggaccuugacugccuauuaccucaagaauggguccaauacuucuaucaagaagcagcuccugcacagagugacgucgcucuuuuaagauuuguaaauccugacacaggaagaguuuuauucgaauguaaacuacauaaaucaggauacgucacaguagcacacacaggucaacacgaucuaguaaucccaccuaacggauauuuucgauucgauuccuggguaaaucaauuuuacacuuuagcaccaaugggaaauggaacaggcagaagaagauaa

SEQ ID NO: 34368 - RNA, 1617 nt, Artificial Sequence
  derived and/or modified sequence opt6 from VP1__Norovirus_and/or_Norovirus-like__KF060084
augaaaauggcauccucugaugcuaacccaucagauggaucaacugcaaacuuaguaccagaaguuaauaaugaaguaauggcucuagaaccaguagucggagcagcaauagcagcaccaguagcuggacaacaaaacguaauagauccauggauucguaauaacuucguucaggcaccaggcggagaauuuacaguaaguccaagaaaugcacccggagaaauauuauggucagccccauuaggaccugauuuaaaucccuaucuaucucaccuagccagaauguacaacggauaugcaggcggauucgaaguccaaguaauuuuagcaggaaaugcauucacagcuggaaaaauaauauucgcagcaguucccccuaauuucccaacugaaggacuaucccccucacaaguaacaauguucccacacauaauaguagacguaagacaacuugaaccaguauuaauaccucuacccgauguacgaaauaauuucuaucacuauaaucaaucaaacgacccaaccauaaaacuaauagcaauguuauacacaccacuaagagcuaauaacgcaggagacgauguuuucacaguaucuuguagaguauuaacaagaccuuccccagauuucgauuuuauauucuuaguaccaccaacaguagaaucaagaacuaaaccuuuuucaguaccaguacucaccguagaagaaaugacuaauagucguuuuccaauaccauuagaaaaacuauuuacaggucccuccucagcuuucguaguacaaccucaaaauggucgauguaccacagacggaguacuccuuggaacaacucaauuaucaccagucaauauaugcacauuucgaggugacguaacucauauauccggcucaagaaacuauacaaugaaucuagcaucucaaaacuggaacucuuaugauccaacagaagaaauaccagcaccacuagguacaccagacuuuguagguaaaauacaaggagucuuaacacaaacaacaagaacagacggaucaacacgaggacauaaagcuacaguauacacugguucagccgauuuuuccccuaaacuuggaagaguacaauuugcaacagauacagauaacgauuuuguaacaaaucaaaauacaaaauucacaccaguaggaguaauacaagacgguuccacaacaccacgcaaugaaccccaacaauggguucuaccaucauauucagguagaaauacucauaacguucacuuagcuccagcaguagcaccaaccuucccaggugaacaacuauuauucuuucgaaguacaaugccugguuguucagguuauccaaauauggaucuagacugcuuauuaccacaagaauggguucaauacuucuaucaagaagcagcaccagcacaaucugaugucgcauuacuccgauucguaaacccagacaccggaagaguacuauuugaaugcaaauuacauaaauccggauauguaacaguugcacacacuggucaacacgaucuaguuauaccucccaacggcuauuuuagauucgacagcuggguaaaccaauucuacacucuugcacccauggguaacggagccggccgaagaagauaa

SEQ ID NO: 34369 - RNA, 1617 nt, Artificial Sequence
  derived and/or modified sequence opt6 from VP1__Norovirus_and/or_Norovirus-like__KF060082
augaaaauggcaucaucugacgcaaauccuagcgauggauccacugcaaaucucguaccagaaguaaacaacgaaguuauggcccuagaaccaguuguaggagcagcaauagcugcuccaguagcaggacaacaaaaugucauagacccauggauaaggaauaacuucguucaagcuccaggaggagaauuuacaguaucuccuagaaacgccccaggcgaaauuuuauggucagcaccauuagggccagaucuaaauccauauuuaucacauuuagcaagaauguauaaugguuaugcaggaggcuucgaagugcaaguuaucuuagcaggaaaugcauucacagcaggaaaaauaauauucgcagcaguuccaccaaauuucccuacugaaggacuaucaccaucacaaguuacaauguucccucauauaaucguugacguaagacaacucgagccaguucucauaccauuaccagauguacgaaacaacuucuaccacuauaaccaaucaaaugacccaacaauaaaacuaauagcaaugcucuauacaccacuucgagcuaacaacgcaggagacgacguauuuacaguaucaugucguguacuaacacgaccuagcccagacuucgacuucauauucuuagucccuccaacaguagaaucuagaacaaaaccauucucuguaccaguacuaacaguagaagaaaugacaaauucaagauuuccaauuccauuagaaaaauuauuuacaggaccaucaucagcuuucguaguacaaccccaaaacggaagaugcacuaccgaugguguucuauuaggaacaacacaacucucaccaguaaacaucuguacauuuaggggagacguaacacauauacccggaucaagaaauuacacaaugaaccuagccucucaaaacuggaacucauacgauccaacugaagaaaucccugcaccacuuggaaccccagauuucguagguaaaauacaagguguacuaacacaaaccacaagaacuaacggaucaacacgaggacacaaagcaacugucuacacaggaucagcagacuucuccccaaaacuuggaagaguccaauuugcgacagauacagauaacgauuuugaaaccaaucaaaacacaaaauuuacaccaguaggaguaauacaagacggaucaacuacaccaagaaacgaaccacaacaauggguacuaccaucauacagcggaagaaauauacauaauguccaccuagcaccagcuguagcacccacauuuccaggugaacaauuacucuucuuuagaucuacaaugcccggcugcucaggcuacccaaacauggaccuagauugcuuauuaccucaagaauggguacaauauuucuaucaagaagcagcuccagcccaaucugacguugcacuuuuaagauucguaaacccagacacaggccgcguacuauucgaauguaaacuccauaaaucuggauacgucacuguagcacacacaggacaauacgaucuagucaucccaccaaauggcuauuuuagauucgauucauggguaaaucaauuuuacacacuagcuccuaugggaaauggaacaggcagaagacgcuaa

SEQ ID NO: 34370 - RNA, 1617 nt, Artificial Sequence
  derived and/or modified sequence opt6 from VP1__Norovirus_and/or_Norovirus-like__KF060079
augaaaauggcaucaucagacgcaaaccccucagacggauccacagcaaacuuaguuccugaagugaacaaugaaguuauggcacuagaaccaguugucggugcagcaauagcugcaccaguagcuggucaacaaaauguaauagaucccuggauaagaaacaauuuuguacaagcaccaggaggcgaauuuacagucuccccaagaaaugcaccaggcgaaauacuuuggucagccccauuaggaccugauuuaaauccauaucucucacacuuagccagaauguauaauggguacgccgggggauucgaaguacaagucauauuagcaggaaaugccuuuacagcaggaaaaauaauauucgcagcaguaccaccuaacuuuccaacagaaggacucucuccaucacaaguuacaauguuuccacacauaaucguagacguaagacaacuagaaccaguauuaauucccuuaccagauguaagaaacaauuuuuaucacuauaaccaaagcaaugacccuacaauaaaacuaauagcaaugcuuuauacaccauuacgcgcaaacaaugcaggcgacgacguauucacaguauccugcagaguacucacuagaccaucaccagacuucgacuuuauauucuuaguaccaccaacaguugaaucacguacaaaaccauucucaguuccaguccuaacaguugaagaaaugacaaacucacgauuucccauaccuuuagaaaaacuauuuacagguccaucguccgcuuuuguaguacaaccacaaaauggccgauguaccacugaugguguacuacuuggaacaacacaacuuucaccagucaauauuugcacauuuagaggagaugucacacacauaaguggcucccgaaauuacacaaugaaucucgcaucacaaaacuggucaucauacgacccaaccgaagaaauucccgcaccccuagguacaccagauuucguaggaaaaauucaaggaguacuaacacaaacaaccagaacagauggaucuaccagaggacacaaagccaccgucuacacugguuccgccgacuucucaccaaaacuaggacgaguacaauucgcaacagacacugacaacgauuucguaacaaaccaaaauacuaaauuuacaccaguagguguaauacaagacggaucaacaacaccaagaaaugaaccacaacaauggguauuaccaucuuauagcggaagaaauacccacaacguacacuuagcaccagcaguugccccuacauuuccaggagaacaacuauuauucuuuagaucaacaaugccaggcugcucaggauacccaaauauggaccuugauugccuccuaccacaagaauggguucaauauuuuuaucaagaagcagcaccagcacaaucagauguagcacuuuuaagauucguaaauccugauacaggaagagucuuauucgaauguaaauuacauaaaagcggauacguuacaguagcccauacuggacaacacgaucuaguaauaccaccuaauggauauuucagauucgauucauggguaaaucaauucuacaccuuagcccccaugggaaauggaacaggaagacgcagauaa

SEQ ID NO: 34371 - RNA, 1617 nt, Artificial Sequence
  derived and/or modified sequence opt6 from VP1__Norovirus_and/or_Norovirus-like__KF060058
augaaaauggccucaucagaugcaaauccaucugaugguucaacagcaaacuuaguaccugaaguaaacaacgaaguuauggccuuagaaccaguuguaggagcagcaauagcagcaccaguagcaggccaacaaaauguaauagacccuuggauaagaaauaauuucguacaagcaccaggaggugaauuuacaguaucaccuagaaaugcaccaucuacaauauuauggucagccccauuaggaccagaucuaaauccauaccuaucucauuuagccagaauguauaauggauacgcaggagguuucgaaguccaagucauucucgcaggaaacgcuuucacagcaggcaaaaucauauucgccgccguaccuccuaacuucccaacagaaggccucucaccaucacaaguaacaauguucccucauauaauaguugacguaagacaacuagaaccagucuuaauuccccuacccgacguacguaauaauuucuaucacuacaaucaauccaacgacccaacaauaaaacuaauagcuauguuauauaccccacucagagcaaacaaugcuggugacgauguauuuacaguaucaugcagaguacuaaccagaccaucuccagauuuugacuuuauauuuuuaguaccaccaaccguagaaucaagaacaaaaccauuuucagucccagucuuaacaguugaagaaaugacuaauucaagauucccaauaccauuagaaaaauuauuuacaggcccaagcagcgcauucguaguacaaccucaaaauggacgcugcacuacugacggcguacuauuagguacaacacaacuaucacccguaaauauaugcacuuuuagaggagacguaacacauaucucaggaagucgaaauuacacaaugaaccuagcaucacaaaacuggaacucuuaugaccccacagaagaaauaccugcaccauuaggaaccccagauuuuguaggcaaaauacaaggagucuuaacacaaacaaccagaacagacggaucaacaagaggucacaaagcuacaguauauacaggaucagcagacuuuucuccaaaauuaggacguguacaauucgcaacagauacagacaacgauuucguuacaaaucaaaauaccaaauucacaccuguuggagucauucaagaugguucuacaacaccaagaaaugaaccucaacaauggguccuaccaucauauucaggaaggaauauccauaauguccaccuagcacccgcuguugcaccaacauuuccaggagaacaacuauuauucuuucgcucaacaaugccaggauguucuggauauccaaauauggacuuagacugccuuuuaccacaagaauggguccaauauuuuuaucaagaagcagccccagcacaaucugacgucgcucuacuaagauucguaaauccagauacaggacgagucuuauuugaauguaaauuacauaaaucaggauauguaacugucgcacacacaggacaacaugaucuaguaauaccuccaaauggauauuuucguuucgacucaugggucaaccaauucuacacacuugcuccaaugggaaaugguacuggaagacgcagauaa

SEQ ID NO: 34372 - RNA, 1617 nt, Artificial Sequence
  derived and/or modified sequence opt6 from VP1__Norovirus_and/or_Norovirus-like__KF060039
augaaaauggcaucaucagacgcaaauccaagugacggaucaacagcaaacuuaguaccugaaguaaacaaugaaguaauggcacuagaaccaguaguaggcgcagcaauugcagcaccagucgccggacaacaaaaugucauagaucccuggauaagaaauaacuuuguccaagcaccaggaggagaauuuacaguauccccucgaaacgcaccaggagaaauuuuauggucugcaccucuaggaccagaccuuaacccauacuuaucacauuuagcaagaauguauaauggauacgcaggcggauucgaaguacaaguaauacuagcaggaaaugccuuuacagcaggaaagauaauauucgcagcaguaccacccaacuuucccacagaaggacuaucaccaucccaaguaacaauguuuccucacauaauagucgauguuagacaauuagaaccagucuuaauccccuuacccgauguuagaaacaauuucuaccauuacaaccaaucaucugacccaacaauaaaauuaauagcaauguuauauacacccuuacgagcaaacaaugcuggcgaugacgucuucacaguaucaugucgagucuuaacaagaccuagcccagacuucgauuuuauauuccuagucccuccaacaguugaaucaagaacuaaaccauucucaguaccaguauuaacuguagaagaaaugacaaacucucguuuuccaauacccuuagaaaaauuauuuaccggaccuucuucagcauucguaguucaaccacaaaacggacgauguacaacagauggaguucuauuaggaacuacacaacuaucuccuguaaauauauguacauuuagaggcgacguuacacauauauccggaagcagaaauuauacaaugaaucuagcaucacaaaacuggaacucauacgacccaaccgaagaaauaccagcaccauuaggaacacccgacuuuguaggaaaaauacaaggagucuuaacacaaacaacaagaacugacggaucaacuagaggccacaaagccacaguguauaccggaucugcagauuuuaguccuaaacuaggcagaguacaauuugccacugacaccgauaaugauuucguuacaaaccaaaauacaaaauucacaccagucggcguuauacaagauggaucaacaacaccucgcaaugaaccacaacaauggguccuaccaucauauucaggaagaaauacacacaauguccacuuagcacccgccgucgcaccaacauuuccaggagaacaacuucuauucuucagaucaacaaugccaggauguucaggauauccaaauauggaucuugauugucuucuaccccaagaauggguucaauauuuuuaucaagaagcagcaccagcacaaucagauguagcauuacuacguuucguaaaccccgauacaggacgcguauuauucgaaugcaaacuacauaaaucaggauauguaacaguagcucacacuggacaacacgauuuaguaauacccccaaacgguuacuucagauucgauucauggguuaaccaauuuuacacacuagcaccaaugggaaauggcaccggucguagaagauaa

SEQ ID NO: 34373 - RNA, 1617 nt, Artificial Sequence
  derived and/or modified sequence opt6 from VP1__Norovirus_and/or_Norovirus-like__KF060030
augaaaauggcaucaucagaugcaaacccaagcgaugguucugcagcaaaucuaguaccagaaguaaauaaugaaguuauggcauuagaaccaguuguuggagcagcaauagcagcaccuguagcuggacaacaaaaugugauagauccauggauaagaaauaacuucguccaagcuccuggaggagaauuuacaguaucacccagaaacgcaccaggagaaauccuuuggaacgccccacuaggcccagauuugaauccauauuuaucacacuuagccagaauguauaacggauaugcaggaggauuugaaguucaaguaauccuagcuggaaaugcauuuaccgcugguaaaguaauauuugcagccguaccaccuaauuuucccacagaagguuuaucuccaucccaaguaaccauguuuccucacauaguaguagauguaagacaauuagaaccuguacuaauaccacuccccgauguucgaaacaauuuuuaucauuauaaucaaaguaacgauccaacaauuaaauuaauagcaauguuauacaccccauuaagagcuaacaacgccggugaugaugucuuuacaguaaguugccguguuuuaacaagaccaucgcccgauuucgauuucauauuucuagucccaccaaccguagaaucaagaacuaaaccauucucuguaccaguacuaacuguagaagaaaugacaaauagucguuucccaauuccacuagaaaaacuauuuacuggaccuucaucagcauucguuguacaaccccaaaauggcagauguacaacagauggcguacuuuuaggcacaacucaauuaucuccagucaacauuuguacauuuagaggugauguuacacauauaacugguagucguaauuauacaaugaaucuagcaucucaaaauuggaauaauuaugacccaacugaagaaauaccugcaccacuaggaacuccagacuuugucgguaaaauucaaggaguauuaacccaaacaacuagaacagacggaucaacuagaggacauaaagcaacaguauauaccggaucagcagauuuugcaccaaaacuaggacgaguacaauuugaaacagacacagaucaugacuuugaagcgaaucaaaacacaaaauucacuccaguaggaguuauacaagauggaggaacaacucaucgaaacgaaccacaacaauggguauugccaucauauucaggaaggaauacucauaauguacaccuugccccagcugucgccccaacauuuccaggagaacaacuuuuauucuuuagaucaaccaugccaggaugcucaggauauccaaauauggacuuagauuguuuauuaccccaagaauggguacaauauuucuaucaagaagcugcuccagcacaauccgacguagcauugcuaagauuugucaauccagacacagguagaguuuuauuugaauguaaacuucauaagucaggauaugcaacaguagcacauacaggucaacacgauuuaguaauaccuccaaauggauauuuuagguucgacucauggguuaaucaauuuuacacauuagcaccaaugggaaauggaacaggaagaagacguuaa

SEQ ID NO: 34374 - RNA, 1617 nt, Artificial Sequence
  derived and/or modified sequence opt6 from VP1__Norovirus_and/or_Norovirus-like__JX439829
augaaaauggguuccaaugacgcaaacccaucugauggaucaacagccaaccuaguaccagaaguaaauaacgaaguaauggcacucgaaccagucguaggagcagcuauagcugcaccaguagcaggccaacaaaauguaauagauccauggauaagaaauaacuuuguacaagcaccuggaggagaauuuacaguuucuccaagaaaugcuccaggagaaauacuuuggucugcacccuuaggaccagauuuaaauccauaucucucacaucuagcacgaauguacaacggauacgcaggaggcuucgaaguacaaguuauauuagcuggaaaugcauuuacagccggaaaaauuauauucgcugcaguaccaccuaacuuuccuaccgaaggacuaucacccucccaaguuaccauguucccacacauaauaguagauguucgccaacuugaaccaguauuaauuccacuaccugauguccguaacaacuuuuaccacuauaaccaaucuaaugauccaacaauaaaacuaauagcuauguuauacacaccacuaagagccaauaaugcaggagaugauguauuuacaguaucauguagaguacucacuagaccaucaccugacuuugacuuuaucuuccucguaccaccaacugucgaaucuagaacaaaaccuuuuucaguacccguacuuacaguugaagaaaugacaaauucgagauuuccgauaccucuagaaaaauuauuuacuggacccuccagugccuuuguaguucaaccacaaaacggucgaugcacaacugacggaguucuacuaggaacaacacaacuauccccuguaaacauauguacauuuagaggagauguaacucauauaccaggaucuagaaauuacaccaugaaucucgccucccaaaacuggaacucauacgacccaacugaagaaauaccugcaccuuuaggaacaccugauuucguaggaaaaauacaaggagucuuaacacaaacaacacgaaccaauggaucuacaagaggucacaaagcaacuguauauacugguagcgcagacuucucaccuaaauuaggcagaguacaauuugcuacugacacagacaaugauuuugaaacaaaccaaaauacaaaauucacaccaguuggcguuauccaagacggcucaacaacaccccgaaaugaaccacaacaauggguacuaccaucauauuccggaagaaauauucacaacguucacuuagcaccagccguagcaccaaccuucccaggugaacaacuauuauucuuuagauccacaaugccagguugcucuggauacccaaauauggaccucgacugcuuacuaccacaagaauggguacaauauuucuaucaagaagccgcacccgcccaaucagauguagcacuauuacgauucguuaauccagacacugguagagucuuauuugaauguaaacuacacaaaucaggauauguaacagucgcacacacuggccaacaugacuuaguaauaccaccaaacggcuauuuccgauuugauucauggguaaaccaauuuuacaccuuagcacccaugggaaauggaacaggaagaagaagauga

SEQ ID NO: 34375 - RNA, 1617 nt, Artificial Sequence
  derived and/or modified sequence opt6 from VP1__Norovirus_and/or_Norovirus-like__KC409282
augaaaauggcauccaaugacgcuaaccccagcgaugguucugcagccaaccuuguaccagaagucagcaaugaaguaauggcacuagaaccaguuguuggagcagcaauagcagcaccuguagcaggacaacaaaauguuaucgacccuuggauacgaaauaacuuuguacaagccccuggaggagaauuuacagucucaccaagaaaugcaccuggagaaaucuuauggucagcaccauuagguccagauuuaaauccauauuuaucacaucuugcccgaauguauaacggcuacgcuggcggauucgaaguccaaguaauacuagcuggaaaugccuucaccgcuggaaaaauaaucuucgcugcaguuccacccaauuuuccaaccgaaggacuaucacccucacaaguaaccauguucccacacaucauaguagauguaagacaauuagaacccguucuaaucccacuuccagacguacgaaacaacuucuaccacuauaaccaaacuaaugauucaaccauuaaauuaauagcuaugcuauacacaccccuucgagcaaauaaugccggugaagauguauuuacaguaagcugucgcguucuaacuagaccaagcccugacuucgauuuuaucuuucuaguacccccaacaguagaaucuagaacaaaaccuuuuacagucccaauauuaaccgucgaagaaaugacuaacuccagauucccaauuccucuugaaaaauuauuuaccgguccaucaggagcauuuguuguccaaccacaaaauggaagaugcacaacagauggaguauuauuaggaaccacacaauuaucaccaguuaauauauguaccuuccgcggagacguaacacauauagcaggaucccgcaauuacacuaugaaucuagcuucacuuaacuggaacaauuacgauccuacugaagaaaccccagcaccacuagguacucccgacuuuguaggaaaaauacaagguguacucacacaaacaacaaaaggagacgguucuacgagaggacauaaagccacaguauauaccggaucagcacccuuuacacccaaauuaggaucaguacaauucucaacagacaccgaaaaugauuucgaaacacaucaaaacaccaaauuuacuccaguuggaguaauccaagacggagguacuacacauagaaaugaaccccaacaauggguauuaccaucuuauuccggaagagauguacauaacguucaucuagcaccagcagucgcaccaacauuucccggagaacaacuauuauucuucagaucaacaaugccaggaugcuccggauaccccaauauggaucucgacugucuuuuaccccaagaauggguacaacauuucuaccaagaagcagcacccgcccaaucugacguagcauuacuaagauuuguaaauccagacacaggccgaguauuauucgaaugcaaacuucauaaaucuggauauguuacaguagcacauacuggccaacacgauuuaguaauaccaccuaacggauauuuccgauucgauucauggguaaaccaauuuuacacacucgcaccgaugggaaauggaacaggaagaagacguuaa

SEQ ID NO: 34376 - RNA, 1617 nt, Artificial Sequence
  derived and/or modified sequence opt6 from VP1__Norovirus_and/or_Norovirus-like__KC409259
augaaaauggcuuccaaugaugcaaacccaucagauggaucagcagcaaacuuaguaccugaaguuucaaaugaaguaauggcauuagaaccaguaguuggagccgcaauugccgcacccguagcuggacaacaaaauguaauagaucccuggauaagaaauaacuuuguacaagcaccagguggagaauuuacaguaagcccuagaaaugcaccuggugaaauauuauggucagccccacuaggaccagauuuaaauccauaucuuucacauuuagcucgaauguauaacggauacgcugguggcuucgaaguccaagucauccucgcaggaaaugcauuuaccgcaggaaaaauaauauucgcagcaguacccccaaauuuucccacugaagguuuaucaccaucacaagugacaauguucccucauauaauaguugauguaagacaauuagaaccaguauuaauaccccucccagauguaagaaauaauuucuaccauuauaaucaaacaaaugacucaacaauuaaacuuauagcaauguuauacacaccacuacgagcuaacaacgcuggugaagacguuuuuacaguaucauguagaguacuaacccgaccaucaccagacuuugacuucauauuucucguaccuccaacaguagaaucaagaacuaaaccuuucacaguaccgauauuaacaguagaagaaaugacaaacucuagauuuccaaucccacuagaaaaauuauuuaccggaccaaguggugcauuuguaguccaaccacaaaacggaagauguacaacagacggcguacuccuagguacaacacaauuaucaccaguuaauauauguacauuccgaggagauguaacacacauugcaggaucaagaaacuauacuaugaauuuagcauccuuaaauuggaacaauuacgauccaacugaagaaauaccagcaccucuaggcacaccugacuuuguugguaaaauacaaggaguccucacccaaacaacaaaaggagauggaucaacacgaggacacaaagcaacaguauauacggguucagcuccauuuacaccgaaauuaggaucaguccaauucucaacagauacugaaaacgauuuugaaacacaucaaaauacaaaauucacaccaguaggaguaauacaagacggaggaacaacacacagaaacgaaccacaacaauggguucuaccaucauacucaggaagagacguccauaauguacaucuugcaccagcaguagcaccaacauucccaggagaacaauuacuauucuuuagaucaaccaugccaggaugcucaggauauccaaauauggacuuagauugucuccuuccacaagaauggguucaacacuucuaucaagaagcagcuccagcacaaucugacguugcacuucuaagauuuguuaacccagacacaggcagaguauuauuugaaugcaaacuucacaaaccaggauaugucacagucgcucacacaggacaacacgaucuaguaauaccucccaacgguuauuucagauuugauucauggguaaaucaauuuuauacucuagcaccaaugggaaacgguacaggacgccgaagauaa

SEQ ID NO: 34377 - RNA, 1617 nt, Artificial Sequence
  derived and/or modified sequence opt6 from VP1__Norovirus_and/or_Norovirus-like__JX459659
augaaaauggcuucuucagaugcuaauccuucugauggaucuacugcaaaucuuguaccagaaguuaauaacgaaguaauggcccuagaaccaguuguaggagcagcuauagcagcaccaguagcuggacaacaaaacguaauugauccauggauaagaaacaacuuuguacaagcaccaggaggugaauuuacuguauccccuagaaaugcucccggagaaauacuauggucugcuccccuaggaccggauuuaaaucccuaucuaucacacuuagcaagaauguauaacggauaugcugguggauuugaaguccaaguaauauuagcaggaaacgcauuuaccgcagguaaaauaauuuucgcagcaguaccuccaaacuuuccaacagaaggucuaucacccucacaaguaacaauguuuccacauauuguuguagacguacgacaacucgaaccaguauuaauaccauuaccagauguacgaaacaauuucuaccauuauaaccaaucuaacgauccuacaauaaaauuaauagccauguuauauacaccacuaagagcaaacaacgcaggagacgauguauuuacuguaucaugcagaguauuaacuagacccucacccgacuucgauuuuauauuucuuguaccaccaacaguagaaucaagaacaaaaccauucucaguaccaguauuaacugucgaagaaaugacaaacucucgauuuccaauaccacuagaaaaauuguuuacagguccaucauccgcauucguaguacaaccacaaaacggccguugcacaacagauggcgucuuauuaggaacaacacaacuuucaccagucaauauauguacauuucgaggcgauguaacacauauaucaggaucaagaaauuauacaaugaaucuugcuucucaaaacuggaacucauacgaccccacugaagaaauaccagcaccacuaggaacuccagauuucguaggaaaaauacaaggaguauuaacacaaaccacaagaacagacggaucuacaagaggucacaaagcaacuguauauacgggaucugcagauuuuucaccaaaauuaggacgaguacaauuugcaacugacacagacaaugacuucguuacuaaucaaaauacaaaauuuacaccaguaggaguaauacaagacggaucgacaacaccaagaaacgaaccucaacaguggguucuaccaucauauagcggucgaaauacacauaauguacacuuagcacccgcaguagcaccaacuuuuccuggugaacaauuacuauucuuuagaucaacaaugccaggauguucaggauauccaaauauggaccuagauugccuccucccacaagaauggguacaauacuuuuaccaagaagcagcuccagcacaaagcgauguagcacuacuaagauucgucaauccugauacaggacgaguauuauucgaaugcaaauuacacaaaucaggauacguaacaguagcacacacaggacaacacgaccuaguaauucccccgaacggauacuuccgauuugauucauggguaaaucaauuuuacacauuagcucccaugggaaauggaacaggacgaagaagauaa

SEQ ID NO: 34378 - RNA, 1617 nt, Artificial Sequence
  derived and/or modified sequence opt6 from VP1__Norovirus_and/or_Norovirus-like__JX459658
augaaaauggcaucuucugacgcaaauccaucagaugguucuacagccaaucucguaccugaaguaaauaaugaagucauggcauuagaaccugucguaggugcagcuauagcagcaccaguagcaggacaacaaaauguaauagacccauggauacgaaauaauuuuguccaagcaccaggaggagaauuuacaguaucaccacgaaaugcaccaggugaaauauuauggucagcuccauuaggccccgauuuaaaucccuaccuuucacaucuagcaagaauguauaauggauacgccggaggauuugaaguccaaguaauucuggcaggaaaugcauuuacugccggaaaaauaauuuucgcugcaguaccacccaauuucccaacagaaggauuaucaccuucacaaguaacaauguucccacauauuauugucgacguaagacaacuagaaccaguucuaauaccucuaccagacguaagaaacaauuuuuaucauuauaaucagucuaaugaccccacaauaaaauuaaucgcaaugcuauacacuccauuaagagccaacaacgccggugacgauguauucacaguuucaugucgcguacuaaccagaccaucuccagacuucgacuucauauuccuagucccaccaacaguagaaucucgaacaaaaccauuuucagugccaguacuaacaguagaagaaaugacaaacagucguuuuccuauaccacuagaaaaacuauucacagguccaucauccgcauucaucguacaaccacaaaacggacgaugcacaacagacggaguacuuuuaggaaccacacaacuaagcccaguaaauauauguacauuccgaggagacgucacucauauuucaggaucaagaaacuauacaaugaauuuagccucccaaaacuggaacucauaugacccaacagaagaaauuccagcaccauugggaacacccgacuuuguagguaaaauucaaggugucuuaacacaaacaacaagaacagacggaagcacaagaggacauaaagcgacaguuuauacagguucugcagauuuuaguccuaaauuaggaagaguacaauuugccacugauacagacaacgacuucguaacaaaucaaaacaccaaauucacaccaguaggaguaauacaagacggaucuacaacuccuagaaaugaaccacaacaauggguucuaccuagcuauucuggaagaaacacccacaacguacacuuagcuccugcaguagcaccaacauucccaggagaacaauuauuauuuuuccgaucaaccaugccggguugcucaggauacccaaauauggauuuagauugucuacuaccacaagaauggguacaauacuuuuaucaagaagcagcaccagcacaaucugauguugcauuacuaagauucguaaauccagacacaggucgaguacuauucgaauguaagcuacacaaaucagguuauguaacugucgcacacaccggccaacaugacuuaguaauaccaccuaacgguuauuuuagauuugauucuuggguaaaccaauuuuacacacuagcacccaugggaaauggaacaggcagaagaagauaa

SEQ ID NO: 34379 - RNA, 1617 nt, Artificial Sequence
  derived and/or modified sequence opt6 from VP1__Norovirus_and/or_Norovirus-like__JX459595
augaaaauggccaguaaugaugcaacacccucagauggaucaacagcaaacuuaguaccugaaguaaacaacgaaguuauggcacuagaaccaguugucggugcugcuauagcugcaccuguagcuggucaacagaacguaauagacccauggauuagaaacaauuucguacaagcaccaggcggagaauuuacaguaucaccaagaaaugcacccggugaaauauuauggucagcaccuuuaggccccgaucuaaauccauauuuaucacaucuagccagaauguauaacggcuaugcaggaggauucgaaguccaaguaauacuagcaggaaacgcauucaccgcaggcaaaauaauauucgcugcaguaccaccaaauuuucccacugaaggcuuaucuccaucacaaguaacaauguucccccauauaauaguagacguacgacaauuagaaccaguucucauaccccuaccagauguaagaaacaauuuuuaucacuauaaccaaucaaacgacucaacaauaaaauuaauccccauguuauacaccccauuacgugcuaacaacgcaggagacgauguuuucacaguaucuuguagaguuuuaacaagaccaucuccugacuuugacuucauauuuuuaguuccaccaacaguagaauccagaacaaaacccuucucugucccuauacucacaguagaagaaaugaccaacucacgguuuccaauaccauuagaaaaauuauuuacaggaccaucaagcgcauuuguaguucaaccacaaaauggaagaugcacaacugauggaguacuucuagguacuacacaacuaucaccuguaaauauaugcacauuuagaggcgaugucacucauauagcaggaacacaaucauauaccaugaaucuagcuucucaaaacuggaauaauuaugaucccacagaagaaauuccagcucccuuaggaacucccgauuuuguaggaaaaauucaaggaguccuaacccaaacaacccgcggagauggaucaacaagaggccauaaagcaacuguaucaacaggaucaguacacuucacaccaaaacucggaucaguccaauucucaacugauacaucuaacgauuucgaaacaggucaaaacacacguuucacaccaguagguguaguacaagacggauccacuacacaucaaaaugaaccccaacaauggguauuaccaaacuauucuggaagagauucucauaauguacaccuugcuccugcaguagcaccaacauucccaggagaacaacuacuuuucuuuagaucaacaaugccaggaugcuccggauaccccaauaugaaucuagauugucuauuaccacaagaauggguacaacacuuuuaucaagaaucagcuccagcacaauccgacguagcacuucugagauuuguuaacccagacacuggcagagucuuauuugaaugcaaacuacacaaaaguggauauguaacaguagcacauaccggacaacacgaucuaguaauaccuccaaauggauacuuucguuuugauuccuggguaaaucaauucuauacauuagcaccgauggguaauggagcuggacgaagaagauaa

SEQ ID NO: 34380 - RNA, 1617 nt, Artificial Sequence
  derived and/or modified sequence opt6 from VP1__Norovirus_and/or_Norovirus-like__JQ613560
augaaaauggcaucaucagacgcuaacccuagugauggaucuacugcaaacuuaguaccugaaguaaauaaugaaguuauggcacucgaaccaguaguaggagcugcaauugcagcuccagucgcaggccaacaaaauguuauagacccauggauuagaaauaauuuuguccaagcaccaggaggugaauuuacaguaagcccucgaaaugcaccaggugaaauacuauggucugccccucuagguccugauuuaaaccccuaucuuucacaccuagcaaggauguauaauggauaugcaggaggauucgaaguccaaguuauacuagccggaaaugcauuuaccgcaggaaaaauaaucuucgccgcuguucccccaaacuuuccaacagaaggcuuaucaccaucacaaguaacaauguuuccacauaucaucguagacguacgacaauuagaaccuguauuaauaccacuaccagauguccguaauaacuucuaucacuauaaccaaucaaacgacccaacaaucaaacuuauagcuaugcuauauacuccacuacgagccaauaaugccggcgacgauguauuuacaguuucaugccgaguacuaacucgaccaucaccugacuuugacuuuauauuuuuaguaccaccaacaguugaaucacgaacuaaacccuucucaguaccaguucuaaccguugaagaaaugacaaacucucgauuuccaauuccauuagaaaaacuauucacaggacccucaucagcuuucguaguucaaccacaaaacggaagauguacuacagacgguguauuacucggaacaacacaacucucaccagucaauauuuguacauuucguggcgauguaacccauauaccaggaucucgcaacuacacaaugaaucuagcaagccaaaauuggaacucauacgacccaacagaagaaauaccagcaccauuagguacaccagacuucguaggaaaaauacaaggaguucuuacacaaacuacacgagcaaauggauccacaagaggacauaaagcaacuguauauacaggaucagcagacuuuucaccuaaauuaggaagaguucaauucgccacagauacagauaacgacuuugaaacaaaucaaaauacaaaauuuacuccaguagguguaauacaagacggcucaacaacacccagaaaugaaccacaacaauggguacuuccaucauauucaggcagaaauauccacaacguacaucucgcaccagcaguagcaccaacauuuccaggagaacaauuauuauucuuuagaucuaccaugccaggaugcaguggauauccaaauauggaucuagacugucuauuaccacaagaauggguacaguauuuuuaucaagaagcagcaccagcacaaucagacguagcacucuuaagguuuguaaauccugauacaggaagaguauuauucgaauguaaauuacauaaaucuggauacguuacaguagcacauacaggccaacacgaccuaguuauaccaccuaauggauauuuccgcuuugauucauggguaaaucaauuuuacacucuagcuccaaugggaaauggaacuggcagaagaagauaa

SEQ ID NO: 34381 - RNA, 1617 nt, Artificial Sequence
  derived and/or modified sequence opt6 from VP1__Norovirus_and/or_Norovirus-like__JQ613545
augaaaauggcaucaagcgacgcuaauccaucugaugguucaacagcaaacuuaguaccagaaguaaacaacgaaguuauggcccuagaaccaguuguaggugcagcaauagcagcuccuguagcaggacaacaaaauguuauagacccauggaucagaaauaacuuuguacaagcaccaggaggagaauuuacaguaucaccacgaaaugcaccaggagaaauacuaugguccgccccauuagguccagaucuaaacccauaccuaucucaccucgcccgaauguauaacggauacgcaggaggauucgaaguacaaguaauauuagcuggaaacgcuuuuacagcuggaaagauaauauuugcugcaguacccccaaauuuucccacagaaggacucucaccaucccaaguaacuauguuuccacauauaauuguagaugucagacaauuagaaccaguauuaauaccauuaccagauguaagaaauaauuuuuaucacuauaaucaaucaaaugaucccacaauaaaacuaauagcaauguuauacacaccacucagagcaaauaaugcaggagacgacgucuuuacugucucauguagaguauuaacaagaccaucuccagauuucgacuuuauauuccuaguuccaccuacaguugaaucaagaacaaaaccuuucucaguuccaguacuuacaguagaagagaugaccaauucaagauuuccaauuccauuagaaaaauuauuuacaggaccaucuucagcuuucguaguacaaccacaaaacggcagauguacaacagacgguguacuacuaggcacaacccaacuaucaccagucaauauauguacauuuagaggagacguaacccacauaccagguucacgcaauuacacuaugaauuuggcaucccaaaacuggaauaauuaugacccaacagaagaaauaccugcaccacuuggaacaccagacuuuguaggaaaaauucaaggaguauuaacucaaacaacacggacaaauggaucaacuagaggccauaaagcaacaguauauacagguuccgcagacuucucuccuaaacucggcagaguacaauuugcuaccgauacugauaaugauuucgaaaccaaucaaaacacaaaauucacaccuguaggaguuauacaagauggaucaaccacuccaagaaaugaaccccaacaauggguauuaccauccuauagcggacgaaauauccacaauguccaccuagcuccagcaguugcaccaacauucccuggugaacaacucuuauucuuccgaucuaccaugccaggaugcucaggauauccaaauauggaccuagacugccuucuaccacaagaauggguucaauauuuuuaucaagaagcagcaccagcacaaucagauguugcacuccuaagauucguaaacccagauacgggacgaguauuauucgaauguaaauuacauaaaaguggauacgucacaguugcacacacaggacaacaugaucuaguaauaccaccaaacggauauuuccgcuucgauucauggguaaaucaauucuacacucucgcaccaaugggaaacggaacaggacguagaagauaa

SEQ ID NO: 34382 - RNA, 1617 nt, Artificial Sequence
  derived and/or modified sequence opt6 from VP1__Norovirus_and/or_Norovirus-like__AB541288
augaaaauggcauccaaugacgcaaacccuuccgauggcuccgcagcaaacuuaguaccagaaguuaacaaugaagucauggcacuagaaccaguaguaggagcagcaaucgcagcaccaguagccggacaacaaaacguaauagacccuuggauacgaaauaauuuuguccaagcuccuggaggugaauuuacaguaucaccuagaaacgcaccaggugaaauaccuuggucagcaccucucggaccagaccuaaacccauauuuaucucaucuagcuagaauguacaacggcuacgcaggaggauucgaaguccaaguuguauuagcaggaaaugccuucaccgcaggaaaaguaauauucgcagcaguaccaccaaauuuucccacugaaggccuaucccccucacaagucaccauguuuccacacauaauaguagacguaagacaacuagaaccaguuuuaauuccauuaccagauguaagaaacaauuuuuaucacuauaaucaaucaaaugacucaaccaucaaauuaauagcaaugcucuacacaccucucagagcuaacaaugcaggagaagauguuuucacaguaucguguagaguauuaacucgacccuccccagauuuugauuuuauauuuuuaguaccaccaacaguagaaucaagaacaaaaccauucacaguaccaauccuuacaguagaagaaaugacaaacucaagauucccuauaccacuagaaaaauuauuuacugguccaucaggagcauuuguaguacagccucaaaauggaagauguacaacagacggaguacuauuaggaacaacucaauuaucaccuguaaauauaugcacauucagaggagacguaacacauauagcaggaagccguaauuacacaaugaaccuugcaucccuuaacuggaacaauuacgaucccacugaagaaauaccagcaccuuuaggaacaccugacuuuguagggaaaauacaggguguacucacacaaacuacuaaaggugauggaucaacccgaggacacaaagcaacaguauacaccggaaguacuccauuuacaccaaaauuaggcucaguucaauucuccacugauacagaaaacgauuuugaaaaccaucaaaauacaaaauucacaccaguagguguaauacaagauggaggaacaacacauagaaacgaaccacaacaauggguccucccaagcuauucaggccgaaauguacaaaauguucacuuagccccugcaguagcaccaacauuuccaggagaacaacucuuauucuuucgaucaacaaugcccggaugcucaggcuaucccaauauggaucuagacugcuuacuaccucaagaauggguucaacacuuuuaccaagaagcagcucccgcacaaagcgauguagcauuacuacgauuuguaaauccagauacaggaagaguauuauucgaaugcaaauuacacaaaaguggauauguaacuguugcucauacaggccaacaugaucuaguuauaccaccuaauggauauuucagauuugauucaugggucaaucaauuuuacacacuagcaccaaugggaaacggaacaggaagaagacgauaa

SEQ ID NO: 34383 - RNA, 1617 nt, Artificial Sequence
  derived and/or modified sequence opt6 from VP1__Norovirus_and/or_Norovirus-like__AB541247
augaaaauggcuucaaacgacgccaauagaucagacggaucugcagcaaaucuaguaccagaaguaaacaacgaaguaauggcucuagaaccagucguuggagcagcaauugcugcacccguugccggccaacaaaauguaauagacccauggauaagaaauaacuuuguacaagcaccaggaggagaauuuacaguaucaccaagaaaugcaccaggagaaauacuauggucagcaccuuuagggccagaucuaaacccauauuuaucacaccuugcgagaauguacaauggauacgccggaggauucgaaguacaaguaauuuuagcuggaaacgcauucacagcuggaaaaauaauauuugcagccguuccaccaaauuucccuacagaaggacuaagcccuucacaaguaacuauguuuccccacauaauuguagacgucagacaauuagaaccaguucucauaccauuaccagacguaagaaacaauuucuaucacuacaaccaaucaaaugacucaacaauaaaacuaauagcaaugcuuuacacaccacucagagcaaacaaugcgggagaagauguauuuacuguaucaugccgugucuuaacaagaccaucaccagacuuugacuuuauauuccuaguaccaccaacaguagaaucuagaaccaaaccuuucacuguaccaauacuaacagucgaagaaaugaccaauucuagauuuccaauuccuuuagaaaaauuauuuaccgguccaucaucagcauuugucguacaaccacaaaacggaagauguacuacagacggcgucuuacuaggaacaacccaacuaucaccaguaaauauaugcaccuucagaggagacguaacacauauagcaggguccagaaauuauacaaugaauuuagcaucuuuaaacuggaacaauuacgauccaacagaagaaaucccagcuccuuuaggaacaccagauuucguaggaaagauucaaggaguauuaacacaaacaacuaaaggagacggaucaaccaggggacauaaagcaacuguauacacaggaucagcuccuuucacuccuaaauuaggauccguacaauucucaacugauacagaaaaugauuuugaaacacaccagaauacaaaauucacaccaguagguguaauacaggacgguaguacuacacacagauccgaaccucaacaauggguacuaccaucauauucuggaagaaauguaccuaacguacaucucgccccugcaguagcaccaacauuuccaggagaacaacuacuauucuuccgaucaacuaugccagguuguucuggcuauccaaacauggaucucgauugcuuacuuccucaagaauggguacaacauuucuaccaagaagcugcaccagcacaaucugacguugcacuauuacguuucguaaauccagauaccggaagaguauuauuugaaugcaaacuccauaaaucaggauaugucacaguagcacauacaggacaacacgauuuaguaaucccacccaacgguuauuucagauuugauagcuggguaaaucaauucuauacacuagcacccaugggcaacggaacaggaagaagacguuaa

SEQ ID NO: 34384 - RNA, 1617 nt, Artificial Sequence
  derived and/or modified sequence opt6 from VP1__Norovirus_and/or_Norovirus-like__EU839585
augaagauggcaucaaaugacgcaaacccaucagauggaucaacagcaaaccugguacccgaaguaaacaaugaaguaauggcacuggaaccagucguaggcgcagcaauugcagcaccuguugcaggacaacaaaacguaauagacccauggauaagaaauaauuucguacaagcaccaggaggugaauuuacaguaucacccagaaaugcaccuggagaaauauuaugguccgcuccuuuaggaccagaucuaaauccauaucuuucacaccuagcuagaauguauaacggauaugcugguggauucgaaguacaaguaauauuagcaggcaacgcauuuacugcugguaaaauaaucuucgcugcaguuccaccaaauuucccaacugaaggacuaucaccaucucaaguaaccauguucccacacauuaucgucgacgucagacaacucgaacccguauuaauaccacuacccgauguccgaaacaacuuuuaucacuacaaucaaucaaaugacucaaccauaaaacuaauagcuaugcuguauacaccccuacgagcuaauaaugcaggagaugacguuuuuacaguaucauguagaguauuaacacguccaucaccagauuuugauuuuauauucuuaguacccccuacuguagaaucuagaaccaaaccuuucacaguacccauauuaacagucgaagaaaugacaaacucaagauuuccgauaccuuuagaaaaacuauucaccggcccuuccuccgcauuuguaguucaaccucaaaaugguagauguaccacagauggaguauuacuaggaacaacacaacucucaccagugaauauuuguacauuuagaggagacgucacccauaucccaggaacaagaacuuacagaaugaauuuagcaucucaaaauuggaauaauuaugauccaacagaagaaauaccagcuccccuuggaacaccugauuuuguaggaaaaauacaaggcauguuaccacaaacaacaaaaggugacggaucaacacgaggucauaaagccacaguaucuacaggaagcguagauuuuaccccuaaauuaggcucaguacaauucgcaacagauacagauaacgauuucgaaacaggccaaaacacaagauucacuccaguagguguaauucaagauggcagcucaacacaucgcaaugaaccacaacaauggguauuaccagauuauucaggaagaacagucuauaacguacacuuagcaccagcaguagcaccaacauuuccaggugaacaacuauuauucuucagaucaacuaugccagguugcucgggauauccgaacauggaucuagauuguuuacucccucaagaauggguacaacauuuuuaucaagaagccgcaccaucccaauccgacguagcauuacucagguucguaaacccagacacagguagaguccuauucgaauguaaauuacauaaagcugguuauguaacaguugcacacaccggacaacacgaccuaguaauaccaccaaaugguuauuucagauuugauucauggguaaaccaauucuauacucuagcaccaaugggaaacggugcuggaagaagaagauaa

SEQ ID NO: 34385 - RNA, 1617 nt, Artificial Sequence
  derived and/or modified sequence opt6 from VP1__Norovirus_and/or_Norovirus-like__AY588021
augaaaauggcauccaacgacgcaaauccaucagauggauccacagccaacuuaguaccagaaguaaacaaugaaguaauggcauuagaaccagucguuggagcagcaauagcugccccuguugcaggacaacaaaauguuauagauccauggauucgaaauaauuuuguacaagcucccggaggagaauuuacaguuucaccucgaaacgcaccaggcgaaauauuauggagugcaccacuaggacccgacuuaaauccauaccucagccacuuagcaagaauguauaauggcuacgccggcggauucgaaguacaaguaauauuagcaggaaaugcauuuacagcuggaaaaauaaucuuugcagcaguaccuccaaacuucccaacagaaggacuaucuccuucccaaguaaccauguucccacauauaauaguagacguaagacaauuagaaccaguuuuaauaccucuuccagaugucagaaacaacuuuuaucacuacaaccaaucaaaugacccaacgauaaaacuuauagcaaugcuauauacaccauuaagagcaaacaaugcuggugaagauguauuuacaguauccuguagagucuuaacuagacccucucccgauuucgacuucauauuuuuaguacccccuaccguugaaucaagaacaaaaccauuuacaguaccaauacuaaccguagaagaaaugacaaacaguagauuuccaauaccauuagaaaaacucuucacaggaccaucaggagcauuugucguacaaccacaaaacggacgaugcacaacagauggagucuuacuaggaaccacucaauuaucaccuguaaauauuuguaccuuuagaggcgacguaacacauauagcaggaacacacaauuauacaaugaaucuagcaucacaaaacuggaacaacuaugaucccacugaagaaauaccagcaccuuuagguacaccagacuucguuggacgaauacaaggaauguuaacacaaacaacuagaggagauggaucaacacgaggacacaaagcuacuguauccacaggugacguccauuucacaccaaaacuaggaucaauacaauuuaauacagauacaaauaacgacuuugaaacaggacaaaauacaagauucaccccaguuggaguaguacaagacggaaacgguacacaucaaaacgaaccacaacaauggguauuacccucuuauaguggaagaacaggacauaauguacaccuagcaccagccguagcaccaacauuuccuggcgaacaacuuuuauucuuuagaucaacuacaccaggcuguucaggauauccaaauaugaaccuagacugccuccuaccacaagaguggguucaacauuucuaccaagaagcagcuccagcacaaucugaugucgcauuacucagauuugucaauccagauacgggaagagucuuauuugaaugcaaauuacacaaauccggauaugucaccguugcacauacaggccaacacgaucucguuauuccaccaaauggcuauuuccgcuucgacucauggguaaaucaauuuuauacacuugcucccaugggaaacggcacuggcagacguagauga

SEQ ID NO: 34386 - RNA, 1617 nt, Artificial Sequence
  derived and/or modified sequence opt6 from VP1__Norovirus_and/or_Norovirus-like__KX514188
augaaaauggcaucaaacgaugcuaauccaucagauggauccgcagcaaacuuaguaccugaagucaauaacgaaguuauggcacuagaaccuguuguaggagcagcaauagcagcuccuguagccggacaacaaaauguaauugaucccuggauaagaaauaauuuuguacaagcaccaggaggagaauuuacaguaucaccaagaaacgccccaggagaaauacucuggucagcaccauuaggaccagacuuaaauccauauuuaucucacuuagcacguauguauaacggauacgccggaggauucgaaguucaaguaauauuagcugguaaugcauuuacagcugguaaaauaauuuucgcugcaguaccaccaacauuuccuacugaaggucuauccccaucacaaguaacaauguucccacacauuauaguugacgucagacaauuagaaccaguccuuauuccccuuccagacguacgaaauaacuuuuaucacuacaaccaaucaaaugauucaacaauaaaacuuauugcaaugcuauacacaccauuaagagcaaacaauccaggcgaugacguauuuacaguaucaugucgaguucuaacaagaccaucucccgauuuugacuuuauauuucuagucccaccuacaguagaaucacguacaaaaccuuucucaguaccaauacuaacaguuggagaaaugacaaacaguagauuucccauuaaccuagacaaauuauuuacaggaccaagcucagcaaauguaguacaaccacaaaacggaagauguacaauugacggagaacuuuuaggaacaacacaacuuucaccaguaaauauaugcacauuucgaggcgauguaacgcaccccagagauucacaaauauacacaaugaaucuggccucaccuaacuggaauaauuaugauccaaccgaagaaauaccagcaccacuaggaacaccagauuuuguaggaaaaauucaaggaaugcucacacaaacaacaaaaggagaagguucuacuagaggacauagagcaacaguauauguagguucagccaacuaugccccuaaauuaggacgaguccaauuugaaacugauacuacuaaugaucuugaugcacaccaaaacacaaaauucaccccagucggagucguacaaggaggugaaucaccuaaaggauccgaaccacaacaauggguccuacccucauacucaggcagagacacaccuaauguucaccuagccccagcaguagcuccuacauuuccaggcgaacaacuuuuauucuuucgcucaacaauaccgggcugcggaggccaucccaauaugaaccuagacugccuacuaccacaagaauggguacaacauuuuuaucaagaagcagcaccggcacaaucagacguagcauuauuaagauuuguaaacccagauacuucaagaguauuauucgaaugcaaacuucacaaaucaggauauguaacaguagcacauacaggacaacaugaucuaguaauaccaccaaauggauauuucagauucgauucauggguaaaccaauucuacacacucgcacccaugggaaauggaaccggacgaaaaagauaa

SEQ ID NO: 34387 - RNA, 1617 nt, Artificial Sequence
  derived and/or modified sequence opt6 from VP1__Norovirus_and/or_Norovirus-like__KX354101
augaaaauggcaucauccgacgcuaacccaucagaugguucagcugcaaacuuaguacccgaagucaauaaugaagucauggcacuagaacccguaguaggugccgcaauagcagcaccaguagcaggacaacaaaauguaauagaucccuggauaagaaauaacuuuguacaagcaccaggcggagaauuuacaguaucaccaagaaaugcaccaggugaaauacuauggucugcuccuuuaggaccagacuuaaauccauaucuaucacaucuugcaagaauguauaacgguuacgcaggaggauucgaaguccaagucauacuagccggcaaugccuuuacagcaggaaaaguaauauucgcagcgguaccaccaaauuucccaaccgaaggacuaucuccaucacaaguuacaauguucccucacauaguaguagauguaagacaacuagaaccuguccuaauaccacuccccgauguaagaaauaacuucuaccacuauaaucaaucaaaugauccaacaauaaaauuaaucgcaauguuguauacaccauuacgugcuaacaacgcaggagaugauguuuucacaguaucuugcagaguauuaacaagaccauccccagacuuugauuucauuuucuuaguuccaccaacaguagaaucucguacaaaaccauucucaguuccaguauuaaccguagaagaaaugacaaacucuagauuuccaauuccauuagaaaaauuauuuacaggaccauccucagcauuuguuguacaaccacaaaauggaagauguacaacagaugguguauuacucggaacaacacaauuaucaccuguaaacaucuguacauuucguggcgauguaacacauauaacaggaucaagaaauuacacaaugaauuuggcuucucaaaauuggaacaauuaugaccccacagaagaaacaccagcuccauuaggaacuccugauuuuguaggaaaaauacaaggaguauuaacacaaacaacaagaacugauggaucaacucgaggccacaaagcuacugucuacacaggaucagcugacuuugcuccaaaauuaggaagaguacaauucgaaacagauacagauagagauuuugaagcuaaccaaaauacaaaauuuacaccaguuggugucauacaagauggagguacaacccacagaaaugaaccucaacaauggguacuaccuucauacucuggaagaaacacacauaacguucaucuagcuccugcaguagcaccaacauuuccaggagaacaauuauuauucuuucgaucaacaaugccuggaugcucaggauauccaaauauggaccuagacugucuguuaccacaagaauggguacaauauuuuuaccaagaagcagccccagcacaauccgacguagcacuauuaagauucguaaacccagauacaggaagaguauuauucgaaugcaaacuucauaaaucaggauauguaacaguagcacacacaggacaacacgacuuaguaauaccaccuaacggauacuucagauucgacucuuggguaaaucaauuuuacacacucgcuccuaugggcaauggaacaggaagaagacguuaa

SEQ ID NO: 34388 - RNA, 1617 nt, Artificial Sequence
  derived and/or modified sequence opt6 from VP1__Norovirus_and/or_Norovirus-like__KX354023
augaaaauggcuucaucagaugcuaaucccuccgacggcucagcggcuaauuuagucccugaaguaaauaaugaaguaauggcacucgagccaguaguuggagcugcaauagcagcuccaguugcaggucaacaaaauguaauagauccauggauaagaaauaacuucguucaagcaccagguggagaauuuaccgucucaccuagaaaugcaccuggagaaaucuuauggucagcuccauuaggcccagaucuaaauccauaucuaucacauuuagccagaauguauaacgguuaugccggaggauuugaaguucaaguuauacuagcugguaacgcauuuacugcaggaaagguaauauucgcagcaguaccaccaaacuuuccaacugaaggcuuaucaccaucacaagucacuauguucccucauauaguaguugacguaagacaacuagaacccguucuaauaccucuaccugacguuagaaauaacuucuaccacuauaaccaaucaaaugacccaacuaucaaacucauagcaaugcuauacacaccuuuacgagcaaauaacgcaggagaugacguauuuaccguaucuugccguguucuaacaagaccaucaccagauuuugacuucauauuuuuagucccaccaacugucgaaucuagaacaaaaccauuuucaguaccaguauuaacuguagaagaaaugacaaacucacguuuuccuauaccacuagaaaaauuauuuacaggacccuccucagccuucguaguccaaccucaaaauggaagauguacaacagauggcguuuuacuuggaacaacacaacucaguccaguaaauauuuguacauucagaggugaugucacacacauaacaggaucacgaaauuauacaaugaacuuagcuucacaaaacuggaauaauuaugauccaacagaagaaauaccagcaccauuaggcacaccugauuuuguaggaaaaauacaaggaaugcuaacacaaacuacacgugcagacgguucaacuagaggacacaaagcuacaguauacacaggaucugcagauuucgcaccaaaacuaggacgaguacaauuugaaacagauacagaucacgacuucgaagcuaaccaaaauacaaaauuuacaccuguaggcguaauacaagauggaucaacuacucauagaaaugaaccacaacaauggguauuaccaucauauucaggucggaacacacacaacguucaucuagcaccaccaguugcucccacauucccaggagaacaauuauuauucuuuagaucaacaaugccuggauguucaggcuacccaaauauggaccuagauuguuuauuaccacaagaauggguacaauauuuuuaucaagaagcggcaccagcacaaucagauguagcauuacuaagauuuguaaaccccgauacuggcagaguacuuuuugaaugcaaauuacacaaaaguggauacguaacaguugcacauacagggcaacaugauuuaguaaucccucccaauggauauuucagauuugauucauggguaaaucaauuuuauacauuagcaccuaugggaaauggaacagguagaagaagauaa

SEQ ID NO: 34389 - RNA, 1617 nt, Artificial Sequence
  derived and/or modified sequence opt6 from VP1__Norovirus_and/or_Norovirus-like__KX353979
augaaaauggcaucauccgaugcaaauccaucugauggaucaaccgccaauuuaguacccgaaguaaacaacgaaguuauggcuuuagaaccagucgucggugcagcaaucgcagcaccaguagcuggccaacaaaauguaauagauccauggauaagaaauaacuucguacaagcaccuggcggagaauuuacaguauccccacgcaaugcaccaggagaaauucuuugguccgcaccacuaggcccagaucuaaauccauauuuaucucaccuagcuagaauguauaauggauacgcaggaggauucgaaguacaaguaauauuagcagguaaugcauucacagcaggaaaaauaauuuuugcagccguaccaccaaacuucccuacagaaggacuauccccuucccaaguaacaauguucccacacaugauaguugauguacgacaacuugaaccaguucuaauacccuuaccagauguaagaaauaauuuuuaucacuauaaucaaucaaaugacccaaccaucaaauuaauagcaaugcuuuauacaccuuuaagagcaaacaaugcuggugaugacguauuuacaguaucauguagaguacuuacaagaccauccccugauuucgauuucauauucuuaguacccccaacaguugaaucaagaacuaaaccuuucucaguaccaguauuaacagucgaagaaaugacuaacucacgcuuuccaauuccucuagaaaaacuauucacaggaccaucaucagcauuuguaguacaaccucaaaacggacgcugcacaacagacggaguacucuuagguacaacacaacuuucaccaguaaacauauguacauuuagaggagauguaacacauauaucuggaucucgaaacuauaccaugaauuuagcuucacaaaacuggaacucuuaugauccuacagaagaaauaccagcacccuuaggaacaccagauuuuguuggaaaaauacaaggaguauuaacccaaacaacacgaacaaacgguucuacaagaggacacaaagcaacuguauauacuggaucagcugauuucucaccaaaauuaggaagaguacaauucgcaacugauacagauaacgauuuugaaacaaaucaaaauacaaaauucacacccguaggaguuauacaagaugguucaacaacaccuagaaaugaaccacaacaauggguucuaccauccuauucuggaagaaauauacauaacguacauuuagcaccagccgucgcaccaacuuuccccggugaacaacuauuauuuuuccgaucaacaaugccagguugcuccggcuauccaaauauggaccuagacuguuuauuaccucaagaauggguccaauauuuuuaccaagaagcagcaccagcacagucagacguagcccuccuacguuuuguaaauccugauaccggacgaguauuauuugaaugcaaacugcauaaaucuggauauguaacugucgcucauacaggucaacaugaucuaguuauuccuccaaauggauauuuuagauucgauucauggguaaaucaauuuuauacauuagcacccaugggaaacgguacuggacgacgaagauaa

SEQ ID NO: 34390 - RNA, 1617 nt, Artificial Sequence
  derived and/or modified sequence opt6 from VP1__Norovirus_and/or_Norovirus-like__AB972491
augaaaauggccucaucagacgccaacccaucugauggaucagcagcaaauuuaguaccagaaguaaacaacgaaguuauggcauuagaaccugucguaggagcagcuauagcugccccuguagcuggacaacaaaaugucauagacccauggauaagaaauaacuuuguacaagcaccuggaggagaauuuacuguaucgccaagaaacgcaccaggagaaauuuuauggucagcacccuuagguccugaucuaaauccuuauuuaucucacuuagcaagaauguauaauggcuaugcaggagguuucgaaguacaaguaauacuagcaggaaacgcauucacagcaggaaaaguaauuuucgcagcaguaccaccaaauuuucccacagaaggauuaucacccucucaagugacaauguucccacacauuguaguagauguuagacaacuagaaccaguccuaauaccacuaccagauguaagaaauaauuuuuaccacuacaaccaauccaaugaccccacuauaaaauuaauagcuaugcuuuacacaccacuaagagccaauaaugcaggagacgauguauuuacagucucuugucgaguacuaaccagaccauccccagauuucgauuuuaucuuuuuaguuccaccuaccguagaaucacguacaaaaccauuuucaguaccaguguuaacaguugaagaaaugacaaauucaagauucccaauaccauuagaaaaacuauuuacaggaccaucaagugcuuucguaguacaaccacaaaacggaagaugcacaacagacggcguuuuacuuggaacaacccaacuaucuccaguaaauauauguacauuuagaggagauguuauacauauuacuggaucaagaaacuacaccaugaaucuagcaucacaaaauuggucuaauuacgaucccacagaagaaauaccagccccacuuggaacaccugauuucguaggaaaaauacaaggcguacuuacucaaacaacaagaacagacggaucaacacguggucacaaagcaacagucuauacaggaucagcugacuucgccccaaaauuaggcagaguacaauuugaaacagacaccgaucacgacuuugaagccaaucaaaauacaaaauuuacuccaguaggcguaauucaagacggcucaacaacacauagaaaugaaccucaacaauggguccuaccaucauacuccggucgaaauacaccaaacguacaucuagccccugcaguagccccaacauuucccggugaacaauuauuauuuuucagaucaacaaugccaggauguucaggcuacccuaauauggaucuugacugcuuacuaccacaagaauggguacaauauuucuaucaagaagccgccccagcacaaucagacguagcucuacucagauucgucaacccagacacaggaagagucuuauuugaaugcaaauuacacaaauccggauacguaacaguugcacacacaggacaacacgaucuaguaauaccaccaaauggauacuucagauucgauagcugggucaaucaauuuuauacccuagcacccaugggaaauggcacaggaagacgaagauaa

SEQ ID NO: 34391 - RNA, 1617 nt, Artificial Sequence
  derived and/or modified sequence opt6 from VP1__Norovirus_and/or_Norovirus-like__AB972469
augaaaauggcauccucagaugcaaauccaucagauggcucagcagcuaauuuagucccagaaguaaacaacgaaguaauggcauuagaaccaguugucggugcagcaauagcagcacccgucgcaggacaacaaaacguaauagaucccuggauaagaaauaauuuuguucaagcaccuggaggagaauuuacaguauccccaagaaaugcaccuggugaaauccuauggagugcaccacuaggacccgaucuaaauccauaccuaagucaccucgcccgaauguauaacggauaugcaggaggauucgaagugcaaguaauucuagcagguaaugcuuucacagcaggaaaaguaauuuuugcagccguaccaccuaauuuuccaacugaaggucuaucaccaucacaaguaacaauguucccccauauaguuguugauguaagacaacuagaacccguauuaauaccauuaccagauguacguaacaacuucuaucauuacaaccaauccaaugacccaacaauaaaauuaauagcuauguuauauacaccacuuagagcaaacaacgcuggugaugacguauuuaccguaucaugucgaguauuaacaagaccuucaccagauuuugauuucauauuccuagucccaccuacuguagaaucaagaaccaaacccuucucaguuccaguauuaacaguagaagaaaugacaaacucaagauucccaauuccauuagaaaaacuauuuaccggaccaucaagcgcauucguaguacaaccacaaaauggaagauguacaacagacggaguauuauuaggaaccacacaauuauccccaguaaauauuuguacauugagaggagauguaacccacauaacaggaucaagaaacuacacaaugaauuuagcuucacaaaacugguccaauuaugauccaacagaagaaauaccugcaccacuaggaacucccgacuucguaggaaaaauccaaggaguauuaacucaaacaacuagaacagauggaucuacaagaggucacaaagccaccguauauaccgguucagcagacuucgcuccaaaacuuggccguguacaauuugagacagauacugauagagauuucgaagcaaaucaaaauacaaaauucacaccaguuggaguaauacaagauggcucuacaacacacagaaaugaaccacaacaauggguacuaccuuccuauuccggaagaaauaccccaaacguacaccucgcaccagccgucgcaccaacuuuucccggagaacaacuauuauuuuuccgaucuaccaugccuggaugcucuggcuacccaaauauggauuuagauugucuacuaccacaagaauggguacaauauuucuaucaagaagcagccccagcccaaagugauguagcauuauuaagauucguaaauccagacacaggacguguauuauucgaauguaaauuacauaaaucaggauauguuacaguugcacauacuggacaacacgaucuaguuauaccaccaaaugguuauuuuagauuugauaguuggguuaaucaauucuacacccuagcaccaauggguaauggaacaggaagacgacgauaa

SEQ ID NO: 34392 - RNA, 1617 nt, Artificial Sequence
  derived and/or modified sequence opt6 from VP1__Norovirus_and/or_Norovirus-like__LC101819
augaaaauggcaucuaaugacgacaauccaucagauggcucugccgcuaacuuaguucccgaaguuaauaaugaaguaauggcacuagaaccaguaguaggagcagccauagcagccccuguagcaggacaacaaaaugucauagauccauggauacgaaauaacuucguacaagcaccaggcggcgaauuuaccguaucaccucgaaaugcuccuggagaaauacuauggucagcaccccuaggaccagacuuaaacccauaucuaucccaccuagcaagaauguauaauggauacgcuggaggauucgaaguccaaguaauauuagcuggaaaugccuucacagcaggaaaaguaauauucgcagccguaccaccaaauuuuccaacagaaggacuaucuccaucacaagucacaauguucccucacauagucguagauguaagacaauuagaaccaguauuaauaccauuaccugacguaagaaauaauuucuaucauuacaaccaauccaacgauccaacaauaaaauuaauagccaugcucuacacaccauuacgagcaaacaaugccggagacgauguuuucacaguuucauguagaguacuaacccgaccaucuccagauuuugacuuuauauucuuaguuccaccaacaguagaaagcagaaccaaaccauuuucaguucccguauuaacagucgaagaaaugaccaauucacgauuuccaauacccuuagaaaaacucuuuacagguccauccuccgcauuuguaguacaaccucaaaauggaagauguacaaccgacgguguuuuauuaggaacuacacaauuaucaccaguaaauauauguacauuucgaggugacguaacacacauaaccggaucacgaaauuacacaaugaaccuagcaucacaaaauuggaauaacuaugaucccacagaagaaauuccagcaccacuaggaacaccugacuuuguuggaaaaauacaagguguauuaacacaaacaacaagaacugauggaucaaccagaggacauaaagcaacaguuuacacaggcucugcugauuucgcaccaaaacuaggcagaguacaauuugaaacagauacagaucacgauuucgaagcuaaucaaaacaccaaauucacacccguaggaguuauacaagacggaggaacaacacaccgaaaugaaccccaacaguggguauuaccauccuauucaggaagagacacacauaacguucaccuagcaccagcgguagcaccaacauuccccggugaacaauuauuauucuuuagauccacaaugcccggaugcaguggcuauccaaauauggauuuagauugcuuacuaccacaagaauggguacaauauuucuaccaagaagcagcaccagcacaaucagaugucgcacuauuacgauuuguuaacccagacacuggaaggguauuauucgaauguaaauuacauaaaucaggauauguuacaguagcccauacaggacaacaugacuuaguaauaccucccaauggcuacuuucgauuugacucaugggucaauaaauucuacacuuuagccccaaugggaaacggaacuggacgaagacgauaa

SEQ ID NO: 34393 - RNA, 1617 nt, Artificial Sequence
  derived and/or modified sequence opt6 from VP1__Norovirus_and/or_Norovirus-like__KT202795
augaaaauggcuucaucagaugcaaauccaucagauggcucagcugcaaaucucguaccugaaguaaacaaugaagucauggcuuuagaaccaguaguaggcgcugcaauagcagcuccuguagcaggacaacaaaacguaauagauccauggauaagaaauaauuuuguacaagccccuggaggagaauuuacagucucaccaagaaaugcaccaggcgaaauauuaugguccgccccacuaggaccagaucuaaauccauaucuaucacaccuagcaagaauguauaacggcuacgcaggaggauucgaaguucaaguaauacuagcuggcaaugcuuuuacagcaggcaaaguuauauuugcagcagucccaccaaauuuuccaacagaaggauuaucaccuucacaaguuacaauguucccacacauuguuguagauguaagacaauuagaaccaguacucauacccuuaccagauguaagaaauaacuuuuaccauuauaaccaaucuaaugacccuacuauaaaauuaauagcaaugcucuacacaccauuaagagcuaauaacgcaggagaugacgucuuuacaguaucaugccgaguacuaacacgacccucuccagacuuugacuuuauauuuuuaguaccacccacaguagaaucucgaacuaaaccauuuucaguaccaguauuaacaguagaagagaugacuaacucuagauuuccaauuccauuagaaaaauuauuuacaggaccuucaucugcauuuguaguucaaccacaaaaugguagauguaccacagauggaguauuacuaggaaccacacaauuauccccaguaaauauaugcacauuuaggggagauguaacacauauaaccggaucuagaaacuacacuaugaauuuagcaucacaaaacugguccaauuaugacccaaccgaagaaauuccagcaccacuaggaacaccagauuuugucggcaaaauccaaggaguuuuaacacaaacaacaagaacagaugguucaacaagaggucauaaagcaacaguauacaccggaucagcagauuuugcaccuaaacuagguagaguacaauucgaaacugauacagauagagacuucgaagcuaaucaaaacaccaaauuuacuccaguagguguaauucaagacggagguacaacccacagaaaugaaccacaacaauggguuuuaccauccuauucuggacgaaauaucccaaacguacauuuggcccccgcaguagcaccuacauuuccaggcgaacaacuauuauuuuucagaucuacaaugccaggauguucuggauaucccaacauggaucuagacugccucuuaccucaagaauggguacaauauuucuaucaagaagcagcuccagcacaaucagacguagcacuucuaagauuuguuaauccagauacaggcagaguuuuauuugaaugcaaauuacacaaaucaggauauguaacaguagcacacaccggucaacacgaucuaguaauacccccuaauggauacuuccgauuugacucuuggguaaaucaauucuacacccuagcaccuaugggcaauggaacaggucgcagaagauag

SEQ ID NO: 34394 - RNA, 1617 nt, Artificial Sequence
  derived and/or modified sequence opt6 from VP1__Norovirus_and/or_Norovirus-like__AB933742
augaaaauggcaucuucugacgcaaauccauccgauggaucaacugcaaaccuaguccccgaaguaaacaaugaaguaauggcauuagaaccaguaguaggagcagcaaucgcugcaccuguagcuggccaacaaaaugucauagacccauggauaagaaacaacuucguucaagcaccaggcggagaauuuaccguaucaccaagaaacgcaccuggugaaauauuaugguccgccccauuaggaccagauuuaaauccauaucuaucacauuuagcacgaauguauaacggauacgcaggaggauucgaaguacaaguaauucuagcaggaaacgccuucacagcuggaaaaauaauuuuugcugcaguaccuccaaacuucccaacagaaggacuuucaccaucacaagucacaauguucccacauauaauaguugacgugagacaacuagaacccguucuaauaccauuacccgauguaagaaacaauuuuuaucacuauaaccaauccaaugauccuaccauaaaauuaauagcaauguuauauacaccuuuaagagcaaauaaugcaggcgacgacguauuuacagucucuugcagaguauuaacaagacccucacccgacuucgauuucauauuuuuaguuccaccaacagucgaaucccgaaccaaaccauucucagucccaguauuaacaguagaagaaaugacaaauucaagauuucccauuccauuagaaaaauuauuuacaggccccucaucagcauuugugguacaaccacaaaauggacgauguacuacugauggaguacuacuaggaacaacacaacuaaguccuguaaauaucugcacauuuagaggagauguaacacacauaccuggaucacgaaauuacacuaugaaccucgcaucacaaaauuggaacucauacgaccccaccgaagaaauaccugcuccuuuaggaacacccgauuuuguagguaaaauacaaggaguacucacacaaaccacaagaacaaaugguucaacaagaggacauaaagcuacaguauacacaggaucagcagauuucucaccuaaacuaggaagaguacaauuugcaacagauaccgauaacgacuucgaaacaaaucaaaauaccaaauucacacccguuggcguuauccaagauggaucaacaacaccacgaaaugaaccacaacaauggguacuacccucauauucagguagaaauauacauaacguacaucuagccccagcaguugcaccaacauucccaggcgaacaacuauuauucuuuagaucuaccaugccaggaugcucaggauauccaaauauggaucuagauuguuuacuaccacaagaauggguacaauauuucuaccaagaagcugcaccagcccaaucagacguagcccuacuaagauucguaaaccccgacaccgguagaguauuauuugagugcaaacuacauaaaucuggauaugucacagucgcucauacaggacaacaugauuuaguuaucccaccaaauggauauuuuagauuugauagcuggauaaaucaauuuuauacacuagcaccaaugggaaacggcacaggaagacgaagauaa

SEQ ID NO: 34395 - RNA, 1617 nt, Artificial Sequence
  derived and/or modified sequence opt6 from VP1__Norovirus_and/or_Norovirus-like__AB933722
augaaaauggcaucauccgacgcaaauccaucagacggaucagccgcaaacuuaguuccagaaguaaacaaugaaguaauggcacuagaaccaguuguaggagcugcaauagcagcaccuguagccggacaacaaaauguaauagacccauggauuagaaauaacuuuguacaagcaccaggaggugaauuuacaguuucaccucgaaacgccccaggagaaauacuuuggucagccccauuaggaccagauuuaaaucccuaucuaucacauuuagcaagaauguauaacggauacgcaggaggauucgaaguacaaguaauacuagcuggaaaugcauuuaccgcaggaaaaauaauauucgcagcagucccaccaaacuucccaacugaaggacuaucucccucucaagucacuauguucccacauaucauaguugacguaagacaacuagaaccaguacucaucccacuuccagacguccgaaauaauuucuaucauuauaaccaaucaaacgauucaacaauaaaauuaauagcaauguuauacaccccacuacgagcuaacaaugccggugaagauguauuuacuguaaguugcagaguacuaacacgaccauccccugacuuugacuuuaucuuucuuguaccaccaaccguagaaagccgagcaaaaccuuucacagucccuauauuaacaguugaagaaaugacaaacucuagauuuccuauaccauuagaaaaacuauucacagguccaucuucugcauucguuguccaaccucaaaauggaagaugcaccacagacggaguauuacuagguaccacacaauuaucaccuguuaauauauguacauuuagaggugauguuacacauauagcugggucaagaaauuacacuaugaaccuagcuucaccaaacuggaacaacuacgauccuacagaagaaauaccagcaccauuaggaacacccgacuuuguaggaaaaauucaaggaauguuaacgcaaacaaccaaaggcgauggcagcaccagaggccacaaagcuacaguuuauaccggaucagcaccauuuacuccaaaauuaggaucaguccaauuuucaacagauaccgaaaaugauuucgaaacccaccaaaauaccaaauucacaccaguuggaguaauacaagaugguucaacaacccauagaaaugaaccacaacaauggguacuaccauccuauucaggucgaaauguucccaacguccaucuagcaccagccguagcaccuacauucccuggugaacaacuccuauucuuucgaaguacaaugccaggaugcucuggcuauccuaauauggaucucgauugcuuacucccacaagaauggguucaacauuuuuaucaagaagccgcaccagcccaaucagacguugcacuacuacgauuuguaaacccagacacuggucgcguacuuuucgaauguaaacuccacaaaucaggauauguaacuguagcccauacaggacaacacgaucuaguaauaccacccaacggauauuuuagauucgauucaugggucaaccaauuuuacacucuagcaccaaugggcaacggaacuggacgcagaagauaa

SEQ ID NO: 34396 - RNA, 1617 nt, Artificial Sequence
  derived and/or modified sequence opt6 from VP1__Norovirus_and/or_Norovirus-like__KJ678138
augaaaauggcaucaucagacgcaaaccccagugacgguucagcagcaucauuagucccugaaguaaacaaugaaguaauggcccuugaacccguuguaggcgcagcaauagccgccccagucgcaggucaacaaaaugucauagacccauggauuagaaauaauuuuguacaagcacccgguggagaauuuacaguaucuccaagaaacgccccuggagaaauccuaugguccgcaccauuaggcccugaucuaaacccauaucuaucacaccuugcaagaauguauaauggcuacgcaggcgguuucgaaguacaaguuauacuagcagguaaugccuucacagcaggaaaaguuauuuucgcugcaguuccaccaaacuuuccaaccgaaggacuaucuccaucacaaguuacaauguuuccacacauuguaguagauguucgacaauuagaaccagucuuaauaccuuuaccagauguaagaaauaacuuuuaccacuacaaccaaucaaaugacccaaccauaaaacuaauagcaaugcuauacacaccacuaagagcaaauaacgccggagaugacguauuuacagucagcuguagaguacucacacgaccaucaccagacuuugacuucauuuuucuaguuccaccaacugucgaaucuagaacuaaaccauucucaguaccaguauuaacaguagaagaaaugacaaacucaagauuuccaauaccacuagaaaaauuauuuacaggaccaucaagugcauuuguaguucaaccacaaaacgguagauguacaacugaugguguucucuuaggaacaacacaauuaagcccaguuaauaucugcacuuuuagaggagacgucacacauaucacuggcucaagaaauuauacuaugaaccuugcaucacaaaacugguccaauuacgauccaacagaagaaauccccgcaccauuaggaacaccagacuuugucggaaaaauacaagguguauuaacccaaacaacucgaacugacggaucaacacguggacauaaagcaacuguuuacauaggaucagcagacuuugcaccaaaauuaggaagaguacaauuugaaacagauacagaucacgauuucgaagcuaaucaaaauacaaaauuuacucccguaggaguaauacaagacggaucaacaacacauagaaacgaaccacaacaauggguauuaccauccuacucaggaagaaauacaccaaacguucauuuagcaccagcagucgcaccaacauuucccggagaacaauuacuuuucuuuagauccacaaugccaggaugcuccggauacccaaauauggacuuagacugcuuacucccacaagaauggguacaauacuuuuaccaagaagcagcaccagcccaaucugauguagcauugcuuagauucguuaaucccgauacaggccgaguacucuuugaauguaaacuacauaagucuggcuauguuacaguagcucacacaggacaacacgaucucguaauaccaccaaauggauacuucagauuugauucauggguaaaucaauuuuacacucuugcaccaaugggcaauggaacaggaagaagaagauaa

SEQ ID NO: 34397 - RNA, 1617 nt, Artificial Sequence
  derived and/or modified sequence opt6 from VP1__Norovirus_and/or_Norovirus-like__KP244317
augaaaauggcaucuagcgaugcaaacccaagugauggaagcacagcaaaccuuguaccagaaguaaacaacgaaguaauggcucucgaacccguaguaggagcagcuauagcugcaccagucgcagggcaacaaaaugucauagacccauggauaagaucaaacuuuguccaagcacccggcggugaauuuaccguuucaccacgcaacgcuccaggcgaaauauuauggagugccccgcuaggaccugauuuaaauccauaucuaucacauuuagcaagaauguacaacggauacgcaggaggauucgaaguacaagucauauuagcaggaaaugcauucacagcaggaaaaauuauauucgcagcaguaccaccaaacuuuccaacagaaggacuuucacccucacaaguaacaauguucccacauauuauagucgacguuagacaauuagaaccaguauuaauaccauuaccagacguaagaaacaauuucuaucacuauaaucaguccaaugauccaacuauaaaacuaauugcaagauuauauacacccuuacgugcaaauaaugcaggagacgauguuuucacaguauccugucgaguacuaacacgcccaagcccagacuucgacuucaucuuuuuaguaccaccuacaguugaaucaagaaccaaaccauuuucaguaccaguacuuacaguagaagaaaugaccaacucacguuuuccaauuccauuagaaaaauuauuuacagguccaucaucugcuuucguuguacaaccacaaaauggaagauguacuacugacggaguacuccucggaacaacacaacuaucccccguaaauaucuguacuuuuagaggagacguaacucauauaucaggaucuagaaauuauacaaugaaucuagcaucacaaaacuggaacucauacgaccccacagaagaaauuccagcuccacuugguacaccagacuucgucggaaaaauacaaggaguauuaacacaaacaacaaaaacaaauggauccacacgaggacacaaagcaacuguauauacaggauccgccgacuucaguccuaaauuaggcagaguacaauuugcaacugacacagacaaugacuucgaaacaaaucaaaauacaaaauuuacaccaguaggaguaauacaagauggcuccacuacaccaaggaacgaaccacaacaauggguucuaccaucauacaguggaagaaauacacauaacguacacuuagcaccagccgucgcaccaacuuuuccaggagaacaacuccuauucuuuagaucuacaaugccaggaugcucaggauauccaaacauggaucuagauugucuauuaccucaagaauggguacaauauuucuaucaagaagcagcaccagcacaaagugacgucgcauuacuaagauucguaaacccagauacuggccgaguuuuauucgaauguaaauuacacaaaucaggcuauguaacuguagcacacacaggucaacaugauuuaguaaucccaccaaauggauauuuccgauuugauagcugggucaaucaauuucacaccuuagccccaaugggaaacggaacaggcagaagaagauaa

SEQ ID NO: 34398 - RNA, 1617 nt, Artificial Sequence
  derived and/or modified sequence opt6 from VP1__Norovirus_and/or_Norovirus-like__KP698925
augaaaauggcaucaucagaugcaaacccaucagauggaucugcagcaaacuuaguaccagaaguaaacaacgaaguaauggcauuagaaccuguaguaggagcagcuauagcagcuccaguagcuggacaacaaaacguuauugauccguggauuagaaauaauuuuguucaagcaccaggaggagaauuuacuguuucaccacgcaaugccccuggagaaauacuauggucagcaccucuaggaccagaucuuaauccauaucuuucacaccuagcaagaauguauaauggauacgcaggaggcuuugaaguacaaguaauacuagcuggaaaugcuuuuacagcaggcaaaguuauuuuugcagcaguaccaccaaauuuuccaacugaaggucuaucaccaucacaaguaacuauguuuccacauauuguaguagacguacgacaacuagaaccaguuuuaauaccacuccccgauguacguaacaauuucuaucauuauaaucaaucaaaugacccaacaauaaaauuaauagcaauguuauacacaccccucagagcaaacaacgcuggagacgauguauucacuguaucaugccgaguauuaacucguccuucuccugacuuugacuucaucuucuuaguucccccaacaguagaaucuagaaccaaaccauucagcguaccaguacuaacaguugaagaaaugacaaauucacgauuuccuauaccccuugaaaaacuauuuacaggaccaagcucagcauuuguaguacaaccacaaaauggaagaugcacaacagauggaguauuacuuggcacaacccaacuuucaccaguaaacauauguacauuucgaggggacguuacacauauuacuggaucaagaaauuacacaaugaaccucgcaucucaaaauuggucuaauuaugacccaacagaagaaauaccagccccuuuaggaacaccagacuuuguuggcaaaauacaaggaguauuaacacaaacaacacgcacugacgguucaacuagaggacacaaagcaacaguuuauacaggaucagcagacuucgcuccaaaacuuggaagaguccaauucgaaacagauacagaucacgauuucgaaacaaaucaaaauacaaaauucacccccguaggcguaauacaagacgguagcacaacacacagaaaugaaccacaacaauggguauuaccaucauacucaggcagaaauacuccaaacguacaucuagcuccugcaguagcaccuacauucccuggagagcaguuauuauuuuuccgauccacaaugccaggcugcagugguuauccaaauauggauuuagauuguuuauuaccacaagaauggguucaauauuuauaucaagaagcagcaccagcacaaucagacguugcauuauuaagauucguuaauccugacaccggacgaguauuauucgaguguaaacuacacaaauccggcuauguaacaguagcacacacaggucaacaugaucuaguaauacccccaaaugguuauuuccgauucgacuccugggucaaucaauuuuacacacuagcaccaaugggaaauggaacaggacgacgaagauaa

SEQ ID NO: 34399 - RNA, 1617 nt, Artificial Sequence
  derived and/or modified sequence opt6 from VP1__Norovirus_and/or_Norovirus-like__LC005727
augaaaauggccuccagcgaugccaacccacccgacggaucagcugcaaauuuaguuccagaaguaaacaacgaagucauggcacuugaaccaguaguaggagccgcuauugcagcuccaguagcuggacaacaaaacguaauagauccuuggauaagaaauaauuuuguacaagcuccaggaggugaauuuacuguaucaccacgaaaugccccaggagaaauucuauggucagcaccauuaggaccugauuuaaacccauauuuaucucaccuagcaagaauguauaauggauacgccgguggauucgaaguacaagucauacuagcaggcaaugcauucacagcuggaaaaguaauauuugcagcaguuccaccaaauuucccaaccgaaggacuaagcccaucacaaguuacuauguuuccucauauaguagucgacguccgucaacuugaaccaguccuaauaccauuaccagaugucagaaacaauuuuuaucauuauaaccagucuaaugacccaacaauaaaacuaauagcaaugcuuuauacaccauuacgugccaacaacgcaggagaugacguauuuacaguaucauguagaguauuaacuagacccucuccagauuucgauuuuauauuuuuaguacccccaacuguagaaucacgaacaaaaccuuuuuccguaccaguacuuacaguagaagaaaugacaaacucacgauucccaauaccacuugaaaaacuauuuacaggaccaucuucugcauucguaguacaaccccaaaacggaagauguacaacagauggaguucuacuaggaacaacucaauuauccccaguaaauauauguacauuucgaggcgacguaacacauauaaccggaucccauaacuacacaaugaaccuugcuucacaaaauuggaauaauuaugauccaacagaagaaauaccugcuccacuuggaacacccgauuuuguagguaaaauacaaggaguacuaacucaaacaacaagaaccgauggauccaccagaggccauaaagcuaccguauauacuggaucggcugauuucgcuccuaaauuaggucgaguccaauucgaaacugauaccaaucacgauuuugaagcaaaucaaaauacaaaauuuacaccaguaggaguaauacaagauggaggaacaacacaccguaacgaaccgcaacaauggguacuuccaucauauucaggacgaaauacacauaauguacauuuagcaccggcaguugcuccaacauucccaggagaacaacuauuauuuuucagaucuaccaugccaggcugcucaggauacccaaauauggauuuagauugccuauuaccacaagaauggguacaauauuuuuaccaagaagccgcaccagcacaaucagacguagcacuauuacgauuuguuaacccagauaccggccgagucuuauuugaauguaaauuacacaaaucaggcuaugucacagucgcucauaccggacaacacgaucuuguaauaccaccaaauggauacuucagauuugauuccuggguuaaucaauuuuauacucuagcaccaauggguaacggaacaggacgaagacguuaa

SEQ ID NO: 34400 - RNA, 1617 nt, Artificial Sequence
  derived and/or modified sequence opt6 from VP1__Norovirus_and/or_Norovirus-like__LC016603
augaaaauggcuaguaaugacgcaucaccaagcgacggaucuacagcaaaucuaguacccgaaguaaauaaugaaguuauggcauuagaacccguagucggagcagcaauagcagcaccaguagcaggacaacaaaauguaauugacccuuggauaagaaauaauuuuguacaagcaccugguggagaauuuacuguaucuccacgcaaugcaccaggagaaauacuuuggucagcaccauuaggacccgacuuaaauccauauuugucacaucucgcaagaauguauaacggauacgcaggaggauucgaaguacaaguaauacuugcagguaacgcauuuacagcaggaaaaauaauauucgcagcagucccuccaaauuuuccuaccgaaggacuaucaccuucacaagucaccauguuuccacauauaauagucgauguacgacaauuagaacccguacuaauaccacuaccagauguaagaaauaacuuuuaucacuauaaucaaucaaaugauucuacaauuaaauuaauagcaaugcuauacacuccauuaagagcuaacaaugcuggagaugacguauucacuguaucuugucgagucuuaaccagaccaucucccgauuuugacuucauauuucuuguaccaccaaccguagaauccagaaccaaaccauuuacaguucccauacuaacaguagaagaaaugacuaacuccagauuuccaauuccccuagaaaaacuauuuacagguccaucaucugcauuugucguucaaccacaaaauggaagauguacaacugacggaguacuauuaggcacaacacaacuuuccccaguuaauauauguacauuccgaggugacguuacucauauuucaggcacuucuacauacagaaugaacuuagcuucacaaaacuggaacaauuacgaucccaccgaagaaauaccagcaccccuaggaacaccagauuucguaggaaaaauacaaggaauguuaacacaaacaacaaaaggagauggcaguacgagaggacacaaagcuacaguaucaacaggaucaguagauuucacaccuaaauuagguaguguacaauucgccacagauacagauaaugauuucgaaacaggacaaaauacaagauuuacaccaguaggagucauacaagauggaucaggagcacaucgaaaugaaccacaacaauggguacuuccagacuacucaggaaaaacuguacauaauguacaccuagcaccagcaguagcuccaacauuuccaggagaacaauuauuauucuuuagauccacaaugccagguuguucaggauacccaaacauggaccucgacugucuuuuaccacaagaauggguacaacauuuuuaucaagaagcagcccccgcacaaucagauguagcacuauuaagauucguuaauccugacaccggaagaguacuauucgaaugcaaacuacacaaaacagguuacgucacaguagcacauacaggacaacaugacuuaguaauaccacccaaugguuauuuccgauucgauucuugggucaaccaauucuacacauuagcacccaugggcaauggagcaggcagacgaagauaa

SEQ ID NO: 34401 - RNA, 1617 nt, Artificial Sequence
  derived and/or modified sequence opt6 from VP1__Norovirus_and/or_Norovirus-like__LC016599
augaaaauggcauccaacgaugcaucaccaucagacggaucaacagcaaacuuaguaccugaaguaaacaacgaaguuauggcuuuagaaccaguagucggagcagcuauagcagcaccaguagcuggucaacaaaauguaauagaucccuggauacgaaacaacuuuguacaagccccaggaggagaauuuacaguauccccacgaaacgcacccggagaaaucuuaugguccgcaccucuaggaccagaucuaaaucccuaccucucccacuuagcucgaauguauaacggauacgcuggagguuucgaaguacaaguaaucuuagcagguaaugcauucacugcaggaaaaaucauauucgcugcaguaccaccaaacuuuccaaccgaaggcuuaucuccaagucaaguuaccauguucccacacauuauaguagacguuagacaacuagaaccaguuuuaauaccacuaccagaugucagaaacaacuucuaccacuacaaucaaucaaaugacucaaccauaaaacuaauagcuaugcucuacacacccuuaagagcuaacaacgcaggagacgauguuuucaccguaaguugcagaguauuaacaagaccaucacccgacuuugacuuuauauuuuuaguaccaccaacaguagaaucacgaacaaaaccauucacaguaccuauuuuaacaguagaagaaaugacuaacucaagauuuccaauaccauuagaaaaacuauuuacaggaccuucauccgcauuuguaguacaaccacaaaacggucgauguacaacggacggaguucuacuaggaaccacucaauuaucaccaguaaacauuuguacauuuagaggagacguaacacauauaccuucaaccagaacauaucgaaugaauuuagcaucacaaaacuggaacaauuaugaucccacagaagaaauuccugcaccauuagguacaccagacuuuguuggaaaaauacaaggaauguuaacacaaaccacaaaaggagacggaucaacuagaggacauaaagcaacaguuucuaccggaagcguagauuuuaccccaaaacuaggaucaguacaauucgccacagauacggacaacgauuucgaaaccggccaaaacacacgauuuacuccaguugguguaauacaagauggaucauccgcucauagaaaugaaccucaacaauggguauuaccggacuauucaggaagaaccguacauaauguacauuuagcaccagccguagcaccaacauuuccaggagaacaacuauuauucuuccgaucaaccaugccaggcugcucaggauauccaaauauggaucuagauugucuauuaccacaagaauggguacaacacuuuuaucaagaagcagcuccugcacaauccgauguagccuuacuaagauucguaaacccggacacaggaagaguccuauuugaauguaaacuucauaaaacaggcuauguaacagucgcacacacaggccaacaugaccuaguuauaccaccaaauggcuacuuuagguucgauucaugggucaaucaauucuacacuuuagcuccuaugggcaacggagcuggaagacgacgauaa

SEQ ID NO: 34402 - RNA, 1617 nt, Artificial Sequence
  derived and/or modified sequence opt6 from VP1__Norovirus_and/or_Norovirus-like__KP293587
augaaaauggcuucuuccgacgccaauccaucugauggaucagccgcaaaucuaguacccgaaguaaacaacgaaguaauggcauuagaaccaguaguaggcgcagcaauagcagcaccaguugcuggacaacaaaauguaaucgauccuuggauuagaaauaauuucguacaagcacccggaggugaauuuacuguauccccacgaaacgcaccuggagaaauacuauggucugccccauuaggaccagaccuuaauccuuaucuaucucauuuagcacgaauguacaauggauacgcaggaggauuugaaguacaaguuauauuagcagguaaugcauucaccgcaggaaaaguaauauucgcagcaguacccccaaauuuuccuacagaaggauuaucacccucucaagucacaauguuuccacacauaguaguagacguaagacaacuaaagccaguccuaauuccauuaccagaugucagaaacaauuucuaucauuauaaccaaagcaacgauccaacaauaaaacuuauagcuaugcuauacacaccauuacgagcaaacaacgcaggcgacgaugucuuuacaguaucaugcagaguauuaaccagaccauccccagacuucgauuuuauauuuuuaguacccccaacaguagaaucaagaacuaaaccauuuucaguccccguacuaaccguagaagaaaugacaaacucucgauuuccaauaccauuagaaaaauuauucacaggaccaucuagugcauucgucguacaaccucaaaacggccgauguacaacagauggaguauuacuuggaacaacacaacuaagcccaguaaauauauguacauuuagaggagauguuacacauauaacaggaucucauucauacacaaugaaucuugcaucucaaaacuggucgaauuaugauccaacugaagaaauaccagcaccacuuggcacaccagauuuuguaggaaaaauucaaggcguauuaacacaaaccacaagaacagaugguucaacaagaggacacaaagcaacuguauauacaggauccgccgauuucgccccaaaauuaggaagagugcaauucgaaaccgauacaaaccacgauuuugaagcaaaucaaaauacaaaauucacaccaguaggaguaauacaagauggaucaacaacccacagaaaugaaccacaacaauggguacuuccaucuuauaguggaagaaacaccccgaacguacaucuagccccagcaguagcuccaacauuucccggagaacaacuacucuuuuuccgaucaacaaugccagguuguucaggauauccaaauauggaucuugauuguuuacuaccucaagaauggguccaauauuuuuaucaagaagcagcaccagcacaaucagacguagcuuuacuaagauucguuaacccagauacaggacgaguacucuucgaauguaaacuacauaaaucuggauacguuacaguagcacauacaggacaacaugaccuuguaauaccaccaaacggcuauuucagauuugacaguuggguaaaucaauucuauacacuagcuccaaugcgaaacggaacaggaagacgaagauaa

SEQ ID NO: 34403 - RNA, 1617 nt, Artificial Sequence
  derived and/or modified sequence opt6 from VP1__Norovirus_and/or_Norovirus-like__KP176402
augaaaauggcuucauccgaugcuaacccuuccgauggauccgcagcaaacuuaguuccagaagucaacaaugaaguaauggccuuagaaccaguuguuggagcggcuauugcagccccagucgcaggacaacaaaacguaaucgacccauggauaagaaauaaucuaguacaagcaccagguggugaauuuacaguaucaccuagaaaugcaccuggagaaauauuauggucagcccccuuaggcccagaauuaaauccauauuuaucacauuuagcuagaauguacaauggauacgcaggagguuucgaaguacaaguuauauuagcaggaaaugcauuuacagcuggaaaaguaaucuucgcagccguuccacccaacuuuccaacagaaggucuaucaccaucacaaguuacuauguuuccccacauaguaguagauguacgacagcuagaaccaguccuaauuccucuacccgauguaagaaauaacuuuuaucauuauaaccagucaaacgauccaacuauaaaacuaaucgcuauguuauacacaccauuacgagcuaauaaugcaggcgaugauguauuuaccguauccuguagaguccuuacccgaccuucacccgacuuugacuuuaucuuuuuaguacccccaacuguagaaucacgaacaaaaccguuuucagucccaguauuaacaguagaagaaaugacaaacucacgauuuccaauuccuuuagaaaaauuauuuaccgguccaucaucugcauucguaguacaaccacaaaacggaagauguaccacagauggaguacuacuaggaacaacacaauuaucaccaguaaauauauguacuuuuagaggugacguaacacacauaacaggauccagaaauuacacaaugaauuuagcaucacaaaacuggucaaauuacgauccaacagaagaaauuccagcgccacuaggcacaccagauuuuguaggaaaaauccaaggaguacuuacacaaacaacaagaacagacggaucaacaagaggacacaaagcaacagucuauacagguagcgccgacuuugcaccuaaacuaggaagaguacaauucgaaacugauacagaucgcgacuucgaagcaaaucaaaauacaaaauucacccccguaggcguaauccaagauggauccacaacacaucgaaaugaaccacaacaauggguauuaccaucauauucaggucgaaacacaccaaacguacaccuagcaccagcaguagcaccaacuuuuccuggcgaacaacuauuauuuuuccgaucaacaaugccaggauguagcggauaccccaacauggaccuugauugccuacugccucaagaauggguacaauacuucuaucaagaagcagcuccugcacaauccgauguugcauuacucagauucguaaaccccgauacagguagaguauuauucgaaugcaaacuacauaaaucagguuauguaacaguagcucacacaggacaacaugaucuaguaauuccucccaacgguuacuucagauuugauucauggguaaaucaauuuuacacauuagcaccaaugggaaacggcacaggcagaagacgauaa

SEQ ID NO: 34404 - RNA, 1617 nt, Artificial Sequence
  derived and/or modified sequence opt6 from VP1__Norovirus_and/or_Norovirus-like__KJ196287
augaaaauggcaucuucagacgcaaacccuagcgauggaucgacagcuaaccuuguaccagaaguuaacaaugaaguaauggcauuagaaccagucgucggagcagccauagcugcaccaguugcaggccaacaaaauguuauagacccuuggauccgaaauaacuuuguacaagcaccaggaggagaauuuacaguuucaccucguaaugcaccuggagaaauacuauggucagcaccacucggucccgacuuaaauccauaucuaucccauuuagcaagaauguauaacggccaugcaggagguuucgaaguccaaguaauauuagccggaaaugcauucaccgcaggaaaaauaauauuugcagcaguacccccuaacuuuccaacagaaggacucucccccucucaaguaacaauguucccucacauuauaguagacgucagacaacucgaaccaguauuaauaccccuuccagauguaagaaacaauuuuuaccacuauaaccaaucaaaugauucaacaauaaaauuaauagcaauguuauacacaccauuaagagcaaauaaugcaggagaagacgucuuuacagucucaugccgaguacucacaagaccaucaccagacuuugacuucauauuucuaguaccaccaacaguagaaucaagaacaaaaccauuuaccguaccaauacuuacgguugaagaaaugaccaacucuagauuuccaaucccacuugaaaaauuauuuacaggacccucuagugccuucguuguccaaccacaaaaugguagauguaccacagacggaguacuacuaggaacaacacaauuauccccagucaacauauguaccuuuagaggagaugugacacauauagcaggaucacgaaauuacacaaugaaucuagcauccuuaaacuggaacaacuacgacccaacugaagaaaucccagcaccacuaggaaccccugacuucguaggaaaaauccaaggaguauuaacccaaacaacaaaaggagacggauccacaagaggacauaaagccacaguauauacagguucagcaccuuuuacaccaaaauuaggauccguacaauuuucaacagacacagaaaacgauuucgaaacacaccaaaacacaaaauuuacaccaguaggaguaauacaagauggaggaacaacacaccguaacgaaccucaacaauggguacuaccaucauacagcggcagaaauguacauaacguacaucucgcuccugcaguagcaccuacuuuuccaggagaacaauuauuauucuucagauccaccaugccaggaugcucaggauauccaaauauggaccuagauuguuuacucccacaagaauggguacaacauuuuuaccaagaagcagcuccggcacaaucugacguagcacucuuaagauucguuaacccagacacuggucgaguacuuuucgaaugcaaacuacacaaaucaggauacgucacaguugcacacacuggccaacacgaucuaguaauaccaccgaaugguuacuuucgauuugauucauggguaaaccaauucuauacccuugcaccaaugggaaauggcacuggcagacgacgauaa

SEQ ID NO: 34405 - RNA, 1617 nt, Artificial Sequence
  derived and/or modified sequence opt6 from VP1__Norovirus_and/or_Norovirus-like__KM198480
augaaaauggcaucaaaugacgcaaacccauccgacggaucagcagcaaauuuagucccagaaguaucaaaugagguuauggccuuagaaccaguaguaggugcagcaauagccgccccaguugcaggacaacaaaauguuauugacccauggauaagaaacaacuucguucaagccccaggaggagaauuuacaguaucaccaagaaaugcccccggagaaauucuauggucagcaccucuuggaccagacuuaaauccauauuuaagccacuuagcaagaauguauaacggauacgcuggaggauucgaaguacaaguaauauuagcaggaaacgccuuuacagcaggaaaaauaauuuuugcagccguaccaccaaauuuuccaacagaaggccuaaguccuucacaaguaacaauguucccucacauuauagucgacguaagacaauuagaaccaguacuaauaccccuaccagacgucagaaauaauuucuaccacuauaaucaaacaaaugauucaacaauuaaauuaauagcaaugcucuacacaccacuucgagcaaacaaugcuggagaagauguauuuaccguaucauguagaguauuaacacgaccaucucccgauuucgauuuuauauuuuuaguuccaccuacgguagaaucccgcacaaaaccauucacuguaccaauccuaacagucgaagaaaugacuaauucaagauucccuauaccucuugaaaaacuauucacaggaccaucuggggcuuuuguuguucaaccacaaaacggacguuguacaacagacggcguauuauuagguacaacacaauuaagcccuguuaacauaugcacauuuagaggagacgucacacauauagcaggaucaagaaauuauacaaugaaucuagcaucucuaaacuggaacaacuacgaucccacagaagaaauaccugcaccccuuggaacaccagauuuuguaggcaaaauccaaggaguauuaacacaaacaacuaaaggugacgguucaacaagaggacacaaagccacaguuuauacaggaucagccccauuuacaccaaaacuaggaaguguacaauucucgacugacacugaaaacgauuucgaaacacaucaaaacaccaaauucacaccuguaggcgucauccaagacggaggaacaacacacagaaaugaaccacaacaauggguauuaccuucauacuccggaagagauguacauaacguacauuuagccccugccguagccccuaccuuucccggagaacaacuacuauucuucagauccacaaugccuggauguucaggauacccaaauauggaucucgacugucuucuuccucaagaauggguacaacacuucuaccaagaagcagcaccagcacaaagcgauguugcauuacuucgauuuguaaauccagacacuggaagaguucucuuugaauguaaacuauauaaaucuggcuauguaacuguagcacauacaggccaacaugacuuaguaauaccaccaaacgguuacuucagauucgauuccuggguaaaccaauuuuacacacuagcaccaaugggaaaugguacuggccgaagaagauaa

SEQ ID NO: 34406 - RNA, 1617 nt, Artificial Sequence
  derived and/or modified sequence opt6 from VP1__Norovirus_and/or_Norovirus-like__KJ716357
augaaaauggcaucaucagacgcaaauccuucugauggaagugcagcaaacuuagucccugaaguaaacaaugaaguaauggcauuagaaccuguuguaggagccgcaauagcagcaccuguagcuggacaacaaaaugucauagacccauggauaagaaacaauuucguacaagcaccaggaggcgaauuuacaguauccccaagaaaugcaccuggagaaauacuuuggucugcaccucucgguccagaucuaaauccauauuuaucccacuuagcaagaauguacaacggacacgcuggaggauucgaaguacaaguaaucuuagcaggaaaugcuuuuacagcuggaaaaguuaucuuugcagcaguuccacccaauuuuccaaccgaaggauuauccccuucacaaguaacuauguuuccucacauaguaguagacguuagacaauuagaaccaguacuuauaccucuaccagaugucagaaacaauuuuuaucacuauaaucaaucuaaugaucccaccaucaaauuaauagcaauguuauacacacccuuaagagcaaauaacgcaggagaugauguauuuacaguaucaugucgaguauuaacacgaccaucaccagacuuugauuucauauuucuaguaccaccaacagucgaaucaagaacuaaaccuuuuucaguaccaguucuaacuguugaagaaaugacuaauaguagauuuccaauuccucuagaaaaacuauuuaccgguccuaguucugccuucguaguucaaccacaaaauggcagauguacaacagacgguguacuucuaggcacaacucaauuaucaccagugaauauuugcacuuuuagaggagacguaacacauauuacuggaucaagaaauuauacaaugaaucuagcuucucaaaauuggaauaacuacgauccaaccgaagaaauuccagcaccccuaggaacuccagacuuugugggaaaaauccaagguguacuaacacaaacaacacgcacagacgguucaacaagaggacauaaagcuacaguuuauacaggaucagccgauuuugcaccaaaacuugguagaguacaauucgaaacagauacugaucacgauuucgaggccaaucaaaauacaaaauuuacaccuguaggaguaauacaagacggaggaacuacacauagaaacgaaccucaacaauggguauuaccaucauauucaggaagaaauacucauaauguacaccuagcaccagcaguugcaccaacuuuuccaggugaacaacuuuuauucuuuagauccacaaugccaggauguucagguuacccaaacauggaucuugauuguuuacuaccacaagaauggguucaauacuuuuaucaagaagccgcccccgcucagagcgauguugcucuauuaagauuuguaaauccagacacugguagagucuuauuugaauguaaauuacauaaaucuggguacguaacaguagcccacacaggacaacacgacuuaguuauacccccaaauggauauuucagauucgacucauggguaaaucaauuuuauacauuagcucccaugggaaauggaacaggacgaagaagauaa

SEQ ID NO: 34407 - RNA, 1617 nt, Artificial Sequence
  derived and/or modified sequence opt6 from VP1__Norovirus_and/or_Norovirus-like__KJ716354
augaaaauggcuucuucugacgccaaucccuccgauggaucagcagcaaauuuaguaccagaagucaacaacgaaguuauggcauuagaaccaguuguaggagcagcuaucgcagcaccuguagcaggucaacaaaauguaauagacccauggauuaggaauaacuuuguucaagccccuggaggagaguucacaguaucaccccguaaugcaccuggagaaauacuauggucagcaccccuaggcccugaucuaaacccauacuuaucucaucuugccagaauguacaacggauaugcaggaggauucgaaguacaaguaauacucgcugguaaugcauuuacugcuggcaagguaauauucgcagcugugccaccaaacuuuccaacugaaggccuuucaccaucacaaguaaccauguucccccacauaguaguugacguccgacaauuagaaccaguucuuauaccacuaccagauguaagaaacaacuucuaccauuauaaccaaucaaaugacccuaccauaaaauuaauagcaaugcuuuauacacccuuaagagcuaauaacgcuggugacgacguauucacagugucaugcagaguuuuaacucgaccuagcccagauuuugacuuuauauuucuaguaccaccuacaguagaauccagaacuaaaccauuuaguguaccaguauuaaccguagaagaaaugacuaacucacgauuucccauuccacuugaaaaacuauuuaccggaccaucaucagcauucguaguacaaccacaaaacggaagauguacaacagacggaguccucuuaggaacaacacaacuaucaccagucaauauauguacauuuagaggagauguaacccacauaacaggaucaagaaacuacacuaugaacuuagcaucacaaaauuggaacaauuaugauccaacagaagaaauaccugcaccacuuggaaccccagacuuuguaggaaaaauacaagggguacuaacucaaacaacacgaacugacggaucaacaagaggacacaaagcaacaguuuacauagguucugcagacuuugcaccaaaguuaggaagaguacaauucgaaacugauacagaccacgacuucgaagcaaaccaaaacacaaaauuuacaccaguuggaguaauccaagacgguggaacaacucacagaaacgaaccacaacaauggguucuacccucauauucaggacgcaauacacacaauguacauuuagcaccagcagucgcaccaacauuuccuggugaacaauuauuauucuuccguucaacaaugccaggauguucaggauacccaaauauggauuuagauugucuacuaccccaggaauggguacaauauuuuuaccaagaagcagcacccgcacaaucagacguagcauuacuacgauuuguuaacccagauacaggaagaguauuauucgaaugcaaacuccauaaaucuggauauguuacaguugcucacacaggacaacaugauuuaguaauaccaccaaacggauacuuucgauuugacagcuggguaaaucaauuuuacacauuagccccaaugggcaauggaaccggaagaagaagauaa

SEQ ID NO: 34408 - RNA, 1617 nt, Artificial Sequence
  derived and/or modified sequence opt6 from VP1__Norovirus_and/or_Norovirus-like__KJ685403
augaaaauggcaucaucagaugcuaaccccagcgacggcucuacagcuaacuuagucccagaaguuaauaaugaaguuauggcacucgaacccguaguaggagccgcaaucgcugcaccaguagcaggacaacaaaacguaauagauccauggauaagaaauaacuuuguccaagcaccuggaggugaauuuaccguauccccaagaaacgcacccggagaaauauuauggucagcaccacuaggaccagauuuaaacccauacuuaucucaucucgcucgaauguacaaugguuacgcaggaggauucgaaguacaaguaauacuagcaggaaaugcauucacagcaggcaaaauaaucuucgcagcaguucccccaaauuucccaacagaagguuuaucuccaucccaaguaaccauguuuccacacauaauaguagauguaagacaacuagaacccguauuaauaccauuaccagaugucagaaacaacuucuaccacuacaaccaaucaaacgacccaacaauaaaacuaauagcaauguuauauacaccacuacgagccaauaacgcuggugacgauguauuuacaguaucuuguagaguuuuaacaagaccaucgccagacuuugauuuuaucuuccuaguuccuccuaccguugaaucuagaacaaaaccauuuucaguaccaguacuaacuguugaagaaaugacuaauaguagauuuccuauaccacuugaaaaacucuuuacaggaccaucuucagcauucguaguacaaccacaaaacggcagauguacaacugacggugucuuacuaggaaccacacaauuaucaccagucaacauauguacauucagaggugaugucacacauauauccggcucaagaaauuacacuaugaacuuagcaucacaaaauuggaacucuuaugauccuacagaagaaauuccugcaccacuugguacaccagacuucguaggcaaaauucaaggaguuuuaacccaaacaacacguaccgacggaucaacacgaggucacaaagccacuguauacacaggaucagcagacuucaguccaaaacuaggaagaguacaauuuacaacagauacagacaaugacuucguaacaaaccaaaauacaaaauucacaccaguuggaguuauacaagacggcucuacuacaccccguaacgaaccacaacaauggguccuaccauccuacagcggucgaaauacacacaacguucaucuagcaccagcaguagcaccaacauuuccaggagaacaacuacucuucuucagaucaacaaugccagguugcucuggcuauccaaauauggauuuagauugcuuauuaccacaagaauggguacaauauuuuuaucaagaagcggccccagcacaaagugacguagcucuauuaagauuuguaaaccccgacacaggaagaguccuauuugaauguaaacuacauaaaucaggauauguaacaguagcucacacaggacaacacgaccuaguaauaccucccaauggguauuucagauuugauucuugggucaaccaauucuauacgcuagcaccaaugggaaacggaaccggcagaagaagauaa

SEQ ID NO: 34409 - RNA, 1617 nt, Artificial Sequence
  derived and/or modified sequence opt6 from VP1__Norovirus_and/or_Norovirus-like__KF060108
augaaaauggcaucaucagaugcuaauccaucagauggaucuucagcaaacuuaguaccugaaguaaacaaugaaguaauggcuuuagagccaguaguaggagcagcaauagcagcaccaguagcaggacaacaaaauguaaucgauccauggauaagaaauaacuuuguccaagccccuggaggugaauuuaccguuucaccaagaaaugcaccaggagaaaucuuaugguccgcuccauuaggcccagaucucaaucccuaucuaucacaccuagccagaauguacaauggauaugcaggagguuucgaaguccaaguuauauuagcuggcaacgcauucacggcaggcaaaauaauauucgcugcuguaccaccaaacuuuccaacugaaggauuaucaccuucacaaguaacuauguuuccucauauaauaguugauguaaggcaacuugaaccaguccuaauuccauuaccugauguaagaaacaauuucuaccacuauaaccaaucaaaugacccuacaauaaaauuaauagcaauguuauauacuccucuaagagcuaauaacgcaggcgacgauguauucacaguaaguuguagaguucuuaccagaccuagcccagacuucgacuuuauauuuuuaguuccaccaacaguagaaucaagaacaaaaccuuucagcgucccaguauuaacaguggaagaaaugacaaacucaagauuuccaauuccauuagaaaaauuauuuacugguccaucaagugcuuucguaguacaaccccaaaacggcagauguacaacagacggaguauuacuaggcacaacacaacuauccccuguuaacauuuguacauuuagaggagacguaacacauauauccggcucacgaaauuacacaaugaaucuagcuucccaaaacuggaauaguuacgacccaacagaagaaauaccagcaccucucggaacaccagacuuuguagguaaaauucaaggaguacuuacacaaacaacuagaacugauggaucaacuagaggucacaaagccacaguauacacaggauccgcugacuuuucacccaaacuaggccgaguacaauucgcaacagauacagacaaugauuucguaacuaaucaaaauacaaaauuuacacccguuggaguaauacaagauggaucaacaacaccaagaaaugaaccacaacaauggguauuaccaucauauucaggccgaaacacacauaacguucaccuugcaccagccguagcaccaacauuuccaggagaacaacuauuauucuuucgauccacaaugccaggauguucaggauauccaaacauggacuuagauugucucuuaccacaagaauggguucaauacuucuaccaagaagcagcccccgcucaaucagaugucgcacuauuacgauuuguaaacccugauaccggacgaguauuauucgaaugcaaacuccacaaaagugguuacguuacaguagcacauacaggacaacacgaccuagucauaccuccaaacggauauuucagauucgauuccuggguaaaccaauucuauacuuuagcaccaaugggaaacggcacaggaagaaaacgcuaa

SEQ ID NO: 34410 - RNA, 1617 nt, Artificial Sequence
  derived and/or modified sequence opt6 from VP1__Norovirus_and/or_Norovirus-like__KF060099
augaaaauggcaaguucugacgcuaacccaucagauggauccaccgcuaauuuaguaccugaagucaacaaugaaguaauggcauuggaaccuguuguaggagcagcaaucgcugcuccaguagcaggacaacaaaaugucauagauccauggauccgaaauaacuuuguucaagccccaggaggagaauuuacaguauccccaagaaaugcaccaggcgaaauauugugguccgcaccauuaggaccagauuuaaacccauaccuaucacaccucgcuagaauguauaacgguuaugcuggaggauuugaaguucaaguaauauuagcaggaaacgcauucacugcaggaaaaauuauuuucgcagcuguuccaccuaauuuuccaacagaaggacucuccccaucacaaguaacuauguucccucacauaauaguagacguacgacaauuagaaccaguacugauaccucuuccagauguaagaaacaacuucuaucauuacaaucaaucuaacgauccaacaauaaaacucauagcaauguuauacacgcccuuacgugcuaauaaugcaggagaugacgucuucaccguaucauguagaguucuaacacgaccaucaccagacuuugauuucauauucuuaguacccccuacuguagaaucucgcaccaaaccauucuccguaccagucuuaacaguagaagaaaugacaaauucccgauuucccauaccauuagaaaaacuuuucacuggaccaucauccgcauuuguaguacaaccccaaaauggacgaugcacaacagacggaguuuuacuaggaacaacucaacucucuccuguaaauauauguacuuuuagaggagacguaacacauauaccaggcucaagaaauuauacaaugaauuuagcaucucaaaauuggaacucauaugauccaacagaagaaaucccagcaccuuuaggcacuccagacuuuguagguaaaauacaagguguucucacacaaaccacaagaacagaugguucaacacgaggacacaaagcaacaguauauacagguucagcagauuuuucaccaaaacuuggaagaguacaauucgcuacagauaccgauaaugauuucguuaccaaucaaaauacaaaauucacccccguuggcguuauccaagacggaucaacaacucccagaaaugaaccacaacaauggguacuuccaucuuauucaggaagaaacacucauaacguacaucuagccccugcaguagcaccuacauucccaggagaacaacuuuuauuuuuccgaagcaccaugccaggauguucgggcuacccaaacauggacuuagauugucuacuaccacaagaauggguacaauauuucuaucaagaagcagcuccagcucaaucagacguagcacuacuacgauuuguaaacccagauacugguagaguuuuauuugaauguaaauuacacaaaucagguuaugucacaguagcccacacaggacaacacgaucuagucauaccaccuaacggcuauuuuagauucgauuccuggguaaaucaauucuacacucuagccccuaugggaaaugguacaggaagacgaagauaa

SEQ ID NO: 34411 - RNA, 1617 nt, Artificial Sequence
  derived and/or modified sequence opt6 from VP1__Norovirus_and/or_Norovirus-like__KF060004
augaaaauggcuagcucagacgcaaauccaucagauggaucaguagcuaacuuaguuccugaaguaaacaaugaaguaauggcccucgaaccaguaguaggagccgcuauagccgccccagucgccggacaacaaaacguaauugacccauggauaagaaauaauuuuguacaagcaccaggaggugaauuuacaguauccccacgaaacgccccaggagaaauacucugguccgcaccccuaggaccggacuuaaacccauaucuaucucaccuagcaagaauguauaaugguuaugcuggaggcuucgaaguccaaguaauuuuagcagguaaugcauuuacagcaggcaaagucauuuuugcagcaguaccaccaaacuuuccaacugaaggacuaucaccaucacaaguaacaauguuuccacacauaguuguagacguacgacaacucgaaccaguauuaauaccucuccccgauguaagaaacaauuuuuaucauuauaaucaaucuaaugauccaacaauuaaacucauagccaugcucuauacuccauuaagagcaaacaaugcaggagaugauguauucacaguaucaugucgcguucucacuagaccaucaccagauuuugauuuuauauuccuagucccaccaacagucgaaucaagaacuaaaccuuucucaguaccaguauuaacaguugaagaaaugacaaacuccagguuuccaauaccucuugaaaaacuauuuacugguccaucaucugcuuucgucguacaaccucaaaauggacgauguaccacagauggcgucuuauuaggaacuacacaauuauccccuguaaauauauguacauuuagaggagacguaacucacauaacugguucaagaaauuacaccaugaacuuagcaucucaaaacuggaauaacuacgauccaacagaagaaauaccagcacccuuagguacaccagacuuuguagguaaaauacaaggaguucuaacucaaaccacuagaacagacggcucaaccagaggacauaaagcaacugucuauacagguagugccgacuuugcaccaaaacucggcagaguacaauuugaaacagauacagaucaugauuucgaagcaaaccaaaacacaaaauuuacaccaguaggcguuauacaagacggaggaacaacacauagaaaugaaccucaacaauggguacuacccagcuauucaggacgaaacacccacaauguacacuuagcacccgcaguagcaccuaccuuuccaggagaacaacuauuauucuuuagaucaacaaugccaggaugcucaggcuacccaaauauggaucucgauuguuuauuaccacaagaauggguacaauauuucuaucaagaagcagcaccagcacaauccgauguugcccuuuuacguuucguaaacccagacacaggaagaguauuauuugaauguaaauuacacaaaucaggcuacguuaccguugcacacacaggacaacacgacuuaguaauaccuccuaauggauacuuuagauucgauuccuggguaaaccaauuuuacacacuagcuccaaugggcaacgguacaggaagacgaagauaa

SEQ ID NO: 34412 - RNA, 1617 nt, Artificial Sequence
  derived and/or modified sequence opt6 from VP1__Norovirus_and/or_Norovirus-like__KF060006
augaaaauggcuucaucugaugcaaauccaucugauggaucuacagcuuccuuaguacccgaaguaaacaaugaaguuauggcucuugaaccuguuguuggcgcagcaauagcagcaccaguugcaggccaacaaaauguaauagacccauggauaagaaauaacuuuguacaagcuccuggaggagaauuuacuguuuccccacgaaaugcaccaggugaaauauuauggucugccccacuagguccagaucuaaacccauauuuaucacaucuugcacguauguacaauucuuacgccgguggcuuugaaguccaaguaauucuagcaggcaaugcauuuacugccggaaaaauaauuuucgcagcuguaccaccaaacuucccaacagaagguuuaucaccaucacaaguaacuauguuuccacacauaauagucgacguuagacaacuagaaccaguacuaauaccacuucccgauguccgaaacaacuucuaucacuacaaucaaaguaaugauccuacaauaaaauuaauagcaauguuauauacaccauuacgagcuaacaaugcuggugaugauguauucacaguuucuugcagaguacucacuagaccuucuccagacuuugacuucauauuucuaguucccccaacaguagaaucaagaacaaaaccuuucucgguaccagucuugacaguagaagaaaugaccaacucaagauuuccaauuccauuagaaaaauuauuuacuggccccucaucagcauuuguuguacaaccccaaaauggacgaugcaccacagaugguguauuauuaggcacaacccaacuaucaccaguaaauauauguacauuuagaggcgacguaacacacauaaguggaucacacaauuauacaaugaaucuagcaucacaaaacuggaacucauacgauccaacagaagaaauaccagcuccacuugggacaccagacuucguugguaaaauacaagguguauuaacucaaacuacacgaaucaacgguucuacuagaggacacaaagcuacaguauauacaggcucugcagacuuuucuccuaaacuaggaagaguccaauucgcaacugauacagauaaugauuuugaaacaaaucaaaauacaaaauucacuccaguaggcguaauacaagacggaucaacaacaccacgaaacgaaccacaacaauggguacucccaucauacucugguagaaacacucauaauguucaucucgcaccagcuguagcccccaccuucccuggugaacaacuacuauucuuucgcucuacaaugccaggaugcucugguuauccaaauauggaucuugauugccuauuaccacaggaauggguucaauacuuuuaucaagaagcagcaccagcacaaucagauguagcauuauuacgcuuuguaaauccagacacaggaagaguauuauucgaaugcaaauuacacaaaucaggcuauguaacaguagcacauacaggccaacaugaucuagucauaccaccaaauggauacuucagauuugauucauggguaaaucaauucuacacucuagcaccaaugggcaauggaaccggacgaagacguuaa

SEQ ID NO: 34413 - RNA, 1617 nt, Artificial Sequence
  derived and/or modified sequence opt6 from VP1__Norovirus_and/or_Norovirus-like__KC517371
augaaaauggcaucuaaugacgccaacccaucugauggcucugcagcuaacuuaguaccagaaguagacaaugaaguaauggcauuagaaccaguuguuggagcagcaauagcggcaccaguagcuggccaacaaaauguaauagacccauggauaagaaauaacuuuguacaagcaccagguggagaauuuacaguauccccacgaaaugccccaggagaaauacucuggucagcaccacuaggaccagaucuaaaucccuaucuaucccacuuagcaagaauguauaacggauacgcaggaggauuugaaguccaaguaauacuagcaggaaaugcauucacagcuggaaagauaauauucgcagcaguaccuccaaauuucccaaccgaaggauuaucaccaucucaaguaacaauguuuccacauauuauuguugaugucagacaacuagaaccaguacuaaucccauuaccagacguacgaaauaauuucuaucauuauaaccaaagcaaugacucaacuauaaaacucauagcuauguuauauaccccacuacgagccaauaaugcaggagaagauguauuuacaguauccugucgaguacucaccagaccaucaccugacuuugacuuuauauucuuagccccaccaacuguagaaucaagaacaaaaccuuucacaguaccuauauuaacagucgaagaaaugacuaacucuagauucccuauaccacuagaaaaauuauucacagguccaucaucugcuuucguaguacaaccccaaaacggaagauguacuacagauggaguauuacuagguacaacacaauuaucaccaguaaacauuugcacauuuagaggugauguaacacauauagccggaucuagaaacuauacaaugaacuuagcaucacucaacuggaacaauuaugauccaacagaagaaauaccagcaccccuaggcaccccagauuucguagguaaaauacaaggaaugcuaacacaaacaacaaaaggagauggaucaaccagaggacacaaagcaacggucuauacagguucugcccccuuuacaccuaaauuagguuccguccaauuugaaaccgauacagaaaacgacuucgaaacacaucaaaauaccaaauucacacccguaggaguuauccaagauggaggaacaacucauagaaaugaaccccaacaauggguacuaccaucauauucaggucgaaaugucccuaauguacacuuagcaccggcaguagcaccaacauuuccuggagaacaauuacuauucuuucguucaacuaugccaggaugcuccggauacccaaauauggaucuagauugccuacuaccucaagaauggguccaacacuucuaucaagaagcugcuccugcacaaucagacguggcauuauuaagauuuguuaacccagacacuggcagaguacuuuuugaaugcaaacuacauaaaucaggauauguaacaguagcacacacaggacaacacgauuuaguuauaccaccaaacggauauuucagauucgacucauggguaaaucaauucuauacccucgcaccaaugggaaauggaacuggaagaagaagauaa

SEQ ID NO: 34414 - RNA, 1617 nt, Artificial Sequence
  derived and/or modified sequence opt6 from VP1__Norovirus_and/or_Norovirus-like__JX459657
augaaaauggcaagcucugaugcacauccaucugauggaucgacagcaaaucuaguaccagaaguaaauaaugaaguaauggcacuagaaccagucguuggagccgcuauagcagccccaguggcuggacaacaaaauguaauagacccuuggauaagaaauaauuuuguacaagcacccggaggagaauuuacaguaucaccacgaaacgcaccuggcgaaauacuuuggucagcaccauuagguccagaccuaaauccuuaucuaucacaucuagcaagaauguauaauggauaugcuggaggauuugaaguccaagucauauuagcaggcaaugcauuuacagccggaaaaauuaucuucgcugcaguaccaccaaacuuuccaacagaaggacuaagccccucucaaguaacaauguucccacacauaguagucgacguaagacaauuagaaccaguauuaauaccccuuccagacgucagaaacaacuucuaccacuauaaucaauccaaugacccaacaauuaaacuaauagcuauguuauauacacccuuaagagcuaauaacgcaggagaugacguauucaccguaucauguagaguauuaaccagaccuucaccagauuuugacuuuaucuuuuuaguuccaccaacaguagaaucaagaacaaaaccuuuuaguguacccgucuuaaccguagaagaaaugacaaacucucgauuucccauuccacuugaaaaauuauucacuggaccaucaucagcauuuguuguacaaccccaaaacgguagauguacaacagacggcguauuauuaggaaccacccaauuauccccagucaauauauguaccuuuagaggcgacguaacacacauaucugguucaagaaacuauacaaugaaucuagcaucacaaaauuggaacucauacgauccaaccgaagaaauuccugcaccauuaggaacuccagacuucgucggaaaaauacaaggaguauuaacacaaacaacaagaacagacgguucaacaagaggacacaaagcuacuguauauacaggaucagcagauuuuucaccaaaguuaggucguguacaauuugcaaccgauacugauaaugacuucguaacuaaucaaaauacaaaauucacaccaguaggagucauacaagacggaucuacaacaccaagaaaugaaccccaacaauggguacuacccagcuauagcggacgaaacacacacaacguacaccucgcaccagcaguagcaccuacauuuccaggagaacaauuacuauucuuuagaucuaccaugccaggcugcaguggauauccaaauauggaucuagacugcuuauuaccucaagaauggguacaauauuuuuaccaagaagcagccccugcacaaucagacguagcacuauuaagauucguaaacccagauacuggccgcguacuauucgagugcaaacuacauaaaucuggauauguaacagucgcacacacaggacaacaugaucuuguuauaccaccuaacggauacuuccguuucgauucauggguaaaucaauuuuacacucuagcucccaugggaaaugguacaggucgaagacgauaa

SEQ ID NO: 34415 - RNA, 1617 nt, Artificial Sequence
  derived and/or modified sequence opt6 from VP1__Norovirus_and/or_Norovirus-like__JX459656
augaaaauggcaaguucagacgcacauccaucagauggcucgacagcaaaucuuguacccgaaguaaacaacgaaguaauggcacucgaaccaguuguaggcgcagcaauugcagcaccaguagcaggacaacaaaauguuauagacccuuggauacgcaacaauuucguacaagcaccaggaggagaauuuacaguaaguccacgaaaugcaccaggagaaauauuauggucagcaccuuuaggucccgaucuuaauccauauuuaucacaccuagcacgcauguauaacggauacgcaggaggauucgaaguacaagucauccucgccgguaaugccuuuacagcuggaaaaauaauauucgccgccguaccaccaaauuuuccaacugaaggacuuuccccaucccaaguaacaauguucccacauauaaucguagacguacgacaacuagaaccuguucuaaucccacucccagaugugagaaacaauuucuaucauuauaaucaauccaacgauccaacaauaaaacuaauagcaaugcuauacacaccacuaagagcaaauaacgccggagacgauguauuuaccguuucaugucguguuuuaacuagaccaucaccagauuuugauuuuauauuccuaguacccccaacagucgaaucaaggacuaaaccauuuuccgucccagucuuaacagucgaagaaaugacaaacucacgauucccaauaccacucgagaaauuauucacagguccaucaucugcauucguaguacaaccacaaaacggacgaugcacaacagacggcguacuacuuggaacaacucaacucucaccuguaaauauauguacauucagaggagauguaacccacauaccaggaagccgaaacuauacaaugaaucuagcaucacaaaacuggaacucauacgacccaacagaagaaaucccagcaccacuaggaaccccagacuucguaggaaaaauacaagguguccuaacucaaaccacgagaacaaauggaucaacuagaggacauaaagcaacaguauauacaggaucagcagauuuuuccccaaaacuuggcagaguacaauucgcaacagauacagacaaugacuucgaaacaaaucaaaauacaaaauuuacaccaguaggaguaauacaagacggauccacaaccccaagaaaugaaccacaacaauggguacuaccauccuauucaggaagaaauauacauaauguucauuuagcaccagcaguagcaccaacauuuccaggugaacaacuauuauucuuucgaucuacaaugccuggguguuccggauacccaaacauggacuuagauugccuccuaccacaagaauggguccaauauuucuaucaagaagccgcaccagcacaaucagacguagcauuacucagauuuguaaacccagauaccggacgaguacuauucgaauguaaacuacauaaaucaggauauguaacuguagcacauacaggacaacaugaccuaguaauaccaccaaauggauauuucagauucgacucguggguaaaccaauuuuauacccucgcuccaaugggaaacggaacaggccgaagaagauga

SEQ ID NO: 34416 - RNA, 1617 nt, Artificial Sequence
  derived and/or modified sequence opt6 from VP1__Norovirus_and/or_Norovirus-like__JX445152
augaaaauggcauccaaugacgcaaauccauccgacgguagcaccgcaaauuuaguaccugaagucaacaaugaaguaauggcauuagaaccagucguaggagcagcaauagcugcaccugucgcaggucaacaaaacguuauagauccauggauacgaaacaauuuuguucaagcaccagguggugaauuuacaguauccccaagaaaugcaccuggcgaaaucuuauggucagcaccacuaggucccgaucucaacccauacuuaucacaccuagcacgaauguauaauggauaugcuggagguuuugaaguacaaguaauccuagcuggcaaugccuuuaccgcaggaaaaaucauauucgcagcaguaccuccaaacuuuccaacagaagguuuaucuccaucacaaguaaccauguuuccacacauuauaguagacguacgacaauuagaacccguacuaauuccccuacccgacguaagaaacaauuucuaucauuauaaucaauccaaugauccuacaaucaaacuaaucgcaauguuauacacaccacuuagagcaaacaaugcuggagaagacguauuuacuguaucauguagaguacuaacuagaccaucuccagacuucgauuucaucuuuuuaguucccccaacaguagaaagucgaacgaaaccauucacaguacccauacuaacagucgaagaaaugacuaauucacgauucccaaucccacucgaaaaauuauuuaccgguccauccggagcauucguaguccaaccucaaaaugguagauguacuacugacggcguccuccucgguacaacacaacuaucaccaguaaauauuugcacauuuagaggagacguaacccauauagcagguacacacaauuacacuaugaaucuagcaucacaaaauuggaauaauuacgauccaacagaagaaauaccagcaccacuagguaccccagauuucguaggaagaauacaaggaauguuaacacaaaccacuagaggagacggaucuacacguggacacaaagcaaccguaucuacaggagacguacauuucacaccaaaacuuggauccauccaauuuaacacagauacaaacaaugacuuugaagcaggucaaaacacaaaauuuaccccugauggaguuguacaagauggaaacgguacacaucaaaaugaaccacaacaauggguacuaccaucauauucaggaagaacaggccauaauguucauuuagcaccagcuauagcaccaaccuucccaggcgaacaauuacuuuucuuuagaucaacaaugccaggauguucagguuauccuaacaugaauuuagacugccuccucccacaagaauggguacaacacuuuuaucaagaagcagcaccagcccaaucagacguagcccuucuacgauucguaaacccagauacaggacgaguauuauucgaaugcaaacuacacaaaucuggcuacguaaccguagcacauacaggacaacacgacuuaguaaucccaccaaauggcuauuucagauucgauuccuggguaaaucaauuuuacacacuagcacccauggguaauggaacuggacgucgcagauaa

SEQ ID NO: 34417 - RNA, 1617 nt, Artificial Sequence
  derived and/or modified sequence opt6 from VP1__Norovirus_and/or_Norovirus-like__JQ613553
augaaaauggcuucaucugacgcaaaccccagcgauggauccacugccaaucucguaccagaaguuaauaacgaaguaauggcccuagaaccaguaguaggagcagcuauagcagcaccaguagcuggacaacaaaauguaauagacccuuggauacgaaauaacuuuguacaagcaccaggaggagaauuuacaguuucaccaagaaaugcaccaggcgaaauacuauggucugcaccauuaggaccagaucucaauccauaccuaucacacuuagcaagaauguacaacggauaugcaggaggauucgaaguacaaguaauauuagcaggaaaugccuuuacugcgggaaaaauaauauuugcagcuguacccccaaacuuuccuaccgaaggacuaucacccucacaaguaacaauguucccacacauuaucguugauguaagacaacuagaacccguauuaauaccccuaccagacguaagaaauaacuucuaucacuauaaccaaucuaaugacccuaccauaaaacucauagcaauguuauauacuccacuacgcgcaaacaaugcaggagaugauguauuuacaguaucauguagaguacucacgagaccaucaccagacuucgauuuuauauuucuaguacccccaaccguagaaucaagaacuaaaccuuucuccguaccaguucuaacaguucaagaaaugacaaacucaagauuuccaauuccacuagaaaaauuauucacaggaccauccucagcuuucguaguucaaccacaaaacggcagauguaccacagauggaguauuauuaggaaccacccagcuauccccuguaaauauauguacauuccguggugauguaacacauaucccaggaucgcgaaacuacacaaugaaccuagcgucacaaaauuggaacucuuaugacccuacagaagaaauacccgcuccacuaggaacuccugacuuugucggaaaaauccaagguguuuuaacacaaacaacaagaaccaacggaucaacaagaggacacaaagcaaccguauauacaggaucagcagacuuuagcccaaaauuaggaagaguacaauucgcaacagacaccgauaacgauuucgaaacaaaucaaaauacuaaauuuaccccaguuggaguaauccaagacgguucaacaacaccuagaaaugaaccacaacaauggguauuacccucauauucuggacgaaauauacauaacguucacuuagcuccugcagucgcaccaacauuuccuggagaacaacuauuauucuuuagauccacaaugccuggauguucuggauacccaaauauggaucuagacugccuauuaccacaagaauggguacaauauuuuuaucaagaagcagcaccagcacaaucagacguagccuuacuaagauuuguaaauccagauacaggucgaguauuauucgaaugcaaauuacauaaaucaggcuauguaacaguagcucauacaggccaacacgacuuaguaauaccaccaaacggauacuuuagauuugacucaugggugaaucaauucuacacauuagcaccaauggguaauggaacuggaagaagaagauaa

SEQ ID NO: 34418 - RNA, 1617 nt, Artificial Sequence
  derived and/or modified sequence opt6 from VP1__Norovirus_and/or_Norovirus-like__JQ613521
augaaaauggcaucaaacgacgccaauccuagcgauggaucugcagccaacuuaguuccagaaguaucaaaugaaguaauggcauuagaacccguaguaggagcagcuauagcugcaccaguagcaggacaacaaaauguaaucgauccuuggauaagaaauaacuuuguacaagcaccuggcggagaauuuacaguuucaccuagaaaugcaccaggagaaauuuuguggucagcaccacuuggaccagaccucaauccauauuuaucucacuuagcaagaauguacaacggauacgcaggaggauucgaaguccaagucauacuagcaggaaaugcauucacugcuggaaaaauaaucuucgcugcaguuccaccaaacuuuccaaccgaaggccuaucacccucucaaguaacaauguucccucacauaauaguggacguacgacaacuagaaccaguauuaauuccuuuacccgacguaagaaacaacuucuaccacuauaaucaaucuaaugauucaaccauaaaauuaauagcuaugcuauacacaccccuaagagcaaauaaugcuggugaagauguuuuuacaguaaguugcagaguccuaacacgaccaucaccugauuuugauuuuauauuucuaguacccccuacuguagaaucacgaacuaaaccauuuacagucccaauuuuaacaguugaagaaaugacuaacaguagauucccaauacccuuagaaaaacuauuuacaggaccaucaggagcauucguuguucaaccacaaaauggcagaugcaccacagacggaguguuauuaggaacaacacaacuaucaccuguaaauauauguacauucagaggagacguaacacacauagcaggaagcagagacuauacaaugaauuuagcaucucuuaacuggaacaacuaugauccaacagaagaaacaccagcaccacuaggaacacccgauuuuguaggaaaaauacaaggaauguuaacacaaacaacuaaaggagauggaaguacaagaggacacaaagcaacaguuuacacaggaucagcaccauuuacacccaaauuaggcaguguaagauucucaacagauacagaaaaugacuucgaaacacaccaaaauacaaaauuuaccccaguuggaguaauacaagacggauccacaacacauagaaacgaaccacaacaauggguucuuccaucguauucaggacgagauguacauaacguccacuuagcacccgcagucgcacccacauuccccggagaacaauuacuauucuuuagaucuacaaugccaggauguucuggauauccaaauauggaccuagauugccuauuaccacaagaauggguacaacauuuuuaccaagaagcugccccagcccaaucagacgucgcauuacuaagauucguuaauccagacacaggacgaguacuauucgaaugcaaauuacauaaaucugguuauguaaccguagcucauaccggacaacacgaccuaguaauaccaccaaauggcuauuuuagauucgauuccugggucaaucaauuuuacacacuagcaccaauggguaacggaacaggacguagaagauaa

SEQ ID NO: 34419 - RNA, 1617 nt, Artificial Sequence
  derived and/or modified sequence opt6 from VP1__Norovirus_and/or_Norovirus-like__HQ005298
augaagauggcaucaucagaugcaaacccaucagaugguucaaccgcaaacuuaguacccgaaguaaauaacgaaguaauggcuuuagaaccaguaguaggugcagcuauagcagccccaguagcaggacaacaaaacgucauagaucccuggauuagaaauaauuuuguccaagcaccagguggagaauuuacuguaucaccuagaaacgcaccaggagaaauauuauggucagcaccauuaggacccgauuuaaauccauaucucucacacuuaucgagaauguauaacgguuacgcaggaggauucgaaguccaaguaauauuagccggcaaugccuuuaccgcaggcaaaaucauuuucgccgcaguuccaccaaacuuuccaacagaaggacuuucaccaucacaaguaacgauguuuccacacaucauaguggacguaagacaacuagaaccaguucuuauaccccuuccagacguaagaaauaauuucuaucacuauaaucaauccaaugauccaacaauuaaauuaauagcaaugcuauauacaccauuaagagcaaauaaugccggugacgaugucuuuacaguaucuugcagaguucucacaagaccuucaccugauuucgacuucauauuucuaguaccacccacuguagaaucacgaacaaaaccuuucucaguucccguacuaaccguagaagaaaugacuaacucacgauucccaauaccacucgaaaaauuauuuacaggaccaucaucagcauuugucguacaaccacaaaaugguagauguacaacagacggaguacuacuaggcacaacucaacuaucaccagucaauauaugcacauuuagaggagauguuacacauauaucaggaucaagaaauuacacuaugaaucuagcaucacaaaacuggaacucuuaugauccaacagaagaaaucccagcaccuuuaggaacaccagacuuugucggaaaaauccaaggaguauuaacacagacaacacgaacuaauggaucaacaagaggacacaaagcaacuguauauaccggaucagcagacuuuucaccaaaauuaggccgaguacaauucgcaacagauacagauaacgacuucgaaacuaaucaaaauacaaaauucacaccagucggcguaauacaagauggaucaacuacuccuagaaaugaaccccaacaauggguuuuaccaucauacucaggacgaaacauacauaauguccaccuagcuccugcaguagcaccuacauucccaggagaacaacuacucuucuuucgcucaacaaugccaggcugcucaggauaucccaauauggaccuagacugucuacuaccucaagaauggguacaauacuucuaucaagaagcagcaccagcacaaucagacgucgcccuauuaagauucguaaacccugauacaggccgagucuuauuugaaugcaaacuacauaaauccggcuauguaacaguagcacauacuggacaacaugaccuaguaauacccccaaauggauauuuccgcuuugauucauggguuaaucaauucuacacacuagcaccuaugggaaauggaaccgguagacgaagauaa

SEQ ID NO: 34420 - RNA, 1617 nt, Artificial Sequence
  derived and/or modified sequence opt6 from VP1__Norovirus_and/or_Norovirus-like__HQ005296
augaaaauggcaucaucagacgcaaacccaucagauggaucuacugccaacuuaguacccgaaguaaacaaugaaguuauggcauuagaaccaguaguaggcgcugcaaucgcagcaccuguagccggacaacaaaacgucauagacccauggauacguaacaauuucguacaagccccaggaggagaauuuacuguaucaccaagaaaugcccccggagaaauucuuuggucagcuccucuaggccccgaucuaaacccauaucuaucacaccucucaagaauguauaacggauaugcugguggauucgaaguccaaguaauuuuagcaggaaaugcauucacagcuggaaaaauaaucuucgccgcaguaccaccaaacuuucccacagaaggauuaucaccaucacagguaacaauguucccacacauaaucguagauguacgucaacuagaaccaguauuaauaccacuaccugauguaagaaacaauuucuaucacuacaaccaaucaaaugacccaacaaucaaauuaauagcaauguuauacacuccacuaagagcuaauaaugcuggugacgacguauuuacaguaucauguagaguauuaacacgaccuuccccagacuucgacuuuauauuccuaguuccaccaacaguugaaucaagaacaaaaccauuuucaguaccaguauuaacaguagaagaaaugacaaacucaagauuuccaauaccacuagaaaaauuauuuacaggcccauccucagcauucguaguacaaccacaaaauggccgauguacaacugacggaguuuuauuagguaccacacaauuaucuccggucaauauauguacauucagaggagacgugacacacaucccaggcucccgaaauuauacaaugaaucuugcaucacaaaacuggaacucauacgauccuacagaagaaauaccagcaccauuagguaccccagauuuuguaggaaaaauacaaggcguauuaacacaaacaacacgaacaaauggaucaaccagaggucacaaagccacugucuauacaggaucugccgauuuuucaccuaaauuaggaagaguacaauucgcuacagacacagauaacgacuucgaaaccaaucaaaauacaaaauucacuccaguuggaguuauacaagacgguucaacaaccccuagaaaugaaccacaacaauggguucuaccuuccuauucaggaagaaauacucacaauguucaucuugcaccagcaguugcaccaaccuuuccgggagaacaacuacuauucuuucguucaaccaugccuggauguucaggauauccaaacauggaucuugauugcuuauuaccucaagaauggguacaauauuucuaucaagaagcagcaccagcacaaucagacguagcacuucuucgauucguaaacccagacacaggcagaguacuuuuugaaugcaaacuccauaaaucaggauauguaacaguagcucacacaggacaacacgacuuaguaauacccccaaacgguuauuucagauucgauucauggguaaaucaauuuuacacauuagcaccaauggguaacggaacuggaagacgcagauaa

SEQ ID NO: 34421 - RNA, 1617 nt, Artificial Sequence
  derived and/or modified sequence opt6 from VP1__Norovirus_and/or_Norovirus-like__HM802555
augaaaauggcaucuaaugacgcaaguccaagugauggcuccacagcaaaucuaguaccugaaguaaacaacgaaguaauggcauuagaacccguuguuggagccgcaauagcagcacccgucgcaggacaacaaaauguaauagacccauggauaagaaacaacuucguacaagcaccaggaggugaguucacagugucaccaagaaacgcucccggcgaaauacuauggagcgccccucucggaccagaccuaaauccauauuuaucacauuuagcuagaauguauaacggauacgcaggaggauuugaaguccaaguaauacuagcaggaaaugcauuuaccgcuggaaaaauaauuuucgcagcaguuccaccuaauuucccaacagaaggacuaucaccaucacagguaacaauguucccacauauaauaguagacguaagacaacuugaaccaguacuaauuccauuaccagacguaagaaacaacuuuuaucacuauaaccaauccaaugacagcacaauaaaauuaauagcaauguuauacacaccacuaagagcaaacaaugcaggagaugauguauuuaccguaucauguagagucuuaacucgaccaucaccagacuuugacuucauauuucuaguuccaccuacaguugaaucaagaacaaaaccauucaccgucccaauacuuacaguagaagaaaugacaaacucuagauucccaauuccacuagaaaaauuauuuacaggaccaaguagugcauuuguaguccaaccccaaaacgguagaugcacaacagacggcguauuacuuggaaccacacaacuaucaccaguaaauaucugcaccuuuagaggagacguaacacauaucccuggcacaagaacuuaccgaaugaaucuagccucacaaaacuggaauaauuacgauccuacagaagaaauaccagcuccauuaggaacuccagauuucguaggaaaaauacaaggaauguuaacccaaacaacaaaaggagacggaucaacaagaggacauaaagcaacaguaucgacuggcucaguagauuuuacuccaaaacuaggaucaguacaauuugcaacagauacagauaacgauuucgaaacaggacaaaacacaagauucacaccaguaggaguaauacaagauggaucaucagcacaucgaaaugaaccacaacaauggguuuuaccagauuauucaggaagaaccguucauaacguucaccuagcaccagccguagcaccaacauucccaggagaacaacuccuauucuuuagaucuacaaugccaggaugcucaggauauccaaacauggaucuagacugccuucuaccacaagaauggguacaacacuucuaccaagaagcagcaccagcacaaucugacgucgcacuucuuagauucguaaauccagacaccggaagaguauuauuugaauguaaacuacacaaaacaggauauguuacaguagcacauacaggccaacaugaucuaguaauaccuccuaacggauauuuccgauuugacucauggguuaaccaauuuuacacacuagcaccaaugggaaacggagcaggaagaagacgauaa

SEQ ID NO: 34422 - RNA, 1617 nt, Artificial Sequence
  derived and/or modified sequence opt6 from VP1__Norovirus_and/or_Norovirus-like__GQ246801
augaaaauggcuucauccgaugcucauccaucagacggcucaacagcaaacuuaguuccagaaguaaauaaugaaguuauggcacuagaaccaguagucggagccgcaauagcagcaccaguagcaggacaacaaaacguaauagauccauggauaagaaauaacuucguccaagcaccagguggugaauuuacaguaucacccagaaaugcaccaggagaaauauuauggucagcuccacuaggacccgacuuaaauccauaucuaucccauuuagcaagaauguauaacggauacgcaggaggauucgaaguccaaguaauauuagcagguaaugcauucacagcaggaaaaaucauauucgcagcaguuccaccaaacuuuccuacagaaggacuaucaccaucacaaguaacuauguucccacauauuauugucgauguacgacaacuagaacccgucuuaauaccauuacccgauguaagaaacaauuucuaccacuauaaccaaucuaaugauccuaccauaaaauuaaucgcaauguuauacaccccuuuacgagcaaauaacgccggagacgacguauucacagucucuugucgcguacugacacgaccuucuccagacuucgauuuuauauuucuaguacccccaacaguagaaucgcgaacaaaaccauucucuguaccagucuuaaccguagaagaaaugacaaauagcagauuucccauuccauuagaaaaacuauuuacuggaccaucauccgcauucguaguccaaccccaaaacggaagauguacuacagauggaguacuacucggaaccacacaacuaucaccagucaacauuuguacuuuuagaggcgauguaacacauauuccaggaucaagaaacuacaccaugaaucuagcaagccaaaauuggaauaguuacgauccuacagaagaaauaccagcaccucuaggaacuccagauuuugucggcaaaauacaaggcguacuaacacaaacuacaagaacaaauggaucaacuagaggacauaaagcaacaguauauacaggaucagcugacuuuuccccuaaauuaggacgaguacaauucgccacagacacugauaacgacuuugaaaccaaccaaaauacaaaauucacaccaguaggcgucauucaagacggaucuacaacaccuagaaaugaaccacaacaauggguccuaccauccuauuccggaagaaauauucauaauguacaccuagcucccgccgucgcaccuacauuuccaggugaacaauuauuauucuuuagaucaacaaugccaggaugcucaggauaccccaacauggauuuagauugccucuuaccacaagaauggguacaauauuuuuaucaagaagcagcaccagcccaaucagauguugccuuauuaagauuugucaauccagacacaggaagaguuuuauucgaauguaaauuacauaaauccggauauguaacuguagcauacaccggacaacacgaccuagucauuccaccaaauggauauuuuagauuugacucaugggucaaucaauuuuauaccuuagcaccaauggguaacggaacaggacgaagaagauaa

SEQ ID NO: 34423 - RNA, 1617 nt, Artificial Sequence
  derived and/or modified sequence opt6 from VP1__Norovirus_and/or_Norovirus-like__AB504308
augaaaauggccuccaaugacgcaucaccaucagauggaucaaccgcaaacuuaguaccagaaguaaacaaugaagugauggcuuuagaaccuguaguaggagcagccauugcagcaccuguagccggacaacaaaauguaauagauccuuggauaagaaacaauuuuguacaagcgcccgguggagaauuuacuguuucgccaagaaaugcaccaggcgaaauccuauggucagcaccacuaggaccagacuuaaacccauaucucucccauuuagcccgcauguauaacggauaugcaggaggauucgaaguacaaguaauacucgcaggaaaugcauucacagcagguaaaauaauauucgcugcagucccaccaaauuuuccuacagaaggacuuaguccaucacaaguuacaauguuuccacacauaauaguagauguacgacaacuagaaccaguacuaauaccauuacccgaugucagaaauaauuucuaucacuacaaccaaucaaacgacaguacuaucaaauuaauagcaauguuauauacaccccuaagagcaaacaaugccggugacgauguauuuacuguaucauguagagucuuaacaagacccucuccagauuuugacuucauauuuuuaguaccaccaacaguugaaucacguacaaaaccauucacagucccaauauuaacaguugaagaaaugacaaacaguagauuuccaauaccacucgaaaaauuauuuacaggaccaucaucagcauuuguaguacaaccacaaaacggcagaugcacaacagacgguguacuacucggaaccacucaacuaaguccaguuaacauaugcacauuuagaggagacguaacacacauaccuggaacacgaacauacagaaugaaccuagcgagucaaaacuggaacaauuaugauccuacugaagaaauaccugcaccacuaggaacaccugacuucguaggaaaaauacaaggcaugcuuacacaaacaacuaagggugacggaucaacucacggacacaaagcuacaguaaguacaggauccguagauuuuaccccaaaacuaggcuccguacaauucgccacagacacagauaacgacuuugagacuggacaaaauacaagauucacacccguaggaguaauacaagacggaucuucagcacauagaaaugaaccccaacaauggguacuuccagacuauucuggacgaaccguacauaacgugcaucuagcuccagcaguagcucccacauuuccuggagaacaacuucuauucuucagaucaacaaugccagguugcucaggauacccaaacauggauuuagauugcuuacuuccacaagaauggguacaacacuucuaucaagaagccgccccugcacaaucugauguagcacuccuuagauucguuaauccagacacaggccgaguacuauucgaauguaaauuacauaaaacaggauauguuacaguagcacauacuggacaacaugauuuaguaauaccaccaaauggcuacuucagauucgacucauggguaaaucaauuuuauacucuagcaccaaugggcaauggagcaggaagaagaagauaa

SEQ ID NO: 34424 - RNA, 1617 nt, Artificial Sequence
  derived and/or modified sequence opt6 from VP1__Norovirus_and/or_Norovirus-like__DQ369797
augaaaauggcaccaaaugacgcaucacccucagauggaagcacagccaacuuaguaccagaaguaaacaaugaaguaauggcacucgaaccaguuguaggagcggcaauagcagcaccagucgcaggacaacaaaacguaauugacccauggauaagaaauaauuuuguacaagcaccaggcggagaauuuaccguaucaccuagaaaugccccuggagaaauauuaugguccgcaccauuaggaccagauuuaaauccauauuuaucucacuuagcaagaauguauaauggcuacgcaggcggauucgaaguacaaguaauuuuagcaggaaaugcauuuacagcaggaaaaauaauauuugcagcaguuccuccuaauuuuccaacagaaggacuaucaccuucucaaguaacaauguucccacacauuaucgucgauguacgacaauuagaaccaguccuuauaccccuaccagauguaagaaacaauuucuaucacuauaaccaauccaaugacucaaccauuaaauuaauagcaauguuauauacaccauuaagagcaaacaacgcuggugacgauguauucacaguauccugucgaguuuuaacaagaccuuccccagauuucgacuuuauauuuuuaguuccacccacuguagaaucaagaacuaaaccauucacuguaccaauccuaacaguagaagaaaugacaaacuccagauuuccaauaccacucgaaaaauuauucacuggacccucaucagcauuuguaguacaaccacaaaacggaagauguacaacagaugguguauuauuaggaacaacacaacuaucaccugucucuaucuguacauucagaggagacguaacucauauuccuggaacaagaauauaucgaaugaauuuagcaucacaaaacuggaauaauuaugacccaacagaagaaauaccugcaccucucggaacaccagacuuuguaggaaaaauacaaggaauguuaacacaaacaacaaaaggugaugguucaacuagaggacauaaagcaacuguaucaaccggaucagucgacuuuacaccaaaacucggaucaguacaauuugcaacagauacagacaacgauuucgaaaccggacaaaauacaagauuuacuccuguaggaguaauucaagaugguucaucagcacauagaaacgaaccacaacaauggguacuaccugacuauucaggaagaacaguccauaacguucaucuugcuccugcaguagcaccaacauucccaggagaacaacuauuauucuuuagaucaacuaugcccggauguaguggcuauccaaauauggaucuagauugcuuacuaccacaagaauggguacaacauuuuuaccaagaagcagcaccuucucaaucagacguagcacuacuacgauucguaaacccagauacaggaagaguacuauucgaauguaaauuacauaaagcagguuauguuacagucgcacacacaggccaacacgauuuaguaauaccaccaaaugguuacuucagguuugauucauggguaaaucaauuuuacacacuagcuccaaugggaaacggagccgguagacgacgauaa

SEQ ID NO: 34425 - RNA, 1617 nt, Artificial Sequence
  derived and/or modified sequence opt6 from VP1__Norovirus_and/or_Norovirus-like__LC177661
augaaaauggcauccucagacgcaaacccauccgacggaucugccgccaacuuaguacccgaaguaaauaacgaaguaauggcuuuagaaccaguaguaggugcugcaauugcagcacccguugcaggccaacaaaauguaauagacccauggauaagaucaaacuuuguucaagcaccagguggcgaauuuacagucucaccaagaaaugcaccuggagaaauauuauggucagcaccacuugguccagaucuaaaucccuauuuaagucaucuagcccgcauguauaacggauacgcaggcggcuucgaaguucaaguaauacuagcugguaacgcauucacagccgguaaaguaauauucgcugcaguaccaccaaacuucccaacugaaggauuaucucccucucaaguuacgauguuuccucacauuguaguagacguaagacaacucgaaccaguacuaauaccauuaccagacguucgcaauaacuucuaucauuacaaccaauccaacgauccuaccauaaaacuaauagcaauguuauauacaccauuacgagcaaacaacgccggagacgauguauuuacaguuucaugcagaguacuuaccagaccaucaacugauuuugacuucauauuucuaguaccaccaaccguugaaucacgaacaaaaccauuuucuguacccguauuaacagucgaagaaaugacaaacuccagauuuccaaucccccuagaaaaacuauuuaccggaccguccucagcauucguaguacaaccucaaaacggacgauguacuacagacgguguauuacuagguacaacucaacuaucaccaguaaacauauguaccuuuagaggagauguaacacauauaacaggaucaagaaacuacacaaugaauuuagcaucccaaaauuggaacaauuacgauccaaccgaagaaauaccagcaccauuagguacaccugacuuugucggaaaaauacaaggaaugcuuacacaaacaacaagaacggauggaucuacuagaggucacaaagcaacaguauacacagguucugcagauuuugcaccuaaacuaggacgaguacaauuugaaacagauacagaucacgauuucgaagcaaaucaaaauacuaaauuuaccccaguaggaguaauacaagacggaucaacaacacaucgcaacgaaccacaacaauggguauuaccaucauacucuggaagaaauacaccaaacguacacuuagcacccgcaguagcaccaacauuucccggagaacaacuauuauuuuucagaucaacuaugccaggauguucuggauacccaaauauggaucuagacugcuuacuaccacaagaauggguucaauauuuuuaucaagaagcugcuccugcacaaucagauguagcacuucuccgauuuguaaauccugacacaggaagaguacuauuugaaugcaaacuacacaaaucaggauauguaacaguagcacacacaggacaacaugaccucguaauacccccaaauggauauuucagauucgauucauggguaaaucaauuuuacaccuuagccccaaugggcaauggcacaggcagaagaagauaa

SEQ ID NO: 34426 - RNA, 1617 nt, Artificial Sequence
  derived and/or modified sequence opt6 from VP1__Norovirus_and/or_Norovirus-like__LC175468
augaaaauggcaaguucagaugcaaauccaucugauggcucagcugcaaacuuagucccagaaguaaauaaugaaguaauggcauuagaaccaguuguaggagcggcaauagcagcaccaguugcuggacaacaaaauguaauagauccuuggauaagaaacaacuuuguacaagcaccaggaggagaauuuaccguaucuccaagaaaugcaccaggcgaaauacuauggucugcaccacuaggaccagaucuaaacccuuacuuaucacacuuggcacgcauguacaacggcuacgcaggaggauucgaaguacaaguaauucucgcaggaaaugcuuucacagcaggaaaaauaauauuugcagccguaccaccaaauuuuccaacugaagguuuaucccccucacaaguaacuauguucccacacauaauaguugauguacgacaacuagaaccaguauuaauaccacuacccgauguaagaaauaauuuuuaucacuacaaccaauccaaugacucuacaauaaaacuaauagcuauguuauacacaccccuuagagcaaacaacgcuggagacgacguauuuacaguaagcuguagaguacuaaccagaccaucaccagacuucgacuuuauauuucuaguaccuccaacagucgaaucaagaacaaaaccauucucaguaccuguacuaacaguugaagaaaugacaaacucaagauucccuauuccucuagaaaaacuauucacaggacccucuucugcauuuguuguucaaccacaaaacggacgcugcacaacagacggaguacuucuaggaacaacacaauuaaguccaguaaacauauguacuuucagaggugacguuacacauauaacuggauccagaaauuacacaaugaaucuagcaucccaaaacuggaacaacuaugauccaacagaggaaauaccagcaccauuaggcacaccagauuucguaggaaaaauccaagguauguuaacacaaacaacacgcacagacggaucaacacguggacauaaagcuacuguauauacaggaucugcugacuucgcaccaaaauuaggaagaguacaauuugaaacagacacagaucaugauuuugaagccaaucaaaauacaaaauuuacaccaguaggaguaauacaagauggauccacaacacaucgaaaugaaccacaacaauggguacuuccaucauauucaggacgcaauacacacaacguacacuuagcacccgcuguagcaccaacauucccaggagaacaauuacuuuucuucagaucaaccaugccaggaugcucaggcuacccaaacauggauuuagauuguuuauuaccacaagaauggguacaauacuucuaucaagaagcagccccugcacaaucagacguagcacuacuacguuucguaaaccccgauaccgguagaguacuuuucgaauguaaacuacauaagucagguuacguaaccgucgcacauacaggacaacaugaucuaguuaucccaccaaaugguuauuucagauuugauucauggguuaaccaauuuuauacauuagcaccaaugggcaauggaacuggccgaagacgauaa

SEQ ID NO: 34427 - RNA, 1617 nt, Artificial Sequence
  derived and/or modified sequence opt6 from VP1__Norovirus_and/or_Norovirus-like__KX354137
augaaaauggcaucaucugaugcuaacccaucagaugguucagcagcaaaccuaguaccagaaguuucaaaugaaguaauggcauuagaaccaguaguaggagcagcaauagcagcaccagucgcaggucaacaaaacauaauagacccauggauucgaaauaacuucguccaagcaccuggaggugaauuuacaguaucaccaagaaaugcaccaggagaaauuuuauggucagcaccucuagguccagaccuaaauccuuaucuaagucaucuagcacgaauguacaacggauacgcuggaggauuugaaguacaaguaauucuagcuggcaaugcauuuaccgccggaaaaaucauuuuugcagcagucccuccaaacuuucccacugaaggauuaucaccuucccaaguuacaauguucccacauauuauaguagacguaagacaacuagaacccguauuaauaccauuaccagauguacgaaacaacuucuaucauuauaaucaaagcaacgacccaacaauaaaacuaauagcaauguuauacacuccacuaagagcgaacaacgccggugacgacguauuuaccguuucaugucguguauuaacaagaccaucaccagacuuugacuuuauauuucuagucccaccaacaguugaaucuagaacaaaaccauucuccguaccaauauuaacaguagaagaaaugaccaacucaagauuuccaauaccacuagaaaaauuauuuacuggaccaucaucagcauuuguaguacaaccucaaaacggaagauguacaaccgauggaguacuuuuaggaacaacucaauuaucaccaguuaacauauguaccuuucgaggugauguaacucauauaacaggaucacacaacuacacaaugaauuuagcaucucaaaacuggaacaacuacgauccuacugaagaaauaccagcaccccuaggcaccccagacuucguaggaaaaauacaagguguccuuacccaaacaacaagaucagacggaucaacaagaggacacaaagccacuguauauacagguucagcagauuuugcacccaaauuaggaagaguacaauucgaaacugauaccgauagagacuuugaaacaaaucaaaauacaaaauucacaccaguagguguaauacaagauggaaccacagcacauagaaaugaaccacaacaauggguccuuccaucauauucugguagaaauauccacaauguacacuuagcaccagccgucgcaccuaccuuuccaggagaacaauuacuaaguuuuagaucuaccaugccagguugcucaggauaccccaacauggaccuagauuguuuauuaccccaagaauggguacaauauuucuaccaagaagcagccccagcacaaucagauguagcauuauuaagauuuguuaauccagacaccggcagaguccuauuugaaugcaaacuucacaagucaggauauguaacaguugcacacacaggucaacaugaucucguaauaccaccaaauggauauuuccgauuugauucauggguaaaccaauucuacacucuagcaccaaugggaaacggaacaggacgaagacgauaa

SEQ ID NO: 34428 - RNA, 1617 nt, Artificial Sequence
  derived and/or modified sequence opt6 from VP1__Norovirus_and/or_Norovirus-like__KX354036
augaaaauggcaucaucugacgcuaacccaagugauggaucgacagcaaaucuaguaccagaaguuaauaaugaaguaauggcacuagaaccaguaguaggagcagcaauugcagccccaguugccggacaacaaaauguaauagauccauggauaagaaacaacuucguacaagccccagguggagaauuuacaguaucaccaagaaaugcaccuggagaaauacuauggucagcaccacuagguccugauuuaaaucccuaucucucucacuuagcacgaauguauaauggauacgcaggcgguuuugaaguacaaguaauauuagcaggaaaugccuuuacagcaggaaaaauaaucuuugcagccguaccaccaaacuucccuaccgaagguuuaucucccucucaaguaaccauguucccacacauuauaguugauguacgacaacuagaacccguuuuaauaccacuaccugauguaagaaacaauuucuaucacuauaaucaaucaaacgauccuaccauuaaacuaauagccauguuauacacuccacuaagagccaacaaugcaggagaugaugucuuuacuguaucaugcagaguacuaaccagaccaagcccagacuuugacuuuauauuucuagugccaccuacuguugaaucacgaacuaaaccauucucaguucccguacuuacaguagaagaaaugacaaacucacguuuuccaauucccuuagaaaaacucuuuacaggaccaucuucagcauucgucguccaaccccaaaacgguagauguacaaccgacgguguauuauuagguacaacacaacuuagccccguuaauauauguacauuucgcggagacguaacacauauaccaggaucuagaaauuauacaaugaacuuagcaucucaaaacuggaacucauaugaccccacagaagaaauaccugcaccacuaggaucaccggacuucguaggaaaaauacaagguguacuaacacaaacaacaagaacaaauggaucaacuagaggccacaaagcaacaguuuacacaggaucagcagacuuuucaccgaaacuuggacguguacaauucgcaacagauacagacaacgauuucgaaacaaaucaaaauacgaaauuuacaccagucgguguuauacaggacggaucaacaacuccaagaaaugaaccacaacaauggguacuuccuaguuauuccggacgcaacauacauaacguacacuuagcaccagcuguagcuccuaccuuuccaggugaacaauuauuauucuuuagaucaacaaugccaggauguucaggcuauccaaauauggaucuagauugcuuacuaccccaagaauggguacaauauuuuuaccaagaagcagcccccgcacaaucagacguagcacuacuaagauuuguaaaccccgauacagguagaguacuauucgaaugcaaauuacauaaaucagguuauguaaccguagcacauacaggacaacaugacuuaguaauaccuccaaauggauauuuuagauucgacucaugggucaaucaauuuuacaccuuagcaccaaugggaaauggaacuggcagaagacguuaa

SEQ ID NO: 34429 - RNA, 1617 nt, Artificial Sequence
  derived and/or modified sequence opt6 from VP1__Norovirus_and/or_Norovirus-like__KX354011
augaaaauggcaucauccgacgcaaacccaucagauggauccaccgcaaauuuaguaccagaaguuaacaaugaaguaauggcacuagaacccguaguaggagcugcuauagcugcaccaguagcaggacaacaaaacguaauagauccuuggauaagaucuaacuuuguacaagcaccaggaggagaauuuaccguauccccacguaaugcaccaggcgaaauacuuuggucagcaccacuagguccagaucuaaacccauauuuaucucaccuugcccgaauguauaacggcuacgcaggcggcuuugaaguacaaguaauuuuagcgggaaaugccuucacagcaggaaaaauaauauucgccgcaguacccccuaauuucccaacugaaggacuuucaccaucacaaguaacuauguucccacacauaauaguagaugucagacaauuagaacccguacuaauuccacuccccgacguaagaaacaauuuuuaccacuauaaucaaucuaaugauucaacaauaaaacuaauagcaauguuauacacaccacuacgcgcaaacaacgccggugacgacguuuucacaguaucaugucgaguccucacaagaccaucgccugacuuugacuuuauauuucuaguaccaccaacaguagaaucacgaacaaaaccauuuucuguaccaauacuuacuguagaagaaaugacuaacucucguuucccuauaccccuagaaaaacuuuuuacaggaccuucaucagccuuuguaguacaaccacaaaauggucgauguacaacagauggaguacuauuagguacaacacaauuaucuccuguaaauauaugcaccuuuagaggagacguaacacacauaccaggcucucauaauuauacaaugaacuuagcaucacaaaauuggaacaguuaugauccaacugaagaaauacccgcuccccuagguaccccagauuucgucggaaaaauucaagguguauuaacucaaacaacauccacuaaugguucaacuagaggacauaaagcaaccguauauacaggaucagcugauuuuucaccuaaacuaggucgaguucaauucgcuaccgacacuaauaacgauuucgaaacaaaucaaaauacaaaauuuacaccuguaggcguuauacaagacgguucaacaacaccccgaaaugaaccacaacaaugggucuuaccauccuauaguggccgcaacauacauaacguacaucucgcaccagcaguagcaccaacauuuccaggcgaacaauuacucuucuuuagaucaacuaugccuggauguucuggauauccaaauauggaccucgauuguuuauuaccucaagaauggguucaauauuucuaucaagaagcagccccugcacaaucagauguagccuuauuacgauucguaaauccagacaccggaagaguucuauuugaaugcaaauuacacaaaucuggauacguaacaguagcacacacaggucaacaugauuuaguaauaccuccaaacggcuauuuccgauucgauucauggguaaaccaauuuuacacucuagcaccaaugggaaauggaacaggccguagacgauaa

SEQ ID NO: 34430 - RNA, 1617 nt, Artificial Sequence
  derived and/or modified sequence opt6 from VP1__Norovirus_and/or_Norovirus-like__LC153122
augaaaauggcaucaucagacgcaaacccuucagauggaagcgcagcaaacuuaguacccgaagucaacaaugaaguaauggcauuagaaccaguaguaggugcagcaauagccgccccaguagcaggacaacaaaauguaauagaccccuggaucagaaacaacuucguacaagccccaggcggagaauuuacuguuuccccaagaaacgccccaggagaaauccuuuggucagccccuuuaggaccagauuuaaauccauauuuaagucaccuugcacgaauguacaauggcuacgcuggagguuucgaaguacaagucauauuagcaggaaaugcauucacagcaggaaaaauaauauucgcugcaguucccccaaacuuuccuacugaaggauuaucaccaagucaagucacaauguuuccacacauaauaguagacguuagacaauuagaaccuguauuaauaccacuaccagauguaagaaacaauuuuuaccacuauaaucaaucuaacgacucaacuauaaaacuaauagcaaugcuauacaccccauuaagagccaauaaugccggagaugauguguucacaguuucaugucgaguacuaacacgacccagcccugauuuugauuuuauauucuuaguaccaccaacaguagaaucucgaaccaaaccuuuuucaguacccguacuaacagucgaggaaaugacuaauaguagauuuccaauaccucuagaaaaacuauuuacaggaccaaguuccgcuuucguaguacaaccccaaaauggaagaugcacaacagauggaguacuucucggaacuacacaacuaucaccuguaaacauauguacuuuucgaggagacgucacacacauaaccggaucuagaaauuacacaaugaacuuagucucacaaaacuggaauaauuacgacccuacagaagaaauacccgcuccacuaggaacccccgacuuuguaggcaaaauucaaggaaugcuaacacaaacaacaagaacagacgguucaacaagaggucacaaagcaacaguauauacuggauccgcagauuuugcaccuaaauuaggaagaguccaauucgaaacagauacagaccaugauuuugaagcaaaucaaaauacaaaauucacaccaguagguguaauacaagauggcucaacuacacauagaaaugaaccacaacaauggguauuaccaucauauucgggacgaaacacucauaacguucacuuagcaccagcaguugcaccaacuuucccaggagaacaacuauuauucuuucgaucaacaaugccaggaugcucuggauacccaaacauggaucuagauugccuuuuaccacaagaauggguacaauauuucuaucaagaagccgcaccagcacaaucagauguagccuuauuacgcuucguaaauccagacacaggaagaguauuauuugaauguaaacuacacaaaagugguuauguaacaguagcucacacuggccaacacgaucuaguaauuccaccaaacggauauuuccgcuucgauucauggguaaaucaauuuuauacauuagcaccuaugggcaacggcacuggacgacgccgauaa

SEQ ID NO: 34431 - RNA, 1617 nt, Artificial Sequence
  derived and/or modified sequence opt6 from VP1__Norovirus_and/or_Norovirus-like__KR131777
augaaaauggcaucaucagacgcaaauccuucugauggaucaacagccaaccuuguuccagaaguaaauaacgaaguaauggcucuagagcccgucguaggagccgcuauugcagcaccaguagcaggacaacaaaaugucauagaucccuggauaagaaauaacuuuguacaagcaccagguggugaauuuacaguaucaccaagaaaugcaccaggugaaauacuauggucagcaccacuaggucccgaccuaaacccauaucuaucacacuuagcacgaauguauaauggcuacgcuggcggauucgaaguacaaguaauacuagcuggaaaugccuuuacagcaggaaaaauaauauucgccgcaguuccaccaaacuucccaaccgaaggucuaucaccaucacaaguaacaauguucccacacauuauaguagauguuagacaacuggaaccaguuuuaauaccuuuaccagauguucguaacaauuucuaccacuacaaccaaucaaaugacccuacaauaaaacuaauagcaauguuauacacacccuuacgcgcaaacaaugcuggugaugauguauuuaccgucagcugcagagucuuaacccgcccauccccagacuuugauuuuauauuccuaguuccaccaacaguugaauccagaacaaaaccauucucaguaccaguauuaacaguagaagaaaugacaaauucaagauucccaauaccuuuagaaaaauuauuuacaggcccaucuucagcauucguuguccaaccacaaaaugguagauguacaacugaugguguacuauuaggcacaacucaacuaucacccguaaauauauguaccuuuaggggagauguaacacacauaccaggauccagaaauuauaccaugaaucuagcaucacaaaacuggucuucauacgacccaacagaagaaauacccgcaccacucggaacaccagauuucguaggaaaaauucaaggugucuuaacacaaacaacacgaaccaauggaaguaccagaggccacaaagcaacaguauauacaggaucagcagacuuuuccccuaaauuaggaagaguacaauucgcaaccgacacagauaacgacuucgaaacaaaucaaaauacaaaauuuacacccgucggcguaauacaagauggaucaacaacaccaagaaaugaaccucaacaauggguacuacccucauauucugguagaaauauacacaacguucacuuagccccugcaguugcacccacauuuccaggagaacaacuauuauucuuucgaucuaccaugccaggcuguucaggcuauccaaauauggaucuagacugccuccuaccacaagaauggguucaauacuucuaccaagaagcagccccugcacaaucagacguggcacuuuuaagauucguaaacccagauacaggaagaguccuauucgaauguaaacuccacaaaucagguuacguaacugucgcccacacuggccaacaugaucuagucaucccaccaaauggauauuucagauuugacucauggguaaaucaauuuuauacacuagcaccuauggguaauggaacagguagacgaagauaa

SEQ ID NO: 34432 - RNA, 1617 nt, Artificial Sequence
  derived and/or modified sequence opt6 from VP1__Norovirus_and/or_Norovirus-like__AB933764
augaaaauggccaguucugaugcaaacccaucugacggaaguacagcuaacuuagucccugaagucaauaacgaaguaauggcauuagaacccguuguaggagcagccauugcagcgccaguagcuggacaacaaaaugucaucgacccauggaucagaaauaacuuuguacaagccccuggaggagaauuuacaguaucacccaggaacgcacccggagaaauacuauggucagcaccacucggaccugaucuaaauccauauuuaucacaccuagcacguauguauaacggauaugccggaggauuugaaguacaaguuauauuagcaggaaaugcauuuacagcaggaaaaauaauauuugcagcaguaccaccaaacuucccaacagaaggacuaucaccaucacaaguaacaauguucccccauauuauaguagauguaagacaacuugaaccaguacuaaucccacuaccagauguuagaaacaacuucuaucauuauaaucaacuaaaugauccaacaauuaaauuaauagcaaugcuauauacucccuuacgagcuaacaaugcaggagacgauguauuuacugucuccuguagaguucuaacuagaccaucaccugauuuugauuuuauauuucuaguaccaccaacaguagaaucacgaacaaaaccauuuuccguacccguucuuacaguagaagaaaugacaaauucaagauucccuauaccacucgaaaaacuuuuuacaggaccaucuagcgcauucguuguacaaccccaaaacggccguuguacaaccgacggaguccuuuuaggaaccacacaauuaucaccaguuaauauauguaccuuucguggggacguaacacauauaccaggaucacgaaauuauacaaugaauuuagcuucccaaaauuggaacucauaugacccaacagaagaaauaccagccccuuuaggaacaccugacuuuguagguaaaauacaaggcguauuaacacaaacaacacguacaaacggaucaacacgcggucacaaagcaacaguauacacugguuccgccgacuuuucaccaaaacuuggcagaguccaauucgcaacagacacagacaaugauuucgaaaccaaucaaaauaccaaauucacaccuguaggaguuauacaagauggaucuacaacaccacguaacgaaccacaacaauggguacuaccuucauacucagguagaaauauacacaacguucaccuagcuccugcaguagcaccaacauucccaggagaacaacuauuauucuuucgaucaacaaugccagguugcucaggauaccccaacauggaccuagauuguuuacucccucaagaguggguacaauauuucuaucaagaagcagcacccgcucaaucugauguugcacuacuaagauuuguuaacccagacaccgguagaguuuuauucgaauguaaacuacauaaauccggauauguaacaguagcacauacaggacaacaugauuuaguaaucccuccaaauggauauuucagauuugauucuuggguuaaucaauuuuauacacuagcaccaauggguaauggaacaggaagaagacgauaa

SEQ ID NO: 34433 - RNA, 1617 nt, Artificial Sequence
  derived and/or modified sequence opt6 from VP1__Norovirus_and/or_Norovirus-like__LC016600
augaaaauggcaucuaaugaugcuaguccaucagacggaucaacagcuaaccuuguaccagaaguaaauaacgaaguaauggcacuagaaccaguaguaggcgcugcaauagcugcaccaguagcuggacaacaaaacguaauagacccauggauacgaaacaauuucguacaagcaccagguggagaauuuaccguuucaccaagaaaugcacccggagaaauauuauggucagccccucuaggaccugacuuaaauccauacuuaagccaccuagcuagaauguauaacggauaugcugguggauuugaaguacaaguaauacuagcaggaaaugcauuuacugcaggcaaaauaauauucgcagcuguuccaccaaacuuuccaacagaaggucuaucuccaucccaaguuacaauguuuccucauauaauaguagauguuagacaacuagaaccuguacuuauaccacuaccagaugucagaaauaauuucuaucauuauaaccaaucaaaugacucaacaauaaaauuaauagccauguuguauacuccauuaagagcaaacaacgcuggugaugacguauuuaccguuucuugccgaguacuaacaagaccuucaccagauuuugacuuuauauuucuaguaccaccaacaguugaauccagaacuaaaccuuuuacaguaccaauccuaaccguugaagaaaugacaaauucaagauuucccauaccacuagaaaaacuauucacaggcccaucauccgcauucguuguucaaccacaaaauggucgauguacaacagacggcguauuauuaggaacaacucaacuaucuccaguaaacaucuguacauuucgaggagauguuacucauauaccagguacaucuaccuacagaaugaacuuagcuucucaaaacuggaacaauuaugacccaacagaagaaauaccagcaccauuaggaaccccagacuucguaggaaaaauacaaggaauguuaacccaaaccaccaaaggugauggaucaacuagaggacacaaagccacaguaucaaccggaucaguagacuuuacaccuaaacuuggcucaguacaauuugccacugauaccgauaacgauuuugaaacaggucaaaacacaagauuuacaccaguaggcguuauucaagacggaucuggugcacauagaaacgaaccacaacaauggguauuacccaacuacucagguagaacaguacauaacguacaucuagcacccgcagucgcaccaacauucccuggugaacaacuacuauucuuuaggaguacaaugccuggauguaguggauacccaaacauggaucucgacugcuuacuaccccaagaauggguccaacauuucuaucaagaagcagcaccagcucaaucugauguugcuuuacucagauucguaaauccugacacugggagaguucuuuuugaauguaaauuacauaaaacaggauacgucacaguagcucauacaggacaacacgaccuaguaauaccucccaauggcuauuuuagauuugauucauggguaaaccaauuuuauacacuagcaccaaugggaaauggagcagguagaagacgauaa

SEQ ID NO: 34434 - RNA, 1617 nt, Artificial Sequence
  derived and/or modified sequence opt6 from VP1__Norovirus_and/or_Norovirus-like__KJ433970
augaaaauggcauccucagaugccaauccuuccgaugguucugcagcuaaucuaguaccugaaguaaauaaugaaguuauggcacuagaacccguaguuggagcagccauagcugccccagucgcuggacaacaaaacguaauugauccauggauuagaaauaacuuuguacaagcaccaggaggagaauuuacugugucaccaagaaaugcaccaggugaaauacuauggucagcaccacuaggcccagaucuaaauccauacuuaucucacuuagccagaauguauaacgguuaugcaggaggauuugaaguacaaguaauuuuagcuggcaaugccuucacggcugguaaagucauauucgcugcaguuccaccuaacuuuccuacagaaggauuaaguccaucucaaguaaccauguuuccacacauaguagucgacguacgacaacuagaaccaguacuaauaccauuaccagacgucagaaacaacuuuuaccacuauaaucaaucuaaugacccaaccauuaaacuaauagcaaugcuauacacaccccuaagagcaaacaaugcaggagacgacguauuuacaguaucauguaggguauuaacaagacccucaccugacuucgauuuuauauuuuuaguuccaccaacaguagaaucaagaacaaaaccuuucucagucccaguauuaacaguagaagaaaugacaaauucaagauuccccauuccacuagaaaaauuauuuacgggaccaucuucugcauucguuguccaaccacaaaacgguagauguaccacugacgguguacuacuagguacaacucaacuuuccccaguaaacauauguacauuucgaggagauguaacacauauaacaggaucacgaaacuauacaaugaauuuagcaucacaaaacuggucaaauuacgacccaacugaagaaauaccagcaccacuaggaacaccagauuuuguaggaaaaauucaagguguucuaacacaaacaacacgaacagaugggucaacaagaggccauaaagcaacaguauauacaggaucagccgauuuugcuccaaaauuaggcagaguacaauucgaaacugauacagaccacgauuuugaagcaaaucaaaauacaaaauuuaccccaguaggagucauccaagacggaucaacaacacauagaaacgaaccucaacaauggguuuuaccaucauauucaggacgcaauaccccaaacguacaucucgcaccagcaguagcaccaacauuuccaggugaacaacuacuauucuuucgcucaacaaugccugguugcucaggauauccaaacauggaccuagauugucuacuuccacaagaauggguacaauauuucuaucaagaagcagcaccagcccaaucugacguugcacuacuuagauucguuaacccagauacuggaagaguucuauuugaauguaaauuacauaaaucgagauauguaacuguagcacauacaggacaacacgauuuaguaaucccuccuaauggauauuuccgauucgauucauggguuaaucaauuuuacacauuagcuccaauggguaaugguacaggaagaagacgauaa

SEQ ID NO: 34435 - RNA, 1617 nt, Artificial Sequence
  derived and/or modified sequence opt6 from VP1__Norovirus_and/or_Norovirus-like__KP176395
augaaaauggcaucaucugacgcuaauccuuccgacggaucagcagcuaacuuagucccagaaguuaauaaugaaguuauggcauuagaaccaguagucggagcggcuauagcagccccuguagcugggcaacaaaauguaauagauccuuggauccguaacaacuuuguacaagccccagguggagaguucacaguauccccaagaaacgcaccaggagaaauauuauggucugcaccuuuaggaccugaucuaaauccauauuuaucacaccuagccagaauguauaauggauaugcaggaggauucgaaguacaaguaauauuagccgguaaugcauucacugcaggaaaaguaauauucgcagcaguaccaccaaauuuucccacagaaggacuaucacccucccaaguaacaauguuuccacacauaguaguugacguacgucaacuagaaccaguccuaaucccacuaccagauguaagaaauaauuuuuaucauuauaaccagucaaaugacccaacaauaaaauuaauagcuaugcucuacacacccuuaagagccaacaaugcuggugacgacgucuuuacaguaucgugucgaguacuaacaagaccaucuccagacuucgacuuuauuuuucuagucccuccaacaguagaaucuagaacuaaacccuucaguguuccaguauuaacaguagaagaaaugacaaacucuagauuccccauuccacuugaaaaacuuuuuacagguccuucaagugcauuuguaguacaaccacaaaauggacgauguacaacugacggaguauuacucggaacuacacaauuauccccaguaaacauauguaccuuuagaggagaugucacacacauaacugguucuagaaacuacaccaugaaucuagcaucccaaaauuggucuaauuaugauccaacagaagaaauaccagcaccccucggaacaccagauuucguagguaaaauacaaggcguacucacacaaacaaccagaacugauggaucaaccagaggacacaaagcuacuguauauacaggaucuguagacuuugccccaaaauuaggacgcguacaauuugaaaccgacaccgaucaugauuuugaagcaaaucaaaauacaaaauucacacccguaggaguuauacaggauggaagcacaacacacagaaaugaaccucaacaauggguauuaccuucauacucaggaagaaauacaccuaacguacauuuagcaccagcaguagccccaacauuucccggugaacaacuacuuuucuuuagaucaacaaugccaggauguucaggcuauccuaauauggauuuagauugccuacuaccccaagaauggguucaauacuucuaccaagaagccgcuccugcucaaucugauguagccuuacucagauucguaaaucccgauacuggacgagucuuauucgaauguaaacuacacaaauccggcuauguuacaguugcacacacaggccaacaugaucuaguaauaccacccaacggauacuuucguuucgacucauggguaaaucaauuuuacacacucgcaccaaugggaaauggaacaggaagacgaagauaa

SEQ ID NO: 34436 - RNA, 1617 nt, Artificial Sequence
  derived and/or modified sequence opt6 from VP1__Norovirus_and/or_Norovirus-like__KM982947
augaaaauggcaucaucugaugccaaucccucagacggaucagcagcaaauuuaguaccagaaguuaacaaugaaguuauggcauuagaaccaguaguaggugccgcaauagcagcacccguagccggccaacaaaacgucauugacccauggauaagaaauaauuucguacaagcaccagguggagaauuuacuguaucaccacgaaaugcaccaggcgaaauuuuaugguccgcaccauuaggaccagauuuaaaucccuacuuaucucacuuagcaagaauguauaacgguuacgcugguggauucgaaguacaaguaauuuuagcaggaaaugcauuuacagcuggaaaaguaauuuucgcagcaguucccccuaauuuuccaacagaaggcuuaucuccaucacaagucacaauguucccacacaucgcagucgacguucgucaauuagaaccuguacuaauaccacuaccugacguuagaaacaacuuuuaucauuauaaccaaucaaacgacccaacaauaaaauuaauagcuauguuauacacaccauuaagagcaaacaaugcaggagaugaugucuuuacaguauccuguagaguucuuacuagacccucccccgacuucgauuuuauauuuuuaguaccaccaacuguugaaucuagaacaaaaccauucucaguaccaguauuaacaguagaagaaaugaccaacuccagauuuccaauucccuuagaaaaacuauucacaggacccucuucagcauucguaguacaaccacaaaacggaagaugcacaacagacggaguccuacuaggaacuacucaauugucacccguuaauauauguacauuuagaggagauguaacacauauuacuggaucaagaaauuauacaaugaauuuagcaagucaaaauuggucaaacuaugauccuacagaagaaauccccgcaccauuaggaacaccagauuuuguaggaaaaauucaaggaguauuaacacaaaccacaagaacugaugguaguacacgaggacauaaagcaacugucuauacaggaucagcugacuuugcuccuaaauuaggacguguacaauucgaaacagauaccgaccacgacuuugaagcaaaucaaaauacaaaauucaccccaguuggaguuauucaagacgguggaacaacgcauagaaaugaaccacaacaguggguuuuaccauccuacucaggaagaaacacuccaaacguucacuuagcaccagcaguagcaccaacauuuccaggagaacaauuauuauucuucagaucuacaaugccaggaugcucuggauacccuaauauggauuuagauugcuuauuaccucaagaauggguacaauauuucuaccaagaagcagcuccagcucaaucagacguagccuuacuucguuucguaaaccccgacacaggaagaguuuuauucgaaugcaaacuacacaaaucaggauauguaaccgucgcacacacaggacaacaugauuuaguaauaccaccaaacggauauuuccgauucgauucaugggucaaucaauuuuacacuuuagcuccaaugggaaauggaacaggaagaagaagauaa

SEQ ID NO: 34437 - RNA, 1617 nt, Artificial Sequence
  derived and/or modified sequence opt6 from VP1__Norovirus_and/or_Norovirus-like__KJ685414
augaaaauggcuucauccgaugcaaacccuucagacgguucaaccgcaaauuuaguacccgaaguaaauaaugaaguuauggcacuagaaccaguagucggagcagccauagcugcaccaguugccggacaacaaaauguaauagacccuuggauaagaaauaacuuuguacaagcaccaggaggugaauuuacaguaucaccaagaaaugcaccaggcgaaauuuuauggucugcaccucuaggaccagaucucaauccuuaucuaucccauuuagcaagaauguacaacgguuaugcaggaggcuucgaaguacaaguuauauuagccggaaaugccuuuacagccggaaaaauaauauuugccgcaguaccaccuaacuuuccaacagaaggucuaucacccucucaaguaacaauguucccucauauaauagucgacguaagacaacuagaaccaguacuaauaccacucccagauguacgaaacaacuucuaccauuauaaccaaucaucagauccaaccauaaaacuaauagcuauguuauacacaccauuaagagcuaacaaugccggagacgacguauucacaguuucaugucggguacuaacacgcccaucaccggauuucgacuucauauuuuuaguaccaccaacaguagaaucucgaacuaaaccauucucugucccuguuuuaacaguagaagaaaugacaaauucuagguucccaauucccuuagaaaaacuauucaccggaccgucaucugcuuucguuguacaaccacaaaacggacgcugcacaacagauggaguauuauuagguacaacacaacucucuccgguuaauauauguaccuuuagaggagacguuacccauaucccaggaucaagaaacuacacaaugaauuuagcaucacagaauuggaacucauacgauccaacagaagaaauaccugcacccuuaggaacuccagauuuuguaggaaaaauacaaggagucuuaacccaaacuacaagaacuaauggaucuacuagaggucacaaagcaacaguuuauaccggaagcgcagacuucucaccaaaauuaggacgaguacaauucgcuaccgacacagauaaugauuucgaaaccaaucaaaauacaaaauucacaccaguuggagucauucaagauggaucaacaacaccacgcaacgaaccacaacaauggguacuacccucauauaguggacgaaauauacauaacguacaucuagcaccagcaguagcaccaacauuuccaggagaacaacuauuauucuucagaucuacaaugccaggauguucuggauaccccaauauggaucuugauugcuuacuaccacaagaauggguucaauacuuuuaucaagaagcagccccagcacaaucagacguugcauuacuaagauuuguuaaccccgacacaggaagaguccuuuucgaauguaaauuacauaaaucaggauacguaacuguagcacacacuggccaacacgaucuaguaauaccaccaaacggauauuucagauucgacuccuggguaaaucaauuuuacacacuagcccccaugggaaacgguacuggaagaagacguuaa

SEQ ID NO: 34438 - RNA, 1617 nt, Artificial Sequence
  derived and/or modified sequence opt6 from VP1__Norovirus_and/or_Norovirus-like__KF060093
augaaaauggccucaucagacgcaaacccuucagacggauccacugcaaaccucgucccagaaguaaauaacgaaguaauggcucuagaaccaguagucggcgcugcuauagcugcaccaguagccggacaacaaaauguuauugacccauggauuagaaauaacuuuguacaagcaccuggcggcgaauuuacaguuucaccaagaaaugcaccaggagaaaucuuauggucagcaccacuaggaccagaucuuaauccauaccuaucacauuuagccagaauguauaacggcuacgcaggaggauucgaaguacaaguaauacuugcaggcaacgcauuuacagcaggaaaaauuauuuuugcagcaguaccaccuaacuucccaacagaaggccuaaguccaucacaaguuaccauguucccacacaucauaguagauguaagacaacuagaaccgguauuaauaccgcuaccagauguacgaaauaacuucuaccacuauaaccaaucaaaugaccccaccauaaaacuaauagcuauguuauauacaccucuuagagcaaauaaugccggagacgauguauucacaguuucauguagaguauuaacucgaccaucaccugacuucgacuuuauauuucuaguaccaccaacagucgaaucaagaacaaaaccauucucuguaccaguuuuaaccguagaagaaaugacaaacucaagauuuccaauuccacuugaaaaauuauuuaccgguccaucaucagcauucguaguacaaccacaaaacgguagguguacaaccgacggcguacuacuaggaacaacacaauuaucaccaguaaacaucugcacuuuucguggagauguaacacauauaaguggaucaagaaauuacacaaugaaucuagcuucacaaaacuggaacucuuacgaucccacagaagaaauaccagcaccacuaggaacuccagauuucguuggaaaaauucaaggaguccuaacacaaacaacaagaacagauggaucaacacguggacacaaagcaacagucuacacuggauccgcagacuuuucaccaaaauuaggccgaguacaauuugcaacagauaccgauaaugauuuuguaaccaaccaaaauaccaaauuuacaccaguaggaguaauacaggacggaaauacaacaccucgaaaugaaccucaacaauggguucuaccaucuuauucaggacgaaacacacacaauguccacuuagcaccagcugucgcaccuacauuuccuggugaacaacuauuauuuuuccgaucaaccaugccaggaugcucagguuauccaaauauggacuuagauugcuuauuaccacaagaauggguacaauacuuuuaucaagaagcugcaccagcacaaucagauguagccuuacuucgauucguaaaccccgacaccggacgaguacuauucgaauguaaauuacauaaaccuggauauguaaccguagcacacacuggucaacaugaucuagucauaccuccaaauggauacuuuagauucgauucauggguaaaucaauuuuauacacuagcaccaaugggaaaugguacaggaagaagaagauaa

SEQ ID NO: 34439 - RNA, 1617 nt, Artificial Sequence
  derived and/or modified sequence opt6 from VP1__Norovirus_and/or_Norovirus-like__KC456070
augaagauggcaucaucagacgcaaaucccagcgauggauccgcagcaaauuuaguaccaaaagucaacaaugaaguaauggcauuagaacccguaguaggugcagcaauagcugcaccuguagccggacaacaaaauguaauagacccauggauuaaaaauaauuuuguccaagcaccaggaggagaguucacaguauccccuaaaaaugcaccuggagaaauacucuggucugcacccuuaggacccgauuuaaauccauaccuaucacaccuagcaaaaauguauaauggauacgcuggcggcuucgaaguacaagucauacuugcaggcaaugcauuuaccgcuggaaaaguaauauucgcagcaguaccacccaauuucccaacagaaggacucucuccuucacaagucacaauguucccacacauaguaguagacguaagacaauuagaaccaguucuaauaccacuaccagauguaagaaacaacuuuuaucacuacaaccaaagcaacgaucccacaauaaaauuaauugcuaugcuauauacaccucuaagagcaaacaaugcaggagaugacguauuuacaguuucuuguagaguccuaacaagaccaucaccagauuuugacuuuauauuuuuaguaccaccuaccgucgaaucaagaacuaaaccauucucaguaccaguucuaacagucgaagaaaugacaaauucaagauucccaauaccauuagaaaaacuauuuacaggcccuucaucugcuuuugucguacaaccacaaaacgguagaugcaccacagauggaguuuuauuaggaaccacacaauuaucaccuguaaauauauguacauucagaggcgacguuacacauacaauaggaucaagaaauuauacaaugaauuuagcuucucaaaauuggaacaauuacgaucccaccgaagaaauaccugcaccauuagguacaccagacuuuguaggaaaaauucaagguguacuaacacaaacaacacgaacugaugguucaacaagaggccauaaagcaacaguauauacaggaucugcagacuuugcaccaaaauuaggacggguucaauucgaaacagauacagaccacgauuucgaagcaaaucaaaauaccaaauuuaccccuguaggcgucauacaagauggcucaacaacucauagaaaugaaccacaacaauggguauuacccucauauucaggcagaaauacccauaauguucacuuagccccugccgucgcuccaacauuuccaggagaacaacuacuuuucuuucgcucaaccaugccaggguguucuggcuauccuaauauggaucuagauugccuccucccacaagaauggguacaauacuuuuaucaagaagcagccccugcacaaucagacguugcacuuuuaagauucguuaauccugacacaggacgaguacuauucgaauguaaauuacacaaaucaggauauguaacagucgcccauacaggccaacaugaccuagucauaccaccaaacggauacuucagauucgacagcuggguaaaucaauuuuauacacuagcaccaaugggaaacggaacuggaagaagacgauaa

SEQ ID NO: 34440 - RNA, 1617 nt, Artificial Sequence
  derived and/or modified sequence opt6 from VP1__Norovirus_and/or_Norovirus-like__KC409299
augaaaauggcuucaucagaugcaaaucccucagacggauccacagcaaauuuagucccugaaguaaauaaugaaguaauggcauuagaacccguagucggugcugcaauagcagcuccaguugcuggccaacaaaacguaaucgacccuuggaucagaaauaauuuuguccaagcaccuggaggggaauuuaccgucucaccaagaaaugcaccaggagaaauuuuaugguccgcaccccuaggaccugauuuaaauccauaucuaucucauuuagcacgaauguauaacggauaugccggcgguuuugaaguucaaguaauauuagcagguaacgcauuuacagcaggaaaaaucauauucgcugcaguaccacccaacuuuccaacagaaggacuaucaccuucacaagucacaauguucccccauauaauaguagacguaagacaacuagaacccguccuaauaccuuuaccagacguaagaaacaauuucuaccacuauaaccagucaaaugacccaaccauaaaacuaauagcaaugcuauacacuccauuaagagcaaacaaugcaggcgaugacguauuuaccguaucaugucguguacuaacuagaccaucaccugacuuugauuucauauuuuuaguacccccuacaguagaaucaagaaccaaaccuuucucugucccuguacuaacaguugaagaaaugacuaacucaagauuuccaauaccacuagaaaaacuuuuuacaggaccauccaaugcauuugucguccaaccacaaaauggacgaugcacuacagacggaguauuacuaggaacaacacaacuauccccagucaauauaugcacauuucgaggugauguuacacacaucccaggaucaagaaauuacacaaugaaucuagcaucccaaaauuggaacucauacgauccaaccgaagaaauaccugcaccacuaggaacuccagauuucgucggcaaaauccaaggaguacuuacacaaaccacccgcacaaacggaagcacuagaggccacaaagcuacaguuuauacaggcucagcugacuuuucaccaaaacuaggaagaguacaauuugcaacagauacagacaacgauuuugaaacaaaucaaaauacuaaauuuacaccaguaggaguaauacaagacggaucaacaaccccaagaaacgaaccccaacaauggguacuaccaucauacucaggaagagacguccauaacguccacuuagcccccgcuguagcaccaacauuuccaggagaacaacuucuauucuuuagaucaacaaugccagguuguucaggauaucccaauauggaccuugacugccuauuaccucaagaauggguccaauauuuuuaccaagaagcagcaccagcccaaucagacguugcacuccuacgauucguaaauccagacacaggacgagucuuauucgaauguaaauuacacaaaucaggcuauguuacaguagcacauacaggucaacacgaucuagugauaccaccaaauggcuauuuuagauucgacucauggguaaaucaauuuuacacucuagcacccaugggaaauggaacaggcagaagaagauaa

SEQ ID NO: 34441 - RNA, 1617 nt, Artificial Sequence
  derived and/or modified sequence opt6 from VP1__Norovirus_and/or_Norovirus-like__JX984947
augaaaauggcuucaaacgacgcuaacccaagugauggaucagcagcaaacuuaguaccagaagucaauaaugaagucauggcuuuagaaccuguaguaggugcugcuauagcagcacccguagcaggacaacaaaacguaauagauccauggauacgaaauaacuuuguccaagcacccggaggugaauuuaccguaucaccaagaaaugccccaggugaaauauuauggucagcaccguuaggaccagacuuaaauccuuaccuuagucacuuagcacgaauguacaauggauaugcuggaggauucgaggugcaaguaauauuagcaggcaaugcauucacagcuggcaaaauaauauucgcagcuguaccaccaaacuuuccaacagaaggacuaucucccucacaaguaacaauguucccacauauaauaguugauguucgccaacuugaaccaguacucauaccacucccagauguaagaaauaauuuuuaccacuacaaccaaucaaaugauucgacaauaaaacucauagccaugcuauacacacccuuaagagcuaacaaugcaggagaagaugucuucacuguaagcugucgaguacuuacaagaccaucuagugacuuugauuucauauuucuaguaccaccaacaguagaaucacgaacuaaaccuuuuacaguaccaauauuaaccguagaagaaaugaccaacucaagauuuccaauuccauuagaaaaauuguuuaccggucccaguucagcauuugucguccaaccccaaaacggaagauguacaaccgacggcguacuacuaggaacaacacaacuauccccaguuaacacaugcacauuuagaggagauguuacacacauagcagguucccgaaauuacacaaugaaccuagcaucauuaaacuggaacaauuaugauccaacagaagaaauaccugcaccacuaggaacacccgauuucgugggaaaaauacaaggaguacuaacucaaacaacaaaaggcgacggauccacucguggccauaaagcuacaaucuacacaggcucagccccuuuuacaccuaaacuaggauccguacaauuuaauacagacacugaaaacgauuucgagacccaucaaaacacuaaauucacaccagucggaguaauccaagacggaggcacaacucauagaaaugaaccacaacaauggguauuacccucuuauagcggaagaaauauaccaaacguacauuuagcaccagccguagcaccaacauuccccggagaacaauuacuuuucuucagauccacaaugccaggaugcuccggcuauccaaacauggaucuagauugcuuacuaccacaagaauggguucaacacuuuuaccaagaagcagcaccagcacaaucugauguagcauuauuacgauucgucaauccagacacaggaagaguauuauucgaauguaaauuacacaaaucaggcuauguaaccguagcacacacaggacaacaugaccucguaaucccaccaaauggauacuuuagauucgacucauggguaaaucaauuuuauacacuugcacccaugggcaacggaaccggaagaagacguuag

SEQ ID NO: 34442 - RNA, 1617 nt, Artificial Sequence
  derived and/or modified sequence opt6 from VP1__Norovirus_and/or_Norovirus-like__KC175385
augaaaauggccuccucagaugcuaacccuucaaauggaucaacagcaaaccuaguaccagaaguaaacaaugaaguaauggcauuagaaccaguaguaggugcagcuauagcagcaccaguagcuggacaacaaaacgucauagacccuuggauacgaaauaacuucguacaagcaccagguggagaauuuaccgucucuccacgaaaugccccaggagaaauauuaugguccgcuccgcuaggaccugaucuaaauccuuacuuaucacaucucgcuagaauguacaacggauacgcaggaggauucgaaguccaaguuauauuagcaggaaaugcauuuacugcaggaaaaauaaucuucgcugcaguuccaccuaacuucccaacugaaggucuaucaccaucacaaguaacaauguuuccucacaucauaguagauguaagacaauuagaacccguacuaauuccacucccagauguacgaaacaauuucuaccacuauaaucaauccaacgacccuacaauaaaauuaauugcaaugcuauacacacccuugagagcuaauaacgcaggagacgauguauuuaccguaucauguagaguacuaacacgaccaucaccagacuucgacuucauauuucuaguaccuccuacaguagaaucccgcacaaaaccauuuucaguaccaguacucacaguagaagaaaugacaaacucaagauucccaauaccauuagaaaaauuauuuacaggaccaagcagugcuuuuguaguucaaccccaaaacggaagauguacaaccgacgguguucuauuaggaaccacucaacuaucaccaguaaacauauguaccuucagaggagacguaacacauauccccuccucacacaauuauaccaugaaccuagcaucacaaaacuggaacucauaugacccuacagaagaaauaccagcaccauuaggaacaccagacuuuguaggaaaaauacaagguguauuaacacaaacaacuagaacugacggauccacucgaggacacaaagcaacaguauauacaggaucagcagacuuuuccccuaaacuaggaagaguacaauucgcaacagacacagauaaugauuuccaaacaaaucaaaauacaaaauucacaccaguaggcguuauucaagacggauccacaacuccaagaaaugaaccgcaacaauggguccuaccaucauauagugguagaaauauccacaacguucacuuagccccugcaguugcuccaaccuucccaggagaacaacuccucuucuuccgcuccacuaugcccggauguucaggauauccuaacauggaucuagacugccuauuaccacaagaauggguccaauauuucuaucaagaagcugcaccagcucaaucagacguagcucuauuacgauucguaaacccagauacuggaagaguacuauucgaaugcaaacuacacaaaucaggcuauguaaccguugcacacacaggacaacacgauuuaguuauaccaccaaacggauauuuuagauucgacaguugggucaaucaguucuauacacuagcacccaugggaaacggaacuggaagaagacgauaa

SEQ ID NO: 34443 - RNA, 1617 nt, Artificial Sequence
  derived and/or modified sequence opt6 from VP1__Norovirus_and/or_Norovirus-like__JQ613563
augaaaauggcauccucagaugccaauccaucagauggaucaacagcaaaccuuguuccugaaguuaauaacgaaguaauggcccuagaaccaguaguaggagcagcaauagcagcaccaguagccggacaacaaaacguaauagacccauggauaagaaacaauuuuguacaagcaccuggaggcgaauuuacaguuucacccagaaaugccccaggagaaauuuuauggucagcaccacuaggacccgaccugaacccauaucucucucacuuggcaagaauguauaacgguuaugcaggaggauuugaaguccaagucauacucgcaggaaacgcuuuuacagccggaaaaauuauauuugcagcuguaccuccaaacuuuccaacagaaggacucucaccaucacaaguaacaauguucccacauaugaucguagacguacgccaacuagaaccaguucuaauaccacuaccugauguccgaaauaauuuuuaucacuauaaccaauccaaugauccaacaaucaaacuaauagccaugcuauacacaccacuucgcgcaaauaaugcuggugacgauguguucaccguaucaugucgagucuuaacaagaccuucaccagacuucgacuuuaucuuucuaguaccuccaacuguugaaucacgcacuaaaccauuuucaguaccaguacucacuguagaagaaaugacaaacucccgauuuccuauaccacuugaaaaauuauucacaggcccaucauccgcauuugucguacaaccacaaaacggaagauguacaacagacggaguauuauuagguaccacacaauuaucaccuguuaauauaugcacauuucgaggcgauguaacacacacucccggaucacacaauuacacaaugaacuuagcaucucaaaacuggaacuccuaugauccaacggaagaaauacccgcaccacuaggcacaccugauuucguaggaaaaauacaaggaguacuaacccaaaccacacgaacaaauggaucuaccagaggacacaaagcaacuguauauacaggcucugcagacuuuagcccuaaauuaggcagaguacaauuugcaacagauacagauaaugauuucgaaacaaaucaaaacacaaaauucacaccaguuggcguaauccaagauggauccacaaccccaagaaaugaaccucaacaauggguauuaccaucauauucaggcagaaacauucauaauguacauuuagccccagcaguagcaccaaccuuuccaggagaacaauuacuauucuuuagaucaacaaugcccggaugcucaggauacccaaauauggaccuugauugccuacugccacaagaauggguacaauacuucuaucaagaagccgcaccagcacaaucugauguagcauuauuaagauucguaaacccagauaccggacgcguucuauucgaaugcaaacuacauaaaucugguuauguaacaguagcccauacaggacaacacgaccuaguaauaccaccaaauggauacuuuagauuugauucauggguuaaccaauuuuauacacuagcaccaaugggcaauggcacaggcagacgaagauaa

SEQ ID NO: 34444 - RNA, 1617 nt, Artificial Sequence
  derived and/or modified sequence opt6 from VP1__Norovirus_and/or_Norovirus-like__JQ613558
augaaaauggcuucauccgaugcuaaccccucagauggaucuacagcaaaucuaguacccgaaguaaacaaugaaguuauggcauuagaaccaguaguaggcgcagcaauagcagcaccggucgcuggacaacaaaauguaauugacccuuggauaagaaauaacuuuguacaagcuccuggaggagaauuuaccguaagcccccgaaaugcaccuggagaaauauuauggucugcaccacuaggcccagauuuaaauccauauuuaucucaucuagcccguauguacaaugguuaugcaggcggauucgaaguacaagucauauuagcaggaaacgcauucacagcagguaaaauuauauucgccgcaguaccacccaauuuuccaacagaaggcuuaucaccuucacaaguaacuauguuuccucacauuauuguagauguaagacaacuagaaccaguacuaauuccauuaccagauguccgaaacaauuuuuaucauuauaaucaaucaaaugacccuacaauuaaauuaauagcuaugcuauacacucccuuaagagcaaacaaugcuggugaugauguauuuacaguuucaugcagaguuuuaacaagaccaucacccgauuuugacuuuauauuucuaguaccaccaacaguagaaucacgaacuaaaccauucucaguaccaguacuaaccguagaagaaaugacuaacuccagauuuccaauaccacuagaaaaacuauuuacuggacccuccagugcuuucguaguccaaccccaaaacggaagaugcacaacagacggcguacuacuaggaacaacucaauuaucuccuguaaauauauguacuuuuagaggagacgucacacauauaccaggaucacgaaauuacaccaugaauuuagcaagccaaaauuggaauaguuacgauccuaccgaagaaaucccagcuccauuaggaacaccugacuuugucgguaaaauccaaggaguuuuaacccaaacuacuagaacuaauggaucaacacgaggacacaaagcaacagucuauacaggcucagcugacuuuucaccaaaauuaggaagaguacaauucgcaacagauacagauaacgauuuugaaaccaaucaaaauacaaaauuuacaccaguaggaguaauacaagauggaucaacaaccccacgaaacgaaccucaacaauggguacuucccucauauucagguagaaauauacauaacguacauuuagcaccagcaguagcaccaacauuuccaggcgaacaacuauuauucuuuagaucuacaaugccagguuguucugguuauccuaauauggacuuagauugccuauuaccucaagaauggguacaauauuucuaucaagaagcugcaccagcccaaucagauguagcacuucuacgauuuguuaauccugauacaggacgaguuuuauucgaaugcaaacuucacaaaucagguuauguaacaguagcacacauaggacaauaugauuuaguaauaccucccaacggauacuuuagauuugacuccuggguaaaccaauuuuacacauuagccccuaugggaaacggcaccggccgaagaagauaa

SEQ ID NO: 34445 - RNA, 1617 nt, Artificial Sequence
  derived and/or modified sequence opt6 from VP1__Norovirus_and/or_Norovirus-like__GQ856451
augaaaauggcuuccaaugaugccaauccauccgacggaucuguagcaaauuuaguacccgaaguaaacaaugaaguaauggcacuagaacccguaguaggagcagcuauagcagcuccaguagcaggacaacaaaauguaaucgacccauggauuagaaauaacuuuguacaagcuccaggaggugaauuuacaguaucaccaagaaacgcaccuggugaaauucucuggagugcaccauuaggaccagauuugaauccuuaccucucacaucuagcacgaauguacaacggauaugcaggagguuucgaaguucaaguaauauuagcaggaaaugcauuuacagcaggaaaaauaauauuugcagcugucccaccaaacuuuccaaccgaaggacuaucaccaagucaaguuaccauguucccacacaugauaguagacgucagacaacuagaaccuguauuaauacccuuaccagacguuagaaacaauuucuaccacuacaaccaaucaaaugacucaacaauaaaacuaauagcaaugcuuuacacccccuuacgagcagacaaugcaggagaagauguauucacaguaucaugucguguacuaacaagacccucaccugacuucgacuuuauauuucuaguuccaccaacaguagaaucaaaaacaaaaccauuuacaguacccauacuaaccguagaagaaaugacaaauuccagauuuccaauaccauuagaaaaacuauuuacaggucccucauccacuuuuguaguacaaccacaaaaugguagauguacaacagacggaguauuauuagguaccacacaauugucaccaguaaacauauguaccuuuagaggagacguuacacauauagccggauccagaaauuacacaaugaacuuagcaucacuaaauuggaacaacuacgauccaaccgaagaaauaccugccccucuaggaacaccagacuuuguaggaaaaauacaaggugucuuaacacaaacaacaaaaggagacggcucaacuagaggacacaaagcaacaguauauacaggcucagccccauuuaccccaaaauuaggaucuguccaauucuccacagauacagaaaacgacuucgaaacacaccaaaauacuaaauuuaccccaguuggaguaauacaagauggaaguacaacgcacaggaaugaaccucaacaauggguucuaccaucauauucaggaagaaauguccauaauguucauuuagccccagcaguagcacccacauucccaggugaacaauuauuauucuucagaucaacaaugccaggaugcucuggcuacccaaauauggaccuugauuguuuacuaccacaagaauggguacaacauuuuuaucaagaagccgcuccagcacaaucugacguugcacuacuacgauucguuaacccagacacaggaagaguauuauuugaauguaaacuucauaaaucaggauacguaacugucgcucacacaggccaacacgaccuaguaauaccaccaaaugguuacucaagauuugauagcuggguaaaucaauucuauaccuuagcacccauggggaauggcacaggaagaagaagauaa

SEQ ID NO: 34446 - RNA, 1617 nt, Artificial Sequence
  derived and/or modified sequence opt6 from VP1__Norovirus_and/or_Norovirus-like__DQ419908
augaaaauggcaucaaacgacgcaucaccaucugauggaucaacagcaaaucuaguacccgaaguaaacaacgaaguaauggcacuagaaccuguaguaggagcagcaauagcagcgccaguagcaggccaacaaaauguaauagaccccuggauaagaaauaacuuuguacaagcaccaggaggagaauuuacagucucacccagaaaugcuccaggagaaauauuauggucugcaccacuaggacccgaucuaaacccuuaucuaucacacuuagcuagaauguacaauggauacgcaggagguuucgaaguacaaguaauacuagcaggaaaugcauuuacagcaggaaaaauaauauuugcagcaguaccaccaaacuucccaacagaagguuuaucacccagccaagucacaauguucccucacaucauaguugacguaagacaauuagaaccuguauuaauucccuuacccgauguaagaaauaauuuuuaucacuauaaccaaagcaacgacucaacaauaaaauuaauagcaaugcuauauacaccccuuagagcaaauaaugccggugaugacguauucaccguaucuuguagaguacuaacaagaccaagcccagauuuugacuuuauauuuuuaguaccaccuacaguugaaucccgaacaaaacccuuuacaguaccuauauuaacaguagaagaaaugacaaauucaagauucccaauaccauuagaaaaacuauuuacaggaccaucaucagcauucguaguacaaccucaaaaugguagauguacaacagaugguguauuacuaggaacaacccaacuauccccugucaacauaugcacauuucgaggugauguaacacauauaccuggaacacgaacauacagaaugaauuuagcaagucaaaacuggaauaacuacgacccaacugaagaaauacccgcuccacucgguacaccagacuuugucggcaaaauccaagggaugcuaacacagaccaccaaaggagauggaucaacacgaggucauaaagcaacagucucaaccgguucaguugacuuuacaccuaaauuagacucuguacaauuugcaacagauacagacaaugauuucgaaacaggacaaaacaccagauucacaccagucgguguaauacaagaugguucaucugcacaucgaaaugaaccacaacaauggguucuaccagacuauucaggacgaacaguacauaauguacauuuagcuccagcaguugcacccaccuuuccuggagaacaacuauuauucuuuagaucaacaaugccagguuguucaggauauccaaacauggauuuagauugcuuacuaccacaagaauggguccaacauuuuuaucaagaagcagcaccaucacaaucugauguugcauuauugcguuucguaaaccccgauacaggccgaguauuauucgaauguaaacuacauaaagcaggauauguaacugucgcucauacuggacaacaugaucucguaauaccaccaaaugguuacuuucguuucgauuccuggguuaaccaauuuuacacauuagcaccuaugggaaauggcgcaggcagaagaagauaa

SEQ ID NO: 34447 - RNA, 1617 nt, Artificial Sequence
  derived and/or modified sequence opt6 from VP1__Norovirus_and/or_Norovirus-like__KX514354
augaaaauggcaucuaaugacgcaaacccuucagaugguucagcagcaaaccuaguaccagaaguuaacaaugaaguaauggcauuagaacccguaguaggugcagcaauagcagcaccaguagcuggacaacaaaauguaauagacccuuggauaagaaauaacuuuguacaagcaccaggaggcgaauuuaccguaucuccuagaaaugcaccuggagaaauacuauggucagcaccccuuggaccagauuuaaauccuuaucuuucacaccuagcuagaauguauaacggauacgcaggcggcuuugaaguacaaguaauacuagcagguaaugcguuuacagcaggaaaaauaauauucgcagcaguaccuccaaacuuuccaacugaaggacuuucaccaucccaagucacaauguucccucacauaauaguugacguaagacaacuagaaccaguauuaauaccauuaccagauguccgcaauaacuuuuaccacuauaaucaaucuaacgauucaacuauaaaacuuauagcaauguuauauacuccauuaagagcuaacaaugccggugaugacguauuuacaguuucauguagaguauuaacaagaccuucaccagauuuugacuuuauauuuuuaguuccacccacaguagaaucuagaucaaaacccuuuagcguaccaguacuaacaguacaagaaaugacaaauucuagauucccugcaacacuagacaaacuauuuacaggcccaucaucuacacucgucguacaaccacaaaauggaagauguaugauugacggcguauuacuaggaaccacucaauuaucaccaguaaauaucuguacauucagaggagacguaacacauuccagagacuccacaaucuacacaaugaaccucgccucacccaacuggaauaauuacgauccuacagaagaaaucccugcaccccucggaacaccugauuuuguaggaaaaauacaaggaguucuuacacaaacaacaaaaggugaaggauccacaagaggccaccgugcuacaguauacguaggaucugcaaacuauacaccuaaauuaggaaaaguucaauucgaaacaaauaccacaaaugauuuauaugcacaccaaaauacccgauucacaccagucggaguuguucaaggaggcgaaucugcacauagaucugaaccacaacaauggguuuuaccaucuuauucugguagagauacaccuaacgugcauuuagcaccagcaguugcaccuacuuuucccggagaacaauuacuuuucuuuagaucaacuauacccggaugcggaggacaucccaacauggaccuugacugccuccuaccacaagaauggguacaacacuuuuaccaagaggcugcacccgcacaaucagacguagcacuauuacgcuucguuaauccugauacaucacgaguacuauuugaaugcaaauuacauaaauccgguuaugucacaguagcacauacaggacaacacgacuuaguaauuccacccaacggguacuuccguuuugauuccugggucaaccaauucuacacacuagcaccaaugggaaaugguacuggaagaaaaagauaa

SEQ ID NO: 34448 - RNA, 1617 nt, Artificial Sequence
  derived and/or modified sequence opt6 from VP1__Norovirus_and/or_Norovirus-like__KX354062
augaaaauggcaucauccgacgcuaauccuagcgacggaucaacagccaaccuagucccagaaguuaacaaugaaguaauggcacucgaaccaguaguaggagcagcaauagcagcaccaguugcaggucaacaaaaugucauagacccauggaucagaaacaacuuuguacaagcuccuggaggagaauuuacaguaucaccacgaaacgcuccaggcgaaauacuauggucagcaccacuagguccagaccuaaacccuuauuuaucacacuuagcaaggauguacaauggcuacgcuggaggauucgaaguacaaguaauauuagcaggaaacgcauucacagccggaaaaauaauauuugcggcaguuccaccaaacuuuccaacagaaggacuaucacccucacaaguuacaauguuuccacauauaauugucgauguccgacaacucgaaccaguauuaaucccacuucccgauguaagaaacaauuucuaucauuauaaucaaucaaaugacucaacaaucaaacuuauagcaaugcuuuacacaccacuucgagcaaauaacgcaggagaugacguauucacaguaucauguagaguacuaacgcgaccaucacccgacuucgacuucauauuucucguuccacccaccguagaaucucgcacaaaaccauucucuguaccaauacuaacaguagaagaaaugacaaauucucgauuuccuauaccacuagaaaaauuauuuaccggacccucuagcgcuuucguaguacaaccacaaaacgguagaugcacaaccgacggaguucuauuaggaacuacucaacuuucuccaguaaauauauguacauucagaggagacguaacccacauaccaaacucucacaauuauaccaugaauuuagcaucacaaaacuggaacucauacgacccaacagaagaaauaccagcaccuuuagguaccccagauuucguaggaaaaauacaaggcguccucacacaaacuacauccacaaaugguucaacacgaggacacaaagcaacuguauauacaggauccgcagauuuuucaccaaaauuagguagaguacaauucgcaaccgauacaaacaacgauuucgaaacaaaucaaaauaccaaauucaccccagucggaguaauacaagacggcaguaccacacccagaaaugaaccccaacaauggguauuaccaucauacucaggcagaaauauacauaacguucaccuugcaccagcaguagcaccaacauuuccuggagaacaacuacucuucuuuagaucaacaaugccagguugcucaggauacccaaauauggaucuagauugucuccuaccucaagaauggguucaauauuucuaccaagaagcagcuccagcucaaucugauguagcacuacuaagauuuguaaauccugacacaggaagaguauuauucgaaugcaaacuacauaaaucaggauacguaacaguagcacacacaggacaacacgauuuagucauaccacccaauggauauuuuagauucgauucauggguuaaucaauuuuacacacuagcaccaaugggaaauggaacuggaagaagaagauaa

SEQ ID NO: 34449 - RNA, 1617 nt, Artificial Sequence
  derived and/or modified sequence opt6 from VP1__Norovirus_and/or_Norovirus-like__AB972532
augaaaauggcaucaucagacgcaaacccuucagacgguucugcagcaaaucuaguaccugaaguuaacaacgaaguaauggcauuagaaccaguuguaggagcagcuauagcagcuccuguagccggacaacaaaauguaauagacccauggauaagaaacaauuuuguacaagcaccaggaggugaguucacaguaucaccucgaaacgcaccaggcgaaaucuuauggucagcaccacucggcccagaucuaaauccuuauuuaucacaucuagcaagaauguauaauggauaugccggaggauuugaaguacaagucauacuagcaggaaaugcauuuacagcaggaaaaguaauauuugcagcaguacccccaaacuuuccaacagaaggucuaucaccaucucaaguaaccauguucccucacauaguaguagacguaagacaacuagaaccaguuuuaauaccauuaccugacguaagaaacaacuuuuaccacuauaaccaauccaaugacucuaccauaaaauuaauagcaaugcuauauacaccacuacgcgcaaacaaugcaggagacgaugucuucacaguaucuugucgcguacuaacuagaccauccccugauuucgacuuuaucuuuuuagugcccccaacaguagaaucaagaacaaaaccauucucuguaccaguacugacaguagaagaaaugacaaacagcagauuuccaaucccuuuagaaaaacuauuuaccgguccaucuucagcauucguuguucaaccacaaaacggaagaugcaccacagauggaguacuacuaggaacaacucaacuuucaccaguuaauauauguacauuuagaggagaugucacacauauaacuggcucaagaaacuauacaaugaaucuagcaucacaaaauugguccaacuaugacccaacagaagaaauccccgcaccacugggaaccccugacuuugucggcaaaauacaaggaguccuaacacaaacaaccaggacagacggauccaccagaggacauaaagcaacgguauauacaggauccgcagacuuugcaccuaaauuaggcaggguacaauucgaaacagacacugaucaugauuuugaagcuaaucaaaauacaaaauuuacaccuguaggcguaauacaagaugguucaacaacacauagaaaugaaccacaacaauggguacuaccaucauauuccggcagaaauacaccaaauguacaucuagcaccagcaguugccccaacauuuccaggagaacaauuauuauucuucagaucgacaaugccaggauguucaggauaucccaauauggaucuagauugucuuuuaccacaggaauggguacaauauuucuaccaagaagcagcacccgcacaaagcgauguagcauuacuaagauuuguaaauccugacacaggaagaguccuauucgaaugcaaacuacauaaauccggauacguaaccgucgcacauacaggacaacacgaccuaguaaucccuccaaacggcuacuuccgauuugauucuuggguuaaucaauuuuacaccuuagcaccaaugggcaauggaaccggaagaagacgauaa

SEQ ID NO: 34450 - RNA, 1617 nt, Artificial Sequence
  derived and/or modified sequence opt6 from VP1__Norovirus_and/or_Norovirus-like__KT202796
augaaaauggcuucuagugacgcuaauccuucagauggaagcgcagcaaaccuuguuccugaaguaaauaaugaaguuauggcccuggaaccaguaguaggugcugcaaucgccgccccaguagccggacaacaaaauguaaucgauccuuggauacgcaauaauuuuguacaagcaccaggaggugaauuuacuguaucaccacgaaaugccccaggagaaauacucuggucugcaccacuaggaccagaucuaaacccuuauuuaucacacuuagcaagaauguauaauggcuaugcaggaggauucgaaguacaaguaauuuuagcagguaaugcauuuaccgccggaaaaguaauauuugcagccgucccuccaaacuuuccaacugaaggauuaucucccucacaaguuacuauguuuccucauauugucguugauguuagacaauuagaaccuguuuuaauaccacuuccagacgucagaaacaacuucuaucauuauaaucaauccaacgauccaacaauaaaacuaauagcuaugcuauacaccccacuucgagcaaacaacgcaggagacgauguauuuacagucucauguagaguuuuaacuagaccauccccagauuucgacuuuauauuuuuaguaccaccaacagucgaaucuagaaccaaaccauuuucaguaccaguauuaaccguugaagaaaugacaaacucuagauuuccaauaccacuagaaaaacuauuuacaggacccucaucagcauucguaguccaaccucaaaacggaagauguacaacagacggcguacuauuaggaacaacacaauuaucaccaguaaacauaugcacuuucagaggagauguuacccacauaacaggaagcagaaacuauacaaugaaucuagcaucacaaaauuggucaaauuaugauccaacagaagaaauaccagcaccgcuagguaccccagacuuuguagguaaaauacaaggaguacuuacacaaacaacaagaacagacggaagcacaagaggacacaaagcuacuguauauacuggaucagcagacuuugcacccaaauuaggucguguacaauucgaaacagauacagaucaugacuuugaagcaaaucaaaauacaaaauucacaccaguaggcguaauacaagauggagguacaacucaucgaaaugaaccucaacaauggguauuaccaucauauuccggcagaaauacuccuaacguucaucuugcaccagcuguagcaccaacauuuccuggugaacaacuacuauucuuuagaucaacaaugccaggaugcaguggauauccuaauauggacuuagauugcuuacuaccacaagaauggguacaauacuuuuaucaagacgcugcacccgcccaauccgauguagcacuccucagauuuguaaauccugacacaggcagaguacuauuugaauguaaacugcauaaaucuggauacgucaccguagcucauacaggccaacacgaccucguaaucccaccaaauggauauuuccgauuugacuccuggguaaaccaauucuacacacuagcgcccaugggaaauggaacaggacgaagacguuaa

SEQ ID NO: 34451 - RNA, 1617 nt, Artificial Sequence
  derived and/or modified sequence opt6 from VP1__Norovirus_and/or_Norovirus-like__AB933751
augaaaauggcaucaucugacgcuaaccccucagauggaucaacagcaaauuuagucccagaaguaaacaaugaagucauggcauuagaaccaguuguaggagcagcaaucgcagccccaguagcaggccaacaaaauguaauagauccauggauaagaaauaacuucguacaagcuccaggaggugaauuuacaguuucgccacgaaacgcaccuggcgaaauacucuggagugcaccucuaggaccagauuuaaauccuuaccugucacacuuagcaagaauguauaauggauacgcgggaggauucgaaguacaaguaauauuagccggaaaugcauuuacagcaggaaaaaucauauuugcugcaguuccaccuaauuuuccaacagaaggacuaucaccaucacaaguaacuauguuuccacacauaaucguagacguaagacaacuagaaccuguauuaauaccacuuccagauguaagaaacaauuucuaccacuauaaucaaucaaaugauccaacaauaaaacuaauagccauguuauacaccccuuuacgagccaacaaugccggugacgauguauucacaguauccuguagaguauuaacaagaccaucaccagauuuugauuucauauuucuaguaccaccaacaguagaaucaagaacuaaaccauucucaguacccgucuuaacaguagaagaaaugaccaacuccagauuucccauuccacucgaaaaauuauucaccggaccaucuucagcauuuguaguacaaccacaaaacgggcgcugcacaaccgaugguguauuauuagguacaacacaauuaucacccgucaacauauguacauuucgaggagauguaacacauauaccaggaucaagaaauuacacaaugaaucuagcaucacaaaacuggaacucauacgacccaacagaagaaaucccagcaccccuagguacuccagauuuuguaggaaaaauucaaggcguacuuacacaaacuacuagaaccaauggaucaacaagaggccacaaagcaacaguauacacuggaucggcagacuuuagcccaaaacucggacgaguacaauucgcaacagauacggauaaugacuuugaaaauaaucaaaauacuaaauucacaccaguaggaguuauacaagacggcaguacuacaccaagaaaugaaccucaacaauggguacuuccuucuuauucaggacguaacauacauaacguacaccuagccccugcaguagcaccaacauucccuggugaacaauuauuauucuuuagaucuacaaugccuggauguuccggauauccaaauauggaccucgacugcuuauuaccacaagaauggguucaauacuucuaucaagaagcagcuccugcacaaucugacguagcauuacuacgauuuguuaacccagacacaggcagaguacuuuucgaaugcaaacuacauaaaucuggauauguaacuguagcucacacaggucaacacgauuuagucauaccuccuaauggcuacuuuagauucgauucauggguaaaucaauuuuacacacucgcaccaaugggaaauggaacuggaagacgaagauaa

SEQ ID NO: 34452 - RNA, 1617 nt, Artificial Sequence
  derived and/or modified sequence opt6 from VP1__Norovirus_and/or_Norovirus-like__KM514078
augaaaauggcaucaucagacgcaaacccaucugauggaagugcagcaaacuuaguacccgaaguaaacaaugaaguucuagcacuagaaccagucgucggagcagcaauagcugccccaguagcaggacaacaaaauguaauagacccauggauacgaaauaauuuuguacaagcaccuggaggagaauuuacaguaagcccuagaaaugcaccaggugaaauacuuuggagugcuccacuagguccagauuuaaacccauaucuaucccaucucgcacgaauguacaauggauaugcaggaggauuugaaguccaagucauacuagcaggaaaugcauuuaccgcuggaaaaguaauuuucgcagcaguucccccuaauuuuccaacugaaggauuauccccaucacaaguuacaauguucccccacauuguuguagacguaagacaacuagaaccaguacugaucccucuaccagacguaagaaacaauuuuuaucacuauaaucaauccaaugacccaacaauaaaauuaaucgcaaugcuauauacaccacuaagagcaaauaaugcaggagacgacguauuuaccguaucaugucguguucuaaccagacccagcccagauuuugauuuuaucuucuuaguaccaccaacaguugaaucaagaacaaaaccauucucaguuccaguauuaacagucgaagaaaugaccaacucaagauucccaauaccucuagaaaaauuauuuacaggaccauccucagcuuuuguaguacaaccacaaaauggucgauguacaaccgauggaguauuacuaggaacaacccaacuaucaccaguaaacauauguacauuucgaggugacguaacacacauaacaggcucucgaaauuauacaaugaauuuagcuucacaaaauuggucuaauuacgauccaacugaagaaauaccagcacccuuaggaacccccgacuucguuggaaaaauccaaggaaugcuaacacaaacuacacgaacagacgguucaaccagaggucacaaggcaacuguuuacacaggaucagccgauuucgccccuaaauuagggagaguacaauucgaaacagauaccgaccacgacuuugaagcuaaccaaaauacaaaauuuaccccaguaggagucauacaagacgguucaacaacacaccgaaaugaaccacaacaauggguacuaccauccuauucaggacgcaauaccccaaauguacaccuagcaccagcaguagcaccaacauuuccaggagaacaacuacuauucuucagaucaacaaugccagguuguucaggauauccaaauauggaucuagauuguuuauuaccacaagaauggguccaauauuuuuaccaagaagccgcacccgcucaaucagauguugccuuauuaagauucguuaauccagacacugguagaguauuauucgaauguaaacuccacaaaucuggauauguaaccguagcucacacaggacaacacgaucuaguaauaccuccuaacggauauuuccgauucgauucuuggguaaaucaauuuuauacgcuagcaccaaugggaaauggaacaggucgacgaagauaa

SEQ ID NO: 34453 - RNA, 1617 nt, Artificial Sequence
  derived and/or modified sequence opt6 from VP1__Norovirus_and/or_Norovirus-like__KM198569
augaagauggccucaaacgaugcuaauccaagugauggaucugccgcaaacuuagucccagaaguaucaaaugaagucauggcacuagaaccaguagcuggagccgcuauagcugcaccaguagcaggacaacaaaauguaauagauccauggauaagaaacaacuuuguacaagcuccaggaggugaauuuacaguuucuccuagaaacgcaccaggugaaauacuauggucagcaccuuuaggaccagacuuaaauccuuaucuaucccauuuagcaagaauguauaacggauacgcggguggauucgaaguacaaguaauuuuagcaggcaaugcauuuacagcaggcaaaauaauauucgcagcagucccaccaaauuuuccaacagaaggauuaucaccaagccaaguaacaauguucccucacauuauagucgauguaagacaacucgaaccaguauuaauaccacuaccugaugucagaaauaacuucuaucacuacaaccaaacaaaugacaguacaauaaaauuaauagcuauguuauacacaccacuaagagccaacaaugccggcgaagaugucuuuaccguuucaugucgaguucuaacaagaccaucaccugauuuugacuucauauuuuuaguaccaccaacuguagaaucccgcacuaaaccuuucacaguaccuauucuuacagucgaagaaaugacaaacuccagauuuccuauacccuuagaaaaacucuuuacuggaccaucaggagcuuucguaguacagccacaaaacggaagaugcacaaccgacggcguacuauuaggcacaacccaacuaucccccguuaauauuugcacuuucagaggagacgucacucacauagcaggauccagaaauuacacaaugaaucuagcaucuuuaaauuggaacaacuaugauccaaccgaagaaauaccagcaccacucggaacacccgacuucguaggaaaaauacaaggcguauuaacacaaacaacaaaaggagacggaucuacacgcggccauaaagcaacaguauacacagguucagcaccauuuacacccaaacuuggaucaguccaauuuuccacagauacugaaaaugacuuugaaacacaucaaaauacaaaauuuacacccguuggcguaauacaagacggaggaacuacacauagaaaugaaccacaacaauggguauuaccaucauacuccggaagagacguacauaacguacacuuagccccagcuguagcaccaacuuuccccggagaacaacuauuauucuucagaucaacaaugccaggauguucaggauauccaaauauggaucuagauugcuuauuaccucaagaauggguacaacauuucuaucaagaagcagccccagcgcaaucugauguagcuuuauuacgauucguaaauccagacaccggaagaguauuauucgaaugcaaacuacacaaaucaggauauguaacuguagcacauacuggacaacaugaucuaguaaucccaccaaacggauauuucagauucgacucauggguaaaucaauuuuauacacuagcaccaaugggaaacggaacuggaagaagaagauaa

SEQ ID NO: 34454 - RNA, 1617 nt, Artificial Sequence
  derived and/or modified sequence opt6 from VP1__Norovirus_and/or_Norovirus-like__KF768522
augaaaauggcaucaucagacgcaaauccaucagauggaucaacagcaaauuuaguaccagaaguaaauaaugaaguuauggcucuugaaccaguaguaggugcagcuauagcagcaccaguagcaggacaacaaaauguaauagacccuuggaucagaaacaauuuuguacaagcaccaggcggagaauuuacugucucaccaagaaaugccccaggagaaauacuaugguccgcaccuuuaggacccgauuuaaauccauaucuaucucaccuugcuagaauguauaacggauacgcaggaggauuugaaguacaaguaauacuagcagguaacgcauuuaccgcaggcaaaauaauauuugcagcaguaccaccuaacuucccuaccgaagguuuaagcccaucucaaguaacaauguuuccccauauuauaguugacguacgacaacuagaacccguacuaauaccacuaccugacguaagaaacaauuucuaccacuauaaucaauccaaugacccuaccauaaaacuuauagcaaugcucuauacaccccuacgcgcaaacaaugcaggcgacgauguuuuuacaguuuccuguagaguacuaacccgaccaucaccggacuucgacuuuauauuuuuaguuccaccaaccgucgaauccagaacaaaaccauucucuguaccaguuuuaacaguugaagaaaugacaaacucaagauuucccauucccuuagaaaaacuauuuacaggaccaucaucagcauuuguaguccaaccacaaaauggacgauguaccacagacggaguuuuauuaggaacaacacaacuaucaccuguuaauauaugcacuuuucgcggcgacgucauacauauaucugguucaagaaacuacacaaugaaucuagccucucaaaacuggaacucuuacgaccccacagaagaaauccccgcaccacuaggcacuccagacuucguaggcaaaauacaaggcguauuaacucaaacaacuagaacaaacggaagcacacguggacacaaagcaaccguauauacagguucugcagacuuuucaccaaaauuaggaagaguacaauuugcaacagauacugauaaugauuucgaaacaaaucaaaacacaaaauuuacucccguaggagucauacaagaugguucuacaaccccaagaaaugaaccacaacaauggguauuaccaucuuauuccggaagaaauauacauaacguacauuuagcaccagcuguagcaccaacauuuccgggagaacaauuacucuucuuuagauccacaaugccagguugcagcggcuacccaaacauggauuuagauuguuuauuaccccaagaauggguacaauauuuuuaccaagaagccgcuccagcucaaucagauguagcacuacuacgcuucguaaaccccgacacaggaagaguacuauucgaauguaaacuccacaaaucuggauauguaacaguagcacauacaggacaacaugacuuaguaauaccaccaaacggcuauuuuagauucgacucaugggucaaccaauuuuacaccuuagccccaaugggaaauggcacaggcagaagaagauaa

SEQ ID NO: 34455 - RNA, 1617 nt, Artificial Sequence
  derived and/or modified sequence opt6 from VP1__Norovirus_and/or_Norovirus-like__KF060120
augaaaauggccucaucugacgccaaccccagugaugguucaaccgcaaauuuaguacccgaaguaaacaaugaaguaauggcauuagaaccuguaguuggagcugcaauagcagccccaguagccggacaacaaaauguaauagacccauggauaagaaauaauuucguacaagcaccagguggagaauuuacaguuuccccacgaaacgcuccaggcgaaauauuauggaaugcaccacucgguccagaucuaaauccauaucucucacacuuagcaagaauguauaacgguuacgcuggagguuucgaaguccaaguaaucuuagcuggaaaugccuuuaccgccggaaaaauaauauucgcugcaguaccaccuaacuuuccuacagaaggacuuucaccuucccaaguaaccauguucccacacauaauugucgacguaagacaauuagaaccaguucuaauaccucuuccagacguaagaaacaacuucuaucacuacaaccaaucuaaugauccuacaauaaaacuaauagcuaugcuauacacaccacucagagcuaacaaugcaggagacgauguauuuacaguaucuuguagaguucuaacaagaccaucaccugacuuugauuuuauauuucuaguaccaccaacaguugaaucucgcacuaaaccauucucaguaccaguacuaaccguagaagaaaugacaaacuccagauuccccauaccauuagaaaaauuauuuacaggaccaucaucugccuucgucguacaaccucaaaacggaaaaugcacaacagacggaguucuacuaggaacaacacagcuauccccaguaaacauauguacauuucgaggugacguaacacauauaccaggcuccagaaauuacaccaugaacuuagccucacaaaauuggaacucuuacgauccuaccgaagaaauaccagcuccacuagguacuccagauuuuguaggaaaaauacaaggaguacuaacacaaaccacacgaacaaauggaucaacaagaggucacaaagcaacaguauauaccggcagugcagacuucucaccaaaauuaggaagaguacaauucgcaacugauacagacaacgacuucgaaacaaaucaaaacacaaaauuuacaccaguuggaguaauucaagacggcuccacaacaccaagaaaugaaccccaacaauggguucuacccucauauucaggaagaaauauccauaacguucauuuagcaccagcaguagcaccuacauucccaggagaacaacucuuauucuuucgaucaacaaugccaggcugcuccgguuacccuaauauggaucucgauugccuauuaccacaagaauggguacaauacuuuuaccaagaagcagcuccagcacaaucagacguagcucuuuuaagauucguaaacccagacaccggacgaguucuuuucgaaugcaaacuacacaaaucaggauauguaacagucgcacauacaggccagcaugacuuaguaauaccucccaacggauauuuuagauuugauucaugggucaaucaauucuauaccuuagcucccaugggcaacggaacaggcagaagaagauaa

SEQ ID NO: 34456 - RNA, 1617 nt, Artificial Sequence
  derived and/or modified sequence opt6 from VP1__Norovirus_and/or_Norovirus-like__KF060102
augaaaauggcaucauccgacgcaaauccaagcgacgguucagcugcaaaucuaguaccagagguaaauaaugaagucauggcccuagaaccaguaguaggagccgcaauagcagcaccaguagcaggucaacaaaacguaaucgacccauggauaagaaauaauuuuguacaagcaccuggaggagaauuuacuguaucaccuagaaaugcacccggcgaaaucuuauggucagcuccauuaggaccagauuuaaauccuuaccuaucacacuuagcaagaauguauaacggcuaugcuggugguuuugaaguacaaguaauucuagcagguaaugcuuuuacugcaggaaaaguaauauucgcagcaguuccaccaaacuuuccuacagagggauuaucacccucccaaguaaccauguucccucauauagucguugauguaagacaacuagaacccguauuaauuccguuacccgauguucgaaauaauuuuuaucauuauaaccaaagcaacgauccuacaauaaaauuaauagcaauguuauauacaccacuaagagcaaauaacgcaggagacgacgucuuuacaguaucauguagaguauuaacacgcccaucaccagacuuugacuuuauauucuuaguaccaccuacuguagaaucuagaacaaaaccauuuuccguacccguauuaacaguagaagaaaugacaaacucuagauuuccaaucccccuagaaaaacuguuuacuggaccuucuucugcauuuguaguacaaccacaaaacggaagauguacaacagauggaguacuccuaggaacaacucaauuaucaccaguaaauauuuguacauuuagaggcaauguaacacauauaaccggaucgcgaaauuauaccaugaaucuagccucucaaaacuggaauaacuacgauccaacagaagaaauuccugcaccacuaggaacucccgauuuuguaggaaaaauacaagguguucuuacccaaaccacaagaacugacggauccacccgaggucauaaagcaacagucuauauaggauccgcagacuuugcuccaaaacuaggaagaguacaauucgaaacagauacagaucacgauuucgaagcuaaucaaaacaccaaauuuaccccaguaggcguaauacaagacggaggcacaacucacagaaaugaaccacaacaauggguauuaccaucauauucaggucgcaacacacauaacguccauuuagcuccugccguagcaccaacauuuccaggagaacaauuauuauucuuuagaucuacuaugcccggauguucuggauacccaaauauggaucuagacugcuuacuaccacaagaauggguacaauacuuuuaucaagaagcagcaccagcccaaucagauguagcacuucuaagauuuguaaauccagacaccggcagagucuuauucgaaugcaaauuacauaaaucugguuauguaacuguagcacauacaggacaacacgauuuaguaaucccacccaauggcuauuuuagauucgacucauggguuaaccaauuuuacacauuagcuccaaugggaaacggaacaggaagacgacgauaa

SEQ ID NO: 34457 - RNA, 1617 nt, Artificial Sequence
  derived and/or modified sequence opt6 from VP1__Norovirus_and/or_Norovirus-like__KF060088
augaaaauggcaucaucugacgcaaauccaucagacggcucaacagcaaacuuaguuccagaaguaaacaaugaaguaauggcauuagaaccaguaguuggagcagcaauagcugcaccagucgcaggccaacagaauguaauagacccauggauaagaaauaacuuuguacaagcaccaggaggagaauuuacaguaucaccacguaaugcaccaggagaaauacuuuggucagcaccauuagguccugauuuaaauccauaucuaucacaucuagcacgcauguauaacggcuacgcaggaggauucgaaguacaaguaauauuagcuggaaaugcuuuuaccgccggaaagauaauuuucgcugccguaccaccuaacuuuccaacugaaggauuaucuccaagucaaguaacuauguuuccccacauaauaguagacguacgucaauuagaaccaguuuuaauaccacuccccgauguucguaacaauuuuuaccacuauaaccaaucaaaugauccuacaauaaaauuaauugccauguuauauacuccacugcgagcaaacaacgcaggagacgauguuuuuacaguaucaugcagaguuuuaacccgaccaucaccugacuuugacuuuauauuccuaguuccaccuacaguggaauccagaacaaaacccuucucaguaccuguauuaacaguagaagaaaugacaaacucuagauuuccaauacccuuagaaaaacucuucacaggaccuucaucugccuucguaguucaaccacaaaacgguagauguaccacagacggaguccuacuaggaacuacacaauuaucaccaguaaauauauguacauucagaggagauguuacacacauaucaggaucaagaaauuauacaaugaaucuagcaucacagaacuggaacucauacgauccaacugaagaaaucccagcaccauuagguacaccugacuuuguaggaaaaauccaaggaauguuaacacaaacaacaagaacagauggaucaacaagaggacacaaagcaacagucuacacagguucagcagacuuuucaccaaaauuaggaagaguucaauucgcaacagacacugauaacgauuucguuaccaaucaaaauacaaaauuuacaccaguaggaguaauacaagacggguccacaaccccucgaaaugaaccacaacaauggguacucccaucuuacucuggaagaaauacacauaacguacaccuagcccccgccguagcaccaacauuccccggagaacaauuacuauucuuuagauccacaaugcccggaugcucgggauauccuaacauggaucucgauugccuacuaccucaagaauggguacaauauuuuuaccaagaagcagcaccggcacaaucagauguagcccuucuaagauucguaaauccagauaccggcagaguacuauucgaaugcaaauuacauaaaucaggcuacguaaccguagcucauacaggucaacaugaucuagucaucccaccaaauggauauuuuagauucgauuccugggucaaccaauuuuauacacuagcaccaaugggaaacggaacaggaagaagaagauaa

SEQ ID NO: 34458 - RNA, 1617 nt, Artificial Sequence
  derived and/or modified sequence opt6 from VP1__Norovirus_and/or_Norovirus-like__KF060025
augaaaauggcaucuucagacgcaaauccaagcgauggaucaaccgcaaaccuagucccagaaguaaauaacgaaguaauggcacuugaaccaguaguuggagcugccauagcagcaccaguagcaggacaacaaaauguaauugaccccuggauaagaaauaauuucguacaagcaccuggaggugaguucacugucagcccacgaaaugcaccaggagaaauacuaugguccgcaccucuagggccagauuuaaauccauauuuaucucaucuagccagaauguauaacggauacgcaggagguuuugaaguacaagucauacuagcaggaaacgcuuuuaccgcaggaaaaauaauauuugcagcagugccaccaaauuuuccaacagaaggauuaagcccaucacaaguaacaauguuuccucauauuaucguagacguucgacaauuagaaccaguccuuauaccacuaccagauguaagaaacaacuuuuaucauuacaaucaaucaaacgauccaacuauaaaacuuauugccaugcuauauaccccacuaagagcuaacaaugccggugacgacguauucacaguaucaugucgaguacucacaagaccaucaccagacuuugauuuuauauuccuuguuccuccaacuguagaauccagaacaaaaccauuuuccgucccagucuuaacaguagaagaaaugacuaauucccgcuuuccaauaccauuagaaaaacuauuuacugguccaucuagcgcuuucguaguacaaccacaaaacgguagauguaccacagacgguguacuacuagguacaacucaauuaucaccaguaaauauauguacauuuagaggagauguaacacacauaaguggauccagaaauuauacaaugaacuuagcuucacaaaacuggaacuccuacgacccaaccgaagaaauaccagcaccuuuaggaaccccagacuuuguaggaaaaauucaaggaguauuaacccaaacaacaagaacugaugguucuacacgaggacacaaagcaacagucuacacaggaucagccgacuuuucaccuaaauuaggcagaguccaauucgcaacagauacagauaaugacuucguagcagaucaaaauacaaaauucacaccaguuggcguaauacaagauggaagcacuaccccuagaaaugaaccucaacaauggguacuaccaucuuacuccggacgaaauacacauaauguacauuuggccccugcaguggcaccaaccuucccaggagaacaacuauuauucuuucgaucaaccaugccaggaugcucuggauaucccaauauggaccuagauugucuacuuccucaggaauggguacaauauuucuaccaagaagcagcacccgcacaaucagauguagcauuauuaagauucguuaacccagacacuggacgaguauuauuugaaugcaaacuacauaaaucagguuacguaaccguagcucacacaggacaacacgaccuuguaauaccuccaaauggauauuucagauucgacuccuggguaaaccaauucuauacccuagcaccaauggguaacggaacuggaagaagaagauaa

SEQ ID NO: 34459 - RNA, 1617 nt, Artificial Sequence
  derived and/or modified sequence opt6 from VP1__Norovirus_and/or_Norovirus-like__KC517378
augaaaauggcaucauccgaugccaauccaucagauggauccgcagcaaaucucgugccugaaguaaauaaugaaguaauggcauuagaaccaguaguaggagcagcuauagcagcuccaguagcaggccaacaaaacguaauagauccauggauacgaaauaauuuuguacaagcacccggaggugaauuuacaguaucgccacgcaacgcaccuggugaaauauuaugguccgcaccauugggccccgacuuaaacccauauuuaucacauuuagcaagaauguauaacggauacgcuggagguuuugaaguccaaguaauauuagcuggaaaugcauucacugcugguaaaguaauauucgcagcaguacccccaaauuuuccaacugaaggacuaucuccaucucaagucacuauguuuccacauauuguaguugauguccgacaauuagaaccuguauuaauaccacuucccgauguagguaauaacuuuuaucauuacaaucaaaguaacgacccaaccauaaagcucauagcuaugcuauacacuccacuaagagcaaauaaugccggagaugauguauuuacuguaucaugccgaguacuuacaagaccauccccugacuucgauuuuauuuuucucguacccccaacaguagaaaguagaaccaaaccuuuuucaguaccaguacuaacaguagaagaaaugacaaauucacgauuuccaauaccgcuagaaaaauuauuuacaggaccuucuucugcauuuguuguacaaccacaaaauggucguuguacaacagacggaguacuccuuggaacaacucaacuuagcccaguaaacauuuguacauuuagaggagauguaacacauauuacuggaucaagaaauuauacuaugaacuuagccucacaaaacuggaauaauuaugauccaaccgaagaaauaccugcgccuuuaggaacaccagauuuuguuggaaaaauacaagggguuuuaacacaaacaacccgcacagaugguucaacuagaggacauaaagcaacaguauauacaggauccgcugacuuugcaccaaaauuaggcagaguacaauucgaaacagauacagaccacgacuuugaagcaaaucaaaauacaaaauuuacaccaguaggaguuauacaagaugguggaacaacacacagaaaugaaccucaacaaugggucuuaccaucuuauucaggaagaaacacacauaacguacacuuagcaccagcaguagcaccuacauucccaggagaacaacuacuauucuuucgaucaacuaugccaggaugcaguggauaucccaacauggaucucgauugccuacucccacaagaauggguucaauauuuuuaccaagaagcugcaccagcacaauccgacguugcacuucuacguuuuguaaauccagacacaggacgaguauuauuugaaugcaaacuacauaaauccggauauguaacaguugcacacacaggacaacacgaucucguuauucccccuaacggauauuuuagauuugacucauggguaaaucaauuuuauacauuagcuccaaugggaaauggaaccggcagaagaagauaa

SEQ ID NO: 34460 - RNA, 1617 nt, Artificial Sequence
  derived and/or modified sequence opt6 from VP1__Norovirus_and/or_Norovirus-like__JX459640
augaaaauggcuucaucagacgcaaauccaucagauggaucaaccgcacaccuaguaccagaaguaaacaaugaaguaauggcucuagaacccguaguaggugcagcuauagcagcuccuguugcaggacaacaaaacguaauagacccauggauaagaaacaacuuuguucaagcaccaggaggagaauuuaccguaagcccuagaaaugcaccaggagaaauacuauggucagcaccucucggaccagauuuaaaucccuacuuaucacaucuagcacgaauguauaacgguuacgccggaggauucgaaguacaaguuauauuagcaggcaaugccuucacagcuggaaaaauaauauuugcagcuguaccaccuaacuuuccuacagaaggacucucaccaucacaaguaacaauguuuccucauauuaucguagacguaagacaacuugaaccaguccuaaucccauuaccagauguuagaaauaauuuuuaucacuauaaccaaucaaaugacccaacaauaaaacucauagcaaugcucuacacaccauuaagagcuaacaacgccggugacgacgucuucacaguaucaugcagaguacucacgcgaccauccccagacuucgauuuuauauuucuaguaccuccuacaguggaaucucgcacaaaaccauucucagucccaguucuaacagucgaagaaaugacaaauucacgauuuccaaucccauuagaaaaacuauucacagguccaucaucagcauucguaguacaaccacaaaacgguagaugcacuaccgauggaguauuacuaggaacaacucaauuaucacccguaaacauaugcacauuuagaggugacguaacacacauuccaggaucaagaaauuauacaaugaauuuagcaucacaaaacuggaacucuuacgauccaacagaagaaauaccagccccauuaggaacaccagacuuuguaggaaaaauacaagguguauuaacacaaacaacaagaacaaacgguucaacacgcggacacaaggcaacuguauauacaggaucagccgacuuuaguccaaaacuagguagaguacaauucgcuacagauacagauaacgacuuugaaaccaaucaaaauaccaaauucacaccaguugguguaauacaagauggauccaccacaccaagaaaugaaccacaacaauggguauuaccauccuauucaggaagaaauauacacaacguucacuuagcaccagcuguugcuccaacauuccccggugaacaacuacuauuuuuccgaucaacaaugccaggaugcucaggauacccaaacauggauuuagauuguuuacuuccccaagaauggguucaauauuuuuaucaagaagcagcuccagcacaauccgacguagccuuacuaagauuugugaauccugauacaggcagaguauuauucgaaugcaaacuucacaaaaguggauaugucacagucgcccauacaggccaacaugauuuaguaauaccacccaaugguuauuuuagauuugauucauggguaaaucaauuuuauacauuagcaccaauggguaacggaacaggucgaagaagauaa

SEQ ID NO: 34461 - RNA, 1617 nt, Artificial Sequence
  derived and/or modified sequence opt6 from VP1__Norovirus_and/or_Norovirus-like__JQ613512
augaaaauggcaucaucagaugcaaacccaucagaugguaguaccgcaaaccuagucccagaaguuaacaacgaagucauggcauuagaaccaguaguaggagcugcaaucgcugcaccagucgcuggccaacaaaaugucauagaccccuggauacgaaauaacuucguacaagccccaggaggcgaauuuacaguaucaccgagaaaugcaccaggagaaauacuaugguccgccccauuagguccugaucugaaucccuauuuaucucaccuugcacguauguauaacggauaugccggugguuucgaaguacaagucauacuagcaggaaaugcauuuacagcaggaaaaauuaucuucgcagcaguuccaccuaacuuuccuacagaaggacuuucaccuucucaaguuacaauguucccucauauuaucguagacguacgucaacuagaacccguauuaauaccacuacccgacguaagaaauaauuuuuaucauuauaaccaaucuaaugauaguacaauaaaacuaauagcaaugcuauacacacccuuaagagcaaacaaugcaggagaagauguauuuacaguaucuuguagaguauuaacucgaccaucaccggacuuugacuucauauuuuuaguacccccaaccguugaaucaagaacaaaaccauuuacaguaccuauacuuacaguagaagaaaugacaaauucacgauuuccaaucccauuagaaaaauuauuuacuggacccaguggagcauucguaguacaaccacaaaauggaagaugcacaacugacggaguccuacuuggaaccacacaauuaaguccaguaaauauaugcacauucaggggagacgucacacauauagcaggcucucgaaauuauacaaugaauuuagcaucgcuaaauuggaacaacuaugacccaacugaagaaauacccgcaccacuaggaacaccagauuucgucggaaaaauacaaggaguauuaacacaaacaacuaaaggugauggcuccacaagaggucacaaagcaacagucuauacaggauccgccccauucacaccaaaacucggaucuguacaauucucuacagauacagaaaacgauuuugaaacacaucaaaauacuaaauucacuccaguaggcguaauacaagacggcucaacaacacacagaaaugaaccacaacaauggguauuaccaucuuauuccggaagaaacguacauaacguacauuuagcucccgcaguugcaccuacauuuccaggcgaacaauuauuauucuuuagaucaacaaugcccggaugcucagguuaccccaauauggaucuagacugucuacuaccacaagaauggguacaacacuuuuaccaagaagcagcccccgcucaaucagacguagcacuacuacguuuuguuaacccagauaccggcagaguccuauuugaaugcaaacuacauaaaucaggauauguuacaguagcacauacaggacaacacgaucuaguaauacccccuaauggauacuuuagauuugaugcauggguaaaccaauucuauacccuagcaccaaugggaaacgguacuggacguaaacgauaa

SEQ ID NO: 34462 - RNA, 1617 nt, Artificial Sequence
  derived and/or modified sequence opt6 from VP1__Norovirus_and/or_Norovirus-like__HQ005299
augaaaauggcguccucugacgcgaaucccagcgauggaaguacagcaaaccuaguaccagaaguuaacaaugaaguaauggcacuugaaccuguuguaggugcagcaauagcagcacccguagccggacaacaaaacguaaucgacccuuggauacgaaauaauuuuguacaagcuccaggcggugaauuuacagucucaccacgaaacgcaccuggugaaauacuuuggucagcaccacucgguccugacuuaaaccccuaucuaucacacuuaucacgaauguauaacgguuacgcuggagguuuugaaguacaaguaauacuagccggaaacgcauuuacugcaggcaaaauuauauuugcagcagugccaccaaacuuucccaccgaaggauuauccccuagccaaguaacaauguucccacacauaauaguagacguaagacaacuagaaccaguacuuauuccauuaccagacguaagaaacaauuuuuaucacuacaaccaaucaaaugauccaacaauuaaacuaauagcuaugcucuacacaccacuaagagccaacaacgcuggugacgauguauuuaccguaucauguagaguuuuaacuagaccuucuccugauuucgacuucauauuucuaguaccaccaacagucgaauccagaacuaaaccuuucucaguaccaguauuaacaguugaagaaaugacaaacucacgauucccaauaccauuagaaaaacuuuuuacaggacccucaagugcauucguaguucaaccacaaaacggaagaugcaccacagacggaguacuucuuggcacaacucaacuuucaccugucaauauaugcaccuuuagaggagacguuacccauauaccaggcucaagaaauuauacaaugaaccuagcaucccaaaauuggaacucauacgauccuacagaagaaaucccagcaccucucggaacuccugauuuuguaggaaaaauucaaggaguacuaacccaaacaacacguacaaauggaucaaccagaggucacaaagcaacaguauauacuggaucugcagacuuuucaccaaaauuaggaagaguacaauucgcaacagauaccgacaacgauuucgaaacaaaucaaaauacuaaauucacaccaguaggcguaauacaagacgggucaacaacuccaagaaaugaaccccaacaauggguauuacccucauauuccggaagaaauauacauaacguucauuuagcaccagcagucgcaccaacauuucccggcgaacaauuauuauucuuuagauccacaaugccagguugcucaggauacccaaauauggaucuagauuguuuauuaccacaagaauggguacaauauuuuuaucaagaagcagcaccagcacaaucagacguagcauuauuacgauucguaaacccagacacaggacguguucuauucgaaugcaaauuacacaaaucuggauauguaacaguagcucauacaggccaacaugaccuaguuauaccaccaaauggcuacuuccgauuugauucaugggucaaucaauuuuauacacuagcaccaaugggaaacggaacaggacggagacgauaa

SEQ ID NO: 34463 - RNA, 1617 nt, Artificial Sequence
  derived and/or modified sequence opt6 from VP1__Norovirus_and/or_Norovirus-like__AB541312
augaaaauggcuucaucagaugccaauccaagcgacggcucuacugcaaacuuagucccagaaguaaacaacgaaguaauggcacuugaacccguuguuggagcagcuauagcagcaccagucgcuggucaacaaaauguaauagauccuuggauaagaaacaauuucguacaagcaccgggaggagaauuuacaguaucaccacgaaacgcaccuggcgaaauauuauggagcgcaccccuagguccagacuuaaaucccuaucuaucacaucucgcccgaauguauaauggauaugcugguggauucgaaguacaaguaauacucgcagguaaugcauucacugcaggcaaaauuauauuugcagcuguuccaccaaauuuuccaacagaaggacuaucuccaucacaagucacaauguuuccacauauaauaguagauguaagacaauuagaaccuguccucauuccucuaccagauguaagaaauaauuuuuaucauuacaaccaauccaaugauccaacuauaaaauuaauagcaaugcuuuauacuccacuaagagcaaacaaugcuggugaugauguauuuacuguuuccuguagaguacugacacguccaucuccagauuuugacuguauacuagaucuaccaccaacaguagaaucucgcacaaaacccuucuccguaccuauauuaacaguagaagaaaugacaaauucuagauuuccaauaccuuuagaaaaacuauucaccggaccuagcucugcauucguaguucaaccucaaaauggaagaugcacaacagacggaguucuacuaggaacuacacaacuaucaccaguuaauauauguacuuuuagaggagauguaacucauauaacaggaucacgaaacuauacaaugaaccuagcaacacaaaacuggaacucuuaugaucccacagaagaaauaccagcaccauuaggaacaccagacuuuguagguaaaauccaagguguacuuacccaaacaacaagagcagaugguucaacaagaggucauaaagcaacaguauacacaggaucugcagauuuugcacccaaacuaggcagaguacaauuugcuaccgauacagacaaugauuuugaugcaaaucaaaauacuaaauucacaccaguuggaguaauccaagauggagauacugcucacagaaaugaaccucaacaguggguauuaccaucauacucuggaagaaacucacauaauguacaucuagcuccagcaguagcuccaacauuuccuggcgaacaauuauuauuuuuccgaucaacaaugccaggcuguucagguuauccaaacauggaucuagauugcuuacuuccucaagaauggguacaauacuucuaucaagaagccgcuccugcucaaucagacguugcacuauuaagauuuguaaaucccgauaccggaagaguauuauucgaauguaaauuacauaaaucugguuauguaacagucgcacauacaggacaacacgaccuaguaauaccuccaaauggauauuuuagauuugacucuuggguaaaucaauuuuacacacuagcaccuaugggcaauggaacaggccgacguagauaa

SEQ ID NO: 34464 - RNA, 1617 nt, Artificial Sequence
  derived and/or modified sequence opt6 from VP1__Norovirus_and/or_Norovirus-like__AB541275
augaagauggcaucauccgacgcaaauccaccugauggauccgcagcaaacuuagucccagaaguaaauaaugaagucauggcuuuagaaccuguuguaggugcugcaauagcagccccaguggccggccaacaaaaugucauagacccuuggauuagaaauaauuuuguacaagcaccuggaggagaauuuacuguaagcccaagaaaugcaccaggagaaauacuaugguccgcaccacuaggaccugauuuaaacccauauuuaucacaucuugcacgaauguauaacggcuaugcaggaggauucgaaguccaaguaauacuagcaggaaaugcauucacagcaggaaaaaucauauucgcagcaguuccaccaaacuuuccaacagaaggacuaucaccaucacaaguuacaauguuuccacacauaauagucgauguaagacaacucgaaccaguacuaauuccacuaccagaugucagaaacaauuucuaucauuauaaccaauccaaugauuccacaauaaaauuaauugcaauguuauacacaccauuacgagcaaauaacgcaggcgaagauguauuuacaguaucaugucgaguacuaacuagaccaucaccugacuucgauuuuauauuuuuaguaccaccaacaguagaaucaagaaccaaaccauucacaguaccaauucuaacaguagaagaaaugacuaauucaagauuccccauaccauuagaaaaauuauuuacaggacccucaggagccuucguuguacaaccccaaaacgguagaugcacaacugacggaguacuucuaggaaccacccaacuaucuccaguaaauauauguacauuucgaggagacguaacacauauugcaggaucuagaucauacacuaugaaccuagccucacugaauuggaauaacuacgauccaacagaagaaauuccagcaccacuaggaacacccgauuuuguagguaaaauacaaggaaugcuaacacaaaccaccaaaggagauggaaguacacgcggucauaaagccacaguauauacaggaucagcuccauucacacccaaauuaggaucaguacaauuuucaacagacaccgaaaacgauuuucagacacaucaaaauacaaaauuuacaccaguagguguaauacaagacggcucaacuacacaucgaaaugaaccccaacaauggguucucccauccuauucaggacgagauguccacaacguacacuuagcuccagcaguagcaccaacauuccccggagaacaacuucuauucuuuagaucuacaaugccagguugcaguggauauccaaacauggauuuagauugcuuacuaccacaagaauggguacaacauuuuuaucaagaagccgcuccugcacaaucugacguagcccuacucagauucguaaauccugacacagguagaguauuauucgaaugcaaauuacacaaaagcggauacguaacaguagcgcauacaggccaacacgaucuagucauaccaccaaacggauauuucagguucgauagcuggguaaaucaauuuuacacauuagcaccaaugggaaacgggacuggaaggagaagauaa

SEQ ID NO: 34465 - RNA, 1617 nt, Artificial Sequence
  derived and/or modified sequence opt6 from VP1__Norovirus_and/or_Norovirus-like__AB303930
augaaaauggcaucaaaugacgcaacucccucagauggcucuacagcuaaucuaguaccagaaguaaauaaugaaguaauggcacuagaaccaguagucggagcagcaaucgcugcaccaguagcaggccaacaaaacguaauugauccauggauucgaaauaacuuuguccaagcaccagguggugaguucaccguaucaccuagaaaugcaccaggagaaauauuauggucagcaccacuaggacccgaucuaaacccauauuuaucacaccuagcaagaauguauaauggauaugccggaggauuugaaguacaaguaguacuagcaggcaaugcauuuacagcugguaaaaucauauucgcugcaguuccuccaaacuuuccuacugaaggcuuauccccaucucaaguaacaauguuuccacauauaauaguagauguaagacaacuagaaccaguuuuaauuccacuaccugacguacgaaacaaucuauaucacuauaaccaaucaaaugauccaaccauaaaacuaaucgccauguuauauaccccacucagagcaaauaaugccggugaagauguauuuacaguaucuugucgaguauuaacaagacccucacccgacuuugacuuuauauuucuagucccacccaccguagaaucaagaacuaaaccauucacagucccuauauuaacaggcgaagaaaugacaaauaguagauuccccauaccauuagaaaaacuauuuacaggaccaucuggagcauucguaguacaaccccaaaauggcagaugcacaacugacggcguauuacuagguacaacacaauuacuaccagucaauauauguaccuuuagaggugauguaacacacauagcaggaacacauaauuauacaaugaaccucgcaucacaaaauuggaauaacuacgacccaaccgaagaaauaccugcuccacuaggaacuccagauuuuguuggacgaauacaaggcauguuaacacaaaccacuagaggcgacggaucaacaagaggucacaaagccacuguaucaacaggugacguacauuuuacccccaaacuaggaucaauacaauuuaacacagauacaaacaaugacuuugaaacaggacaaaauacaaaauucacucccguaggaguaguacaagacggaaacggaacucaccaaaacgaaccacaacaauggguauuaccaucauauucaggaagaacaagucacaacguacacuuagcuccagccguagcaccuaccuuuccaggagaacaauuacuauucuucagaucaaccaugccaggaugcucagguuaccccaauaugaaucucgauugcuuauuaccucaagaauggguacaacacuucuaccaagaagcagcuccugcacaaagugauguagcauuacuaagauuuguaaauccugauacaggacgcguacuuuucgaaugcaaacuacauaaaucaggcuacguaacuguagcccacacaggacaacacgaucuaguaauaccaccaaacggauauuucagauucgauuccuggguaaaucaauuuuacacacuugcaccaauggguaauggaacaggcagaagacguuga

SEQ ID NO: 34466 - RNA, 1617 nt, Artificial Sequence
  derived and/or modified sequence opt6 from VP1__Norovirus_and/or_Norovirus-like__AY485642
augaaaauggccucuaaugaugcaaacccuucugauggaucaaccgcaaaccuaguaccagaaguuaacaaugaaguaauggcacucgaacccguaguaggagcagcuauagcagcaccugucgcaggacaacaaaaugucauagacccauggauaagaaauaacuuuguacaagcaccaggaggugaauuuacaguaucaccaagaaaugcuccaggagaaauauuauggucagcaccucuuggaccagaccucaauccauaccuaccucacuuagcaagaauguauaauggauaugcuggcggcuucgaaguacaaguuauacuugcagguaacgcauuuacagccggaaaaauaauauucgcagccguaccaccaaauuuuccuacugaaggauuaucaccuucccaaguuacaauguucccacacauaauuguagauguccgacaacuagaaccaguacuaauacccuuaccggauguacguaacaauuucuaucauuauaaccaaucaaaugauccuacaauaaaauuaauagcaaugcuauacacuccauuaagagcuaacaacgcaggggaagauguauuuaccguuucuugucgagucuuaacaagaccaagcccagacuucgacuuuauauuuuuaguaccaccuacaguagaaucucgaacuaaaccuuucacuguaccuauuuuaaccguugaagaaaugacaaauucaagauuuccgauaccacuagaaaaauuauucacaggucccuccggcgcauucguaguucaaccccaaaacgguagauguacaacugauggaguacuauuaggaacuacacaauuaucaccaguaaauauauguacauuuagaggagacguuacccauauagcaggcacacacaacuacacaaugaaucuagcuagccaaaacuggaauaauuacggaccaacagaagaaauaccugcaccccuaggaacuccugacuucguaggccguauucaaggaaugcuaacucaaaccacccgaggagauggcaguacgcgaggucauaaagcaacagucucaacaggagacguccauuuuacaccaaaacuaggaucuauacaauucaauacagacacaaacaaugacuucgaaacaggacaaaauaccaaauucacuccugucggaguaguacaagacggaaacggaacucaccaaaaugaaccacaacaauggguacuuccaucauauuccggccguacaggccauaauguacaccuugcuccugcaguagcaccuaccuuuccaggugaacaacuccucuucuucagaucaacaaugccaggaugcuccggauaucccaauaugaaucuagauugcuuacuaccacaagaauggguucaacauuuuuaucaagaagcagcucccgcucaauccgauguagcacuucuacguuuuguaaacccagauacuggaagaguucuauuugaaugcaaacuacauaagucaggcuauguaacaguagcucacacaggacaacaugaucuuguaauaccucccaacggauacuucagauuugauuccuggguaaaucaauucuauacacuagcuccaaugggaaauggaacaggaagaagacgcuaa

SEQ ID NO: 34467 - RNA, 1617 nt, Artificial Sequence
  derived and/or modified sequence opt6 from VP1__Norovirus_and/or_Norovirus-like__KX514343
augaaaauggcaucaaacgaugccaauccauccgauggaucugcagccaaucuuguaccagaaguaaacaacgaaguuauggcccuagaaccaguugucggagccgcaauagcagcuccaguugcuggacaacaaaauguaauagacccuuggauaagaaauaauuucguucaagcaccaggaggcgaauuuacaguuucaccacgaaacgccccaggggaaauauuauggucagcaccccuaggaccagauuuaaauccauaucuuucacaucuagcaagaauguacaacggcuacgcaggagguuucgaaguacaaguaaucuuagcaggaaaugcuuuuacagcaggaaaaauaauauuugcagcaguaccaccuaacuucccaacagaaggucuaucaccaucacaaguaacaauguucccucauauuauaguagauguuagacaacucgaaccaguauuaauaccuuuacccgauguaagaaauaacuucuaucauuauaaccaauccaaugacucaacaauaaaauuaauagcaauguuauacacaccacuaagaacaaacaacgcuggcgacgaugucuuuacaguuucuugcagaguauuaacaagaccuucaccagacuucgauuucauauuucuaguuccaccaacaguagaaucaagauccaaaccauuuucaguaccuguucuuacuguugaagaaaugacuaauucacgauuucccgcaacuuuagacaaauuauucacaggaccaucaucaacauucguaguacaaccccaaaacggacguuguaugaucgauggaguauuacuaggcacaacucaauuaucaccagucaacaucugcacauucagaggcgacguaacacaauccggcaauacaaaaauuuauaccaugaauuuagccagcccaaauuggaauaauuaugauccaacagaagaaauaccagcaccacuagggacuccagauuucguaggcaaaauacaaggaaugcuuacacaaacaacuaaaggagaaggaucuaccagaggacaucgugcaacaguuuacgucggaucagcaaacuacgcgccaaaauuaggacguguacaauucgaaacagacacaacagacgaccuagacgcacaccaaaacacaaaauucacaccaguugguguaguucaaucuggagaaucaccaaaaggaucagaaccucaacaauggguuuuacccucuuauuccggaagagacacacccaacguacauuuagcaccagcaguagcaccuacauuuccaggugaacaacuuuuauucuucagaucaacaauaccuggaugcggaggacauccuaauaugaaucuugauugccuauuaccacaagaauggguacaacauuuuuaucaagaagcagcaccagcucaauccgacguagcacuacuaagauuuguaaauccagauacaucaagaguccuuuuugaauguaaauuacauaagucaggauauguaacaguugcacauacaggacaauaugacuuaguucucccaucaaacggcuauuuccguuuugauucauggguaaaucaauuuuacacacuagcaccgauggguaauggaacaggaagacgaagauaa

SEQ ID NO: 34468 - RNA, 1617 nt, Artificial Sequence
  derived and/or modified sequence opt6 from VP1__Norovirus_and/or_Norovirus-like__KX514274
augaaaauggcuaguaacgacgccaacccaucugaugguucagccgcaaaucuaguuccagaaguaaacaaugaaguaauggcauuagaaccaguaguuggugcggcaauagcagcaccaguagcaggacaacaaaauguaauagauccauggauaagaaacaauuuuguccaagcaccaggaggugaauuuacaguaucaccaagaaaugcaccaggagaaauauuaugguccgcaccuuuaggaccagaccuuaacccauaucuaagccaccuugcaagaauguauaacggauaugcaggaggauuugaaguacaaguuauauuagcuggaaaugcuuuuacugcagggaaaauaauauuugcagcaguaccaccuaauuucccaaccgagggacuuuccccaucucaaguuacaauguuuccucauauuauagucgacguaagacaacuagaaccaguacuuauuccauuaccugauguucguaauaauuuuuaucauuauaaucaaaguaaagauagcacaauaaaauuaauugcaauguuauauacaccauuaagagcaaauaacgcuggagaugauguauucacaguaaguuguagaguucuaaccagaccaucaccagacuuugauuuuauauucuuaguaccaccuaccgucgaaaguagauccaaaccauuuucuguaccaguauuaacaguagaagaaaugacuaauucaagauuuccagucacacuagauaaacuauuuacaggaccaucaucuacaauaguaguucaaccacaaaaugguagauguaccauagacggaguacuauuaggaacaacacaacuauccccaguaaauauauguacauuucgaggagaugucacacauccacgagauucuacaauauacacaaugaaucuagcaucaccuaauuggaacacauaugauccaacagaagaaauucccgcucccuuaggaacaccagauuuuguaggaaaaauccaaggaaugcuuacucaaacaacaaaaggagcgggauccaccaggggacacagagcaacaguuuauguuggaucagcuaacuaugcaccaaaacuaggacguguucaauuugaaacaaauacaucugaugacuuagacgcccaucaaaacacaaaauuuacuccaguaggaguaauacaaggaggagaaagugcacauagaucagaaccacaacaauggguauuaccuucuuauucuggaagagauauuccuaacguacaccuagcaccagcaguagcaccaacauucccuggagaacaauuacuauucuuuagaucaacuauaccaggauguggaggucacccaaacauggacuuagauugucucuuaccccaagaauggguacaacauuuuuaccaagaagcagccccagcacaaagcgacguagcucuauuaagguuugucaacccugacacaucuagaguacuauucgaaugcaaauuacacaagucaggauacguaaccguagcacauaccggccaacaugaucucguaauaccaccuaauggauacuuucgauuugacucuuggguaaaucaauuuuacaccuuagcaccuaugggaaauggaacaggaagaaaaagauaa

SEQ ID NO: 34469 - RNA, 1617 nt, Artificial Sequence
  derived and/or modified sequence opt6 from VP1__Norovirus_and/or_Norovirus-like__KX514175
augaaaauggcauccaacgaugcaaauccaucagauggauccgcagcaaaucuaguaccagaaguaaauaaugaaguaauggcauuagaaccaguaguaggugcagcaauagcagccccaguagcaggccaacaaaacguaauagacccuuggauacguaauaauuuuguacaagcaccagguggagaauuuacaguaagcccuagaaaugcaccaggagaaauauuauggagcgcaccacuaggaccugaucucaacccauaucuaucucaucuagcuagaauguauaauggauaugcgggcggauucgaaguucaaguaauauuagcaggaaaugcauucacugccggaaaaauaaucuucgcagcagucccucccaauuuccccacagaaggacucuccccaucucaaguaacgauguucccacauauaauagucgacgucagacaauuagaacccguucuuauaccauuaccagauguaagaaauaacuucuaucauuauaaccaauccaacgauucaacaauaaaauuaauugccaugcuauacaccccacuuagagcaaauaaugcaggagaugauguauuuacaguuucauguagaguucuaacaagaccuucaccagauuucgacuuuauauuucuaguaccaccuacuguugaaaguagaaguaaaccauuuucugucccuguacucacuguagaagaaaugacaaacucaagauuucccgcuacauuagauaaauuauuuacuggaccauccucuacauuuguaguucaaccucaaaacggcagaugcaugauugauggaguucuguuagguacaacucaacuuucuccaguaaauaucugcacauuuagaggagacguaacacauccucgagauucuaaaauauauacaaugaaucuagcauccccaaauuggaacaauuaugauccaacugaagaaauacccgcacccuuaggaacaccagacuuuguaggaaaaauacaaggaauguuaacacaaacaacuaaaggagagggaucaacucgaggucauagagcaaccguauauguaggauccgcaaauuaugcaccuaaauuagguagaguacaauucgaaacagauacaacagaugaucuagaugcacaucaaaacacuaaauuuacucccgucggugucguucaagguggcgaaucaccaaaagguucagaaccacaacaauggguacuaccauccuauaguggagcaaauacauuuaacguacaucuagcaccagcaguugcaccuaacuucccaggcgaacaauuauuauucuuuagaucaacacuaccaggaugcggaggacacccuaauauggauuuagauugucuucuaccucaagaauggguacaacauuuuuaucaagaagcagcaccagcccaaucagacguugccuuauuaagauuuguaaauccugauacauccagaguacucuuugaauguaaauuacauaaaucaggcuauguuacugucgcacacacaggucaacaugauuuaguaauaccaccaaacggauauuucagauucgacagcuggguaaaccaauucuacacucuagcaccaauggguaauggaacaggaagaaaacgauaa

SEQ ID NO: 34470 - RNA, 1617 nt, Artificial Sequence
  derived and/or modified sequence opt6 from VP1__Norovirus_and/or_Norovirus-like__KX354093
augaaaauggcauccucagacgcuaacccaucagacgguuccacagcaaauuuaguaccagaaguaaacaaugaaguuauggcauuagaaccaguagucggagcagcaauagcagccccuguagcaggucaacaaaacguuaucgauccuuggauaagaaauaacuucguacaagcaccaggaggggaauuuacaguaucacccagaaaugcaccaggugaaauccuuuggucugcaccacuaggacccgaucuaaaucccuacuuaagucacuuagccagaauguauaaugguuaugcaggcggauucgaaguucaaguaauuuuagcaggaaacgccuuuacagcaggaaaaauaauauuugcagcaguaccacccaacuucccaacagaaggauuaucaccaucccaaguaacaauguuuccacauaucauaguagacguaagacaacuagaacccguauuaauuccauuaccagacguuagaaacaauuucuaucacuacaaccaaagcaaugacucaacaauuaaauuaauagcaaugcuauacacaccacuaagagccaacaaugcaggagacgauguauuuacaguaucaugcagaguuuuaacacgacccucaccugacuuugauuuuauuuuucucgucccacccaccguagaaucacgaacaaaaccauuuucuguaccaauauuaacagucgaagaaaugaccaacucuagauuuccaauaccacuugaaaaacuauuuacaggaccaucaucugcuuucguuguacaaccucaaaauggacgauguacaacagacggaguacuccuaggaacaacacaauuaaguccagucaauauuuguacauuucgcggcgacgucacucacauuccaggcucacauaauuacacaaugaauuuagcaucucaaaauuggagcaguuaugacccaacagaagaaauaccagcuccacucggaacacccgacuuugucggcaaaauucaaggaguauuaacacaaacaacaucaacaaacggauccaccagaggacacaaagcaacaguauauaccggauccgcagacuuuucaccaaaacuaggcagaguacaauuugcuacggacacuaacaaugauuucgaaaccaaucaaaauacaaaauuuacuccaguagguguaauucaagacggcuccacuacaccuagaaaugaaccgcaacaauggguucuaccaucauauucaggacgaaauauacauaacguccacuuagcaccagcagucgcaccaacauuuccaggagaacaauuacuauucuucagaucaacaaugcccgguugcucuggauaucccaauauggacuuagauugccuacucccacaagaauggguacaauacuucuaucaagaagcagccccagcccaaucagauguagcauuacuaagauuuguaaacccugacacaggaagaguauuauucgaauguaaacuucauaaaucaggauauguaacagucgcacauacaggacaacaugacuuaguaauaccaccaaacggauauuucagauuugauucuuggguaaaucaauuuuacacacuagccccaaugggaaacggaacaggaagacgaagauaa

SEQ ID NO: 34471 - RNA, 1617 nt, Artificial Sequence
  derived and/or modified sequence opt6 from VP1__Norovirus_and/or_Norovirus-like__KX354003
augaaaauggcaucuucagacgcaaacccuucagacggaucgacagcaaaucuaguaccagaaguuaacaacgaaguaauggcacucgaaccaguaguuggcgcugcaauugcugcaccuguagcaggccaacaaaacguaauagaccccuggauacgaaauaacuuuguacaagcaccuggcggagaauuuacaguaucuccaagaaaugcaccaggagaaauacuuuggucugcaccacuaggucccgaucuaaauccauauuuaucacaucuagccagaauguauaaugguuacgcaggaggauucgaaguacaaguaauauuagcaggaaacgccuucacugccggaaaaauuauauucgcagcaguuccaccuaacuuuccaacagaaggacuaucaccaucacaaguuacuauguucccacacauaauaguagacguuagacaauuagaaccaguacuuauuccauuaccagauguaagaaacaauuucuaucacuauaaccaaucuaaugacucaaccauaaaacuuauagccauguuauacacaccacuaagagccaauaaugcuggugaugaugucuuuacgguaucuugcagaguacucacaagaccauccccugacuucgacuuuauauuuuuaguaccaccaacaguagaaucacguacaaaaccuuucuccguuccaguauuaaccguagaagaaaugacaaauucaagauuccccauaccauuagaaaaacuuuuuacaggucccucuucagcuuucguaguucaaccucaaaacgguagaugcacuacagacggaguucuucuaggaacaacacaauuaucuccaguuaauauaugcacuuuuagaggugauguaacacauauaccagguucacgaaauuauacaaugaaucucgcaucacaaaacuggaacagcuacgauccaacagaagaaauaccagcaccacuagguacuccagacuuuguaggaaaaauucaagguguuuuaacacaaacaaccagaacaaacggauccacacgaggucacaaagcaaccguauauaccgguuccgccgacuucucaccaaaauuaggcagaguacaauucgcuacagauacagauaaugauuuugaaacuaaucaaaauacuaaauuuacaccaguagguguaauucaagauggaucaaccacaccucgaaaugaaccucaacaauggguacuuccaucauauuccggucgaaauacacauaacguacacuuagcaccagcaguagcuccaacauuuccaggugaacaacucuuauucuuccgaucuacuaugccaggcuguucuggcuauccaaacauggaccuagauugucuacuaccccaagaauggguucaauauuuuuaucaagaagccgcaccagcacaauccgacguugcacuauuaagauucguaaaccccgauacaggaagaguuuuauuugaaugcaaacuacauaaaucuggcuacgucacaguagcccacacuggacaacacgaucuuguaauaccaccaaauggauauuucagauucgauaguuggguuaaucaauuuuacacacuagcaccaauggguaauggaacaggaagaagacgauaa

SEQ ID NO: 34472 - RNA, 1617 nt, Artificial Sequence
  derived and/or modified sequence opt6 from VP1__Norovirus_and/or_Norovirus-like__KR131778
augaaaauggcaucauccgacgccaauccuucagauggaucaacagcaaaccuaguaccugaaguaaacaacgaaguaauggcacuagaaccaguaguuggugcugccauagcagcuccagucgcaggucaacaaaacguaauagauccuuggauaagaaacaacuuuguacaagcaccuggaggagaauuuacaguauccccuagaaaugccccaggagaaauacuauggucagccccacuuggaccagaccuaaauccauaucuaucacaucuagcacgaauguauaacgguuaugccggugguuucgaaguacaaguuauacuugcaggaaacgcauucacagcagguaaaauaauauuugcagcaguuccuccaaacuucccaacugaaggucuuuccccaagucaaguaacaauguucccucacauaauaguugauguuagacagcuagaaccaguuuuaauaccuuuaccugauguaagaaacaauuuuuaucauuauaaccaauccaaugacccaacuauaaaacuaaucgcaaugcuauauacaccauuaagagcuaacaacgcuggcgaugaugucuuuacaguuuccugcagagucuuaacccgcccuucaccugauuuugauuuuauuuuucuaguaccaccaacaguagaaucuagaacuaaaccuuuuuccguaccuguauuaacaguagaagaaaugacaaacucacgauuccccauaccacucgaaaaauuauucacuggcccaucuucagcuuuuguaguacaaccacaaaauggaagaugcacaacagacgguguacuauuagguacaacacaauuaagcccgguaaauauauguacauuucgcggugacguuacacauauaucuggaucacgaaauuauacaaugaaucuugcaucacaaaacuggaacucauacgauccuaccgaagaaaucccugcaccucuaggaacaccagauuucguuggaaaaauucaaggaguacucacacaaacaaccagaaccgauggcucaacucgaggucacaaagccacaguauauacaggaucagcagacuuuagcccuaaacuaggaagaguacaauucgcaacagauacagauaaugacuuuguuacagaucaaaauacaaaauuuacaccaguaggaguaauacaagacgguaguacuaccccuagaaaugaaccacaacaauggguacuucccuccuauaguggaagaaacacacauaacguacaccuagccccagcuguagcaccuacuuucccuggagaacaacuuuuguucuuuagaucaacuaugccagguugcucuggcuaccccaacauggauuuagauugccuccucccucaagaauggguucaauacuuuuaucaagaagcagcaccagcacaaucugacguugcacuauuaagauuuguaaacccagacacaggucgcguauuauucgaaugcaaacuacacaaaucuggauauguaaccguagcacacaccggucaacacgaucuaguaauacccccaaacggcuauuuucgcuucgauaguuggguaaaucaauuuuauacacuagcacccaugggcaacggaacuggaagacgaagauaa

SEQ ID NO: 34473 - RNA, 1617 nt, Artificial Sequence
  derived and/or modified sequence opt6 from VP1__Norovirus_and/or_Norovirus-like__AB972468
augaaaauggcuuccucugaugcaaaccccucagacggaagugcagcaaacuuaguacccgaaguuaauaaugaaguuauggcucuagaaccaguaguaggagcagccauagcagcaccuguagcaggacaacaaaauguaauagacccauggauaagaaacaauuuuguacaagcccccggcggugaauuuacaguuucaccaagaaaugcaccuggagaaauucuauggucagcaccacuuggaccagaucuaaauccauaccucucacaccuagccagaauguauaaugguuacgccgguggauucgaaguucaaguaauucuagcaggaaacgcauucacagcugguaaaguaauuuuugcagcaguaccuccuaauuucccaacagaaggauuaucaccaucacaaguaacaauguucccacauauuguaguagauguaagacaacuagaacccguauuaauaccauuaccagauguccguaacaauuuuuaucauuauaaccaaagcaacgacucaacaauaaaauuaauugcaaugcuauacaccccucuuagagcaaacaaugccggagaugacguauuuacaguaaguugcagaguacuaacuagaccuucaccagacuuugauuucauauuuuuaguaccgccaacaguugaauccagaaccaaaccauuuucaguaccaguauuaacaguagaagaaaugacaaacucuagauucccaauuccacuugaaaaacuauuuacaggaccaucaucagcauuugucguacaaccacaaaaugguagauguacuacagacggaguacuauuaggaacaacacaacuaucaccaguuaauauuuguacauuuagaggugacguaacacauauaacugguucuagaaauuauacaaugaaucuagcaucacaaaacuggucaaauuaugauccaacugaagaaauaccggcuccacuaggaaccccugacuuuguagguaaaauccaagguguacuuacacaaacaacucguaccgacggaucaacacgaggacacaaagcaacugucuauacaggauccgcagacuuuguaccaaaauuaggccgcguacaauuugaaacagauacagauagagauuucgaagcaaaucaaaauacuaaauucacaccaguaggaguaauacaagacgguucaacaacacauagaaacgaaccacaacaauggguccuacccucauacucaggacgaaauaccccaaauguacaccuagcuccagcaguugcaccaacauucccuggggaacaauuauuauucuuuagaucuacaaugcccggaugcucaggauacccuaacauggaucucgauugccuucuaccucaagaauggguacaauauuuuuaucaagaagcagcaccagcacaaucagacguagcauuacuacgauucguuaacccagacacagguagaguccuauucgaauguaaauuacauaaaucuggauacguaacaguagcccacacaggucaacaugaccuaguaauacccccaaauggauauuuuagauucgacucuuggguuaaccaauuuuauaccuuggcaccaaugggaaauggcacagguagaagaagauaa

SEQ ID NO: 34474 - RNA, 1617 nt, Artificial Sequence
  derived and/or modified sequence opt6 from VP1__Norovirus_and/or_Norovirus-like__KR904222
augaaaauggcuagcagugaugcaaauccaucagauggaucugcagcaaaccuuguucccgaaguuaacaaugaaguaauggcacuagaaccugucguaggcgcagcaauugcugcaccaguugcaggacagcaaaaugucauugauccuuggauaagaaauaauuuuguacaagcuccaggaggagaauuuacuguaucuccaagaaaugcaccaggugagauacuauggucugcaccauuagguccugauuuaaauccauauuuaucacaccuagcaagaauguauaauggauacgccggcggcuuugaaguccaagucauacuagcuggaaaugcauuuaccgcuggaaaaaucauauucgcagccgucccaccaaacuuuccaacagaagguuuaucuccaucccaaguaaccauguuuccacauauaauaguugacguacgccaauuagaaccaguacuaauaccacuaccagacguaagaaauaacuucuaucauuauaaccaaucgaaugacucuacaauaaaauuaauugcaaugcucuacacaccauuaagagcaaacaaugcuggagaugaugucuucacuguaucaugucgaguauuaacaagaccaucaccagacuuugauuuuauauuuuuaguaccuccaacagucgaauccagaacaaaaccuuuuucaguacccguacucacaguagaagaaaugacaaauucaagauuuccuauuccccuagaaaaauuauuuacaggacccucauccgcauucgucguacaaccacaaaacggcagauguacaacagacggaguauuacuuggaacaacucaauuauccccaguaaauauuugcaccuuucgaggcgacguaacacacauaacuggaucuagaaauuacacuaugaaucuugcuucacaaaacuggaacaauugugacccuacagaagaaauaccagcuccacuagguaccccagacuucguaggaaaaauacaaggaauguuaacacaaacuaccagaacugacggaucaacaagaggccacaaagcgacaguauauacaggaucagcugacuuugcaccuaaacuaggccguguccaauuugaaacagacaccgaccaugauuuugaagcaaaccaaaauacaaaauucacaccaguaggaguaauucaagacggaucaacaacacaccgaaaugaaccccaacaauggguccuaccaucauauucaggaagaaauacacauaauguccacuuagcaccagcaguagcacccacauucccuggagaacaacucuuauucuuucgaucaacaaugccaggauguucagguuauccaaacauggauuuagauugcuuacuaccacaagaauggguccaauacuuuuaucaagaagccgcccccgcacaaucagacguagcauuacuaagauuuguaaauccagacacaggcagaguacuuuucgaaugcaaacuacauaaaucaggauauguaacugucgcgcacacuggacaacacgaccucguaauaccuccaaauggauauuucagauucgauuccuggguaaaucaauuuuacacacucgcaccaaugggaaauggaacaggcagaagaagauaa

SEQ ID NO: 34475 - RNA, 1617 nt, Artificial Sequence
  derived and/or modified sequence opt6 from VP1__Norovirus_and/or_Norovirus-like__KP244320
augaagauggcaucuucagaugcaaacccuucugauggcucaaccgcaaaucuagugccagaaguaaauaacgaaguaauggcucuagaaccaguaguaggagcauccaucgcagccccaguagcaggacaacaaaacguaauagauccauggauaagaaauaauuuuguccaagcacccggaggagaauuuaccguuucuccaagaaacgcaccaggugaaauauuauggucagcuccauuaggaccagaucuuaauccuuaucuaccacaucuagccagaauguauaacggauacgcugguggauuugaaguccaaguaauacucgcaggaaacgcauuuacagcaggcaaaauaauuuucgcagcuguuccacccaacuuucccacugaaggauuaucaccaucacagguuacaauguuuccucauauaauaguagauguaagacaauuagaacccguacuaauaccucucccugacgucagaaauaauuuuuaccauuacuaccaauccaacgauccaaccauaaaauuaauugcaauguuauacacaccauuacgcgcaaauaaugcuggugaugauguauuuacaguaucaugcagagucuuaacacgacccucaccugacuuugacuuuauauuuuuaguaccaccaacagucgaauccagaacuaaaccauucucaguaccaguucuaacaguagaagaaaugacaaacucaagauucccaauaccucuagaaaaacuauuuacaggaccuuccucugcauuuguaguacaaccacaaaauggcagauguacaacagacgguguccuacuaggaacaacacaacuaucacccguaaauauauguaccuuuagaggagacguaacccacauaucuggcaguagaaacuacaccaugaaucucgcaucacaaaauuggaacucauacgacccaacagaagaaauaccagcaccacuaggaacaccagacuuuguuggaaaaauacaaggaguucuaacacaaacaacacgaaccaacggcagcacaagaggccauaaagccacaguauacacagguagcgccgacuucucuccuaaacuaggaagaguucaauuugccacagacacugacaaugacuucgaaacaaaucaaaacacaaaauuuacaccaguuggugucauacaggacggcuccacaacaccaagaaacgaaucacaacaauggguacuaccaucauacucaggcagaaauacacauaacguacauuuagcacccgcaguagccccaacauuuccaggugaacaauuauuauucuuuagaucaacaaugccuggaugcucuggauacccaaauauggauuuagauugccuauuaccacaagaauggguacaauauuuuuaucaagaagcagcaccagcacaaucagacguagcuuuacuuagauuuguaaacccagauacaggacgaguacuauuugaaugcaaacuccacaaaucaggauauguuacaguagcacauacuggucaacacgaucucguaauaccaccuaacggcuauuucagauuugauucauggguaaaucaauuuuacaccuuagcacccaugggaaacggaaccggaagaagaagauaa

SEQ ID NO: 34476 - RNA, 1617 nt, Artificial Sequence
  derived and/or modified sequence opt6 from VP1__Norovirus_and/or_Norovirus-like__KP244315
augaaaauggccucaucagaugcuaauccuucagauggaucaacagcaaauuuagucccugaaguuaauaacgaaguaauggcacuggaaccaguuguuggagcagcuauagcagccccuguagcaggacaacaaaacguaaucgauccuuggauaagaucaaauuucguacaagcaccuggcggagaauuuacaguuucaccuagaaaugcaccaggagaaauauuauggagugcaccucuugguccagaucuaaauccauaccuaagucaccuagcgagaauguacaacggauacgcugguggauuuguaguucaaguaauuuuagcagguaaugcauucacugcaggaaaaauuauauucgcagcaguaccuccuaauuuuccuacagaagguuuaucacccucccaaguuaccauguuuccccauauaauuguagacgcaagacaacuagaaccaguacuuauuccacucccugauguaagaaacaauuuuuaucacuacaaccaauccaacgauccaaccauaaaacuuaucgcuauguuauauacuccccucagagcaaauaaugccggagacgaugucuucaccgucucaugcagaguucuaacucgaccaucaccagacuuugacuuuauauuucucguuccuccuaccguagaaucaagaaccaaaccauucucaguaccaguacuaaccguagaagaaaugacaaacuccagauuuccaauaccauuagaaaaacuauuuacaggacccucaucagcuuuuguaguccaaccacaaaauggaagauguaccacagauggagucuuacuaggaacuacacaacuuucaccaguaaauauauguaccuuuagaggagacguaacacauauaucaggaaguagaaacuacacaaugaaucuagcaucacaaaacuggaacucauaugacccaacagaagaaauaccagcaccacuuggcacaccugacuucguaggaaaaauacaaggaguuuuaacccaaaccaccaaaacagacggauccacaagaggacacaaagcaacaguuuacacugguuccgcagacuuuuccccaaaauuaggaagaguccaauuugcuacugauaccgacaaugauuuugaaacaaaucaaaacacaaaauuuacucccguagggguaauacaagauggaucuacaacuccacgcaaugaaccccaacaauggguccuaccuucauauucaggacguaauacacauaauguacaucuagcaccagcuguugcaccaacauuucccggagaacaauuacucuucuuuagaucaacaaugccagguugcucaggauacccaaacauggacuuagacugcuuacuaccucaagaauggguucaauauuuuuaucaagaagcagcaccagcccaaucagauguagcauuauuaagauuuguuaaccccgauacagguagaguuuuauucgaaugcaaacuacauaaaucuggauauguaacaguugcacauaccggacaacacgacuuaguaauaccaccaaauggauacuuuagauucgacucuuggguaaaucaauuuuacacucuagcaccaaugggaaauggaacaggaagaagacgauaa

SEQ ID NO: 34477 - RNA, 1617 nt, Artificial Sequence
  derived and/or modified sequence opt6 from VP1__Norovirus_and/or_Norovirus-like__KP244314
augaaaauggcaucaucugaugcaaacccaagcgacgggucaacagcgaaucugguaccugaaguaaacaaugaaguaauggcccuagaacccguaguuggagcagcaauagcagcaccagucgcaggacaacaaaaugucauagacccauggauuagaaauaacuuuguacaagcaccaggaggcgaguucacagucucaccuagaaaugccccaggagaaauauuauggucagccccucucggaccagaccucaauccauacuuaucccaccuagcacgaauguauaauggauauguugguggauucgaaguucaaguaauacucgccggaaaugcuuucacagccggaaaaauaaucuucgcugcaguuccacccaauuuuccuacagaaggacuuucaccaucucaaguaacaauguucccacacauaauuguugacguaagacaacuagaaccaguacuuauaccccuaccagauguuagaaauaauuuucaucacuacaaucaaucaaaugacccuacuauaaaacuaauagcuaugcuauacacaccauuaagagcuaauaaugcaggagaugauguuuuuacaguaucaugcagaguacuaacaagaccaucacccgacuuugauuuuaucuuuuuaguuccuccaacaguagaauccagaacuaaaccauucagcgucccaguccuaacaguagaagaaaugacuaacucacgauucccaauaccuuuagaaaaacuguucacaggcccaucaucagcauucguaguacaaccacaaaacggaagaugcacaacagacgguguauuauuaggaacaacucaauuaaguccaguaaacauauguacauucagaggagacguaacucauauaccagguucacgaaacuauaccaugaauuuagcaucacaaaacuggaacucuuacgaccccacagaagaaauacccgcaccacuaggaacuccagauuucguaggaaaaauacaagguguucuaacucaaacuacaagaacaaacggaucaacaagaggacacaaagcuacaguauacacagguucugcugacuuuucuccaaaacuaggaagaauacaauucgcaaccgauacagauaaugauuuugaaacaaaucaaaauacaaaauuuacaccaguuggaguaauccaagacggaucuacaacaccaagaaaugaaccccaacaauggguuuuaccuucauacucuggaagaaauacucauaacguccauuuagcaccagcaguagcaccaacauucccaggugaacaauuauuauuuuuccgaucaacaaugccaggaugcucagguuauccuaauauggaccuagauuguuuauuaccacaagaauggguacaauauuucuaccaagaagccgcaccagcucaaagugauguagcacuauuacgauucguaaacccagauacaggaagaguacuauucgaauguaaauuacauaaaucaggauacgucacaguagcgcacacaggacagcacgauuuaguaauaccaccaaauggcuacuucagauucgauagcuggguuaaucaauuuuacacacuagcccccaugggaaauggcacaggaagacgacgcuaa

SEQ ID NO: 34478 - RNA, 1617 nt, Artificial Sequence
  derived and/or modified sequence opt6 from VP1__Norovirus_and/or_Norovirus-like__KM268078
augaaaauggcuucaucagacgcaaaucccucagauggaucugcugcuaaccucgucccagaaguaaauaaugaaguaauggcacuagagccaguaguuggagcagcuaucgcugcaccuguagcaggacaacaaaacgucauagacccauggaucagaaacaauuuuguccaggccccaggcggagaauuuacaguaagcccccgcaaugcaccuggcgaaauccuuugguccgcaccacuaggaccagaucuaaauccauauuuaucucauuuagcccguauguauaaugguuaugccggugguuuugaaguacaagucauucuagcaggaaaugcauuuacagcaggaaaaguaauauucgcagcuguuccaccaaauuuuccaacagaaggacuaucaccaucccaaguaacaauguuuccacacauaguuguagacguaagacaacuagaaccaguuuuaauaccauuaccagauguaagaaacaauuuuuaucacuacaaucaauccaacgacucaacaauuaaauuaauagcuauguuauauacaccacuaagagcaaacaacgcaggagacgacguauuuacaguaucaugucgcguauuaacaagaccaucaccagacuuugacuuuauauuccuaguaccaccaacaguugaaaguagaaccaaaccauuuucuguuccaguacuaacaguugaagaaaugacaaauucaagauuuccaauaccauuagaaaaauuauucacaggccccagcucagcauuuguaguccaaccacaaaauggaagguguacaacagacggaguacuacuuggaacaacacaauuaagcccaguaaacauaugcacauuuagaggugaugucacacacaucaccggaucaagaaauuacacuaugaauuuagcuucacaaaacuggucaaauuacgauccaacagaagaaauacccgcaccacuaggaacaccagacuuuguuggaaaaauacaaggagucuuaacacaaacaacacgaacagauggaucaaccagaggacauaaggcaacaguauacacaggauccgcagacuuugcaccaaaauuaggcagaguacaauucgaaacagauacagaucaugauuucgaagcaaaucaaaacacaaaauuuacaccaguugguguaauacaagacgggggaaccacccauagaaaugaaccccaacaauggguucuaccaucauauaguggacguaauacaccaaacguacacuuagcacccgcagucgccccaacauuuccaggagaacaacucuuauuuuuccgaagcacaaugccaggauguucaggauauccuaacauggauuuagauuguuuauuaccacaagaauggguacaauauuucuaucaggaagcagcaccagcucaaucugacguagcccuacuaagauuugucaacccagacacaggaagaguccucuucgaaugcaaauuacauaaaucaggauauguuacagucgcacacaccggucaacaugacuuaguaauaccaccaaacggauauuucagauucgacucauggguaaaucaauucuacacauuagcuccaaugggaaauggaacuggaagaagaagauaa

SEQ ID NO: 34479 - RNA, 1617 nt, Artificial Sequence
  derived and/or modified sequence opt6 from VP1__Norovirus_and/or_Norovirus-like__KM198555
augaaaauggcaucaucagacgcaaacccaucugauggaucuacagcaucauuaguaccagaagucaacaaugaaguaauggcccucgaaccaguaguaggagccgcuauugcagccccaguagcaggucaacaaaauguaauagacccauggauaagaaauaauuucguacaagcacccggaggagaauuuacaguauccccaagaaacgcacccggagaaauauuauggucagccccacuugguccugaucuuaauccauaccuaucacacuuagcacgaauguauaacggauacgcaggaggauucgaaguacaaguaguccuagcaggaaaugcauucacagccgguaaaauaauuuuugccgcaguucccccaaacuucccaacagaaggcuuaucaccaucucaaguaacaauguuuccccacauaauaguagacguaagacaauuagaaccaguacucauuccacuaccagacguaagaaauaauuuuuaccacuauaaccaauccaaugauccuacaauaaaauuaauagcaaugcuauacacaccauuaagagcaaacaaugcaggagacgauguauucacaguaucaugcagaguucuaacuagaccuucuccugacuuugacuucaucuucuuaguaccucccacagucgaaucucgaacaaaaccauucucuguaccggucuuaacaguagaagaaaugacaaacucaagauuuccuauaccacuagaaaaacuauuuacugguccaucaucagcauucguuguacaaccucaaaauggaagauguacaacugauggagucuuacuaggaacaacacaacuaucaccaguaaauaucuguacuuuuagaggagacguaacacauauaucagguucccgaaacuauacaaugaaucuagcaagccaaucauggaacuccuacgauccaacagaagaaauaccagcaccauuaggcucaccagacuucguagguaaaauucaaggaguccuaacacaaacuacacgcacaaacggaucaacaagaggacacaaagccacagucuauaccgguucagcagacuucucaccaaaauuaggcagaguucaauucgcaacagacacagauaacgacuucgaaacaaaccaaaauaccaaauucacacccguaggagucauacaagacggcucaacuacacccagaaaugaaccacaacaauggguauuaccaucauacucaggacgaaacauacauaacguacacuuagcuccagcaguagcaccaacauuuccaggagaacaauuacuauucuucagaucaacaaugccagguuguucaggauaccccaacauggauuuagauugucuacuaccucaagaauggguacaauauuucuaccaagaagcagcaccagcucaauccgacguagcauuauuaagauucguaaacccugauacuggaagaguccuauuugaauguaaacuacacaaaucaggauauguaaccguagcacacacaggacaacacgaucuuguaauuccuccaaauggcuacuuccguuuugacucuuggguaaaucaauucuauacacuagcaccaaugggaaaugguacaggaagaagaagauaa

SEQ ID NO: 34480 - RNA, 1617 nt, Artificial Sequence
  derived and/or modified sequence opt6 from VP1__Norovirus_and/or_Norovirus-like__KF060115
augaaaauggcauccucagacgcaaauccaagcgacgguuccaccgcaaaccuaguacccgaaguuaauaacgaaguuauggcacucgaaccaguaguaggagcagccauugcugcuccaguugcaggacaacaaaacguaauugaucccuggauacgaaauaacuuuguucaagcaccaggaggagaauuuacaguaucuccaagaaaugcaccaggagaaauacucuggucugcaccacucgguccagaucuaaauccauacuuaucacacuuagcaagaauguacaacgguuaugccgguggauuugagguacaaguaauacucgcaggaaaugcauuuacagcugguaaaauuauuuucgcagcaguaccacccaacuuuccaacagaagguuuaucuccaucucaaguaacaauguuuccacacaucauagucgauguaagacaacuagaacccguacuaauuccacuuccagacgucagaaacaauuucuaucauuauaaucaaucaaaugacccuacaauuaaacuaauagcaaugcucuacacacccuuaagagcaaacaaugccggagaugauguauuuacaguaucaugcagaguacuaacaagaccuucuccagauuucgacuuuauauuuuuaguuccuccaacaguugaauccagaacuaaaccuuucucaguaccaguccuuacaguugaagaaaugacaaacucucgauuuccaauaccuuuagaaaaacuauuuacagguccauccagcgcuuucguaguacaaccacaaaaugguagauguacaacugaugguguucuauuaggaacuacucaacuaucaccaguuaacauaugcacuuuuagaggagacguuacacacauacccggaucacguaauuauacaaugaaccuagcaagccaaaacuggaauaguuacgauccaacagaagaaaucccagccccacuaggaacaccagacuuuguaggaaaaauacaaggagucuuaacgcaaacaacacgaacaaacgguucaacucgaggucauaaagcaacaguauauacagguucagccgacuuuucaccaaaauuaggaagaguacaauuugcaacugauaccgauaaugacuuugaaacaaaucaaaacaccaaauucacaccaguaggaguaauucaagaugguucaacaacaccucguaaugaaccucaacaauggguauuaccaagcuauuccggacgaaauauacauaacguacaccuagcuccagcaguagccccaacauucccaggagaacaauuacuauucuuuagaucaaccaugccaggcugcucaggcuauccuaauauggaucucgacuguuuacuaccacaagaauggguucaauauuuuuaccaagaagccgcaccagcccaaucagacgucgcacuucucagauuugugaauccagacacaggacgaguauuauuugaauguaaauuacauaaaccuggcuaugucacuguagcucacacaggacaacaugaucuaguuauaccacccaauggauacuuccguuucgauuccuggguaaaccaauuuuacacccuugcaccaaugggaaauggcacuggaagacgacguuaa

SEQ ID NO: 34481 - RNA, 1617 nt, Artificial Sequence
  derived and/or modified sequence opt6 from VP1__Norovirus_and/or_Norovirus-like__KF060018
augaaaauggcaucuucagacgcaaaccccagcgacggauccacagcaaauuuaguaccugaaguaaacaaugaaguaauggcacuugaaccagucguaggugcagcuauugcagcaccaguugcuggacaacaaaacguaauagacccuuggauaagaaauaauuuuguccaagcaccgggaggcgaauuuacagucucaccaagaaaugcaccaggagaaauauuauggucagcaccacuuggcccagaucuaaacccauaucucucacaccuagcacgaauguauaacucauacgcaggcgguuuugaaguccagguaauucuagcagguaaugcauuuaccgcaggcaaaauuauauuugccgcuguaccaccuaauuuuccaacugaaggccuaucaccaucacaaguuacaauguucccacacauuauaguagauguaagacaacuagaaccagucuuaauaccauuaccagacguaagaaauaacuuuuaucauuauaaccaaucaaaugauccuacaauaaaauuaauagcuaugcuauauacaccauuaagagcaaauaaugccggagaugaugucuuuacaguaucaugucgcguauuaacacgaccaucaccugauuuugacuuuauauuucuuguaccucccacaguagaaucacgaacaaaaccuuucucaguaccaguacuaacagucgaagaaaugacaaacucaagauucccaauuccauuagaaaaacuuuuuacagguccaucaucugcauucguaguucaaccacaaaauggaagguguacaacagacgguguacucuuaggaacaacacaauuaucuccagucaacauauguacauuucgaggagacguaacccacauuucuggaucaagaaauuacacuaugaauuuagccucucaaaacuggaacaguuaugacccaacagaagaaauacccgcaccacuagguacaccagacuuuguaggaaaaauacaaggaguccuaacccaaacaacacguacugaugguucaacuagaggucauaaagcaacugucuauacaggaagcgcagauuuuucuccuaaacuaggacgcguucaauuugcaacugauacugacaacgauuucguuacaaaccaaaauacaaaauucaccccuguaggaguaauucaagaugguucaacaacaccaagaaacgaaccacaacaauggguucuaccaucauauucaggaagaaauacacacaacguucacuuagcaccagcaguagcucccacauucccaggugaacaacuauuauucuuuaggucaacaaugccaggaugcucuggcuauccaaauauggaucuagauugcuuacuaccucaagaauggguacaauacuuuuaccaagaagccgcaccagcccaaucagauguagcauuacucagauucguaaacccagacacaggaagaguacucuuugaaugcaaauuacauaaaucaggauauguaacaguagcacacacaggacaacacgaucucguaauaccuccaaauggcuacuuccgauucgauagcuggguaaaucaauucuacacccuagcaccaaugggaaacggaacaggacgaagacgauaa

SEQ ID NO: 34482 - RNA, 1617 nt, Artificial Sequence
  derived and/or modified sequence opt6 from VP1__Norovirus_and/or_Norovirus-like__KC517365
augaaaauggcauccaaugacgcaaacccaucagacggaucugcagccaaccuuguaccagaaguuaacaaugaagucauggcucucgaaccaguaguuggcgcagcaauagcagcaccaguugcuggacaacaaaacguaauugacccuuggauucgaaauaacuuuguacaagcaccaggaggagaauuuaccguuuccccuagaaaugcaccaggagaaauucuuuggucagccccuuuaggaccagaccuaaauccauaccuaucacauuuagcacguauguauaacggauacgccggcgguuucgaaguucaaguaaucuuagcuggaaaugcuuuuacagcaggaaaaauaauauucgcugcaguaccaccaaacuuuccaacagaaggacuaucucccucacaagucacaauguuuccucacauaauaguugauguacgacaauuagaaccaguacuaauuccauuacccgauguacgaaacaauuucuaccauuauaaucagucaaaugauucaacaauaaaauuaaucgcuaugcucuacacaccucuaagagcaaauaaugcaggagaagacguauucacaguaucaugcagaguacuaacuagaccaucaccagacuucgauuucauauuuuuaguaccacccacugucgaaucacgcacaaaacccuucacuguaccuauauuaacugucgaagaaaugacaaacucacgauuuccaauaccacuugaaaaacuauuuacugguccaucauccgcuuucguuguacaaccacaaaauggaagauguacuacugacgguguauuacuagauacaacacaauuaucaccaguaaauauaugcacauucagaggagacguaacacacaucgcagguuccagaaauuacacaaugaauuuagcuucacuuaacuggaauaauuacgauccaacagaagaaauacccgcaccucuugguacaccagacuuugucggaaaaauacaagguauguuaacacaaacaacaaaaggugauggaucaacaagaggccacaaagcaaccguauauacaggaucagcucccuuuacaccaaaacuaggaucuguacaauucgaaaccgacacugaaaacgauuuugaaacacaucaaaauacaaaauucacacccguaggaguaauacaagaugguggaacaacacacagaaaugaaccccaacaauggguauuaccaucauauuccggucgaaauguccccaacgcacaucuagcaccagcaguagcaccaacuuucccaggagaacaauuacuauucuucagaucaacaaugccagguugcaguggauauccaaauauggaucuagacugccuacuaccacaagaauggguccaacacuuuuaucaagaagcagccccugcacaaucagauguagcauuacuaagauucguuaauccugauacaggacgaguauuauuugaaugcaaauuacauaaaaguggauauguaacagcagcacauacaggccaacacgaccucgucauaccaccaaauggauauuucagauuugauucuuggguaaaucaauuuuacacacuugcaccaaugggaaauggaacagguagaagaagauaa

SEQ ID NO: 34483 - RNA, 1617 nt, Artificial Sequence
  derived and/or modified sequence opt6 from VP1__Norovirus_and/or_Norovirus-like__KC517360
augaaaauggcuucaaaugaugcauccccauccgacggcagugcagccaauuuagucccagaaguuaauaaugaaguaauggcucuagaacccguaguaggagcagcuauagcagcccccguagcaggacaacaaaauguuauugacccuuggauaagaaauaauuucguucaagcaccaggaggugaauuuacuguaucuccucgcaacgcaccaggugaaauauuauggucagcaccacuaggcccagaucuaaauccauaucuaucacaccuagcaagaauguacaacggcuacgcaggaggauuugaaguacaaguaauauuagcugguaaugcauuuaccgcaggaaaaauaauauucgcagcagucccaccuaacuuucccacugaaggcuuaucuccuucacaaguuacaauguucccacacauuaucguagacguccgacaacuagaaccaguauuaauaccacucccagaugucagaaauaauuucuaccauuacaaccaaucaaaugacucgaccauaaaauuaauagcuaugcuauacacaccacuaagagcaaauaaugccggagaagacguauuuacaguaucaugccgaguauuaacaagaccuagcccagacuuugauuuuauauuucuuguuccaccaacaguagaauccagaacuaaaccauucacaguacccauacuaacaguagaagaaaugacaaacuccagauucccaaucccacuagaaaaauuauuuacaggcccaucuuccgcauucguaguccaaccacaaaacggaagaugcacaacagacggaguauuacuagguaccacacaacuauccccaguaaauaucugcacuuuuagaggugauguaacacauauagcuggaucacgaaacuacacaaugaauuuagcaucuuuaaauuggaacaauuaugaucccacagaagaaauaccagcaccucucggaacaccagauuuugucgguaaaauacaaggcauguuaacacaaacagcaaaaggagacgguucgacucgcggacauaaagcaacagucuauacaggaucagcaccauucacaccuaaauuaggaaguguccaauuugaaacugauacugaaaacgauuuugaaacccaccaaaacacaaaauuuacacccguaggaguaauucaagacggaggaacaacacacagaaaugaaccucagcaauggguuuuaccaucuuauucaggucgaaaugucccaaacguacaucuagccccugcaguugcaccaaccuuuccaggagaacaauuacuuuucuuuagaucaacaaugccaggaugcucagguugcccagauauggaccucgacuguuuauuaccucaagaauggguccaacacuuuuaccaagaagcagcacccgcccaaucagacgucgcccuauuaagauucguaaacccugacacagguagagucuuauucgaaugcaaacuccacaaaucaggcuauguaacaguagcacauacagggcaacacgaucuaauaauaccaccaaauggcuacuuccgauucgauucauggguuaaucaauuuuacacucuagcacccaugggcaacgguaccggaagaagaagauaa

SEQ ID NO: 34484 - RNA, 1617 nt, Artificial Sequence
  derived and/or modified sequence opt6 from VP1__Norovirus_and/or_Norovirus-like__JX846928
augaaaauggcaucaagcgacgcaucuccuuccgacggaucaacagcaaacuuaguaccugaaguaaauaaugaaguaauggcuuuagaacccguugcuggugcagcaauugcugcccccguagcuggacaacaaaaugucauagacccuuggauuagaaauaacuuuguccaagcaccaggaggagaauuuacuguuucuccaagaaaugccccaggagaaauauuauggucugcaccauuaggaccagauuuaaauccuuaccucucucauuuagccagaauguauaaugguuaugcuggugguuucgaaguacaaguaauacuugcaggaaaugcauucaccgcaggaaaaauaauuuucgcagcaguuccaccaaacuucccuacagaaggacuaaguccaucucaaguaacaauguuuccacauauaauaguagacguaaggcaauuagaaccaguccuaauaccacuaccagaugucagaaacaauuucuaucacuacaaucaauuaaacgauccaacaaucaaauuaauagcaauguuauacacuccauuaagagcaaacaaugccggugacgacguauuuacuguaucaugcagaguacuaacaagacccagccccgacuuugacuuuauauuuuuaguaccaccaacaguugaaagccgaacuaaaccauuuucugucccaguuuuaaccguugaagaaaugacaaacucacgguucccuauaccacuagaaaaguuauuuacuggaccuucaucagcauuuguaguacaaccacaaaauggacgauguacaacagacgguguacuacuagguacaacacaacuaucaccagucaauauuugcacauuuagaggugacguuacacauauaucuggauccagaaauuacacaaugaauuuagcuucacaaaacuggaacucauacgauccaaccgaagaaaucccagcaccucucggaacacccgacuuuguaggaaaaauacaaggcguccuaacacaaaccacuagaacaaaugguaguacaagaggacauaaagcaacaguuuauacaggcucagcagauuucaguccaaaacucgguagaguacaauucgcaacagauacagacaaugauuucgaaacaaaucaaaauacaaaauucacaccagucggaguaauacaagacggaaacacaaccccaagaaaugaaccacaacaauggguauuaccaucauauucaggaagaaauauacaaaacguacaccucgcacccgcaguagcaccuacauuucccggagaacaguuauuauucuuuagauccaccaugccaggaugcaguggauacccaaauauggacuuagauuguuuauuaccacaagaauggguacaauauuucuaucaagaagcagcuccugcacaaucagacguugcacuauuaagauuuguaaacccugauacaggaagaguacucuuugaauguaaacuucauaaaaguggauauguaacaguagcucacacaggacaacacgauuuagucauaccaccuaauggauauuuucgauucgacucaugggucaaucaauucuauacacuagccccaaugggaaauggaacuggaagaagaagauaa

SEQ ID NO: 34485 - RNA, 1617 nt, Artificial Sequence
  derived and/or modified sequence opt6 from VP1__Norovirus_and/or_Norovirus-like__JX459904
augaaaauggcuuccagcgacgcaaauccaucagacggaucuacagcuaacuuaguaccagaagugaacaaugaaguaauggcauuagaacccguagucggugcagcaauagcagcaccaguugcaggacaacaaaauguaauagacccauggauaagaaacaacuuuguucaagcaccuggaggagaauuuaccguaucaccacguaaugcaccaggagaaaucuuauggagugcaccauuaggaccagauuuaaauccauaucuaucccacuuagcacgaauguauaaugguuacgcugguggauucgaaguacaaguuauuuuagcaggcaaugcauuuacagcaggaaaaauaauauucgcugcuguuccacccaacuucccuacugaagguuuaaguccaucacaaguaacuauguucccucacaucauaguugauguucgccaacucgagccaguauuaauaccucuuccagauguacguaacaauuucuaucacuauaaccaaucaaaugacccaacaauuaaauuaauagcuaugcuuuacacaccucuacgagcuaacaacgccggcgaugauguuuucacaguaucaugcagaguacucacaagaccaagcccagacuucgacuuuauauuuuuaguaccaccaaccguagaaucaagaaccaaaccauuuucaguaccaguacuuacaguugaagaaaugacaaacucuagauuuccuauuccacuagaaaaauuauuuacaggaccaucaucagcauucguaguucaaccacaaaauggacgauguacaacagauggaguacuucuagguacaacacaauuauccccaguaaauauauguacauucaggggagacguaacacauauaucaggaucaagaaacuacacuaugaaccuagcaucacaaaauuggaacucuuaugacccaacagaagaaaucccugcaccauuaggaacaccagacuuuguaggaaaaauacaagguaugcuuacacaaacaacaagaacugacggaucaaccagaggacacaaagcuacuguauauacaggaagcgccgacuuuucuccaaaauuaggacgaguucaauuugcaacagauacagacaacgauuuuguaacuaaucaaaauacaaaauucacuccaguaggaguaauucaagauggaucuacaacuccuagaaacgaaccccaacaauggguacuaccuucauacucaggaagaaauacucauaauguacacuuagcaccagcagucgcaccuaccuucccaggagaacaacuacuuuucuuuagaucaacaaugccaggauguucaggauacccaaacauggauuuagauugcuuacuaccacaagaauggguccaauacuuuuaccaagaagcagccccagcacaaucggacguagcauuauuaagauuuguaaauccagacacaggcagaguuuuguucgaaugcaaacuacauaaaacaggauauguaaccgucgcacacacaggacaacacgauuuaguaauaccaccaaacggauacuuccgauucgauucauggguaaaucaguucuauacucuugcacccaugggaaauggaaccggacguagaagauaa

SEQ ID NO: 34486 - RNA, 1617 nt, Artificial Sequence
  derived and/or modified sequence opt6 from VP1__Norovirus_and/or_Norovirus-like__JX459649
augaaaauggcaucaagugacgcaaauccaucugacggaaguacugcaaaucucguaccagaaguuaacaacgaaguaauggcacuagaaccaguaguaggagcagcuauugccgcaccaguugcuggacaacagaacguaauagacccauggauuagaaguaauuuuguacaagcaccuggaggagaguucacagucucaccuagaaaugcccccggagaaauacuauggucagcaccccuagguccagacuuaaacccuuacuuaucacacuuagcuagaauguauaauggauaugcaggagguuuugaaguacaaguuauauuagcaggaaaugcauuuacagcaggaaaaaucauauuugcagcaguaccuccaaacuuuccaacagaaggucuaucaccaucacaaguaacaauguucccucacauaauaguugauguccgacagcuagaaccagucuuaauaccucuuccagacguuagaaauaauuucuaccacuacaaucaaucaaaugacccaaccauaaaacuuaucgcaaugcuauacacaccacuaagagcuaauaacgcuggcgaugauguuuuuaccguuucauguagagucuuaacccgaccuucaccagacuucgacuucaucuuccuaguacccccuaccguagaaucuagaacuaaaccuuucucaguuccaguacucacuguugaagaaaugacuaauucaagauuuaguauaccacuagaaaaacuauuuaccggacccuccucugcauuuguuguccaaccccaaaaugguagauguacaacugacggaguacuacucggaacaacacaacuaucuccgguaaauauauguacauuucgaggagauguuacacauauaccaggaucaagaaauuacacaaugaaccucgcaucacaaaauuggaacuccuaugauccaacugaagaaauaccagcaccacuaggaacuccagacuuugucggcaaaauacaaggagucuuaacacaaacaacuagaacaaacggaagcacaagaggacauaaagcuacaguauauaccgguucagccgauuuuucaccaaaacucggacgcguucaauuugcuacagauacagauaaugauuucgaaaccaaucaaaauacaaaauuuacaccaguuggaguaauacaagauggaucgacaacaccacgaaacgaaccucaacaauggguacuaccaucauauuccggccgaaauauacauaauguacacuuagcccccgcaguagcaccaacuuuuccaggugaacaauuauuauucuuuagaucaaccaugccaggauguucaggauauccuaauauggaucuagauugcuuauuaccacaagaauggguucaauauuuuuaucaagaagcagcuccagcacaaucugaugucgcauuauuaagauucguuaacccagacacaggucgagucuuauuugaauguaaacuacauaaauccggcuauguaacaguagcccauacaggccaacaugacuuaguaauaccaccaaauggauacuucagauuugauucauggguuaaucaauuuuauacacuagcuccaaugggaaaugguacagguagaagaagauaa

SEQ ID NO: 34487 - RNA, 1617 nt, Artificial Sequence
  derived and/or modified sequence opt6 from VP1__Norovirus_and/or_Norovirus-like__JX459643
augaaaauggcaucaucagacgcaaacccaagcgacggaucaacagcaaaccuuguuccagaaguuaacaacgaaguaauggcacuagaaccaguaguaggagcagcaaucgcagccccaguagcaggacaacaaaacgucauugaccccuggauaagaaacaacuucguacaagcaccuggaggagaauuuaccguaucuccacgaaacgcaccaggagaaauauuaugguccgcuccauuaggaccugaucuuaauccauaucuaucccauuuggcccgaauguacaauggauaugcaggaggcuucgagguacaaguaauauuagcaggcaacgcauucacagccggcaaaauaauauucgcagcaguaccaccgaacuucccuacagaaggcuuaucaccaucccaaguaacaauguuuccacacauaaucguagacguacgacaacuagaaccaguauuaauuccccuccccgacguaagaaauaauuucuaucacuauaaccaauccaaugauccaacaauaaaauuaauagcaauguuauauacaccccuaagagcaaacaaugcaggagaugauguuuuuaccguauccuguagaguauuaacacgaccaucaccagacuuugacuuuauauuuuuaguaccacccacagucgaaucuagaacaaaaccauuuucaguaccaguauuaacaguagaagaaaugacuaacucuagauuuccaauaccucucgaaaaauuauuuacagguccuagcucagcauucguaguacaaccacaaaacggaagauguacaacagacgguguauuauuaggaacaacucaacucucaccuguaaauauuugcacauuuagaggagacguaacacauauaccuggaucacgaaauuacacuaugaaucuagcuucacaaaauuggaacucuuacgauccaaccgaagaaauaccagcacccuuaggcaccccugauuuuguaggaaaaauucaaggagucuuaacacaaacaaccaggacaaacgguucaacaagaggacauaaagcuacaguauauaccggaucagcugacuucucaccaaaacuugguagagucgaauuugccacagacacagauaacgauuucgaaacaaaucaaaacacuaaauuuacucccguuggaguuauacaagauggauccacaacaccacguaacgaaccacaacaauggguacuaccaucauacuccgguagaaauauucauaauguacacuuagcaccagccguagcaccaacauuucccggugaacaacuucuauucuuucgaagcacaaugcccggaugcuccggcuauccaaauauggaucuagacuguuuacuaccccaagaauggguacaauacuuuuaucaagaagcagcaccagcucaaucugacguugcauuauuacgauuuguaaacccagauacugguagaguauuauucgagugcaaacuacauaaaaguggauauguaacaguagcucacacuggacaacacgaucuaguaauaccaccaaauggauauuuccgauucgacaguugggucaaucaauucuauacucuagccccuaugggcaauggcacaggaagaagaagauaa

SEQ ID NO: 34488 - RNA, 1617 nt, Artificial Sequence
  derived and/or modified sequence opt6 from VP1__Norovirus_and/or_Norovirus-like__JX459602
augaaaauggcaaguaacgaugcaaacccaucagauggaagcgcugcuaauuuaguaccagaaguaaacaacgaaguaauggcucuagaacccguuguaggagcagcaauagccgcuccaguagcuggccaacaaaauguaauugacccauggaucagaaauaauuuuguacaagcaccuggaggugaauuuacagucucaccaagaaaugcaccuggugaaauacuauggucugccccuuuaggaccagaccucaacccauaucucucucaccuagcaagaauguacaauggauaugcaggagguuuugaaguccaagucauauuagcuggaaacgcauuuacugcaggaaaaauaauuuuugcagcaguaccaccuaacuuccccacagaaggauuaucacccucacaaguuacaauguuuccacacauaauaguagacguacgucaacucgaacccguacuaauaccacuucccgacguacggaacaacuuuuaucacuauaaccaaucaaaugauucaacaauaaaacuaauagcaaugcuauacacaccacuacgagcaaacaaugcaggagaagaugucuuuaccguauccugucgaguauuaacccgaccaucacuagauuuugacuucaucuuucuaguaccaccaacaguugaauccagaacaaaaccauuuacaguaccaauucucacaguagaagaaaugacaaauucuagauuuccaauuccauuagaaaaacucuuuacaggacccucuggagcauucguaguacaaccucaaaacggacgauguaccacugacgguguucuacuaggaacaacacaauuaucaccaguaaacauauguaccuuuagaggagauguaacucacauugcaggauccagaaacuacacaaugaauuuagcgucauugaauuggaauaauuaugauccaacugaagaaacuccugcuccauuaggaacaccagauuuuguaggaaaaauacaaggaguauuaacacaaacaacaaaaggcgauggauccacaagaggacacaaagccacaguauauacagguagugcucccuuuacaccuaaacuaggauccguacaauucucuacagauacagaaaaugauuucgaaacucaucaaaauacaaaguucacaccaguagguguaauacaagacggaggaacuacacauagaaaugaaccucaacaauggguacuaccaucauauucaggacguaacguacacaacguacaucuagcacccgcaguagcaccaacauuccccggagaacaacuauuauuuuucagaucaacuaugccaggauguucugguuauccaaacauggaccuagauugucuacuaccacaagaauggguucaacauuucuaccaagaagcugccccagcucaaucagacgucgcucuacuacgauucguaaacccagauacgggacgcguauuauuugaauguaaauuacacaaauccgguuauguuacagucgcucacaccggacaacacgauuuagucauaccaccuaauggauauuuccgauuugauucauggguaaaccaauuuuacacauuagcuccaaugggaaauggcacuggcagacgaagauaa

SEQ ID NO: 34489 - RNA, 1617 nt, Artificial Sequence
  derived and/or modified sequence opt6 from VP1__Norovirus_and/or_Norovirus-like__LC177655
augaaaauggccucaucugaugcaaauccuucagacggauccgccgcaaaucuaguaccagaaguaaacaacgaaguaauggcucuagaaccaguaguaggagcagcaauugcagccccagucgcaggccagcaaaauguuauugacccauggaucagaaauaacuuuguccaagcacccggaggagaauuuacaguaucaccacgcaacgcaccaggcgaaauauuauggcgagcuccacuaggacccgaccuaaacccauauuuaucacauuuagcaagaauguacaauggcuaugcaggaggauuugagguacaaguaauacuagcaggaaaugcauuuacagcagguaaaguaauuuuugcugcuguuccucccaauuucccaacugaaggauuaucaccaucucaaguuacaauguuuccacauauaguagucgacguacgccaauuagaaccaguuuuaauaccucugcccgacguaagaaacaauuuuuaucacuauaaucaaucaaaugacccuacaauuaaauuaauugcaauguuauauacaccauuaagagcaaacaaugcaggcgaugacgucuuuacagucucuugcagaguauuaaccagaccaucuccagacuuugacuucauauuuuuaguuccuccaaccguagaaucuagaacuaaaccauucaguguacccguccuaacagucgaagaaaugacaaauucaagauuccccauuccuuuagaaaaauuauuuacaggaccauccuccgcauuugucguucaaccucaaaauggcagauguacaacugauggaguauuacuaggaacaccacaacuuucaccaguaaauauauguacauuuagaggagaugucacucauauaacagguucuagaaacuauacaaugaaucuagcaucccaaaacuggucaaauuacgauccaacagaagaaaucccagccccacuaggaacaccagacuuugucggaaaaauacaagguguauuaacccaaacaacucgaacugauggaucaacacgaggacauaaggcaacaguauauacaggauccgcagauuuugcaccuaaacuaggcagaguacaauucgaaacagauacagauagagauuucgaagcaaaccaaaauacaaaauuuacacccgucggcguaauacaagauggcucaaccacucauagaaacgaaccucaacaauggguauuacccucauacucuggaagaaauacuccuaauguucaccucgcaccagcuguagcaccaaccuuuccaggagaacaacuacuauucuuucguucaacaaugccaggauguucaggauauccaaauauggaucucgauugccuacuuccacaagaauggguucaauacuuuuaucaagaagcggcuccugcacaauccgauguugcacuccuucgauuuguuaauccagacacggguagaguauuauucgaaugcaaacuacauaaaucagguuauguaacuguagcacauacuggucaacacgauuuaguaauaccaccuaauggauauuuuagauuugauuccuggguaaaccaauuuuauacuuuagcaccaaugggaaauggaacaggaagacgaagauaa

SEQ ID NO: 34490 - RNA, 1617 nt, Artificial Sequence
  derived and/or modified sequence opt6 from VP1__Norovirus_and/or_Norovirus-like__KP784698
augaaaauggccaguagugaugcaaacccgucugauggaucuacagcaaacuuaguaccagaaguaaacaaugaaguuauggcucucgaaccaguagucggagcagcaauagcggcacccguagcuggucaacaaaacguaauagacccauggauuagaaauaacuucguacaagccccuggaggagaauuuacaguaucaccuagaaaugcacccggcgaaauccuuuggucugccccacuaggaccagaccuuaacccauaucuaucucacuuagcaagaauguauaauggcuacgcuggaggauuugaaguucaaguaauacuagccggaaacgcauuuacagcuggaaaaauaauauucgcagcaguacccccaaacuuuccaacagaaggacuaucacccucacaaguaacaauguucccacauauaauaguagauguaagacaacuagaacccguucuaauacccuuaccugauguaagaaacaauuucuaucauuauaaccaaucuaaugacagcacuauuaaacuaaucgcaaugcuuuauacaccacuaagagcaaauaacgcaggagacgauguauuuacagucucaugucgaguacuaacuagaccaucgccugacuuugacuucauauuuuuaguaccaccaacaguggaaucaagaacaaaaccauucucaguaccuguacuaacaguagaagaaaugaccaacagcagauucccaauaccacuugaaaaacuauuuacuggaccaucaucagcauucguaguacaaccccaaaacggaagauguaccacugacggaguucuacuagguacaacacaacuaucuccuguaaauaucuguacuuuuagaggugacguuacacacaucuccggaucccgaaauuacaccaugaaucucgcaucacaaaauuggaacucauaugauccaacagaagaaauaccagcaccacuaggaacaccugauuuuguaggaaaaauucaaggaguauuaacucaaacaacuagaaccgauggaucaacacgaggacacaaagcaacaguauauacgggcagugcugauuuuacaccaaaacuaggccgaguacaauucgcaacugacaccgauaaugauuucguaacaaaucaaaauaccaaauucacuccaguaggaguaauacaagauggcucaaccacacccagaaaugaaccacaacaauggguacuuccaucauauucaggaagaaauacacauaauguacaucuagcuccagcagucgcuccuacauuuccaggagaacaacuauuauucuuucgcucaaccaugcccggaugcucaggcuacccaaauauggaucuagauuguuuauuaccacaagaauggguccaauauuuuuaccaagaagccgcaccagcacaaucagacguagcacuacuacgauucguaaacccagacacaggaagaguacuauucgaauguaaauuacauaaauccggauauguaacaguagcacauacaggccaacacgauuuaguaaucccaccaaacggcuauuucagauucgauucauggguaaaccaauuuuauacacuagcucccaugggcaauggaaccggacgaagaagauaa

SEQ ID NO: 34491 - RNA, 1617 nt, Artificial Sequence
  derived and/or modified sequence opt6 from VP1__Norovirus_and/or_Norovirus-like__KX354104
augaaaauggcuucaagcgacgcaaauccaagugacggcucugccgcaaaucuaguaccagaaguaaacaaugaagucauggcuuuagaaccuguaguaggagcagcuauagcagcaccugucgccggacaacaaaauguuauugauccauggauacgcaacaauuuuguccaagcuccugguggagaauuuacaguaucuccaagaaaugcaccaggagaaauauuauggucugcaccauuaggaccugaucuaaacccauaucuaucccaccuagcaagaauguauaacgguuacgcuggaggauuugaaguacaaguaauuuuagcaggcaaugcauucaccgccggaaaagucauauucgcugcaguuccaccaaauuucccaacagaagguuuauccccaucucaaguaacuauguuuccacauauaguuguagauguaagacaacuagaaccaguauuaauaccauuaccagacguaagaaacaauuucuaccauuauaaucaauccaaugauccaacuauaaaacuuauagcuauguuauacacgccccuuagagcuaauaaugcaggagaugauguauuuacaguaagcuguagaguauuaacacgaccuucaccagauuuugacuuuauauuuuuaguaccaccaacaguagaaucuagaacaaaaccauuuucaguaccuguauuaacagucgaagaaaugacaaacucaagauuuccaauaccauuagaaaaacucuuuacuggucccucaucagcauucguaguacaaccacaaaacggucgauguaccacagacggaguacuucuaggcacaacacaacucucaccuguaaauauauguacauuucgaggagauguaacccauauuacaggaucaagaaauuacaccaugaaucuagcaucacagaauuggucaaacuaugauccaacagaagaaauccccgcacccuuaggaacacccgauuucguagguaaaauucaaggaguucucacacaaaccaccagaacagaugguucuacaagaggccauaaagcuacaguauauauaggaucagcugacuucgccccaaaacuagggagaguacaauucgaaacagauacagaucaugauuucgaagcaaaucaaaauacuaaauucacuccaguaggcguuauucaagacgguggaacaacacaucgcaaugaaccacaacaauggguacuaccaucauacucagguagaaacaccccaaauguacacuuagcuccugcaguagcaccaacuuucccuggcgaacaacuauuauucuuuagaucaaccaugccaggauguucaggauauccaaauauggaucuagauugcuuacuaccucaagaauggguucaguauuucuaccaagaggcagcaccagcccaaucagauguugcacucuuacguuuuguaaauccugacaccggucgcguccuauucgaaugcaaacuccacaaaagcggauacguuacugucgcacauacuggacaacacgaucuaguaauaccuccaaauggcuauuuuagauuugauagcuggguaaaucaauucuacacauuagcaccaaugggaaacggaacuggaagaagaagauaa

SEQ ID NO: 34492 - RNA, 1617 nt, Artificial Sequence
  derived and/or modified sequence opt6 from VP1__Norovirus_and/or_Norovirus-like__KR904211
augaaaauggcuucaagcgacgcaaacccaucagauggcuccacagcaaauuuaguaccagaaguaaacaaugaaguaauggcauuagaaccaguuguuggugcagccauagcugccccuguagcuggacagcaaaaugcaauugacccauggauaagaaauaacuucguacaagccccuggcggagaauuuacagucucucccagaaaugcaccaggagaaauauuauggucugcaccacuagguccagaucuaaaucccuaucucucacaccucgcaagaauguacaauggauacgccgguggauucgaaguacaaguaauauuagcaggaaaugcauucacagcaggaaaaauaauauucgcagcaguuccaccaaacuucccaacugaaggacuaagcccaucacaaguaaccauguucccacauauaaucguagauguaagacaacuagaaccaguacuaauaccauuaccugauguaagaaacaauuuuuaccauuauaaccaaucaaacgauucaacaauuaaauuaauagcaaugcuuuauacaccacuaagagcaaacaaugcaggagaugacgucuucacaguauccugcagaguccuaacaagaccuucaccagacuuugacuuuauauuuuuaguacccccuacaguugaaucucgaacaaaaccauuuucaguaccaauacuaacaguagaagaaaugacuaacucaagauuucccauaccucuagaaaaauuauucacaggaccaucaucggcauucguaguacaaccacaaaacggaagauguaccaccgacggcguuuuauuaggaacaacacaacuuucuccaguaaauauauguacauuucgaggagacguaacacauauagcaggaucccgaaauuauacaaugaauuuagcaucccaaaacuggaacucauacgacccaacugaagaaauaccagcaccauuaggcacaccagauuuuguaggaaaaauacaaggaguauuaacacaaacaacacgaacagauggaaguaccagaggacacaaagcaacaguauacacagguuccgcagauuucucaccaaaacucgggcgaguacaauuugcaacugacacugauaaugauuucgacgcaaaucaaaauacaaaauuuacaccuguagguguuauucaagacggcgguacaacacauagaaaugaaccacaacagugggucuuaccauccuacucuggaagaaacauacauaacguacaccuagcaccagcaguagcaccuaccuuuccaggugaacaacuacuauucuuucgaucaacaaugcccggauguucaggauaucccaacauggauuuagauugucuucuaccacaagaauggguacaauauuucuaucaagaagcagcaccagcucaaucugacguagcccuacuacgcuucguaaacccugacacaggaagaguacuuuuugaauguaaacuacacaaaucuggauacguaaccguugcccacacaggccaacacgaucuaguaauacccccaaauggauauuuuagauuugauucguggguuaaucaauuuuauacucuagcuccaauggguaauggaacuggaagaagaagauga

SEQ ID NO: 34493 - RNA, 1617 nt, Artificial Sequence
  derived and/or modified sequence opt6 from VP1__Norovirus_and/or_Norovirus-like__AB933743
augaaaauggcauccucagacgcaaacccauccgauggaucaacagcaaaucuaguucccgaaguaaauaaugaaguuauggcacuagaacccguaguaggagcagcaauagcagcaccuguagcaggacaacaaaacgucauugauccauggauaagaaauaacuuuguacaagcacccggcggagaauuuacaguaaguccgagaaacgcaccaggagaaauauuauggucagccccuuuaggaccagauuuaaacccauaucuaucacacuuagcaagaauguauaacggauacgccgguggauucgaaguacaagucauacuagcaggaaaugcauuuacagcaggaaaaauuauauucgcagcuguaccuccaaacuuuccaacagaaggauuaucaccaucacaaguaaccauguucccacacauaauaguugacguaagacaauuagaaccuguauuaauacccuuaccagauguaagaaacaauuucuaucacuauaaucaaaguaaugacucuacaauuaaacuuauagcuaugcuauacacucccuuaagagcaaauaaugccggugacgaugucuuuacaguauccugucgcguucuuaccagaccaucaccagacuuugacuuuauauuucuaguacccccuacaguagaaucacgcaccaaaccauucucuguuccaguucuuacaguagaagaaaugacaaauucccgauuuccaauaccacuagaaaaauuauucacagguccauccucagccuuuguuguccaaccacaaaaugguagauguaccacagacgguguccuucuaggaacaacacaauuaagcccaguaaacauauguacuuuuagaggagauguaacacauauaucugguucaagaaauuauacaaugaacuuagcaucacaaaacuggaacucauacgaccccacugaagaaauuccagcuccacuaggaacuccagauuuuguaggaaaaauccaaggaguacugacacaaaccacacgaacuaaugggucaaccagaggccacaaagcuacaguauauaccggaucugccgauuuuuccccaaaauuagguagaguccaauucgcaacagacacugauaacgauuuugaaacaaaucaaaauacaaaauucacaccaguaggaguaauacaagauggcucaacaacaccacgaaaugaaccacaacaauggguacuaccaucauauagugguagaucaauacacaaugugcaccuugcuccggcaguugcuccaacauuccccggagaacaacuacuuuucuuuagaucuacaaugccagguuguucaggauaucccaacauggauuuagauugcuuacuaccacaagaauggguacaauacuuuuaccaagaagcagcuccagcgcaaucugacguagcuuuacucagauucguaaacccagacacaggcagaguauuauucgaaugcaaacuacacaaaucaggauauguuacuguagcacacacaggacaacacgaucucguaauacccccaaauggauauuuuagauuugauuccuggguaaaucaauuuuauacacuugcaccaaugggcaauggcaccggacgacguagauaa

SEQ ID NO: 34494 - RNA, 1617 nt, Artificial Sequence
  derived and/or modified sequence opt6 from VP1__Norovirus_and/or_Norovirus-like__LN854572
augaaaauggcaucaucagacgccaauccauccgauggcucaaccgcuaaccuagucccagaaguaaauaacgaaguuauggcgcucgaaccugucgucggcgcagcaauagccgccccaguagcaggacaacaaaacguaauugauccauggauaagaaacaauuucguucaagcaccugguggcgaguucaccguaucaccaagaaaugcacccggggaaauauuauggucagcaccauuaggacccgaucuaaauccauaccuaucacauuuagcucgaauguacaacggauacgcuggaggauucgaaguacaaguaauccuagccggcaacgccuucaccgcaggaaaaauaauauuugcagcaguaccacccaacuuccccacagaaggauuaucaccaucacaaguuacaauguucccacauauuauaguugacguuagacaacuagaacccguccuuauaccacuacccgaugucagaaacaauuucuaccauuauaaccaauccaaugauccaacaauaaaacuaaucgcaaugcuauacacaccauuaagagcaaacaaugcuggugaugauguuuuuacaguuaguuguagaguacucacuagaccauccccagacuucgacuuuauauuuuuagucccaccaaccguagaaucaagaacaaaaccuuucucaguaccaguacuuacaguagaagaaaugacaaacucaagauuuccuauucccuuagaaaaacuuuuuacaggaccaucaucagcauuuguaguacaaccacaaaauggcagaugcacaacagacggaguacuacucggaacaacacaacuauccccugucaauauauguacauuucgaggagacgucauacacauaccuggaucaagaaauuacacaaugaaccuagcaucccaaaacuggaacucauacgaucccacugaagaaauacccgcaccacuuggaacaccagacuuuguaggaaaaauacaaggcguacuaacacaaacaacaagaacaaaugguucaacccgaggacauaaagcaacaguauauacaggaucagcagacuuuucuccaaaauuaggacgaguacaauucgcaaccgacaccgacaacgacuucgaaacaaaucaaaauacaaaauuuacacccguaggaguaauacaagacgguagcacaacacccagaaaugaaccccaacaauggguguuaccaucuuauucaggaagaaauauacauaauguucaucuagcaccagcagucgccccaacuuuccccggagaacaauuacuauucuuuagaucaacaaugcccggaugcucuggauauccaaauauggaucuagauuguuuacuaccacaagaauggguacaauacuuuuaucaagaagcugcacccgcucaaucugacguagcacuacuaagauucguuaacccagacacaggcagaguauuauuugaaugcaaauuacacaaaucaggauaugucacaguugcccacacaggacaacacgacuugguaaucccaccaaacggauauuuuagauuugacaguugggucaaucaauucuacacucuagcacccaugggcaauggaacugguagaagacgauaa

SEQ ID NO: 34495 - RNA, 1617 nt, Artificial Sequence
  derived and/or modified sequence opt6 from VP1__Norovirus_and/or_Norovirus-like__KP244319
augaaaauggcaaguucagaugcuaaccccucagauggauccacagcaaauuuaguaccagaaguaaauaaugaaguaauggcccuugaacccguuguaggcgcagcaauagcagcaccaguagcuggucaacaaaacguuaucgauccauggauuagaaauaacuuuguacaagcaccuggaggcgaauuuacaguaucgccaagaaaugcaccaggagaaauucucuggucugcaccccuaggcccagauuuaaauccauaccuaucacacuuagcacgaauguauaauggauaugcaggaggauucgaaguacaaguaauauuagcaggcaaugcauuuaccgcaggcaaaaucauuuucgcugccguuccaccaaauuuccccacagaaggauuaucaccaucucaagucacuauguucccucacauaauaguugacguaagacaauuagaaccagugucaaucccucucccagacguaagaaauaauuuuuaucacuauaaucaaucaaaugacccaacuauaaaauugauagcaauguuauauacaccacuucgugcaaacaacgccggugacgauguauuuacaguaagcugcagaguacuaacaagaccuucaccugacuuugacuucauauuccuaguaccucccaccguagaaucaagaacuaaacccuuuucagucccaguauuaaccguagaagaaaugacaaacucaagauuucccauaccauuagaaaaauuauuuacaggaccuucuucagcauuuguuguacaaccccaaaauggcagauguacaaccgacggaguauuacuagguacaacacaauuaucaccaguaaacauauguacauuuagaggugauguaacacauauaccaggaucaagaaauuacacaaugaaucucgcaucacaaaauuggaacucauacgacccuacagaagaaauuccugcaccuuuaggaacaccagauuucguaggaaaaauucaaggugucuuaacacaaacuacacgcgcaaauggcagcacaagaggacauaaagcaaccgucuacacagggucagcagauuuuucaccuaaauuaggaagaguacaauucgcaaccgauacagacaaugauuuugaaacuaaucaaaacacaaaauucacaccagucggcguaauacaagacggaucaacaacaccaagaaacgaaccccaacaauggguuuuaccaagcuauucuggaagaaauauacauaacguacacuuagcaccagcagucgcaccaacauuuccaggagaacaauuauuauucuuucgcuccacaaugccuggauguucaggauauccaaacauggaucucgauugcuuacuuccccaagaauggguucaauauuucuaucaagaagcagcacccgcccaaucagauguagcauuauuaagauucguaaauccagauacaggaagaguuuuauuugaauguaaauuacauaaaucuggcuauguuacagucgcucauacaggacaacaugaucuuguaaucccuccaaacggauauuuccgauuugacucauggguuaaucaauucuacacacuagccccaaugggcaauggaacaggaagaagaagauaa

SEQ ID NO: 34496 - RNA, 1617 nt, Artificial Sequence
  derived and/or modified sequence opt6 from VP1__Norovirus_and/or_Norovirus-like__KF768470
augaaaauggccucaucagaugcaaacccaagcgauggaucaacagcaaaccuaguaccagaaguaaauaaugaaguuauggcauuagaaccaguaguaggagcagcaauagcagcaccaguagcuggccaacaaaacgucauagacccauggauaagaaauaacuucguacaagcaccaggaggcgaguucacaguaucaccacgaaaugcucccggagaaauauuaugguccgccccucugggaccagaucuaaauccauauuuaucacaccuagccagaauguacaauggauacgccggaggauucgaaguccaaguaauccuagcaggcaaugccuuuaccgcagguaaaaucaucuuugcagcaguaccaccaaacuucccuacugaaggacuaucacccucacaaguaacaauguuuccacacauuauaguagauguacgacaacuagaaccaguacuaauaccacuacccgacguaagaaauaacuucuaucauuacaaccaaucaaaugacucuacaauaaaauuaauagccauguuauauacaccacuacgagcaaauaacgcaggagaugauguauuuacagucucuuguagaguacuaacuagacccucaccugauuucgauuuuauauuucuaguuccaccaacaguugaauccagaacuaaaccauuuucaguaccuguucucacaguugaagaaaugacaaauucacgauuuccaauaccucuagaaaagcuauuuacagguccaucaucagccuuuguaguucaaccccaaaauggaagauguacaacagacggaguucuacuaggaacuacccaauuaucacccguauccauaugcaccuuucgaggagacguaacacauauaccaggaucacacaauuacacaaugaauuuagcaucacaaaacuggaacucauacgauccuacagaagaaauaccagcuccuuuagguacaccagacuucgucgguaaaauacaagguguccucacccaaacaacuagaacaaacggaucaacaagaggacauaaagcaacaguuuauacaggaucagcagacuuuuccccaaaacucggaagaguacaauucgcuacugacacaaauaaugauuuugaaacaaaucaaaauacaaaauucaccccaguagguguaauacaagauggaucuacaaccccaagaaaugaaccacaacaauggguuuuaccuucauauuccggaagaaauauacauaacguacaccuagccccagccguagcaccaacauuccccggcgaacaacuauuauucuuucguucaacuaugccaggaugcucaggauauccaaauauggaccuagauugucuauuaccacaagaauggguucaauauuucuaucaagaagcagcuccagcucaaucagacguugcuuuauuaagauucguuaauccagacaccggacgaguacuuuuugaaugcaaacuacacaaauccggauacguaacuguagcccauacaggccaacacgauuuaguuauacccccaaauggauauuucagauucgauucuuggguaaaucaauucuauacacuagcaccgaugggaaauggaacuggaagacgaagauaa

SEQ ID NO: 34497 - RNA, 1617 nt, Artificial Sequence
  derived and/or modified sequence opt6 from VP1__Norovirus_and/or_Norovirus-like__KC456073
augaaaauggcauccucagacgcuaacccaagcgauggaucagccgcaaauuuagucccaaaaguaaauaacgaaguaauggcauuagaaccaguagucggcgcagcaauugccgcaccaguagcaggccaacaaaacguaauagauccguggaucaaaaacaacuuuguucaagccccaggaggagaauuuacaguuuccccuaaaaaugcaccaggcgaaauauuauggagugcaccacuaggaccugacuuaaauccauauuuaucucaucuugcaagaauguauaauggauacgcaggaggauuugaaguacaaguaauauuagccggaaacgcuuuuacagcaggaaaagucauauuugcugccgucccaccaaauuucccaaccgaaggacuaucaccaucacaaguuaccauguuuccccacaucguuguagauguuagacaauuagaaccuguacucauuccauuaccagauguaagaaacaauuucuaucauuauaaucaaucaaaugacccaacaauaaaacuaauagcuaugcuauacacuccuuuacgagcaaacaacgccggugacgauguauuuaccguuucauguagaguacucacaagaccaucuccagauuuugacuucauauuucuaguacccccaacaguugaaucucgaacaaaaccauuuaguguaccaguuuuaaccguagaagaaaugaccaauucacgauucccaauaccauuagaaaaauuauucacuggacccuccuccgcauuuguuguacaaccacaaaauggaagaugcaccacagauggaguauuauuaggaacaacucaauuaaguccuguaaauauauguaccuuccgaggagacguaacacauauaacagguucucgaaauuacacaaugaaucuugcaucucaaaauuggaauaauuaugauccaacugaagaaauaccagcaccauuaggaacacccgacuuuguaggaaaaauccaaggaguauuaacucaaaccacaagaaccgacgguucuacaagaggacauaaagcaacaguuuacacaggauccgcagauuuugcaccuaaacucggacgaguacaauucgaaacagacacagaucaugauuuugaagcaaaucaaaacacaaaauuuacuccaguaggaguaauacaagacggaggaacuacacauagaaaugaaccccaacaauggguuuuaccaucuuauucuggaagaaauacacacaauguucacuuagcuccagcaguugcaccuacauuuccaggugaacaacuacuauucuuuagaucaacuaugcccggcugcuccgguuauccaaauauggaccucgauugcuuacucccacaagaauggguacaauauuuuuaucaagaagcugcaccagcccaaucagauguagcuuuacucagauuuguaaacccagacacaggcagaguacuuuuugaauguaaacuacauaaaucaggguaugucacaguagcacacacaggacaacaugacuuaguaauaccaccaaauggcuauuuuagauuugauucaugggucaaccaauucuacacauuagcaccaauggguaauggcacagguagaagaagauaa

SEQ ID NO: 34498 - RNA, 1617 nt, Artificial Sequence
  derived and/or modified sequence opt6 from VP1__Norovirus_and/or_Norovirus-like__KC456072
augaaaauggcuagcuccgacgccaauccauccgauggaucugccgcaaaccuuguccccaaaguaaacaaugaaguaauggcacuagaaccaguaguaggugccgccaucgcagcacccguagcaggacaacaaaacguuauagacccauggauuaaaaauaacuuuguacaagccccaggaggugaauuuacagucucacccaaaaaugcaccaggagaaauacuuuggucagcaccacuuggaccagaucucaauccauauuuaucacacuuagcaagaauguacaauggauacgcaggcgguuucgaaguacaaguaauccucgcaggaaaugcauuuacagcaggaaaaguaauauucgcagcaguaccaccaaauuuuccaacagaaggucuauccccaucacaaguaacaauguuuccucacauaguaguagacguccgacaacucgaaccagucuuaauaccauuaccagacgucagaaacaauuucuaucauuacaaucaaucaaaugacccuacaauaaaacucauugcaauguuauacaccccacuaagagccaacaacgcuggugacgauguauucacaguaucuuguagaguucucacaagaccaucuccagauuuugauuuuauauuuuuaguuccacccacaguugaaucacgcacaaaacccuucucuguaccuguacuaaccguagaagaaaugacaaacucacgauucccaauaccauuagaaaaauuauucacaggaccaucaagcgcauuuguaguucaaccacaaaauggacgcuguacaaccgacggaguauuacuaggaacaacacaacuaucuccaguuaauaucuguacauuucgcggagacguaacucauauaacaggaucaagaaauuauacaaugaauuuagcuucucaaaauuggucaaauuaugauccaacagaagaaauaccagccccacuaggcacacccgacuuugucggcaaaauucaaggaguacuaacacaaacaacaagaacagacggauccacaagaggccacaaagcaacaguauacacuggauccgccgacuuugcaccuaaauuagguagaguacaauucgaaacagacacagauagagauuucgaagcaaaucaaaacacuaaauucacaccaguuggagucauccaagauggaagcacaacacauagaaaugaaccacaacaauggguacuaccaucuuacucaggacguaauaccccaaauguacacuuagcaccagcagucgcaccaaccuuuccuggagaacaauuauuauucuuuagaucaacaaugccaggaugcucugguuaucccaauauggaucuagacugccuauuaccucaagaauggguccaauacuucuaccaagaagcagcacccgcacaaagugacguagcacuacucagauucguaaauccugacacaggacguguucuauuugaaugcaaauuacauaaaucaggauaugucacaguugcacacacaggacaacacgauuuaguaauaccaccaaauggauauuuuagauucgauucaugggucaaccaauuuuauacauuagcaccaaugggcaauggcacuggaagaagacgauaa

SEQ ID NO: 34499 - RNA, 1617 nt, Artificial Sequence
  derived and/or modified sequence opt6 from VP1__Norovirus_and/or_Norovirus-like__JX459622
augaaaauggcaucaaaugaugcacauccuucagacggaucagcagcaacauuagucccuaaaguaaacaacgaaguaauggcacucgaaccuguaguaggugcugcuauagcagcaccagucgcaggacagcaaaauguaauagacccuuggauacgcaauaauuuuguacaagcaccaggaggugaauuuacagucucaccuagaaaugcaccuggagaaauccucuggucugcaccccuaggaccagauuuaaacccauaucuuucucaccuagccagaauguauaacggauacgcugguggcuucgaauuacauguauuacuagcaggaaaugcauucacagcaggaaaaauaaucauagcagcaguacccccaaauuuuccaacagaaggauuaucaccaucacaaguaacaauguucccacauauuaucguagacgucagacaacuagaacccguacuaauuccacuaccagauguaagaaacaauuucuaccauuauaaccaaucaaaugauucaacuauaaaacuaauagcaaugcuauauacaccauuacgagcaaacaacgcuggugaagauguauuuacaguuucauguagaguauuaacaagaccaucacccgauuuugacuuuauauuccucguacccccaacaguagaaucccguacaaaacccuuuacaguccccauauuaacaguagaagaaaugacaaauucucgcuuuccaauaccccuagaaaaauuauuuacaggucccucaggugcauuuguaguacaaccacaaaacggacggugcacaacagacggaguacuccuaggaaccacacaauuaucaccagucaauauaugcauauuuagaggugauguaacacacauagcagguagucgaaauuauacaaugaaucuugcagcuuuaaauuggaacaauuaugauccaacugaagaaauacccgcaccacucggcacaccagacuucguuggcaaaauucaaggaguacuuacccaaacaacuaaaggagacgggucaacaagaggucacaaagccacaguuuauacagguucagcugacuuuaccccuaaauuaggaucaguacaauuuucaacagauacagaaaacgacuucgaaacucaccaaaacacaaaauucacaccuguuggaguuauacaagacgguucuacaacacauagaaacgaaccccaacaauggguacuaccaagcuauucaggaagaaacguacacaacguucaccucgcaccagcaguagcaccaacauuccccggagaacaacuacuuuucuuuagaucaacaaugccaggaugcuccggcuaucccaauauggacuuagauugcuuacuaccacaagaauggguucaacauuucuaucaagaagcagcaccagcucaaucugacguagcacuucuacgauuuguuaacccagacacaggucgcguuuuauucgaauguaaauuacauaaaucaggauaugucacaguugcacacacaggacaacacgauuuaguuauaccacccaauggauauuucagauucgauucauggguaaaucaauuuuauacacuggcacccaugggcaauggaacaggaagaagaagauaa

SEQ ID NO: 34500 - RNA, 1617 nt, Artificial Sequence
  derived and/or modified sequence opt6 from VP1__Norovirus_and/or_Norovirus-like__KX514290
augaaaauggcaucuaaugacgcaaauccaucagauggaucagcugcaaauuuagucccugaaguaaauaaugaaguuauggcuuuagaaccagucguaggagcagcuaucgcugcuccaguagcaggccaacaaaauguaauagauccauggaucagaaauaauuuuguacaggcuccaggaggagaauuuacugucucgccaagaaacgcaccaggagaaauacucuggucagcaccacuuggaccagauuuaaauccauauuuaucacaucuagcaagaauguauaauggauacgcugguggauuugaaguccaaguaauacuagcaggaaaugcauucacugcaggaaaaauaauauucgcugcuguuccaccaaacuucccuaccgaaggccuaaguccaucacaaguuacgauguuuccucauauaauuguagauguaagacaacuagaaccaguacuuauaccacuaccagacguacgaaauaauuucuaucauuacaaccaauccaaugacuccacaauuaaacuaaucgccauguuauacacaccacuaagagcuaacaaugcaggagaugauguauucacaguauccuguagaguauuaacaaggcccucaccagauuuugauuuuauauuccuaguaccaccaacaguagaaucaagaaguaaaccauuuucagucccaauauuaaccguaggugaaaugacaaacucccgauuuccaauaaacuuagaaagauuauuuacuggaccaucaucagccaacguaguucaaccucaaaacggaagauguaccauagauggagaauuauuaggcacuacacaauuaucaucaguaaauaucuguacuuucagaggcgaugucacacauauaggcucuacacaucacuggacaaugaauuuagcaucaccaaauuggaauaauuaugauccaacagaagaaacgccugcuccauuaggaacuccugauuucguuggaaaaauacauggaauguuaacacaaacaacucaagaaaauggaucaacaagagcacaucgagcaacugucuacgucggcucagcagauuucacaccaaaacuaggcaaaguucaauuugaaacagacacuacuaaugaucuagacgcucaucaaaacacaaaauucacuccaguaggaguuguacaaggaggagaaucaccuaaaggaucugaaccacaacaauggguguuaccuucauauucaggaagagauaccccaaauguucacuuagccccagccguagcuccuacauucccaggagagcaacuguuauucuuuagaaguaccauaccuggaugcggaggccaucccaauaugaaucuugacugcuuacuuccacaagaauggguacaacauuuuuaccaagaagcagcaccagcacaaucagauguagcauuacuacgauuuguaaauccugauacaucucgcguauuauuugaauguaaacuccauaaaucaggauauguaacgguugcacauacaggacaacacgaucuagucauuccaccaaacgguuauuuuagauuugauucauggguaaaccaauuuuauacucuugcuccuaugggaaacggaacaggaagaaaacgauaa

SEQ ID NO: 34501 - RNA, 1617 nt, Artificial Sequence
  derived and/or modified sequence opt6 from VP1__Norovirus_and/or_Norovirus-like__KP784695
augaaaauggcaucaagugacgcaaacccaucagauggaucaacugcaaauuuaguaccagaaguaaacaaugaaguaauggcacucgaaccaguuguaggugcagcaauagcagcaccuguagcuggacaacaaaacguaauugacccauggauaagaaauaacuuuguacaagcuccaggcggagaauuuaccgucucucccagaaaugcaccuggagaaauauuauggagugcacccuuaggucccgaccuaaaccccuauuuaagucacuuagcaagaauguauaauggauaugcaggaggauucgaaguacaagucauacuagcuggaaacgcauucacugcuggaaaaauuauauuugcagcaguuccucccaacuuuccuacugaaggucuaucuccaucacaaguaaccauguucccacauauaauaguagauguuagacaauuagaaccugucuuaauaccauuacccgauguaagaaacaauuucuaccacuauaaccaaucaaacgacucaacaauaaaauuaauugcuauguuauauacaccauuacgagcaaauaacgcaggcgacgauguuuuuacaguaucauguagaguacuaaccagaccaucaccagacuucgacuuuauauuucuaguaccaccaacaguagaaucgagaaccaaaccuuucuccguaccaguacuaacagucgaagaaaugacaaacucacgauuuccaauaccucuagaaaaauuauuuacaggacccagcucugcauucguaguucaaccacaaaacgguagguguacaacagaugguguauuacuaggaacaacucaauuaucuccuguaaacauauguacauuucgaggagacguaacacauaucucaggaaguagaaauuauacaaugaaucuagcaucacaaaacuggaacuccuacgacccaacagaagaaauaccagcuccauuaggaacaccugacuuugucggcaaaauacaaggaguuuuaacacaaacuacaagaacugacggaaguaccagaggucauaaagcaacagucuauacagguucugcagacuuuucuccuaaacuuggccggguacaauuugcaacagacacagauaacgauuuuguaacgaaucaaaauacaaaauuuacuccaguuggcgucauacaagauggaaacacaacaccuagaaaugaaccacaacaaugggucuuaccauccuauucaggaagaaauacacacaauguacaccuagcaccagcaguagcuccuacuuuucccggagaacaacuacuauucuuuagaucaacaaugccaggaugcucaggauacccuaauauggauuuagauugcuuauuaccacaagaauggguucaauacuuuuaucaagaagcagccccugcacaauccgauguagcacuauuaagauucguaaacccugauacuggcagaguauuauuugaaugcaaacuacauaaaucaggauacgucacaguagcacacacaggccaacaugauuuagucauaccaccaaaugguuauuucagauuugacucuuggguaaaccaauucuacacacucgcaccaaugggaaaugguacaggcagaagacgauaa

SEQ ID NO: 34502 - RNA, 1617 nt, Artificial Sequence
  derived and/or modified sequence opt6 from VP1__Norovirus_and/or_Norovirus-like__KX608865
augaaaauggcuucauccgacgcaaacccaucagauggaucaacagcaaaucuaguaccagaaguaaauaaugaaguaauggcauuagaacccguagucggagcagcaaucgccgcuccugucgcaggccaacaaaacgucauugaccccuggauacgcaauaauuuuguccaagcaccaggaggagaauuuacaguaucaccaagaaaugccccaggagaaaucuuauggucagcaccccuagguccagaucuaaauccauaucuuucacaccuagcaagaauguauaacggauaugccggaggauucgaaguucaaguaauccuagcuggaaacgccuucaccgcuggaaaaauaauauucgcagcaguaccaccaaacuucccaaccgaaggacuaucaccaucacaaguaaccauguucccucacauuauaguagauguacgacaacuagaaccaguauuaauaccauuaccagauguacgaaauaauuucuaucauuacaaccaaucaaaugacucaaccauaaaauuaauagcuaugcuauacacuccccuaagagccaauaaugcuggugaugacguauucacaguauccuguagaguacucacucguccaagcccagacuuugauuuuaucuuucuaguaccaccuacaguugaaucaagaacaaaaccuuuuuccgucccaguauuaacagucgaagaaaugacuaauucaagauucccaauaccccuagaaaaauuauuuacaggaccaucuucagcauucguuguacaaccucaaaacggaagaugcacuacugacggaguucuacuaggcacaacucaacuuucaccaguaaauaucuguacauuuagaggagacguaacacauauagcaggcucccgcaacuauacaaugaacuuagcaucccaaaauuggaacucauacgauccaacugaagaaauaccagcaccacuaggaacacccgacuucguagguaaaauucaaggaguauuaacucaaacaacuagaacugacggcuccacaagaggucacaaagcaacaguauauacuggaucagcagauuucucacccaaacuaggacgaguacaauuugcaacagauacugauaacgacuucgucacaaaucaaaauacaaaauucacaccaguaggaguuauacaagacggaucaacaacaccacgcaaugaaccucaacaaugggucuuaccaucauacagcggaagaaauacccauaacguacauuuagcaccagcagucgcaccaacauuuccaggagaacaacuuuuauucuuuagaucuaccaugccuggaugcuccggauacccaaauauggaucuagauugcuuacucccacaagaauggguacaguauuucuaucaagaagcagcuccugcacaaucagacguagcauuacugagauuuguuaauccagauacaggccgaguauuauuugaaugcaaauuacacaaaucaggauacguuacagucgcacacacaggacaacaugaucuuguuaucccuccaaacggauacuuuagauucgacuccuggguaaaucaauuuuacacacuagcaccuaugggaaauggaacuggacgacggagauaa

SEQ ID NO: 34503 - RNA, 1617 nt, Artificial Sequence
  derived and/or modified sequence opt6 from VP1__Norovirus_and/or_Norovirus-like__AB972500
augaaaauggcaucauccgacgcaaacccaucagacggauccaccgcaaauuuaguaccugaaguaaauaaugaaguuauggcauuagaaccaguaguaggagcagcaauagcagcaccuguagccggacaacaaaaugucauagacccuuggaucagaaauaacuucguacaagcaccaggaggugaauuuacaguuucaccacgaaaugcaccaggcgaaauauuauggucagccccauuagguccagaucuaaaucccuauuuaucacacuuagcuagaauguauaaugguuaugcaggcggcuucgaaguacaaguaauccuugccggcaacgcauucacagcaggcaaaauaauauuugcagcaguaccuccuaacuuuccaacagaaggauuaucuccaucacaaguaacaauguuuccucauaucauagucgaugucagacaacuagaaccaguauuaauaccuuuaccggauguuagaaauaauuucuaccacuauaaucaaucuaacgacucaacaauuaaauuaauagcuauguuauacacuccucuaagagcaaauaacgcaggagacgacguauuuacuguaucuuguagaguauuaacuagaccaucaccagauuuugacuuuauauuccugguaccaccaaccguugaaagccgaacaaaaccuuuuucaguuccaguauuaacaguagaagaaaugaccaacucaagauucccaauuccucuugaaaaacuuuuuacagggcccucauccgcuuucguuguacaaccacaaaacgguagauguacaacagauggaguacuacuaggcaccacccaacuauccccagucaauaucugcacauuuagaggagacguaacccauauaucuggaucacgaaauuacacaaugaaucucgcaucucaaaauuggaacucauacgauccaacagaagaaauuccugcaccucucggaacaccagacuucguaggaaaaauacaaggaguacuaacacaaacaacacgcacaaacggcucaacgagaggacauaaagcuacuguauauacaggaagugcagacuuuucaccaaaacuaggacgaguacaauuugcaacagauacagauaacgauuucgaaacuaaccaaaacacaaaauuuacaccaguaggagucauacaagacggaucaacuacaccaagaaacgaaccacaacaauggguauuaccauccuauucaggacgaaauauacauaauguccaccuagcuccugcaguagcaccaacguuuccaggagaacagcuucuuuucuuucgaaguacaaugccuggaugcuccggauaucccaauauggaucuagauugcuuauuaccacaagaguggguccaauauuucuaccaagaagcagcuccugcucaauccgauguagcuuuacuacgauucguaaauccagauaccggaagaguuuuauucgaaugcaaacuacacaaauccggauauguaaccguugcacacaccggacaacacgacuuaguuauucccccaaacggauauuuucgauucgacucauggguaaaucaauucuauacauuagcaccaaugggaaauggaacagguagaagaagauaa

SEQ ID NO: 34504 - RNA, 1617 nt, Artificial Sequence
  derived and/or modified sequence opt6 from VP1__Norovirus_and/or_Norovirus-like__KT033902
augaaaauggccucaucugacgccaauccauccgauggaucaacagcaaacuuaauaccugaagucaacaacgaaguuauggcauuagaaccuguaguaggagcagcuauugcagcaccaguagccggacaacaaaauguaauugauccauggauaagaaauaacuuuguacaagcuccaggcggagaauuuacaguaucaccaagaaaugcaccaggagaaauauuauggucugcacccuuaggaccagauuuaaauccauaucuuucucacuuagcaagaauguacaaugguuaugcuggagguuuugaaguacaaguaauauuagcaggcaaugcauucacagccggaaaaaucauauucgccgccguacccccaaacuuucccacagaaggccuaucaccaucacaaguuaccauguuuccacacauaauaguagacguaaggcaacucgaaccuguacuaauuccauuaccagacgucagaaauaacuucuaccacuauaaucaaucaaacgacucaacgauaaaacuaaucgcuauguuauauacaccauuacgagcaaauaaugccggagacgacaucuuuacaguaucaugcagaguccuaacucgaccuucaccagauuuugacuuuauauuucucguacccccaacagucgaaucccgaacaaaacccuucucaguaccuguuuuaaccgucgaagaaaugacaaauucaagguuuccaauaccacuagaaaaauuauuuacaggccccucauccgcacucguaguccaaccacaaaauggacgauguacaacagacggaguauuauuaggaacuacacaauuaucuccuguuaauauaugcacuuuuagaggagacguuacacauaucccaggaucaagaaauuauaccaugaauuuagcaucacaaaacuggaacucuuaugacccaaccgaagaaauaccagcaccuuuaggaacccccgauuuuguaggcaaaauacaaggaguauuaacucaaacaacuagaacaaacggaucaacccgaggccacaaagcaacgguauauacaggaucagcugacuuuucaccaaaacucggaagaguacaauuugcaaccgauacagauaaugacuucgaaacaaaccaaaacacuaaauucacacccguugguguaauacaagauggaagcacaacaccaagaaaugaaccucaacaauggguauuaccuucauacucaggaagaaauauacauaauguucacuuagcaccagcaguagcuccuacauuuccaggagaacaacuacuuuucuuuagaucaacaaugccaggaugcucaggauauccaaauauggacuuagacugcuuacuaccucaagaauggguccaauauuuuuaccaagaagcagcccccgcacaaucugacguugcucuacuaagauuuguaaacccugauacagguagaguauuauuugaauguaagcuacacaaaucugguuacguaacugucgcacacaccggucaacacgaucucguaauuccaccaaacggauauuucagauucgauagcugggucaaccaauuuuacacacucgcuccaauggguaauggcacaggacgaagaagauaa

SEQ ID NO: 34505 - RNA, 1617 nt, Artificial Sequence
  derived and/or modified sequence opt6 from VP1__Norovirus_and/or_Norovirus-like__KR904220
augaaaauggcaucauccgacgcaaacccuucagauggaucaacagcaaaccuuguaccugaaguuaacaacgaagucauggcucucgaacccgucguaggugccgcaauagcugcaccuguagcaggacaacaaaauguaauagauccauggauaagaaauaacuuuguacaagcaccaggaggagaauuuacaguaucaccuagaaacgcaccuggugaaauccucuggucugccccauuaggaccagaucuaaacccauaucuaucacacuuagcaagaauguacaacggauaugcaggagguuucgaaguacaaguaauccuagucggaaaugcauucacagcugguaaaauaauauucgcagcaguacccccuaacuuuccaacagaaggacuuaguccaucucaaguaacaauguucccacauauaaucguagacguacgacaacuagaacccguauuaauaccucuaccagauguuagaaauaauuuuuaucacuauaaucaaucauccgacucaacaauuaaauuaauagcaauguuauacacuccccuuagagccaauaaugccggagacgacguauucacaguaucuugucgaguucucacaagaccuucaccugacuuugacuucauauuuuugguaccaccaacaguagaauccagaacaaaaccauucucaguaccuguauuaacuguugaagaaaugaccaacucaagauucccuaucccacuagaaaaauuauuuacagguccaucauccgcauuuguuguacaaccacaaaacggaagauguacaacagauggaguccuacuaggaacaacccaguuaucaccaguaaauauauguacuuucagaggagauguaacacauauaucuggaucacacaauuauacuaugaaucucgcaucacaaaauuggaacucuuacgacccuacagaagaaaucccugcaccauuagguaccccagacuuuguaggaaaaauacaaggaguuuuaacacaaacaacaagaacagauggauccacucgcggacacaaagcaacaguauauacaggcaguacagacuuuacaccuaaacuugguagagcacaauucgcuacugauaccgauaacgauuucgaaacaaaucaaaauacaaaauuuacaccaguaggagucauacaagauggaggaaccacccaucguaaugaaccucaacaauggguauuaccuucauauucagguagaaauacacacaacguacacuuagcaccagcaguagcaccaacauuuccuggcgaacaacuacuuuucuuuagaucaacaaugccuggauguucaggcuaucccaacauggauuuagauugcuuacuaccacaagaauggguacaauauuuuuaccaagaagcagccccugcccaauccgacguugcauuauuacgauuuguaaacccagacacaggcaggguauuauuugaauguaaauuacauaaaucaggauauguaacuguagcacauacuggacaacaugacuuaguaauuccaccaaauggauauuuccgauuugauucauggguaaaucaauucuauacacuagcacccaugggaaauggaacuggcagaagaagauaa

SEQ ID NO: 34506 - RNA, 1617 nt, Artificial Sequence
  derived and/or modified sequence opt6 from VP1__Norovirus_and/or_Norovirus-like__LN854566
augaaaauggcaucaagugacgcaaacccaucagauggcucugcugcuaauuuaguucccgaaguuaacaaugaaguuauggcucuagaaccuguaguaggagcagcaauagcagcaccaguagcaggccaacaaaacgucauagacccuuggauaagaaauaauuucguccaagcccccggaggugaauuuacaguaucaccaagaaaugcaccaggugaaauauuauggucagcaccauuaggcccagaucucaacccauauuuaucacaccuugcucguauguacaacggauaugcugguggauuugaaguucaaguaauauuagcuggaaacgccuucacagcuggaaaaauaauauucgcagcaguaccacccaauuucccaacagaaggacuaaguccaucacaaguaacaauguuuccacauauaauaguagauguuagacaacucgaaccuguauuaauacccuuaccagacguacgaaacaacuucuaucacuacaaucaauccaaugauucaacaauuaaacucauugcaauguuauauacaccacuaagagccaacaacgcuggagaugaugucuuuacaguaucaugucgaguauuaacuagaccaaguccugacuuugauuuuaucuuucuagucccaccaacaguugaaucacgaacaaaaccauuuucuguaccaguacuaacaguagaagaaaugacaaauucaagauuucccauaccauuagaaaaacuuuuuaccggaccuaguucagcauuugucguccaaccacaaaauggucgauguacuacugauggaguauuauuaggaacaacacaacuauccccaguuaauauauguacauuccguggugacguaucucauauaacaggaucaagaaacuauacaaugaaucuagcuucucaaaacuggaauaauuacgacccaacagaagaaaucccagcaccuuuaggaacaccagacuucguagguaaaauacaagguaugcuuacucaaacuaccagagccgauggauccacacgaggucauaaagcuaccguuuauacagguagugcugacuuugcacccaaacuaggucgaguacaauucgaaacagauacagaccaugacuuugaagcaaaccaaaacacaaaauuuacacccguaggaguuauacaagauggauccacaacacauagaaacgaaccccaacaaugggucuuaccaucauauagugguagaaauacacacaauguucaccuugcaccagccguagcaccaacuuucccaggugaacaauuauuauucuuuagaagcacaaugccagguuguucuggauaucccaauauggaucuagauugccuacuaccccaagaauggguacaauauuucuaccaagaagcagcuccagcacaaucugacguagcacuacuacgauucguaaauccugacacaggacgaguauuauuugaaugcaaacuacauaaaaguggauacgucacagucgcucacacaggacaacacgaucucguuauaccaccaaacggauacuuuagauuugauucuuggguaaaucaauuuuacacuuuagcuccaaugggaaacggaacaggaagacgucgauaa

SEQ ID NO: 34507 - RNA, 1617 nt, Artificial Sequence
  derived and/or modified sequence opt6 from VP1__Norovirus_and/or_Norovirus-like__KP244313
augaaaauggcaucaucagaugcuaacccuucugauggaucaacagcaaauuuaguaccugaaguaaacaacgaaguuauggcacuggaacccgucguaggagcagccaucgcagccccaguagcuggacaacaaaauguaauagacccguggauaagaaauaacuuuguacaggcaccaggaggugaauuuaccgucucuccacgaaacgcaccaggagaaaucuuauggucagcuccauuaggaccagauuuaaaucccuacuuaucacacuuagcuagaauguacaacggauacgcuggaggauuugaaguacaaguaauacuagcagguaaugcauucacagccggaaaaauaauauucgcagccguaccaccuaacuuuccaacagaaggacuaucuccaucucaaguaacaauguucccacauauuauuguagacguuagacaacuagaaccaguuuuaauuccccuaccagauguaagaaauaauuuuuaucacuauaaccaaucaaacgacucuacaauaaaauuaauugccaugcuuuauacuccucuacgagcaaacaaugcaggagacgauguauuuacaguauccugucgagucuuaacaagaccauccccagauuuugauuuuaucuuucuaguaccaccaacaguagaaucaagaacaaaaccauucucaguaccaguccuaacuguugaagaaaugacaaauucacgauucccaauuccacuagaaaaacucuuuacuggaccaucuucagcuuucgucguacaaccucaaaacgguagauguacaacagauggaguacuucuagguacaacucaauuaucaccagucaauauauguaccuuucgaggugacguaacucauaucuccggaucuagaaauuauacaaugaauuuagcaucacaaaacuggaauagcuaugauccaaccgaagaaaucccagcaccccuaggaacacccgauuuugucggaaaaauccaaggaguauuaacacaagccaccagaacuaacggauccacaagaggucauaaagccaccguauacacaggcuccgcagacuuuucaccuaaauuaggaagaguacaauucgcuacugauacagauaacgauuucgaaacaaaucaaaauacaaaauucacucccgucggaguaauacaagacggaagcacuacaccucgcaaugaaccacaacaauggguacuaccaucauauucaggacgcaacauacauaauguacaucuugcuccugcaguagcaccuacauuucccggagaacaauuauuauucuuuagaucuaccaugccaggcugcuccggauauccaaacauggauuuagacugcuuauuaccacaagaauggguacaauauuucuaucaagaagcagcaccagcacaaucagacguugcacuuuuaagauucguaaacccagauaccggcagaguauuauucgaaugcaaacuacauaaaucaggauacguaaccguagcacauacuggccaacaugauuuaguaaucccuccaaacggcuauuucagauuugauaguuggguaaaucaauucuacacucuagcuccaaugggaaauggaacaggacgaagacgauaa

SEQ ID NO: 34508 - RNA, 1617 nt, Artificial Sequence
  derived and/or modified sequence opt6 from VP1__Norovirus_and/or_Norovirus-like__KP096342
augaaaauggcuagcucagacgcaaauccuagugauggaucagcagcaaaucuaguaccagaaguaagcaaugaaguaauggcauuagaacccguaguaggagccgcaauagcagcaccagucgccggucaacaaaauguuauagaccccuggauacgaaauaacuuuguacaagcacccggcggcgaauuuacaguaucaccaagaaacgccccuggagaaauacuauggagugcuccucuaggacccgauuuaaaucccuaucuaucacacuuagcaagaauguauaauggcuacgccggcgguuucgaaguucaagucauuuuagcaggaaaugcauuuaccgcaggcaaaguuaucuucgcagccguuccucccaauuucccaacggaaggacuuucaccaucacaagucacaauguuuccacacauaguaguugacguacgucaacuagaaccuguccuaauuccacuaccagacguaagaaauaauuucuaucacuacaaccaaucaaaugauccaaccauaaaauuaauagcaaugcuauacacaccauuaagagcaaauaacgcaggagacgauguauuuacuguuucuuguagaguacuaacccgcccaucaccagacuucgauuucauauuuuuaguaccaccaacaguagaaucaagaacaaaaccauucucaguaccaguauuaacaguagaagaaaugacuaauucacgauuuccuauaccacuugaaaaacuauuuacaggaccaucaagcgcguucguaguacaaccacaaaauggcagauguacaacagacggcguacuacuaggaacuacacaauuaucaccaguaaacauaugcacauucagaggagacguaacacauauaacaggaucaagaaauuauacaaugaaccucgcuucucaaaacuggucuaacuaugacccaacagaagaaauaccugcaccacuaggaacaccagacuuuguuggaaaaauacaaggaaugcuaacccaaacaacucgaacugacggaaguacacguggacacaaagcaacuguauacaccggaucugcagauuuugcaccuaaauuaggaagaguccaauucgaaaccgacacagaucacgacuucgaagcaaaucaaaauacaaaauucacaccaguaggaguaauucaagacggaucaacaacucauagaaaugaaccucaacaauggguauuaccuucauauucuggaagaaauacaccaaauguacaucuugccccagccguagccccuacauuuccaggagaacaauuacuauucuuuagaucaaccaugcccggcuguucuggauauccaaauauggaucuagauugcuuacucccacaagaauggguucaauauuuuuaccaagaagcagcuccagcucaaucagacgucgcacuacuccgauucgucaacccugacacagguagaguauuauuugaauguaaauuacauaaaucugguuacguaacaguagcucauacaggacaacaugauuuagucaucccaccaaacggauauuucagauucgauucauggguaaaucaauuuuacacccuagcaccuauggguaacgguaccggaagaaaacgauaa

SEQ ID NO: 34509 - RNA, 1617 nt, Artificial Sequence
  derived and/or modified sequence opt6 from VP1__Norovirus_and/or_Norovirus-like__KM514067
augaaaauggcaucaucagacgcaaauccuagcgacggauccgcagcaaacuuaguaccugaaguaaacaaugaaguaauggcacuagaacccguaguaggcgcagcuaucgcagccccuguugcaggacaacaaaaugucauugacccauggauaagaaacaacuuuguacaagcuccaggaggcgaauuuacaguaucaccuagaaaugcaccuggagaaauauuauggucagcaccacuuggcccagauuuaaauccuuaccuaucacauuuagcaagaauguauaacggcuaugcaggaggauuugaaguacaagucauacuagcaggaaaugccuuuacugcaggaaaaguaauauucgcugcaguaccaccuaacuucccaacagaaggacuaucaccaucucaaguaacuauguucccccauauaguaguugauguaagacaacuagaacccguucuuauaccauuaccagacguccgaaacaacuucuaucauuacaaccaaucaaacgacccaacaauaaaacuaaucgcaaugcuuuacacaccauuacgagcaaacaaugcuggagacgauguauuuacaguaucaugcagaguacucacucgaccaucaccagauuuugauuuuauauuucuaguuccaccuacaguagaaucaagaacuaaaccauucuccguaccaguauuaacaguagaagaaaugaccaauucaagauuucccauaccacucgaaaaacuuuuuacuggaccgucaucagcauucguuguacaaccacaaaauggaagauguacaacagacggcguauuacuaggaacaacacaauuaucaccaguuaauauauguaccuucagaggagacguaacacacauaacagguuccagaaauuacacuaugaauuuagccucacaaaauugguccaauuaugacccuacagaagaaauaccagcuccacuaggaacaccagacuucguaggcaagauacaagguguucuuacccaaacaacccgaacugauggauccacucgaggacacaaagccacaguauauacaggaucugcagauuucgccccaaaguuagguagaguccaauuugaaacagauacagaucacgauuucgaagcaaaucaaaauacaaaauuuacaccaguagguguaauccaagacggaggaacuacacaucgaaaugaaccccaacaauggguacucccaucauacucagggagaaauacaccaaauguucaccuagcaccagcaguugcaccaacauuccccggagaacaauuacuauucuuuagaucuacaaugccaggauguucugguuauccuaauauggaucuagauugccuccuuccuccagaauggguacaauauuucuaucaagaagcagcuccugcacaauccgacguagcacucuuacgauucguuaacccugauacaggcagaguuuuauucgaaugcaaauuacacaaaucaggauacguuacaguagcacacaccggacaacacgaucuaguaauacccccuaauggauauuucagauuugauucauggguaaaucaauuuuacacuuuagcaccaaugggaaauggaacuggcagaagaagauaa

SEQ ID NO: 34510 - RNA, 1617 nt, Artificial Sequence
  derived and/or modified sequence opt6 from VP1__Norovirus_and/or_Norovirus-like__KF060049
augaaaauggcaucaucagacgcaaacccaucagacggaucaaccgcuaauuuaguuccagaaguuaauaaugaaguuauggcacuagaaccaguaguaggugcagcaaucgcagcaccaguagcaggacaacaaaacauaauagauccuuggauacgaaauaacuuuguacaagccccaggcggagaguucacagucucaccaagaaaugccccaggagaaauacuauggucagcaccccuagggccagacuuaaacccauauuuaucucaucuagcaagaauguauaauggauacgcuggcggauuugaaguccaaguaauucuugcagguaaugcauuuacagcaggaaaaauaauuuucgcugcuguaccaccaaauuuucccaccgaaggacuaaguccaucccaaguaacaauguuuccacacaucauaguugacguaagacaacuagaaccaguauuaaucccacuaccagauguaagaaauaauuucuaucauuauaaucaauccaaugauucuacaaucaaacuaauugcaauguuauacacaccauuaagagcaaauaacgcaggcgacgacgucuuuacaguaucauguagaguacuuacaagaccuucuccagauuuugacuuuaucuuccuaguuccaccaacaguugaauccagaacuaaaccauuuagugucccaguauuaaccguagaagaaaugacuaauucuagauuuccuauaccauuagaaaaauuauucacaggaccaucuucagcauucguuguacaaccccaaaauggacgauguacaacugauggaguacuucuaggaacaacucaacuuaguccaguaaacauaugcaccuucagaggagacguaacacauauaagugguucaagaaauuacacaaugaaucuagcuucccaaaacuggaacucuuacgacccaacugaagaaauaccagcaccacuaggaacaccagauuuuguaggaaaaauucaaggaguauuaacccaaacaacaagaacagacggauccacaagaggccacaaagcaacagucuauacaggauccgcagacuuuucucccaaacuaggacgaguacaauucgcaacagacacagacaaugauuuuguuacgaaucaaaacaccaaauuuacaccuguaggcguuauacaagauggaucaacaacaccacgaaacgaaccacaacaauggguacuaccuucguacaguggccgaaauacccacaacguucaucuagcuccugcaguagcaccaacauuuccaggagaacaauuacuuuucuuuagaagcaccaugccaggauguucaggauauccaaacauggauuuagauugccuacuaccacaagaauggguccaauauuucuaucaagaagcagcaccagcacaaucagaugucgccuuauuacgauuuguaaauccagacacaggacgagucuuauucgaauguaaauuacacaaaucuggauacguaacuguagcacacacuggacaacacgacuuaguaauuccacccaauggauauuucagauucgauaguugggucaaccaauucuacacucuagcaccaaugggcaauggaacuggaagaagaagauaa

SEQ ID NO: 34511 - RNA, 1617 nt, Artificial Sequence
  derived and/or modified sequence opt6 from VP1__Norovirus_and/or_Norovirus-like__KF059998
augaagauggcauccucagacgcaaacccaucagauggaucuacagcaaacuuaguaccagaaguaaacaaugaaguaauggcauuagaaccaguaguuggagcagcaauagcagcaccaguugcaggacaacaaaauguaauugaccccuggaucagaaauaacuuuguacaagcaccaggaggugaauuuacugucucuccuagaaaugccccuggugaaaucuuauggucugcaccgcuuggaccagaucuaaauccauauuuaucucaucuagcaagaauguauaacggcuaugcaggcggauuugaaguccaaguaauuuuagcugguaaugcauucacugcaggaaaaauaaucuucgcagcaguaccaccuaacuucccuacugaaggauuaucaccaucacaaguaacaauguucccacacauaaucguagauguacgacaauuagaacccguacuaauaccccuacccgauguacgaaacaauuuuuaccacuauaaccaaucuaaugacuccacuauaaaacuaauugcaaugcucuauacaccccuccgagcaaauaaugcaggagacgauguauuuacuguaucaugucgaguacuaacuagaccuucaccagauuuugacuucauauuuuuaguacccccaacaguagaaucaagaacgaaaccauucuccguaccaauauuaacuguagaagaaaugacuaacucuagauuuccaauaccacuugaaaaacucuuuacaggcccuucuucagcauucguaguacaaccccaaaacggacgaugcacuacagacggaguacuacuagguacaacacaacuaucaccaguaaacauaugcacauuucgaggagauguaacucauauaccaggaucacauaauuacacaaugaaucuagcuucacaaaacuggaacucuuaugaucccacugaagaaauaccagcaccacuagguacaccagauuuuguagguaaaauacaagguguauuaacccaaaccacgagugcaaacggaucaacuagaggacacaaagcaaccguuuacacugguucugccgacuuuucaccaaaauuaggcagaguucaauucgcuacagacacaaauaaugauuuugaaaccaaucaaaauacaaaauuuacuccuguaggaguaauucaagacggaaauacaacaccaagaaacgaaccacaacaauggguacucccaucauauuccggccgcaauauucauaacguucacuuggcacccgccguagcaccuacauucccaggagagcaacuacuauuuuuccguucaacaaugcccggaugcucaggauaccccaauauggaucuagauugcuuauuaccacaagaauggguacaauacuuuuaccaagaagcagcaccagcccaaucagacguugcccuacuaagauucguaaauccagauacaggccgcguacuuuucgaaugcaaacuucauaaaucagguuauguaacaguagcacauacaggacaacaugaccuugucauaccaccaaauggauacuucagauucgauucuugggucaaucaauuuuacacccuagcccccaugggaaauggaacagguagaagaagauaa

SEQ ID NO: 34512 - RNA, 1617 nt, Artificial Sequence
  derived and/or modified sequence opt6 from VP1__Norovirus_and/or_Norovirus-like__JX439833
augaaaauggccucaagugacgcuaauccaucugacggaaguaaagccaaccuuguuccagaagucaacaaugaagucauggcccuagaacccguagucggagcugcaaucgcugccccaguugcaggacaacaaaacguaauagaucccuggauaagaaauaacuuuguacaagccccuggaggugaauuuaccguaaguccucgaaaugcaccaggagaaauauuauggucugcaccauuaggcccagaucuaaaucccuauuuaucacaucuagcacgaauguacaacggauacgcaggaggauucgaaguucaaguaauacuagccggaaaugccuuuacagcaggaaaaauuauuuucgccgccguaccacccaacuuuccuaccgaaggucuaaguccaucacaaguuaccauguucccucauauuauaguugauguccgacaacucgaaccuguauuaauaccccuuccagacguaagaaacaacuuuuaucauuauaaccaaucaaaugacccaaccauaaaacuaauagcuaugcuauacacaccacuacgagcuaacaacgcaggagacgauguauuuacaguauccugucgaguacuaacacgaccaucaccagauuuugauuuuauuuucuuaguaccaccaacaguagaaucaagaaccaaaccuuucuccguuccaguacuuacaguagaagaaaugacaaacucaagauuuccaauccccuuagaaaaauuauuuaccgguccaucuucagcauucguaguccaaccacaaaacggcagauguacaacagacggaguauuauuaggcacaacacaacuaucaccaguaaauaucugcacauuuagaggagauguaacacauauaccuggaucccgaaacuacacaaugaaucuagcaucacaaaauuggaacucuuacgaucccaccgaagaaauaccugcaccacuaggaacaccagauuuuguaggaaaaauucaaggcguacuaacucaaacaacuagaacuaacggaucuacucgaggccacaaagcaacaguauacacagguucagcagacuuuagcccuaaauuaggaagaguacaauucgcaacagauacugacaacgauuuugaaacaaaucaaaauacaaaauucacaccaguaggcguaauacaagaugguaguacaacaccccgaaacgaaccacaacaauggguacuaccaaguuauuccggaagaaauauucacaacguucauuuagcccccgcuguagcaccaaccuuuccaggagaacaacuauuauuuuuccgauccaccaugccuggauguucaggcuauccaaauauggaccuagauugcuuacuuccacaagaauggguacaauacuuuuaccaagaagcagcuccagcacaaucagacguugcacuauuacguuucguuaacccagacacuggacgaguauuauuugaaugcaaacuacauaaaucuggauauguaacaguugcccacacaggacaacacgaccucguuauaccaccaaauggcuauuuuagauucgacucauggguaaaucaauucuauacucucgcaccaaugggaaauggaacaggaucaagacgcuaa

SEQ ID NO: 34513 - RNA, 1617 nt, Artificial Sequence
  derived and/or modified sequence opt6 from VP1__Norovirus_and/or_Norovirus-like__JQ613548
augaaaauggcuuccucagacgcaaacccaucugacggaagcacagcaaacuuaguaccagaaguaaacaacgaaguaauggccuuagaaccaguaguaggagcugcuauagcagcaccuguagccggacaacaaaauguaauugaucccuggauaagaaauaauuuuguacaagcacccggaggagaauuuacaguaaguccacguaaugcaccuggagaaauauuauggucagcaccacuaggaccagaucuaaacccauaccuaagccaccuugcacgaauguauaacgguuaugccggaggauucgaaguacaagucauucuagcuggaaacgccuuuacagcaggaaaaauaauauucgcugcaguaccaccaaauuucccaacugaagguuuaucaccaucacaaguaacaauguuuccacauauuauaguagauguaagacaacuagaaccuguacucauaccacucccagacguacgaaacaacuucuaucacuauaaucaauccaacgacucaacaauaaaauuaauagcuaugcuuuauacaccuuuaagagcaaauaacgcuggugacgaugucuuuacaguauccuguagaguucuaacaagaccaucacccgacuuugacuuuaucuuuuuagucccacccacaguagaaaguagaacuaaaccauucucaguaccuguacucacugucgaagaaaugacaaacucaagauuuccaaucccuuuagaaaaauuauuuacaggccccucaucugcauuuguaguucaaccgcaaaauggacgauguacuacagacggaguauuauuagguacuacucaacuauccccaguaaacauauguacauucagaggagacguaacacauaucuccgguucaagaaauuacacaaugaaccuugcuucccaaaauuggaacucauacgacccagccgaagaaauaccagcaccacuaggaacaccagauuuuguaggaaaaauucaaggaguacuuacacaaacaacacguacuaauggaucuacucgaggacauaaagcaacagucuauaccggauccgcagacuuuucaccuaaauuaggaagaguccaauuugcaacagacacagauaaugauuuugaaacaaaucagaauacaaaauucacaccagucggaguaauucaagacggaucaacaacaccacgaaaugaaccacaacaguggguuuuaccaucauauucgggaagaaauauucacaacguccauuuagcaccagcaguagcaccaacauuuccaggagaacaacuacuuuucuuuagauccacuaugcccggauguucaggauauccaaacauggaccuagauugcuuauuaccacaagaauggguacaauacuuuuaucaagaagccgccccagcacaaucugauguugcacuacuaagauuuguuaacccagacacaggucgaguuuuauucgaaugcaaacuacacaaaucaggcuauguaacaguagcacauaccggucaacacgacuuaguaauaccaccaaauggauauuucagauuugacucuuggguaaaucaauuuuacacauuagcaccaaugggaaauggaacagguagacgaagauaa

SEQ ID NO: 34514 - RNA, 1617 nt, Artificial Sequence
  derived and/or modified sequence opt6 from VP1__Norovirus_and/or_Norovirus-like__JN595867
augaaaauggccucuuccgacgcaaacccaucagauggaucaacugcuaaucuaguaccagaaguaaacaaugaaguaauggcauuagaacccguaguaggugccgcuaucgcagcaccaguagcaggucaacaaaacguaauagacccauggauaagaaacaacuucguccaagcaccaggcggcgaauuuaccguuucaccucgaaaugcaccuggugaaauauuauggucugcaccucucggaccagacuuaaauccauacuuaucacaccuagcacgaauguauaacggauacgcaggagguuucgaaguccaagucauuuuagcuggaaacgccuucacagcaggcaaaauaauuuucgcagcaguaccaccuaauuuuccaacagaaggacuaucacccucucaaguaacaauguuuccacacauuauaguagacguaagacaacucgaaccaguuuuaauuccauuacccgacguucguaauaauuucuaccacuauaaccaaucaaaugacccuacaauaaaauuaauagcaaugcuauacaccccacucagagccaauaaugcaggagacgauguauucacuguuuccugcagaguucuaacaagaccaucaccugacuuugauuuuauauuccuaguaccuccaacaguugaaucaagaacuaaaccauuuuccguaccuguauuaacaguugaagaaaugacaaauucaagauuuccuauaccacuagaaaaauuauucacaggaccaucaucagcauuuguaguacaaccacaaaacggaagauguacuacagauggaguuuuauuagguacaacacaacuaucaccuguaaauauauguaccuucagaggagacguaacacacauuccaggcucaagaaauuacacaaugaaucucgcaucacaaaacuggaacuccuaugauccaacugaagaaacacccgcaccauuaggaacacccgacuucguaggaaaaauacaaggagucuuaacacaaacaacucguaccaacgguuccacacgaggucacaaagcaacuguauacacuggcucagcugacuuuucaccaaaauuaggccgcguacaguuugcaaccgauacagacaacgauuuugaaacaaaucagaacacaaaauucacaccaguaggaguuauacaagacggaagcacaacaccacgcaaugaaccccaacaauggguauuaccaucauacucaggaagaaacauacacaacguucaucuugcaccagcaguugcaccaacauuuccaggagaacaacuauuauuuuuccguucuaccaugccaggaugcucaggauauccaaauauggauuuagauuguuuacucccccaagaauggguacaauauuuuuaucaagaagccgcaccagcacaaucugacguggcauuacucagauucguaaauccagauacaggacgaguauuauucgaauguaaacuacacaaauccgguuauguaacaguagcgcacaccggccaacacgaccuaguaauaccaccaaauggcuauuucagauuugauucaugggucaaucaauuuuauacauuagcuccaaugggaaauggaacuggccgcagacgauaa

SEQ ID NO: 34515 - RNA, 1617 nt, Artificial Sequence
  derived and/or modified sequence opt6 from VP1__Norovirus_and/or_Norovirus-like__AB629944
augaaaauggcaucuucagacgcuaacccaagcgacggaucaacagcaaacuuaguacccgaaguaaacaaugaagucauggcacuagaaccuguaguaggagcagcaauagcagcccccgucgccggccaacaaaauguaauugauccauggauacgaaacaauuucguacaagcaccaggaggagaauuuaccgucucaccacgaaaugcaccuggagaaauccuuuggucagcaccucuaggaccugaucuaaacccauauuuaucccaccuagcccgaauguacaauggauacgcaggaggauucgaaguacaaguaauucuagcaggaaacgcuuucacagcaggaaaaauaauauuugcagcaguucccccaaacuucccaacagaaggccuuucaccaucucaaguaacuauguucccacacauaauagucgacguccgucaauuagaaccaguauuaauaccauuaccagacguaagaaauaacuuuuaucacuauaaccaaucaaaugacccaacaauaaaauuaauagcaaugcucuauacaccauuaagagcaaacaaugcaggagacgaugucuuuacaguauccugcagagucuuaacucgccccucaccugacuuugauuuuaucuuuuuaguaccacccacagucgaaucaagaacaaaaccauucucaguacccguacucacaguagaagaaaugaccaacucaagauucccaauuccccuagaaaaauuauucacaggaccaucaucagccuucguaguacaaccccaaaacggaagaugcacaacugacggcguauuauuagguacaacucaauuaucaccaguaaacauauguacauuuagaggagacguaacacauaucucaggaucaagaaacuacaccaugaauuuagcuucacaaaauuggaacucauacgauccaacugaagaaauaccagcaccacuagguacacccgacuuuguaggaaaaauccaagguguauuaacucaaaccacucguacuaauggcucaacaagaggacacaaagcaaccguauauacaggaucugcagacuuuucaccuaaauuaggcagaguacaauuugcaacagauaccgauaaugauuucgaaacaaaucaaaauacaaaauucaccccagucggagucauccaagacgguucaacaacaccuagaaaugaaccucaacaauggguacuaccaucuuauagcggucgaaauacacacaacguucacuuagcacccgcaguugcaccaaccuuuccuggugaacaauuacuauucuuucgaucuacuaugccugguugcuccggauacccaaacauggacuuagacuguuugcuaccccaagaauggguacaauacuucuaucaagaagccgcaccagcacaaucugacguagccuuauuaagauuuguaaacccagacacuggacguguauuauuugaaugcaaacuacacaaaucauccuauguaacaguagcacacacuggccaacaugaucuaguaauaccaccaaacggcuauuuucgauucgauuccuggguaaaccaauucuacacacuagcaccaaugggcaauggaacuggcagaagacauuaa

SEQ ID NO: 34516 - RNA, 1617 nt, Artificial Sequence
  derived and/or modified sequence opt6 from VP1__Norovirus_and/or_Norovirus-like__AB541192
augaaaauggcaaguucagaugcaaauccaccagauggaucagcagcaaaucucguuccagaagucaacaaugagguuauggcauuagaaccaguaguaggagccgcuauagcagcaccugucgcaggacaacaaaacguaauugauccauggauaagaaauaauuuuguacaagccccaggaggagaguuuaccguaucaccaagaaaugcaccaggugaaauauuauggucugcaccauuaggaccggacuuaaaccccuacuuaucacacuuagcaagaauguacaacggauacgcuggaggauuugaaguacaaguaauacuagcaggaaacgcauuuaccgcaggaaaaauaauauuugcagcaguuccaccaaauuucccaacugaaggacuaucaccaucccaaguuacaauguucccacauaucauaguugacguaagacaauuagaaccaguacuaauaccacuucccgacgucagaaacaauuuuuaucauuauaaccaaucaaacgauagcacaauaaaauuaauagcaaugcuuuauacuccucuaagagcuaacaaugcaggcgaagauguauuuacaguaucauguagaguacuaacacgaccauccccagauuuugauuuuauauucuuaguuccaccaacaguagaaucaagaacaaaaccauuuacaguaccaauauuaacagucgaagaaaugacaaacucaagauuccccauuccacuugaaaaacuauuuacaggaccaucaggcgcuuucguaguccaaccacaaaacggaagaugcacaacagacggaguauuauuaggcacaacacaacuaucaccaguaaacauauguacauuuagaggagacgcuacacacauugccggaucacgauccuacacaaugaaucuagcaucauuaaacuggaacaauuacgauccaacagaagaaauaccugccccauuagguacaccggacuucguaggaaaaauacaaggaaugcuuacccaaacuacuaaaggagacggaaguacucgcggacacaaagccacaguuuauacagguucagcuccauuuacuccaaaauuagguuccguacaauucucaacagacacagaaaacgacuuccaaacacaucaaaauacuaaauuuaccccuguagguguuauacaagauggaagcacaacccauagaaaugaaccccaacaaugggucuuacccuccuacucagguagagauguacauaacguccaucuagccccugcaguagcaccaacauuuccaggugaacaauuacucuucuuuagaucaacuaugcccggaugcucuggauacccaaacauggacuuagacugcuuacuaccacaagaauggguacaacauuuuuaucaagaagcagcaccagcacaauccgauguagcauuauuaagauucguaaacccagauacaggacgaguacuauucgaauguaaacuccacaaaucuggauauguaacaguagcacacacuggacaacacgaucucguaaucccaccgaauggauauuucagauucgauuccuggguaaaucaauuuuacacauuagcaccaaugggcaaugguacaggucgccgacgauaa

SEQ ID NO: 34517 - RNA, 1617 nt, Artificial Sequence
  derived and/or modified sequence opt6 from VP1__Norovirus_and/or_Norovirus-like__AB504314
augaaaauggcuuccaaugaugcuucacccucugauggaucaaccgcaaacuuaguaccagaaguaaauaaugaaguaauggcuuuagaaccaguaguaggagcagcaauagcugcuccuguugccggacaacaaaaugucauagauccuuggauuagaaauaacuuuguccaagcacccggcggcgaauuuacaguaucaccccgcaacgcacccggagaaauacuauggucagcaccucucggcccagaucucaacccauaucuaucacaccuagccagaauguauaacggauaugcaggaggauucgaaguucaaguaauacucgcugguaaugcauuuacagcaggaaaaauuauauucgcugcaguacccccaaacuuuccaacagaaggccuaucccccucucaaguaacuauguucccacacauuauagucgacguaagacaacuagaaccuguacucauuccauuaccagauguacguaauaauuucuaccacuauaaccaaucaaacgacuccacuauaaaacuaauagcaaugcuauacacaccauuaagagcaaauaaugcuggugaugacguauuuacagucuccuguagaguauuaacaagaccuucaccugauuuugacuucauauuucuaguaccuccaacuguagaaucaagaaccaaaccauuuaccguacccauacugacaguagaagaaaugacaaacucuagauuuccaauccccuuagaaaaacucuucacugguccaucuucagcauucguuguacaaccucaaaauggaagauguacaacagacggaguauuacuuggaacuacacaacuauccccagucaauauaugcacauuucgaggagauguaacccacaucccagguaccagaacauaucgaaugaaccuagcaucacaaaauuggaacaacuacgauccaacagaagaaaucccagcaccauuagguacaccagacuuuguaggaagaauacaagguauguuaacacaaacaacaaaaggagaugguucaacaagaggacacaaagcaacuguaucaaccggaucaguagacuucacaccaaaacuaggaaguguacaauuugcaacugauacagauaacgacuuugaaacaggucaaaauacaagauuuacuccuguaggaguaauucaagacgguucuucugcucuaagaaaugaaccacaacaauggguccuaccagauuauuccggaagaacaguacauaauguacaucuagccccagcaguagcacuaacauuuccaggagaacaacuccuuuucuuuagaucaacaaugccaggaugcucaggcuauccuaauauggauuuagauuguuuauuaccucaagaauggguucaacauuuuuaucaagaagcagcaccaucacaaucugacguagcauuacuuagauucguaaacccagacacaggacgaguauuauuugaaugcaaacuacauagagcaggcuacgucacuguagcccacacaggacaacaugaccuagucauaccaccgaauggauauuuuagauuugauagcuggguaaaucaauuuuauacacuagcuccaaugggcaauggagccggacgacguagauaa

SEQ ID NO: 34518 - RNA, 1617 nt, Artificial Sequence
  derived and/or modified sequence opt6 from VP1__Norovirus_and/or_Norovirus-like__KX514350
augaaaauggcuucaaaugaugcaaauccaucagacggaucagcagcuaaucuaguaccagaaguaaauaaugaagucauggcacuagaacccguaguaggagcagcaauagcagcaccaguagcaggucaacaaaauguaaucgacccauggauacgcaauaauuucguacaagcuccuggcggagaauuuacaguaucuccaagaaaugcaccaggagaaauauuauggagugcaccccuaggaccagaucuaaauccauaucuaucucauuuagcaagaauguauaauggcuacgcaggagguuucgaaguacaaguaauucuagccggaaaugcauucacugcaggaaaaauaauauuugcagcaguaccaccaaauuucccuacagaaggacuaagucccucucaagucacaauguuuccacauauuauaguagacguacgacaacuagaaccuguacucauucccuuaccagacguacguaauaacuuuuaucauuauaaucaaucaaaugauucaacaauaaaauuaauagcaaugcuauauacaccacuaagagcuaauaaugcaggagacgauguauuuacuguaucaugcagaguauuaacuagacccucaccagacuucgauuucauuuuccuaguuccaccaacagucgaaagucgaucuaaaccguucuccguaccugucuuaaccguagaagaaaugacuaauucaagauucccagcaacucuugauaaacucuucaccggcccuucaucaaccuuugucguacaaccacaaaauggaagaugcaugauagauggcguacuacuagguacaacucaacucucgccaguaaauauauguacuuuuagaggugauguaacucaaucaggaaauacaaaaauauacacaaugaauuuagcaucuccuaauuggaauaauuaugauccuacagaagaaauacccgcucccuuaggaacuccagacuuuguagguaaaauacaaggaaugcuaacacaaaccacuaaaggagaaggaagcaccagaggacauagagcaacagucuauguaggaucagcaaauuacgcaccaaaacucggacgaguacaauucgaaacagauacuacagaugaccuagacgcacaucaaaauacaaaauuuacuccaguuggaguaguacaaucuggagaaaguccaaaagguuccgaaccacaacaauggguacuccccucauauucuggaagagauacuccaaacguacaccuagcaccagcaguagccccaacauucccaggugaacaacuacuuuucuuucgaucaacaauaccaggcugugguggacauccuaacaugaaccuugacuguuuacuaccucaagaauggguacaacacuuuuaucaagaagccgcaccagcacaaucagauguagcacuauuaagauuuguaaauccagauacaucacgcguauuauuugaauguaaauuacacaaaucagguuacguuaccguagcucacacaggacaacaugauuuaguaaucccucccaaugguuacuuuagauucgacucuuggguaaaccaauucuauacauuagcacccaugggaaauggaacaggaagaaaaagauga

SEQ ID NO: 34519 - RNA, 1617 nt, Artificial Sequence
  derived and/or modified sequence opt6 from VP1__Norovirus_and/or_Norovirus-like__KX514342
augaaaauggcuucaaaugaugccaauccauccgaugguuccgcagcuaaucuuguaccagaaguaaauaacgaaguaauggcauuagaaccaguuguaggugcugcaauagcagcuccaguagcaggucaacaaaauguuauugacccauggauaagaaauaacuuuguacaagccccgggaggugaauuuacuguuucaccuagaaacgcacccggagagauacuauggucagcaccauuaggaccagaccuaaauccauauuuaucacauuuagcaagaauguauaacgguuacgcaggaggauuugaaguacaaguaauacuagcaggaaacgcauuuacagcaggaaaaauaaucuucgcagccguucccccaaacuuucccacagaaggacuuucaccaucacaaguaacaauguuuccccacauaauuguugacguaagacaauuagaaccaguacuaauuccacuuccagacguaagaaacaauuucuaccauuauaaucaaucaaacgacucuacuauaaaauuaauagcuauguuauauacaccacuaagagcaaacaaugcaggagaugacguauuuacuguaucauguagaguacuaacaagaccaucuccagauuuugacuuuauauuucuaguaccuccaacuguugaaucacguaguaaaccauuuucaguaccaguuuuaacaguagaagaaaugacaaacaguagauuuccugcaacauuagauaaauuauuuacaggaccaucauccacuuuuguuguucaaccacaaaacggacgaugcaugauagacggaguacuuuuaggaacuacacaacuauccccagucaauauauguacauuccgaggagauguaacacaaucaggaaacaccaaaauuuauaccaugaauuuagccaguccaaacuggaacaauuaugacccaacugaagaaauaccagcaccacuagguaccccagacuucguaggaaaaauacaaggaauguuaacacaaacaacuaaaggugaaggaucaacaagaggacaucgugcaacaguauaugugggauccgcaaauuacgcaccaaaauuaggcagaguccaauuugaaacugauacaacugacgaccuagacgcacaucaaaauaccaaauucacaccuguuggaguaguacaauccggcgaaucacccaaaggaucagaaccacaacaauggguacuaccuucauauucaggucgugauacaccuaauguucacuuagcaccagcaguugcaccaacauuuccaggagaacaauuacuuuucuuuagaucaaccauacccgguugcgguggacacccaaauauggauuuagauugucucuuaccacaagaauggguacaacacuuuuaucaagaagcagcuccagcccaauccgauguagcguuacuaagguucguuaacccagacacaucaagaguacuauucgaauguaaauuacauaaaaguggauauguaacaguagcacacacaggucaacaugaucuaguaauaccaccuaauggauacuucagauuugauucaugggucaaucaauucuauacauuagcaccaauggguaacggaacuggacgaaaaagauaa

SEQ ID NO: 34520 - RNA, 1617 nt, Artificial Sequence
  derived and/or modified sequence opt6 from VP1__Norovirus_and/or_Norovirus-like__KX514280
augaaaauggcaucaaaugacgcuaaccccucagauggaucaacagcaaacuuaguaccagaggucaacaaugaaguaauggcuuuagaaccaguaguaggagccgcaauagcugccccaguagcaggccaacaaaaugucauagauccauggauacgaaacaacuuuguacaagcacccggcggugaauuuacuguaucaccucgaaaugcaccaggagaaauacucuggucagcaccccuagguccagauuuaaacccuuaccuaucacaccucgcuagaauguacaacggauaugcuggcggauucgaaguacaaguaauacuugcaggaaaugcuuucacugccggaaaaauaauauuugcugcaguuccaccaaauuuuccaacugaaggucuaucaccaucacaaguuacuauguucccacauauuauaguagauguaagacaacucgaaccaguacuaauaccacuaccagacguacgcaauaauuuuuaucacuauaaccaaucaaaagauuccacaauaaaauuaauagcaaugcuauauacuccauuaagagccaauaaugccggagaugauguauuuacuguaucaugcagaguacuaacaagaccaucacccgauuuugauuucauauuuuuaguuccaccaacaguagaaaguagaucaaaaccauuuuccguaccuguacuuacuguugaagaaaugaccaauucucgauuuccaguaacacuugacaaacuauuuacaggaccaaguucaaccauaguaguacaaccacaaaaugguagauguacaauugacggaguccuguuaggaacaacacaacuaucaccaguaaacaucuguacauuuagaggagacguuacucacccaagggacaguacaauauauacaaugaacuuagcaucaccuaacuggaacacguacgaucccacugaagaaauaccagcuccacuaggaacuccugacuuuguaggaaaaauccaaggaauguuaacucaaacaaccaaaggagcuggaucuacccgaggacaccgagcaacaguauauguaggaucagcuaauuaugcaccaaaacuaggacgaguucaauuugaaacaaauacaagcgaugauuuagaugcucaccaaaauacaaaauuuacaccaguaggaguaauacaagggggagaauccgcacauagaagugaaccacaacaauggguucuaccaucuuacucagguagagauauuccaaauguacaccuagcaccagcaguagcacccacuuuuccuggagaacaauuauuauucuuuagaucaaccauuccagguuguggaggacaccccaacauggaucuagauuguuuacugccacaagaauggguacaacauuuuuaucaagaagcagcuccagcucaaucagauguagcccuauuaagauuuguaaauccagacacaucucgaguacuauucgaauguaaauuacauaagucaggauauguuacagucgcccacacaggucaacacgacuuaguaauaccaccaaacggauauuucagauuugauucauggguaaaucaauuuuauacacuagcaccaaugggaaauggcacuggaagaaaacgcuaa

SEQ ID NO: 34521 - RNA, 1617 nt, Artificial Sequence
  derived and/or modified sequence opt6 from VP1__Norovirus_and/or_Norovirus-like__LC177654
augaaaauggcauccuccgacgcaaauccaagcgauggaucaacagcaaauuuaguaccagaaguaaacaacgaaguaauggcacuugaaccaguaguaggugcagcaauugccgcuccaguagcuggacaacaaaacguaauagauccauggauaagaaauaacuuuguacaagcaccaggaggagaauuuaccguuucaccuagaaacgcaccuggagaaauauuauggagcgcaccacuaggaccagaucuaaauccauaucucagucaccuagcacgaauguauaauggauacgcugguggauucgaaguacaaguaauacucgcagguaacgcauuuacugcaggaaaaauaaucuucgcagcaguuccaccuaauuuuccaacugaaggacucucuccaucacaaguaacaauguucccacacauaauaguagacguaagacaauuagaaccaguacuaauaccccuuccugacguaagaaauaauuucuaucacuacaaucaaaguaaugauucaacuauaaaauuaauagcaauguuauacacccccuuacgagcaaacaacgcaggagaugauguauuuacaguaucaugccgcguauuaacuagaccuucaccagacuuugacuucauauuccuaguaccaccaacuguagaaucaagaacaaaaccauucucaguacccguccuaacaguugaagaaaugacaaacucaagauuuccuaucccucucgaaaaauuguuuacaggaccuuccucugcuuucguagugcaaccacaaaacggaagauguacaacagacgggguacuacuaggaacaacacaacuaagucccguuaauauauguacuuucagaggagauguaacucacauaccaggaucaagaaauuacacaaugaacuuagcaucacaaaauuggaacucauacgauccaacggaagaaaucccugcaccacuaggcaccccagacuuuguaggaaaaauacaaggcguauuaacacaaacaacacgcacaaauggaaguacacgaggacacaaagcaacuguauauacagguucagcagauuuuucaccaaaacuaggaagaguacaauucgcaacugauacagacaaugacuucgaaacaaaucaaaauaccaaauucacaccaguaggaguaauacaagacggaaguacaacuccuagaaaugaaccacaacaauggguauuacccucauauucaggaagaaacauacauaacguacauuuagcuccugcaguagcaccaacauucccaggagaacaauuacuauuuuucagaucaacaaugccaggauguuccggcuaucccaacauggaucuagauugccuacuaccacaagaauggguacaauauuucuaccaagaagcagcccccgcacaaucugacguagcauuauuaagauucguuaacccugacacaggaagaguauuauucgaauguaaacuacauaagucaggauauguaacgguagcacacacuggucaacaugaccuaguuauuccaccuaauggcuacuucagauucgauuccuggguaaaccaauucuauacacuagcuccaaugggaaauggcaccggacgcagaagauaa

SEQ ID NO: 34522 - RNA, 1617 nt, Artificial Sequence
  derived and/or modified sequence opt6 from VP1__Norovirus_and/or_Norovirus-like__KX354026
augaaaauggcuuccucagacgcaaauccaucagaugguucaacagccaaccuuguaccagaaguuaauaaugaaguuauggcccucgaaccaguagucggcgcagcuauagcagcaccuguagcaggacaacaaaauguaauagacccuuggauaagaaauaacuuuguacaagcaccuggaggugaauuuacaguauccccuagaaaugcuccaggagaaauauuauggucagcaccauuagguccagacuuaaauccauaucuaucacaucuagcaagaauguauaacggauacgcaggaggauucgaaguucaaguuauacuugcagguaaugcauuuacagcagguaaaauaauuuuugcugcaguucccccaaacuuccccacagaaggccucucaccaucccaaguaaccauguucccccauaucauaguagacguuagacaacuagaaccuguacuaaucccacuucccgauguacgaaacaauuucuaucacuacaaucaaucaaaugacuccaccauaaaacuaauagcaauguuauacacaccauuaagagcgaacaaugcuggugaugauguauuuaccguauccuguagaguauuaacaagaccaucaccagacuuugauuuuauauuccuuguuccuccaacuguagaaucaagaacaaaaccauuuucuguacccauauuaacaguagaagaaaugacaaauucuagauucccgaucccccucgaaaaauuauucacaggaccaucaucagcauucgucguucaaccccaaaauggaagaugcacuacugauggaguucuucuaggcacaacacaacuaucaccaguaaacauaugcacauuuagaggagacguaacacauauaccaggaucacacaauuacacuaugaauuuagcaucccaaaacuggaacuccuaugauccaacagaagaaauaccagcaccauuagguaccccugacuuuguuggaaaaauacaaggcguauuaacccaaacaacuagcaccaacggaucaaccagaggccauaaagcuacaguauacacaggaucagcagauuucuccccuaaacuaggcagaguacaauucgcaacagauacuaacaacgauuucgaaacaaaccaaaacacaaaauucacaccagucgguguaauccaagaugguucaaccacacccagaaacgaaccacaacaauggguacuuccuucauacucaggacgaaacauccauaacguucacuuagccccagcaguagcaccaacuuuuccaggagaacaauuacuauucuuuagaucaacaaugccaggaugcucuggauaccccaauauggauuuagauuguuuauuaccacaagaauggguucaauauuucuaucaagaagccgcaccagcacaaucugaugucgcacuauuacguuuuguuaacccagauacagguagaguccucuuugaaugcaaauuacacaaaagcggauauguaacaguagcucacacuggacaacaugaucuaguaauaccacccaauggauacuuucguuucgauucauggguuaaccaauuuuacacucucgcaccaaugggaaauggaacaggucgaagacguuaa

SEQ ID NO: 34523 - RNA, 1617 nt, Artificial Sequence
  derived and/or modified sequence opt6 from VP1__Norovirus_and/or_Norovirus-like__KR904218
augaaaauggcaucaucagacgcaaacccuucagauggauccacagcaaacuuaguacccgaaguaaacaaugaaguaauggcacuagaaccaguaguuggugcagcaauagcagcuccaguagcuggacaacaaaacguuauagacccauggauacgaaacaauuucguacaagcaccagguggagaauuuacaguauccccaagaaacgcaccaggagaaaucuuauggagugccccauuagguccagauuuaaaccccuauuuaucacauuuagcaagaauguacaauggauacgcaggaggauuugaaguccaaguaauacuugcaggaaaugcuuuuacugccggaaaaaucauauucgcagcaguaccaccaaauuucccuacagaaggguuaucaccaucucaaguaacaauguucccaaggauaauaguagauguaagacaacuugaaccaguuuugauuccacuaccagacguacgaaacaacuucuaucacuauaaucaaucaaacgacccaacaauaaaauuaauagcuauguuauauacaccuuuaagagcaaacaacgcuggugaugauguauuuacaguaucauguagaguauuaacaagaccaucaccagauuucgacuuuauauuccuaguuccaccuacagucgaaucaagaacaaaacccuuuucaguaccuauauuaacuguagaagaaaugacaaacagucgauucccaauacccuuagaaaaacuauuuacaggacccucaucagcauuuguuguucaaccacaaaauggaagauguucuacugauggaguuuuacucggaacaacacaacuaagucccguaaauauaugcacauuucgaggugacguaacccacauagcuggaucacauaacuacaccaugaaucucgcaucacaaaauuggagcucauacgacccaacggaagaaauaccagcaccacuuggaacaccagauuuuguaggaaaaauacaaggaguucuaacacaaaccacaagaacagacggaucaacacguggacauaaagcuaccguauacacaggcucagcagauuucucacccaaacuaggaagaguacaauucgcuacugauacuaacaacgacuuugaauccaaucaaaacaccaaauuugcaccuguagguguaauacaagacggugguacagcucauagaaacgaaccacaacaauggguacuaccaucauauucaggaagaaacauucauaacguacacuuagcaccagcaguugcaccaacauuuccaggagaacaauuauuauucuuuagaucaacaauaccugguuguucaggauauccaaacauggauuuagauugucucuuaccacaagaauggguacaauauuuuuaccaagaagcugccccagcucaauccgauguagcauuacucagauucguaaacccagacacaggacgcgucuuauuugaaugcaaauuacacaaaucaggcuaugucacaguagcacauacaggacaacacgaccucguaauuccaccaaacgguuauuuccgauuugacuccuggguuaaucaauuuuauacauuagcacccauggguaauggcacuggaagaagaagauaa

SEQ ID NO: 34524 - RNA, 1617 nt, Artificial Sequence
  derived and/or modified sequence opt6 from VP1__Norovirus_and/or_Norovirus-like__KJ678150
augaaaauggcaucuucagaugcaaauccuucugauggaucagcugcaaaccuaguaccagaaguuaauaaugaaguaauggcacuagaaccaguaguuggagcagcaaucgcugcaccuguugcaggacaacaaaauguaauugauccauggauacgcaacaauuuuguacaagcaccuggaggugaauuuacuguaucaccccgaaaugccccuggagaaauucuauggucagcaccuuuaggaccugacuuaaauccauacuuaucucauuuagcuagaauguauaauggauacgcaggagguuuugaaguacaggucauauuagcuggaaaugcauuuacagcagguaaaguaauuuucgcagcaguuccuccaaacuuuccaacagaaggacuaucuccaucacaaguaacaauguuuccacauauaguaguagauguacgacaacucgaaccaguuuuaaucccauuaccagacguaagaaauaacuuuuaccauuauaaucaaucaaaugacucuacaauaaaacuuauagcaaugcuuuacacaccuuuaagagcaaauaaugcaggagaugauguguuuacuguaucauguagaguauuaacacgaccuucaccagacuuugauuuuauuuucuuaguacccccaacaguagaaucuagaacuaaaccauuuucaguaccuguucuuacaguagaagaaaugacaaauaguagauuuccuacaccacuagaaaaauuauuuacaggacccucaucagcuuuuguaguucaaccacagaauggacgauguacuacagauggaguacuacucggcacaacacaacuaagcccuguuaauauauguacauuucgaggagaugucacccauauaacuggaucacggaauuauacaaugaaucuagcuucucaaaauuggucaaauuaugaccccacugaagaaauuccagccccauuagguacuccagauuuugucggaaaaauacaaggaguacuaacacaaacaacaagaacugaugguucaacacguggacauaaagcuacaguauauacuggauccgcugauuucgcucccaaauuaggaagaguacaauucgaaacugauacugaucaugauuucgaaacaaaucaaaacacuaaauuuacuccaguaggaguaauacaagacggcucaacaacucaucguaaugaaccccaacaauggguacuuccaucauauucaggacguaacacaccaaauguccaucuagcaccagcaguagcacccacauuuccuggagaacaacuuuuauucuuuagaucaacaaugccaggaugcaguggcuacccaaacauggauuuagacuguuuauuaccucaagaauggguacaguacuucuaucaagaagccgcuccggcacaaucagacguagcacuacuacgauucguuaauccagauacugguagaguauuauuugaaugcaaauuacauaaaucuggauacguaacaguagcucacacaggacaacaugauuuaguaauaccuccaaauggauauuuccgauucgauucuuggguuaaucaauuuuauacacuagcucccaugggaaauggcacuggacguagacgauaa

SEQ ID NO: 34525 - RNA, 1617 nt, Artificial Sequence
  derived and/or modified sequence opt6 from VP1__Norovirus_and/or_Norovirus-like__KJ678148
augaaaauggcuuccagugaugcaaacccaucagaugguucggcagccaaccuuguaccagaaguaaacaaugaagucauggcacuagaaccaguuguaggagccgccauagcagcaccuguugccggacaacaaaauguaauugacccuuggauaagaaacaauuucguucaagcuccaggaggagaauuuacaguuucaccuagaaacgcaccaggagaaauacuauggucagccccucuuggcccagaucuaaacccauaccuuucgcaccucgcccgaauguauaauggauacgcaggggguuuugaaguucaagucauacuagcaggaaaugcauucacagcaggaaaaguaauauucgcagcaguaccaccaaacuuuccaaccgaaggacuaucaccuucacaaguaacaauguucccgcacauagucguagauguucgccaacuugaaccaguuuuaauacccuuacccgauguaagaaacaauuucuaucauuauaaccaaucaaaugacucaacuauaaaauugauagcuauguuauacacuccacuucgagcaaacaacgcaggagacgaugucuucacaguauccugcagagucuuaacaagacccucaccagacuuugacuuuauauuuuuaguacccccuacagucgaaucuagaacaaaaccuuucucaguaccaguauugacaguagaagaaaugaccaauucacgauuccccacaccacuagaaaaacuauuuacuggaccaucaucagcauuuguaguucaaccacaaaacgguagauguaccacugacggagucuuacuaggaacaacacaacuaagcccuguaaauauaugcaccuuucgcggagacguuacacacauaacaggaucuagaaacuacaccaugaauuuagccagucaaaacuggucaaacuaugacccuacagaagaaauaccagcaccuuuaggaacaccagauuucgucgguaaaauacaaggagucuuaacacaaaccacaaggacagacggaucuacaagaggucauaaggccacaguauacacaggaucugcagauuuugccccaaaauuaggaagaguacaauuugaaacagauacugaucaugauuuugaaacaaaucaaaacacaaaauucacaccaguaggaguuauacaagacggaucaacaacacauagaaaugaaccacaacaaugggucuuaccuucuuauuccggaagaaauacaccuaacguacacuuagcucccgcaguagcacccacauuuccaggagaacaacuauuauucuuccgaucaacaaucccaggaugcagcggcuacccaaacauggaccuagauuguuuacucccucaagaauggguacaauauuuuuaucaagaagcagcaccagcacaaucagaugucgcauuacuaagauuuguaaaccccgauacaggaagaguauuauucgaauguaaacuacacaaaucuggauaugucaccguagcacacacaggacaacacgaucuaguaauaccaccaaauggauacuucagauucgauucaugggucaaucaauuuuacacacuagcuccaaugggaaaugguacaggacgucgacgauaa

SEQ ID NO: 34526 - RNA, 1617 nt, Artificial Sequence
  derived and/or modified sequence opt6 from VP1__Norovirus_and/or_Norovirus-like__KP244316
augaaaauggcaucaucugacgcaaacccaucugacggaucaaccgccaaucuaguuccugaaguaaauaacgaaguaauggccuuagaaccagucguaggagccgcaauagcugcaccuguagccggacaacaaaauguaauagacccauggauccgaucaaauuuuguacaagcaccaggaggagaauuuacaguuucuccaagaaaugcaccaggagaaauucuuuggucagcaccccuuggaccagaucucaacccuuaucuaucacaucuagccagaauguacaacggauaugcaggcggauucgaaguucaaguaauacuagcugguaaugcauuuacagcaggaaaaauaauuuucgcagcaguaccaccaaacuucccaacagaaggacuaucaccaucacaagucaccauguuuccucacauaaucguagacguuagacaauuagaaccaguacuaauaccauuaccagacguuagaaacaauuuuuaccacuauaaccaaucaaacgacccaacaauuaaauuaauugcaauguuauauacaccucuuagagcaaacaacgcuggcgacgacgucuuuacagucucaugccgcguacuaacaagacccucaccagacuuugacuucauauuccuaguuccuccaacagucgaaucacgaacaaaaccauuuucuguaccaguauuaacuguugaagaaaugacaaacuccagauucccaauuccuuuagaaaaacuauucacaggaccaucuucagcauuuguaguacaaccacaaaacggacgcugcaccacugacggaguccuucuaggaaccacccaacuaucaccuguaaauauauguacauuuagaggagacguaacccacauaaguggaagccgaaauuauacaaugaaucuagcaucacaaaacuggaacucauaugacccaacagaagaaauuccugccccucuuggaacuccugacuucguaggaaaaacacaaggagucuuaacacaaacaacaaaaacaaauggaaguacucguggacauaaagcaacagucuacaccggaucagcugacuucucaccaaaauuaggaagaguacaauucgcaacugauacagauaaugauuucgaaacaaaccaaaauacaaaauuuaccccaguugguguaauacaagacggaucaacaacaccucgagaugaaccccaacaauggguacuaccaucuuauucuggaagaaauacacauaacguucauuuagcuccagcaguagcacccacauuuccaggagaacaacucuuauucuuuagaucuacaaugccuggauguuccggcuacccaaacauggauuuagauagacuacuaccacaagaauggguucaauauuuuuaccaagaaccugcuccagcucaauccgacguagcacuauuacgauuuguaaaucccgacacaggaagaguauuauucgaauguaaacuacauaaaucaggauauguaacaguagcacacaccggacaacaugauuuaguaauaccaccuaaugguuacuuccgauucgacucauggguaaaucaauuuuauacauuagcacccaugggcaauggaacaggaagaagaagauaa

SEQ ID NO: 34527 - RNA, 1617 nt, Artificial Sequence
  derived and/or modified sequence opt6 from VP1__Norovirus_and/or_Norovirus-like__KF060072
augaaaauggcaucaucagacgcuaauccaucagaugguucagcagcaaacuuagucccagaaguaaauaaugaaguaauggcauuagaaccaguuguaggagccgcuaucgcagccccaguagcuggacaacaaaauguaauugaucccuggauuagaaacaacuucguacaagcaccaggaggagaauuuacaguuucaccccgaaacgcaccaggagaaauccuaugguccgccccuuuagguccagaucuaaacccauaccuaucacacuuagcaagaauguacaauggauaugccggaggauucgaaguacaaguaauacuagcaggaaaugccuuuacagcaggaaaaaucauauucgcugcaguaccacccaauuuuccaacagaagguuuaucaccaucacaaguaacaauguuuccacauauuauaguagauguuagacaacuugaacccguacuaauccccuuaccugauguaagaaauaauuucuaucacuauaaccaaucuaaugacucaacuauaaaacucaucgcaauguuauauacaccacuucgagcuaauaaugcaggagacgacguauuuaccguuucaugucgcguauuaacaagaccuucccccgacuucgacuucaucuuuuuaguaccaccaacaguagaaucaagaacaaaaccauuuuccgucccaguauuaacaguagaagaaaugacaaacucuagauuuccuauaccccuagaaaaacucuuuacagguccaucuucagcuuucguaguacaaccccaaaacggaagauguacuacagacggaguauuacuaggaacaacucaacuaagcccaguaaacauauguacuuucagaggugauguaacacauaucucaggaucacgaaauuacaccaugaaccuagcaucacaaaacuggaacucuuaugaucccacagaagaaauaccagcaccacuaggaacaccagacuucguaggaaaaauacaaggaguuuuaacacaaaccacaagaacagacggaucaacaagaggacacaaagcaacuguauauaccggcuccgcagacuuuagccccaaacuuggccgaguccaauucgcaacugauacagauaaugauuuuauaacaaaucaaaauacaaaauuuacacccguuggaguaauacaagacggcucuacaacacccagaaaugaaccacaacaauggguauuaccaucauauucaggaagaaauacccauaauguacauuuagcaccagccguugcaccaacauuuccaggagaacaauuauuauucuuucgcuccaccaugccuggaugcucuggcuaccccaauauggaucuagauugcuuauuaccacaagaauggguacaauauuucuaucaagaagcagccccagcacaaucugauguugcuuuacuaagauucguaaacccagacacaggccgcguauuauuugaaugcaaacuucauaaacccggauaugucacaguagcucauaccggacaacacgaucuaguuauaccaccuaauggcuauuuccgauucgauaguugggucaaccaauuuuacacucuagcccccaugggaaacgguacaggacguagaagauaa

SEQ ID NO: 34528 - RNA, 1617 nt, Artificial Sequence
  derived and/or modified sequence opt6 from VP1__Norovirus_and/or_Norovirus-like__JX439822
augaaaauggcauccucagacgcuaauccaucagauggauccacugcaaacuuaguaccagaaguaaacaaugaaguuauggcauuagaaccuguuguaggugccgcaauugcagcaccuguagcuggacaacaaaauguuauagauccauggauuagaaauaacuuuguacaagccccagguggugaauuuacuguaucaccuagaaaugcaccaggugaaauacuauggagugcaccacuaggaccagaucuaaauccauauuuaucacaccuagccagaauguauaauggauacgcaggaggauucgaaguacaaguaauauuagcaggaaaugcauuuacagcaggaaaaauaauauucgcugcaguaccuccuaacuucccaacagaaggucucucaccgucccaaguaacaauguuuccacacauaauaguagacguacgacaauuagaaccaguuuuaauaccacuacccgauguaagaaacaauuucuaucacuacaaccaaucuaacgacccaacuauaaaacuaauagcaaugcuauacacuccacuacgugcuaauaaugcaggagacgacguauucacaguauccugucgaguccucacucgcccaucaccugauuucgacuuuauauuucuaguuccaccuacaguagaauccagaacaaaaccauuuucaguuccaguuuuaaccguagaggaaaugacaaauucaagauuuccaauuccacuagaaaaacuauuuacagguccuucaucagcuuucguaguacaaccacaaaaugguagaugcaccacagacgggguauuacuuggaacaacacaauuauccccaguaaauauaugcacauuuagaggagacguuacacauaucccagguucuagaaauuauacaaugaaucuugcaucccaaaacuggaacucuuacgaucccacagaagaaaucccagcaccacuaggaaccccagacuuuguaggaaaaauacaaggaguacuaacucaaacuacacguacaaaugguucuacccgaggacacaaagcaacuguauauaccggaucagcagauuuuuccccaaaacuaggaagaguacaauucgcaacagacacagauaacgauuucgaaaccaaccaaaauaccaaauuuacaccaguaggaguaauucaggacggaucaacaacaccaagaaacgaaccucaacaauggguccuuccaaguuauucuggacguaauauacacaacguacaucuagccccugcaguugcaccuaccuuuccaggugagcaauuacuuuucuuccgaucaacaaugccaggaugcucaggcuauccaaauauggauuuagauugucuccuaccacaagaauggguacaauauuuuuaccaagaagcagcacccgcacaauccgauguugcccuacucagauuuguuaacccagacacaggacgaguucuguuugaaugcaaacuacacaaaucaggauauguaacuguugcucauacaggccaacacgaucuuguaauuccaccaaauggauauuuucgcuuugauuccuggguaaaucaguucuauacuuuagcaccuaugggaaaugguacaggcucaagacgauaa

SEQ ID NO: 34529 - RNA, 1617 nt, Artificial Sequence
  derived and/or modified sequence opt6 from VP1__Norovirus_and/or_Norovirus-like__KC463910
augaaaauggcaucaucugacgcaaacccaucugauggcaguacagcaaacuuaguaccagaaguaaauaaugaaguuauggcacuagaaccaguagucggagcagcaauugcagcacccguagcaggccaacaaaacguuauagacccuuggauaaggaacaacuuuguacaggcaccaggaggagaauuuacuguaucaccacgaaacgcaccaggagaaauauuauggucugcacccuuaggucccgauuuaaacccauaucuaucacauuuagccagaauguacaaugguuacgccggaggauucgaaguacaaguaauauuagcaggaaaugcauuuacagcuggaaaaauaauauuugcagcuguacccccaaauuucccaaccgaaggacuaucuccaucacaaguaacaauguuuccacacauaaucguagauguaagacaauuagaaccaguacuaauaccucuaccagacguaagaaacaacuuuuaucacuauaaucaaucaaaugacaguacaaucaaauuaauagcaaugcucuauacaccacuaagagcuaacaaugcaggagacgauguuuuuaccguuagcugucgaguuuuaacgagacccaguccagauuucgauuuuauauuccucguacccccaaccgucgaaucaagaacaaaaccauucucaguuccaauacuaaccgucgaagaaaugacaaacucuagauuuccaauacccuuagaaaaacuuuuuaccggaccaucaucagcauucguaguacaaccacaaaauggcagauguacaacugacggaguacuauuaggaacaacucaauuaaguccugucaauauaugcacauuuagaggugauguaacacacaucccaggcucacacaauuacaccaugaaccuagcaucacaaaauuggaacaguuacgauccaacagaagaaauuccagcuccccucggaaccccagacuuuguaggcaagauucaagguguacuaacacaaacaacaucaacaaacggaucaacaagaggacacaaagcaacaguauauacaggaucugcagacuuuucaccaaaacuaggacgcguacaauucucaacugauacaaacaacgauuuugaaacaaaucaaaauacuaaauucacaccaguuggcguuauacaagauggaucaacaacaccaagaaacgaaccucaacaauggguccuaccaucuuacaguggaagaaacauacauaauguacauuuagccccagcaguugccccuacauuucccggcgaacaauuauuauuuuucagaucaacuaugccaggaugcucaggauaucccaauauggauuuagacugucuauuaccucaagaauggguucaauauuucuaccaagaagcugcaccagcccaaucagauguagcccuacuaagauuugucaauccagauacaggcagaguauuauucgaaugcaaacuacauaaaucaggauacguaacaguagcccacacaggacaacaugacuuaguaauaccaccaaauggauauuuccgcuuugacucauggguuaaucaauuuuacacauuggcaccuaugggaaauggaacuggacgaagaagauaa

SEQ ID NO: 34530 - RNA, 1617 nt, Artificial Sequence
  derived and/or modified sequence opt6 from VP1__Norovirus_and/or_Norovirus-like__JX459651
augaaaauggcaucaucagacgccaauccuucagauggaucaaccgcaaaccuaguaccagaaguaaauaacgaaguaauggcacuagaaccaguuguaggagcagcaauagcagcaccugucgcuggucaacaaaacguaauagauccuuggauacgaaacaauuuuguccaagcgccuggaggagaauuuacaguauccccacgaaaugcuccaggugaaauauuauggagugcaccuuuaggaccagaccuaaauccauaccuuucccauuuagccagaauguauaauggauaugcaggaggauucgaaguacaaguuaucuuagcaggaaaugccuuuacagcagguaaaauaauauucgcagcaguaccaccaaacuuucccacagaaggacuaucuccaucccaaguaacaauguuuccacacauaauuguagauguaagacaauuagaaccaguacuaauuccacucccagauguaagaaauaacuuuuaucacuacaaucaauccaaugacccaacaauaaaauuaaucgcaaugcuauauacaccauuacgugcaaacaaugccggagacgaugucuucacaguaucaugucgaguuuuaacaagaccaucaccagacuuugauuucauauuuuuaguuccaccaaccguagaaucaagaacaaaaccauucagcguaccuguucuuaccguugaagaaaugacaaacucaagauuuagcauaccauuagaaaaauuauuuacaggaccaucuuccgcauuuguaguacaaccacaaaauggucgauguacuacagacgguguacuauuaggaaccacccaacuaaguccaguaaauauauguacauuucgaggcgauguaacucauauccccgguuccagaaacuacacaaugaacuuagcaucacaaaacuggaacucauaugacccaacagaggaaauccccgcaccauuaggaaccccagacuuuguaggaaaaauccaagguguacuaacacaaacaacacgaacaaacgguucaacaagaggacacaaagcuacuguauauacaggauccgccgacuuuucaccaaaauuaggacgaguacaauucgcaacugauacagauaaugauuucgaaaccaaccaaaauacuaaauucaccccaguagguguaauacaagaugguucaacuacaccacgaaaugaaccacaacaauggguacuuccauccuauucaggcagaaauauacauaacguccaccucgcaccagcaguagcaccaacauucccaggagaacaacuccuauucuuuagaucaacaaugcccggaugcucagguuauccuaauauggaucuagacugccuccuaccacaagaauggguacaauacuuuuaccaagaagcagcaccagcacaaucagacguugcacucuuaagguuuguaaacccugacacaggccgaguccuauucgaauguaaacuacacaaaucaggauauguaacagucgcacacacaggccaacacgauuuaguuauaccaccaaacggcuauuuucgauucgacagcuggguaaaucaauuuuauacacucgccccaaugggaaauggaacgggacggagaagauaa

SEQ ID NO: 34531 - RNA, 1617 nt, Artificial Sequence
  derived and/or modified sequence opt6 from VP1__Norovirus_and/or_Norovirus-like__AB541314
augaaaauggcaucauccgaugcuaauccaucugacggcuccgcagcuaaccuugucccugaaguaaacaacgaaguaauggcuuuagaaccaguaguaggagccgcaauagcagcaccagucgcaggacaacaaaauguaauagauccuuggauaagaaauaauuucguacaagcacccgguggugaauuuacaguaucuccaagaaaugcacccggagaaauacuauggagugcaccucuagguccagaucuaaauccauaucuaucacacuuagcacgcauguauaauggauacgccgguggcuucgaaguacaaguaauacuugcaggcaaugcauucacagcaggcaaaaucaucuuugcagcaguacccccaaacuuuccaacugagggacuaucacccucacaaguaacuauguucccacacauaauaguagacguacgccaauuagaaccaguucuaauacccuuaccagacgucagaaacaauuucuaucacuauaaccaaaguaaugacucuaccauaaaacuaaucgcaaugcuauacacaccacuaagagcaaacaaugcaggagaaguugucuuuacaguaucuuguagaguucuuaccagaccuucaccagacuucgacuuuaucuguuuaguaccaccaacaguagaaucuagaacaaaaccuuucacuguaccaauauuaacaguggaagaaaugacuaacucaagauucccaauaccuuuagaaaaauuauuuacaggaccuaguucagccuucguaguccaaccgcaaaacggaagauguacaacagacggagucuuacucggaacaacccaauuaucaccaguuaacauauguaccuucagaggagacgucacacacaucgccggaucccgaaacuauacaaugaaccuagcaucacuuaacuggaauaauuaugauccaacagaagaaauaccagcaccauuaggaacaccugauuucguagguaaaauacaaggaguacuaacacaaacaacaaaaggagauggaucaacaagaggucauaaagcuacuguauauaccggcucagcaccauuuacaccaaaacuaggaaguguucaauucucaacagacacugaaaacgauuucgaaacacaccaaaauacaaaauuuacuccagucggcguuauacaagaugguggaacaacacauagaaacgaaccacaacaauggguucuaccaaguuauucagguagaaauguuccaaauguacaucuagcuccugcaguagcaccaacauuuccaggagaacaauuauuauucuuuagaucaacaaugccaggaugcucaggauauccaaauauggaucuagacuguuuauuaccucaagaauggguacaacauuuuuaucaagaagcagcaccagcacaaucagauguagcgcuacuaagauuuguuaacccugacaccggaagaguauuauuugaaugcaaauuacauaaaccuggauauguaacaguagcccacacuggacaacaugauuuaguaaucccaucaaauggauacuucagauuugauagcuggguaaaccaauucuauacauuagcaccaaugggcaaugguacaggacgcagaagauaa

SEQ ID NO: 34532 - RNA, 1617 nt, Artificial Sequence
  derived and/or modified sequence opt6 from VP1__Norovirus_and/or_Norovirus-like__AB504323
augaaaauggcaucaucagacgcaaauccuagcgacgguucagccgcaaauuuagucccugaaguuaauaacgaaguuauggcauuagaaccaguaguaggugcugcaauagcugcaccaguagcaggucaacagaaugugauagauccauggauaagaaacaauuucguacaagcaccuggaggagaauuuacuguaucacccagaaaugccccaggagaaaucuuauggucagcaccacucggaccugaucucaacccauaucuuucucaccuagccagaauguauaacggauacgcuggaggauuugaaguacaaguaauauuagcuggaaaugcuuucacugcaggaaaaauaauauuugcugcaguuccaccuaauuuuccuacagaaggauuaagcccaucucaaguaacaauguucccucauauaauaauagauguaagacaacuugaaccaguucuaauuccauuaccagaugucagaaacaauuuuuaccacuauaaccagucuaaugauucuacaauaaaauuaaucgcaaugcucuacacaccauuacgagcaaacaaugcaggagaagacguauuuacaguaagcugcagaguacuaacaagacccucauuagauuucgauuucauauucuuaguaccaccaacaguugaaucaagaacaaaacccuuuaccgucccaauauuaaccguagaagaaaugacuaauucaagauuuccaauaccauuagaaaaauuauuuacaggaccaucaggagcauucguaguacaaccacaaaacggacgcuguacaacugauggaguccuuuuaggaacaacacaauuaucaccagucaauauauguacauuaagaggugacguaacacauauagccggaucuagaaacuacacaaugaaucuagcaucauuaaacuggaauaauuaugauccaacagaagaaauuccagcaccacucggaaccccagauuuuguaggaaaaauacaaggugucuuaacacaaacaacaaaaggagaugguagcacacgaggucauaaagcaacaguuuauacugguucagcaccauucacuccaaaacuuggaucuguacaauucucuacagauaccgaaaaugacuuugaaacccaccaaaauacuaaauuuacuccaguuggcguaauacaagauggcucaacaacacaucgaaaugaaccacaacaauggguauuaccuuccuauucaggaagaaacguucauaacguacauuuagccccagccguugccccaacauuuccaggagaacaacuacuauucuuucguuccaccaugccaggaugcagcggauauccaaacauggaucuagacugcuuacucccucaagaauggguccaacauuucuaucaagaagcagcucccgcacaaucagacguagccuuauuaagauucguaaacccagauaccggccgcguacuauucgaaugcaaauuacauaaaucaggauauguaaccguagcccacacaggccaacaugaucuagucauaccacccaauggauauuuucgauuugacucauggguaaaccaauuuuacacauuagcacccaugggaaaugguacaggacgacgcagauga

SEQ ID NO: 34533 - RNA, 1617 nt, Artificial Sequence
  derived and/or modified sequence opt6 from VP1__Norovirus_and/or_Norovirus-like__KX353963
augaaaauggccucaucugaugccaacccuucagauggaucuacagcuaacuuaguaccagaagucaauaaugaaguaauggcguuagaaccagucguaggagcagcaauagcugcaccaguagcuggacaacaaaauguaauagauccuuggauuagaaauaauuuuguacaagcaccaggcggagaauuuacaguaucuccacgaaaugcaccaggagaaauauuauggucagcaccacuaggaccagaucuaaauccauaucuaucacacuuagccagaauguacaauggauaugcaggaggauuugaaguucaaguuauacuagcuggaaaugcuuuuaccgcaggaaaaauaaucuucgcagcaguaccaccaaauuuuccaacugaaggacuaucaccaagccagguaaccauguuuccucauauaauaguagauguaagacaacuagaacccguacuaauaccuuuaccagacguaagaaauaauuuuuaucauuacaaccaaucaaaugacuccacaauaaaauuaaucgcaaugcuauauacuccacuaagagcuaacaacgcuggagacgacguauuuaccguuucaugucgaguacuaaccagacccagcccagacuuugauuuuauauuucuaguaccacccacagucgaauccagaacaaaacccuucucaguaccaguacuaacaguagaagaaaugacaaauucacgauuuccaauaccauuagaaaaauuauuuacaggaccaaguucagcauucguaguacaaccccaaaacggacgaugcacaaccgacggaguacuccuaggaacaacucaauuaaguccaguaaauaucuguacauucagaggcgacguaacucauauaccgggcucaagaaacuacacaaugaaccuagcaucucaaaacuggaacucauaugauccuacagaagaaauaccugccccauuaggaacaccagacuuuguaggaaaaauacaagguguauuaacccaaacaacaagaacaaauggaagcacaagaggucauaaagcgacaguuuacacaggaucagcagauuuuuccccuaaauuaggaagaguacaauuugcaaccgauaccgauaacgacuucgaaacaaaccaagauacaaaauuuaccccaguaggaguaauacaagacgguucuacaacaccaagaaaugaaccacaacaguggguacucccauccuauucaggacgaaauauacauaacguccaucucgcaccagcaguagcaccaacauuuccaggagaacaacuacuauucuuuagaucuacuaugcccggauguuccggcuauccaaauauggacuuagauugccuauuaccccaagaauggguccaauauuuuuaucaagaggcagcaccagcccaaucagauguagcacuucuaagauucguaaacccagauacuggaagagucuuauucgaaugcaaauuacacaaauccggauauguaacaguagcccacacuggacaacacgaucuaguuauaccacccaauggcuauuuuagauuugauucuuggguaaaucaauuuuacaccuuagcuccaauggguaaugguacaggaagaagaagauaa

SEQ ID NO: 34534 - RNA, 1617 nt, Artificial Sequence
  derived and/or modified sequence opt6 from VP1__Norovirus_and/or_Norovirus-like__KR904213
augaaaauggccucuuccgacgccaaccccucagacgguucuacagcaaaccuuguacccgaaguaaacaaugaaguaauggcccucgaaccaguagucggugccgcaauagcagcuccagucgcaggacaacaaaauguaauugauccauggauaagaaauaauuuuguacaagcaccaggaggcgaauuuacaguaucaccuagaaacgcaccaggagaaaucuuauggucagcuccacuagguccagaucucaauccauauuuaucacaccucgcaagaauguacaauggauacgcaggaggauucgaaguacaaguaauucuagcuggaaaugcauucacagcagguaaaauaauuuuugcagcaguuccuccaaacuuuccaacagaagguuuauccccaucacaaguaacaauguuuccacauauaauaguugacguaagacaacuagaacccguacuaauaccacuaccagacguaagaaacaauuucuaucacuauaaucaaucaaaugacuccaccauaaaauuaauagcaauguuauauacaccacuaagagcuaauaaugcaggcgacgacguauuuacaguaucauguagaguucuaacaagaccaucaccugacuuugauuuuaucuuucuaguaccaccuacuguggaaucaagaaccaaaccauucucaguacccgucuuaacuguagaagaaaugacaaacucccgcuuuccaauuccacuagaaaaacuauuuacuggaccaucuucagcauucgucguccaaccacaaaacggaagaugcacaacagauggaguacuacuagguacaacucaauuaucaccagucaauauuuguacauuucgaggcgacguaacacauauaccaggaucaagaaacuacacaaugaaucuugcaucacaaaacuggaacucauacgacccaacagaagaaauaccugcaccacuugguacaccagacuuuguuggaaaaauacaaggaguauuaacacaaacaacaagaacuaacggaucaacacgcggucauaaagcaacuguauauacuggaucugcagauuuuagcccuaaacuuggcagaguucaauuugcaacagacacagacaaugauuucgaaaccaaucaaaauacuaaauucacuccaguaggaguaauacaagacggaucaacaaccccaagaaacgaaccacaacaauggguauuaccuucauauucaggacgaaauauacauaacguacaccuugcaccagcagucgcaccaacauuuccaggagaacaacuauuauuuuucagaucaacaaugcccggaugcagcggauauccuaauauggaucuagauugcuuacucccacaagaauggguccaauauuucuaucaagaagcagccccagcccaaucagauguagcacuauuaagauucgucaacccagacaccggaagaguauuauucgaauguaaauuacauaaauccggauauguaacugucgcccacacaggacaacacgaccuaguaauaccaccaaauggauauuucagauuugauucauggguaaaucaauuuuucucccuagccccaaugggaaacggaacuggaagaagaagauaa

SEQ ID NO: 34535 - RNA, 1617 nt, Artificial Sequence
  derived and/or modified sequence opt6 from VP1__Norovirus_and/or_Norovirus-like__AB933745
augaaaauggcaucaaaccauguuaauccaucagauggcaguacagcaaaucuaguucccgaaguaaauaacgaaguaauggcauuagaacccguagucggcgcagcaauagcagcaccaguugcuggacaacaaaauguaauugauccauggaucagaaauaacuuuguccaagcaccuggcggagaauuuacaguaagcccacgaaaugccccaggagaaaucuuauggucugcaccauuagggccagacuuaaacccauaucucucacaccuugcaagaauguauaauggcuaugccgguggauucgaaguacaaguaauacuagcaggaaaugcuuuuacagcgggaaaaauaauauucgcagcaguuccuccaaauuuuccaaccgaaggacuauccccuucacaagucacaauguuuccucacaucauaguagacgucagacaacuagaacccguucucauuccauuaccagacguaagaaacaauuuuuaucacuauaaccaaucaaacgacccaacaauaaaauuaauagcaauguuauacacaccucuacgugcaaacaacgccggagaugacguauuuacaguaaguugucgaguucuaacacgaccuaguccugacuuugacuuuauauuucuaguaccucccacaguagaaucuagaacuaaaccauuuucaguaccaguauuaacaguagaagaaaugacaaauucuagauuuccaauaccacuugaaaaacuuuuuacaggaccaucauccgcuuucguaguacaaccacaaaacggacgauguacaacugauggaguacuucuaggaacaacucaauuauccccuguaaauauauguaccuuccgaggagacguaacccacauaccaggaucaagaaacuacacaaugaaucuugcaucacaaaacuggaacucauacgaucccacagaagaaauaccagcaccacuaggaaccccagacuucguugguaaaauacaaggaguuuuaacacaaacaacuagaacaaauggauccacaagaggacacaaagcaacaguauauaccggaagcgcagacuuuuccccaaaauuaggaagaguacaauucgcaaccgauacagauaaugauuucgaaacaaaucaaaauacaaaauucaccccaguaggaguaauacaagauggcuccacuacaccaagaaaugaaccucaacaauggguacuaccaucauacucaggaagaaauauucauaacguccaccuagcacccgcagucgcacccacuuucccuggugaacaauuacuauuuuucagaucaauaaugcccgguugcuccggauauccaaauauggaucuagauugucuccuaccacaagaauggguacaauauuuuuaccaagaagcugcaccagcucaaucugauguugcauuacuaagauuuguaaauccugauacaggucgaguauuauucgaaugcaaacuucauaaauccggauacguaaccguugcacauacuggacaacacgauuuaguuaucccuccuaaugguuauuucagauuugacaguuggguuaaccaauuuuacacacuagcacccaugggaaauggaacaggacgucgaagauaa

SEQ ID NO: 34536 - RNA, 1617 nt, Artificial Sequence
  derived and/or modified sequence opt6 from VP1__Norovirus_and/or_Norovirus-like__KP096341
augaaaauggcguccucagacgccaauccaucagacgguucugcagcaaacuuaguaccugaagucaauaaugaaguaauggcacuagaaccaguaguaggagccgcaauugccgcaccaguagcuggccaacaaaacguaauagauccauggauaagaaauaacuuuguacaagcuccaggaggagaauuuacaguaucuccaagaaacgcuccaggagaaauauuauggagcgcaccacuagguccugaucuaaacccauaucuaucccauuuagcacgaauguauaauggauacgcuggaggauucgaaguacaaguaauucuagcaggaaacgcauuuacagcuggaaaaguaauauucgcagcaguaccaccaaacuuuccaacagaaggacuaaguccuucacaaguaacaauguuuccacacauuguuguagacguaagacaauuagaaccuguauuaauaccuuuaccagauguaagaaauaacuucuaucacuacaaccaaucaaaugauccaacgauaaaacuaauagcaauguuauacacuccacuaagagcaaacaacgcuggugacgauguuuuuacaguaucauguaggguauuaacaagacccuccccagacuuugauuuuauauuuuuaguaccaccaacaguagaaucacgcacaaaaccauucagcguccccguacuuacuguagaagaaaugacaaauucaagauucccaauaccacuagaaaaauuauuuacagguccaucaucagcauuuguaguucaaccucaaaauggaagaugcacaacagauggugucuuauuaggaacuacacaauuaaguccaguaaacaucuguacauuuagaggcgauguaacacauauaacaggcucucgaaauuauacaaugaaccucgcaucacaaaacuggucuaacuacgaucccacagaagaaauuccugcaccacuagguacaccagauuucguaggcaaaauacaagguauguuaacccaaacaacuagaacagacggcucaaccagaggacauaaagcaacaguauacaucggaggugcugauuucgcaccaaaacuaggaagaguacaauucgaaacagauacagaucacgauuuugaagcuaaccaaaauacaaaguucacacccguaggaguaauacaagauggaucuacuacucacagaaacgaaccacaacaauggguauuaccaucauauucaggaagaaacacacccaacguucaucuagcaccagcaguagcaccuacuuuuccaggugaacaacuauuauuuuucagaucuacaaugccaggauguaguggauaccccaacauggaucuagauugccuucuaccacaagaauggguacaauacuuuuaccaagaagcagcuccugcacaaucagacguagcguuacuuagauucguaaauccagauaccggaagaguacuauucgaauguaaacuacauaaaagcggauauguaacugucgcccauacuggacaacacgaucuaguaauaccacccaauggauauuuuagauucgauucauggguaaaccaauuuuacacacuagccccaaugggcaaugggacaggaagaagacgcuaa

SEQ ID NO: 34537 - RNA, 1617 nt, Artificial Sequence
  derived and/or modified sequence opt6 from VP1__Norovirus_and/or_Norovirus-like__KM114291
augaaaauggcaucauccgaugcaaaccccucugauggcucagcagcuaaucuaguaccagaaguuaacaaugaaguaauggcacuagaaccagucguaggagcagcuauagcagcaccaguugcaggacaacaaaauguaauugauccauggauaagaaauaauuuuguaccugcuccaggaggagaauuuaccguaucuccuagaaaugccccuggugaaauuuuauggucugcaccauuaggaccagaucucaacccauaucuaagucauuuagcaagaauguacaacgguuaugcugguggauuugaaguacaagucauauuagcaggaaaugcauuuacagcagguaaagucauauuugcagccguaccaccuaauuucccaacagaaggacuaucacccucacaaguaacuauguucccacauauaguuguggauguaagacaauuagaaccagucuuaauaccacuaccagaugucagaaacaauuuuuaucacuauaaccaaaguaacgauccaacuauaaaauuaauagcuauguuauauacaccacuaagagcaaauaacgcuggugacgacguauuuacagucuccugucgcguucuaacacgaccauccccugauuuugauuucauauuccuaguacccccaacaguagaaucuagaacaaaaccauuuucaguacccguccuaacaguugaagaaaugacuaauucuagauuuccaaucccacuagaaaaauuauuuacuggaccaucaagugcauucguaguacaaccacaaaaugguagauguacaacugaugguguauuauuaggugcaacacaacuaucaccaguaaauauauguacauuccguggugauguaacucacauaacaggaucucgaaacuacacaaugaaucuugcaucccaaaauuggucuaauuaugacccuacagaagaaauaccugcaccauuagguacaccugauuuuguaggaaaaauacaaggcguauuaacccaaaccacaagaacugacggaucgacaagaggucauaaagcaaccguauauacaggcucagcugacuuugcaccaaaauuagguagaguacaauucgaaacagacacagauagagauuuugaagcaaaucaaaauacaaaauucacacccguagguguuauacaagacggcucaacuacacaccguaaugaaccucaacaauggguauuaccaucuuauucaggaagaaauacaccuaauguucaucucgcaccagcaguagcucccaccuucccaggagaacaacuucuguucuuuagauccaccaugccaggauguucaggauauccuaacauggauuuagauugccuacuaccacaagaauggguacaauacuuuuaucaagaagcugcacccgcacaaucagauguagcacuucuacgauuuguaaauccugauacaggucgagucuuauuugaauguaaacuacauaaaucuggauauguuacaguagcacacacuggacaacaugaucuuguaauuccaccaaauggauauuuuagauucgacucaugggucaaucaauucuacacacuagcaccaauggggaauggaacuggcagaagaagauaa

SEQ ID NO: 34538 - RNA, 1617 nt, Artificial Sequence
  derived and/or modified sequence opt6 from VP1__Norovirus_and/or_Norovirus-like__KF060105
augaaaauggcaucaucagacgcaaauccuucagacggcucaacagccaaucuaguuccagaaguuaacaacgaaguaauggcucucgaaccaguuguaggagcugcuauagcagccccuguagcuggccaacaaaauguaauagacccauggauucgaaacaauuuuguacaagcacccgguggagaauuuacaguaucucccagaaaugcaccaggagaaauauuauggucagcaccccuaggaccagaucuaaauccauaucuuucacaucuugcaagaauguauaacggauacgcaggagguuucgaaguacaaguaauuuuagcaggaaaugccuucacugccggaaagaucauauuugcagcaguaccgccaaacuucccaacagaaggauuaucacccucacaaguuacaauguuuccacacauaauagucgacguaagacaacuagaaccaguucuaauaccacuaccugaugucagaaacaacuucuaucauuacaaccaaucaaacgacuccacgauaaaauuaauagcaaugcuauacacuccacugagagcaaacaacgcaggagacgauguauucaccguauccugucgaguacuaaccagacccucaccugacuuugacuuuauauuucuaguaccaccaacaguggaaucaagaacaaaaccuuucucuguaccaauauuaacaguugaagaaaugacuaacuccagauuuccaaucccacuagaaaaauuauuuacaggucccagcagcgcuuuuguaguacaaccacaaaacggucgaugcacaacagacggaguccuccuaggcacaacacaacucucaccagucaaugucuguacauuuagaggugauguaacacauauacccggaucucauaacuacacuaugaaucuagcaucacaaaacuggaacucauacgauccaacagaagaaauaccugcaccacucggaacaccagauuuuguuggaaaaauacaagguguauuaacccaaaccacauccacuaauggauccacuagaggccacaaagcaacagucuauacagguucagcagacuucucuccaaaacucggaagaguccaauucgcaaccgauacaaauaaugauuuugaaacaaaucaaaauaccaaauucaccccaguuggcguaauccaagacggcuccacaacuccacgaaaugaaccacaacaaugggucuuaccaucauauucaggucgaaauauacauaacguacauuuagcaccagcaguagcacccaccuuuccaggagaacaacuauuauuuuucagaaguacaaugcccggauguucaggcuaucccaacauggaucuugacugccuauuaccacaagaauggguacaauauuucuaccaagaagcagcaccagcucaaucagaugucgcacuauuaagauucguuaacccagacacaggaagagucuuauucgaaugcaaacuacacaaaucuggauauguaacaguagcucauacuggucaacacgaucuaguuauuccucccaacggauauuucagauucgauucauggguaaaucaauucuauaccuuagcccccaugggaaauggaacaggaagaagaagauaa

SEQ ID NO: 34539 - RNA, 1617 nt, Artificial Sequence
  derived and/or modified sequence opt6 from VP1__Norovirus_and/or_Norovirus-like__KF060081
augaaaauggcaucuucagacgcaaauccaucagauggaucaacugcaaauuuaguacccgaagucaauaaugaaguaauggcauuagaaccagucgucggagcagcaauugcagcaccaguagcaggacaacaaaauguuaucgauccauggaucagaaacaacuuuguucaagcaccaggaggagaauuuacagucucuccaagaaaugcuccaggagaaauauuauggucagcccccuuaggaccagauuuaaaucccuacuuaucacauuuagcacguauguauaacggauacgcaggaggauuugaaguacaaguaauucuagcuggaaaugccuuuacagcuggaaagauaauuuuugcagccguaccaccuaacuuuccaacagaaggacuaucaccaucccaaguaacuauguuuccucacauuaucguugacguacgucaacuagaaccaguccuaauucccuuaccagauguaagaaacaauuuuuaccacuacaaccaaaguaacgacuccaccauaaaauuaauagcaauguuauauacaccauuaagagccaacaaugcgggagacgauguuuuuacaguaucuugccgaguacuaacaagaccuucaccagacuuugauuucauauuccuaguaccaccuaccguagaauccagaacaaaaccauucucagucccaguacuaacaguagaagaaaugacaaacucacgcuuuccaauaccauuagaaaaacuauuuacugguccuuccucugccuucguaguacaaccacaaaauggucgauguacuacagacggcguacucuuaggaacuacacaauuaaguccuguaaauauauguaccuucagaggagacguaacacauauaccaggaucucacaacuauacaaugaauuuagcaucucaaaacuggaacucauacgauccaacagaagaaauuccagcaccacuaggaacaccagauuuuguaggaaaaauucaaggaguauuaacacaaaccacaucaacaaauggaucaacacgaggucauaaagccacaguuuauacaggaucagcagacuuuucaccaaaauuaggcagaguacaauuugcaaccgauacaaauaaugauuucgaaacaaaccaaaauaccaaauuuacaccaguuggaguaauacaagacggauccacaacaccacgcaaugaaccacaacaauggguacuuccauccuauucaggaagaaacauccauaauguacacuuagccccugcaguagcaccaacauucccaggcgaacaacucuuauucuuuagaucuacaaugcccggauguucaggauauccaaauauggaucuugauuguuuacucccacaagaauggguacaauauuucuaccaagaagcagcaccagcacaaucagacguagcauuacuaagauuuguaaacccugacacaggaagaguacuauuugaaugcaaacuacacaaaucgggcuauguaacuguagcgcauacaggacaacaugaucuuguaaucccgccaaauggauacuuccgauucgauucauggguaaaucaauuuuauacacucgcuccuaugggaaauggaacagguagacgaagauga

SEQ ID NO: 34540 - RNA, 1617 nt, Artificial Sequence
  derived and/or modified sequence opt6 from VP1__Norovirus_and/or_Norovirus-like__KF059999
augaaaauggcaucaucagacgcaaacccaucagauggaucagcagcuaaccuuguaccugaaguaaauaaugaagucauggcauuagaaccaguaguaggugcagccauagcagcccccguagcaggacaacaaaauguaauagacccauggauaagaaacaacuuuguccaagcacccggaggagaauuuacaguaucaccacgaaaugcaccaggagaaauauuauggagugcuccauuaggaccagauuuaaauccauaccucucucacuuagcaagaauguauaacggcuacgccgguggcuuugaaguacaaguaauacuagcaggaaaugcauuuaccgcaggaaaaguuauauuugccgcaguaccuccaaacuucccaacagaagguuuaucgccaucacaaguaacaauguucccacacauaguagucgacguucgacaauuagaaccaguacuaauuccuuuaccagaugucagaaacaauuuuuaucacuacaaccaauccaaugauccaacaauaaaauuaaucgcaaugcuauacacaccauuaagagcaaacaaugcaggcgaugauguauuuacagucuccuguagaguacuuacaagaccaucaccugauuuugauuucauauucuuaguaccuccaacuguagaaucaagaacuaaaccauuuaguguacccguacuuacaguagaagaaaugaccaacucuagauuuccuaucccauuagaaaaacuauuuacaggaccuucaagugcauucguaguacaaccacaaaauggacgauguacaacagacggugucuuacuaggaaccacucaacuaucaccugucaauauaugcacauuucgaggcgauguuacucacauaacuggaaguagaaacuacacuaugaaccuagcaucacaaaauuggaacaacuacgauccuacagaagaaauaccagccccacuaggaacaccagauuuuguugguaaaauccaaggcguauuaacacaaacuacuaggacagauggaucaacuagaggacauaaagccacaguuuauaccgggagcgcagacuuugcaccaaaacuaggaagaguucaauuugaaacagauacagaucaugacuucgaagccaaucaaaacacaaaauuuacuccaguaggggucauacaagauggaggaacaacccauagaaaugaaccacaacaauggguucuaccauccuacucaggaagaaauacacacaacguacacuuagcaccagcaguagcaccaacauuuccaggagaacaacuacuauucuuuagaucaaccaugccagguugcucaggauauccaaacauggacuuagauugcuuauuaccacaagaauggguucaauauuuuuaccaagaaacagcuccagcacaaucugacguagccuuacuacgcuucguaaacccagacacaggaagaguacuauuugaaugcaaauuacacaaaucuuguuauguaacuguagcccacacaggacaacaugaucuugucauacccccaaaugguuauuucagauuugauucaugggucaaucaauuuuauacacuagcaccaaugggaaauggaacaggaagaagaagauaa

SEQ ID NO: 34541 - RNA, 1617 nt, Artificial Sequence
  derived and/or modified sequence opt6 from VP1__Norovirus_and/or_Norovirus-like__JX644036
augaaaauggcaucaucagaugcaaacccaucagauggaucaacagcaaaccuaguaccagaaguaaacaaugaaguaauggcacuagaacccguuguuggugcagcuauagcugcaccuguagcaggccaacagaacguaauugacccauggauaagaaauaauuuuguacaagcucccgguggagaauuuacaguaucaccaagaaaugcaccaggagaaauccuauggucagcaccacucgguccagaccuaaauccauauuuaucacauuuagcaagaauguauaacggauacgccgguggauucgaaguacaaguaauacucgcaggaaaugcauuuacugcaggcaaaauaaucuucgcugcaguaccaccaaacuuuccaacagaaggcuuaucaccaucacaagucaccauguuuccucacauaauaguagacguaagacaacuagaacccguacuaauaccauuaccagauguaagaaauaauuucuaucacuauaaccaauccaaugauuccacaauaaaacucauagcaauguuauacacaccauuaagagcuaacaacgcgggagacgacguauuuacaguuagcugcagaguacuaacgagaccuucaccugacuucgacuuuaucuuucucgucccaccgacaguagaaucuagaacaaaaccauuuucaguaccaguacuaacuguagaagaaaugacaaacucucgcuuuccaauaccauuagaaaaacuauuuacagguccaucaaaugcauuuguuguacaaccacaaaauggcagauguacaacagaugguguacuuuuaggaacuacucaauuauccccaguaaauauauguacuuuuagaggugacguaacacauauaccaggcucaagaaauuacacaaugaauuuagcuagucaaaacuggaacagcuacgauccaacagaagaaaucccagcuccccucgguaccccugauuuugugggaaaaauucaaggaguuuuaacacagacaacaagaacaaacggauccacaaggggucacaaagcaaccgucuacacuggaucagccgauuuuucaccaaaauuaggaagaguacaauuugcaacugauacagacaacgauuucgaaacuaaccaaaauaccaaauuuaccccuguagguguuauucaagacggaucaacaacaccaagaaacgaaccacaacaauggguauuaccaucuuacuccggacgaaauauacauaauguucauuuagcaccagcaguagcaccuacauuuccaggagaacaauuacuauucuuuagaucaaccaugccuggaugcucagguuauccaaauauggauuuagauuguuuacugccacaagaauggguacaauacuuuuaucaagaagcagcaccagcacaaucugacguagcucuacuacgauuuguuaauccagauaccggacgaguuuuauuugaaugcaaacuacacaaaucaggauauguaacaguugcacauacaggacaacacgaucuuguaauaccaccaaaugguuauuucagauuugacuccuggguaaaccaauuuuacacucuagcaccaauggguaauggaacaggacgaagaagauaa

SEQ ID NO: 34542 - RNA, 1617 nt, Artificial Sequence
  derived and/or modified sequence opt6 from VP1__Norovirus_and/or_Norovirus-like__JX459654
augaaaauggcaucaaaugacgcaaaccccucagacggauccacagcaaaucuuguuccugaaguaaacaaugaaguuauggcauuagaaccuguaguaggagcagcgauagcagcaccaguagccggucaacaaaacguaauagacccauggauccgaaauaauuucguccaagccccuggaggcgaauuuacuguuucaccuagaaaugcacccggagaaauacuauggucagcccccuuagguccagaucuaaacccauacuuaucucacuuagccagaauguauaacggauacgcgggugguuucgaaguacaaguaauauuagccggaaaugcauuuacagccggaaaaauaauuuucgcagccguaccaccaaauuucccaacagaaggccuuucaccaucacaaguuaccauguucccacacauuauuguagauguaagacaacuagaacccguauuaauaccauuacccgauguaagaaacaauuucuaucacuauaaucaauccaacgacccaacaauaaaauuaauagcaauguuauauacaccacuaagagcuaacaaugcgggugaugacguuuucaccguauccugcagaguucuaacacgaccuagcuuagacuuugauuucauauuuuuaguaccaccaaccguagaaucccgaacaaaaccauucucuguccccguacuaacagucgaagaaaugacaaauucucgcuuuccaauaccacuugaaaaauuauucacaggaccaucaucagcauucgucguacaaccacaaaacggaagauguacaacagacggaguacuuuuaggaacuacacaacuaucacccguaaauauaugcacauucagaggagacguaauucauauucccggaucaagaaacuacacaaugaauuuagcaucucaaaacuggaacucauaugacccaacugaagaaauacccgcacccuuaggaacaccagauuucguagguaaaauacaaggagucuuaacacaaacaacuagaacaaacggaucuaccagaggucacaaagcuacaguauauacugguucugcagauuuuucaccuaaauuaggacgaguacaauucgcaacugauacagauaaugauuuugaaacuaaccaaaacacaaaauucacaccaguaggagucauucaagacggaucaacaacaccaagaaacgaaccacaacaauggguauuaccaagcuacucaggucguaauauccauaauguacaucuagcacccgcuguagcaccaacauuccccggagaacaacuacuauucuucagaucuacaaugcccggauguucagguuaucccaauauggaucucgauugcuuauuaccucaagaauggguacaauacuucuaccaagaagcagcaccagcacaaucugauguagccuuacuaagauuuguaaauccugauacaggcagaguucuauucgaaugcaaauuacauaaaucaggcuaugucacugucgcacacacaggccaacaugaucuuguaauaccacccaauggguacuuuagauucgauucauggguuaaucaauucuauacacuagcacccaugggaaaugguacuggaagacgaagguaa

SEQ ID NO: 34543 - RNA, 1617 nt, Artificial Sequence
  derived and/or modified sequence opt6 from VP1__Norovirus_and/or_Norovirus-like__JN400621
augaaaauggcaucaucagacgcuaauccuuccgauggaucaacagcaaacuuaguuccagaaguaaacaacgaaguuauggcacuagaacccguaguaggagcagcaaucgcagcuccaguagcaggacaacaaaaugucauagacccauggauacgaaauaauuuuguacaagcaccuggaggagaauuuacaguuucaccucgaaaugccccaggagaaauacuuuggagugcaccauuaggaccagaucuaaacccauaucuaucucacuuagcaaggauguauaauggcuacgcugguggauucgaaguccaagucauucucgcaggaaaugcauuuacagcaggcaaaaucauauucgcagcagucccaccaaauuuuccaacugaaggacucucaccaagccaaguaacaauguucccucauaucauaguagacguaagacaacuagaacccguacuaaucccccuacccgauguaagaaacaacuuuuaucacuauaaccaaucaaaugauuccacaauuaaacuaaucgcaaugcuguacacaccauuaagagcaaacaaugcaggagacgacguauuuacaguuucauguagaguucuuacaagaccaucuccagacuuugacuuuauauuuuuaguaccaccaacaguugaauccagaaccaaaccuuuuucuguaccaguauuaacaguagaagaaaugaccaacucacgauuuccaauaccuuuagaaaaauuauucacagguccaucaucagcauuuguaguacaaccacaaaauggaagauguacuacagacggcguucuucuaggcacaacacagcuaucaccugucaacauauguacauuuagaggagacguuacacauauaccaggaucacgaaacuauacuaugaauuuagcuucacaaaacuggaacucauacgacccaacugaagaaauaccugcaccucuuggaacucccgauuucgucggaaaaauacaagguguauuaacucaaacuacaagaacaaacggcuccacacgaggucacaaagcaacuguauauacagguucugcagauuuuucacccaaauuaggaagaguucaauucgcaacagauacugauaacgauuuugaaacaaaccaaaacacaaaguucacuccaguaggcguuauacaagacgguucuacaacaccacgcaacgaaccacaacaauggguauuaccuuccuauucaggacguaauauacauaacguacauuuagcacccgcaguagcacccacauuccccggagaacaauuauuauucuuuagaucaacaaugcccggauguucuggcuacccaaauauggaucuagauugucuccuaccccaagaauggguucaauacuuuuaccaagaagcagccccagcucaaucugauguagcacuauuaagguuuguuaacccagauacaggcagaguaauguuugaaugcaaacuacauaaaucaggauauguaacagucgcccauacaggccaacaugaucuaguaauaccaccaaauggcuauuuuagauucgauucuugggugaaccaauucuacacacuagcuccaaugggaaacggaacaggaagaagaagauaa

SEQ ID NO: 34544 - RNA, 1617 nt, Artificial Sequence
  derived and/or modified sequence opt6 from VP1__Norovirus_and/or_Norovirus-like__AB541260
augaaaauggcaucaaacgacgcuaacccauccgacggaucagcagcaaaucuaguaccagaaguaaacaacgaagucauggcucuugaacccguaguaggagcagcaauagcagcaccaguagccgcacaacaaaacguaauagacccauggauuagaaauaacuucguacaggcaccaggaggagaauuuacaguaucaccuagaaaugcaccauccgaaauuuuaugguccgcaccacucgguccagaucucaacccauaucuuucucauuuugcacguauguauaauuguuacgcuggcggauuugaaguacaaguaauacuagcaggaaaugcauuuacagcaggcaaaauaauauuugccgcaguaccaccuaacuucccuacagaaggauuaucaccaucucaaguaacaauguucccccacauaauaguugacguuagacaacuagaacccguauuaaucccucuaccagauguacgcaauaacuuuuaucacuauaaucaaucaaaugauucuacaauaaaacuuauagccauguuauacacuccauuaagagcaaauaaugccggagaagauguauuuacaguuucaugucgaguauuaacaagaccuucaccagauuuugacuuuauauuccuaguucccccgaccguugaaucacgaaccaaaccauucacuguaccuauuuuaacagucgaagaaaugacuaacucucgauuuccaauaccauuagaaaaauuauuuacuggaccuucuucagcauucguaguucaaccacaaaauggaagauguacaacagacggaguacuauuagguacuacacaauuaucaccagucaacauauguacauuuagaggcgacgucacccauaucgcagguucaagaaauuauacaaugaaccuagcaucauuaaauuggaauaacuaugauccuacagaagaaauaccugcaccacuaggcaccccugacuucguaggcaaaauacaaggaguacuaacacaaacaacaaaaggugauggcagcaccagaggccacaaagcaacaguauauacugguucugcgccauucacaccuaaacuaggaucaguacaauucucaacagauaccgaaaacgauuucgaaacacaucaaaauacaaaauucacaccaguaggaguaauacaagauggaggaacaacccauagaaacgaaccucaacaauggguucuuccuucauauuccggaagaaacguaccaaauguccaccuugcucccgcaguagccccuacauuuccaggagaacaacuauuauuuuucagaucaacaaugccagguuguucagguuauccaaauauggauuuagacugcuuacuaccacaagaauggguucaacauuucuaucaagaagcugcucccgcacaaucagacguugcauuauuacguuucguaaacccagacacaggaagaguacuauucgaaugcaaauuacauaaaucagguuaugucacuguagcucacacuggacaacacgaucuaguaauaccucccaacggauauuuuagauuugacucauggguaaaucaauuuuacacacuagccccaaugggaaauggaacaggacgccgucgauaa

SEQ ID NO: 34545 - RNA, 1617 nt, Artificial Sequence
  derived and/or modified sequence opt6 from VP1__Norovirus_and/or_Norovirus-like__KX514341
augaaaauggccagcaaugacgcaaauccaucagauggaucagcagcaaacuuaguaccugaagucaauaacgaagucauggcauuagaaccagucguuggugcagcaauagccgcaccaguagcuggucaacaaaauguaauugacccuuggauaagaaauaacuucguacaagcaccgggcggugaauuuacagucagcccaagaaaugcucccggugaaauucuaugguccgcaccacuaggaccagauuuaaauccauaccuaucccacuuagcaagaauguacaauggauacgcaggaggauucgaaguacaaguaauucuagcaggaaacgccuucacagcaggaaaaauaauuuuugcagcaguaccaccaacauuuccuacggaaggucucucaccaagucaaguaaccauguuuccacauauaauuguagauguaagacaauuagaaccaguauuaauaccacuacccgaugucagaaacaacuucuaucauuacaaucaaucaaaugauucaacuaucaaacuaauugcaaugcucuacacaccacuacgagcaaauaaugcaggagacgauguauuuaccguuucauguagaguauuaacacgucccucaccagacuucgauuuuauauuuuuaguacccccaacaguugaaucuagaagcaaaccauucucaguaccaguacuaacaguagaagaaaugacaaauuccagauucccagcaacauuagacaaauuauucacagguccaucaucaacauucguuguucaaccacaaaacggaagauguaugauugacggaguauuacucgguacaacucaacucuccccaguaaauauauguacauuuagaggagacgucacacaaucaggaaacaccaaaaucuauacuaugaacuuagcuucuccaaacuggaauaauuacgacccaacagaagaaauaccagcaccccuaggaacaccagacuuugucggaaaaauccaaggcaugcuuacacaaacaacuaaaggugaaggaucaacaagaggacacagagcaacaguauauguagguucagcaaacuacgccccaaaauuaggaagaguccaauucgaaaccgauacaacugaugaucuugacgcacaccaaaauacaaaguuuacaccaguuggaguuguacaaaguggagaaucaccaaaaggaucagaaccucaacaauggguuuuaccaucauacucaggaagagauacaccaaauguacauuuagcaccagcuguugcaccaacauuuccaggugaacaauuacuauucuuuagauccacaauaccuggaugcggaggccacccuaacaugaaucucgauuguuuacuaccgcaagaauggguacaacauuuuuaucaagaagcagccccugcccaaucugauguugcacuccuaagauucguaaauccagauacauccagaguauuauucgaaugcaaacuacauaaaucagguuacguuacaguagcacacaccggacaacaugacuuagucauaccaccaaauggcuauuuuagauuugauucauggguaaaucaauucuacacauuagcaccuaugggaaacggaaccggcagaaaacgcuaa

SEQ ID NO: 34546 - RNA, 1617 nt, Artificial Sequence
  derived and/or modified sequence opt6 from VP1__Norovirus_and/or_Norovirus-like__KX514253
augaaaauggcuucaaaugacgcaaacccaucagacggaucaacagcaaaccuugugccagaaguaaauaacgaaguaauggcacuagaaccuguaguaggugcugcaauagcugcaccaguagcuggucaacaaaauguaauagacccauggauaagaaacaauuuuguacaagccccaggcggagaauuuaccguuucuccuagaaacgcaccaggugaaauacuauggucagcaccauuaggaccagguuuaaauccuuaucucucacaccuagcccgaauguauaaugguuacgcuggcggauucgaaguucaaguaauauuagcaggaaacgccuuuacagcaggaaaaauaauuuucgcagcagucccaccaaauuuuccaacagaaggauuaaauccaucccaagucacaauguucccucauaucauagucgauguccgacaacuagaaccuguacuuauaccuuuaccagauguaagaaauaauuucuaucacuacaaccaaucaaacgauucaacaaucaaauuaaucgcaaugcuauauacuccguuaagagcaaauaaugcuggugaugauguauuuacaguaucauguagaguacuaacacgaccuuccccagacuucgacuuuauuuuucuuguuccaccaacaguagaaagcagaucuaaaccauuuuccguaccagucuuaacaguacaagaaaugacaaacucuagauucccagcaacucuugacaaauuauuuacaggaccaucaucaaaucucgucguucaaccucaaaacggacgauguaugauugacggaguuuuauuaggaacaacacaguuaagucccguaaauauaugcacauuucgaggagaugucacacauuuaagagacucaacaauauauacaaugaacuuagcaucaccaaauuggaauaauuaugacccuaccgaagaaaucccugccccacuaggaacaccugacuucguaggaaaaauacaaggaguuuugacacaaacaacgaaaggagaaggcucaacaagaggacaccgagcaacagucuauguagguucagcugauuauacacccaaacuaggaaaaguucaauucgaaacaaacacaacaaacgaucuauaugcccaccaaaacacaaaauucacaccaguaggcguaguacaaggaggagaaucugcacacagaucagaaccccaacaguggguacuacccggauauucaggaagagauacuccuaauguacaucucgcuccugcaguagcaccaaccuucccaggugaacaacuacucuucuuuagaucaacaauaccagguugcggaggacauccaaacauggaucucgauugucuauuaccacaagaauggguacaacauuuuuaccaagaagcugcaccagcacaaucagacguagcccuucuccgauuuguaaacccagauacaucaagaguccuauucgaaugcaaauuacacaaaucugguuacguaacaguagcacacaccggacaacacgaccuagucauaccacccaacggauauuuucgcuuugauucuuggguaaaucaauuuuacacucuagcuccaauggguaacggaacuggcagaaaaagauaa

SEQ ID NO: 34547 - RNA, 1617 nt, Artificial Sequence
  derived and/or modified sequence opt6 from VP1__Norovirus_and/or_Norovirus-like__KX514195
augaaaauggcaucauccgacgcuaacccuucugacggaucugcagcuaaccuaguaccagaaguaaauaacgaaguaauggcuuuagaaccaguaguaggagcugcaauagcagccccuguagcaggacaacaaaauguaauugacccauggauaagaaauaacuucguacaagcaccaggaggugaauuuacuguuucaccaagaaaugcuccuggagaaauacucuggucagcuccauuagguccagaccugaauccauaucucucacaccuagcccguauguauaauucauaugcugguggcuucgaaguacaaguaaucuuagcaggaaaugcauuuacagcagguaaaauaauauuugcagcaguaccuccuacauuuccaacugaagguuuaucuccuucacaaguuaccauguuuccacacauuauaguugacguacgacaauuagaaccaguucuuauaccacuaccagauguccgaaauaauuuuuaccauuauaaucaauccaacgacagcacaauaaaacucauagcaaugcucuauacaccucuacgagcaaacaacccuggagaugauguauucacaguaucauguagaguucuaacacgaccuucuccagacuuugacuucaucuuuuuaguuccacccacaguagaaucaagaacuaaaccuuucucaguaccgauucuuaccguaggagaaaugacuaauucaagauuuccaauaaacuuagaaagacuauucacaggaccuucaucaacuuuaguaguccaaccacaaaauggccgguguaugauugauggcguacuacuaggaaccacacaacucucaccagucaacauauguacuuucagaggugauguaacacacucaagagacucuacaaucuacacaaugaaucuagcaucacccaauuggaauaauuacgacccuacagaagaaauaccagcaccauuaggaacaccagacuuugucggaaaaauccaaggcguauuaacacaaacaacuaaaggagaagguaguacacgcggucacagagcaacuguuuauguagguuccgcuaacuacacaccuaaacucggaaaaguacaauucgaaacaaacacaacaaaugauuuauaugcacaccaaaauacgagauuuacaccaguaggagucguacaaggaggugaauccgcacauagaucugaaccacaacaauggguauuaccaucguacucaggacgugacacaccaaauguacauuuagcaccagcuguagcaccuaccuucccaggcgaacaauuacucuucuuuagaagcaccauaccugguugcggcggacauccuaacauggaucuagauugccuauuaccacaagaauggguucaacauuuuuaccaagaagcagcaccagcacaaucagauguagcacuacuacgcuuuguaaaccccgauacaucuagaguacuauucgaauguaaauuacauaaaucuggauauguaacaguagcacauacuggacaacaugacuuagucauaccuccaaauggcuauuucagauucgauuccuggguuaaucaauuuuacaccuuagcaccaaugggaaauggaacaggaagaaaaagauaa

SEQ ID NO: 34548 - RNA, 1617 nt, Artificial Sequence
  derived and/or modified sequence opt6 from VP1__Norovirus_and/or_Norovirus-like__KX354016
augaaaauggcaucuagcgacgcaaacccuucagauggcucaacagcaaaccucgucccagaaguuaacaaugaaguaauggcacucgaaccaguaguaggagccgcaauagcagcaccaguagcaggacaacaaaaugucauagacccauggauuagaaacaauuuuguccaagcaccuggaggcgaauuuacaguuagcccaagaaaugcaccaggagaaauacucuggucagccccucucgguccagaucuaaauccauaccuaagucaccuggcaagaauguacaacggauacgcaggaggauucgaaguacaaguaauacuagcaggaaacgcauucacagccggcaaaauaauauucgccgcagucccuccaaacuuuccaaccgaaggacuaucaccaucacaaguaacuauguuuccccacauuauaguagacguuagacaacuagaaccuguucucauaccacuuccagauguacgaaacaauuuuuaucacuauaaucaaucaaacgacucaacaauaaaacuaauagcaaugcuuuacaccccauuacgagcuaacaaugcaggagaugaugucuuuacaguaucaugucguguucuaacuagaccuucacccgacuuugauuuuauauucuuagucccaccaacaguugaaucccguacuaaaccauucuccguacccauacuaacaguagaagaaaugacaaauucuagauucccaauaccuuuagaaaaauuauuuacaggcccaucaucugcauucguuguacagccccaaaauggccgcugcacuacagauggcguacuacuaggaaccacucaacucucuccaguaaacauuugcacauucagagguggcguaacccauaucccaggaucucauaauuacacaaugaauuuagcaagucaaaauuggucaucauaugauccaacagaagaaauuccagcaccacucggaacaccagauuucguaggaaaaauucaaggaguauuaacccaaacaacaucaacaaauggaucuacucguggucacaaagcaacagucuauacuggaucagcugauuuuuccccaaaacuuggacgaguacaauucgcaacagauacuaacaacgauuucgaaaccaaccaaaauacaaaauucacaccagucggaguaauccaagauggauccacaacuccuagaaaugaaccucaacaauggguauuaccuucauacucaggaagaaauauacacaacguacauuuagcacccgcaguagcaccaacuuuuccaggugaacaauuacuuuucuuuagaucuacaaugccuggaugcucuggauacccuaauauggaccuagauuguuuauuaccacaagaauggguacaauauuucuaucaagaagcugcaccagcacaaucagacguagcacuacuacguuuuguaaacccagacacuggaagaguccuuuuugaaugcaaacuucauaagucuggauacguaacaguagcacacacaggacaacaugaucuaguaauaccaccaaauggauauuucagauuugauucauggguaaaucaauuuuacacauuagcuccaaugggaaacggaacaggacgcagaagauaa

SEQ ID NO: 34549 - RNA, 1617 nt, Artificial Sequence
  derived and/or modified sequence opt6 from VP1__Norovirus_and/or_Norovirus-like__KM245073
augaaaauggcuaguucagacgcuaacccaucagauggcucaacagcuaaccuuguuccggaaguaaacaaugaagugauggcucuugaacccguaguaggagcagcaauagccgcaccuguagccggucaacaaaaugugauagacccuuggauaagaaauaacuuuguucaagccccuggaggagaauuuacaguaucuccuagaaacgcuccaggagaaauccucuggucagcaccucuagguccagaucucaacccauaucuuucacaccuagccagaauguauaauggauacgccggagguuucgaaguacaaguaaucuuagcuggaaaugcuuuuacagcaggaaaaauaauauuugccgcaguacccccaaacuuccccacugaaggauuaucacccucacaaguaacaauguucccucaccuaauuguagauguaagacaacuagaaccaguucuaauaccauuaccugauguacgaaauaacuucuaccacuauaaucaaucaaacgacuccaccauaaaauuaaucgcuauguuauacacaccauuaagagcgaauaacgccggugacgauguauuuaccguaucaugucgcguauuaacacgaccauccccagauuuugacuucauauuucuagucccucccacaguugaaucaagaacaaaaccauucucugucccaguacucacagucgaagaaaugacaaacucaagauuuccaauuccacuagaaaaacuauuuacagguccaucuucagcauucgucguccaaccucaaaacgguagauguacaacagauggaguccuacuaggcacaacacaacucucuccaguaaauauuuguacauuuagaggugacguaacucauauaccugggucaagaaacuauaccaugaauuuagcaucacaaaacuggaacucauaugauccaacugaagaaaucccugcacccuuaggaacaccagauuuuguaggaaaaauacaaggaguccucacccaaacaacccgaacaaauggauccacucgaggacauaaagcaacagucuauaccgguagugcagacuuuagcccaaaacucggaagaguacaauuugcaaccgauacagacaaugauuucgaaaccaaccaaaauacaaaauucacacccguaggaguaauacaagaugguucaacaacuccaagaaaugaaccacaacaauggguacuaccgucauauuccggaagaaauauccauaauguucauuuagcaccagccguagccccaacauuucccggagaacaacuccuauucuuuagaucaacaaugccaggauguucaggauauccaaacauggaucuagauuguuuauuaccucaagaauggguacaauauuucuaccaagaagccgcacccgcacaauccgacguagcauuacuuagauucguaaauccagacacaggacgaguucuauuugaauguaaauuacauaaaucaggauauguaacagucgcccacacaggacaacacgauuuaguaauuccaccaaacggauauuuucgauuugauuccuggguaaaccaauuuuauacacuagcaccaaugggaaacggaacaggcagaagaagauaa

SEQ ID NO: 34550 - RNA, 1617 nt, Artificial Sequence
  derived and/or modified sequence opt6 from VP1__Norovirus_and/or_Norovirus-like__LN854567
augaaaauggcaucaucagaugcaaauccaucugauggauccgcagcuaaccuaguaccagaaguuaauaaugaaguaauggccuuagaaccaguuguaggagcagcaauugcagcaccuguagcaggacaacaaaauguuauagaucccuggauacgcaauaacuucguacaagcacccggaggcgaauuuacaguaucaccaagaaaugcacccggggaaauauuauggucagcuccuuuaggacccgauuuaaauccauacuuaucacaccuugcacgaauguacaauggauaugcaggaggauucgaaguacaaguaauacuagcaggaaacgcauuuacagcagguaaaguaauauucgcagcuguuccaccuaacuucccaacagaaggacucucaccaucacagguuacaauguuuccacauauagucguugacguacgacaacuagaaccuguacuaauaccacuuccagauguaagaaauaauuuuuaucacuauaaucaaucuaaugacccaacuauaaaauuaauagcaauguuauauacaccucuaagagcaaauaacgcuggugacgauguauucacaguauccugcagaguucuaacaagaccaucaccagauuucgacuucauauuccuaguaccucccacagucgaguccagaacaaaaccuuucucaguaccuguacuaaccguagaagaaaugacaaacaguagauuuccaauaccauuagaaaaauuauuuacaggaccaucauccgacuucgucguacaaccucaaaacggcagauguacaacagacgguguacucuuaggaacaacccaauuaagcccaguaaauauaugcacauuucguggagacguuacacauacaacagguucacgaaauuauacaaugaaucuagcuucacaaaacuggaacaauuacgacccaaccgaagaaacaccagccccacuuggaacccccgauuucguaggaaaaaucagaggaauguuaacccaaaccaccagagcagacggcucaaccagaggccacaaagcaacagucuacacaggaucagcagacuuugcuccaaaauuaggacgaguacaauuugaaacagauacagacaaugacuucgacgcaaaucaaaauacaaaauucacucccguaggcguaauacaagauggcaccacaacacaccgcaaugaaccaagacaauggguucucccuucauauucuggaagaaauacacauaacguacaccuagcaccagccguagcacccacauuuccuggugaacaacuauuauucuuuagaucaacaaugccaggaugcucuggauauccgaacauggaucuagacugccuacuaccacaagaauggguacaauucuuuuaucaagaagcagcaccagcacaauccgacguugcuuuauuaagauuugucaacccagacacaggaagaguacuuuucgaaugcaaacuacacaaaucaggauacguaacaguugcacauacaggaccucacgaccuaguaauaccacccaauggauacuuucgauucgauucauggguaaaucaauuuuacacacuagcaccaaugggaaauggaacaggacgaagacgauaa

SEQ ID NO: 34551 - RNA, 1617 nt, Artificial Sequence
  derived and/or modified sequence opt6 from VP1__Norovirus_and/or_Norovirus-like__JN400619
augaaaauggcauccucagaugcaaauccaucagauggcucaacugcaaaccuagucccugaaguuaauaaugaaguuauggcauuagaacccguaguaggagccgcaauagcagcaccuguagcaggacaacaaaacguaauagauccuuggauaagaaacaauuuuguacaagccccuugcggugaauuuacaguaucaccaagaaacgccccaggcgaaauacuauggagcgccccacuaggaccagauuuaaauccauaucuaucacaccuagcaagaauguauaauggauaugcuggcggcuuugaaguacaaguaauauuagcaggaaaugcuuucacagcaggaaaaauaaucuucgcagcugucccaccaaauuuucccacugaaggccuuucaccaagucaagucacaauguucccacauauaauaguagacguacgacaacuagaacccguauuaauaccauuaccagacguuagaaacaauuuuuaccauuauaaccaaucaaacgacaguaccauuaaacuaaucgcuaugcuauacacaccacuacgcgcaaacaaugcuggugacgauguauuuaccguauccugcagaguacuaacacguccaucaccagacuuugauuuuauuuucuuaguaccaccaacuguagaaucaagaacaaaaccauuuucuguaccuguacuaacaguagaagaaaugacaaacucacgcuuuccuauuccucuggaaaaauuauucacaggccccuccuccgcauucgucguacaaccacaaaauggaagaugcacaaccgacggaguauuauuaggcacaacacaacuaucaccaguaaauauuuguacauucagaggagauguaacccauauaccagggucacgaaauuacacaaugaaucuagcaucucaaaauuggaacucauacgauccaacagaagaaauaccagcaccacuuggaacuccagauuuugucggaaaaauacaaggaguacuuacacaaacaacuagaacuaaugguuccacaagaggacacaaagcaacagucuauaccggaucagcagacuuuucaccaaaauuaggaagaguucaauucgcaacagauacagacaaugacuucgaaacaaaccaaaauacaaaauuuacaccaguaggcguaauacaagacggaucaacuacacccagaaaugaaccacaacaauggguauuaccaucauauuccggaagaaacauacacaauguccaccucgcaccagccgucgccccuacuuuuccaggagaacaauuauuauuuuucagaucaacaaugccaggaugcuccgguuauccaaauauggacuuagauugucuacuaccacaagaauggguacaauauuuuuaucaagaagcagcuccagcucaaagugacguagcauuacuaagauucguaaacccagauacaggacgaguacucuucgaauguaaacuacauaaaucuggauauguuacuguugcucacacaggacaacacgauuuaguaauaccuccaaauggcuacuuuagauucgauucauggguaaaucaauuuuauacacuagcucccaugggaaacggcacuggcagaagaagauaa

SEQ ID NO: 34552 - RNA, 1617 nt, Artificial Sequence
  derived and/or modified sequence opt6 from VP1__Norovirus_and/or_Norovirus-like__KF060052
augaaaauggcaucauccgacgcaaaccccucagauggaucaaccgcaaauuuaguuccagaaguaaacaaugaaguuauggcauuagaaccagucguuggugccgccauagcagcaccuguagcaggacaacaaaaugucauagauccuuggauaagaaacaauuuuguucaagcuccagguggcgaauuuacaguaucaccaagaaaugcaccaggagaaauauuauggucagcaccauuagguccagaucuuaauccuuacuuaagucaucuagcaagaauguacaauggauacgcaggaggauuugaaguacaagucaucuuagcagguaaugcauuuacugcaggaaaaaucauauucgcugcaguuccuccaaacuuuccaacagaaggacucuccccaucacaaguaacuauguucccucacauuauaguagacguaagacaauuagaaccaguauuaauaccucuaccagaugucagaaauaauuucuaucauuauaaccaaucaaaugacucaacaauaaaacuaauugcaauguuguauacaccauuacgugcaaacaaugcaggagacgacguauucaccguaucauguagaguucuaacuagaccauccccagauuucgauuuuauauucuuaguaccuccuacagucgaaucuagaaccaaaccauucucuguaccaauauuaaccguugaagaaaugacuaacucuagauuucccauaccauuagaaaaauuauuuacaggacccucuucugcauucguaguucaaccacaaaacggacguuguacuacugacggcguauuacuaggcacaacacaacuaucuccuguuaacauauguacauuuagaggagauguaacacauauaccaggaagucacaacuauacaaugaacuuagcaucacaaaacuggaacuccuaugauccaacagaagaaaucccagccccauuagguacaccagacuuuguaggaaaaauacagggcguucuaacucaaacaacauccacaaaugguucaacaagaggacacaaagcaacaguuuauacaggcucagcugacuuuucaccuaaacuaggccgaguucaauucguaacugacacaaauaacgacuucgaaaccaaucaaaauacaaaauuuacaccagucggaguaauccaagacggaucaacaacaccucgaaaugaaccucaacaauggguauuaccuuccuauucuggacgaaauauacacaacguacacuuagcccccgcuguugcaccaacuuuuccaggcgaacaacuauuauucuuuaggucuacuaugccgggaugcuccggcuauccaaauauggaucuagauugccuauuaccacaagaguggguacaauauuucuaucaagaagcugcuccagcucaaucagauguagcacuauuacgauucguuaauccagauacuggacgaguuuuauucgaaugcaaacuacacaaaucaggauauguaacuguagcacauacaggacaacacgaccucguaauaccaccaaauggauacuuucgcuucgauuccuggguaaaucaauuuuauacucuagcuccaaugggcaaugguacaggacgcagaagauaa

SEQ ID NO: 34553 - RNA, 1617 nt, Artificial Sequence
  derived and/or modified sequence opt6 from VP1__Norovirus_and/or_Norovirus-like__KF060014
augaaaauggcuucaucagacgccaacccuucagauggaucaacagcuaacuuaguaccagaaguaucaaaugaaguaauggcucuagaacccguaguaggagcugccaucgccgcaccuguugcuggucaacaaaacguaauagacccauggauaagaaauaacuuuguccaagcacccggaggagaauuuacaguuucuccaagaaaugcaccaggagaaauacuauggucagcaccauuagguccagauuuaaauccuuaucucucacaccuugcaagaauguacaacggauacgccggcggauucgaaguacaaguuauacucgcaggaaaugccuucaccgcaggaaaaauaaucuucgcugcaguaccaccaaauuucccaaccgaaggucuaucacccagccaaguaacaauguucccacacauuauaguagacguaagacaacuagaaccaguucuaauaccauuaccagauguaagaaacaacuuuuaccauuacaaucaauccaaugacucaacuauaaaacuaauagccaugcuuuauaccccauuaagagcuaacucugccggagacgauguuuuuacaguuaguugcagaguauuaacaagaccaucaccagacuuugauuuuauauuccuugucccuccaacaguagaaagcaggacaaaaccauuuucuguaccaauacucacaguagaagaaaugaccaacucaagauucccaauaccacuagaaaaacuuuuuaccggaccaaguucagcuuucguaguacaaccacaaaacggcagauguacaacugauggaguauuacuagguacaacacaacucucucccguaaauauuuguaccuuuagaggagacguaacacauauaccagggucucacaauuauaccaugaaucuagcaucccaaaauuggaacucuuaugacccaacugaagaaaucccagcaccuuuagguacaccagacuuuguaggaaagauucaaggcguucuaacacaaacgacuucaacaaauggaucaacaagaggccacaaagcaacaguauauaccgguucagcagacuuuuccccuaaacuaggaagaguacaauucgcuacagacacuaacaacgacuucgaaacaaaccaaaauacuaaauuuacacccguuggaguaauccaagauggaucaacaacaccaagaaacgaaccacaacaauggguucucccuucauauucaggcagaaauauccacaacguacacuuagcaccagccgucgcacccacauuccccggugaacaauuacuauucuuuagaucaaccaugcccgguugcucaggauauccaaauauggaccuagauugucuucuaccgcaagaauggguacaauauuuuuaucaagaagcugcaccagcacaauccgaugucgcacuauuacgcuucguaaacccagacacaggucgaguauuauuugaauguaaauuacauaaaucaggauauauaacaguagcacacacaggacaacacgauuugguaauacccccaaaugguuauuucagauucgacucauggguaaaucaauuuuacacacuagcuccaaugggaaacgguacaggaagaagaagauaa

SEQ ID NO: 34554 - RNA, 1617 nt, Artificial Sequence
  derived and/or modified sequence opt6 from VP1__Norovirus_and/or_Norovirus-like__KC517375
augaaaauggcaagcucagacgcaaaccccucugauggaagugcugcaaacuuaguuccagaaguaaacaacgaaguaauggcauuagaaccaguagccggagcagcaauagcugccccaguagcaggacaacaaaaugugauagaucccuggauaagaaacaauuuuguacaagcacccgggggagaauuuacaguaucuccucgaaaugcuccaggugaaauacuuugguccgccccauuagguccagacuuaaacccauaccucucccaccuagcaagaauguauaacgguuaugcuggcgguuucgaaguucaagucauccuagcaggcaaugcauuuacugcaggaaaaguaauauucgcagcaguuccaccaaacuuuccaacagaaggcuuaucacccucacaaguaacaauguuuccacauauagucguagauguaagacaauuagaacccguauuaauaccuuuaccagauguaagaaauaauuuuuaccacuauaaucaaucaaaugacccuacaauaaaauuaauagcaaugcuauaugcaccauuaagagcaaauaacgcuggagaugauguuuuuacagucucauguagaguucuaacacgaccaucaccugacuuugauuuuaucuuucuaguaccaccuacaguagaaucacgaacaaaacccuucucaguaccaguauuaacuguagaagaaaugacuaacucaagauuuccaauuccauuagaaaaacuuuucacagguccaucauccgcuuucguaguacaaccacaaaaugguagauguacaacagacgguguauuauuaggaacaacacaacuaucaccuguaaauauuugcacauucagaggagacguaacccauauaacaggaucuagaaauuauacaaugaaccuagcuucucaaaauuggaauaauuaugauccaacagaagaaaucccagcaccauuaggaaccccagauuucguagguaaaauacaaggcguauuaacacaaacaacuagaaccgauggcucaacaagaggacacaaagcaaccgucuauacaggauccgcagauuuugcuccaaaauuaggaagaguacaauuugaaacagauacugaccaugauuucgaagcaaaccaaaacacaaaauuuaccccaguagguguaauccaagauggagguacaacucauagaaacgaaccccaacaauggguauuacccucauauucuggaagaaacacucauaacguccacuuagcaccagcaguagcaccuacauuuccuggagaacaauuacuauucuuuagaaguacaaugccuggaugcaguggauacccaaauauggauuuagacugucuauuaccacaagaauggguucaauauuucuaucaagaagcagcuccagcacaauccgauguagcuuuacuacgauuuguaaauccagauacaggcagaguucuauuugaauguaaacuacauaaaucaggauauguaacaguagcacauacaggucaacaugacuuaguaauuccacccaauggauauuuuagauucgauucuuggguaaaccaauucuauacccuagcacccaugggaaacgguacaggcagacgaagauaa

SEQ ID NO: 34555 - RNA, 1617 nt, Artificial Sequence
  derived and/or modified sequence opt6 from VP1__Norovirus_and/or_Norovirus-like__JX644039
augaaaauggcaucaucagaugcaaacccauccgacgguucaacagcaaauuuaguaccagaaguaaacaaugaaguaauggcacuagaaccaguagucggagcagcaauagcagcaccaguagcaggucaacaaaauguaauagacccauggauacgaaauaacuuuguacaagcccccggaggagaauuuaccguuucaccaagaaaugccccaggagaaauauuauggagcgcaccuuuaggaccugaccuuaacccauaucuaucucacuuagcaagaauguauaauggauacgcaggaggauucgaaguacaaguuauacuagcaggaaaugcuuucacugccggaaaaauaauauuugcagccguaccaccaaacuucccaacugaaggucucucaccuucccaaguuacaauguuuccucacauaauaguagacguuagacaauuagaaccaguuuuaaucccacucccagauguuagaaacaauuucuaucauuacaaccaaucaaaugacuccaccauaaaacuaauagcaaugcuauacacaccacuacgugcaaauaaugcaggagacgacgucuuuacgguaucuugcagaguacuaacaagaccuucacccgacuuugauuucauuuuccucguuccaccuaccguagaaucaagaacaaaaccauuuaguguaccaauucuaacaguagaagaaaugacaaacucaagauuccccauaccauuagaaaaauuauuuacagguccaucaucagcauucguuguacaaccacaaaacggaagauguacaacugauggcguucuauuaggcacaacucaacuauccccaguaaauauaugcaccuuucgaggagauguaacacacaucucuggcucccgaaacuauacuaugaaucuagcuucacaaaacuggacaucauaugauccaacagaagaaauaccagcaccacuaggaacaccagacuuuguuggcaaaauacaaggaguuuuaacacaaacaacaagaacaaauggaucuacacgaggucacaaagcaacugucuauacagguucugcagacuuuucuccaaaacuaggaagaguacaauucgcaacugauacagauaaugacuucgaaacuaaucaaaacacaaaauucacaccaguaggcguaauacaagaugguucaacaacaccaagaaaugaaccacaacaguggguccuaccaucauacuccggaagaaauauucauaacguucaccuagcaccagcaguagcccccacauucccaggagaacaauuacuauucuuuagaucuacaaugcccggauguuccggguaucccaacauggacuuagacugucuauuaccucaagaauggguacaauauuuuuaccaagaagccgcuccugcacaaucagauguagcacuauuacguuuuguaaacccagacacaggaagaguuuuauucgaaugcaaacuacacaaauccggauacgucacaguagcacacacaggacaacaugaccuaguuauaccaccaaauggauauuuccgauucgacaguuggguaaaucaauuuuauacauuagcacccaugggaaacggaacaggcagaagaagauaa

SEQ ID NO: 34556 - RNA, 1617 nt, Artificial Sequence
  derived and/or modified sequence opt6 from VP1__Norovirus_and/or_Norovirus-like__JX644031
augaaaauggccucaagugaugcaaacccuagcgauggaaguacagcaaaccuaguaccugaagucaacaacgaaguaauggcuuuagaaccagucguaggagcugcaauagcugcaccaguagcuggucaacaaaacguaaucgacccuuggaucagaaauaauuuuguccaagcaccaggaggagaauuuacuguuagcccaagaaacgcaccaggagaaauccuauggucagcaccauuaggacccgaucugaauccuuaucuaucacacuuagcuagaauguauaacgguuacgcaggaggauuugaaguccaaguaauacucgccggcaaugcauuuacugcagguaaaauaauauucgcugccguuccaccuaacuucccaacagaaggacuaucaccaucccaaguaacaauguuuccacauaucauaguugacguucgacaauuagaaccaguacuuaucccuuuaccagauguuagaaacaacuuuuaucauuacaaucaaucaaaugauucaacaauuaaacuaauugcuauguuauacaccccacuacgagcaaacaacgcaggagacgacgucuucacaguuaguuguagaguucucacaagaccaucaccagauuuugacuuuaucuuucucguacccccaacaguugaaucccgaacaaaaccauuuucuguaccuguacuuacaguagaagaaaugacaaacucaagauuuccaauaccucuagaaaaacuauuuacuggucccucaucagcauuugucguacaaccccaaaacgguagauguacaacagacggcguacuacuaggaacaacacaauuaucaccuguaaauauaugcacauuccgcggagacguaacacacauaccaggaucucgaaauuacacaaugaaucuagcaucacaaaacuggucaucauacgauccuacugaagaaauaccagcaccuuuaggaacuccagauuuugucggaaaaauacaaggagucuuaacacaaaccacacguacaaacggaucaacacgaggacauaaagcaacaguauauacaggaagcgcagacuuuagcccaaaauuaggacgaguacaauucgcaacagauacagacaacgacuucgaaacaaaucaaaauacaaaauuuacaccaguugguguaauacaagacggaucaacgacaccaagaaaugaaccacaacaauggguucucccaucauauucaggaagaaacauacauaacguucaccuagcaccagcaguagcuccaacauuucccggugaacaauuauuauucuucagaucaacaaugccaggauguuccggauacccuaauauggauuuagauuguuuacucccacaagaauggguucaauauuucuaucaagaagcagcaccagcacaaucagauguagcccuacuuagauuuguuaauccagacaccggacgaguccuuuucgaaugcaaacuacauaaaagcggauaugucacuguagcacacacaggccaacacgacuuaguuaucccuccaaauggcuauuucagauucgauuccuggguaaaucaauuuuauacuuuagcacccaugggaaacggaacaggacgaagaagauaa

SEQ ID NO: 34557 - RNA, 1617 nt, Artificial Sequence
  derived and/or modified sequence opt6 from VP1__Norovirus_and/or_Norovirus-like__HM191773
augaaaauggcuuccucugacgcaaauccuuccgauggauccaccgcuaacuuaguaccagaaguaaauaaugaaguaauggcauuagaacccguaguaggagcagcaaucgcagcccccguagcuggacaacaaaacgucauagaucccuggauuagaaauaauuucguacaagcacccggaggagaauuuacagucucaccaagaaaugcccccggagaaauauuauggucagcaccccuaggaccugaccucaacccauauuuaucacauuuaagcaggauguacaacggauacgcaggcgguuuugaaguccaaguaauauuagcaggaaaugcauuuacagcaggaaaaauaauuuucgccgcaguacccccaaacuuccccacugaaggacuaucaccaucucaagugaccauguuuccucauauaauaguugauguaagacaauuagaaccaguauuaauaccacuacccgauguaagaaauaauuucuaucauuacaaccaaucaaaugauccuacaauuaaauuaauagcaauguuauacacaccccuuagagcaaacaaugcaggcgacgauguuuucacaguuuccuguagaguauuaaccagaccaucacccgauuuugauuuuauauuuuuaguaccaccaacaguagaauccagaacaaaaccuuucucaguaccaguauuaacaguagaagaaaugacaaacuccagauuuccaauaccauuagaaaaacuauuuacaggaccauccucagcuuuuguaguacaaccacaaaauggaagaugcacaacagauggaguacuuuuaggaaccacacaauuaucaccuguaaacaucugcaccuuuagaggagacguaacacacauaccuggaucaagaaauuacacaaugaaucuagcuagucaaaacuggaacaguuacgauccuaccgccgaaauucccgcaccucuagguacaccagacuucgucggaaaaauacaaggcguucuaacacaaaccacacgcacaaacggcucaaccagaggacauaaagcaacaguauacacagguucugcagauuuuucccccaaacuaggacgaguccaauucgccacugauacagauaaugauuucgaaacaaaccaaaauacaaaauuuacaccaguugguguuauccaagacggaucaacuaccccaagaaaugaaccacaacaauggguauuaccaucuuauucaggaagaaacauacauaacguucaucucgccccugcaguugcaccaaccuucccuggugaacaauuauuauucuuuagaucaacaaugccaggauguucuggauauccaaauauggauuuagacugucuucuaccacaagaauggguacaauacuucuaucaagaagcagcaccagcacaaucagacguagcacuccuacgauucguaaacccagacacaggacgaguacuauucgaauguaaacuacacaaaucaggauacguaacaguagcacacacaggccaacacgaucuaguaauaccaccuaacggauacuuuagauucgauuccuggguaaaucaauuuuacacacuagcuccaaugggaaauggcacuggcagacgucgcuaa

SEQ ID NO: 34558 - RNA, 1617 nt, Artificial Sequence
  derived and/or modified sequence opt6 from VP1__Norovirus_and/or_Norovirus-like__AB504309
augaaaauggcaucuaaugacgcgucuccaucugauggaucaacagcuaaccuuguaccagaaguaaauaaugaaguaauggcauuagaaccaguagucggugcagcuauagcagcaccaguugccggacaacaaaacguuauagacccauggauaaggaauaacuuuguacaagccccuggaggugaauuuaccgucucaccaagaaaugcacccggagaaauacuauggucugccccucuaggcccagaucuaaauccauaucuaucccaucuagcacguauguauaauggauacgcaggaggauuugaaguacaaguaauauuagcaggaaaugcauucacugcaggaaaaauaauauuugcagcaguacccccaaacuuucccaccgaaggacuaucaccaucccaaguuacaauguucccucacauuauaguagacguaagacaauuagaacccgucuuaauaccacuaccagauguaagaaauaauuuuuaucauuauaaucaaagcaacgauucaacaauaaaauuaauagcuaugcuauacacaccauuaagagcaaacaaugcaggagacgauguuuuuacaguuucuugcagaguauuaacacguccaucaccagauuucgacuuuauauuuuuaguaccuccuacaguugaaucccgaacuaaaccauucacagucccaauucuaacaguagaagaaaugacaaacucuagauuuccaauuccucuagaaaaacuauuuacuggaccaucaucagcuuucguaguacaaccacaaaauggaagauguaccacugacggaguauuacuaggaacaacacaauuauccccuguaaauauaugcacuuuuagaggagacguaacacauauaccaggaacaagaacauauagaaugaaucucgcaucccaaaacuggaacaacuacgauccaacagaagaaauaccagcaccauuaggaacaccagauuuugucggaaaaauacaaggaguauuaacacaaaccacaagaggugacggcucaacacgaggacacaaagccacaguaucaacuggaucaguagacuuuacaccaaaacuaggaucaguucaauuugcaacugacaccgauaaugauuucgaaaccggacaaaauacaagauucacacccguaggaguuauacaagaugguuccuccgcacacagaaaugaaccacaacaauggguacuaccagauuacuccggaagaaccguccauaauguccacuuagcaccagcaguugcaccuacuuuuccaggagaacaauuacuguucuuuagauucacaaugccugguugcucuggauacccaaacauggaccuagauugccuacucccucaagaauggguacaacacuucuaccaagaggcugcaccagcccaaucagacguugcauuacuacgcuucguaaauccugacacaggccgaguauuauuugaauguaaacuacacaaaacaggauauguaaccgucgcacacacuggacaacaugaccucguaaucccaccaaacggcuauuuuagauucgauucauggguaaaucaauuuuauacacuagcaccaaugggaaauggugcaggaagacgaagauaa

SEQ ID NO: 34559 - RNA, 1617 nt, Artificial Sequence
  derived and/or modified sequence opt6 from VP1__Norovirus_and/or_Norovirus-like__KX514216
augaaaauggcaucaaaugacgcaaauccaucagauggaucagcagcaaauuuaguaccagaaguaaacaaugaaguaauggcucuagaaccaguaguaggugcagcaaucgccgcaccaguagccggucaacaaaacguuauagauccuuggauuagaaacaauuucguccaagcucccggaggcgaauuuaccgucucaccacgaaaugccccaggagaaauauuauggucagcaccacucggaccagaccucaauccauaucuaucacaucuagcaagaauguauaacggauacgcaggaggauucgaaguacaaguaauacuagcaggaaaugcauucacugcaggaaaaaucauauuugccgcaguaccaccuaauuuuccaacagaagguuuaucaccuucacaaguaacaauguuuccacauaucauugucgauguaagacaauuagaaccaguacuaauaccccuaccagaugucagaaacaacuuuuaccacuacaaucaaucaaaugacucaacaauaaaauuaauagcuaugcucuauacaccucuaagagcaaauaaugcaggagaugacguuuuuacaguuagcugccgaguuuuaacaagaccuuccccagacuuugauuuuauauuccuaguaccaccaacaguagaaucaaggucaaaaccuuuuucaguaccaguauuaacaguagaagaaaugacuaacucacgauuuccagcaacauuagacaaacuauucaccggcccauccaguacauucguuguacaaccucaaaaugguagaugcaugauagacggaguacuuuuaggaacaacccaacuaucaccaguuaauauauguacauucagaggagacguuacacauuuaagagauuccccuauauacacaaugaaucucgcaucuccaaacuggaauaacuacgauucuacagaagaaauacccgcaccucuuggcacuccugauuuuguagguaaaauacaaggaguguuaacacaaacaacaaaaggcgaaggaucaacaagaggucacagagcuacaguuuauguaggaucagcaaacuacacaccaaaacuuggaaaaguacaauuugaaaccaauacaacaaacgaucuauaugcucaucaaaauacaaaauucacaccaguaggaguaguacaaggaggagaaucagcucauagauccgaaccacaacaauggguuuugccuggauauucagguagagauaccccaaacguucaucuagcuccugcaguugcaccaacauuuccaggagaacaacuacuauucuuuagaucaacaauacccggcuguggaggacacccaaauauggauuuagacugcuuacuaccccaagaauggguucaacauuucuaccaagaagcagcaccagcacaaucugacguagcccuccuaagauucguaaauccagauacaucacguguacuauucgaaugcaaauuacacaaaucuggauauguuacaguagcccacacaggccaacacgaucuuguuauaccaccaaacggauauuucagauucgauucauggguaaaccaauuuuauacacuagcuccaaugggaaauggcacaggaagaaaacgauaa

SEQ ID NO: 34560 - RNA, 1617 nt, Artificial Sequence
  derived and/or modified sequence opt6 from VP1__Norovirus_and/or_Norovirus-like__KX514212
augaaaauggcuucaaaugacgccaauccauccgaugguagugcagccaauuuaguaccagaaguaaauaaugaaguaauggcacuagaaccagucguaggagccgccauagcagcaccuguagcaggacaacaaaauguaauagauccauggauacgaaacaauuuuguacaagcaccaggaggagaauuuaccguaucaccaagaaaugcaccaggagaaauauuauggucagcaccauuagguccagaauuaaacccauaccuaagccaucuagccagaauguacaacggauaugcaggaggauucgaaguacaaguuauauuagccggcaaugccuuuacagcuggaaaaauaaucuuugcagcaguaccaccuaauuuuccaacagaaggcuuaucacccucacaaguaacaauguuuccccacauaauaguugaugugagacaauuagaaccugucuuaauuccguuaccagauguuagaaacaauuucuaccacuacaaucaaucaaaugauucaacaaucaaacuaauugccauguuauauacaccauuaagagcaaauaaugcaggagaugacguuuucacaguaucuuguagaguucuaacuagaccuuccccagauuuugauuuuauauuccuuguaccaccaacagucgaaucacgaucaaaaccauuuucuguuccaguacuaacaguacaagaaaugacaaacucucgcuuuccagccacuuuagacaaacuuuuuacaggaccaaguucaaaccucguaguucaaccccaaaacggaagauguaugauugacgguguucuacuaggaaccacccaacuaucaccaguuaauauaugcaccuuccgaggagacguaacacacccacgcgacucuccaaucuauacaaugaaccuagcaucaccaaacuggaauaauuacgacccaaccgaagaaauacccgcuccacuaggaaccccagacuucguaggaaaaauucaagguguauuaacacaaacaaccaaaggagaaggauccacacgaggacauagagcuacggucuauguagguucugcaaauuacaccccuaaacuuggaaaaguccaauuugaaacaaauacaacaaaugaccuuuaugcacaccaaaacacaaaauucacaccaguagguguuguacaaggaggagaaucagcccaccgaucagaaccacaacaauggguacuaccaggauauucugguagagauacaccaaauguucauuuagcuccugcaguagcaccuacuuuuccaggcgaacaacuacuauucuuuagaucaacaauaccaggaugugguggacauccuaacauggaucucgacugucuacuaccacaagaauggguucaacacuuuuaucaagaagcagcaccagcacaaucagaugucgcucuacuaagauucguaaacccagauacuucaagaguuuuauucgaauguaaacuucauaaaucagguuacguuacagucgcacauacaggucaacaugaccuaguaauaccaccaaauggauacuuucgcuuugauucauggguaaaucaauucuauacuuuagccccaaugggaaauggaaccggaagaaaacgauaa

SEQ ID NO: 34561 - RNA, 1617 nt, Artificial Sequence
  derived and/or modified sequence opt6 from VP1__Norovirus_and/or_Norovirus-like__KX354138
augaaaauggcaucaucagacgcaaacccaucagacggauccgccgcuaacuuaguaccagaagcuaacaaugaaguaauggcccuugaaccaguagucggagcagcaauagcagcaccaguagcaggacaacaaaaugucauagacccauggauaagaaauaauuuuguccaagccccagguggagaguucacuauuagcccacguaaugcaccuggagaaauucuaugguccgcuccacucggcccagauuuaaaucccuauuuaucccaucuugcacgaauguauaacggauacgcaggaggauucgaaguacaaguaauacuagcagguaaugcauuuacagcaggaaaaguaauuuucgcugcaguaccaccaaacuuuccaacagcaggauuaucaccaucccaagucacaauguuuccauccauugucguagacguacgacaacuugaaccuguauuaauaccacuaccagaugucagaaauaauuuuuaucauuauaaccaaaguaacgauccuacaauaacauuaaucgcuaugcuuuauacaccacuaagagcuaacaaugcaggagacgacgucuucacaguaucaugcagaguauuaacaagaccaucaccagacuucgauuucauauucuuaguaccaccaacaguagaaucuagaacaaaaccauuuagcguacccguucuaacagucgaagaaaugacuaauucccgauucccuauaccuuuagaaagauuguuuacaggaccuuccucagcuuucgucguacaaccacaaaacggaagauguacaacagauggaguucuauuaggaacaacucaacuaucacccgucaauauuuguacauuuagaggagauaucacacacaucacaggaucccauaauuacacaaugaauuuagcaucucaaaacuggaauaacuacgauccaaccgaagaaauaccagccccauuaggaacaccagacuuugucgguaaaauacaaggaguacucacucaaacaaccagaggagacggaucaacaagaggacacaaagcaaccguauauaccggaucagcugacuucagcccaaaacuaggaagaguucaauucgaaaccgauacaaaucaugacuuugaagcaaaucaaaauaccaaauucacaccuguuggaguuauacaagacgguucaacaacucaucgcaaugaaccccaacaaugggucuuaccaucuuacucuggacgaaauacacauaacguacaucuugcacccgcaguagcacccacauucccaggagaacaauuacuuuucuucagauccacaaugccaggaugcucuggauaucccaauauggauuuagacugucuuuugccucaagaauggguacaauauuucuaucaagaagcagcuccggcacaaucagacgucgcacuauuaagauuuguuaauccagauacaggcagaguccucuucgaaugcaaacuacauaaaucaggauacauaacagucgcacacacaggacaacacgaucuaguaauaccaccuaauggauauuuuagauuugauucauggguuaaucaauuuuauacguuagcaccaaugggaaaugguacaggacgaagacgauaa

SEQ ID NO: 34562 - RNA, 1617 nt, Artificial Sequence
  derived and/or modified sequence opt6 from VP1__Norovirus_and/or_Norovirus-like__AB933747
augaaaauggcuucaagugaugcaaauccauucgacgguucaaccgcaaaucuaguaccagaaguaaauaaugaaguaauggcauuagaacccguuguaggagcugcaauagccgcacccguagcaggacaacaaaaugucauagacccuuggauaagaaauaauuuuguacaagcaccaggaggugaauuuacagucucucccagaaacgccccuggagaaauauuauggagugcaccacuagguccagauuuaaauccauacuuaucacaccuaucaagaauguacaacggauacgcuggaggauuugaaguacaaguaauuuuagccggaaaugcauuuaccgccggaaaaauaauauuugcagcagucccaccaaauuuuccaaccgaaggacuaucuccaucccaaguaacaauguuuccucauauaauuguugacguaagacaacuugaaccaguacuaauaccucuacccgacguccgaaacaauuuuuaccacuacaaccaauccaaugacccaaccauuaaauuaauugcuaugcuauauacaccucuaagagcaaauaacgccggagaugacgucuuuacaguaagcuguagaguccucacuagacccucacccgauuucgacuuuauauuccuaguaccuccaacaguugaaucuagaacaaaaccauuuucaguuccaguauuaacaguugaagaaaugacaaauuccagauuuccaauaccuuuagaaaagcuauuuacagguccaucuagugcauucguaguacaaccacaaaauggaagaugcacaacugauggaguacuacuuggaaccacucaauuaucuccagugaauauuugcacauuuagaggagacguuacacauauaccagguucuagaaacuauacaaugaaucuagccucucaaaacuggaacucauacgaccccacagaagaaaucccagcaccccuuggaacaccagacuuuguaggaaagauucaaggaguauuaacacaaaccacaagaaccaacggaucaacucgaggacacaaagccaccgucuauacaggauccgcugacuucucaccaaaacuuggcagaguacaauuugcaacagauacagauaacgauuuugaaacaaaucaaaauacaaaauucacuccaguaggaguaauccaagaugguucuacaacuccacgaaacgaaccacaacaauggguucuaccaagcuauagcggacgaaauauacauaauguccacuuagcaccagcaguagcacccacauucccaggagaacaauuauuauucuuuagaucaacaaugcccggauguucaggauauccaaacauggauuuagacugcuuauugccccaagaauggguacaauauuuuuaccaagaagcagcuccagcacaaucagauguugcauuacucagauuuguaaauccugacacaggaagagucuuauucgaauguaaacuacacaaaucuggauauguuacaguagcucauaccggacaacacgaccuaguuauaccaccaaacggauauuuuagauucgauucauggguaaaucaauuuuacacacuugcucccaugggaaacggcacuggaagacguagauaa

SEQ ID NO: 34563 - RNA, 1617 nt, Artificial Sequence
  derived and/or modified sequence opt6 from VP1__Norovirus_and/or_Norovirus-like__KJ955493
augaaaauggcaaguuccgacgcaaauccuucugauggauccgcagcaaaccuaguaccugaaguaaacaaugaaguaauggcacuagaaccuuuuguuggagcagcuauagcugcaccgguagccggacaacaaaauguuaucgauccuuggauacgaaauaauuucguacaagcaccaggcggagaauuuacaguaagcccgagaaaugcaccuggagaaauacucuggucagcuccacuaggaccagauuuaaauccauaucuaucacacuuagcaagaauguauaacggauaugcaggagguuucgaaguacaaguuauacuagcaggaaaugcuuucacagcaggaaaaguaaucuucgcagcaguaccacccaacuuuccaacugaagguuuaucaccaucacaaguuacaauguuuccacacauaguaguagacguaagacaauuagaacccguacuaauaccacucccagauguaagaaauaauuuuuaucauuauaaucaaucuaaugacccaacaauaaaauuaauagcaauguuauauacaccauuaagagcaaauaaugcaggagaugacgucuucacugucucaugucgcguauuaacuagacccagcccagauuuugauuuuauauuucuuguacccccaacaguagagucuagaaccaaacccuucucaguccccguuuuaacagucgaagaaaugacaaacucuagauuuccaauuccauuagaaaaacucuuuacuggaccaucaucagcuuucguaguccaaccacaaaauggccgaugcacaacugacggaguacuacucggaacaacacaauuaucucccgucaacauauguaccuucagaggagauguaacccacauaacaggaucacgaaauuacacaaugaaucuagcaagccaaaacuggaacaauuaugaccuaacagaagaaaucccagcaccacuaggaacuccagauuuuguaggcaaaauucaagguguacuaacucaaacaacaagaacagaugguaguacuagaggacacaaagcaacaguauauacaggcucagcagauuuugcuccaaaacuaggacgaguccaauuugaaacagauaccgaccaugauuucgaagcaaaucaaaauacuaaauucaccccaguaggcguaauacaagaugguggaacuacacaucgaucagaaccacaacaauggguucuacccuccuacucaggaagaaauacuccaaacguacaucuagcuccugcaguugcaccaacauucccuggugaacaacuacucuucuuuagaucaacuaugcccggaugcucugguuauccaaacauggacuuagacuguuuacuaccacaagaauggguacaauauuucuaucaagaagcagcaccagcacaaucagacguagcuuuacuaagauucguaaauccagauacaggcagaguauuauuugaaugcaaauuacauaaauccggauacguaaccgucgcccacacaggacaacacgaucuaguaauuccaccaaaugguuauuuuagauucgauaguuggguaaaccaauucuacaccuuagcaccaauggguaauggcaccggaagaagacgauaa

SEQ ID NO: 34564 - RNA, 1617 nt, Artificial Sequence
  derived and/or modified sequence opt6 from VP1__Norovirus_and/or_Norovirus-like__KJ678153
augaaaauggcaucauccgaugccaauccuuccgauggaucagccgcuaacuuaguuccagaaguaaacaaugaaguaauggccuuagaaccaguagucggagcugcaauugcagccccaguagcaggccaacaaaauguaauagauccguggauuagaaacaauuuuguacaagcaccaggaggugaauuuacaguaaguccaagaaacgcacccggagaaaucuuauggucugcaccacuaggaccagacuuaaaucccuauuuaucacaucucgcaagaauguacaacgguuacgcaggagguuuugaaguccaagucauucuagcaggaaacgcuuuuacagcuggcaaagucauauucgcagccguaccaccaaacuuuccuacagaaggucuaucaccaucccaaguaacaauguucccccacauaguaguagauguaagacaauuagaaccaguacuaauaccauuaccagauguaagaaauaauuuuuaucacuacaaccaauccaaugacucaacaauaaaacuaaucgcaauguuauauacuccacuaagagccaacaaugcuggugacgacgucuuuaccguaucuugucgaguauuaacaagaccaucaccugacuucgacuuuauauuucuagucccaccaacaguagaaucaagaaccaaaccauucucagucccaguacucacaguagaagaaaugacaaacuccagauuuccaacaccucuagaaaaacuauuuaccggaccaucaucagcauuuguaguacaaccucaaaauggcagauguacuacugacggaguauuauuagguacaacacaacuaucucccguaaauaucuguacauucagaggagacguaacucacauaacuggaucaagaaauuauacgaugaauuuagcuucacaaaauuggucaaauuacgaucccaccgaagaaauaccagcucccuuaggaacaccugacuuugucggaaaaauucaaggaguucuuacacaaacaacacgcacagacgguucaacacgaggacacaaagcuacaguauauauaggaucagcagauuucgcaccaaaacuaggaagaguucaauucgaaacagacaccgaucaugauuuugaaacaaaucaaaacacaaaauucacaccaguuggaguaauccaagacgguucuacaacacacagaaacgaaccacaacaauggguuuuaccaucauauaguggcagaaacacaccaaacguacauuuagcaccagccgucgcuccaacauuuccuggagaacaacuauuauucuuuagaucaacauuaccaggcuguucaggcuaucccaauauggaucuagacuguuuauuaccacaagaauggguacaauacuucuaucaagaagcagccccagcucaaucagacguugcauuauuacgauucguuaauccagauacuggacgaguccuauucgaaugcaaacuacauaaaucagguuacguaaccguagcacacacaggucaacacgacuuaguaauaccaccaaacggcuauuucagauucgauucauggguaaaucaauuuuauaccuuagcuccaaugggaaauggcacaggcagaagaagauaa

SEQ ID NO: 34565 - RNA, 1617 nt, Artificial Sequence
  derived and/or modified sequence opt6 from VP1__Norovirus_and/or_Norovirus-like__KC456071
augaaaauggcaucaucagacgcaaacccuccagaugguucugccgcaaauuuaguaccuaaaguaaauaaugaaguaauggcuuuagaacccguaguuggugcagcaauagcagcaccuguagcaggacaacaaaacguaauugauccauggauuaaaaauaacuuuguacaggccccaggaggcgaauuuaccguuucaccuaaaaacgccccaggagaaauauuauggucugcaccacuaggaccagaucuaaauccauauuuaucccacuuagcaagaauguauaacgguuaugcugguggauucgaaguccaaguaauauuagcagguaaugcauuuacagcaggcaaaguaauauucgcagcaguaccuccgaacuuuccaacagaaggauuaucaccaucacaaguaacaauguucccucacaucguaguagacguaagacaacuagaaccaguacuaauuccauuaccugacguaagaaauaauuuuuaccacuacaaucaaucaaacgaccccacaauaaaacuaauagcaaugcuuuauacaccucuaagagcaaacaaugcaggagacgauguauuuaccgucucauguagaguacuaaccagaccaucccccgauuuugacuucauauucuuaguaccaccaacuguagaaucacgaacaaaaccauuuucaguaccuguccuaaccguagaagaaaugacaaacucaagauucccaauacccuuagaaaaacuauuuacaggaccaucuucagccuuuguaguucaaccacaaaacggaagaugcacuacagacgguguauuauuagguaccacacaacuaucacccgucaauauuugcacuuucagaggagauguaacacauauaacaggaucucgaaauuauacaaugaaucuagcaagccaaaauuggaauaacuaugauccaacagaagaaauuccagcaccauuagguacaccugauuuugucggaaaaauacaaggaguacucacacaaacaacuagaacugacgguucuacaagaggacacaaagcgacaguauauacaggaucugccgauuuugcuccaaaauuaggcagaguacaauucgaaacagauacagaucacgauuucgaagcuaaucaaaauacaaaauuuacuccaguuggaguaauacaagauggaagcacaacacauagaaacgaaccacaacaauggguacuaccaucauauucaggaagagauacccacaacguacacuuagcuccugcaguagcaccuacauucccaggagaacaauuauuauucuuuagaucuacaaugccagguugcucuggauauccuaauauggaucuagauugccuuuuaccacaagaauggguacaauacuuuuaccaagaagcagcccccgcacaaucugauguagcauuauuaagauucgucaacccugauacaggacgaguauuauucgaaugcaaauuacacaaaucaggauauguaacuguagcacacacuggccaacacgaucuaguaauaccuccaaacggauauuucagauucgauuccuggguaaaccaauuuuauacccuagcaccaaugggaaauggaacagguagacgaagauaa

SEQ ID NO: 34566 - RNA, 1617 nt, Artificial Sequence
  derived and/or modified sequence opt6 from VP1__Norovirus_and/or_Norovirus-like__KC175384
augaaaauggcauccuccgacgcaaacccaucagaugguucaacagcaaaccuagucccugaaguuaauaaugaaguaauggcucuagaaccaguaguaggagccgccauagcagccccagucgcaggacaacaaaacguuauagacccauggauacguaacaacuuuguacaagcacccggaggagaauuuacaguaucuccaaggaaugccccaggcgaaauucuauggucagcaccauuaggaccagaucuaaacccauaucucucacaccuagcacgaauguauaacggauaugcaggaggauucgaaguacaagugauacuagcaggaaacgcauucacugcaggaaaaauaaucuuugcagcaguaccaccaaacuucccaacugaaggauuaucaccaucacaaguaaccauguuuccacacauaauaguagaugucagacaacuugaaccaguucuaauaccacuaccagauguacgaaacaacuucuaccauuauaaucaauccaaugauccuacaauaaaacuaauagcaauguuauauacuccacuuagagcuaacaaugcaggagacgacgucuucacuguaucaugccgcguacucacuagaccaucuccagacuuugacuucauuuuucuaguacccccaacaguagaaucaagaacaaaaccuuucucaguaccuguacuuacaguugaagaaaugacaaauucacgauuccccauuccauuagaaaaacuauuuacagguccaucaucagcuuucguaguacaaccccaaaacggaagaugcacaacagacggaguacuacuaggaacaacacaauuaucaccuguuaauauuugcacauuucgaggagacguuacacauaucccuggaucacgaaauuauacaaugaauuuagcaucucaaaauugggauucauacgaccccacagaagaaacaccagcaccccucgguacaccagacuuugucggaaaaauacaaggaguauuaacucaaaccacaagaacuaauggaucuacaagaggacauaaagcaacaguauauacagguagcgcugauuuuucaccaaaacuaggacgaguacaauucgcaaccgauacagacaacgacuuugaaacaaaucaaaacacuaaauucacaccaguaggaguaauacaggacgggucaaccacaccaagaaaugaaccccaacaauggguuuuaccaucuuauuccggacgaaauauacauaauguacauuuagcaccagcaguagcaccaacuuuucccggagaacaauuauuauucuucagaucaacaaugccaggcugcuccggauauccaaauauggacuuagauugccuccuuccccaagaauggguacaauauuuuuaccaagaagcagccccugcacaauccgacguagcacuacuaagauucguuaacccugacacuggaagaguacuauuugaaugcaaacuacauaaaucaggauauguaacaguagcacauacaggucaacaugacuuaguaauuccuccaaacggauauuuuagauuugauucaugggucaaucaauuuuauaccuuagcaccaauggguaauggaacuggaagacgacgcuaa

SEQ ID NO: 34567 - RNA, 1617 nt, Artificial Sequence
  derived and/or modified sequence opt6 from VP1__Norovirus_and/or_Norovirus-like__JQ613561
augaaaauggcaaguucagaugccaacccauccgacggaucuacagcuaacuuaguacccgaaguaaacacagaaguaauggcauuagaacccguugucggagccgcaauagcagcaccagucgcaggacaacaaaauguaaucgauccauggauaagaaauaauuucguucaagcaccaggcggagaauuuacuguauccccaagaaaugcuccaggagaaauacuauggucagcuccucucggucccgaucuuaauccauaccucucucaccuagcacguauguauaaugguuacgccggcggcuucgaaguacaagucauauuagcaggaaacgcauuuacagcaggaaaaauaauauucgcugcaguaccaccaaacuuuccaacagaaggauuaucaccuucacaagucacaauguuuccucacauaauaguagauguaagacaacuugaaccaguacucauaccauuaccagacguaaggaacaacuucuaucacuauaaucaaucaaaugauccaaccauuaaauuaauugcaauguuauacacaccauuaagagccaacaaugcaggagaugacguauuuacgguaucaugcagaguacucacacgcccauccccagacuuugacuucauauuccuaguaccaccaacaguagaaucccgaacuaaaccauuuuccgucccaguauuaacaguggaagaaaugacaaauucacgcuucccuauacccuuagaaaaacuauucacaggacccuccucagcauuuguaguacaaccucaaaacggacgcuguacaacagaugguguacuacuaggaaccacacaauuaucaccugucaauauuuguacauucagaggagauguaacacauauaccaggcucucgaaacuauacuaugaaucuagcaucccaaaacuggaacucauacgauccaacugaagaaauaccugcaccacuaggaacacccgauuuuguuggcaaaauacaaggaguacuaacacaaacaacacggacaaaugguucaacaagaggacacaaagcaacaguauauacaggaucagccgauuucucaccaaaacuaggacgaguccaauucgcaacagauacagauaacgacuuugaaacaaaccagaacacaaaauucaccccaguaggaguaauccaagacggauccacaacaccacgcaaugaaccacaacaauggguacucccuuccuauaguggacgaaacauucauaacguacaccuugcucccgccguugcaccaacauuuccaggagaacaacuauuauucuuuagaucaacaaugccaggcugcucuggauauccaaacauggaucuagauugcuuacuaccacaagaauggguucaauauuucuaucaagaagcugcaccagcacaaucagacgcagcacuauuaagauucguaaauccagacacagguagaguauuauuugaaugcaaauuacacaaaucaggcuauguuacaguagcacacacuggacaacacgaucuaguaauaccucccaauggauauuucagauuugauucauggguaaaucaauucuacacacuagcaccaaugggcaauggaaccggaagaagaagauaa

SEQ ID NO: 34568 - RNA, 1617 nt, Artificial Sequence
  derived and/or modified sequence opt6 from VP1__Norovirus_and/or_Norovirus-like__KJ678145
augaaaauggccaguucagaugcaaauccaucagacggaagugccgcaaaucuaguuccugaaguaaauaaugaaguaauggcccucgaaccuguaguaggcgcugcaauagcagcaccagucgcaggacaacaaaauguuauagauccauggauaagaaacaauuuuguacaagcaccuggaggugaauuuacaguaucaccaagaaacgccccaggcgaaauacuuuggagcgcaccacuaggcccagacuuaaauccauaccucagucauuuagcaagaauguauaauggauaugcaggaggauucgaagugcaagucauacuagcagguaacgcuuucacugccgguaaaguuauauucgcugcaguaccaccaaauuuuccaacagaaggauuaagcccuucucaaguuacaauguuuccucauauaguaguugacguaagacaacuagaaccagugcuaaucccuuuaccugauguaagaaacaauuuuuaucauuauaaccaaucaaaugauucuaccauaaaauuaauagcuaugcuuuacacaccacuucgagcgaauaacgcuggugacgauguauuuacaguuucauguagaguauuaacacgaccaaguccagauuucgauuuuauauuuuuaguaccaccaaccguagaaucaagaacaaaaccauuuucaguaccaguauuaacaguugaagaaaugacaaauucaagauuuccaaccccuuuagaaaaauuauuuacaggaccuaguucugcauuuguaguacaaccccagaauggaagauguacaaccgacgguguauuacuaggaacuacacagcuaucaccuguaaauauauguacauuuagaggcgacguaacacacauuaccgguucucgaaauuacacuaugaaccuugcaucacaaaacuggucaaauuacgauccaacugaagaaauuccagcaccuuuaggaacaccagacuucguaggaaaaauucaaggaguacuuacacaaacaacaagaacagacggauccacaagaggccauaaagcaacaguauauaccggcuccgcagauuuugcaccaaaauuaggcagaguucaauucgaaacagauacugaucacgauuuugaaaccaaucaaaauacuaaauuuacaccaguaggaguaauacaagacggaucaacaacacacaggaaugaaccacaacaguggguucuacccucauauucuggaagaaauacccccaauguacaucucgcaccagcaguagccccaacauucccaggagaacaauuauuauucuuuagauccacuaugccaggauguucuggcuaucccaacauggaucucgacugucuuuuaccucaagaauggguacaauacuuuuaucaagaagcggcaccagcccaaucagacguagcacuauuaagauuuguaaauccagauacgggaagaguauuauuugaauguaaacuacacaaguccggauauguaacaguagcucacacuggacaacacgaucucguaauaccaccaaauggauauuuuagauuugaaaguuggguaaaucaauuuuauacauuagcuccuaugggaaauggaacaggaagacguagauaa

SEQ ID NO: 34569 - RNA, 1617 nt, Artificial Sequence
  derived and/or modified sequence opt6 from VP1__Norovirus_and/or_Norovirus-like__KF060116
augaaaauggcaagcucagaugcaaauccuucugauggcucaacagcaaaucucguacccgaaguaaacaaugaaguaauggcacuagaaccugucguaggggccgcaauagcagcaccuguagcaggacaacaaaauguaauagauccauggauaagaaauaacuuuguccaagcuccuggcggagaauuuacaguaucgccuagaaaugcaccaggcgaaauuuuauggucagcaccucuaggaccagaccuuaauccauaucuaucacacuuagcccgaauguauaacgguuaugcaggaggauucgaaguacaaguaauacucgcaggaaacgcauucacagcaggaaaaauaauauuugcagcaguaccucccaacuuucccacagaaggauuauccccaucacaaguuacaauguuuccucauauaauuguugacguaagacaacucgaaccaguccuaauaccauuaccagaugucagaaacaauuucuaucacuacaaucaaagcaacgacuccacaauaaaacuaaucgcaauguuauacacaccacuuagagccaacaaugcaggagacgacguauuuacugucuccugcagaguacuaacaagaccaucaccagacuuugauuuuauuuuucuaguuccaccaacaguagaaucacgaacuaaaccauucaguguaccuauauuaacaguagaagaaaugacaaacucaagauuuccaauacccuuagaaaaauuauuuaccggaccaucuucagcauucguaguucaaccacaaaauggacgauguacaacagauggaguacuauuaggaacaacacaacuaucuccaguaaauauauguacuuucagaggagauguaacucauauaccaggaucacacaauuauacaaugaaucuagccucccaaaauuggaacucauaugauccaacagaagaaacuccagcaccauuaggcacaccugauuuuguaggaaaaauacaagguguucucacucaaaccacuucaacaaaugguuccacuagaggucauaaggcaacaguauauacuggaucugccgacuuuuccccaaaacuaggaagaguacaauuugcuacagacacuaauaacgauuucgaaacaaaccaaaacacuaaauuuacuccuguaggcgucauacaagauggaaguacaacaccaagaaaugaaccacaacaauggguacuaccauccuacucuggucgcaauauucauaauguacauuuagcaccagccguugcaccuacauucccaggagaacaacuuuuauucuuuagaucaacaaugccaggauguucaggauacccuaauauggauuuagauugcuuacuuccacaagaauggguccaauacuucuaucaagaagccgcaccagcccaaucugacguagcacuuuuacgauucguaaacccagacacuggccguguauuauucgaaugcaaacuacauaaaucaggguauguaacuguagcacauacaggacaacacgauuuaguuauaccaccuaacggcuauuuucgcuuugauucuuggguaaaccaauucuacacacucgcaccuaugggaaacggaacuggacgaagacgauaa

SEQ ID NO: 34570 - RNA, 1617 nt, Artificial Sequence
  derived and/or modified sequence opt6 from VP1__Norovirus_and/or_Norovirus-like__KC517362
augaaaauggcaucuucugacgcaaauccaucagauggaucagcagcaaaucucguaccagaaguaaacaaugaaguaaucgcacuagaaccaguaguaggagcagccauagcagccccaguugccggccaacaaaauguaauagauccauggauuagaaauaauuucguacaagcaccagguggagaguucacuguaucaccaagaaacgcuccaggagaaaucuuauggucagccccacucggaccagacuuaaacccuuacuuaucacaccuugccagaauguauaauggcuaugcuggaggcuuugaaguacaaguaauauuagcaggcaaugcauuuacugcaggaaaaguaaucuuugcugcaguaccaccaaauuuuccaacagaaggauuauccccaucacaaguaacuauguucccacacauugucguagacguacgccaacuagaaccaguauuaauaccuuuaccugaugucagaaauaacuuuuaccacuauaaucaaucgaaugacccaacaauaaaacuaauagcaauguuauacacuccauuaagagcaaauaaugcaggagaugauguauuuacagucucaugucgaguacuaacaagaccaucaccagacuuugauuuuauauuccuaguaccuccaaccguagaaucaagaacaaaacccuuuucagucccuguauuaacaguagaagaaaugacaaacucccguuuuccuauaccauuagaaaaacuuuuuaccggacccagcucagcauuuguaguacaaccucaaaacggcagauguacuacugauggaguucuacuaggaacaacacaauuaucuccugucaauauauguacauuuagaggugacauagcacauauaacaggaucacgaaacuauacaaugaacuuagcaucccaaaauuggaauaauuacgaucccaccgaagaaauaccagcaccauuaggaaccccugauuuuguaggaaaaauacaaggcguauuaacacaaacaacacguaccgauggaucaacuagaggucacaaggcuacaguauauacaggaucagcugauuuugcaccuaaacuaggacgaguacaauuugaaacagacacagaccaugacuucgaagcaaaucaaaauacaaaauucacucccguuggaguaauacaagaugguggaacuacacaucgaaaugaaccacaacaauggguauugccaucauauucuggacguaacacacauaacguacacuuagcuccugcagucgcaccaaccuuucccggugaacaacuacuauucuuccgaucaaccaugccaggauguucugguuauccaaauauggaucuagauuguuuauuaccucaagaauggguacaauacuucuaucaagaagcagcaccagcacaaucugauguugcacuauuacgauucguaaacccagauacagguagaguacuauucgaauguaauuuacacaaaucaggcuacguaacuguagcacacacaggucaacacgauuuaguaauaccaccaaauggcuauuuuagauuugacucauggguaaaucaauuuuacacacuagcuccaaugggaaacggaaccggacgaagaagauaa

SEQ ID NO: 34571 - RNA, 1617 nt, Artificial Sequence
  derived and/or modified sequence opt6 from VP1__Norovirus_and/or_Norovirus-like__JX644038
augaaaauggcaucuucugacgcuaauccauccgauggaucuacugcuaacuuaguaccagaaguaaacaaugaagucauggcacuagaaccaguaguaggagccgcaauagcagccccugucgcaggacaacaaaacguaauugacccuuggauaagaaauaacuuuguacaagcaccaggaggugaauuuacagucucaccaagaaaugcacccggcgaaauucuauggagcgcaccacucggacccgauuuaaauccauaucuaucucaccuagcuagaauguauaacggauaugcugguggauuugaaguacaaguaauucuagcaggaaaugcauuuacugcaggcaaaaucauauucgcagcaguaccaccaaauuuccccacagaaggauuaucaccaucacaaguuacaauguuuccacacauaauaguugacguucgacaauuagaaccaguuuuaauuccucuaccagauguacguaacaauuuuuaucacuauaaccaaucaaaugauucaacuauaaaauuaauagcaaugcuuuauacuccauuacgagcaaacaaugccggugaugacgucuucacaguaucauguagaguacuaaccagaccaucuccagacuuugacuuuauauuccuaguaccaccaacagucgaaucacgaacaaaaccauuuucaguaccuaucuuaacuguagaagaaaugacuaacucucgcuucccuauuccacuagaaaaacuauuuaccgguccuucaagugcauucgucguccaaccccaaaacgguagauguacaacagacggaguauuauuagguacaacucaauuauccccaguuaauguuuguacauuuagaggagacguaacacauauaucaggaucuagaaacuauacuaugaaucuggcaucacaaaacuggacaucuuacgauccaacagaagaaauccccgcaccacuaggcacaccagacuucguagguaaaauucaagguguacuuacucaaacaacaagaacuaacggaucaacaagaggacacaaagcuacaguauauacaggaucagcagauuuuucaccaaaacuagguagaguacaauucgcaacagacacagauaacgauuuugaaacuaaucaaaauacuaaauucacccccguaggcguuauacaggacgguuccacaacuccaagaaacgaaccacaacaauggguacuaccaucauauucuggacgaaauauacauaauguacacuuagcaccagccguugcaccaacauuccccggcgaacaacuccuauucuuccgaucaacaaugccuggaugcuccggauauccaaauauggauuuagauugccuacuaccacaagaauggguacaauauuuuuaucaagaagccgcaccagcacaaucagacguugcccuacuccgauucguaaacccagauacuggacgaguauuauucgaauguaaacuccauaaaucaggauauguaacaguugcccauacaggacaacaugaccuaguaauaccacccaauggcuauuuucgauucgacaguuggguaaaucaauuuuauacacuagcaccaaugggcaacggaacaggaagacgacgauaa

SEQ ID NO: 34572 - RNA, 1617 nt, Artificial Sequence
  derived and/or modified sequence opt6 from VP1__Norovirus_and/or_Norovirus-like__AB504313
augaaaauggcaucaaacgaugcuucaccaagcgauggaucuacugcaaauuuaguaccagaaguaaauaacgaagucauggcauuagaaccuguaguaggagcagcaauagcugcacccguagcaggccaacaaaacguaauagaucccuggauacgcaacaacuuuguacaagccccuggaggugaauuuacaguaaguccaagaaaugcaccuggagaaauacucuggucagcaccuuuagguccagaccuaaacccauaucuaucacacuuagcaagaauguauaacgguuacgccgguggcuuugaaguucaagucauauuagcaggaaaugcauuuacagcaggaaaaauaauauuugcagcaguaccaccuaauuuuccaacugaaggucuauccccaucucaaguaacuauguucccacauauaauaguagacguacgccaauuagaaccaguacucauacccuuaccagaugucagaaacaacuuuuaucauuauaaccaaucaaacgauucuacaauaaaauuaauagcaaugcuauacacuccacuccgagcaaauaacgcaggagacgacguauuuacaguaucauguagaguauuaacaagaccuucaccagauuuugauuuuauuuucuuagucccuccuacuguagaaucucgaacaaaaccauucacuguaccaaucuuaacaguagaagaaaugacaaacucaagauuuccuauaccucuugaaaaacuauuuacagguccaucauccgcuuuuguaguacaaccacaaaacgguagauguacaacugacgguguauuauuagguacaacgcaauuaaguccaguaaacauauguacauucagaggugacgucacucauauaccaggaacuagaacauacagaaugaaccuagcuucccaaaacuggaauaauuaugauccaacagaagaaauaccagccccauuaggaaccccagacuucguugguaaaauacaaggaaugcuuacccaaacuacacgaggagacggauuaacaagaggacacaaagcaacagucucaacagguagcguagacuuuacaccaaaacuaggcuccguacaauuugcuacugauaccgauaaugauuucgaaacaggucaaaauaccagguucacaccaguagguguuauucaagaugguucgucugcacaucgaaacgaaccacaacaauggguauuaccagauuauaguggaagaacaguacauaauguacaccuagcuccugcaguagcaccuacauucccuggagaacaacucuuauucuuuagaucaacaaugccaggauguucaggauauccuaauauggaucuagauugcuuauuaccucaagaauggguacaacauuuuuaucaagaagcagcuccagcacaaucagacguagcacuauuaagauucguagacccugacacgggcagaguacuauucgaaugcaaauuacacaaaacaggauauguaacaguagcacacacaggacaacaugaucuaguaauaccaccaaauggauauuucagauuugauuccuggguuaaucaauuuuacacucucgcaccaaugggaaauggagccggaagaagaagauaa

SEQ ID NO: 34573 - RNA, 1617 nt, Artificial Sequence
  derived and/or modified sequence opt6 from VP1__Norovirus_and/or_Norovirus-like__KX514361
augaaaauggcuucaaaugacgcaaacccaucagaugggucugcagcuaaucucguacccgaaguaaacaaugaaguaauggcauuagaaccaguagucggagcagcuaucgcagcaccuguagcaggacaacaaaacguuauagauccauggauaagaaauaacuuuguacaagcaccaggcggcgaauuuacuguaucaccacgcaaugcaccuggugaaauauuauggucagcaccauuaggucccgaccucaacccauauuuaagccauuuagcccgaauguauaaugguuaugcaggaggcuuugaaguacaagucauauuagccgguaacgcauucacagcaggaaaaauuauauuugcagcaguucccccaaauuuuccaaccgaaggacuaucaccaucucaaguuacuauguuuccacauaucauaguagacguaagacaacuagaaccaguauuaauaccuuuaccagacgucagaaacaauuucuaucacuauaaucaaagcaaugacucuacaauaaaacuaauagcuauguuauauacaccacuaagagcaaauaacgcuggugaugauguuuucacuguaucaugccgaguacucacaagaccaucaccagauuuugauuuuauauuuuuaguuccaccaacagucgaaucuagaucaaaaccauucucaguaccaguacuaacaguugaagaaaugaccaauucaagauuuccagcaacauuagacaaacuuuucaccggaccaucuucaacauuuguagugcaaccacaaaaugguagaugcaugauugauggaguuuuacuuggaacaacacaacucucacccguaaacauuuguacguuuagaggagauguaacacauccacgagacucaaaaauauauacaaugaaccuagcaucacccaauuggaauaacuaugauccaaccgaagaaauaccagcaccucuagguacaccugauuuugucgguaaaauccaaggaauguuaacacaaacaacaaaaggugaaggcuccacacgaggucauagagcaaccguuuauguuggcucugcaaauuaugcaccaaaauuaggacgaguucaauuugagacagauacuacagacgaucuagaugcccaucaaaauacuaaauuuaccccaguuggagucguacaagguggugaaucacccaaaggcucagaaccacaacaauggguuuuaccuucauauaguggaaaagacacaccaaacguacaucuugcuccagcaguagcaccaacauuuccaggagaacaauuauuauuuuucagaucaacaauacccgguugugguggacaucccaauaugaauuuagacugucuacuaccacaagaauggguacaacauuuuuaucaagaagcagcacccgcccaaucagauguagcacuucuuagauuuguaaauccagauaccucuagaguccuauuugaauguaaauuacauaaauccggauauguaacaguugcacacacaggacaacaugaccuuguaauacccccaaauggauauuuuagauucgauucauggguaaaucaauucuauacacucgcccccaugggaaauggaacaggaagaaaaagauaa

SEQ ID NO: 34574 - RNA, 1617 nt, Artificial Sequence
  derived and/or modified sequence opt6 from VP1__Norovirus_and/or_Norovirus-like__KX514336
augaaaauggccuccaacgaugccaacccaucagauggaucagccgcuaaucuaguaccagaaguaaauaaugaaguaauggcauuagaaccaguaguaggagcagcuaucgcagcaccaguagcaggacaacaaaacguuauagauccuuggauaagaaauaauuuuguacaagcuccaggaggagaguucacaguaucaccaagaaaugcaccaggcgaaauacuaugguccgcaccucuagguccagaucuaaacccuuaucuuucccacuuagcaagaauguauaauggcuacgcuggaggauuugaaguucaaguaauacuugcaggaaaugcauuuacugcaggaaaaauaauauucgcagcaguaccaccaaacuucccaacagaaggacuaucaccaucccaaguaaccauguucccccacauaaucguagauguucgacaacuagaaccuguacuaauaccucucccagauguucggaauaauuuuuaucauuacaaucaaucaaaugauucgacuauuaaacucauagcaaugcuauauaccccucuuagagcaaauaaugcuggagaugacguauuuaccguaucaugucgaguauuaacacgaccaucaccagauuuugacuuuauauuuuuagucccuccuacaguggaaucaagauccaaaccauuuaguguaccagucuuaacaguagaagaaaugacaaacucaagauuuccugcaacccuagauaaauuauucacagggccaucaucuacauuuguaguacaaccacaaaauggaagauguaugauagauggaguacuauuagguaccacccaacuuagcccaguaaauauaugcacauucagaggugacguaacccauucaggcaacucaaaaauauacaccaugaauuuagcuucacccaacuggaacaauuacgauccaacugaagaaauaccugcaccauuaggcacaccagauuuugucggaaaaauacaaggaaugcuaacucaaacaacaaaaggagaaggaucuacaagaggacacagagcaacaguuuacguaggcucagcaaauuaugcaccaaaauuaggaagaguacaauuugaaacagacacaacugaugaucuagaugcccaucaaaauaccaaauuuacaccaguagguguuguacaggguggagaaucaccaaaaggaucagaaccacaacaauggguacuaccuucuuacucaggaagggacacaccgaauguacaucuagcuccugcaguagcaccaacauucccuggagaacaacuacuauucuuuagauccaccauaccaggaugugguggacauccaaauaugaaucuagacugucuauuaccacaagaauggguacaacauuuuuaucaagaagcagcaccagcacaauccgauguagcauuacuaagauucguuaaccccgauacaucaagaguauuauuugaauguaaacuccauaaaucaggauacguaacugucgcacauacaggacaacaugaucuuguaauaccaccuaauggauacuuuagauucgacucauggguaaaucaauuuuauacacuugcccccauggguaauggaacuggaagaaaaagauaa

SEQ ID NO: 34575 - RNA, 1617 nt, Artificial Sequence
  derived and/or modified sequence opt6 from VP1__Norovirus_and/or_Norovirus-like__KX514203
augaaaauggcaucaucagacgcuaauccaucugauggaucagcagcaaauuuaguaccagaaguaaauaacgaagucauggcacuagaaccaguuguaggagcugcaauagccgcaccagucgcuggacaacaaaacguaauagacccuuggauaagaaauaauuuuguucaagcaccuggaggcgaauuuaccguaucaccucgaaaugcaccaggagaaauacuuuggucagcuccuuuaggaccugacuuaaauccauaccuaagccacuuagcaagaauguacaacggauaugcaggagguuucgaaguccaagucaucuuagcuggaaacgcauucacagcaggaaaaauaauuuucgcagcuguacccccaacauucccaacagaaggauuaucacccucucaagucaccauguucccacacauuauagucgacgucagacaacuagaaccaguacucauacccuuacccgauguucguaacaauuucuaucauuacaaccaaucuaaugauucaacaauaaaacucauugcaauguuauauacaccauuaagagcuaauaauccaggagacgacguauuuacugucucaugccgcguuuuaacaagacccucccccgauuucgacuucauauuucuaguacccccaacaguagaaucacguucaaaaccauucucaguaccaguauuaacaguacaagaaaugacaaacuccagauuuccugccacacuugacaaauuauuuacaggcccauccuccacucuaguuguacaaccccaaaacgguagauguaugauagacggcguccuucuuggaacaacacaauuaucaccuguaaauauaugcacuuuucguggugauguuacucauucaagagacucuacaauauauacuaugaaccuagcauccccaaauuggaauaauuaugauccaacagaagaaauaccugcaccucuagguaccccagauuuuguaggaaaaauacaaggaguacucacacaaacaaccaaaggagaaggcucaacaagaggacaccgugcaacaguuuauguaggaucagcaaacuacacuccuaaacuaggaaaaguacaauuugaaacuaauacaacuaacgaucuuuacgcucaucaaaauacacguuuuacuccaguuggaguaguccaaggaggcgaauccgcacaucgaagcgaaccacaacaauggguccuaccuucauacucaggaagagauacacccaacguacacuuagcaccagcaguagcaccaacauucccaggugaacaacuauuauucuuuagaucaacaaucccaggcuguggaggacacccuaauauggaucuagauugcuuauuaccacaagaauggguucaacacuuuuaucaagaagcugccccggcacaauccgauguagcacucuuacgguucguaaacccagacacaucuagagucuuauucgaauguaaacuacauaaaucuggcuacguaaccgucgcccacacaggacaacacgaucucguaauaccucccaauggauauuucagauuugauucauggguaaaucaauuuuauacucuagcaccaaugggcaauggcacaggaagaaaacgauaa

SEQ ID NO: 34576 - RNA, 1617 nt, Artificial Sequence
  derived and/or modified sequence opt6 from VP1__Norovirus_and/or_Norovirus-like__KP784693
augaaaauggcauccucugacgcaaauccuucagauggaucaacagcaaacuuaguaccagaaguaaacaaugaagucauggcauuagaaccaguagucggagcagcuauagcagcuccaguagcaggacaacaaaauguaauagacccuuggauuagaaacaacuuuguacaagcacccggaggagaguucacaguuucaccuagaaacgcacccggagaaaucuuauggucugcaccauuaggaccagaccuaaauccauacuuaucccaccucgcaagaauguauaacggauaugcaggcggauucgaaguccaaguaauacuagcaggaaaugcauuuacagcaggaaaaauaauauuugcagccguaccaccaaauuuuccaacagaaggucuaucaccuucccaaguaacaauguuuccacacauaaucguagauguaagacaacuagaaccagucuuaauaccacuaccagauguuagaaauaauuuuuaucacuauaaucaauccaaugauuccacaauaaaacuaauagcaaugcuuuacacaccacuacgagcuaacaacgcaggcgacgaugucuucacaguaucaugucgaguauuaacuagaccuucaccugacuuugauuucauauuccucguaccaccuacaguugaauccagaacaaaaccauuuucaguaccugucuuaacaguagaagaaaugacaaacaguagauuuccaaucccauuagaaaaacuauucacaggaccaaguucagcauucguaguacaaccacaaaauggacgaugcacuacugaaggcguucuauuagguacaacacaauugucaccaguaaauauauguacauucagaggagacgucacccacauaucagguuccagaaauuauacaaugaacuuagcaucucaaaacuggaacucuuaugaucccacagaagaaauaccagcaccucuaggaacaccagauuuuguaggaaaaauacaagguguacuuacacaaacaacucgaacugaugguuccacuaggggacacaaagcaaccgucuauacaggaagugcagacuuuucucccaaauuaggccgaguacaauucgcuacugacacagauaacgauuucguaacaaaccaaaauacaaaauuuacucccguaggaguaauccaagauggcuccacaacaccaagaaaugaaccacaacaauggguacuuccaucauauucaggaagaaauacacacaacguccacuuagcuccugcuguugcaccuaccuuuccaggagaacaacuauuauucuucagaucuacaaugcccgguuguaguggauauccaaauauggaccuagauugcuuacuaccacaagaauggguucaauauuucuaccaagaagcugcgccagcacaaucagacguugcauuguuacgauuuguaaauccagauacuggacgaguauuauucgaaugcaaacuacauaaaucaggauauguaacaguugcacauacaggucaacacgaccuuguuauaccaccaaacggauauuuuagauucgacucauggguaaaccaauuuuacacacucgccccaaugggaaauggcgcaggaagacgccgauaa

SEQ ID NO: 34577 - RNA, 1617 nt, Artificial Sequence
  derived and/or modified sequence opt6 from VP1__Norovirus_and/or_Norovirus-like__AB933734
augaaaauggcaaguuccgaugcaaacccaucagacggaucaacagcaaacuuaguccccgaagucaauaaugaagucauggcauuagaacccguaguaggagcagccauagcagcuccaguugcaggacaacaaaaugucauugaccccuggauuagaaauaacuuuguucaagccccaggaggagaauuuaccguaucaccacgaaacgcuccaggagaaauacuauggucagcaccauuaggcccagaucuaaaucccuaucuuucacauuuagcuagaauguacaacggcuacgcaggaggcuucgaaguccaagucauucuagccgguaacgcauucacagcagguaaaaucauuuuugcugcaguaccaccaaauuuuccuaccgaaggucucucaccaagucaaguaaccauguucccacauauaauaguagacguaagacaacuagaaccaguccuaauacccuuaccugauguacgaaauaauuuuuaucauuauaaccaaucaaaugacucuaccaucaaacuuaucgcaauguuauauacuccccuacgagcuaauaaugcaggagaugacguauuuacaguaucauguagaguacuuaccagaccuucaccagacuuugauuuuauauuucuaguuccaccaacuguugaaucagaaacaaaaccauuuuucuuuccagucuuaacaguagaagaaaugacaaacucacgauuuccaauaccccuagaaaaacucuuuacagguccaucuuccgccuuuguaguucagccacaaaacgguagauguacuaccgauggaguauuacuaggaaccacacaauuaucuccaguaaauauauguacauucagaggagacguaacacauauaccagguucaagaaauuauaccaugaaucuagcuucacaaaauuggaacuccuacgauccuacggaagaaauaccugccccacuaggaacaccugauuuuguuggaaaaauacaaggaguauuaacccaaacuacaagaacaaacggaucaacccgaggacacaaagcaacaguauauacgggaucagcugacuuuuccccaaaacuaggaagaguacaauucgcuacugauacagauaacgauuuugaaacaaaucaaaauacaaaauuuacacccguaggaguaauacaagacggaucaaccacaccaagaaaugaaccacaacaauggguacucccaucuuauuccggcagaaauauacacaauguccauuuagccccagccguugcaccaacauucccaggugaacaauuauuauucuuuagauccacaaugccaggcugcucuggcuauccaaacauggauuuagauuguuuacucccucaagaauggguacaauauuucuaccaagaagcggcuccugcucaaucagacguagcauuauuaagauucgucaacccagacacaggcagaguacucuuugaauguaaacuacauaaaucagguuauguaacugucgcucauacaggccaacaugacuuaguaauuccaccaaaugguuauuuccguuucgauucauggguaaaucaauuuuacacucuagcaccaaugggaaacggaacuggacgacgaagauaa

SEQ ID NO: 34578 - RNA, 1617 nt, Artificial Sequence
  derived and/or modified sequence opt6 from VP1__Norovirus_and/or_Norovirus-like__KF060041
augaaaauggcaucaucagacgcaaacccauccgacggaucagcagcaaaccucguucccgaaguuaacaaugaaguaauggcacuugaaccaguuguaggugcagcaauagcagcacccguagccggacaacaaaauguaauagacccauggauacgaaacaacuuuguacaagcacccggaggugaauuuacaguauccccaagaaaugcaccaggcgaaauauuauggucagcaccauuaggaccagaucugaauccauaccuaagucaccuagcaagaauguauaacgguuaugccggaggauucggaguacaaguaauuuuagcaggcaacgcauuuacagcaggaaaaguaauauucgcagcaguaccaccaaauuucccgacagaaggacuauccccaucacaaguaacaauguuuccucacauaguaguuaacguacgucaacuugaaccaguauuaaucccacuaccagauguccgaaacaauuuuuaccacuauaaccaaucaaacgacccaacaauaaaauuaauagcaaugcuauauacaccccuacgagcuaauaaugcaggagaugacgucuucaccguaucuugcagaguacuaacaagaccaucaccagauuuugauuuuauauuuuuaguaccaccaacaguagaaucuagaacaaaaccuuuuagcguucccguucuaacaguagaagaaaugacuaacuccagauucccaauaccucuugaaaaacucuuuacaggaccauccucagcauuuguaguacaaccacaaaauggaagauguacaacagauggagucuuacuaggcaccacacaauuaucaccagucaacauauguacauuccgaggcgauguaacucauaucacagguucaagaaauuacacaaugaaucuagcaucacaaaauuggaacaacuacgacccaacagaagaaacaccagccccucuagguaccccagacuuuguagguaaaauucaaggaguuuuaacccaaacaacuagaacagacggaucaacaagaggccacaaagcuacaguauauacaggaucagcagacuucgcaccaaaauuaggacgaguacaauuugaaacagauacugaccaugacuuugaagccaaucaaaacacaaaauucacgcccguaggaguaauacaagauggaucuacaacacaucguaaugaaccucaacaauggguauuaccaucauauuccgguagaaauacacauaauguacaucuugcaccagcaguagcuccaacuuucccaggagaacaacuacuuuucuucaggucaaccaugccuggaugcucaggauauccaaacauggacuuagauugcuuauuaccacaagaauggguacaauauuucuaucaagaagcagcaccagcacaaucagacgucgcacuuuuaagauucguaaauccagacacaggaagaguauuauucgaaugcaaauuacacaaaucuggauacgucacuguugcauuaacaggucaacaugaucuaguaauaccaccaaacggauauuucagauucgauucauggguuaaucaauuuuauacucuagcaccaauggguaacggaacuggaagaagacgcuga

SEQ ID NO: 34579 - RNA, 1617 nt, Artificial Sequence
  derived and/or modified sequence opt6 from VP1__Norovirus_and/or_Norovirus-like__JX989074
augaaaauggccucaucugacgcuaaccccucagaugguaguaccgcaaaucuaguucccgaaguuaauaaugaagucauggcacuagaaccuguagucggagcugcaauagcugcaccagucgcaggacaacaaaauguaauugacccauggauaagaaacaauuuuguacaagcuccaggaggcgaauuuacaguaucaccaagaaaugcaccaggagaaauccuauggucagcacccuuaggacccgauuuaaaccccuaccucucacacuuagcaagaauguauaacggauaugcuggcggauucgaaguucaaguaauauuagcuggaaacgccuuuacagcaggaaaaauaauuuuugcagccguaccaccaaacuucccaacagaaggauuauccccaucccaagucacaauguucccacacauuauaguugauguucgacaacuagaacccguauuaaucccauuacccgaugucagaaacaauuucuaccauuacaaccaaucaaaugacuccacaaucaaacuaaucgcaauguuauauacaccacuaagagccaacaaugccggugacgauguauucacaguaucuugucgaguacuuacacgaccaucuccagauuuugauuuuauauuucuaguaccaccaacaguagaaucaagaacaaaaccuuucucuguaccaguucuaacuguugaagaaaugacuaacagcagauuucccauaccacuagaaaaacuauuuacaggacccucaucagcauuuguuguacaaccccaaaauggaagauguaccacagauggaguauuauuagguacaacucaauuauccccuguuaauauaugcacauucagaggagauguaacacauauuccaggaucaagaaacuacacaaugaaucuugcaucacaaaacuggaacuccuacgauccaacugaagaaaccccugcaccucucggaacucccgacuucguagguaaaauccaaggaguauuaacacaaacuacccgaacuaacggaucaacaagaggacauaaagcaacaguauacacuggaucagcagacuuuucaccaaaacuaggaagaguccaauuugcaacagauacagauaaugauuucgaaaccaaccaaaauacaaaauucacaccagucggaguuauacaagauggauccacuacaccaagaaaugaaccucagcaauggguucuaccuucauacucaggaagaaauauacacaauguacauuuagcaccagcagucgcaccaacauuuccaggagaacaauuacuauucuucagaucaacaaugccuggauguucaggauauccuaacauggaccucgacugucucuuaccacaagaauggguacaauauuucuaucaagaagcagcaccagcccaaucagacguugcauuauuacgauucguuaacccagacacaggucgaguauuauuugaauguaaauuacacaaaucuggauauguaacuguagcccauaccggacaacacgauuuaguaauaccacccaacggauauuucagauucgauucuuggguaaaccaauucuauacucuagcucccauggguaauggaaccggacgacgaagauaa

SEQ ID NO: 34580 - RNA, 1617 nt, Artificial Sequence
  derived and/or modified sequence opt6 from VP1__Norovirus_and/or_Norovirus-like__JN400624
augaaaauggcaucaucagacgcaaauccaucugacggauccacagcaaaucuugucccagaaguaaacaaugaaguaauggcacuagaaccaguugucggagcagcuauagcugcuccaguagcuggacaacaaaacgucauugacccauggauaagaaacaacuucguacaagccccaggaggagaauuuacagucucacccagaaaugcaccaggagaaauccuauggucagcaccucuuggaccagaucucaauccauacuuaucacaucuagcaagaauguauaacggauacgcuggugguuucgaaguacaagucauacuagcaggaaaugcauucacagccggaaaaauaauauucgcagcaguaccaccaaacuuuccaacugaaggauuaucaccaucccaaguaacaauguucccucacauuaucguugacguacgacaacuugaaccaguacuaauaccauuaccagacguaagaaacaacuucuaccacuauaaccaauccaaugacccaacaauaaaacuaauagcaaugcucuacacuccucuaagagcaaacaaugcaggagacgacguauuuacaguaaguuguagaguacuaacaagaccaucaccagacuucgauuucauauuuuuaguuccaccuacaguagaaucccgaacaaaaccauuuuccgucccaguuuuaacuguugaagaaaugacuaacucacgauucccaauaccacuagaaaaacuauuuacagguccaucaucagcuuuuguuguacaaccacaaaacgauagauguacaaccgacgguguauuacuaggaacuacacaauuaucaccaguuaauauauguacauuucgaggagacguaacacauauaccaggcuccagaaauuacaccaugaauuuagccucccaaaacuggaacucauacgacccaacagaagaaaucccagcuccacuaggaaccccagacuuuguaggaaaaauucaagguguauuaacccaaacaacacgcacaaacggaucuacaagaggucauaaagcaacaguauauaccggaucugcagauuuuuccccuaaauuaggaagaguacaauuugcaacagacacagauaaugauuuugaaaccaaccaaaauacuaaauucacuccuguaggaguaauccaagauggaagcacaacaccuagaaaugaaccccaacaauggguucuaccaaguuacagcggaagaaacauucauuccguacacuuagccccagccgucgccccaacauucccaggcgaacaacuacuauuuuucagaucaacaaugccaggauguucuggcuauccaaauauggaccuagauugcuuacuaccacaagaauggguccaauauuucuaccaagaagcagcgccagcacaaucugacguagccuuauuaagauuuguaaaccccgacacaggacgaguacuauucgaaugcaaauuacacaaaucagguuaugugacaguugcacauacaggacaacacgauuuaguaauaccaccaaauggauauuuucgauucgacuccugggucaaucaauuuuauacccuagcaccaauggguaauggcacuggacgaagaagauaa

SEQ ID NO: 34581 - RNA, 1617 nt, Artificial Sequence
  derived and/or modified sequence opt6 from VP1__Norovirus_and/or_Norovirus-like__EU876894
augaaaauggcaaguucggacgcaaauccaucagauggcucaaccgcaaacuuaguaccagaaguuaacaacgaaguaauggcucucgaaccaguaguaggcgcagcaaucgcugcucccgucgcaggccaacaaaauguaauugacccaagaauaagaaauaauuuuguucaagcaccaggaggagaauuuaccguuucacccagaaaugcaccuggagaaauacuauggucugcaccccuuggaccagaucuaaauccauaucucucacaucucgccagaauguauaacucuuaugccggaggauucgaaguacaagucauacuagcaggaaaugcauuuaccgcuggaaaaauaauauuugcagcagucccuccaaacuuuccuacagaaggcuuaucaccaucacaaguaacaauguuuccucacauuauaguagacguucgacaacuagaacccguucuuauaccacuuccugauguaagaaacaacuucuaccauuauaaccagucaaaugauccaacaauaaaacuaauagcaaugcuauacacaccauuaagagccaacaaugccggugacgauguauucacaguaaguugcuggguauuaaccagaccaucuccagacuucgacuuuaucuuccuuguuccaccaaccguugaaucacgcacaaaacccuucucagucccaauacuaacaguagaagaaaugacaaacucaagauucccaauaccauuagaaaaacuauuuaccggaccaucaucugcauucguaguacaaccacaaaacgguagauguaccacugacggaguauuacuugguacaacucaauuaucaccuguaaauauaugcacauuucgaggugauguuacacauauagcaggaacacaagaauacacuaugaauuuagcuucucaaaacuggaacaauuaugacccaaccgaagaaauaccagcaccauuaggaacaccagacuucgucggaaaaauacaaggaguucuaacacaaacaacaagaucagaugguuccacacguggacacaaagcuacaguaucaacagguucaguucacuuuacaccaaaacuaggccgaauccaauucaguacugacacauccaaugauuucgaaacuggacaaaauacuagauuuacaccaguaggcguuguccaagauggcuccacaacucaucaaaaugaaccccaacaauggguauuaccaaacuauucaggacgagacucacacaacguacauuuagcaccagcaguagcaccaucauuuccuggagaacaacuauuauucuuuagaucaacaaugccaggcugcucaggauauccaaacaugaaucuagauugccucuuaccacaagaauggguacaacauuucuaucaagaagcagcaccagcacaaucagacgucgcauuacuucgauucgucaauccugacacaggaagaguacuauucgaauguaaacuccacaaaucaggauaugucacaguagcccauacaggacaacaugaccuaguaauaccuccaaauggauauuucagauucgacucauggguaaaucaauuuuauacucucgccccaaugggcaauggaacuggaagaagacgauaa

SEQ ID NO: 34582 - RNA, 1617 nt, Artificial Sequence
  derived and/or modified sequence opt6 from VP1__Norovirus_and/or_Norovirus-like__KX514173
augaaaauggcaagcucagacgcaaacccaucagacggaucaaccgcaaaccuuguaccagaaguaaacaaugaaguaauggcccuugaacccguaguaggugcagcuauagcagccccuguagcaggccaacaaaacguaauugacccuuggauaagaaauaauuuuguacaagcuccuggaggagaauuuacaguuucaccaagaaacgcaccuggagaaauauuauggucugcaccacuuggaccagauuuaaacccauauuuaucacaucuagcuagaauguauaauggauacgccggugguuucgaaguacaagucauccuggcagguaacgcauuuacagcaggaaaaauaauauucgcggcugugccaccaacauuuccaaccgaaggauuaucaccaucacaaguaacuauguucccucacauaauagucgauguaagacaauuagaaccaguucuaauaccauuaccagacguuagaaauaauuuuuaucauuauaaucaaucaaacgacucaacaauaaaauuaauagcaauguuauacacaccauuaagagcaaacaacccaggagaugauguauucacaguuagcugcagaguauuaaccagaccaucacccgacuucgauuuuauauuuuuaguaccaccaacuguagaaucaagaacaaaacccuuuucaguaccaauacuaacaguuggggaaaugacuaacucaagauuuccaguaaauuuagaaagacuuuuuaccggacccuccucagccaacguaguucaaccacaaaacggaagauguacaauagauggagaacuauuaggaacaacacaauuaaguucaguuaauaucugcacauuuagaggagacguaacacauauaggaacaacucgacauuggacgaugaauuuagcaagcccaaauuggaauaacuacgauccaacagaagaaacaccagcuccacuaggaacgcccgauuuuguaggaaaaauacaaggcaugcucacacaaacaacaaaaggagaaggaucaacaagaggacacagagcaacaguauacguagguucagccaacuaugcuccaaaauuaggaagaguucaauuugaaaccgauacaacaaaugaucuagaugcccaccaaaacacaaaauuuacaccaguaggaguaguacaagguggagaaucccccaaagguucagaaccacaacaauggguucuaccaucauauucuggacgugauacaccaaauguacaucucgccccagcuguagcaccaaccuuucccggagaacaauuauuauucuucagaucaacaauacccggauguggaggacauccuaauaugaacuuagacugcuuauuaccacaagaauggguacaacauuuuuaccaagaagcugcuccagcacaaucagacguagcacuuuuaagauucguaaauccugauacauccagaguucuauucgaauguaaacuucauaagucuggauauguaacaguugcucauacuggccaauacgaccuaguacuaccauccaaugguuauuuucgauucgauucauggguaaaucaauuuuacacauuagcaccaaugggcaacggaacaggaagaagacgauaa

SEQ ID NO: 34583 - RNA, 1617 nt, Artificial Sequence
  derived and/or modified sequence opt6 from VP1__Norovirus_and/or_Norovirus-like__KX353989
augaaaauggcauccucagacgcuaacccauccgauggaucaacagcuaaccucguaccagaagucaacaaugaaguaauggcacuagaaccaguaguaggagcugcaauagccgcaccuguagcgggacaacaaaaugucauagacccauggauaagaaacaacuuuguacaagccccaggaggagaauuuacaguuucuccacgaaacgcaccaggugaaauauuauggucugcaccacuagguccagaccuaaauccauaucuaucacaccuugcaagaauguauaacgguuaugcaggaggcuucgaaguccaaguaaucuuagcaggaaaugccuuuacagcaggcaaaauaauauucgcagcaguuccacccaacuuucccacugaaggccuauccccaucgcaaguaacaauggucccacacauaauagucgacguaagacaacuagaaccuguacuuauaccauuaccagaugucagaaacaauuucuaucacuacaaccaauccaacgauucuacaauaaaauuaaucgcaauguuauauacucccuuaagagcaaacaaugcaggagaugauguauuuacaguaucaugcagaguuuuaacuagaccaagcccagauuuugauuucauauuucucguaccaccuaccguagaaucaagaacuaaacccuuuucaguuccaauauuaaccguagaagaaaugacaaacucuagauucccuauaccacuugaaaaauuauuuacaggaccaucuucagcuuuuguaguacaaccacaaaacgguagauguacaacagauggaguccuacucgguacaacccaguuaucaccuguaaacauaugcacauucagaggagauguaacucauauaccuggaucacauaauuacacaaugaaucuagcaagucaaaacuggaacucauacgauccaaccgaagaaauacccgccccauuaggaacuccagacuuuguuggcaaaauucaaggaguauuaacacaaacuacuucaacaaauggaucaacacgcggucacaaagcuaccguuuauacagguucagcugacuuuucaccaaaacuuggaagaguacaauucgcuacugauacaaauaaugauuucgaaacaaaucaaaauacaaaauucacaccagucggcguaauacaagauggaucuacaacaccuagaaaugaaccacagcaauggguacuaccaucauacucaggaagaaacauccacaauguacaccuagcaccagcaguagcaccaacauucccaggagaacaacuuuuauucuuuagaucaacaaugccaggauguagcggauauccaaauauggaucuagauugccuacuaccacaagaauggguacaauauuucuaccaagaagcagcucccgcacaauccgacguagcauuauuaagauuuguaaacccugauacaggaagaguucuauucgaaugcaaauuacacaaaucaggauacguaacagucgcacacaccggacaacacgaccuagucauuccacccaauggauauuuuagguuugacucauggguuaaucaauucuauacucuagcaccaaugggaaauggaacaggacgacgaagauaa

SEQ ID NO: 34584 - RNA, 1617 nt, Artificial Sequence
  derived and/or modified sequence opt6 from VP1__Norovirus_and/or_Norovirus-like__KX353962
augaaaauggcuucuucagacgcaaauccuuccgauggcucaacagcaaauuuaguaccagaaguaaauaaugaaguaauggcccuagaaccuguaguuggugcagcaauagcugcuccugucgcaggacaacaaaauguaauagacccauggauaagaaauaauuuuguucaagcaccaggaggagaauuuacgguaucaccgagaaaugcaccaggcgaaauccuauggucagccccauuagggccagaucucaaucccuaucuaucacacuuagcuagaauguauaauggauaugcaggcggcuucgaaguacaaguaauauuagcaggcaaugcauuuacagcagguaaaauaaucuucgcagcagucccacccaacuuuccuacagaaggccucucuccuucucaaguuacaauguucccacauauaauaguugauguaagacaacucgaaccaguucuaauaccauuaccugauguaagaaauaacuucuaucacuauaaccagucaaaugauuccacaauaaaacuaauagccaugcuauacacaccacuaagagccaacaacgccggugaugauguauuuacaguuuccuguagaguucuaacaagaccaucaccagauuuugacuuuaucuuucuaguuccaccaacuguagaaucuagaacaaagccuuucuccguacccguuuuaacaguagaagaaaugacaaacccacgauuuccaauaccccuugaaaaacuauucacaggacccucaucagcauucguaguacaaccacaaaacggacgcuguacaacagacggaguacuauuaggcaccacucaauuaucaccuguaaauauauguacauucagaggcgacguuacacacauaccaggaucuagaaauuacaccaugaauuuagcaucacaaaauuggaacucuuaugacccaacagaagaaauaccagcaccauuaggaacaccugacuucguaggaaaaauacaagguguacuuacacaaacaacacgcacuaauggaucaacuagaggacauaaagcaacuguuuacaccgguuccgcagacuuuaguccaaaauuaggaagaguacaauucgcaacagauacagauaacgauuucgaaacaaaucaagauacaaaauucacacccguaggaguaauacaagauggaucaacaaccccaagaaacgaaccacaacaauggguacuaccaucauacucaggucgaaacauacacaauguucaccuugcaccagccguagcaccaacguuuccaggagaacaacuauuauucuuccgcagcacuaugccagguuguuccggauauccaaauauggaucucgauugccuacuaccccaagaauggguccaauauuucuaucaagaagcagcacccgcccaauccgacguagcccuacuuagauuuguuaacccagacacugguagaguacuauuugaaugcaaacuccauaaaucaggcuauguaaccguagcucauacuggacaacaugauuuaguaauuccaccaaacggcuauuucagauucgauucauggguaaaucaauucuacacauuagcaccaaugggaaauggcacaggaagacgaagauaa

SEQ ID NO: 34585 - RNA, 1617 nt, Artificial Sequence
  derived and/or modified sequence opt6 from VP1__Norovirus_and/or_Norovirus-like__AB972515
augaaaauggcuucaucugacgcaaauccaagcgacggaucaacagcaaaccuugucccagaaguaaacaaugaaguuauggcauuagaaccaguaauaggagccgcaauagccgcacccguagcaggacaacaaaauguaauagacccuuggauacgcaauaacuuuguacaagccccaggaggagaauuuacuguuucaccacgcaaugcucccggugaaauucucuggucagcaccccuaggaccagauuuaaauccauaucuaucacacuuaucacgaauguacaacggauacgccgguggauuugaaguacaaguaauucuagccggcaaugcauuuaccgcuggcaaaauaauauucgcagccguaccaccaaacuucccuacugaaggccuaucaccuucacaaguuacaauguucccacacaugauugucgacguaagacaacuagaaccaguucuaauuccucuaccagacguacgaaauaauuucuaucauuacaaucaaaguaaugacucaaccauuaaauuaaucgcaauguuauacaccccacuacgugcaaauaaugccggugacgauguauuuaccgucucaugucgaguucuaacaagacccucuccagacuuugacuuuauauucuuaguuccaccaacaguagaaucaagaaccaaaccauucucaguaccaguauuaacaguagaagaaaugacaaacucaagauuuccaauaccauuagaaaaauuauuuacaggaccaucuucagcauuuguaguacaaccccaaaacgguagauguacaacugacggagucuuacuaggaacaacacaacuaucaccaguaaacauauguacuuuuagaggagacguaacacacauaccaggaucaagaaauuauaccaugaaucucgcuucccaaaacuggaacucauacgauccaacagaagaaauacccgcaccauuaggaacaccugauuuugucgguaaaauccaaggaguacuaacacaaacuacucgaaccaauggauccaccagaggucauaaagccacuguuuauaccggauccgcagauuuuuccccaaaacucggccguguacaauuugcaacugacacagacaaugauuuugaaacaaaucaaaauacaaaauuuacaccaguaggaguaauacaagauggaucaacaacaccacgcaacgaaccacaacaauggguacuaccaucauauucaggacgcaauauucauaacguacacuuagcgccugcaguagcaccaacauucccaggagaacaacuccucuucuuuaggucuacaaugccaggaugcucugguuauccaaauauggauuuagauugccuucuaccacaagaauggguucaauacuucuaccaagaagcagcacccgcacaaucagacguagcauuauuaagauuuguaaaccccgacacuggaagagucuuauucgaaugcaaauuacauaaaucaggauaugucacaguugcacauacaggccaacacgaccuaguaauaccuccaaauggauauuuccgauucgauucaugggucaaucaauuuuacacacuugcaccaaugggcaauggaacuggaagaagacgcuaa

SEQ ID NO: 34586 - RNA, 1617 nt, Artificial Sequence
  derived and/or modified sequence opt6 from VP1__Norovirus_and/or_Norovirus-like__KT033904
augaaaauggcaucaaaugaugcaaacccaucagauggcagcgcagcaaaucuaguucccaaaguaaacaaugaaguaauggcacuugaaccaguuguaggugccgccauagcugcaccuguagcaggucaacaaaauguaauagacccauggauuaaaaauaauuuuguacaagcaccuggaggaaaauucaccguaucaccgaaaaaugcuccaggagaaauauuaugguccgcuccacuaggacccgaccuaaauccuuauuuaucccaccuagcuagaauguauaaaggacacgccgguggauucgaaguacaagucauacuagcaggaaacgcauuuacagcaggaaaaauaauauuugcagccguacccccaaacuuucccacagaaggacucucuccaucacaaguuacaauguucccacacaucauaguagacguacgacaacuagaaccaguucuuauaccucuaccugacgucagaaacaacuucuaucauuauaaccaaucaaaugacucaacaauaaaauuaaucgcaauguuauauacaccccuccgcgcaaacaaugcaggagaagacguauuuacuguuuccugccgaguauuaacacgaccaaguccugauuucgacuuuauauuucuugucccuccaacaguugaaucaagaaccaaaccuuuuacagugccaauacuaaccguagaagaaaugacaaauucacgauuucccauacccuuagaaaaacuauuuacaggaccaucaucagcauucguuguacaaccucaaaacggaagauguacaaccgacggcguauuacuaggaaccacacaauuaucaccaguuaauaucugcacauuuagaggagacguaacacauaucgcaggaucacguaauuacacuaugaaucuagcuagccuuaauuggaacaauuacgacccaacagaagaaauaccagcaccauuaggaacacccgauuucguuggaaaaauacaaggcguacuuacacaaacuacuaaaggagacggaucaacaagaggacacaaagcaacugucuauacaggaucagcaccauuuaccccaaaacuaggauccguacaauuuucaacugacaccgaaaacgacuucgaaacacaucaaaauacaaaauucacaccaguaggcguaauucaagauggcggaacuacccacagaaaugaaccacaacaauggguauuaccuucauacucaggucgaaacgucccaaacguacaccuagccccagcuguugcacccacauucccuggcgaacaauuacuauuuuucagaucaacaaugccaggaugcucaggauauccaaauauggauuuagauugccuauuaccucaagaauggguucaacauuucuaccaagaagcagcaccagcacaauccgauguugcucuuuuaagauucguaaacccagauaccggaagaguauuauucgaaugcaagcuacauaaaucaggauacguaacaguagcacauacaggacaacacgaucuaguuauaccaccaaauggauauuuccgauuugacucguggguaaaucaauuuuauacauuagcaccaauggguaauggaaccggucgaagaagauaa

SEQ ID NO: 34587 - RNA, 1617 nt, Artificial Sequence
  derived and/or modified sequence opt6 from VP1__Norovirus_and/or_Norovirus-like__KM982942
augaaaauggcaucaucagacgcaaacccaucagauggaucggcagcuaauuuaguaccagaaguuaauaaugaaguaauggcauuagaaccgguaguaggugcugcaaucgcugccccaguagcaggacaacagaauguaauugauccauggauaagaaacaacuucguacaagcucccggaggugaauuuacaguuuccccuagaaaugcaccaggagaaauauuauggucagcaccauuaggcccagaucuuaauccauaucuaagccauuuagccagaauguacaauggauacgcaggaggcuucgaaguacaagucauuuuagcaggaaaugcauuuacagcaggaaaagucauuuucgcugcaguaccaccaaauuuucccacagaaggauuaucuccuagccaaguaaccauguucccacacauaguuguagauguaagacaacuagaaccaguucuaauuccacuaccagauguaagaaacaauuuuuaccacuauaaccaauccaaugacccuaccauaaaacucauugcaauguuauacacuccauuaagagcaaauaaugccggagacgauguauuuacagucucaugcagaguuuuaacaagaccuucaccagacuuugacuuuauauuucuuguaccaccaaccgucgaaucuagaacaaaaccauucucaguaccaguacuaaccguagaagaaaugaccaauucaagauuuccaaucccauuagaaaaauuauucaccgggccauccucagcauucguaguacaaccucaaaacggaagaugcacaacagacgguguauuacuagguacaacacaauuaucaccaguaaauauuuguacauuuagaggagauguaacucauauaacuggaucccacaauuacacaaugaaccucgcaucucaaaacuggucaaauuaugauccaaccgaagaaauaccagcaccucuaggaacuccagacuuugucggaaaaauacaaggcguccuaacacaaacaaccagaacagaugguucaacaagaggacacaaagcaacaguauacauugguuccgcugauuuugcgccaaaacuaggaagaguacaauucgaaacagauaccaaucacgacuuugaagcuaaccaaaauacaaaauucacaccuguaggaguaauacaagauggaggaacaacacaucguaaugaaccacaacaauggguauuaccaucauauucaggaagaaauacaccaaauguucacuuagcccccgccguagcacccacauuuccaggcgaacaauuacuauucuucagaucaacaaugcccggcugcucaggauaucccaauauggauuuagauuguuuauuaccacaagaauggguacaauacuucuaucaagaagcagcaccagcacaauccgauguagcacuacuaagguuuguuaauccugacaccggacgaguacuauucgaaugcaaacuacacaaaucaggauacgucacaguugcacauacaggacaacacgauuuagucauaccacccaacggcuauuuuagauucgauagcagaguaaaccaauuuuacacacuagcucccaugggaaaugggaccggaagaagaagauaa

SEQ ID NO: 34588 - RNA, 1617 nt, Artificial Sequence
  derived and/or modified sequence opt6 from VP1__Norovirus_and/or_Norovirus-like__KJ685417
augaaaauggcaaguucagaugcaaacccaucagacggaucaacagccaaccuaguaccagaaguuaacaaugaaguaauggcauuagaaccuguuguaggagcagcaauagccgccccuguagccggucaacaaaauguaaucgacccguggauaagaaacaauuuuguacaagccccuggaggagaauuuacaguaucaccccgaaaugcaccaggagaaauacuaugguccgcuccacuaggaccagauuuaaauccauauuuaucacaccuagcaagaauguauaacggauacgcaggaggauucgaaguacaagugauauuagccggaaaugcauuuaccgccggaaaaauaauauucgcagcaguaccaccuaauuuucccacagaaggccuaucaccaucucaaguuaccauguuuccccauauaauuguagauguaagacaacuagaaccaguuuuaauaccauuaccagacguccgcaacaauuuuuaucauuacaaccaaaguaaugacucaacaauaaaauuaauagcaauguuauacacaccacuccgcgccaacaaugccggcgacgacguauucacugucucuugucgaguccuaacaagaccaucacccgauuuugauuucauauuucuaguuccaccaacaguagaaucacgaaccaaaccuuuuucaguuccuguacucacagucgaagaaaugaccaacucaagauuuccaauaccccuagaaaaauuauuuacaggaccaaguagugcauucgucguacaaccacaaaacggacgauguacaacagacgguguucuacuaggcaccacacaauuaucuccagucaauauuuguacguuuagaggagauguaauacauauaucugguucucgaaauuacacaaugaauuuagcaucucaaaauuggaacucauacgauccaacagaagaaauaccagcaccucuaggcacaccagacuuuguugguaaaauucaagguguccuaacacaaacaacucgcacagacgguucaacaagaggacacaaagcuacaguauauacaggauccgcagacuuuucaccaaaacuuggacgaguacaauucgcuacagacacagauaaugauuuuguaacaaaccaaaacacaaaauuuacacccguuggugucauacaagacggcucuaccacuccaagaaacgaaccacaacaauggguacuaccuagcuacucgggaagaaauacacauaauguucaucuugcaccagcagucgcaccaaccuuuccaggcgaacaauuauuauucuuuagaucaacaaugcccggaugcucugguuaucccaauauggaccuagauuguuuauuaccacaagaauggguacaauauuuuuaucaagaagcagcaccagcacaaucagacguagcacuacuaagauucguaaauccugauacaggacgagucuuauuugaauguaaauuacacaaaucugguuauguaacuguagcacacacaggacaacaugaucuaguaauaccacccaauggauauuucagauuugacucauggguaaaucaauucuacacccuagcuccaaugggcaauggaacaggucgacgaagauaa

SEQ ID NO: 34589 - RNA, 1617 nt, Artificial Sequence
  derived and/or modified sequence opt6 from VP1__Norovirus_and/or_Norovirus-like__KC907392
augaaaauggcuucaaaugacgcaacaccuagcgauggaucuacagcaaaucuaguaccagaaguuaacaacgaaguaauggccuuagaaccaguuguaggcgcagcuauugcugcaccugucgccggccaacaaaacguaauagacccauggauucgcaacaauuuuguacaagcgccaggaggagaauuuacaguaucaccaagaaaugcacccggagaaauauuaugguccgcaccauuaggaccagacuuaaacccuuaucuaucacaucuugcuagaauguacaacggauaugcuggugguuucgaaguacaagucauucuagcaggaaaugcauucacugcaggaaaaauaauauucgcagcaguaccaccaaauuuuccaacugaaggauuaucuccaucacaaguaacaauguucccccacauuauaguagauguacgacaauuagaaccaguucuaauuccauuaccagacguaagaaacaacuuuuaucauuauaaccaaucaaaugauccaaccauaaaacuaauagcaauguuauauacaccccuaagagcaaacaacgccggugaugacguauucacaguaucauguagaguucuaacaagaccuuccccagacuuugacuuuauauucuuaguaccaccaaccguagaaagccguacaaaaccauucucaguuccaauauuaacaguagaagaaaugaccaacucacguucuccaaucccacuagaaaaauuauuuacaggaccaucuucagcauucguuguacaaccacaaaacggaagaugcaccacagauggaguauuauuaggaacaacacaauuaucuccagucaauauauguaccuucagaggugacgucgcacauauagcaggaacacaaaauuauacaaugaaccuagcaucacaaaauuggaauaauuacgauccaacagaagaaauccccgcuccauuagguacaccaaauuuuguuggcaaaauccaaggagucuuaacacagacuacaaaaagagacgguucaacacguggcagaaaagccacaguaucaacaggaucaguucacuuuaccccaaaauuaggaucaguacaauucucaaccgauaccucaaacgauuucgaaacaggacaaaacacaagauucacaccaguaggaguaguacaagauggauccacaacacauagaaaugaaccacaacaauggguucuaccagauuauucaggaagagacucacacaauguacauuuagcaccagcaguagccccaacuuuccccggagaacaacuccucuucuuuagauccucaaugccuggaugcucaggauauccaaauauggaccuagauugucuauuaccccaagaauggguucaacauuuuuaccaagaaucagcaccagcacaauccgacguagcacuacuaagauuuguaaaucccgacacaggcagaguauuauucgaaugcaaacuacauaaauccggauauguaacaguagcccauacaggacaacacgauuuaguuaucccaccuaaugguuauucccgauucgacuccuggguaaaucaauuuuacacucuagcuccaaugggaaauggugcaggaagaagaagauaa

SEQ ID NO: 34590 - RNA, 1617 nt, Artificial Sequence
  derived and/or modified sequence opt6 from VP1__Norovirus_and/or_Norovirus-like__KC517377
augaaaauggcaucaagcgaugccaauccaucagacggaucagcagcaaacuuaguacccgaaguaaacaaugaaguaauggccuuagaaccaguagucggcgccgcaaucgccgcaccaguugccggacaacaaaacguaauugaucccuggauaagaaacaauuucguacaagcaccaggaggagaauuuacaguuucaccucgcaacgcuccaggagaaauacuauggucagccccauuaggaccagaucuuaauccuuauuuaucucaccuugcacgaauguacaacggauaugcaggcggauuugaaguacaaguaauauuagcaggaaacgcauucacagcaggaaagguaauauuugcagcaguuccuccaaauuuuccaacugaaggauuaucaccaucucaaguaacaauguuuccacacaucguaguagauguacgacaauuagaaccuguauuaauaccacucccagauguaagaaacaauuuuuaucacuauaaccaaucuaaugauccuaccauaaaacucauagcaauguuauacgcaccuuuaagagcaaauaaugcaggagaugaugucuuuacuguaucuugcagaguucucacacgaccaucaccugacuuugacuucauauuucuaguuccaccaacaguagaaucacgaacaaaaccauuuucaguaccaguacuaacaguagaagaaaugacuaacucaagauucccuauuccucucgaaaaauuauuuacaggaccaucaucagcauucguaguacaaccucaaaauggccguugcacaacagacggaguauuacuaggaacuacacaacuaaguccaguuaacauauguacauuuagaggcgauguaacacacauaaccggaucaaggaauuacacaaugaaucuagcaucacaaaauuggaacaacuaugauccuacagaagaaaucccagcuccacuugguacuccagacuuugucgguaaaauacaaggagucuuaacccaaacaacaagaacagacggaucaacccguggccauaaagcaaccgucuauaccggaucagcagacuucgcaccaaaauuaggacguguacaauucgaaacagauacagaucaugauuucgaagcaaaucaaaauacaaaauuuacucccguaggaguuauacaagacggaggaacuacacauagaaaugaaccccaacaaugggucuuaccaucuuauucaggacgcaauacccacaacguucaucucgcaccagcagucgccccuacguucccaggagaacaauuacuuuucuuuagauccacaaugccaggaugcaguggauauccaaauauggaucuagauugucuauuaccacaggaauggguacaauacuuuuaucaagaagccgcacccgcacaaagugauguagcccuauuacgcuuuguaaauccuaacacaggaagaguauuauucgaauguaaacuacauaaaucaggcuauguaacagucgcccauacaggacaacaugacuuaguaauaccaccuaaugacuacuuucgauucgauucauggguaaaccaauuuuauaccuuagcuccaaugggaaacggcacaggacgaaggagauaa

SEQ ID NO: 34591 - RNA, 1617 nt, Artificial Sequence
  derived and/or modified sequence opt6 from VP1__Norovirus_and/or_Norovirus-like__KC517368
augaaaauggcaucaaaugaugcaaacccauccgacggaucagcagccaacuuaguaccugaaguaaacaacgaaguuauggcuuuagaaccugucguaggcgcagcuauagcagcuccaguagcaggacaacaaaacguaauagacccauggauaagaaauaacuuugcacaagcaccuggaggagaauuuacuguaucaccacgaaaugcaccaggagaaauauuauggucagcaccauuaggccccgaucuaaauccauauuuaucacacuuagcucguauguacaauggauacgcuggaggcuucgaaguacaaguaauacucgcugaaaaugcauuuacagcuggaaaaauuauauuugccgcaguaccaccaaauuuucccaccgaaggauuaucacccucaagaguaacuauguucccacacauaauaguagacguaagacaauuagaaccuguauuaauaccauuaccagauguacguaacaauuuuuaucacuauaaccaaucaaaugacaguacaauaaaacuaaucgcaaugcuauacaccccauuaagagcaaacaaugcaggcgaagacguauuuacaguaucuuguagaguuuuaacaagaccuucaccugacuucgacuucauauuuuuaguaccacccacuguugaaucacgaaccaaacccuuuaccguuccuauauuaacaguugaagaaacaacaaacucaagauuuccaauacccuuagaaaaacuauuuacaggaccuucaagugcauuuguaguccaaccacaaaaugguagaugcacuacagacggaguauuacuaggaaccacccaacuaucuccuguaaauauaugcacauuuagaggagauguaacccauaucgcaggaucaagaaauuacacaaugaaucuagcaucucucaauuggaacaacuacguacccacugaagaaauaccagcuccuuuaggaacaccagacuucguaggaaaaguucaaggaaugcucacacaaacaacaaagggagacggcucaacaagaggacacaaagcaacuguuuauacagguucagcaccuuuuacucccaaauuaggaucuguacaauucgaaacugauaccgaaaaugauuucgaaacacaucaaaauacaaaauucacaccaguagguguaauacaagauggaggaacuacccaccgaaaugaaccccaacaauggguuuuaccaucauauucaggaagaaacgucccaaacguacauuuagcaccagcaguugcaccaacguuuccaggcgaacaacugcuauucuuuagaucaaccaugccaggaugcucuggauacccaaauauggaucuagauugcuuauuaccacaagaauggguacaacacuucuaucaagaagcagcaccagcacaauccgacguagcucuacucagauuuguaaauccagacacaggaagagucuuauucgaauguaaacuccauaaaucuggauauguaacuguagcucacacaggccaacaugaccuaguaauaccuccaaauggauacuuuagauucgauucauggguuaaccaauucuacacacuagcaccuaugggcaauggaacaggaagacgccgauaa

SEQ ID NO: 34592 - RNA, 1617 nt, Artificial Sequence
  derived and/or modified sequence opt6 from VP1__Norovirus_and/or_Norovirus-like__AB541310
augaaaaugagaucaagugaugcaaacccaagugacggaucuacugcaaaucuugucccagaagucaauaaugaaguaauggcauuagaaccaguaguaggcgcagccauagcagcaccaguagcaggacaacaaaauguaauagacccauggauucgaaauaacuuuguacaagcaccaggaggagaauuuacaguuucacccagaaaugcacccggcgaaauccuauggucagcuccacuaggcccagaucuaaauccauaucucucccauuuagcucgaauguacaacggauaugcuggagguuuugaaguacaaguaauccuagcaggcaaugcauuuacagcaggcaaaauaauauuugcagcaguaccaccuaauuuuccaacagaaggucuaucuccaucacaaguaacaauguuuccacacaucauaguagacguccgacaacuagaaccaguccuaauuccccuaccagauguucgaaacaacuuuuaccacuacaaucaaucaaaugaucccacaauaaaacucaucgcuaugcuauauacaccauuaagagcaaacaaugcaggagaugacguauucacaggaucaugccgcguuuuaacucgaccauccccugacuuugacuucaucuuuuuaguaccaccaaccguagaaucaagaacaaaaccauucagcguauccuucuuuacaggagaagaaaugacuaauucaagauuuccuaucccacuagaaaaacuauucacagguccaucaucagcauucguaguacaaccccaaaauggaagauguaccacagacggaguauuacuuggaacaacacaacuaucaccugucaacauauguacuuucagaggagacguaacacauauaacagguucgagaaauuauacuaugaaucuagcuacacaaaacuggaacucauacgacccuaccgaagaaauaccggccccuuuaggaacaccagacuuuguuggaaaaauacaagguguauuaacacaaacaacuagagccgacggaucaacaagaggacauaaagcaacuguauauaccgguucagcagauuucgcaccaaaauuaggcagaguacaauucgcuacagacaccgacaacgacuuugaugcaaaucaaaauacaaaauucacaccagucggcguaauacaagacggagauacagcccacagaaaugaaccccaacaauggguucuacccucauauucaggaagaaauucacacaauguacauuuagcuccugcaguugcaccaacauuuccuggagaacaacuucuauucuuuagaucaacaaugccaggauguucuggauauccaaauauggauuuagauuguuuauuaccucaagaauggguccaauauuuuuaucaagaagcagcaccagcccaaagcgauguagccuuauuaagauuuguaaacccagacacaggcagaguauuauuugaauguaaacuacauaaaucaggcuacguaacaguagcacauacaggccaacacgauuuaguuauaccaccaaauggauauuuuagauuugauucauggguaaaucaauuuuacacacuagcaccaauggguaauggaacaggcaggagaagauga

SEQ ID NO: 34593 - RNA, 1617 nt, Artificial Sequence
  derived and/or modified sequence opt6 from VP1__Norovirus_and/or_Norovirus-like__EF535854
augaaaauggcaaccaacgaugcaucuccaucggaugguucaacagcaaaucuagucccagaaguaaauaaugaagucauggcauuagaaccuguaguaggagccgcaauugcagcaccuguagcaggucaacaaaauguuauugacccauggauaagaaacaauuucguacaagcaccagguggagaauuuacaguuucaccaagaaacgcucccggagaaauucuaugguccgcacccuuaggaccagacuuaaauccuuaccuuucacaucuugcaagaauguauaacggauacgcaggaggauuugaaguagaaguaauauuagcuggaaaugcauuuacagcuggcaaaauuauuuuugcugcaguaccaccaaacuuuccaacagaaggucuuaguccaucacaaguaacaauguuuccucauauaaucguagacguacgacaacuggaacccguccuaauaccauuaccagacguuagaaauaauuuuuaucacuauaaccaauccaaugauucaacaauaaaauuaauagccauguuauacacuccauuacgagcgaauaaugcaggagaugauguauuuacuguaucauguagaguauuaacuagaccaucucccgacuucgacuuuauauuucuaguaccuccaacaguagaaagucgaacaaaacccuucacuguaccaauucucaccguagaagaaaugacaaauucacgcuuuccuauaccacuagaaaaauuauuuaccggaccaucaucugcauuaguuguacaaccccaaaacgguagauguacaacagacggcguccuauuaggaacaacacaacuaucucccgucaauauaugcacauuucgaggugauguuacucauauaucaggcacuagaacuuaccgaaugaaucuugccucccaaaauuggaauaacuaugacccaacugaagaaauaccagccccacuaggaacaccagacuuuguagguaaaauacaaggaaugcuaacucaaacuacaaaaggugauggaucuacccgaggucauaaagcaacugucucaacugguuccguagauuucacaccaaaauuagggucuguucaauucgcuacagauacugauaaugauuuugaaacaggacaaaauacaagauucacaccuguuggcguaauacaagaugguucauccgcacauagaaaugaaccacaacaauggguauuaccagauuacucaggaagaacuguacacaauguacauuuagcaccagcaguugcaccuacauuuccuggagaacaauuaccauuuuucagaucaacuaugccuggaugcucaggauaucccaauauggauuuagauugucuuuuaccucaagaauggguacaacauuucuaccaagaagcugcacccucgcaaucagauguagcacuuuuaagauuuguaaauccagauacaggacgaguuuuauuugaauguaaauuacauaaagccgguuacguaacaguagcacacacaggacaacaugauuuaguaauaccaccaaaugguuauuuucguuucgacucauggguaaaucaaagcuauacacuugcacccaugggcaauggugcaggacgacguagauaa

SEQ ID NO: 34594 - RNA, 1617 nt, Artificial Sequence
  derived and/or modified sequence opt6 from VP1__Norovirus_and/or_Norovirus-like__KX514368
augaaaauggcuucuaaugaugcaaacccaucagaugguuccgcagcaaaccuuguacccgaaguuaacaaugaagugauggcauuagaaccaguaguaggugcugcaauugcagcaccaguugcaggacaacaaaauguaauagaucccuggauuagaaauaauuucguacaagcaccaggaggagaauuuacagucucaccaagaaaugcaccuggagaaauuuuauggagugcaccuuuagguccagaucuuaacccauauuuaucacaccuugcacgaauguacaacggauaugcaggaggauucgaaguccaaguaauauuagcaggcaaugcauuuacugcaggaaaaaucauuuucgcagcaguaccaccaaacuuuccuaccgaaggccuaagcccaucucaaguaacaauguuuccacauaucauaguugacguacgacaacuagaaccaguacuaauacccuuaccugacguaagaaauaauuuuuaccacuacaaucaaucaaaugacucuacaaucaaacuaauagcaauguuauacacaccccuaagagcaaauaaugccggagacgauguauucaccguuucuugccgaguauuaacaagacccucaccagacuuugacuuuauauuuuuaguaccaccaacaguagaaucuagaucuaaaccauucucaguaccaguauuaacaguagaagaaaugaccaauucaagauucccagcaacucucgauaaauuauuuacaggaccuucaucaacuuucguaguacaaccucaaaauggaagauguaugauagauggaguacuauuaggaacaacacaacuauccccaguaaacauuugcaccuuccgcggcgauguaacccauccagguaacuccaaaauauauacaaugaaucuagcuucacccaauuggaauaacuaugacccaacagaagaaauacccgcuccacucggaacaccagauuucguaggaaaaauacaaggaauguuaacucaaacaacaaaaggagaaggaucaacccgaggacacagagccacaguauacguagguucagcaaacuaugcccccaaauuaggacgaguucaauuugaaacugacacuacagaugacuuagaugcacaucaaaacacuaaauucaccccaguaggaguaguucaagguggugaaucaccaaaaggauccgaaccacaacaauggguauuaccaucauacucaggaagagauacaccuaacguucacuuagcuccagccguagcaccuaccuuuccuggagaacaauuacucuucuuuagaucaaccaucccagguugcggaggacaucccaauaugaaccuagauugccuccuaccacaagaauggguacaacauuuuuaccaggaagcagcaccagcacaaucagacguagcauuauuacgcuuuguuaauccagacacaucaagagucuuauuugaaugcaaauuacauaaaucaggauauguuacaguagcucacacaggacaacacgaccuaguaauaccaccuaacgguuauuuuagauuugauucauggguaaaucaauuuuacacauuagccccaaugggaaauggcacuggaagaaaaagauaa

SEQ ID NO: 34595 - RNA, 1617 nt, Artificial Sequence
  derived and/or modified sequence opt6 from VP1__Norovirus_and/or_Norovirus-like__KX514351
augaaaauggcaucaaaugacgccaacccuagugacggcucuacugcuaacuuaguaccugaaguaaauaaugaagucauggcauuagaacccguaguaggagcagcaauugcagcuccagucgcaggccaacaaaauguaauugacccauggauucgcaauaauuuuguacaagcaccagguggagaauuuacaguuucaccaagaaacgcgcccggagaaauacucuggucagcaccuuuaggaccaggauuaaacccauaccuaucacauuuagcacguauguacaaugguuaugcuggcgguuucgaaguacaaguaauacuugcagguaacgccuucacagcaggcaaaauaauuuucgcugcagucccuccaaacuucccaacagaaggacuaaauccaucucaaguaacaauguuuccucacaucauagucgauguacgucaauuagaaccaguucuaauuccccuaccagauguccgaaacaauuuuuaucacuauaaucaaucaaaugacuccacaauaaaauuaauagccaugcuuuacaccccauuaagagcuaauaaugccggugaugauguauuuaccguaucaugucguguauuaacaagaccaucaccagauuuugauuucauauuucuaguacccccuacaguugaaucaagaucuaaacccuucucaguaccaguacuuacaguacaagaaaugacaaacucaagauuuccagcaacauuagacaaacucuuuacaggcccaucuucaaaccuaguaguacaaccacaaaacggaagauguaugauagacgguguacuacuagguaccacacaacuuucaccugucaacauaugcacuuuccgaggagacguaacucauuuacgagacucuacaauauacaccaugaaccuagcaucacccaacuggaauaacuaugaccccacagaagaaaucccugcaccacuuggaaccccugacuuugucggaaaaauccaaggaguacuaacacaaacaacaaaaggugaaggauccacucgaggacauagagcaacaguauacguaggcucugcuaauuauacaccaaaacuaggaaaaguacaauuugaaacaaauaccacaaacgauuuauaugcccaucaaaauacaaaauucacaccuguugguguaguacaaggaggagaaucagcacauagaucagaaccccaacaauggguacuuccuggauuuucaggacgagauacuccaaacguucauuuagcuccugcaguagcaccaaccuuuccuggugaacaauuacucuucuuccgaucaaccauuccaggaugcggcggucauccaaacauggaucuagauuguuuacuaccacaagaauggguccaacauuucuaucaagaagcagcuccagcacaaucagacguugcacuucuaagauucguaaacccagacacuucacgagucuuauucgaauguaaacuacauaaauccggauauguaacagucgcacauacuggacaacacgacuuaguaauaccuccuaacggauacuuccgauucgacucuuggguaaaucaauuuuacacacuagcaccaaugggaaauggaacaggaagaaaacgauaa

SEQ ID NO: 34596 - RNA, 1617 nt, Artificial Sequence
  derived and/or modified sequence opt6 from VP1__Norovirus_and/or_Norovirus-like__KC517372
augaaaauggcaucaaaugacgcuaauccaucagauggaucagcaguuaauuuaguaccagaagucaauaaugaaguaauggcauuagaaccaguagucggugcagcaauugccgcaccuguagcaggacaacaaaauguaauagauccauggauaagaaauaauuucguacaagcuccuggcggagaguucacaguaucaccccgaaacgcuccuggagaaauauuauggucagcaccucuaggaccugauuuaaauccauaccuaucccaucuugcacguauguauaacggauacgcaggaggauuugaaguacaaguaauacuagcaggaaaugcauucacugcaggaaaaauaauauucgcugcaguacccccaaacuucccaacagaaggucucucaccuucucaaguuacaauguuuccacauauuauaguugaugcucgacaguuagaaccaguauuaauaccccuaccagacguaagaaauaauuucuaccacuacaaucaaucaaaugauucaacaauaaaacuaauagcaauguuauauacuccacuuagagcuaacaaugcaggagaagacgucuucacaguaucauguagaguacucacucgaccaucaccagacuucgacuuuauauuuuuaguuccuccaacagucgaaucuagaacaaaacccuucacagucccaauuuuaaccguagaagaaaugacaaauucuagguuuccaauaccuuuagaaaaacuuuuuacaggaccuucuucagcauucguaguacaaccacaaaauggcagaugcacuacugacggaguccucuuaggaaccacacaacuuucaccagucaauauauguacauuuagaggagauguagcacacaucgcaggaucaagaaauuauaccaugaaucucgcuucacuaaacuggaacaacuacgacccaacagaagaaauaccagcaccuuuaggaacaccugacuucgucggcaaaauacaaggaauguuaacucaaaccacaaaaggcgacggauccacacgaggacauaaagcaacuguauauacaggcagcgcacccuuuaccccuaaacuaggauccguacaauucgaaacugacacagaaaaugauuucgaaacucaccaaaauacaaaauucacuccuguaggaguuauacaagacgguggaaccacacauagaaacgaaccacaacaauggguauuacccucauauucuggaagaaauguaccuaauguacaccucgcaccagcaguugcaccuaccuuuccaggugaacaacuauuacucuuccgaucaacaaugccuggaugcuccggauacccaaacauggaucuugauugucuacucccacaagaauggguacaacauuucuaucaagaagcagcacccgcucaaucagauguagcccuccucagauuuguaaacccagacaccggacgcguauuauucgaauguaaacuacacaaaagcggauauguaacuguagcucauacaggacaacacgaucuaguaaucccaccaucuggauacuuuagauucgauagcugggucaaccaauuuuacacauuagcuccaaugggcaacgguacaggaagaagaagauaa

SEQ ID NO: 34597 - RNA, 1617 nt, Artificial Sequence
  derived and/or modified sequence opt6 from VP1__Norovirus_and/or_Norovirus-like__JN400613
augaaaauggcaucaaaugaugcaaauccaucagauggcucugcagcaaaccuaguuccagaaguuaacaaugaaguaauggcuuuagaaccuguuguaggagccgccauagccgcucccgucgcaggacaacaaaacguaauagauccauggauaagaaauaauuuuguacaagcaccaggcggagaauuuacaguaucuccacgaaacgcaccaggagaaauacuuuggucagcuccauuaggaccagauuuaaauccauaucuaucacaucuagcaagaauguacaacggauacgcuggaggauuugaaguacaaguaauacuugcaggcaaugcuuucacagcaggcaaaauaauauucgccgcaguaccaccaaacuuuccuacagaaggacuaucaccaucacaaguaacaauguucccccacauaauaguagacguccgacaacuugaaccagucuuaauaccauuaccugacguaagaaacaauuuuuaucauuauaaccaaucuaaugacucaacaauuaaacuaauugcaaugcuauacaccccacuuagagcuaacaaugcaggagaagauguauuuacaguuuccugcagaguacuaacaagaccaucuccugauuuugauuuuauauuuuuaguaccaccaaccgucgaaucacgaacuaaaccuuuuacaguaccaauacucacuguagaagaaaugaccaauucaagguucccuauaccauuagaaaaacuauuuagaggaagaaguuccgcauuaguagugcauccacaaaacggaagauguaccacagauggaguacuacuuggcacaacccaauuaucaccaguaaauaucuguacauuuagaggagacguaacccauauagcagguucacacaauuacacaaugaaccucgcuagucuaaauuggaacaacuacgauccuacagaagaaauaccugcaccauuaggaacacccgauuuuguaggcaaaauacaaggaguccuuacacaaacaacaaaaggagacggaucuacuagaggacacaaagcuacaguauacacaggaucugccccuuuuaccccaaaacucggaucaguacaauuuucaacagacacagaaaaugauuucgaaacacaucaaaauacaaaauucacaccagucggaguaauacaagacgguucuaccacacacaggaaugaaccacaacaauggguccuacccuccuauuccggcggaaauguucacaacguccaccuugcaccagcgguagccccaacuuuccccggagaacaauuauuauucuuuagauccacuaugccuggaugcucaggauaucccaauauggaucuagacugccuccuuccacaagaauggguccaacauuucuaucaagaagcagcacccgcacaaucagauguagcauuacuaagauucguuaacccagauaccggaagaguacuauuugaauauaaauuacauaaaucagacuauguaacaguagcacacaccggacaacaugaucuuguaauaccuccaaacggauacuucagauucgacucauggguaaaucaauuuuauacuuuagcagcaaugggcaauggaacaggccgaagaagauaa

SEQ ID NO: 34598 - RNA, 1617 nt, Artificial Sequence
  derived and/or modified sequence opt6 from VP1__Norovirus_and/or_Norovirus-like__KX514291
augaaaauggcuuccaaugacgcaaauccaucugaugguucagcagcuaaccuaguaccagaagucaauaaugaaguaauggcucuagaaccaguuguaggcgcagcuauugcagcuccaguagccggacaacaaaacguaauagacccauggauuagaaacaacuucguacaagcaccuggaggagaauuuacaguaucaccaaggaaugcccccggagaaauacuauggucagcacccuuaggaccagaccuaaauccauauuuaucucaucucgcaagaauguauaaugguuacgcuggagguuucgaaguacaaguaauauuagcggguaaugcauucacugcagggaaaauaauuuucgcugcaguaccacccaacuucccaacagaaggacuaucuccuucccaagucacuauguuuccucauauaauaguagauguaagacaauuagaacccguacuaauaccccuuccagacguaagaaacaauuucuaucauuauaaucaaucuaacgauucuacaauaaaguuaauagccauguuauauacuccauuaagagcaaauaacgcaggagacgauguauuuacaguaucuugucgaguacuaacaagaccaucaccagauuuugauuuuauauuucuaguaccaccaacaguagaauccagaucaaaaccauucucaguuccaguccucacaguagaagaaaugacaaacucucgauucccagcaacccuagacaaauuauuuacagguccuucaucaacauuuguuguacaaccccaaaauggaagaugcaugauugauggcguauuauuaggaacuacacaacuaucaccaguaaauauauguacauuuagaggagacguaacacauccuagagacaguccaauuuauacaaugaauuuagcuucaccaaauuggaacaacuacgauccaacagaagaaauacccgccccuuuaggaaccccugauuuuacaggaaaaauacaaggaauguuaacucaaacaacaaaaggcgaaggaucaacacgaggacaccgugcaaccguuuauguaggcucagcaaacuacgcaccaaaauuaggaaggguacaauucgaaacagacacuacaaacgaccuagaugcccaucaaaacacaaaauucacaccagucggaguaauucaagguggagaaucugcacaucgaucugaaccucaacaauggguuuuaccauccuacucaggucgagauacaccaaacguacaucuagcaccagccguagcaccaacauuuccaggagaacaacuauuauucuuuagaagcacuauaccaggaugcggaggacacccuaauaugaaucuagacugccuauuaccucaagaauggguccaacauuuuuaccaagaagcugcaccagcacaaucagacgucgcauuacuaagauucguuaauccggauacuucaagaguauuauucgaaugcaaacuacauaaauccggauauguaacuguagcucacacuggacaacaugaucuaguaauaccucccaauggauacuuuagauuugacucauggguaaaucaauuuuacacacucgccccaaugggaaauggaaccggucguaaacgcuaa

SEQ ID NO: 34599 - RNA, 1617 nt, Artificial Sequence
  derived and/or modified sequence opt6 from VP1__Norovirus_and/or_Norovirus-like__KX514219
augaaaauggcuucaaacgaugcuaacccuucagauggaucugcugcuaaucuaguaccugaaguuaauaaugagguaauggcacuagaaccaguaguuggugcagcaauagccgcuccaguugcaggacaacaaaaugucaucgauccauggauacguaacaacuucguacaagcaccaggaggagaauuuacaguuucaccccgcaaugcaccaggagaaauauuauggucagcaccuuuaggaccagacuuaaauccuuaccuaucacauuuagcacgaauguauaauggauaugcugguggauucgaaguccaaguuauacuagcaggaaaugcauuuacagcaggaaaaauaauauuugcagcagucccacccaauuuccccacagaaggcuuaagccccucacaaguaaccauguucccccauauaauaguagauguaagacaauuagaaccaguacuaauaccuuuaccagauguacgaaauaauuucuaucacuauaaucaauccaaugacucaacaauaaaacuaaucgcaauguuauauacaccauuaagagcaaauaaugcaggagaugaugucuuuacaguauccugucguguauuaacaagaccaaguccagauuuugacuuuauauuucuuguuccuccaacuguggaaucaagaucaaaaccauucaguguaccaguacuaacaguugaagaaaugacaaauucaagauuuccagccacacuugacaaauuauuuacagguccaucaucaacuuuuguaguacaaccacaaaauggacgauguaugauagauggagucuuauuaggcacaacacaauuaucaccaguaaauauuugcacuuuuagaggagauguaacacacccaagagauuccccuauauacacuaugaacuuagcaucuccaaauuggaacaauuaugacccaacagaagaaauaccagcaccucuaggaacacccgauuuuguuggcaaaauacaaggcaugcuaacacaaacaacuaaaggugaaggaucuacaagaggucacagagcaacugucuauguagguagugccaauuaugcuccaaaauuaggaagaguacaauucgaaacagauacaaccaacgaucucgacgcacaucaaaauacuaaauuuacuccagugggaguaguacaaggaggagaaucaccacaaaggucagaaccacaacaauggguacuaccuuccuauuccgguagagacacaccuaacguacauuuggcaccagcaguagccccaacuuucccaggagaacaauuacuuuucuuuagaucaacauuaccaggaugcggaggacauccaaauauggaucuugauuguuuacuuccucaagaauggguccaacacuuuuaccaagaagcugcaccagcacaaucugacgucgcauuacucagauuuguuaauccagacacauccagaguuuuauuugaauguaaauuacauaaaucaggcuauguuacuguugcacauacuggacaauacgauuuaguauuaccaucuaaugguuacuuucguuuugauucaugggucaaucaauuuuacacucuagcuccaaugggaaauggaacaggaagacgaagauaa

SEQ ID NO: 34600 - RNA, 1617 nt, Artificial Sequence
  derived and/or modified sequence opt6 from VP1__Norovirus_and/or_Norovirus-like__AB933668
augaaaauggcuuccaaugacgcuaacccaucagauggaucagcagcaaaccuaguaccugaaguaaauaaugaaguaauggcauuagaaccugucguaggugcagcuaucgcagcaccagucgccggucaacaaaauguaauagauccauggauaagaaauaacuucguacaagcaccuggcggugaauuuacaguaucuccaagaaaugcaccaggagaaauacuauggucagcaccuuuaggaccagaccuuaauccauacuuaucacacuuagcuagaauguacaauggauacgcugguggauuugaaguucaaguuauauuagcaggaaaugcauucacaguagucaaaacaacauugucagcaguaccgccaaauuuuccaaccgaagguuuaucaccaucccaaguaacaauguuuccucacauaauaguugauguaagacaacucgaaccaguacuuauucccuuaccagauguaagaaauaauuuuuaccauuauaaccaaucaaaugauucaaccauaaaacuaauagcaaugcuauacacaccacuaagagcaaacaaugcuggugaagacgucuuuacuguaucaugcagaguauuaaccagaccaagcccagauuucgauuuuauauucuuaguacccccuacaguggaaagccgcacaaaaccauuuacuguaccaauauuaacaguugaagaaaugacaaacucacgcuucccaauaccauuagaaaaacuauuuacaggcccaucaucagcauucguaguacaaccucaaaacggacgcuguaccaccgauggcguauuauuaggaacuacucaacuuuccccaguaaacauauguacauuuagaggagauguaacacauauagcaggaucaagaaacuacacuaugaaucuagcaagccucaauuggaauaauuacgacccaacagaagaaauuccugcaccacuaggaacuccugauuuuguaggaaaaauacaaggaguacuaacacaaacuacuaaaggagacgguaguacacgaggccacaaagcaacaguauauacaggauccgcaccauuuacaccaaaauuagguucaguucaauucucaacugauacagaaaacgacuucgaaacacaucaaaauacuaaauuuacaccaguaggaguaauacaagauggaggaacaacacacagaaaugaaccacaacaauggguauuaccauccuauucaggcagaaaugucccaaacguucacuuagccccugcaguagcaccuaccuuucccggugaacaacuacuauucuuuagaucaacaaugcccggauguucaggauaucccaauauggaucucgauugccuacuaccacaagaauggguacaacauuuuuaucaagaagcagcaccagcacaauccgacguagcacuauuaagauuuguaaaccccgauacuggaagaguauuauuugaaugcaaacuacacaaaucuggcuacguaaccgucgcucauacuggucaacaugaucuaguaauaccaccaaauggauauuuuagauuugacucauggguuaaucaauucuacacucuugcccccaugggaaauggcacgggaagaagaagauaa

SEQ ID NO: 34601 - RNA, 1617 nt, Artificial Sequence
  derived and/or modified sequence opt6 from VP1__Norovirus_and/or_Norovirus-like__KJ678149
augaaaauggcaucuuccgacgcuaauccaucagacggaucugcagcuaacuuaguaccagaaguuaauaaugaaguuauggcacuagaaccaguaguaggagcagcaauagccgccccagucgcaggacaacaaaauguaaucgacccauggauaagaaauaauuuuguacaagcaccuggaggagaauuuacaauaucaccaagaaaugcaccuggagaaauccuuuggucagccccauuagguccagacuuaaauccauaucuaucacacuuagccagaauguauaacgguuaugcuggaggcuuugaaguacaagucauucuagcuggaaaugcauuuacagcugguaaaguaauauucgcagcaguaccacccaacuuuccuacugaagguuuaucaccaucucaagucacaauguucccacacauuguaguagauguacgacaacuagaaccaguacuuauuccauuaccagauguacguaauaacuucuaucacuacaaucaaaguaaugauucuaccauaaaacuaauagcaauguuauauacaccauuaagagcaaacaacgcaggagacgauguauuuaccguaucaugucgaguacuaacuagaccuagccccgacuuugacuuaauauuucuaguacccccuacaguagaaucucgaaccaaaccauucuccguaccaguacuuacaguugaagaaaugacaaauucuagauuucccaccccacuagaaaaauuauuuacagguccaucaucagcauucgucguacaaccucaaaauggaagauguacaacagacggaguacuacuuggaacaacacaacucucuccaguuaacauaugcacauucagaggugacgucacucauauuacaggaucaagaaauuacaccaugaaucuagcaucacaaaauuggucaaauuaugauccgacagaagaaauaccugcaccauuagguacaccagacuuuguaggaaaaauucaggguguacuaacacaaacaacaagaacagacgguucaacuagaggacauaaagcaacaguauacacugguucagcagacuuugccccaaaacuaggaagaguacaauuugaaacagacacagaucaugauuuugaaacuaaucaaaacacaaaauucacaccuguaggcguaauacaagacgguucaaccacccacagaaaugaaccacaacaauggguacuaccuagcuacuccggaagaaauaccccaaacguucacuuagccccggcaguagcaccuaccuuuccaggggaacaacuacuauucuucagauccacaauuccaggaugcucuggauacccaaauauggacuuagauuguuuacuaccucaagaauggguacaauauuuuuaccaagaagcagcaccagcacaauccgacguagcacuauuaagauucguuaacccagacacuggaagaguucuuuuugaaugcaaauuacacaaaagugguuaugucacuguagcucauacuggacaacaugauuuaguaauaccucccaauggauacuucagauuugauucauggguaaaucaauuuuacaccuuagcaccaaugggaaauggaacaggcagacgacgcuga

SEQ ID NO: 34602 - RNA, 1617 nt, Artificial Sequence
  derived and/or modified sequence opt6 from VP1__Norovirus_and/or_Norovirus-like__KP244318
augaaaauggcaucuucagacgcaaacccaucugacgguucaaccgcuaaccuaguaccugaaguuaauaaugaaguaauggcccuagagccaguaguaggagccgcaauagcagcacccguagcaggccagcaaaauguaauagaucccuggauaagaaacaauuuuguacaagcacccggcggugaauuuacagucaguccacgaaacgcacccggagaaauacuauggagugccccacuaggaccagauuuaaacccauaucuaucacacuuagcaagaauguauaacgguuaugcaggcggcuuugaaguacaaguaauacucgcuggaaaugcauucacagcaggaaaaauaauauuugcagccguaccaccaaauuuuccuacagaaggacuaucaccaagucaaguaacaauguuuccacacauaauaguagacguaagacaacuagaacccguacuuauaccauuaccagauguuagaaauaauuucuaucacuauaaccaaucuaaugacccaacaauaaaacuaauagccauguuauacacaccacuccgugcuaacaaugccggagacgauguauucacaguaucaugcagaguacucacuagaccuucaccagacuuugacuuuauauuccuaguucccccaacaguagaaucccgaacaaaaccauuuucagucccagucuuaacaguagaagaaaugacaaauucaagauuucccauaccacuagaaaaauuauuuacaggcccaucauccgccuucguaguacaaccccaaaauggaagauguacaacagauggaguacuacuagguacaacucaacuaucaccuguaaauauaagaacauuuagaggugacguaacacacauaccaggaucuagaaauuauacaaugaauagcgcaucccaaaacuggaacucauaugauccaacagaagaaauacccgcaccauuaggaaccccagauuuuguaggaaaaauucaaggaguacuaacacaaacaacaagagcaaauggaaguacaagaggacacaaagcaaccguauauacaggaucagcagacuucucgccuaaacuaggaagaguacaauuugcaaccgauacagacaaugauuucgaaacaaaucaaaacacaaaauuuacaccuguuggaguaauacaagacggaucaacaacaccacguaacgaaccacaacaauggguacuaccaucauacucagguagaaacauacauaacguacauuuagccccugcaguagcaccuacauuuccaggagaacaacuauuauucuuuagaucuaccaugccuggcuguucaggauaccccaacauggaucucgauugcuuacucccacaagaauggguucaauauuuuuaucaagaagcagccccagcucaaucugacgucgcauuauuacgauuuguaaacccagauacaggacgaguauuauucgaaugcaaacuucacaaauccggauacguuacaguagcccacacaggacaacacgaucuaguaauaccuccaaacgguuacuucagauucgacucauggguuaaccaauuuuacacauuagcuccuaugggcaauggcacaggaagaagaagauaa

SEQ ID NO: 34603 - RNA, 1617 nt, Artificial Sequence
  derived and/or modified sequence opt6 from VP1__Norovirus_and/or_Norovirus-like__KX514362
augaaaauggcuucaaacgaugcuaauccaucagauggaucagcagcaaacuuaguaccugaaguaaacaaugaaguaauggcauuggaacccgucguaggagccgcaauagccgcaccaguagcaggacaacaaaacguuauagauccuuggauacgaaauaacuuuguacaagcaccaggaggagaauuuacaguuagcccucgaaaugccccuggagaaauacuuuggucagcaccauuaggaccagacuuaaauccuuaucucagccaccuagcucgaauguauaaugguuaugcaggaggauuugaaguccaaguaauauuagcaggaaaugcuuuuacagcagguaaaauaauauuugcugcagucccacccaacuuucccacagaaggcuuaucccccucacaagucacuauguuuccucauauuaucguagacguacgacaacuagaaccaguauuaaucccacuaccagauguuagaaacaacuuuuaucauuauaaccaaucaaacgauucaacaauaaaacuaauagcaaugcuuuacacaccuuuacgcgcuaacaaugcuggcgaugauguauuuacagucucaugucgaguucuaacuagaccauccccagauuuugauuuuauauuccucguuccaccuacagucgaaucacguucuaaaccauuuucaguaccaguacuuacuguagaagaaaugacaaauagcagauuuccagcuaccuuagacaaauuauuuacaggacccucaaguacauucguaguacaaccucaaaacgguagauguaugauagacggaguucuccuuggaacaacucaauuaucaccuguuaauauauguaccuucagaggagacguuacacauccagguggcucuaaaauauauacaaugaaccuagcaucccccaauuggaauaauuacgacccaacagaagaaauaccugcuccacuaggaacacccgacuuugucgguaaaauucaaggaaugcuaacacaaacaaccaaaggagaagguucaaccagaggccacagagcaacaguauauguaggaagugcuaacuaugcaccaaaacuuggaagaguacaauuugaaacugauacuacagaugauuuagacgcccaccaaaauacaaaauucacaccuguaggaguaguacaagguggagaaucaccaaaaggaucugaaccacaacaaugggugcuaccuucauauucaggaagagauacaccuaauguacauuuagcacccgcaguagcaccaacauucccaggagaacaauuacucuucuuuagaucuacaauaccaggauguggaggacacccaaauaugaauuuagauuguuuacuaccucaagaauggguacaacauuuuuaucaagaagcagccccagcacaaucagacguagcacuauuacgauuuguaaauccagacaccucacgaguuuuauucgaauguaaauuacauaaaagcggauauguaacaguagcccauacaggucaacacgauuuaguaauaccgccaaauggcuauuuccgauucgauucauggguaaaucaauucuauacacuagcgccaauggguaauggaacaggaagaaaaagauaa

SEQ ID NO: 34604 - RNA, 1617 nt, Artificial Sequence
  derived and/or modified sequence opt6 from VP1__Norovirus_and/or_Norovirus-like__KX514329
augaaaauggcaucaucagaugccaaucccucugauggaucagcagcaaauuuaguaccagaagucaauaaugaaguaauggcacuugaaccaguaguaggagcagcaauagcagcacccguugcaggccaacaaaauguaauagacccauggauaagaaauaacuucguccaagcacccggaggugaauuuacgguaucaccaagaaacgcuccuggagaaauauuauggucugcaccauuagguccagauuuaaauccauaucuuucucaucuagcaagaauguacaauggauaugccgguggauucgaaguucaaguaauauuagccgguaaugcuuucacagcaggaaaaauaauauuugcagcuguaccaccuaauuuuccuacagaaggauuaucuccuagccagguuacuauguuuccucacauaauaguagauguucgacaacuagaacccgucuuaauaccacuaccagauguaagaaauaauuuuuaccauuauaaucaaucaaacgauucaacaauuaaacucaucgcaaugcuauacacaccacuaagagcaaacaaugccggcgacgacguuuucacuguauccugcagaguauuaacaagaccaucuccagauuucgauuuuauauucuuaguaccuccuacuguagaauccagaucaaaaccauuuucaguacccguacuuaccguagaagaaaugacaaauucaagauuuccagccacucuagauaaauuauuuacaggaccuuccuccacauuuguaguacaaccacaaaauggacgauguaugauagauggaguucuauuagguacaacacaacuaucaccuguaaacaucuguacauucagaggcgacguaacacauuccggaaauucaaagauauauacuaugaacuuagcuucaccgaacuggaacaacuaugauccuacagaagaaauuccugcaccauuaggaacaccagacuucguaggcaaaauacaaggcaugcuaacacaaacaacuaaaggagaagguucaacaagaggccauagagcaacaguuuauguaggauccgccaauuacgcaccaaaauuaggacguguacaauuugaaacagacacaaccgaugauuuagacgcucaucaaaauacuaaauucacaccaguuggaguaguccaaggaggcgaaucuccaaaaggauccgaaccccaacaauggguauuaccaucauauucaggaagagauaccccaaauguacaucuagcaccagcagucgcaccaacauuuccaggagaacaauuauuauucuuucguuccacaaucccuggaugcggaggccauccaaauaugaaccuugauugcuuacuaccccaagaauggguacaacacuuuuaccaagaagccgcaccagcacaaucugacgucgcacuuuuacgauuuguaaacccagauacuucuagaguauuauucgaauguaaacuucauaaauccggauauguaacuguagcacauacaggucaacaugauuuaguaauuccaccaaaugguuauuuuagauuugacucaugggucaaucaauuuuauacacuagcacccaugggcaacgguacagguagaaaacgcuaa

SEQ ID NO: 34605 - RNA, 1617 nt, Artificial Sequence
  derived and/or modified sequence opt6 from VP1__Norovirus_and/or_Norovirus-like__KJ678152
augaaaauggcaucaucagaugcaaauccaugcgauggaucagcugccaacuuaguaccagaaguaaauaaugaaguaauggcauuagaaccuguuguaggagcagcaaucgcugcacccguaggaggacaacaaaaugucauugacccauggauucguaauaauuuuguucaagccccagguggugaauuuacaguuucaccucgaaaugcaccaggagaaauacucuggucagcaccauuaggaccagaccuaaacccauaccuaucacaucucgcacgcauguacaauggauacgcuggugguuuugaaguacaaguuauacuugcaggaaaugcguucacagcaggaaaaguaauauuugcagcaguuccacccaauuuucccacugaaggacucucaccaucacaaguaacaauguuuccacauauaguaguagauguaagacaauuagaaccuguauuaauaccacuaccagauguccgaaacaauuuuuaucacuauaaccaaucaaaugauaguacaauaaaauuaaucgccauguuauauacuccauuacgagcaaauaacgcaggagaugacguauuuacaguuucaugccguguauuaacuagaccaucaccagauuuugauuucaucuucuuaguacccccuacaguagaguccagaacaaaaccauuuucuguacccguuuuaacuguagaagaaaugaccaauagucgauuuccaaccccuuuagaaaaauuauucaccgggcccucuucagccuuuguaguucaaccccaaaacggaaggugcaccacagacggaguuuuacuaggaacuacacaacuaucuccaguaaacaucuguacauuuagaggagaugucacccauauaacaggaucccgaaacuacacaaugaauuuagcaucacaaaauuggaguaauuacgaucccacagaagaaauaccagcuccauuaggaacacccgacuuugucggaaaaauacaaggcguuuuaacacaaaccacacgaacagacgguucgacucgaggucauaaagcaacaguauauauaggaucugccgauuucgcaccaaaauuaggaagaguccaauucgaaacagacacugaccaugauuuugaaacaaaucaaaauaccaaauuuacaccaguagguguaauacaagacgguucuacaacacaucgaaaugaaccacaacaauggguacuaccaucuuacagcggacgcaauaccccaaacguacaccuagcaccagcuguagcaccuacauuuccaggagaacaauuacuauucuuccgaucaacucuuccagguuguucagguuauccuaauauggaucuagauugucuacuaccacaagaauggguacaauauuucuaccaagaagcagcgccugcacaaagugauguagcucuauuaagguucguaaauccagauacagguagaguauuauucgaaugcaaauuacauaaaucaggauacguaaccguagcacacacaggacaacacgauuuagucauaccuccaaacggcuauuuuagauuugacucauggguaaaucaauuuuauacauuagccccaaugggaaacggcacaggaagaagacgguaa

SEQ ID NO: 34606 - RNA, 1617 nt, Artificial Sequence
  derived and/or modified sequence opt6 from VP1__Norovirus_and/or_Norovirus-like__KX514352
augaaaauggcaucaaaugaugccaacccaucagauggauccgcggcaaauuuagucccagaagucaacaaugaaguaauggcauuagaaccuguaguuggagcagcuauagcagcaccaguagcuggucaacaaaauguuauagaucccuggauaagaaacaacuucguacaagccccaggcggugaguucaccguaucuccaagaaaugcaccaggugaaauauuauggucagcuccauuaggaccagaucucaauccauauuuaucacaucuugcucgaauguauaauggauacgcugguggauucgaaguacaagucauauuagcaggaaaugcauuuacagcaggaaaaaucaucuucgcagcaguuccaccaaauuuuccaacagaaggacuaucaccaucccaagucaccauguucccccauauaauaguugacguaagacaauuagaaccuguauuaauaccccuaccagauguuagaaauaauuuuuaucauuacaaucaauccaaugauuccaccauaaaauuaauagcaaugcucuauaccccucucagagcaaauaaugcaggagacgauguauuuacuguaucauguagaguauuaacacgaccaucuccagauuuugauuuuauuuucuuaguaccaccaacuguagaaucaagaucuaaaccauuuucuguaccaguauuaaccguagaagaaaugacuaacucacgauuuccagcuacacuugacaaacuauuuacaggaccaucaucaacauuuguaguacaaccacaaaaugguagauguaugauagacggaguacuccuagguacaacacaauuaucaccaguaaauauaugcacauucagaggagauguuacacauccuagagacucaccaaucuauacuaugaaccuugccucaccaaauuggaacaauuaugauccaacugaagaaaucccagcacccuuaggaacaccagauuuuguuggaaaaauacaaggaauguuaacacaaacuacaaaaggagaaggauccacaagaggucauagagcaacuguauacguaggcucagcaaacuaugcaccaaaguuaggaaggguucaauucgagacagauaccaccaaugaucuauaugcacaucaaaauacuaaauucacucccguaggugucguacaagguggugaaucagcucauagaucagaaccacaacaauggguuuuaccuggauauuccggaagagauacuccaaauguccaucuugccccugcaguagcaccuacauucccuggugaacaauuauuauucuuucgauccacaaucccaggauguggcggacaccccaauauggauuuagauuguuuauuaccccaagaauggguacaacauuuuuaucaagaagcagcaccagcacaaucagauguagcccuuuuaagauuuguaaauccugacacuucacgaguacuauuugaauguaaacuacacaaaucaggauauguaacaguagcacacacugggcaacaugacuuaguaauuccuccaaauggauauuucagguuugacuccuggguaaaucaauuuuauacccuugcaccuaugggaaacggcacaggaagaaaaagauaa

SEQ ID NO: 34607 - RNA, 1617 nt, Artificial Sequence
  derived and/or modified sequence opt6 from VP1__Norovirus_and/or_Norovirus-like__KX514339
augaaaauggcaucaucagacgcaaaucccucagacggcaguacagccaaucuagucccugagguaaacaaugaaguaauggcuuuagaaccaguaguaggagccgcaauagcugccccuguagcaggccaacaaaauguaauagaucccuggauuagaaauaauuuuguacaagcaccugguggagaauuuaccguaagucccagaaaugccccuggagaaauacuauggucagcuccauuaggaccagaucuaaauccauauuuaucacaccuagcccgaauguauaaugguuaugccggcggauuugaaguucaaguaauauuagccggaaacgcauuuacagccggcaaaauaauauuugcagcagucccaccuaauuuccccacagaaggacuuuccccaucacaagucacaauguucccacacauuauuguagacguaagacaacuugaaccuguauuaaucccacucccagaugucagaaauaauuucuaucauuauaaucaaucuaacgauucaacaauaaaacuuauagcaaugcuauauacaccauuacgcgcaaacaaugcuggugacgacguauucacuguauccugccgaguacuaacaagaccaucaccagacuucgacuucauuuucuuaguaccuccaacagucgaaucucgauccaaaccauuuucugucccaguccuaacaguugaagaaaugacaaacucaagauuuccagcaacauuagauaaacuauuuaccggaccaucuaguacuuuuguaguacaaccacaaaauggacgaugcaugauagacgguguacuucuaggaacaacucaacuaucaccaguaaauauuuguacauucagaggagaugugacucaaucaggaaauacaaaaaucuacacaaugaaccuagcauccccuaacuggaauaauuaugauccuacagaagaaauaccagcaccacuaggaacaccagacuucguaggaaaaauacaaggaaugcugacacaaacaacuaaaggagaaggaucuacacgaggccauagagcuacaguauacguaggaucagcaaacuaugcaccaaaacuagguagaguacaauuugaaacagauacaacagaugaucuagaugcacaucaaaauaccaaauuuacacccguuggcguuguacaagguggagaaucaccuaaagguucagaaccacaacaauggguacuaccuucauauucaggaagagauacaccaaauguacaccuugcacccgcugucgccccaacauuucccggcgaacaauuacuauucuuuagaucaacaauuccaggaugcggaggacauccuaacaugaaccuagauugcuuauuaccacaagaauggguacaacauuucuaccaagaagcagcaccagcacaauccgacguagcucuauuacgauucguuaauccagauacaucaagaguauuauuugaauguaaacuacauaaauccggauauguaaccguagcucacacaggacaacaugaucuuguaauaccacccaauggcuacuuuagauuugacucauggguaaaccaauuuuacacauuagcaccuaugggaaacggaacuggcagacgacguuaa

SEQ ID NO: 34608 - RNA, 1617 nt, Artificial Sequence
  derived and/or modified sequence opt6 from VP1__Norovirus_and/or_Norovirus-like__KR904238
augaaaauggcuucaucggacgccaacccaucugauggaucagcugcuaaccuaguaccagaagucaauaaugaaguaauggcauuagaaccaguaguaggcgcugcuauagccgcaccuguagcuggccaacaaaacguaauagaucccuggaucagaaauaacuuuguccaagcaccuggaggagaauuuacuguaucacccagaaaugcuccaggagaaauuuuauggucugcaccacuaggaccagaccuaaauccauauuuaucacacuuagcaagaauguauaauggcuacgcuggagguuucgaaguacaaguaauauuagcaggaaacgcauuuacagcuggcaaaauaaucuucgcagcuguaccaccaaacuuuccaaccgaaggacuaucaccaucucaaguaacaauguucccacacauaauaguugauguaagacaacucgaaccuguucucauuccauuaccagauguuagaaauaauuucuaccacuauaaucaaucaaaugacucaacaauaaaauuaauagcaaugcuuuacacaccacuaagagcaaauaaugcaggagacgacgucuucacaguuucuuguagaguauuaacacgaccaucaccagacuucgacuuuauauuucuaguaccacccaccguagaaucucgaacaaaaccauucaguguuccuguacuuaccguagaagaaaugacaaacucccgauuuccaauuccacuagaaaagcuauuuaccggacccucuucagcuuucguuguacaaccccaaaacggaagauguacaacugauggaguuuuauuagguaccacucaacuaucuccaguuaacauauguacauuucgaggagacguaacucauauaacaggcucacgaaauuacacaaugaacuuagcaucucaaaacuggaacaauuacgaucccacagaagaaauaccagccccacuaggaacaccagauuuugucgguaaaauccaaggcauguuaacucaaaccacaagaacagauggcucaacuagaggacacaaagcuaccguauacacaggaucagcagauuucgcacccaaacuuggucgaguacaauuugaaacagauacagaccacgauuuugaagcuaaccaaaacacuaaauucacaccaguuggaguaauucaagacggauccacaacacaucgaaaugaaccacaacaauggguucuaccuucauauucaggacguaacacacauaacguucauuuagcaccagcuguagcaccaacuuuuccaggagaacaacuuccauucuucagaucaacaaugcccggaugcuccggauacccaaacauggaucuagauuguuuacuaccacaagaauggguacaauauuucuaucaagaagcagcacccgcacaaucagauguagcucuacuacguuuuguaaacccagacacuggaagaguuuuauucgaaugcaaacuacauaaaucaggauauguaacaguagcacauaccggccaacacgaccuaguuaucccucccuauggcuauuucagauucgauucaugggucaaucaauuuuacacucuagcaccaaugggaaacggaacaggaaggagaagauaa

SEQ ID NO: 34609 - RNA, 1617 nt, Artificial Sequence
  derived and/or modified sequence opt6 from VP1__Norovirus_and/or_Norovirus-like__KJ710245
augaaaauggcuucuucagaugcaaauccaucagacggaucuacagccaaucuuguaccagaagucaacgaugaaguaauggcacucgaaccaguuguuggagcagcucuugcugcacccguagcaggccaacaaaauguaauugacccauggauaagaaauaacuuuguacaagcaccaggaggugaauuuacaguaucaccacgaaaugccccuggagaaauacucuggucugcaccucuugguccagauuuaaaccccuaucuaucacaccuagcgagaauguauaacggauacgcaggaggauucgaaguccaaguaauacuagcugguaaugccuuuacugcaggcaaaguaauauucgcagcaguuccaccuaacuuuccaacugaaggucuuuccccaucucaaguaacaauguucccacauauaauaguagauguaagacaauuagaaccuguucuaauuccacuccccgaugcaagaaauaauuucuaccacuacaaccaaucaaaugaaagcaccauuaaacuuauagcaaugcucuacacaccauuacgagcaaacaaugccggugacgaugucuuuacaguaaguuguaggguauuaacacgaccuucucuagacuucgacuucauauuucuaguuccaccuacaguugaaucaagaacuaaaccuuucucagucccaauauuaacuguagaagaaaugacaaacucuagauuucccauaccacuagaacgauuauuuacaggaccuaguucagccuuugcuguacaaccacaaaacggaagaugcacaaccgacggaguucuauuagguacaacacaauuaucuccaguuaauauauguacauuuagaggagacguuacacauacaacagguucccauaauuacacuaugaaucuagccucccaaaacagaucaaauuacgacccaacagaagaaauaccagcaccucucggcacaccagauuuuguaggaaaaauucaaggcgcauuaacacaaacuacaagagcugacggaucaacuagaggacauaaagcuacaguauauacaggaucagcagacuuuacaccaaaacucggaagaguucaauucgcaacagauacagaucaugauuuugauacuaaucaaaauacaaaauucacuccaguagguguuauccaagacgguucaacuacacacagaaacgaaccacaacaauggguucuaccuuccuauuccggaagaaauacccacaauguacaccuagcacccgcuguagcuccuacauuuccaggagagcaauuacuuuucuuuagaaguacaaugcccggcugcuccgguuaucccaacauggauuuagauugccuauuaccacaagaauggguagcacauuuuuaucaagaagcagccccugcacaaucagauguugcacuauuaagauucguaaauccagauacaggacgaguccuauuugaauguaaacuacauaaaucaggauacguaacaguugcacauaccggacaacacgauuuaguaauaccacccaacggauauuuuagauucgacagcuggguaaaucaauuuuacacucuagcaccuaugggaaauggaacaggaagaagacgauaa

SEQ ID NO: 34610 - RNA, 1617 nt, Artificial Sequence
  derived and/or modified sequence opt6 from VP1__Norovirus_and/or_Norovirus-like__KX514298
augaaaauggcaucgaacgacgcaaauccaucagauggaucugcagcaaaucuaguaccagaagucaauaacgaaguaauggcacuagaaccaguuguaggugcagcuauugcagccccaguagcaggacaacaaaacguaauagaccccuggauacguaauaauuuuguucaagcuccuggcggugaauuuacaguaucacccagaaacgcacccggugaaauacuaugguccgcaccccuagguccagauuuaaauccauauuuaucacacuuagcacguauguacaauggauaugcuggaggauucgaaguacaaguaauacuagcaggaaaugcauuuacugcaggaaaaauaauuuucgcagcaguaccuccaaacuucccaacagaaggacugucuccaucucaaguaacaauguucccucacauaauaguagauguacgacaacuagaaccaguacuaauaccacuuccugaugucagaaauaauuuuuaccacuauaaccaaucaaacgacucuacaauaaaacuaauagcaauguuauacacuccacuaagagcaaacaaugcuggagacgauguauucacaguuucuugucgaguauuaacucgacccuccccugacuucgacuuuaucuuccuuguaccuccaacaguagaaucuagaucuaaaccuuuuuccguaccaguucuaacaguagaagaaaugacaaauucaagauuuccagcuacauuagacaaauuauucacaggacccucaucaaccuuuguuguacaaccucaaaauggcagauguaugauugauggaguuuuauuaggaacaacacagcuaucacccguaaacauauguacauuccgaggagauguaacacauccaagagauucaccuauauauaccaugaaucuugcaucaccuaauuggaacaacuaugacccuacagaagaaaucccagcaccacuuggcacaccagacuucguaggaaaaauucaagguaugcuaacacaaacaacuaaaggagaaggcucaacacgaggacaucgagcaaccguauauguagguucagcaaauuaugccccuaaauuagggcgaguacaauuugaaacagauaccacaaaugauuuagaugcacaccaaaacacaaaauucacuccagucggaguaauucaagguggagaaucggcacauagaucagaaccacaacaauggguacuaccuucauauucaggacgagauauaccaaacguucauuuagccccugcaguagcaccaacauuuccaggagaacaauuacuauucuuccgauccacaauaccaggaugugguggacauccaaauaugaaucuagacugcuuacuaccucaagaauggguacaacacuuuuaucaagaagcagcuccagcccaaucagauguagcacuauuaagauuuguuaauccugauaccucaagaguuuuauuugaaugcaaauuacacaaauccggauauguaacuguagcacauacuggacaacaugaccuagucauacccccaaacggcuacuuccguuuugacucauggguaaaucaauuuuauacucuagcuccaaugggcaauggaacuggacgaaaacguuaa

SEQ ID NO: 34611 - RNA, 1617 nt, Artificial Sequence
  derived and/or modified sequence opt6 from VP1__Norovirus_and/or_Norovirus-like__KX514269
augaaaauggcuucaaaugacgcaaacccuucagacggauccgcagcaaauuuaguacccgaagucaacaacgaaguuauggccuuagaaccgguaguaggugcagcaauagcagcaccaguagccggacaacaaaaugucauugacccauggauaagaaacaauuucguucaagcaccaggaggagaguucacaguaucaccucgcaaugcacccggugaaauauuauggucagcaccccugggaccagaucuaaauccuuaccuaagccauuuagcacgcauguauaaugguuacgcaggaggauucgaaguacaaguaauauuagccgguaaugcuuucacugcaggcaaaauuauauucgcagcaguaccaccaaacuucccaacagaaggacuaucaccaucacaaguaacaauguucccucauaucauagucgauguaagacaacuagaaccugucuuaaucccacuaccagacgugagaaauaacuuuuaucacuacaaccaaucaaaugacucuacaauaaaacucauagcaauguuauacacaccacucagagcaaacaaugcaggagaugacguauuuaccgucucauguagaguauuaacaagaccaucaccagacuuugauuuuauauuucuaguacccccaacaguagaauccagauccaaaccauucucuguaccuguacuuacagucgaagaaaugaccaacucuagauuuccagcaacauuagauaaauuauuuacaggaccaucaucaacauuuguaguacaaccacaaaauggaagaugcaugauagacggaguauuacucgguacaacacaacuaucaccuguaaauauaugcaccuuccgaggagacguuacacauccaagagacaguccaauuuauacuaugaauuuagcuucaccaaauuggaauaacuaugauccuacagaagaaauaccagcuccuuuagguacaccagacuuuacaggaaaaauacaagguaugcuuacucaaacaacaaaaggagaaggauccacaagaggacaccgugcaaccguauacguaggaucagcaaacuaugcaccaaaacucggaagaguacaauucgaaacagauacaacuaaugauuuagaugcacaccaaaacacuaaauucaccccaguaggaguaguacaaucuggugaaucaccuaaagguucagaaccccaacaauggguucuaccaucauauucagguagggacacaccaaacguucaccucgccccagccguugcaccaacauucccaggagaacaacuauuauucuuucgauccacaauaccaggaugcggagggcauccaaauaugaaccuagauugccuacuaccacaagaauggguucaacacuucuaucaagaagcagcaccagcacaaucagacguagccuuacucagauuugucaauccagacacaucaagaguuuuauucgaaugcaaacuucacaaauccgguuacguaacaguagcccacaccggacaacaugaucuagucauaccaccaaacggauacuuucgauucgauaguuggguuaaccaauuuuauacucuagcucccaugggaaauggaacuggaagaaaacgauaa

SEQ ID NO: 34612 - RNA, 1617 nt, Artificial Sequence
  derived and/or modified sequence opt6 from VP1__Norovirus_and/or_Norovirus-like__KX514179
augaaaauggccucaaacgaugcaaauccaagugaugguucagcagcgaauuuaguaccugaaguaaauaacgaaguuauggcucuugaaccaguaguaggcgcagcaauagcagcaccaguagccggccaacaaaauguuaucgauccauggauaagaaauaacuucguacaagccccuggaggagaauuuaccguaucuccaagaaacgcaccaggagaaauacuuuggagcgcaccauuagggcccgaucucaacccuuauuuaucacaccucgcccgcauguacaacgguuaugcaggaggauuugaaguacaaguaauauuagcaggaaaugcuuucacagcagguaaaauaauuuuugcagcaguaccaccaaauuucccuacagaaggacuaucaccaucacaaguuacaauguuuccccauauaauaguagauguuagacaauuagaacccguacuaaucccuuuaccagauguuagaaauaauuuuuaccauuauaaccaaucaaaugauucuacaauaaaauuaauagcaauguuauacacaccacucagagcaaacaaugcgggugaugauguuuuuacaguuucuuguagaguacuuacaagaccuucuccagauuucgauuucauauucuuaguuccaccuacaguagaaucaagaucuaaaccauuuucaguaccaguacuaaccguugaagaaaugacaaacucuagauuuccagcaacauuagauaaacuuuuuacaggaccuucaucaacauuuguaguacaaccacaaaauggaagauguaugauagacggaguuuuauuaggaaccacacaauuaucaccaguaaauauauguacauuuagaggugauguaacccauccacgugacucacaaauauauaccaugaaucuagcuuccccaaacuggaauaacuaugacccuacagaagaaauucccgcuccauuaggaacuccagauuuuguagguaaaauacaaggaaugcuaacacaaaccaccaaaggugaagguaguacaagaggacaucgagccacaguauauguagguucugcaaauuacgcaccaaaacuaggacgaguccaauucgaaacagauacuacaaaugaucuagacgcacaucaaaauacaaaauuuacaccaguaggaguaguacaaggcggagaaucaccaaaaggaucagaaccucaacaauggguacugcccucauacucaggaagagauacaccaaauguacaccuagcaccagcuguagccccaacuuuucccggugaacaauuacuauucuuucguuccacaauaccaggauguggaggacauccuaacaugaacuuagacugucuacucccacaagaauggguucaacacuuuuaucaagaagccgcaccagcacaaucagauguagcauuacuacguuuuguaaacccagacacaucucguguauuauuugaauguaaacuucauaaaucuggcuauguuacaguagcacacacuggacaacaugacuuagucauaccuccaaaugguuauuuucgauuugauucuuggguaaaucaauucuauacacuagccccuaugggcaauggaacaggaagaaaaagauaa

SEQ ID NO: 34613 - RNA, 1617 nt, Artificial Sequence
  derived and/or modified sequence opt6 from VP1__Norovirus_and/or_Norovirus-like__KX514289
augaaaauggcaucaaaugaugcaaauccaucagauggaucagccgccaauuuaguacccgaaguaaauaaugaagucauggcacuagaaccuguaguuggugcugccauagcagcccccguugcaggacaacaaaacguuauagacccuuggauaagaaauaauuucguacaagcacccgguggcgaauuuacaguaucacccagaaaugcacccggugaaauacuuuggucagcaccacuuggccccgaucuaaacccauacuuaucacauuuagcaagaauguauaacggauaugcugguggcuucgaaguacaaguaauauuagcaggaaacgcauucacagcaggaaaaauaauauuugcagcuguaccacccaauuucccuacagaaggauuaaguccuagccaaguaacaauguuuccacacaucauaguagaugucagacaacuagaaccuguauuaauuccauuaccugauguacgaaacaacuucuaucauuacaaccaaucaaaugauucaacaauuaaacuaauugcuaugcuauauacaccuuuaagagcuaauaacgcaggagaugacguauuuacaguaucaugcagaguacuuacacgcccaucuccagauuuugauuucauauuccuuguaccaccaaccgucgaauccagauccaaaccuuucucaguuccuguacuaacaguugaagaaaugacuaacucgagauucccugcaacacuagacaaauuauuuacaggacccaguucaacauuugucguucaaccacaaaauggaagauguaugauagacggcguauuauuaggcacaacacaauuaucaccaguuaacauaugcacauuucguggagauguaacucacccaagagauucaccuauauauacuaugaauuuagcaucaccaaacuggaauaacuacgaucccacugaagaaauaccagcaccauuagguacaccagauuucguuggaaaaauacaaggaauguuaacucaaacuacuaaaggagaaggcucaacaaggggacacagagcuacaguauacguaggcagcgcaaacuacgcaccaaaacuuggaagaguacaauucgaaacugauacaacaaaugaucuagacgcacaccaaaacaccaaauuuacaccuguaggaguaguccaaucuggagaauccccaaaaggaucagaaccacaacaauggguauuaccaucauacucaggaagagauacaccaaauguucauuuagcaccagcaguugccccuacauucccaggagaacaacuacucuuuuuccgaucaacaauaccaggauguggaggacaucccaauaugaacuuagacuguuuacuuccacaagaauggguacaacacuuuuaccaagaagcagccccugcacaaucagauguagcauuauuacgauucguaaauccagauacaucuagaguauuauuugaaugcaaacuacauaaaucaggauauguuacaguugcacauacagggcaacaugacuuaguaauaccaccaaauggcuacuuccgauuugacucauggguaaaccaauuuuauacacuagcaccuaugggaaauggaacuggaagaaaaagauaa

SEQ ID NO: 34614 - RNA, 1617 nt, Artificial Sequence
  derived and/or modified sequence opt6 from VP1__Norovirus_and/or_Norovirus-like__KX514288
augaaaauggcaucaaaugacgcaaauccaucagauggcuccgccgcuaaccucguuccagaaguaaauaacgaagucauggcauuagaaccuguaguaggagcagcaauagcagcaccagucgcuggacaacaaaauguaauugauccguggauaagaaauaacuucguacaagcacccggaggagaauuuacaguaucaccuagaaacgcaccaggagaaauauuauggucugcaccacuaggaccagauuuaaauccuuacuuaucacacuuagccagaauguauaaugguuacgccgguggauuugaaguucaaguaauacuagcaggaaaugcauucacagcaggcaaaaucauauucgcagcaguaccaccaaauuuuccaacugaaggcuuaucaccaucccaaguaaccauguuuccucacauaauaguagauguaagacaauuagaaccaguucuaauaccauuaccagacguacgaaacaauuucuaccacuacaaccaaucaaacgauagcaccauuaaauuaauagcaaugcuauacacaccccuaagagcaaauaacgccggagacgauguauuuaccguaucaugucgaguauuaacaagaccuucgccagauuuugauuuuauauuucuaguaccaccaaccguagaauccagauccaaaccauucuccguaccuguauuaacaguagaagaaaugacaaacucuagauucccagcaaccuuagauaaauuauuuacagguccuucuucaacuuucgucguacaaccacaaaacggccgcuguaugaucgacgguguccuacuaggaacuacacaauuaucaccaguaaauauauguacauucagaggggacguuacacauccaagagacucacccauauauacaaugaaucuugcuucaccuaacuggaacaacuaugauccaacugaagaaauaccagcuccauuaggaacaccugacuucguagguaaaauacaaggaaugcuaacacaaacaacuaaaggcgaaggaucuacaagaggccaucgugcaaccguuuaugugggaucagcaaacuaugcaccaaaacucggaagaguccaauucgaaacugacacaacuaacgauuuagaugcacaccaaaauacuaaauucacccccguuggaguuguacaaucaggagaauccccaaaaggaucugaaccacaacaauggguauuaccaucauauaguggacgagauacaccaaacguucaucuagcaccagcaguagccccaaccuuuccaggagaacaacuacucuucuuuagauccacgaucccagguugcggaggacauccaaauauggauuuagacuguuuacuaccacaagaauggguccaacauuuuuaucaagaagcagcaccagcacaauccgauguagcauuacuacgauuuguaaauccagauacaucuagaguacuauuugaaugcaaauuacacaaaucuggauauguaacaguagcacauaccggacaacaugaucuuguaauaccaccaaaugguuauuucagauuugacucauggguaaaccaauucuacacauuagcaccaaugggaaacggaacagguagaaagcgauaa

SEQ ID NO: 34615 - RNA, 1617 nt, Artificial Sequence
  derived and/or modified sequence opt6 from VP1__Norovirus_and/or_Norovirus-like__KX514268
augaaaauggcuucaaaugaugcuaacccuuccgauggaucagcagcuaauuuaguaccagaaguaaacaacgaagucauggcauuagaaccuguaguaggugcagcaauagcagcaccaguggcaggacaacaaaauguaaucgacccauggauaagaaacaauuuuguccaagcaccaggaggagaauuuacaguaaguccaagaaacgcaccaggagaaaucuuauggucagcaccacuaggaccugauuuaaauccuuaucuaucccaccuagcccgaauguacaauggauaugcaggaggauuugaaguacaagucauauuagcaggaaaugcuuuuacugccggcaaaauaauuuuugcagcuguaccuccaaacuuuccaacagaaggauuauccccaucacaaguaacaauguuuccccauauaauaguagacguacgacaacucgaaccaguauuaauuccacuacccgauguaagaaauaauuuuuaucacuauaaccaaucaaacgauucaacaauuaaacuaauagcaauguuauauacaccacuuagagccaauaaugcuggugacgauguauucaccguaucauguagaguacuaacaagaccaucaccagacuuugacuucauauuuuuaguuccaccuacaguugaaagcagaagcaaaccauucucuguaccaguauuaacuguugaagaaaugacuaacagucguuucccagcaacauuagacaaacuauuuacaggaccaucuucaacauuuguaguacaaccucaaaaugguagauguaugauagauggaguacuacuagguacaacucaauuaaguccaguaaauauauguacauucagaggcgauguaacacacccacgugacucuccaauauauacaaugaaucuugccuccccuaauuggaacaauuaugauccaaccgaagaaauacccgcaccacuuggaacccccgauuuuguuggaaaaauacaugguauguuaacacaaacaacaaaaggagaaggaaguacuagaggacaccgugccacaguauauguaggcuccgcaaauuaugcaccuaaacuaggaagaguacaauuugaaacagacaccacaaacgaccuugacgcacaucaaaacacaaaauuuacuccuguuggcgucguccaagguggugaaucaccaaaaggcucagaaccucaacaauggguacuuccaucauauucuggcagagauacaccaaacguacaucuugcuccagcaguagcaccaaccuuuccaggugaacaauuacuuuucuuuagaucaacaauucccgguuguggaggccaucccaauaugaaccuagauugccuauuaccacaagaaugggugcaacacuuuuaucaagaagcagcaccagcacaaucugauguagcccuguuaagauuugucaaccccgacacgucacgaguacuauuugaauguaaauuacacaaaucugguuacguaacaguagcacauaccggacaacacgacuuaguaauaccaccaaacggauauuuucguuucgauagcuggguaaaccaauuuuauacacuugcuccuaugggaaauggaacaggcagaaaaagauaa

SEQ ID NO: 34616 - RNA, 1617 nt, Artificial Sequence
  derived and/or modified sequence opt6 from VP1__Norovirus_and/or_Norovirus-like__JX459653
augaaaauggccuccucugacccuaauccaucagacggaucuacagcaaacuuagucccagaaguaaauaacgaaguaauggcauuagaaccaguuguaggagcagcaauagcugcaccuguagcaggacaacaaaauguaauugauccauggauacgaaauaacuucguucaagccccuggaggcgaauuuacaguaucaccaagaaacgcaccaggagaaauucuauggucagcaccacuagguccagaucuaaacccauauuuaucacaccuugcacgaauguauaacggauacgcugguggauuugaaguacaaguaauucuagcaggaaaugcauuuacagcuggaaaaauaauuuucgcugcuguacccccaaacuuccccacagaaggacuaucuccaucucaaguaacaauguucccacauauuauaguagacguaagacaacuagaaccaguuuuaauacccuuacccgauguaagaaauaauuucuaucacuauaaccaaucaaaugacucuaaauuaaaauuaagaccuaugcuuuacacuccacuaagagcaaacaaugcaggcgaugauguauuuaccguaagcugucgaguauuaacucgaccaucuccugacuuugauuuuauauuccuuguaccaccuacaguagaaucacgaacuaaaccuuucucaguaccaguccuaacaguugaagaaaugacaaauaguagauuuccaauuccauuagaaaaacuauuuacaggaccaucaucagcauucguuguacaaccacaaaauggaagaugcacaaccgacgguguauuacuuggaacaacacaacuaucaccugucaauauauguacuuucagaggagacguaacacacauaccuggaucucgaaauuauaccaugaauuuagccucacaaaauuggaacagcuacgauccuaccgaagaaauaccugcaccccucgguacaccugacuuuguaggaaaaauucaaggaguacuuacacaaacaacaagaacaaaugguuccacacgaggucauaaagcaacaguauauacagguagcgcagacuucucaccaaaauuaggacgaguacaauucgcuacagacacugauaacgacuucgaaacuaaccaaaauacaaaauucacaccaguaggaguuauacaagacgguaguacaacuccuagaaacgaaccucaacaauggguuuuaccauccuauucuggcagaaauauacauaaugugcacuuagccccagcaguugcuccuaccuuuccaggcgaacaacuauuauuuuucagaucgacaaugccaggaugcucagguuacccaaauauggaucucgauugcuuacuaccgcaagaauggguucaauacuucuaucaagaagcagcaccagcucaaucagacguagcauuacuacgcuucgucaacccugacacaggucgaguacuauucgaaugcaaauuacacaaauccgguuauguaacuguagcccacacuggacaacaugauuuaguaauaccaccaaacggauauuucagauuugacagcuggguuaaucaauuuuauacauuagcuccaaugggcaacggaacaggacgaagaagauaa

SEQ ID NO: 34617 - RNA, 1617 nt, Artificial Sequence
  derived and/or modified sequence opt6 from VP1__Norovirus_and/or_Norovirus-like__KX514359
augaaaauggcuucaaaugaugcaaacccaucagauggaagugcagcaaauuuaguacccgaagucaacaaugaaguaauggcacuagaacccguaguaggagcagcaauugcagcaccaguagcaggccaacaaaauguaauagauccuuggauaagaaacaacuuuguacaagcuccaggaggagaauuuacaguaucacccagaaaugccccaggagaaauacuuuggucagcuccuuuaggcccagaucuaaauccauaucuuucucauuuagcaagaauguacaacgguuaugcugguggauuugaaguucaaguaauacuagcaggaaacgcauucaccgcaggaaaaauaauuuucgcagcaguaccaccaaauuuuccaacagaaggacuuucccccucacaaguaacaauguuuccacacauaauaguugauguaagacaacucgaaccuguucuaauuccccuuccagauguaaggaacaauuuuuaccauuauaaucaaucaaacgauucaacaauaaaauuaauugcuauguuauacacuccccuacgagcaaauaaugcuggagaugauguauuuacuguaucuugcagaguucuaacacgaccaucaccagauuuugacuuuauuuuccuuguacccccaacagucgaaucacguucaaaaccauuuuccguuccuguacuaacaguagaagaaaugacaaacucacgauuuccagcaacauuggauaaacuauuuacaggcccaagcucaacauuuguaguacaaccucaaaacgguagaugcaugauugauggcguacuacuaggaacaacacaacuuucaccaguaaauauuugcacauucagaggagacguaacacacccaagagacagcccaauauacaccaugaauuuagcauccccaaauuggaauaauuaugauccaaccgaagaaauacccgcacccuuaggcacaccagauuuuguaggaaaaauacaaggcaugcucacacaaacaacuaaaggagaaggcucuacaagaggccacagagcaacaguauacguaggauccgcaaauuaugcaccaaaauugggaagaguucaauuugaaacagauacaaccaaugacuuagacgcucaccaaaacacuaaauuuacccccguaggaguaguacaagguggagaaucaccacaaagauccgaaccucaacaauggguauuaccaucuuauucaggucgcgauacaccaaauguacauuuagccccagccguagcaccaacauuuccuggagaacaauuauuauuuuucagauccacaauaccagguuguggaggacacccaaacaugaaucuugauugucuucuuccucaagaauggguacaacacuuuuaccaagaagcagcacccgcacaaucugacguagcauuacuaagauucguuaauccagauacuucuagagugcuauuugaauguaaacuccauaaaucaggauacgucacaguagcucacacaggccaacaugaccucguaauaccaccaaacggauauuuucgauucgauucauggguuaaucaauuuuauacucuagccccaauggguaaugguacaggacguaaacgauaa

SEQ ID NO: 34618 - RNA, 1617 nt, Artificial Sequence
  derived and/or modified sequence opt6 from VP1__Norovirus_and/or_Norovirus-like__KX514296
augaaaauggcuucaaaugaugccaauccaucagauggaucagcagccaaucuuguaccagaaguaaauaacgaagucauggcacuagaaccagucgugggugccgccauugcagcacccguagcaggccaacaaaauguaauagauccuuggauuagaaacaauuuuguucaagcaccuggaggcgaauuuacaguaucucccagaaaugcuccaggagaaauacuauggucugcaccacuaggaccugacuuaaauccauaucuaagccauuuagcaagaauguacaacggauaugcaggaggcuucgaaguacaaguaauuuuagcaggaaacgcauuuacugccggaaaaauaauuuuugccgcuguaccacccaacuuuccaacugaaggccuaucuccaucacaaguaacaauguucccccacauaauuguagacguaagacaacuagaaccaguauuaauuccacuacccgaugucagaaauaacuucuaucauuauaaucaaucaaacgauucaacuauuaaacuuauagcaauguuauauacaccacuaagagcaaauaaugccggugacgauguauuuacaguaucaugucgaguacuaacuagaccaucaccagacuuugacuuuauauuuuuaguaccaccaacuguagaaucccgaucuaaaccauucucaguaccuguacuuacaguugaagaaaugacuaauucuagauucccagcaacacuagauaaauuauuuaccggaccaucuucuaccuucgucguacaaccacaaaauggaagauguaugauugauggaguacuauuagguacaacccaauuauccccaguaaauauaugcacauuuagaggagacguuacacacccucgcgacucaccgauauacacaaugaacuuagcauccccaaacuggaauaauuaugauccaacagaagaaauaccagccccauuaggaacuccugacuuuguaggaaaaauacaagguaugcuaacacaaacuacaaaaggugaaggaucuacacgaggccaucgagcaacagucuacguaggaucugccaauuacgccccuaaauuaggacgaguacaauuugaaacagguacaacaaaugaccuugaugcacaucaaaacacaaaauuuacuccaguaggaguuguacaaggaggugaaucaccacaaggaucagaaccucaacaauggguucuuccauccuacucaggcagagauacuccaaacguucaccuagcaccagcaguagcaccuacauuuccaggagaacaacuacuauuuuucagaucaacaaucccuggaugugguggucauccaaacaugaaucuugauuguuuacuaccacaagaauggguucaacauuucuaucaagaagcagcaccagcucaaucugaugucgcuuuacuaagguucgucaaucccgacacuucacgaguccuauucgaaugcaaauuacauaaaucuggauacguuacaguagcacacacuggacaacaugacuuaguuauaccaccaaacgguuauuucagauucgauucuuggguaaaccaauuuuacacacuugcacccaugggaaauggaacaggcagaaaaagauaa

SEQ ID NO: 34619 - RNA, 1617 nt, Artificial Sequence
  derived and/or modified sequence opt6 from VP1__Norovirus_and/or_Norovirus-like__KX514284
augaaaauggcauccaacgacgcuaauccuucugauggaagcgcagcuaacuuaguccccgaagucaauaaugaaguaauggcacuagaacccguaguaggugcagcaauagcagcaccuguagcaggccaacaaaacgucaucgaucccuggaucagaaauaauuuuguacaagcuccaggcggcgaauuuaccguuaguccaagaaaugcaccuggagaaauacuauggucugcaccuuuaggcccagacuuaaacccuuauuuaucucauuuagcacguauguauaacggauacgccgguggauucgaaguccaagucauuuuagcaggaaacgcauuuacagcaggaaaaaucaucuucgcagcaguucccccaaauuucccuacugaaggacucuccccuucucaaguaacaauguucccacacauaauagucgacguacgacaauuagaaccaguccuaauaccacuacccgauguuagaaacaauuucuaucauuauaaccaaagcaaugauucaacaauaaaacuaauagcaauguuauauacuccauuaagagcaaacaacgccggagacgauguauucaccguaucaugcagaguucuaacuagaccaucccccgacuuugacuuuauauucuuagucccaccaacaguugaaucuagaucaaaacccuucucaguaccuguacuaaccgucgaagaaaugacaaacuccagguuuccagcuacauuagacaaacuauuuacaggaccaucaagcacauuuguuguucaaccacaaaacgguagauguaugauagacggaguucuacuaggcacaacacaauuauccccaguaaauauauguacauucagaggagauguaacacauccaagagacucaccaauauauacaaugaaccuagcaucaccaaauuggaauaauuacgauccaacagaagaaauaccagcaccauuaggaacaccugauuuuguaggaaaaauacaaggaaugcuaacacaaacaacaaaaggagaagguuccacuagaggucauagagcaacaguauacguaggaucagccaacuacgcaccaaaacuaggaagaguucaauuugaaacagauacaacaaacgauuuagacgcacaccaaaauacaaaauuuacaccaguuggaguaguucaaggaggagaaucaccacaaagaucagaaccacaacaauggguacuaccaucauacucuggaagagacacaccuaacguacaucuagcaccagcaguugcaccuacuuuuccaggugaacaacuauuauucuuucgcuccacaaucccaggaugcgguggacauccaaauauggaucuagauugccuacuaccacaagaauggguacaacauuuuuaccaagaagcagcuccagcccaaucagacguagcauuacuacgauucguaaaccccgauacuucaagaguacuauucgaaugcaaauuacauaaaagcggauacguaacuguagcacacacaggucaacacgaccuagucauaccaccaaaugguuauuuccgauuugauagcuggguaaaccaauucuauacauuagcacccauggguaauggaacaggacgaaaaagauaa

SEQ ID NO: 34620 - RNA, 1617 nt, Artificial Sequence
  derived and/or modified sequence opt6 from VP1__Norovirus_and/or_Norovirus-like__KX514245
augaaaauggcaucaaaugacgcaaaccccucagauggaucagcugcaaauuuaguuccugaaguaaauaaugaaguaauggcacuugaaccaguaguaggagcagcaauagcagccccaguugcaggacaacaaaauguaaucgauccauggauuagaaacaacuucguacaagcaccaggcggagaauuuacaguuucuccaagaaaugcuccgggagaaauauuauggagugcuccacuaggaccagaccuaaaucccuaucuaucccaccucgcacguauguacaacggauaugccgguggauucgaaguacaaguuauacuagcaggaaaugcauuuacagcaggaaaaauaauauuugcagcaguaccuccaaacuuucccacagaaggauuaucaccaucacaaguaacaauguucccucacauaauaguagaugucagacaauuagaaccuguauuaauaccccuaccugauguacgaaacaacuucuaucauuauaaucaaucaaaugauuccacaauaaaauuaauagcaaugcuuuauaccccacuuagagcaaacaacgcaggagaugacguauucacaguauccuguagaguauuaacacggccuucccccgacuucgacuucauauuuuuaguaccaccaacagucgaaucacgaagcaaaccuuuuucaguaccuguauuaacaguggaagaaaugacuaauaguagauuucccgcuacauuagauaaacuauuuacaggaccaucaucuacauuuguaguacaaccucaaaauggaagaugcaugauugacggcguucuauuagguacaacacaacugucaccaguaaauauauguacauuuagaggagaugucacucacccgagagauucaccaauauauacaaugaaccuagcaucgccaaauuggaauaauuaugauccaacagaagaaauaccugcaccucucggaacaccagauuuugucggcaaaauacaaggaaugcuaacucagacaaccaaaggugaaggaucuacacgcggccauagagcaacaguauaugucggaucugcuaacuaugcuccaaaacuuggaagaguacaauuugaaacagauacaacuaaugauuuagacgcacaucaaaauacuaaauucacuccaguaggaguaguucaaggcggagaaucaccacaaagauccgaaccacaacaauggguauuaccaucauacucaggcagagacacaccuaauguacaucuagcaccagcuguugcaccaacauucccaggagaacaauuacuauucuuuagaucaacuaucccaggauguggaggccacccaaauaugaaccuagauugccuacuaccacaagaauggguacaacauuuuuaucaagaggccgcccccgcacaaucagacguagcacuacuaagauucguaaauccagauacaaguagaguucuauucgaauguaaauuacauaaaucaggcuauguaacuguaacacauacuggacaacaugaucuaguaauaccuccaaauggauauuuucgauucgauucuuggguuaaccaauucuacacauuagcaccaaugggaaaugguacaggcagaaaacgcuaa

SEQ ID NO: 34621 - RNA, 1617 nt, Artificial Sequence
  derived and/or modified sequence opt6 from VP1__Norovirus_and/or_Norovirus-like__KX514327
augaaaauggcaucaucagaugccaauccuucagauggcucaacagcaaauuuaguaccagaaguaaauaaugaaguaauggcacuagaaccaguaguuggcgcagccauugcugcaccuguagcgggucaacaaaauguuauagacccauggauaagaaacaauuucguucaagcaccaggaggagaauuuacaguaucaccccgaaaugcaccaggagaaauauuauggucagccccacuaggaccugauuuaaauccauaccuaucacauuuagcucgaauguacaacggcuacgcaggaggauucgaaguacaaguaauuuuagcaggaaaugcauucaccgccggaaaaauaauauucgcagcagucccuccaacguuuccaacagaaggcuuaucacccucacaaguuacaauguuuccacauauuauaguagauguaagacaacuagaaccaguauuaaucccacuacccgacgucagaaauaauuuuuaucauuauaaccaaucuaaugacucaacuauaaaauuaauagcaaugcuauacacaccacuacgugcaaacaaugcaggagaugauguauucacuguuucauguagaguauuaacaagaccuucaccagauuuugauuuuauauuucuagucccuccaacaguugaaucuaggucaaaaccauucucuguaccuguacucacuguagaagaaaugacuaauuccagauuuccagcaacccucgacaaacuauuuacaggaccaucaucaaccuucguaguacaaccucaaaauggccguuguaugauagaugguguacuacuaggaacuacacaacuuucaccaguaaacauuuguacauuuagaggugacguuacacacucaggaaauucaaaaauuuauacaaugaaucuagcaagcccaaauuggaauaauuaugauccaacagaagaaauacccgcuccauuaggaacucccgacuuuguaggcaaaauacaaggaauguuaacacaaacuacuaaaggcgaaggaaguacaagaggccaucgagcaacaguauauguagguucagcaaacuacgcaccaaaauuaggaagaguacaauucgaaacagauaccacagaugacuuagacgcacaucaaaacacaaaauuuaccccaguuggaguaguacagggaggagaaucaccaaaagguucagaaccccaacaauggguucuaccaucauauucaggucgugauacaccaaacguacaucuagcucccgcaguagccccaacuuuuccuggugaacaacuucuauucuucagaaguacaauuccaggaugcggcggacauccuaauaugaaccuugacugcuuauuaccacaagaauggguucaacauuuuuaucaagaagccgcacccgcacaaucagauguagcauuauuacguuucguuaacccagacacaucaagaguauuauucgaaugcaaacuucauaaauccggauauguaacaguagcacauacaggccaacaugauuuaguaauaccaccaaacggcuauuucagauuugauucauggguuaaucaauuuuacacauuagcaccaauggguaacggcacaggacgaaaacgauaa

SEQ ID NO: 34622 - RNA, 1617 nt, Artificial Sequence
  derived and/or modified sequence opt6 from VP1__Norovirus_and/or_Norovirus-like__KX514301
augaaaauggcuucaaaugaugcuaauccaucagaugguucagccgcaaacuuaguaccagaagucaacaaugaaguaauggcgcuagaacccguaguaggagcugcaauagcugcacccguagcaggucaacaaaaugucauagacccuuggauaagaaauaauuucguacaggcaccaggaggugaauuuacaguaaguccaagaaaugcucccggagaaauacuuugguccgccccucuagguccagauuuaaacccauaucuaucccauuuagcaagaauguacaacggauacgcaggagguuucgaaguacaaguuauacuagcaggaaacgcuuucacagcaggaaaaauaauuuuugcagcaguacccccaaacuuuccaaccgaaggucuauccccaucccaaguaacaauguucccacauauaauuguagauguaagacaacuagaaccaguacuaauaccacuaccagauguccgaaauaacuucuaccacuauaaccaaucuaaugauucuacaauuaaauuaauagcaaugcuauacacuccauuaagagcaaacaaugcuggugaugauguauuuacaguaagcugcagaguauuaacaagaccauccccagacuuugauuuuauauuucuaguaccaccaacaguagaaucaagaucgaaaccuuucagugucccagucuuaacaguagaagagaugacaaacucuagauuuccagcaacacuugacaaauuauucacaggcccaaguagcacauucguaguccaaccacaaaauggaagauguaugauagacggaguacuacuagguacaacacaacuuucaccuguaaauauauguacauuucgaggugacguuacacauccucgagauucaccaauauacaccaugaaucuagcuucaccaaauuggaacaauuacgauccaacagaagaaauacccgcaccuuuaggaacaccagacuuugucgguaaaauacaaggaauguuaacucaaacaacuaaaggagaaggaucaacacgaggacauagagccacuguauacguaggcagugcaaauuaugcaccuaaauuaggaagaguacaauucgaaacagauacaacuaaugaccuagaugcacaucaaaacacaaaauucacuccaguaggaguaguacaaggaggugaaucaccaaaaggaagugaaccucaacaauggguccuaccaucauauaguggacgugauaccccuaauguacaccuagcuccugcaguugcaccaaccuuuccaggugaacagcucuuauucuuuagaucaacaauacccggaugcggaggacacccaaauaugaaccuagauuguuuacuaccccaagaguggguacaacauuucuaccaagaagcagcaccagcacaaucagacguagcauuauuaagauucguaaauccagacacuucuagaguacuauucgaaugcaaacuucauaaauccggauauguaacagucgcacacacuggacaacaugaucuuguaauuccaccaaaugguuacuuuagauuugauucauggguaaaccaauuuuacacauuagcaccaaugggaaacggaacaggaagaaaaagauaa

SEQ ID NO: 34623 - RNA, 1617 nt, Artificial Sequence
  derived and/or modified sequence opt6 from VP1__Norovirus_and/or_Norovirus-like__KX514299
augaaaauggcaucaaacgacgcuaaucccagugauggaucagcugccaaucucguaccagaaguaaauaacgaaguaauggcucuagaaccaguugucggagcagcuaucgcagcaccaguagcaggucaacaaaauguaauagauccauggauuagaaauaacuucguacaagcaccuggaggcgaauuuacuguaucaccaagaaaugcaccaggagaaauacuaugguccgcaccauuaggacccgaucucaauccauaucuaagucacuuagcacgaauguauaauggauacgccggaggauucgaaguacaagucauucuagcaggaaaugcauuuacagcaggaaaaauuauuuucgcagcagucccuccaaauuuccccacagaaggauuaucacccucucaaguuacuauguuuccucauauaauaguugauguaagacaauuagaacccgugcuuauaccauuaccugacguacguaacaauuuuuaccacuauaaccaaucgaaugacucaacuauaaaacuuauagcaaugcuauauacaccauuaagagcaaacaacgcuggugacgauguuuuuacaguuucauguagaguacuuacucguccuuccccagacuuugauuuuaucuuucuaguaccaccaacagucgaaucuagauccaaaccauuuucaguaccaguacucacaguugaagaaaugacaaauuccagauuuccagcaacacuagauaaauuauuuacaggaccaucuucaacuuucguuguacaaccacaaaacggaagauguaugaucgaugguguacuauuagguacaacccaauuaucaccaguaaacauauguacauuucgaggagacguaacacaucccagagauucaccaaucuacaccaugaauuuagccagucccaacuggaauaacuaugaucccacagaagaaaucccagcaccauuagguacaccugacuucguaggaaaaauacaaggaaugcuuacacaaacaacaaaaggagaaggaucuacacgaggccaucgagcaaccguuuacgucgguuccgcaaacuacgcaccuaaacucggccgcguacaauucgaaacagacacaacaaaugaucucgacgcacaucaaaacacaaaauuuacuccaguaggaguaguccaaggaggagaaucaccucaaggauccgaaccacaacaauggguuuuaccaucauauucuggaagagacaccccaaauguacauuuagccccagcuguugcuccaacauucccuggagaacaacuauuauucuuucgauccacaaucccuggaugcggaggacauccuaauaugaaucuagauugccucuuaccacaagaauggguacaacauuuuuaucaagaagcugccccagcacaaucagauguagcacucuuacgauucguaaauccagauacaucacgugucuuauucgaauguaaacuacauaaaucaggauaugucacaguagcacacacaggacaacaugaucuaguaauaccuccaaauggauacuucagauuugacucauggguuaaucaauuuuauacacuagcaccaaugggaaauggaacaggaagaaaacgauaa

SEQ ID NO: 34624 - RNA, 1617 nt, Artificial Sequence
  derived and/or modified sequence opt6 from VP1__Norovirus_and/or_Norovirus-like__KX514277
augaaaauggccucaaacgacgcaaacccaucagauggcucugcagcaaauuuaguaccagaggucaauaaugaaguaauggcuuuagaacccgucgucggagcagcaauagcagcaccaguugcaggacaacaaaauguuaucgaucccuggauaagaaacaacuuuguacaagcaccaggaggagaauuuacaguaucaccacguaaugcaccaggagaaauucuauggucggcaccauuaggacccgaacuaaacccauauuuaucccaucuugcccgaauguauaacggauaugccggaggauuugaaguacaagucauacuagcaggaaacgccuucacagcaggcaaaauuauuuuugcagcaguaccacccaauuuccccaccgaaggauuauccccaucacaaguuacaauguuuccacauauuauuguugauguaagacaauuagaaccaguauuaauaccauuacccgacguacguaauaacuuuuaucauuauaaccaaucaaaugauucaacaauaaaacuaauagcaauguuauauacaccucuucgcgcuaacaaugcuggcgacgauguauuuacaguuucaugucgaguacuuacucgcccaaguccugauuuugacuucauauuuuuaguacccccaacagucgaaucuagaucuaaaccauucucugucccaguucuaacuguugaagaaaugaccaacucaagauuuccagcaacuuuagacaaacuauuuacaggaccuucaucaacauucguaguccaaccacaaaauggaagauguaugaucgacggaguauuacuaggaacuacucaauuaucaccagucaauauaugcacauucagaggagauguaacacauccaagagacucuccaauauauacuaugaauuuagcuucacccaacuggaauaauuaugauccaacagaagaaauaccagccccauuaggcacaccagacuuugucgguaaaauacaaggaaugcuaacacaaacaacaaaaggagaagguaguacucgaggacauagagcaacaguauaugucggaucagcaaauuaugcuccaaaacuaggaagaguucaauucgaaacagauacaacaaaugauuuagaugcacaucaaaauacaaaauuuacaccaguaggaguaguacaaggaggagaaucuccuaaaggcucagaaccacaacaaugggucuuaccauccuauucaggaagagacacaccaaauguacaucuagcaccagcaguagcaccaacauuuccuggagaacaacuacuauucuuucgcucuacaauaccaggaugcggaggacaucccaauaugaauuuagauugucuacuaccucaagaauggguacaacauuuuuaccaagaagcagcccccgcucaaagugauguugcacuauuaagauuuguaaauccugacaccaguagaguauuauuugaaugcaaauuacacaaaucuggauauguaacaguagcacacaccggccaacacgaucuugucauaccaccaaauggauacuucagauuugacagcuggguaaaucaauuuuauacuuuagccccaaugggaaauggaacuggacgaaaacguuaa

SEQ ID NO: 34625 - RNA, 1617 nt, Artificial Sequence
  derived and/or modified sequence opt6 from VP1__Norovirus_and/or_Norovirus-like__KX514213
augaaaauggcaucuaaugaugcaaacccaucagacggaucagcugcaaauuuaguaccagaagugaauaacgaaguuauggcacuagaaccaguaguaggagccgcaauagcagcaccaguagcaggacaacaaaauguaauagacccauggauacgcaauaacuuuguccaagcaccagggggagaauuuacugucucaccuagaaaugcacccggagaaauuuuaugguccgcaccacuaggaccagaucucaauccauauuuaagccacuuagcacgaauguacaauggauacgcaggagguuucgaaguccagguaauccuagccggaaacgcauucacagcaggaaaaauuaucuuugcagcaguuccaccuaacuucccuacagaaggauuaucaccaucacaagucaccauguucccccauauaauaguugacguacgacaacuugaaccuguacuaauacccuuaccagacguuagaaacaauuucuaucauuauaaucaaucaaacgacucaacgaucaaauuaauugcaaugcuauauacaccauuaagagcaaauaaugcaggagacgacguauuuacaguaucauguagaguuuuaacacgaccauccccagauuuugacuuuauauucuuaguaccaccaacuguagaaucuagaucaaaaccauucaguguaccaguacuuacaguacaagaaaugacuaauuccagauuucccgcaacacuagauaaauuauuuacaggacccucaucaaacuuaguaguacaaccacaaaauggaagauguaugauagacggcguuuuauuaggcacaacacaauuaucaccugucaacauuuguacauucagaggugacguuacacauccaagagacucaccuauauauacaaugaacuuagccucaccaaacuggaauaauuacgauccaacugaagaaauucccgcaccacuuggaacaccugacuucguaggaaaaauacaaggaaugcuaacacaaacaacaaaaggagaaggaucaaccagaggucacagagccacaguauauguaggaucagccaauuaugcuccaaaacuaggaagaguacaauucgaaacagauacaacuaaugacuuagaugcacaccaaaacacaaaauucacaccagucggaguaguacaaggaggagaauccccacaaagaucugaaccucaacaauggguauuacccaguuauuccgguagagacacaccgaacguacacuuagcuccagcagucgcaccaacauucccaggagaacaacuauuauucuuccgaaguacuauaccaggcugcggaggacauccuaauaugaaucucgacuguuuauuaccacaggaauggguacaacauuuuuaccaagaagcagcaccagcacaaucagacguagcacuauuaagauucguaaacccugacacgucaagaguacuauuugaaugcaaauuacauaaauccggauacguaacaguagcucauacaggacaacacgauuuaguaauaccaccuaauggauauuucagauucgauucauggguaaaucaauuuuauacuuuagcuccaaugggcaacggaacaggucgaaaacgauaa

SEQ ID NO: 34626 - RNA, 1617 nt, Artificial Sequence
  derived and/or modified sequence opt6 from VP1__Norovirus_and/or_Norovirus-like__KT033903
augaaaauggcaucaucugacgcuaauccuucagauggaucuacagccaacuuaguaccagaaguaaacaaugaaguaauggcacuagaaccaguugucggagcugcuauagccgcgccuguagcuggacaacaaaauguaauagacccauggauucguaacaacuuuguucaagcaccagguggagaauuuacaguaucaccccgaaaugcaccuggagaaaucuuaugguccgcaccauuaggacccgaucuaaauccauaucuaucacaccuagcaagaauguauaauggauaugcuggcggauucgaaguacaaguaauacuagcaggaaaugcauuuacugcaggaaaaauuauauucgccgcaguucccccaaacuuucccacugaaggacuaagcccaucucaaguaacuauguucccucauauuauuguugacguacgucaacuagaaccaguauuaauccccuuaccagacguaagaaauaauuucuaccauuacaaucaaucaaaugacucuacaauuaaauuaauagcaaugcucuacacaccauuacgugcaaauaacgcaggaggagaugucuucacaguaucaugccguguucuaacaagaccuucccccgacuuugacuuuauauuuuuaguuccaccgacaguagaaucaagaacaaaaccauucucaguaccaguauuaacagucgaagaaaugacaaacucaagauuuccaauuccucuagaaaaauuauuuacuggaccaucaucugcauuuguaguacaaccacaaaauggucgauguacaacagacgguguacuacuuggaacaacacaacuuucuccaguaaauauaugcacauuucgcggagacguuacccacauaccaggaucacgaaauuauacaaugaaucuugcaucacaaaauuggaacucguacgauccaacagaagaaauaccagcaccacuaggaacaccugauuuuguagguaaaguacaaggaguacucacacaaacaacacgaacaaacggcagcacaagaggucacaaagcaacaguuuacacuggaucugcagacuuuuccccaaaauuaggaagaguucaauucgcaacagauaccgauaaugauuucgaaacaaaucaaaauacaaaauuuacuccaguuggaguaauacaagacggaucuacaacaccaagaaacgaaccucaacaauggguucucccaucuuauucaggaagaaauauccauaacguacaccucgccccugcaguagcaccuacauucccaggagaacaauuacuauucuuuagaucuacaaugccaggaugcucaggauauccaaauauggauuuagacugccuauuaccacaagaauggguacaauacuuuuaccaagaagcugcaccagcucaauccgauguagcacuccuacguuuuguaaacccugauacaguaagaguacuauucgaaugcaaauuacauaaauccggauaugucacugucgcacauacaggccaacacgauuuaguaauacccccaaaugguuauuuucgauucgauucauggguaaaccaauuuuauacauuagcaccaaugggaaacggaacaggccgaagaagauaa

SEQ ID NO: 34627 - RNA, 1617 nt, Artificial Sequence
  derived and/or modified sequence opt6 from VP1__Norovirus_and/or_Norovirus-like__HM625866
augaaaauggcauccuccgacgccaaucccucagauggaucaaccgcaaaucuaguuccugaaguaaauaaugaaguuauggcauuagagccaguaguaggagcagcuuccgcugcacccguagcaggacaacaaaacgucauagauccauggauaagaaauaacuuuguccaagcuccaggaggagaauuuacagaaucaccaacaaaugcaccaggagaaaucuuauggucagcaccucuaggaccagauuuaaauccauaucuuucacacuuagcuagaauguacaacgguuaugcuggaggauuugaaguacaaguaauauuagccgguaacgccuuuacagcaggaaaaauaauauucgcagcaguucccccaaacuuuccaacggaaggacucucucccucacaaguaaccauguuuccacacauaauugucgaugucagacaacuagaacccguauuaaucccacucccagacgucagaaacaauuucuaucauuacaaccaaucaaaugauccuacaaucaaauuaauagcaauguuauauacaccacuaagagcaaacaaugccggagacgauguauuuacuguaucauguagaguacucacaagaccaucuccagacuuugacuuuauauuuuuaguuccagcaaccguagaaucaagaacaaaaccauucucaguuccuguucuaacaguagaagaaaugacaaacucaagauuucccauuccccuagaaaaacuauucaccggacccucaucagcauuugucguacaaccacaaaauggaagguguaccacagacgguguacuacuuggaacaacacaacuuucaccaguaaauauauguaccuuuagaggagaugucacacauauaccuggaucaagaaacuacacaaugaaucuagcaucucaaaauuggaacucuuacgaucccacugaagaaauccccgccccuguaggaacuccagauuuuguaggaaaaauacaaggagucuuaacacaaacaacccgcacaaauggauccacacgaggucacaaggcaacaguauauacaggaucagcagacuuuucaccaaaauuaggucgcguacaauucgcaacagauacagacaacgauuucgaaacaaaccaaaauacuaaauuuacaccagucggaguaauacaagacggaucaacaaccccaagaaaugaaccacaacaaugggucuuaccaucauauucaggaagaaauauacauaacguucacuuagccccagcaguagcaccuacauuucccggagaacaacuacuguuuuuccgaucaacaaugccaggauguucaggauacccaaauauggauuuagacugccuccuaccacaagaauggguacaauauuucuaccaagaagcagcaccagcacaaagugaugucgcacuccuucgauuuguuaacccagacaccggaagaguacuauuugaauguaaacuacauaaaucaggauauguaacaguagcacacaccggacaacaugaucucguaaucccaccaaacggauauuucagauucgauucauggguaaaucaauuuuacacauuagcacccaugggaaauggaacaggacgaagacgauaa

SEQ ID NO: 34628 - RNA, 1617 nt, Artificial Sequence
  derived and/or modified sequence opt6 from VP1__Norovirus_and/or_Norovirus-like__KX514319
augaaaauggcaucaucugacgcaaauccaucugauggaucaacagccaaucuaguaccagaaguaaauaaugaaguaauggcacuagaaccaguaguaggagccgcuauagcagcaccuguagcaggucaacaaaacguaauugacccuuggauacgaaauaacuuuguacaagcaccaggaggagaauuuacaguuucaccacgaaaugcacccggagaaauauuauggucagcaccauuaggaccagaucuaaacccuuaucuaucgcacuuagcgagaauguacaauggauacgcaggagguuucgaaguacaaguaauauuagcuggaaaugcuuuuacugcagguaaaauaauauucgccgcaguaccaccuacauuuccaacugaaggacuaucuccaucucaaguuacuauguucccacauauaauaguugauguccgacaauuagaaccaguacuaauaccacuaccagacguuagaaacaauuuuuaucauuacaaccaaucuaaugacagcacaauuaaauuaauagcuauguuauacaccccauuacgagcaaauaaugccggugacgauguauuuacagucucauguagaguauuaacacguccaucaccagacuuugauuucauauuccuaguacccccaaccguagaauccagaucaaaaccguuuucuguaccaguucuaacugucgaagaaaugacaaauucccgauucccagcaacauuagauaaauuauucacaggaccaucaucuacauucguaguacaaccacaaaacggacgaugcaugauagauggaguuuuauuagguacaacacaauuaucaccaguaaacauaugcacauucagaggagacguuacacauccaggugguucaaaaauauacacaaugaaucuagcaucucccaauuggaauaauuacgauccaacggaagaaauaccagcaccacuuggaaccccugauuuuguugguaaaauacaaggaauguuaacacaaacaacuaaaggugaaggaucuacaagaggucaccgugcaacaguauauguagguucagcaaacuaugcaccuaaauuaggaagaguucaauucgaaacagauacaacagaugaccucgaugcacaucaaaacacaaaauuuacaccagucggaguuguacaaggaggagaaucuccaaaaggaucagaaccacaacaauggguacuuccaucauauucaggaagagacacaccaaauguucaccuggcuccugcagucgcaccaacuuucccgggagaacaauuauuauuuuucagaucuaccauuccagguugcggaggacauccaaacauggaucucgauugucuauuaccacaagaauggguucaacauuucuaucaagaagcagcaccagcacaaucagacguagcacuuuuaagauucgucaauccagauacaucacguguuuuauuugaauguaaacuacauaaaucuggauacguaacaguagcacacacaggacaacacgaccuaguaauaccuccaaaugguuacuuuagauuugauucaugggucaaucaauucuacacacucgcacccaugggaaauggaacaggaagaagaagauaa

SEQ ID NO: 34629 - RNA, 1617 nt, Artificial Sequence
  derived and/or modified sequence opt6 from VP1__Norovirus_and/or_Norovirus-like__KX514311
augaaaauggcaucauccgaugcaaauccuucagacgguucaacagccaaucuuguaccagaaguaaauaaugaaguaauggcucuagaaccaguaguaggagcagcaauagcagcuccaguagccggacaacaaaacguaauagauccauggauaagaaauaauuuuguccaagcaccaggaggcgaguuuacaguaucacccagaaacgcaccuggagaaauacuauggucagcaccacuaggcccagaccuuaaccccuauuuaucacaucuagcaagaauguacaaugguuaugcaggaggcuucgaaguucaaguaauauuagcaggaaaugcauuuacagccggaaaaauuauuuuugcagcaguaccuccuaauuuuccaaccgaaggucuaucaccuucucaagucaccauguucccacacauaauaguagacguaagacaacucgaaccaguacuaauaccacuaccugauguuagaaauaauuuuuaccauuacaaucaaucaaacgauucaaccauaaaacuaauugcaaugcuauauacacccuuacgcgcaaacaauccuggugacgauguuuucacaguaucuuguagaguucuaacaagaccaucucccgauuuugauuuuauauuucuaguuccaccaacaguagagucuagaacaaagccauuuucuguaccuauauuaacaguaggcgaaaugacaaauucccgauucccaauaaaccuagaaagauuauuuacagguccuucaucagcaaacguaguacaaccacaaaaugguagauguaugauugacgggguacuccucggaacaacacaauuaucaccaguaaauauauguacauucaggggugacguaacucacccaggaggaucaaaaauauauacuaugaacuuagcauccccaaauuggaacaauuacgauccaacagaagaaauaccugcaccauuaggaacaccagacuucgugggaaaaauacaagguaugcuaacacaaacaacaaaaggagaaggaucaacaagaggacauagagcaacaguauauguaggaucugcuaauuaugcaccuaaguuaggccgagugcaauuugaaacagacacuacugaugacuuagacgcacaucaaaauacaaaauuuacaccugucggagucguucaaggaggagaaucgccaaaaggaucagaaccacaacaauggguacuaccaucuuacucaggaagagacacuccaaauguucauuuagcaccagcuguagcuccuacauuuccuggagaacaauuauuauucuuuagauccacuauacccggcugcggaggacauccaaauaugaaucuagacugucuauuaccacaagaauggguacaacauuuuuaucaagaagcagcuccagcccaaagugacguugcauuauuaagauuuguuaauccagauaccucucgaguacuauuugaaugcaaacuacacaaauccgguuacgucacaguugcucauacaggacaacacgauuuaguaauaccaccaaauggauauuucagauucgacucauggguaaaucaguucuauacauuagcaccaaugggaaauggaacuggaagaaaaagauaa

SEQ ID NO: 34630 - RNA, 1617 nt, Artificial Sequence
  derived and/or modified sequence opt6 from VP1__Norovirus_and/or_Norovirus-like__KX514266
augaaaauggcaagcaacgacgcaaacccaucugauggaagcgcagcaaaccuaguaccagaaguuaacaaugaaguaauggcacuagaaccaguagucggugcagcaauagcagcaccuguagcaggucaacaaaauguuauagauccauggauuagaaacaacuucguccaagcaccaggaggcgaauuuaccguaucaccaagaaacgcacccggagaaauacuaugguccgcaccucuaggcccugauuuaaacccauacuuaucacaucuagcaagaauguacaacgguuacgcuggaggauuugaaguacaaguaauauuagcuggaaacgcuuucacggcuggaaaaaucauauucgcugcaguaccaccaaauuuuccaacugaaggacuaucaccgagucaaguuacaauguuuccacauaucauaguagauguaagacaauuagaaccuguuuuaaucccuuuaccagauguaagaaauaacuucuaucauuauaaucaaucuaacgauaguacaauuaaguuaauugccaugcuauauacaccauuaagagcaaauaaugcaggagaugacguauuuacaguaagcuguagaguuuuaacaagacccucaccugacuuugauuuuauauuucuaguuccucccacaguagaaucacguucaaaacccuuuucaguuccaguacuaacaguagaagaaaugacaaacucuagguuccccgcaacacuagauaaauuauuuacaggaccauccucaacuuuuguaguacaaccucaaaauggaagaugcaugauagacggcguacuacucggaacaacacaauuaucaccaguaaauauauguacauucagaggugauguuacucauccaggagauucaccaauauauacaaugaauuuagcaaguccaaacuggaauaacuaugacccuacagaagaaauuccagcaccauuaggaacccccgauuuuguaggaaaaauucaaggaaugcuaacucaaacaacaaaaggagaaggcuccacuagaggccauagagccacaguuuacgucggaucagcaaauuaugcaccaaaauuagguagaguccaauuugaaacagacacaacaaaugaccuagacgcacaucaaaacacaaaauucaccccuguaggcguaguucaagguggagaaucucccaaagguucagaaccacaacaauggguauuaccaucuuacucagguagagacacaccuaauguacacuuagcacccgcaguagcaccuaccuuuccaggagaacaauuauuauucuuuagaucaacaauaccuggauguggaggacacccaaauaugaauuuagacuguuuauuaccucaagaauggguacaacacuuuuaccaagaagcagcaccagcccaaucagauguagcacuacuccgauuuguuaauccagauacaucaagaguacucuuugaauguaaauuacacaaaucaggauauguaacaguagcacauaccggccaacaugacuuagucauaccaccaaauggauauuuccgauucgauucuuggguaaaucaauuuuacacauuagccccaaugggaaaugguaccggcagaaagagauaa

SEQ ID NO: 34631 - RNA, 1617 nt, Artificial Sequence
  derived and/or modified sequence opt6 from VP1__Norovirus_and/or_Norovirus-like__KX514235
augaaaauggcaucaaaugacgccaaucccucagacggaucagcugcuaaccuuguccccgaaguaaacaaugaaguuauggcauuagaaccaguuguaggagcagccauagccgcaccaguagcaggacaacaaaauguuaucgauccauggauuagaaacaauuuuguacaagcaccgggcggugaauuuacaguaucuccaagaaacgcuccuggagaaauauuauggucagcuccauuaggaccagaucuaaaccccuaucuaucccaucuagcaagaauguauaauggcuaugccggcggauuugaaguacaagucauccuugcaggcaaugccuuuacugcaggaaaaauaauauuugcagcuguaccaccaaacuucccaacagaaggauuaucacccucacaaguaacaauguuuccucacaucauuguagauguaagacaauuagaaccaguacucauuccacuuccagacguuagaaauaauuucuaucacuacaaccaaucauccgacucaaccauaaaacuaauagcaaugcuuuacacaccauuaagagcaaacaacgcaggagaugacguauucacaguuuccuguagaguauuaacaagaccauccccagauuucgacuuuauuuuccuuguuccacccacaguagaaucacgcucuaaaccauuuucagucccaguauuaacuguagaagaaaugacaaacucuagauucccagcuacccuagauaaacuauuuacaggaccaucaucuacuuuuguaguacaaccacaaaauggcagaugcaugauugauggaguacuacuugguacuacacaacuaucaccuguaaauauauguacauucagaggagacguaacacauccaagagacucaccaauauauacaaugaauuuagcaucacccaauuggaauaacuaugacccaacagaagaaauuccagcaccacuuggaacuccagacuuuguaggaaaaauacaaggcauguuaacccaaacaacuaaaggagaaggaucuacuagaggacacagagcaaccguauauguaggaagugcuaauuaugcaccaaaauuaggaagaguccaauucgaaaccgauacuaccaacgauuuagaugcacaucaaaauacaaaauuuacacccguaggcguaguacaaggaggcgaaucaccccaaagauccgaaccacaacaauggguauuaccaucuuauucaggacgagauacaccaaacguucauuuagcaccagcaguagccccaacauucccaggagaacaacucuuauucuuuagaucaacaauuccaggaugcggaggacauccaaauaugaauuuagauugcuuauuaccucaagaauggguucaacauuuuuaccaagaagcagcuccagcacaaucugaugucgcacuauuaagauucguaaacccagauacuucaagaguauuauucgaauguaaacuacauaaaagcggauauguaacugucgcacacacaggacaacacgauuuagucauuccaccaaacggauauuuucgauucgauucaugggucaaucaauuuuauacauuagcaccuaugggaaauggaaccggacgcaaacgauaa

SEQ ID NO: 34632 - RNA, 1617 nt, Artificial Sequence
  derived and/or modified sequence opt6 from VP1__Norovirus_and/or_Norovirus-like__KX354115
augaaaauggcuucaucugacgcaaaccccucagaugguucagcagcuaaucuaguaccugaagccaauaacgaaguuauggcucuagaaccaguugccggcgcagcauuagccgcaccaguugcaggccaacaaaauguaauagaucccuggauaagaaauaauuucguccaagcaccaggaggagaauuuacaauaucuccaagaaaugcuccaggagaaauacuauggucagccccauuaggaccagauuuaaacccauacuuaucacauuuagcaagaauguauaacggauacgcaggaggauucgaaguacaaguaauacuagcaggaaacgccuuuacagccggcaaaguaauauucgcagcagucccacccaacuuuccaacaucuggcuuaucaccaagucaaguaacaauguucccauccguaguaguagacguaagacaacuugaaccaguacuuauuccacuuccagacguaagaaacaauuucuaucacuauaaucaaucaaacgacccaacaauuacacuaauagcuaugcuauacacaccauuaagagccaauaacgccggcgacgauguauucacuguaucauguagaguacuaaccagaccaucacccgacuuugacuuuauuuuccugguuccaccaaccgucgaauccagaacaaaaccauucaguguaccaguacuaacaguugaagaaaugacaaacucccgauuuccaauaccucuugaacgauuauuuacagguccaucuucagcauuuguaguacaaccccaaaacggaagaugcacaacugacggcguccuacuagguacuacacaauuauccccaguaaacauuuguaccuuucguggcgacauaauacauauuacaggaucacacaauuacacaaugaauuuagcaucacaaaauuggaacaauuacgauccaacagaagaaaucccagcuccacuaggcacaccugauuucguaggaaaaauucaaggaguauuaacacaaaccacucgaggagacggaucaacccgaggacauaaagccacuguauacacaggaucugcagauuucauaccaaaacuaggaagaguacaauucgaaaccgauacaaaucaugauuucgaagccaaucaaaauacaaaauuuacuccuguagggguaauacaagacggaucuacuacacauagaaaugaaccacaacaguggguauuaccauccuauaguggaagaaacacacauaauguacacuuagcacccgcuguagcaccaaccuucccaggagaacaauuauuauucuuuagaucaacaaugccaggaugcucuggauauccaaauauggaucuagauugcuuacuaccacaagaauggguacaauauuuuuaucaagaagcggcuccagcucaaucagacguugcuuuacuaagauuugucaauccugauacaggaagaguacuauuugaaugcaaauuacacaaaucaggauauauuacaguugcacacacaggacaacacgauuuagucaucccaccaaauggauauuucagauucgauucauggguuaaucaauuuuacacacuagcaccaaugggaaauggaacaggccgcagaagauaa

SEQ ID NO: 34633 - RNA, 1617 nt, Artificial Sequence
  derived and/or modified sequence opt6 from VP1__Norovirus_and/or_Norovirus-like__KM272334
augaaaauggcaucaucagaugcaaacccuuccgaugguucagcagcaaaucuaguaccagaagucaauaaugaaguaauggcccuugaaccuguuguuggagcagcaauagcagcaccaguagccggucaacaaaacguaauugauccauggauaagaaauaauuuuguacaagccccaggcggagaauuuacgguaaguccaagaaacgcaccaggcgaaauauuauggagcgcuccucuaggacccgacuuaaacccauacuuaucacauuuagcaagaacauauaacggauacgccggaggauuugaaguacaagucauauuagcaggaaaugccuuuacagcuggaaaaguuauauuugcagcaguaccacccaacuuuccaacugaaggacucucaccaucacaaguuacaauguuuccacacauaguagucgaugcacgacaauuagaaccaguacuaauuccauuaccagauguaagaaacaauuuuuaucacuauaaucaaucaaacgauccaacaauaaaauuaauagcuaugcuauauacacccuuacgugcaaauaaugccggagacgauguauuuacaguuucuuguagaguuuuaacucgccccucuccagauuucgauuuuaucuucuuaguaccaccuacaguugaaucacgaacaaaacccuucaguguaccuguuuuaacagucgaagaaaugacaaauucaagauucccuauuccuuuagaaaaauuauucacaggaccuucuucugcuuuuguuguacaaccgcaaaauucccgauguaccacagauggaguacuauuaggaacuacacaauuaucaccagucaacaucuguacauuccgaggagacguaacacauauaacaggaucaagaaauuauaccaugaacuuagcaucacaaaauuggaauaauuacgauccaacagaagaaauccccguuccauuaggaacaccugauuucguuggaaaaauacaaggaguauuaacacaaaccacuagaacagauggaucaacacgcggacacaaagcaacaguauauacaggaucagcagacuuugcaccaaaauuaggacgcguacaauuugaaacugacacagaccaugauuuugaagcuaaucaaaauacuaaauucacaccaguugguguaauacaagacggaggaacaacacauagaaacgaaccucaacaauggguauuacccucauauucuggccgaaauacacauaacguacauuuagcccccgcaguagcuccaacauuccccggcgaacaacuauuauucuuucgaucaacaaugccaggaugcucaggauacccaaauauggauuuagauugucuucuaccacaagaauggguacaauacuuuuaccaaggagcugcaccagcacaaucagauguagcacuuuuaagauuugucaauccagauacuggacgaguacuauuugaaugcaaauuacauaaaucaggauauguaacaguagcucacacuggucaacaugauuuagugauaccaccaaauggauauuuuagauucgauucauggguuaaccaauuuuauacauuagcaccaaugggaaacggaacuggccgacguagauaa

SEQ ID NO: 34634 - RNA, 1617 nt, Artificial Sequence
  derived and/or modified sequence opt6 from VP1__Norovirus_and/or_Norovirus-like__KX354116
augaaaauggcaucauccgacgcaaaccccucagauggcucugcugccaaccuuguacccgaagcaaacaaugaaguaauggcacucgaaccaguagcaggcgcugcuuuagccgcuccuguagcuggacaacaaaacguaauugacccuuggauuagaaauaauuucguccaagcacccgguggagaauuuaccauaucuccuagaaaugcuccaggagaaauauuauggucagcaccucuaggaccagaccucaacccauaccuaucucaccuagcaagaauguauaacgguuaugcuggaggauucgaaguacaaguaauauuagcuggaaaugcauuuacagcaggaaaaguaauauucgcagcaguuccaccaaauuuuccaacagcaggccuaucaccaucccaaguaacaauguucccauccguuguaguagauguacgacaacuagaaccaguacuaauuccuuuaccagacguccgaaauaacuuuuaucauuacaaucaaucaaaugacccgacaauaaccuuaaucgcuaugcuauacacaccacuuagagccaacaacgcaggcgaugauguauuuacagucuccuguagaguacuaacaagaccaucaccagauuuugauuucauauuucuaguucccccuacaguugaaucacguacaaaaccauucuccguaccaguauuaaccguggaagaaaugacaaacucucgauuuccaauaccguuagaaagauuauuuacaggaccaucuucugcauuuguaguucaaccucaaaauggaagauguacaacagauggaguuuuauuaggaacaacacaacucucaccaguaaauaucuguacauucagaggagauauaauacauauaacaggaucacacaacuacacuaugaaucuagcuucacaaaauuggaauaacuacgauccuacagaagaaauaccagcaccacuaggaacaccagacuuugucggcaaaauacaaggaguuuuaacccaaacaacaagaggagacgguucaacuagaggccauaaagcuaccguauauaccgguucagcagacuucauuccuaaauuaggacgaguacaauucgaaacagauacuaaucacgauuucgaagcaaaucaaaauacaaaauucacaccaguuggcguaauacaagaugguucaacaacucaucguaaugaaccacaacaauggguccuaccaucauauucaggucgcaauacucauaacguccacuuagcuccugcagucgcaccaacauucccaggagaacaacuuuuauucuuuagaucaacaaugccaggauguucaggauauccaaauauggacuuagacugucuacuaccacaagaauggguccaauauuuuuaucaagaagcagcaccagcacaaucagaugucgcacugcuaagguucguaaauccagacacuggacgcguauuauucgaaugcaaacuucauaaaucaggauauauaacaguugcucacacuggccaacacgaucuaguaauaccacccaauggcuauuuuagauucgacagcugggucaaucaauuuuacacauuagcuccaauggguaaugguacaggcagacgaagauaa

SEQ ID NO: 34635 - RNA, 1617 nt, Artificial Sequence
  derived and/or modified sequence opt6 from VP1__Norovirus_and/or_Norovirus-like__KX514172
augaaaauggcaucuucagacgcuaauccuuccgacggaucagcagccaacuuaguucccgaaguaaauaaugaaguaauggcucuagaaccuguaguuggagcagcaauagccgcaccaguagcaggacaacaaaacguaauagacccauggauuagaaauaacuucguacaagcuccagguggcgaauuuaccguaucuccacgaaacgcaccaggagaaauacuauggucagcaccacuuggacccgaucuaaacccauaccuaucacaucuagcaagaauguacaacggcuaugcugguggauucgaaguacaaguaauauuagcaggaaaugcauucacagcaggaaaaauaauauuugcugcaguuccuccaacuuuccccacagaaggacuuucaccuucacaaguaacuauguuuccacauauaauaguagacguaagacaauuagagccuguauuaauaccucuaccagauguaagaaacaacuuuuaucacuacaaucaaucaaacgauucaacaauaaaacuaauagccaugcuauauacaccucuacgugcaaauaacgcaggagaugacguauuuacaguaucauguagaguccugacaagaccaucaccagacuucgauuuuauauuuuuaguaccaccaacaguagaaucaagaucaaaaccuuuuucuguuccuguauuaacuguagaagaaaugacaaauucaagauuuccagccacacuugauaaacuuuuuacugguccauccaguacauucguaguacaaccacaaaaugguagaugcaugauugauggaguacuacuuggcacaacacaauuaucaccuguuaauauuugcacauuccgaggagacguaacucauccaagagauucacaaauauauaccaugaauuuagccuccccaaauuggaauaacuaugacccaacagaagaaauuccagccccauuaggaacuccagacuuuguaggaaaaauacaagguauguuaacacaaacaacaaaaggagaaggaucaacaagaggccaccgagcaacuguauacguaggaagcgcaaauuacgcuccaaaauuaggacguguacaauuugaaaccgauacuacaaacgauuuagaugcacaucaaaauacaaaauuuacacccgucggaguuguucaaggcggagaaucaccaaaaggcucugaaccccaacaauggguauuacccucauauagcggaagagauacuccaaauguacaucuagcgccugcagucgcacccacauuuccaggagaacaauuauuauuuuucaggucaacaauaccaggaugugguggacacccaaacaugaauuuagacugucuacuaccacaagaauggguacaacauuuuuaccaagaagccgcaccagcacaaucugacguagcuuuauuacgauuugucaaucccgacaccucaagaguucucuucgaauguaaauuacauaaaucaggauacguaaccguagcacacacaggucaacacgacuuaguuauaccaccuaacggauacuuuagauucgauucauggguaaaccaauuuuauacacuagcaccuauggguaauggaacaggaagaaaaagauaa

SEQ ID NO: 34636 - RNA, 1617 nt, Artificial Sequence
  derived and/or modified sequence opt6 from VP1__Norovirus_and/or_Norovirus-like__KX354114
augaaaauggcaucaucugacgcaaacccuucagauggaucagcagcgaauuuaguaccagaagccaacaaugaagucauggcauuagaacccguagcuggagcagcacuugcagcuccuguagcaggacaacaaaaugucauagacccuuggauaagaaauaacuucguacaagccccaggaggagaauuuacaauuucuccacgaaaugcaccuggagaaauacuuuggucugcaccauuaggcccagaccuaaauccauaucuaucacacuuagcacgaauguauaaugguuacgcaggaggauucgaaguacaaguaauacuagcaggaaacgcuuuuaccgccggaaaaguaaucuuugcugcaguuccaccuaacuuuccuacaucaggucucucuccaucucaaguuaccauguuuccuucugucgucguagacguccgacaacuagaaccaguauuaauaccgcuuccagauguaagaaacaauuucuaccacuauaaccaaucaaaugacccaaccauaacacucauagcaauguuauacaccccauuaagagcaaauaaugcaggcgacgacguauucacaguaucaugccgcguucuaacccgucccucaccagacuuugacuuuauauuucuaguaccuccaacaguugaaucuagaacuaaaccauuuucagucccuguacuuacaguagaagaaaugaccaacucaagauucccaaucccccuagaaagauuauucacaggaccaucuuccgcauucgucguucaaccacaaaauggacgauguacuacugacggaguccuauuaggaacaacucaacuaucacccguaaauauauguacauuuagaggagacauaauacauauaacuggaucacauaauuacacaaugaaucuagcaucccaaaauuggaauaacuacgaucccaccgaagaaauaccagcaccucucgguacaccagauuuuguaggcaaaauacaaggcguauuaacacaaacaacgcggggugauggaucaacaagaggacacaaagccacaguauauacaggaucagcugauuuuauaccaaaacuaggaagaguacaauucgaaacagauacaaaucacgauuucgaagcaaaccaaaauacaaaauucacuccaguaggaguaauccaagacggaucaacaacacacagaaacgaaccacaacaauggguccuccccagcuauucaggacgaaacacacauaauguacauuuagccccagccguagcaccaacauuucccggugaacaauuacuuuucuucagaucaacuaugccaggaugcucuggcuacccaaauauggaucucgauugccuccuaccucaagaauggguacaauauuuuuaccaagaagcagcaccagcacaaucagacguagcacuauuaagauucguaaauccugacacaggaagaguauuauucgaaugcaaauuacauaaaucuggcuauaucaccguagcacauacuggccaacacgauuuaguaaucccuccaaauggauacuuccgcuuugauuccuggguaaaccaauucuauacuuuagcuccaaugggaaauggaacuggaagaaaaagauaa

SEQ ID NO: 34637 - RNA, 1617 nt, Artificial Sequence
  derived and/or modified sequence opt6 from VP1__Norovirus_and/or_Norovirus-like__KX514295
augaaaauggccuccaaugaugcaaaucccucagauggaucugcagcuaacuuaguacccgaaguuaacaacgaaguaauggcccuugaaccagucguaggagcagccaucgcagcaccuguugccggucaacaaaauguaauagauccuuggauacgaaauaacuucguacaagccccaggaggagaauuuacuguaucuccucguaaugcaccuggagaaauacuauggagugcaccacuuggacccgaucucaacccauauuuaucucaucuagccagaauguauaauggauaugccgguggauuugaaguucaagucauacuugccgguaaugcauuuacugcaggaaaaauaauauuugcagcuguaccaccuacauuccccaccgaaggacuaaacccaucucaaguaacaauguucccacacauaauaguugauguaagacaacuagaacccguacuaauaccacuuccagauguaagaaauaauuucuaccauuacaaucaaucuaacgacucaacgauuaaacuaauagccaugcuuuauacaccauuaagagcaaauaaugcuggagacgaugucuucaccguaucuuguagaguacuaacaagaccaucaccugacuuugauuuuaucuuuuuaguaccacccacaguagaaagucgaucaaaaccuuuuucaguaccagugcuaacaguagaagaaaugacaaacuccagauuucccgcaacacuugauaaauuauucacaggcccaucaucaacauuuguaguucaaccacaaaacggaagauguaugauugacggaguacuauuaggaaccacacaguuauccccaguaaacauuugcacuuuuagaggagaugucacacauccucgagauucaccaauuuauacaaugaaucuugcaucuccaaacuggaacaauuacgauccaacugaagaaauaccagcaccauuaggaacacccgacuucguaggaaaaauccaaggaauguuaacacaaacaaccaaaggagaaggcucuacuagaggacaucgagcaacaguauacgucggaucagccaauuacgcaccaaaauuaggcagaguacaauuugaaacugacacaacaaaugaucuugaugcacaccaaaacacaaaauuuacaccuguagguguaguccaaggaggagaaucaccaaaaggaucagaaccccaacaauggguauuacccucuuacuccggaagagacacaccaaacguucaccuagcuccugcaguugcaccaacauuccccggagaacaauuauuauucuuuagaucaacaauaccaggauguggaggacauccuaacaugaauuuagauuguuuacuaccucaagaauggguacaacauuuuuaucaagaagcagcgccagcacaaagugacguagcauuacuaagauuuguuaauccugauacaucaagaguacucuuugaauguaaacuacacaaauccggcuaugugacuguagcucauacaggccaacaugaccuaguuauaccaccaaauggcuauuuuagauuugauucauggguaaaccaauucuauacucuagcacccauggguaacggaaccggacguaaaagauaa

SEQ ID NO: 34638 - RNA, 1617 nt, Artificial Sequence
  derived and/or modified sequence opt6 from VP1__Norovirus_and/or_Norovirus-like__KX514242
augaaaauggccucauccgacgcaaauccuucggauggaucagcagcuaauuuaguaccagaaguaaacaaugaaguaauggcuuuagaaccagugguaggagcagccauugcugcaccaguagcaggucaacaaaaugucauagauccauggauucgaaacaauuuuguccaagcacccgguggagaauuuacagucucuccaagaaaugcuccaggagaaauauuauggucagcaccauuaggaccugaucuaaauccauaucuaagucauuuagccagaauguacaauggauacgcuggaggauuugaaguacagguaauacuagcaggaaacgcauuuaccgcaggaaaaauaaucuuugcagcaguaccuccaaauuuuccuacugaaggacucaguccuucacaagucacaauguucccccacauuauuguagauguaagacaauuagaaccuguauuaauaccauuacccgauguacgaaauaauuucuaucacuauaaucaaucaaaugacucaaccaucaaauuaauagcaaugcuuuacacuccccuaagagcaaauaacgcaggagacgacgucuuuacuguuucaugucgaguauuaacaagaccuucaccagauuuugauuuuauauuuuuaguuccuccaacaguagaaucaagaucaaaaccauuuucaguaccaguccuaaccguagaagaaaugacaaacucucgauuuccagcaacauuagauaaauuauucacagguccaagcucaacauucgucguacaaccacaaaaugggcgaugcaugauugacggaguacuacuagguacaacacaacuaaguccuguuaacauuuguaccuucagaggagauguaacacauccuagagauucacccauuuauacaaugaaccuagccucaccaaacuggaauaauuaugauccaaccgaagaaauacccgcacccuuaggaacaccugauuuuguagguaaaauacaagguaugcuaacacaaacaacaaaaggagaagguucaacacgaggucauagagcaacaguauauguaggcucugccaauuaugcuccaaaacuaggacgaguacaauuugaaacagacaccaccaaugauuuagaugcacaucaaaacacuaaauucacuccaguuggcguuguacaggguggugaaucaccccaaagaucagaaccucaacaauggguucuaccuucguacucagguagagauacaccaaauguucaccuagcuccugccguagcaccuaccuuuccuggagaacaauuacuauucuuuagaucuacaauaccagguugcggaggacauccaaacauggaccuagauugcuuauuaccucaagaauggguacaacauuuuuaucaagaagcagcccccgcucaaucagacguugcacuacuacgauucguaaaucccgauacaucaagaguauuauuugaauguaaauuacauaaaucuggauauguaacaguagcacauacaggacaacaugacuuaguuauaccaccaaauggauacuuuagauuugacucauggguaaaucaauuuuauacuuuagcaccaaugggaaauggaacagguagaaaaagauaa

SEQ ID NO: 34639 - RNA, 1617 nt, Artificial Sequence
  derived and/or modified sequence opt6 from VP1__Norovirus_and/or_Norovirus-like__KX514224
augaaaauggcaucaaaugaugcaaacccaagugacggauccgcagcaaaucucguuccagaaguaaauaacgaaguaauggcauuagaaccaguuguaggagcagcaauagcagcccccgucgcaggacaacaaaauguuauugacccuuggauaagaaauaacuucguacaagcuccuggaggugaauuuacaguuucuccaagaaaugcacccggugaaauacuuuggucagcaccauuaggcccugauuuaaauccauauuugagucaucuugcaagaauguauaacggauaugccggaggcuuugaaguacaaguuaucuuagcaggaaacguauucacagcagguaaaauaauauucgcagcaguuccaccaaacuuuccgacagaaggauuaucaccuagucaaguaaccauguuuccucacauaaucguagacguaagacaacucgaaccagucuuaauaccucuuccagacguacgaaauaauuucuaccacuauaaucaauccaaugacaguacuauaaaacuaauagccauguuauauacuccacuaagagcuaacaacgcuggugaugauguauuuacaguauccugcagaguauuaacaagaccaucuccugacuuugacuuuauuuuucucguaccaccuacaguagaauccagauccaaaccauuuucaguccccguuuuaacaguagaagaaaugacaaauucucgauucccagcaacacuugauaaacuauucacaggcccaucuucuacuuucguuguacaaccucaaaacggaagaugcaugauagauggaguacuuuuaggcacaacucaauuaucuccaguaaauauauguacuuuuagaggagauguaacgcacccccgcgauucaccaauauauacaaugaaucuugcaucuccaaacuggaauaauuaugaucccacagaagaaauaccagcaccauuaggaacaccagauuuuguaggaaaaauucaagguaugcuaacucaaaccacuaaaggugaaggaucaacaagaggacauagagcuacaguuuauguaggaagugccaauuacgcaccaaaacuaggacgaguucaauucgaaacagauaccacuaaugauuuagacgcucaccaaaauaccaaauuuaccccuguuggcguaguacaaggcggagaaucaccccaacgaucagaaccacaacaauggguacuaccaucauauucaggaagagauacaccaaauguucauuuagcaccagcaguagcacccacauuuccaggugaacaauuacuauuuuucagaucaacaauaccaggcugcggaggucauccaaauaugaacuuagauugccuucuaccacaagaauggguacaacauuuuuaucaagaagcagcaccagcacaaucagacguagcuuuauuacgcuuuguaaacccagauacuucaagaguccuuuuugaauguaaacuacauaaaucuggauauguaacaguugcccacacaggucaacaugaccucguuauaccaccuaauggauacuucagauuugauucauggguuaaucaauuuuauacacuagcaccuauggguaacgguacuggacgaaaaagauaa

SEQ ID NO: 34640 - RNA, 1617 nt, Artificial Sequence
  derived and/or modified sequence opt6 from VP1__Norovirus_and/or_Norovirus-like__KX514262
augaaaauggcaucaucugaugcuaacccuucagauggaucagccgcuaauuuaguaccagaaguaaacaacgaaguuauggcacucgaaccaguaguaggagcagcaauagcagcaccaguagcuggucaacaaaauguaaucgacccauggauaagaaauaacuuuguacaagcaccaggaggagaauuuacaguuucaccaagaaacgcacccggugaaauauuauggucagcuccacuuggucccgaucugaacccauaucuuucacacuuagcccgaauguauaauggauacgccggaggauucgaaguacaaguaauauuagcuggaaaugcauuuacagcuggaaaaauuauauucgcagcaguaccaccaacauucccaacagaaggacuaucacccucucaaguuacaauguuuccucacauaauaguagauguaagacaacuugaaccaguccuaauucccuuacccgauguacguaauaauuuuuaucacuauaaccaauccaaugacucaacaauuaaacuaauagcaaugcucuacacuccacuccgagcaaauaacgccggcgaugauguauuuacaguaucuugucguguucuaacacgaccuucaccagacuuugauuucauauuccuaguaccuccaacaguagaaucucgaucaaaaccauucucaguaccaguauuaaccgucgaagaaaugacuaacucaagauuuccagcaacacuagauaaacuauuuaccggcccaucaagugcauuuguuguacaaccccaaaaugguagaugcaugauagacgguguacuucuugguacaacccaacucucaccaguaaauauauguacauuuagaggugauguaacacacccaagagauucaccuauauauacaaugaacuuagcaucaccaaauuggaacaacuaugacccaacagaagaaauaccagcaccacucggaacaccagauuucguuggaaaaauucaaggaauguuaacacaaacaaccaaaggagaaggaaguacaagaggacacagagccacagucuauguaggaucagcuaacuacgccccaaaacuagguagaguacaauucgaaaccgauacaacuaaugauuuagaugcacaucaaaauacaaaauucacaccaguaggaguaguacaaggaggagaaucaccaaaaggaucagaaccacaacaauggguacuaccaagcuauucagguagagauacaccaaauguacaucuugcaccagcaguugcuccaacauuuccaggugaacaauuacuuuucuuuagaucuacaauaccagguugcggaggacauccaaauaugaauuuagacuguuuacuaccucaagaauggguucaacacuucuaccaagaagcagcuccagcacaaucagacguagcccuauuacgauucguuaacccagacacuuccagagucuuauuugaauguaaauuacauaaauccggcuauguaaccgucgcacacacaggucaacacgaccuaguuauaccaccaaacggauacuuucgauucgauucauggguaaaccaauuuuauacauuagccccaaugggaaauggaacgggccgaaaacgauaa

SEQ ID NO: 34641 - RNA, 1617 nt, Artificial Sequence
  derived and/or modified sequence opt6 from VP1__Norovirus_and/or_Norovirus-like__KX354139
augaaaauggcaucaucagacgcaaauccaucagacggauccgccgcuaaccuaguacccgaagcaaacaacgaaguaauggcauuagaaccaguagcaggagcagcacuagcagcaccaguagcaggccaacaaaacguaauagacccauggauaagaaauaauuucguccaagcaccaggaggagaauuuacaauaaguccaagaaaugcaccuggagaaauauuauggucagcaccauuaggaccagauuuaaaucccuaucuaucacauuuagccagaauguauaaugguuaugcuggaggauuugaaguacaaguaauucucgcuggaaacgcauuuacugcugguaaaguaauauuugcagcaguaccaccaaacuucccaacaacaggucuaucaccaucgcaaguaacaauguuuccuucaguaguaguagacguaagacaacucgaaccaguuaugauaccauuaccagauguaagaaacaauuuuuaccacuauaaccaaucaaacgaccccacuauaacauuaauagcuauguuauauaccccacuuagagcuaacaaugcaggagaugauguuuuuacaguaucauguagagucuuaacuagaccaucaccugacuucgacuucauauucuuaguaccaccaacaguugaauccagaacaaaaccauucucaguaccaguacuaacaguugaagaaaugacaaacucuagauuuccuauuccauuagaacgacucuuuaccggaccaucaucugccuucguaguccaaccccaaaacggaagaugcacaacagacggaguacuauuaggaacaacccaauuauccccaguaaauauuuguacauuuagaggagauguaacacacauaacaggaucacgaaauuacaccaugaaccuagcaucacaaaauuggaacaauuacgauccuacagaagaaauaccagcaccccuuggaacccccgauuucguuggaaaaauucaaggcaugcuaacccaaaccacacgcaccgacggaucaacaagaggacacaaagcaacaguauauacagguucagcagacuuugcaccuaaacuaggccguguacaauuugaaacagauacagaucacgauuuugaagcaaaucaaaauacaaaauucacaccaguaggcguuauacaagacggaucaacuacacauagaaaugaaccacaacaauggguacuaccaucauauucaggcagaaacacacacaauguucacuuagcacccgcagucgcaccuacauuuccaggagaacaagucauauucauaagauccacuaugccaggcuccaguggauauccaaauauggaccuagacugcuuacuaccucaagaauggguccaauauuucuaucaagaagcagcacccgcucagucagacguugcaaugauaagauuugucaacccagacacaggaagaguccuauuugaauguaaauuacauaaaaguggcuacauaacugucgcacacacaggacaacaugaccuaguaauaccaccaaauggauauuuuagauucgauucuuggguaaaccaauuuuauacccuagcaccaaugggaaacggcacaggcagaagacguuaa

SEQ ID NO: 34642 - RNA, 1617 nt, Artificial Sequence
  derived and/or modified sequence opt6 from VP1__Norovirus_and/or_Norovirus-like__KX514215
augaaaauggccucgaaugacguaaauccaucagacggaucuacagcaaacuuaguaccugaaguaaacaaugaaguuauggcauuagaaccaguuguaggugcagcaaucgcagcaccaguagcagggcaacaaaacguaauagacccauggauuagaaauaacuuuguacaagccccaggaggugaauuuacaguuucuccaagaaacgccccuggagaaaucuuauggucugcaccacuaggaccaggauuaaacccauauuuaucacaucuugcaagaauguacaacggauacgcaggaggauucgaaguccaaguaauauuagccggaaacgcauuuacagcaggaaaaauaauauuugcagccguaccaccuaauuucccaacugaaggacuuaauccaucacaagucacaauguucccacacauaauaguugacguccgacaauuagaaccaguuuuaauaccauuaccagacguacgaaauaacuucuaccacuauaaucaauccaaugauucaacaauaaaacuuauagccauguuauauacucccuuaagagcaaacaaugcaggagacgauguauuuacaguaucaugcagaguacuaacuagaccuucaccagacuuugacuuuauauuuuuaguaccaccaacugucgaaucaagaucaaaaccauucucaguacccguauuaacuguccaagaaaugacaaacucuagauuccccgcuacacuagacaaacucuucacagguccauccucuacuuuuguaguccaaccacaaaauggaagauguaugauugaugguguacuacuuggaaccacacaauuauccccaguaaauauuuguaccuuucgaggugacguuacacauccuagagauucccccaucuauacaaugaaucuugcuagcccaaacuggaauaacuaugacccaacugaagaaauacccgcuccacuagguacaccagacuuuguagguaaaauacaaggaaugcuuacacaaaccacuaaaggugaagguucaacaagaggacauagagcaaccguuuacgucggcucagcuaauuaugccccaaaauuaggaagaguacaauucgaaacagauacaacaaaugaucuagaugcacaucaaaauacuaaauuuacaccaguaggaguaguacaaggaggcgaaucaccccaaagaucugaaccucaacaauggguacuaccaucauacucaggaagagauaccccaaauguccauuuagcaccagcaguagcacccacuuuuccaggugaacaacucuuauucuuuagaucaacaauaccagguugcggaggucacccaaauaugaaucuugauuguuuauuaccucaagaauggguacaacauuuuuaucaagaagcugcaccagcccaaucagauguagcccuauuaagauuuguaaaccccgacacaucaagaguacuauucgaaugcaaacuccauaaaucuggauauguuacaguagcacauacaggucaacacgaucuaguaauaccaccaaauggauauuucagauuugauaguuggguaaaucaauucuacacacuagcacccaugggaaauggaacuggacgaaaacgauaa

SEQ ID NO: 34643 - RNA, 1617 nt, Artificial Sequence
  derived and/or modified sequence opt6 from VP1__Norovirus_and/or_Norovirus-like__KX514367
augaaaauggcaucaucagacgcaaauccuucugauggcagcacagcuaauuuaguaccagaaguaaacaaugaaguuauggcauuagaaccaguaguaggagcugcaauagccgccccaguggcaggacaacaaaacgucaucgacccauggauaagaaauaauuuuguacaagcaccaggaggcgaauuuacaguaucaccaagaaaugcaccaggagaaauacuauggucugcaccccuuggaccugacuuaaauccauaccuaucacauuuggccagaauguauaauggauaugccggcgguuuugaaguacaaguaauacuagcaggcaacgccuuuacagcuggaaaaauaauauuugcggcaguaccacccacauucccaaccgaaggacuaucuccaucccaaguaacaauguucccacacauuauagucgauguuagacaacuagaaccaguacuaauuccuuuaccugacgucagaaauaacuucuaucauuacaaucaaucaaaugacucuacaauaaaauuaauagccaugcuauauacuccauuacgugcaaauaaugcaggagacgauguauucacuguaucuugccgaguauuaacacgaccuucuccagauuucgauuuuaucuucuuaguuccuccaacuguagaaucaagaucaaaaccauuuucaguacccguucucacaguugaagaaaugaccaauucaagguuuccagcaacauuagauaaacuauucacaggucccucuucuacauucguaguacaaccucaaaacgguagaugcaugauagauggaguacuuuuagguacgacacaauuaucccccguaaauauauguaccuuuagaggagaugucacacauccaagagauucaccaauuuauacuaugaaucuugcauccccaaacuggaacaacuaugauccuacagaagagauaccagcaccacuaggaacuccagacuucguagguaaaauccaagguauguuaacacaaacaacaaaaggcgaaggaucaacaagaggucauagagcaacuguauauguagguuccgcagacuaugcaccuaaauuaggacgaguacaauuugaaacagauaccacaaaugaucucgacgcacaucaaaacacaaaauucacaccaguaggcgucguacaaggaggagaaucuccaaaaggaucagaaccccaacaauggguacuuccaucacauucagguagagauacaccuaauguacaucucgcaccagccguagcaccaaccuuuccuggagaacaacuacuauucuuuagaucaaccauaccaggaugugguggacauccuaacaugaaucuugauuguuuacuaccacaagaauggguacaacauuuuuaucaagaagcagccccagcccaaucagacguugcacuacuuagauucgugaauccagacacaucacgaguauuauucgaauguaaauuacauaaaucaggauauguaaccguagcacauaccggucaacaugaucucgucaucccuccaaauggauauuucagauuugauucauggguaaaucaauuuuauacacuagcaccaauggguaaugguacaggacgaaaacguuaa

SEQ ID NO: 34644 - RNA, 1617 nt, Artificial Sequence
  derived and/or modified sequence opt6 from VP1__Norovirus_and/or_Norovirus-like__KX514243
augaaaauggcaucaaaugacgcaaaccccuccgaugguucagcugcaaacuuaguaccagaaguaaauaaugaagucauggcauuagaacccgucguaggagcagcuauugcagcaccuguagcaggacaacaaaauguaauugacccuuggauaagaaauaauuucguacaagcaccugguggugaauuuaccguaucacccagaaaugcaccuggcgaaauauuauggucagcaccacuaggccccgauuuaaauccauaccuuucucacuuagcaagaauguauaauggauaugcaggaggauucgaaguacaaguaauucuagcaggcaaugccuuuaccgcaggaaaaaucauuuucgcugcaguuccaccaacuuucccaacagaaggacuaucaccaucccaaguaacaauguucccacacauaauuguagauguaagacaacucgaaccaguauuaauuccacuuccagauguaagaaacaauuucuaucacuauaaucaauccaacgacaguacaauaaaacuuauagcuaugcuauauacaccacuaagagcuaacaacgcuggugacgaugucuuuacagucucuuguagaguacuaacuagaccaucacccgauuuugacuuuauauucuuaguacccccaacaguugaauccagaucaaaaccauucucaguucccguacuuacaguagaagaaaugacaaacucccgcuuuccagcaacauuagacaaacuauucacaggaccauccucaaaucuaguaguacaaccacaaaacggucgaugcaugaucgauggaguauuacuaggaacaacacaauuauccccuguaaauaucuguacauuucgaggagacgucacacacccacgagacuccccuauuuacacuaugaaucuagcaucaccgaauuggaacucauacgacccuacagaagagaccccagcaccacuaggcacuccagacuuuguaggaaaaauacaugguaugcuaacucaaacaacacagggaucagguucaacaagagcacacagagcaacuguauaugucggaggagcugaauuuacaccaaaacuuggaaaaguacaauuuaaaaccgaaacagaucacgaucuaucuauacgucaaaauacaaaauuuaccccagucgguguaguccaaggaggcgaaaguccacaaagaagugaaccucaacaauggguccuuccaucauauucaggaagagauacaccuaauguacauuuagccccugcagucgccccaacauuucccggagaacagcuccuauucuuuagaucaacuauaccagguugcggaggccauccaaauaugaauuuagauugucuucuaccccaagaauggguacaacauuuuuaucaagaagcagcaccagcacaaucagacguagcacuacuacgauucguuaacccagauacaucuagaguucuuuuugaaugcaaacuacacaaaucaggauauguaacaguagcucauacaggacaacacgacuuaguaauacccccaaauggcuauuuuagauucgauucaugggucaaucaauuuuacacucuagcacccaugggaaauggaaccggaagaaaaagauaa

SEQ ID NO: 34645 - RNA, 1617 nt, Artificial Sequence
  derived and/or modified sequence opt6 from VP1__Norovirus_and/or_Norovirus-like__KX353996
augaaaauggcaucuucagaugcaaauccuucagacgguuccacagcaaacuuaguucccgaaguaaacaaugaaguaauggcacuagaaccaguaguaggagcagcaauagcagcaccaguagcaggacaacaaaauguaauagauccauggauaagaaauaacuuuguacaagcaccuggaggugaauuuacuguaucuccuagaaacgcuccaggcgaaauacuauggucagcaccucuagguccugacuuaaauccauauuuaucacaucuagcaagaauguacaacgguuacgcaggaggcuucgaaguacaaguaauacucgcaggcaaugccuucacagcaggaaaaauaaucuuugcagccguuccaccaaacuuccccaccgaaggucuuucacccucacaaguaacuauguucccacauauaauaguagacguacgucaacucgaaccaguauuaauaccccucccagauguuagaaacaauuuuuaucauuacaaccagucaaaugauucaacaauaaaacucauugcuaugcucuacacaccuuuaagagcuaauaaugcaggagacgacguauuuacaguuucauguagaguucuuacccgacccucaccagauuuugacuuuauauuccuagucccacccacaguagaaucaagaacaaaaccauucucgguaccaguuuuaacuguagaagaaaugacaaacucaagauucccuauaccauuagaaaaacuuuuuacaggacccucaucagccuucgucguacaaccacaaaacggacgauguaccacagacggaguauuacuaggaacaacucaacuauccccuguaaauauaugcacauuuagaggagacguaacacacaucccaggcucaagaaauuacaccaugaauuuagcaucacaaaacuggaacuccuaugacccaacagaagaaaucccugcaccucuaggaacuccagacuuuguagguaaaauacaaggaguacuaacacaaacaacacguaccaacggaucaacuagaggacauaaagccacugucuauaccggaucagcugauuuuucuccaaaacuagguagaguccaauuugcaacagauacagacaaugauuucgaaacuaaccaaaauaccaaauuuacaccaguaggaguaauacaagauggcucaacaacaccuagaaacgaaccucaacaaugggucuuaccaucauacucaggaagaaacacccacaauguacaccucgccccugcaguagcaccaacauuucccggagaacaauuacucuucuucagaucaacaaugccuggcugcucugguuauccgaacauggaccuagaccgauuaccaccacaagaacgaguacaauacuucuaucaagaagccgccccugcacaaucagauguagcauuauuaagauucguaaacccugauacuggaagaguacuauucgaaugcaaacuacauaaaucaggauauguaacuguagcacacacaggucaacacgaccuuguaaucccacccaauggcuacuuuagauucgauucuuggguaaaucaauuuuacacuuuagcaccaaugggaaauggaacuggaagaagacgauaa

SEQ ID NO: 34646 - RNA, 1617 nt, Artificial Sequence
  derived and/or modified sequence opt6 from VP1__Norovirus_and/or_Norovirus-like__DQ078820
augaaaauggcaucaaaugaugcuucaccuucagauggaucuacagcaaaccuaguacccgaaguaaauaacgaaguaauggcauuagaaccaguagucggagcagcaauagccgcaccaguagcuggacaacaaaauguaauagacccguggauaagaaacaacuucguacaagcaccaggaggagaauuuacaguaucacccagaaacgcuccaggagaaauccuauggucagcgccacucggaccagacuuaaaucccuaucuaucacacuuagcgagaauguauaaugguuacgcuggaggauucgaaguacaaguuauacuagcaggaaaugcauucacagccgguaaaauaaucuuugcugcaguaccacccaacuuuccuacagaaggccuagguccaucacaaguaacaauguucccccacauaaucguagacguaagacaacucgaaccaguacucauaccccuacucgacguaagaaauaaucuauaucacuauaaucaaagcaaugacccaacuauaaaacucauugcaauguuauauacaccauuaagagcaaauaaugcaggagaaguugucuucacuguuucuugucgaguauuaacuagaccaucaccugacuucgauuuuauauuuuuaguuccaccaacuguagaaucucgaacaaaaccuuuuacaguuccaauucuaaccgcagaagaaaugacuaacucaagauucccaacacccuuaggaaaacucuucacagguccaucaagcgcauucguaguucaaccccaaaauggaagaugugcaacagacggaguacuacuaggaacaacucaacuaucaccagucaauaucuguacauuuagaggagauguuacacauaucgcaggaacucaugacuacacaaugaaucuagcaagccaaaacuggaacaauuaugauccaaccgaagaaauaccagcuccauuaggaacaccagacuucguuggcaaaauacaaggaguacuaacccagacuacuagaggagacggaucaacuagaggacauaaagccacaguaucaacuggaucuguccauuuuacaccuaaauuagguggaguacaauuuacuacugauacaaauaacgauuucgaaacaggucaaaacacaaaauuuacaccuguuggaguaauccaagacggaaauucaacccaucaaaaugaaccacaacaaugggucuuaccaaauuauagugguagaacaggacacaaugugcacuuagcaccagcuguagcuccaacuuuuccuggcgaacaguuacuauucuuuagaucaacaaugcccgguuguagcggauaucccaauaugaauuuagauugccuucuaccucaagaauggguacaacacuuuuaucaagaagcagcacccgcucaaucugacguagcauuacuaagauucgugaauccagaugcaggaagaguauuauuugaaugcaaaccacauaaauccggauauguaacaguagcacacaccggccaacacgaucuuguuaucccacccaacggcuauuuuagauuugauucuugggucaaucaauucugcacacuagcaccaauggguaauggaacaggaagacgaagauaa

SEQ ID NO: 34647 - RNA, 1617 nt, Artificial Sequence
  derived and/or modified sequence opt6 from VP1__Norovirus_and/or_Norovirus-like__AB933738
augaaaauggcuucaaaugacgcaaacccuucagauggauccaccgcaaaucuaguaccugaaguaaacaaugaaguuauggcucuagaaccuguaguaggagcugcuauagcugcaccggucgcuggccaacaaaaugucauagauccuuggauaagaaacaacuucguucaagcucccgguggugaauuuacaguaucuccaagaaaugccccaggagaaauacuauggagcgcaccccuaggcccagaucucaauccauauuuauuuccacuagcaagaaaaguaaaaggcuacgcugguggauuugaaguccaaguaauuuuagcaggaaaagcauuccccgcaggaaaaauaauauucgcagcuucuccaccuaacuuuccaacugaaggccuaucaccaucccaaguaacaauguuuccucacauaauaguugacguuagacaauuagaaccaguuuuaauaccauuaccagauguacgaaauaauuuuuaucacuacaaucaaaguaaugauuccacaauaaaacuaauagcuaugcuauacacuccauuacgcgcaaacaaugcaggagaagauguauuuacaguuucaugucguguauugacacgaccaucuccugacuucgacuucauauucuuaguaccaccaacuguagaaucacgaaccaaaccauucuccguaccaaucuuaacuguagaagaaaugacaaacucaagauucccaauaccauuagaaaaauuauuuaccggaccaucuucaacauuuguaguacaaccucaaaacggaagaugcaccacagauggaguauuacuuggaacaacucaacuaucacccguuaacauuuguacauuuagaggagacguaacucauauagcaggaucuagaaauuacacaaugaauuuagcaucacaaaacuggaacucuuacgauccaacagaagaaauuccggcuccacuuggaacaccagacuuuguaggcaaaauacaaggcguacucacacaaacaacaaggagagauggaucaacaagaggacauaaagcuaccguauacacaggcagugcagacuucucaccaaaacuagguagaguacaauucgccacagauacagauaacgacuuugauacacaccaaaauacaaaauucacaccaguuggcguaauacaagacggaggcacagcacacagaaaugaaccacaacaauggguccuaccaucauauucaggaagaaauacccauaacguacacuuagccccagcaguagcaccuaccuuuccaggagaacaacuauuauucuuuagaucaaccaugccagguuguucaggauauccaaauauggauuuagacuguuuauuaccccaagaauggguucaauauuuuuaucaagaagcugcuccagcacaaucugacguagcauuacuucguuuuguaaaucccgacacuggacgaguauuauuugaaugcaaacuacauaaaucagguuacguaacuguagcgcacacuggucaacacgaccuaguaauaccaccaaauggcuacuuucgauuugauucauggguaaaucaauuuuacacacucgcaccaaugggaaauggaacuggccgacgacgauaa

SEQ ID NO: 34648 - RNA, 1617 nt, Artificial Sequence
  derived and/or modified sequence opt6 from VP1__Norovirus_and/or_Norovirus-like__EU780734
augaaaauggcuucuaaugaugcaacaccaucagauggcucaacagccaacuuaguuccagaaguuaauaaugaaguaauggcacuagaaccaguuguaggugcagcaauugcugccccaguagcaggacaacaaaaugucaucgacccauggauuagaaauaacuucguacaagccccaggaggugaauuuacaguuucacccagaaaugcuccaggagaaauccuauggucagcaccacuaggcccagauuuaaauccauauuuaagccaccuagcacgaauguauaauggauaugcuggugguuucgaaguacaaguaauacuagcaggcaaugcauuuacagcaggaaaaauaauauucgcagcaguacccccaaauuucccaacagaagguuuauccccaucucaaguaacaauguucccacauauaaucguugaugucagacaacuagaacccguacuaauaccauuaccagaugucaggaauaacuucuaucauuacaaucaaucaaacgauccaacaaucaaauuaaucgcaauguuauacacaccacuaagagcaaacaacgcaggcgaugauguauuuacaguaucaugucgaguuuuaacuagaccauccccagauuuugacuuuauauuucuaguaccucccacaguagaaucacggacaaaaccuuucaguguaccaauauuaacaguagaagaaaugacuaacagcagauucccaauacccuuagaaaaauuauucacuggaccaucaucagcauuuguaguccaaccucaaaauggaagaugcacuacagauggaguauuauuaggaacaacacaacuaucaccuguaaauauauguacauucagaggagacguuacucauauagccggaacacaaaauuauacaaugaaccuagcaucacaaaacuggaacaauuaugauccaacagaagaaauaccagcaccacuaggaacaccagauuucguagguaaaauacaagguguacuuacucaaacaacaagacgagacggcagcacacgaggucauaaagcaacgguaucuacagguucaauacacuuuacccaaucuugggcaguauucaauucaccacuaauucaagcaaugacacuaaaacuugcaaaaacaagagacagcccacaauccgucguaguacaagaugguucaacaacacaucaaaaugaaccacaacaauggguuuuacccgauuauucaggacgagauuccuacaacguacauuuagcuccagcaguagcaccaacauuuccaggagaacaacuauuauucuuucgaucaacaaugcccggaugcucaggcuacccuaacaugaacuuagauugccuacuaccacaagaauggguccaacauuuuuaucaagaaucagccccagcccagagcgacguagcacucuuaagauucguaaauccagacacaggacgaguacuuuuugaaugcaaauuacacaaaucaggauauguaacaguagcacacacaggucaacacgaucuagucauaccaccaaacggauacuuccgauuugauuccugggugaaucaauucuacacacuagcaccaauggguaacggugcuggaagaagaagauaa

SEQ ID NO: 34649 - RNA, 1617 nt, Artificial Sequence
  derived and/or modified sequence opt6 from VP1__Norovirus_and/or_Norovirus-like__KP064096
auggcuucaaaagaugcuccaacuaacauggauggaacaucaggagcaggacaauuaguacccgaagcaaauacugcagaaccaauaucaauggaaccaguagccggagcaguuacagcagccgcaacagcaggacaaguuaacaugauagaucccuggauaaugaauaauuauguacaagcaccccaaggugaauuuacaauaucaccaaauaauacuccaggagacauuuuauuugauuugcaauuaggaccacaucuuaaucccuucuuaucacauuuagcacaaauguauaaugguuggguuggcaauaugaaaguucgaguuuuacuagcagguaacgcauuuacugcaggaaaaauaauuauaucaugcauucccccuggcuuuguagcacaaaauauaucuauugcccaagcaacaauguuuccacauguaauagcagacgugagaguauuagaaccaauagaaguaccguuagaagauguacgcaacgucuuauuucauaacaaugacaacacaccaaccaugagauuaguaugcauucuauauaccccuuuacgagcaagcggaucaucuaguggcacugauccuuuuguaauagcaggacgaguacuaacauguccaucaccagauuuuucauuuuuauuucuaguccccccaaauguagaacaaaaaacaaaaccuuuuucuguacccaaucucccauuaaauacauuaucaaacucccguguaccaucccuuauuaaaucaaugaugguaucucgagaccauggucaaaugguacaauuucaaaauggaagaguuacacuagauggucaauuacaaggaacaacuccuacuucagcuucacaacuauguaaaauaagaggaucuguuuuccacgcaaacgguggcaaugguuauaaucucacagaacuugauggaucucccuaccaugcuuuugaaucccccgcaccaauaggauuuccagaucuaggugaaugugauuggcauauggaagcauccccaacaacucaauuuaauacaggagacguaaucaaacaaauaaacgucaaacaagaaucugcauuugcaccucaucuuggaacaauucaagcagacggacuaucagauguaagugucaauacaaauaugauagcaaaauuaggauggguaucuccuguauccgauggccacaaaagagacguagauccauggguaauaccaagauauggaucaacacuaacugaagcugcacaacuagcaccacccauauauccacccggauuuggcgaagccauaguauucuuuaugucugauuuuccaauagcucacgguacaaacggauuaucaguacccuguacaauaccucaagaauuugucacacacuuuguuaaugaacaagcaccaacucgaggagaagcugcauuacuucacuauuuagauccagacacacauagaaacuuaggagaauuuaaauuauacccagacggauucaugacauguguuccuaauacaagcggaacagguccacaaacacuaccaauaaauggaguauuuguauucguaucauggguuucacgauuuuaucaauuaaaaccaguaggcacugcaggaccagcaagaagauuauaa

SEQ ID NO: 34650 - RNA, 1617 nt, Artificial Sequence
  derived and/or modified sequence opt6 from VP1__Norovirus_and/or_Norovirus-like__KC473548
augaugauggcaucaaaagaugcaccuacaaacauggaugguacuucaggagccggucaauuaguuccagaagcaaauacugcugaaccacuaccuauaaaaccaguagcaggagccgcuacugcaguugcaacagccggacaaguaaauaugauagauccuuggauuaugaauaauuucguacaagcaccucaaggagaauuuacaauauccccuaacaauacaccaggagauauauuauucgaucuacaacuagguccacauuuaaaucccuuuuuagcacauuuaucaagaauguauaacggcuggguaggaaacaugcaaguuagaauaaugcuagcaggaaaugcauucucagccgguaaaauaauaguuugcugcauaccaccagguuuuucaucccaaaguauuucaauagcacaagcaaccauguuuccccaugucauagcagauguacgaguacuugaacccauagacguaccacuagacgauguacgaaauguauuauuucauaacaaugauaauccccaaacuaugcgccuacuuuguaugcuauacacucccuuaagaaguggaggaacaucaucaggaacugacccauuuguaauagcaggacgagucuuaacauguccaacaccagauuuuuccuuccuauuccuaguuccuccugauauagaacaacguacaaaaccuuuuaguguaccaaacaucccaaugaaucuuaugucgaacucacgaguaucaauguuaaucgacggaaugauggucucaaacgaccaaaaucaaguaccacaauuucaaaaugguagagugacacuagauggccaauuacaagguacaacuacaguaucagcagcauguguagcacgaaugcgaggaagaauauuuaacaauaacgguaacuauggaguaaauuuaacagaauuagacggaaauccuuaucaugcuuucgacucaccagcaccacuaggauuuccugauuuuggaaacugugaucuacauaugacuuuuguuaaaauuaauccaaaugaacuaucaucaggagacccaaguggaaaaguaguaauaagaucuuaugacgcaacauucgcaccacaucuaggcacaguaaaauuagaaaaugacgacgaacuagcaagauucguagguaaagaaguuguacucgaacucacauggguaucaaauagagaaggugccaccuuaaaucuaugggccguuccaaauuauggaucaucacuuacucaagcaucacaacuugcaccaccuauauauccaccaggauucggcgaagcuauaguuuauuucacaucuacauucccuacaguaucaaauccaaaaguucccugcacauuaccccaagaauuuguaucacauuuuguaaaugaacaagcaccuacucgaggagacgccgcauuacuacauuacguagauccugacacacauagaaaucuuggagaauuuaaaauguauccagaaggcuacaugacuugugucccaaaugcaggaggcggaccccaaacacuaccuauaaauggaguauuuguauuuauaagcuggguaucaagauauuaucaauuaaaaccaguaggcacagccggagcugcuagaagacuuuaa

SEQ ID NO: 34651 - RNA, 1617 nt, Artificial Sequence
  derived and/or modified sequence opt6 from VP1__Norovirus_and/or_Norovirus-like__AB684698
auggccucaaaagacgcaccaucuaacauggacggcaccucaggagcuggccaauuaguuccagaagcuaauacagcugaaccuauuaacauggaaucaguagucggugcagccacagcaacagcaacagcaggucaaguaaacuuaauagauccauggaucaugaauaauuauguccaagcaccacaaggagaauuuacaauaaguccuaacaauaccccaggagacguccuauucgaucuccaacuaggaccacaccugaaucccuuucuaucacaucuaucaagaauguauaacggauggguaggaaauaugaaaguaagaguuauguuggcaggcaaugcauuuucggcaggaaaaauaauaauaugcugcauaccaccuggauucacaucucaaucuauaucuauugcccaagcaacaauguuuccacauguaauagcagacguacgcguacuagaaccaauagacguaccauuagaugauguaagaaacguauuauuucauaauaacgauaaugcacaaacaaugcgacuauuaugcauguuauauacaccauuaagaacaggagcaagcucaucuggauccgacccauuuguaauagcuggaaggguucuaacauguccuacacaagauuuuaauuucuuauuuuuagucccaccagaugucgaacaaaaaacaaaacccuuuagcguaccaaauauaccauuaaaucuaaugucaaauagcagaguaccagcacuuauugaugguaugacaguuaguucagaccaaaaccaaguaguacaauuucaaaauggaagagucacacuagauggacaacuccaaggaacaacagcaguauccgcaaguugcguagcaaaaauacgagguagaauauuuaguaaugcaucacacuacggaauaaacuuaacagaaguagauggcacacaauaucaugcauucgauucaccagcuccacuuggcuucccagauuuuggaaauugugauuggcacgucacaggaacuaaagcuucacaaggugaucuccaaacugacaacccaacaauaucagguacaauaaaaucuuaugaaucaucauuugcaccacacuuagguacaguacgaauagaaggcgacgacaacgaacuagcacgauuuaacggaaaagacguacuacuaaaucuaacaugguuuucccaacgaaauggcagucaauuaaacuuguggaccauaccaucauauggcagcaaccuaacagaagcaucacaauuagcaccaccaauuuacccaccaggauucggagaagcaaucguuuacuuuacaucaacuuuuccagcuauaucucgaccaucaguaccaugcacaaugccacaagaauuuguaucacauuuuguaaacgaacaagcaccaacaagaggcgaagcugcacuauuacauuaccuagacccagauacacacagaaaucuaggagaauuuaaaauguaccccgaaggcuuuuucacaugcguacccaacgcaggagguucaggaccacaaacacuaccaauaaauggaguuuuuguauuuguaucuuggguaagcagauacuaucaauuaaaaccuguuggaacuguaggcaugacaagacgauuauga

SEQ ID NO: 34652 - RNA, 1617 nt, Artificial Sequence
  derived and/or modified sequence opt6 from VP1__Norovirus_and/or_Norovirus-like__AF538679
augaaaauggcaucaaaagaugcaccaacuaauauggacgguacaucaggagcaggacaauuaguacccggagcaaauacagcugaaccauuaccaauaaaaccaguagcuggugccgcuacagcagucgcuacagccggacaaguaaauaugauagacccauggauuaugaacaauuuuguccaagcaccccaaggcgaauuuacaauaucaccaaauaauacacccggagauauacucuucgacuuacaauuagguccacaucuaaauccauuucuugcacaucuaucacgaauguauaacggauggguagguaacaugcaaguaagaauaauguuagcaggaaaugcauuuucagcaggcaaaauaauaguaugcugcauuccaccugguuucucaagucaaucaauaucaauagcacaagcaacuauguucccucauguuauagcagacgucagaguucuagaacccauagacguaccccuagaugauguaagaaaugucuuauuccauaauaaugacaauccacaaacaaugcguuuauuauguauguuauauacaccacuaagauccggaggagcuucaaguggaacagauccuuuuguaauagccgguagaguauuaacauguccaacaccugacuuuuccuuucuuuucuuaguaccaccagacauugaacaacgaacaaaaccauuuucuguaccaaacauacccaugaaucucaugucaaauuccagaguaccuauguuaauugauggcaugaugguaucaaaugaucaaaaccaaguaccucaauuucaaaauggccgcguaacauuagauggccaacuucaaggaacaacaacaguaagugccgcauguauagcacgaaugcgaggcagaauauucaauaacaauggaaauuaugguguaaaucucgcagaacuagauggaaauccauaccaugcuuucgauucuccagcaccacuuggauuuccugacuuuggaaacugcgaccuccacaugacauucguaaaaauaaauccuacagaauuaucaacaggagacccaucuggaaaaguugucauacauucuuacgaugccacuuuugcuccccacuuagguacuguaaaauuagaagauaacaacgaauuagaccaauucguaggaaaagaaguuguacuagaacuaacauggguuucuaauaggacaggagcuaccuuaaaucuaugggcugucccaaauuauggaucaaaucuaacacaagcaucacaauuagcuccaccaauauaucccccaggauucggagaagcuauagucuauuuuacuucaacauucccaacaguauccaauccaaaagucccauguacauuaccacaagaauuuguaucacauuucguaaaugaacaagccccaacacgaggugaugcagcauuauuacauuauguagauccagauacacauagaaaucuaggcgaauuuaaaauguauccagaaggauacaugacauguguaccaaaugcaggaggaggaccacaaaccuuaccuauaaauggaguauuuguauucauaucuuggguaucaagauauuaucaauuaaaaccaguaggaacagcaggagcagcaagaagauuauaa

SEQ ID NO: 34653 - RNA, 1617 nt, Artificial Sequence
  derived and/or modified sequence opt6 from VP1__Norovirus_and/or_Norovirus-like__JQ743332
augaugauggcaucaaaagaugcuucacaauccgcagauggagccucuggugcaggacagcuaguaccugaaguaaauacagcagacccuuuacccauggaaccuguagcaggaccaacaacagccguugcuaccgcaggacaaguuaacaugaucgauccauggauaguuaacaacuucguucaaucgccacaaggugaauuuacaauuucacccaacaacacuccaggagauauauuauucgaucuccaacuugguccacacuuaaacccauuuuuaucccauuuaucacaaauguacaauggauggguaggaaauaugagaguccgaaucuuacuagcuggaaacgccuucucagcuggaaaaauaauaguaugcugcguaccaccaggauucacaucaucaagucuuaccauugcccaagcuacauuauuuccucauguaauagcagacguaagaacauuagaacccauugaaaugccacucgaagacguuagaaauguauuauaucauacaaacgauaaucagccaacaaugcgccuaguauguaugcuuuacacaccacuaagaacaggaggaggcucaggcaauucugauucauuuguaguagcaggaagaguuuuaacagcaccaucuucagauuuuaguuuucuauucuuaguaccuccaacaaucgaacagaaaacuagagcauuuacuguacccaacauaccucuacaaacauuaucaaauuccagauuuccaucauuaauacaagguaugauauuaucuccugaugcaucccaagucguacaauuucaaaauggccgcuguuuaauagauggucaacuuuuaggaacaacacccgcaacuucaggacaauuauucagaguacgaggaaaaaucaaucaaggagcaagaacauuaaaccuaacagaaguagauggaaaaccauucauggcauuugauucaccagccccaguaggauuuccagauuucggaaaaugcgauuggcacaugagaauaucaaaaacaccaaauaauacuucaucaggagacccaaugcgaucuguaucaguacaaacaaauguacaagguuuuguuccucauuuaggaucaauccaauucgaugaaguauuuaaucauccaacaggcgauuauauaggaacgaucgaauggauaucucaaccaucaacuccaccagguacagauauaaacuuaugggaaauaccagauuacggauccucacuaucccaagccgcaaacuuagcaccaccagucuuuccaccaggauuuggagaagcauuaguauauuucguaucagcuuuuccaggucccaacaauagaucagcaccaaaugauguuccaugccuacuaccccaagaauacauaacacacuucguaucagaacaagcaccaacaaugggagacgcagcuuuacuacauuauguugacccagauacaaaucguaacuuaggagaauuuaaauuauaucccggaggcuauuuaacauguguaccuaacggaguaggagcaggaccacaacaauuaccccuuaauggaguauuccuuuucguuucauggguaucacguuucuaucaauuaaaaccagucggaacagcaaguacagcacgauaa

SEQ ID NO: 34654 - RNA, 1617 nt, Artificial Sequence
  derived and/or modified sequence opt6 from VP1__Norovirus_and/or_Norovirus-like__GQ856470
augaugauggcaucuaaagaugcaccaacaaacauggacggcacaucaggagcaggacaauuaguaccugaagucucaacagcugaacccaucucuauggaaccagucgcaggagcagcuacagcagccgccacagccggacaaguaaacaugauugauccauggauaaugucuaauuauguccaagcaccacaaggugaauuuacaaucucaccaaacaauacaccuggagauauauuauucgacuuacaauuaggaccacauuuaaauccauuuuuaucucaccuagcacaaauguauaauggauggguaggaaauaugaaaguacgaguauuacuugccgguaaugcauuuaccgcugguaaaauaauaauauccugugucccaccaggauucgcagcacaaaauguaucaaucgcacaagcaacaauguuuccacacguuauugcagacguucguguuuuagaacccaucgaaguaccacucgaagacguaagaaauguacuauuucacaauaaugacucaacuccaacaaugagacuuauaugcauguuguacacaccucuacgagcaucaggaucaucaucuggaacugauccauuuguaauugcaggacgaguauuaaccuguccaucaccagauuuuaacuuuuuauuucuuguuccaccaaauguagagcaaaagacuaaaccauucagcguaccagauuuaccuuugaauguauuaucaaacucaagaguaccaucauuaauaaaauccaugaugguuucacaagaccauggacaaaugguucaauuucaaaauggacgagucacacuugauggacaauuacaggguaccacaccaacuuccgcaucacaacuauguaaaauaagaggaacaguuuaucaugcaacuggaggucaaggcuuaaaccuaacagaaaucgacgguaccccauaucacgcauuugaaucacccgcaccaauuggauuuccagacuuaggagaaugugacuggcacauaaaugcauccccagcuaaugcauuuacagacggaaguaucauacauagaauagauguagugcaagauccaacuuucgcaccacaccuaggaacaauacacuauacaaacgcaaacuaugacgcaaacguuagcuuaauuuguucauuagaaugguuaucaccuccaucaggaggugcauuaaaagcaaacccaugggcaauuccuagauauggcucuacacuaacagaagccgcacaauuagcaccaccaauuuauccuccaggauuuggagaagcaauaguauucuuuaugucagauuuuccuaucgcaaauggaucagauggacuaucagucccauguacaauuccacaagaauuugucacacacuucguaaacgaacaagcaccaacuagaggugaagcagcuuuauuacauuauguugauccagauacucaccguaaccuuggagaauuuaaacuauauccugaaggauuuaugacauguguucccaauuccucaggaucaggaccccaaacauuaccuauaaacggaguauucacuuuuauaucuuggguuucaagauuuuaucaacuaaaacccguuggaacaacaggaccaguaagaagauuauaa

SEQ ID NO: 34655 - RNA, 1617 nt, Artificial Sequence
  derived and/or modified sequence opt6 from VP1__Norovirus_and/or_Norovirus-like__JN603244
augaugauggccucaaaagaugcuccaacaaauauggacggaacaucuggagcuggacaauuaguaccagaaguauccacagcagaacccauauccauggaaccagucgcaggcgcagcuacugccgcagcuacagcaggacaaguaaacaugauagaccccuggauaaugucaaauuauguucaagcaccucaaggagaauuuacuaucucuccuaauaauaccccaggagauauccucuuugauuuacaacuaggaccacauuuaaauccauuccucucacauuuagcucaaauguauaacggauggguagggaacaugaaaguaagagucuuacuagcaggaaaugcuuuuacagcaggcaaaauaauuauuucauguguacccccaggauuugcagcacaaaauguaucaauagcucaagcaacaauguucccucauguuauugcagauguaagaguacuugaaccaauagaaguuccauuagaagauguacguaacguauuauuucauaauaacgauaguacuccaacaaugagacuaauauguaugcuauauaccccacuccgagcaucuggauccuccucagggacagacccauucguaauugcaggaagaguuuuaacuuguccuucaccagauuucaauuucuuauuucuagucccaccaaauguagaacagaaaacuaaaccauucucaguaccuaacuuaccauuaaacgucuuaucaaauucuagaguaccuucguuaauaaaaucuaugaugguaucacaagaucauggccaaaugguucaauuucaaaauggacguguuacacuagauggccaauuacaaggaacaacaccaacuucugcaucacaacuuuguaaaauaagaggaacuguauaucaugcaacuggaggacaaggcuuaaaccuaaccgaaauagacggaacaccuuaucaugcauucgaauccccagcaccaauuggauucccagacuuaggagaaugcgauuggcauauaaacgcaucuccugcaaacgcauuuacugacggaucaauaauacauagaauagauguagcacaagauuccacuuuugccccacaucuagguaccauacauuauacuaacgcagacuauaacgcaaauguaggacuaauauguucucuagaaugguuaucaccaccauccggaggagcaccaaaaguaaauccaugggcaaucccaagauauggauccacauuaaccgaagccgcacaacuugcuccaccuauauauccaccaggauucggagaagcaauaguauuuuucaugucagauuuccccauagcaaauggcucagauggucuaucuguaccauguacaauaccacaagaguucguaacacauuuuguuaaugaacaagcaccaaccaggggagaagcagcacuuuuacauuauguagauccagacacucacagaaauuuaggagaauuuaaauuauauccagaaggauuuaugacauguguacccaauucaucaggaucaggaccacagaccuuaccaauaaauggugucuuuaccuucauaucuuggguaucuagauuuuaucaacuaaaaccaguugguacaacaggaccaguaagaagauuauaa

SEQ ID NO: 34656 - RNA, 1617 nt, Artificial Sequence
  derived and/or modified sequence opt6 from VP1__Norovirus_and/or_Norovirus-like__AB078335
augaugauggcuucaaaagacgcaccacaaucagcugauggagcaucaggcgccggacaauuaguaccugaaguaaauacagccgauccauuaccaauggaaccaguagcaggcccaacaacagcaguagcaacugcuggacaaguuaauaugauugacccauggauaguaaacaauuuuguacaaucuccacaaggagaauuuacaauauccccaaauaauacaccaggagacauacuauucgaccuacaacuaggaccacacuuaaauccauuccuaucucaucuuucacaaauguacaauggauggguaggaaacaugagaguacgaauacucuuagcaggaaaugcuuuuucagcaggcaaaaucauaguauguugcguaccgcccggauuuacaucaaguucauuaacaauagcacaagcaacauuauucccacaugucauugcagacguaagaaccuuagaaccaaucgaaaugccacuagaagauguacgaaauguuuuauaucauacuaaugacaaucaaccaacaaugagauuaguuuguauguuauauacaccauuaagaacuggcggaggaucaggaaacucagauuccuucguaguagcuggaagaguauuaacagcacccucaucagauuuuagcuuuuuauuucuuguaccaccaacaaucgaacagaaaacacgagcauuuacuguaccaaauauaccacuacaaacacucucaaauucacguuuuccaucauuaauacaaggaaugauauuaucaccagaugcaucacaaguaguucaauuucaaaauggcagauguuuaauagacggacaacuauuaggaacaacuccagcaacaucaggacaauuauuuagagucagagguaaaaucaaucaaggagcaaggacacucaaucuaacagaaguagacgguaaacccuuuauggcauucgauucuccugcaccaguaggauuuccagauuuuggaaaaugugacuggcacaugagaauuucaaaaacaccaaauaauacaucaucaggagauccaaugcgaagugucucaguacaaacaaauguacaaggcuuugucccucauuuaggaucuauacaauucgacgaaguuuucaaccauccaacaggagauuauauugguacaauagaauggauaucucaacccuccacuccacccgguacagacauuaaucuuugggaaauuccagacuauggaucaagucuaucacaagccgcaaaucucgcaccaccaguauucccacccggauucggugaagcccuagucuauuucguaagugcauucccaggaccaaauaaccgauccgcaccuaaugauguaccaugccucuuaccacaagaauauauaacacauuuugugagugaacaagcuccuaccaugggagaugcugcuuuauuacauuacguagaccccgauaccaacagaaaccuaggagaauuuaaauuauacccuggaggauaccuaacauguguaccuaaugguguaggugcaggaccacaacaacuaccauuaaauggaguauuuuuauuuguauccuggguaucaagauuuuaccaauuaaaaccaguuggaacugcuagcacagccagauaa

SEQ ID NO: 34657 - RNA, 1617 nt, Artificial Sequence
  derived and/or modified sequence opt6 from VP1__Norovirus_and/or_Norovirus-like__GU299761
augaugauggcaucaaaagaugcccccaccaauauggauggaacaucaggagcaggacaauuagucccugaagcaaauacagcagaaccuuuaccaauaaaaccaguugcuggagcugcuacagcuguagcaacagcaggucaaguaaacaugauugacccuuggaucaugaauaacuuuguacaagcaccucaaggagaauuuacaauaucuccuaauaacacuccaggagauauacuauuugaccuacagcuaggaccacacuuaaacccguuucuagcacacuuaucaagaauguacaauggauggguaggaaacaugcaaguaagaauaaugcuugcaggcaacgcauuuucagcaggcaaaauuauaguaugcuguauuccaccugguuucucaucgcaaucaauaucaauugcacaagccacuauguucccucacguaauagcagauguaagaguauuagaaccaauagauguacccuuagaugauguaagaaauguuuuauuucauaauaaugacaacccacaaacaaugagacuacuauguauguuauauacaccuuuacgauccggaggaacaucaucgggaacagauccuuuuguaaucgccgguagaguccucacaugcccaacuccagauuuuaguuucuuauuccuuguaccaccagauauagaacaaagaacuaaaccauuuuccguaccuaauauaccaaugaauuuaaugucaaacucaagaguuucuaugcuaauagauggaaugaugguaucuaaugaccaaaaucaaguuccacaauuccaaaauggacguguaacuuuagauggacaauuacaagguacuacaaccguauccgcagccuguguagcaagaaugcgaggaaggauauuuaauaauaauggaaauuauggagucaauuuaacagaauuagaugggaacccauaucaugcauuugacucaccagcaccuuuaggcuuuccugauuuuggaaauugugacuuacauaugacauucguaaaaauaaauccaaaugaauuaucaucaggagacccaaguggaaaaguagucauacacucauacgaugcuaccuuugcuccacaccuaggcacagucaaauuagaaaaugacgacgaauuagcgcgauucguagguaaagaaguaguauuagaacuaacauggguuaguaacagagaaggcgccaccuuaaauuuaugggcaguaccuaauuaugguagcucucuaacacaagcaucacaacuagcaccaccuauauacccuccaggauucggugaagcaauaguauacuuuacaucaacauuuccaacuguaaguaacccaaaaguaccuugcacauuaccccaagaauuuguaucacauuuuguaaaugaacaagcaccaacaagaggagacgccgcccuuuuacauuauguagauccugauacacacagaaauuuaggagaauuuaaaauguauccagaaggauacaugacaugcguaccaaaugcaggcggaggaccacaaacuuuaccaauuaauggaguauucguauucauauccugggugucaagauauuaccaacuuaaaccaguaggaacagcaggagccgcacgcagauuauaa

SEQ ID NO: 34658 - RNA, 1617 nt, Artificial Sequence
  derived and/or modified sequence opt6 from VP1__Norovirus_and/or_Norovirus-like__AJ277610
augaugauggcuucuaaaggagcuccccaaucagccgacggaucuagcggagccggacaacuuguaccagaaguaaacacugccgaccccuuaccuauggaaccugucgcaggaccuacaacagcaguagcuacagcaggacaaguuaauaugauugauccauggauaguaaauaacuucguacaaucaccacaaggagaauucacaauaaguccaaacaauacaccuggcgauauacuuuuugauuuacaauuagguccucauuuaaauccauuuuuaucgcauuuaucacaaauguauaauggauggguaggaaauaugagaguacgaaucuuacuagcaggaaacgcauuuucugcaggcaaaauaauaguauguuguguccccccaggauuuacaucuucuucauuaacuauagcacaagcaacacuuuucccucacguuaucgcagauguaagaacuuuagaaccaauagaaaugccauuagaagacguaagaaauguauuauaucacaccaaugacucacaaccuaccaugagauuaguauguaugcuauacacuccuuuaagaaccggaggagguucaggcaacuccgauuccuucguaguugccggaagaguacuaaccgccccaucaagugacuuuucuuucuuauucuuaguaccaccaacaauagaacaaaaaacuagagcuuuuacaguaccaaauauaccuuuacaaacacuaucaaacucccgauuuccaucauuaauacaaggcaugauuuuaucaccagaugcaucacaaguaguacaauuucaaaacggccgcugccuaauagauggucaauuauuaggcacaacuccagcaacaagcggacaacuauuucgaguaagagguaaaauaaaucaaggagcuagaacacuaaacuuaacugaaguagacggaaaaccauuuauggcauucgauucacccgcaccaguuggauuccccgacuucggaaaaugugacuggcauaugcgaguaucaaaaacacccaauaacaccuccuccggugauccgaugcgaucuguaucaguacaaacuaauguacaaggauucguaccccaucuuggaucaauucaauuugacgaaguauuuaaucauccaacaggugacuauauaggcacaauugaauggauuucucaaccaucuaccccacuaggaacagacauaaacuuaugggaaauaccagauuacgguucuucacuaucacaagcugcaaaccuagcaccaccaguuuucccuccaggauucggagaagcucuaguuuauuuuguaucugcauucccaggucccaauaauagaucagccccaaacgauguuccaugccuuuuaccacaagaauauauaacacauuuuguaucugaacaagcaccaaccaugggagaugcggcauuacuccauuacguagauccagacaccaaucgaaauuuaggagaauucaaauuauauccaggcggauaccuuacauguguaccaaacggaguaggagcuggaccacaacaacuaccacuaaacggagucuuccuauuuguaucuuggguuucuagauuuuaucaauuaaaaccaguagguacugcauccacagcaagauaa

SEQ ID NO: 34659 - RNA, 1617 nt, Artificial Sequence
  derived and/or modified sequence opt6 from VP1__Norovirus_and/or_Norovirus-like__GQ856462
augaugauggcaucaaaagaugccccaacaaacauggacggaacaagcggagcaggacaauuaguuccugaagcuaauacagcagaaccacuaccaauaaaacccguagcaggagcugcaacagcaguagcaaccgcaggccaaguuaacaugauagauccauggauaaugaauaauuucguacaagcaccacaaggugaauuuacuauaucaccaaacaauacaccaggagauauacuauucgaucuacaauuaggaccucauuuaaauccauuccuagcucaucuuucaagaauguacaauggauggguugguaauaugcaaguaagaauaaugcuagcaggaaaugcauucucagcagguaaaauaaucguuuguuguauaccaccaggauucucaucacaaagcauaucaauagcacaagcuacuauguucccacauguaauagcagauguaagaguacuagaaccaauagauguuccauuagacgauguaagaaacguuuuauuccauaacaaugauaauccacaaacaaugagauuauuauguauguuauacaccccuuuaagaucaggagggacaucuucaggaaccgacccauucguaauagcaggaagaguauuaacaugcccaacaccugacuucucuuuucuauucuuaguuccacccgauauagaacaaagaacaaaaccuuuuucaguuccuaauauaccuaugaaccuaaugucaaauucaagaguaucuauguuaauagacggaaugaugguaucuaacgaucaaaaccaaguaccccaauuccaaaacggaagaguuacacuagacggacaauuacaagauaccacaaccguaucugcagcuuguguagcuagaaugcgaggaagaauauuuaacaacaauggaaauuaugguguuaacuuaacagaauuagacgguaauccauaccaugcguucgauaguccagcaccucuaggauuucccgauuuugguaacugugaucuucacaugacuuuuguaaaaauuaauccaaaugaacuaucuucaggagaccccucagguaaaguaguaauacauagcuacgaugcaacuuuugccccacaucuaggaacaguaaaauuagaaaacgacgaugaacuagcuagauucguaggaaaagaaguaguauuagaauuaacauggguuucaaauagagaaggagccacucuaaaucuaugggcuguaccaaauuauggcucaucacuaacacaagcaucacaauuagccccuccaauauacccaccaggauucggagaagcaauaguauauuucacaucaacauuuccuacagucucaaauccaaaaguaccauguacauuaccacaagaauuuguuucacacuuuguaaaugaacaagcaccaacacgaggcgaugcagcuuuauuacacuauguagauccagauacccauagaaaucuuggagaauuuaaaauguacccagaaggauacaugacauguguaccaaacgcaggagguggcccacagacacuacccauaaauggugucuucguuuuuauuucauggguauccagauauuaccaacuaaaaccaguagguacagccggagccgcuagaagacuauaa

SEQ ID NO: 34660 - RNA, 1617 nt, Artificial Sequence
  derived and/or modified sequence opt6 from VP1__Norovirus_and/or_Norovirus-like__AF435807
augaaaauggcauccaaagaugcuccucaaucagcugacggagcuucuggugcaggccaauuaguacccgaaguaaauaccgcagauccauuacccauggaaccaguagcaggaccaacaacagcuguagcaacagcaggccaaguaaacaugacagauccauggauaguaaacaacuucguucaaucaccacaaggagaauuuacaauuucaccaaacaauacacccggagacauacuauucgaucuacaauuaggaccacauuuaaauccauuuuuaucacaucucucacaaauguauaauggauggguugguaacaugagaguaaggauacuuuuagcaggaaaugcauuuucagcaggaaaaauaauaguauguugugucccuccuggauuuaccucuuccucacuaacaauagcacaagcuacacuuuuuccacacgucauugcagauguuagaacauuagaaccaauugaaaugccucuagaagauguaagaaauguauuauaucacacuaaugacaaucaaccuacaaugcgauuaguuuguauguuauacacaccauuacgaacuggcggaggcucaggagauagcgauucauuuguaguagcugguaaaguacucaccgcaccauccuccgacuuuucauuccuauuccuaguaccuccaacuauagaacaaaaaacaagagcauucacuguacccaauauaccauuacaaacauuaucaaauucucgauuuccaucacuaauacaaggaaugauacuauccccagacgcuucucaaguaguacaauuucaaaacggaagaugucuaauagacggacaacuauuaggaacaacuccagcaacauccggacaacuauuuagaguuagaggaaaaauaaaccaaggagcaagaacuuuaaaucuuaccgaaguagacgguaaaccuuuuauggccuuugauucacccgcacccguuggauuuccagacuucggaaaaugugauuggcacaugagaauaucaaaaacaccaaacaauacaucauccggugauccaaugagauccguaucaguacaaacaaacguacaaggcuucgucccacaucuaggauccauacaauucgaugaaguauuuaaccaucccacaggagacuacauuggaacuauagaauggauaucacaaccaucaacaccaccagguacagacauaaauuuaugggaaauaccagauuacgguucuucacuaucacaagcagcaaaucuugcaccaccgguuuuuccaccaggauuuggugaagcccuagucuauuucguuagcgcauuuccaggucccaacaauagauccgccccuaaugauguaccaugcuuacucccacaagaauauauaacacauuucguaucagaacaagcaccuacaaugggagacgcugcauuacuacacuacguugauccagacacaaaccgaaaccuuggagaauuuaaauuauacccugguggcuauuuaacauguguaccuaauggaguaggcgcaggaccucaacaacuaccacuuaacggaguuuuucuauuuguaaguuggguaucuagguuuuaccaacucaaaccuguagguacagcaucaacagcccgauaa

SEQ ID NO: 34661 - RNA, 1617 nt, Artificial Sequence
  derived and/or modified sequence opt6 from VP1__Norovirus_and/or_Norovirus-like__KX396056
augaugauggccucaaaagaugcaccuaccaauauggaugguacaucuggcgccggacaacuaguaccugaagcuuccacugcugaaccaauaucaauggaaccaguagcaggagcugcaacagccgcagccacagcaggacaaguuaauaugauagacccauggauaauguccaauuauguucaagcaccacaaggagaauuuaccauaucuccaaauaauacaccaggagauauacuauuugauuuacaacucggaccccauuuaaacccauuuuuaucccaccuagcacaaauguacaacggcuggguuggaaauaugaaaguccgcguccuauuagccggaaaugcuuucacagcaggaaaaaucauaauaaguuguguaccaccugguuuugccgcccaaaauguaucaauagcacaagcuacaauguuuccacauguaauagcugauguacgaguucucgaaccaauugaaguuccuuuagaagauguacguaauguauuauuccacaacaaugacuccacaccaacaaugagacuaauuugcauguuauauacaccauuaagagcaucaggaaguuccucaggaacagaucccuuuguaauugcuggaagaguacuaacaugucccucuccagauuuuaacuuccuuuucuuaguaccaccaaacguugaacaaaaaacuaaaccauucucaguaccaaaucuuccacuaaacguacuauccaacucaagaguuccaucauuaauucgcucaaugaugguuucucaagaucacggacaaaugguacaauuccaaaacggacgaguaacauuagauggucaauuacaaggaacaacaccaacaucagcuucacaacucuguaaaauacgaggaacuguauaucaugcaacaggaggacaaggacuuaaucuaacagaaauagauggaacaccuuaccaugcacuugaaucuccugcaccuauaggauucccagaucuaggagaaugugauuggcauauaaaugcaucaccagcaaaugcauuuaccgauggaucaauaauacauaggauagauguagcacaagacucuaccuuugcaccucaucucggaaccauacacuacacuaacgcuaauuaugaugcuaauauaucacucauauguucuuuagaauggcuaucaccaccaucugguggugcaccaaaaguaaauccuugggcaauaccaagauacggcucuacccuaacugaagcagcacaauuagcacccccuauuuauccaccuggcuuuggugaagcaaucguauuuuuuauguccgacuuuccaauagccaacgguucagauggacuaucaguuccaugcacaauaccacaagaauucguaacacauuucguaaaugaacaagccccaaccagaggagaagcugcauuauuacauuacguagaccccgauacucaccgaaauuuaggcgaauucaaacuauauccagaaggcuucaugacauguguaccuaacucauccggaucaggaccacaaacucuaccuauaaaugguguauucaccuucauaucauggguaucaagauucuaucaacuaaaacccgucgguacuacuggaccaguaagaagacuauaa

SEQ ID NO: 34662 - RNA, 1617 nt, Artificial Sequence
  derived and/or modified sequence opt6 from VP1__Norovirus_and/or_Norovirus-like__AB187514
augaugauggcuuccaaagaugcuccaacaaauauggauggaacaucaggagcuggacaacuagucccagaagcauccacagcagaaccaauuucaauggaaccugucgcaggagcagcaacagcagcagcaacagcaggucaaguaaauaugauagauccauggauaaugucuaauuacguacaagcaccucaaggagaauuuacaauauccccaaacaauacuccaggagacauauuauuugauuuacaacuaggaccacaccuuaauccauuccuaucacacuuagcacaaauguauaauggauggguaggaaacaugaaaguccguguauuacuagcagguaaugcauucacagcaggaaaaauuaucauaucaugcgucccaccaggauucgcugcucaaaacgucuccauagcacaagccacuauguuuccucauguaauagcagacguaagaguucuagaaccaauagaaguuccucuugaagaugucagaaacguacuuuuccauaauaaugauucuacuccaacaaugagacucauauguaugcuauacacucccuuacgagcuuccggaucaucuagugggacagauccauucguuauagcuggcagaguacuaacuuguccauccccugauuuuaauuuucuauuucuagucccaccaaacgucgaacaaaaaacuaaaccuuucucagucccaaacuuaccccuaaauguucuuucaaauucacguguaccaucacuaaucaaaucaaugaugguuucacaagaccauggacaaaugguacauuuucaaauugguagaguuacacuagacggacaauuacaaggaaccaccccaacaucagcaucacaacuaugcaaaauacgcggaacaguauaucacgcaaccggaggacaaggacuaaaccucacagaaauagauggcaccccuuaccacgcuuuugaaucuccagcaccuauaggauucccagaucuaggagaaugugauuggcauauaaacgcaucuccagcaaaugccuucacagacggcucaauuauucauagaauugauguugcccaagauucaacauuugcaccccaccuaggaacaauacacuauacuaaugcuaauuaugaugccaauguuucacuaauauguucucuagaaugguuaucaccuccaucuggaggagcaccaaaaguaaauccaugggcaauuccccgauacggaucaacauuaacugaagcagcacaauuagcaccaccaauauauccaccugguuucggagaagcaauuguauuuuuuaugucagacuucccuauagcaaacggaucagacggucuauccguaccauguacaauaccccaagaauuugucacacauuuuguaaaugaacaagcaccuacuagaggcgaagcugcucuauuacauuaugucgacccggacacacaccgcaaccuaggugaauuuaaauuauacccagaaggauuuaugacuuguguacccaauuccucaggauccggcccacaaacuuuaccuaucaauggaguauucacauuuauuucauggguaucacgauuuuaucaacuaaaaccuguuggaaccacuggccccguuagacgauuauaa

SEQ ID NO: 34663 - RNA, 1617 nt, Artificial Sequence
  derived and/or modified sequence opt6 from VP1__Norovirus_and/or_Norovirus-like__L07418
augaugauggcaucuaaagacgcuccucaauccgcugauggugcauccggcgcuggacaauuaguuccagaaguaaacacagcagacccccuuccuauggaaccaguugcaggcccaacuacagcaguagcaaccgcaggacaaguaaauaugauugauccuuggauaguuaauaacuucguacaaucuccucaaggcgaauuuacaauauccccaaauaauacaccgggagacauacuauuugaucuacaauuagguccucacuuaaaucccuuuuuaucacauuuaucacaaauguauaacggauggguaggaaacaugcguguucgaauacuauuagcuggaaaugcauucucagcagguaaaauuauaguauguugcguaccaccaggauucacuaguaguucucuaacaauagcacaagcaacauuauuuccacauguaauagcagauguacgaacucuagaaccaauagaaaugccucuagaagacguacgaaauguacuauaucauacaaaugauaaucaaccaacuaugcgacuaguuugcaugcuuuauacaccauuaagaacaggaggaggaucaggaaauucagauuccuucguaguagcaggaagaguucuuacagcuccaucaagcgacuucucauuuuuauuucuuguaccaccaaccauagaacaaaaaacaagagcauuuacaguaccaaauauaccauuacaaacacucucaaauucacguuuuccaucauuaauacaaggaaugauacuuucaccugaugcuucacaaguuguacaauuucaaaacggccgaugucucaucgauggacaauuacuagguacaacaccagcaacaagcggacaauuauucagaguacgaggaaaaauaaaucaaggugcaagaacacuaaauuuaacagaaguagaugguaaaccauuuauggcuuuugauaguccugcaccaguaggauuuccagauuuuggaaaaugugacuggcauaugcgaauaagcaaaacaccaaauaauacaggaucaggcgacccaaugcgaagcguaucuguccaaacaaauguacaaggauucguaccacauuuaggaucuauacaauuugaugaaguauuuaaucacccaacaggugacuauauaggaacuauagaauggauaagucaacccuccacaccaccuggaacagauauaaaucuuugggaaaucccagauuauggaucaucccuaucucaagcagcuaaucuugcaccuccaguuuuuccaccaggauucggugaagcauuaguauauuuuguaucugcuuucccaggaccuaauaacagauccgccccaaaugacguaccuugccuauuaccacaagaauacauaacacauuucguaucugaacaagcuccaacaaugggagaugcagcacuacuacacuacgucgauccagauacaaaccgaaaucuuggagaauuuaaacuauacccaggcggguauuuaaccuguguaccaaauggcguaggcgcuggaccccaacaauuacccuuaaacggaguauuuuuauuuguaucauggguuucgagauuuuaccaauuaaaaccuguaggaacagcuucaacugcaagauaa

SEQ ID NO: 34664 - RNA, 1617 nt, Artificial Sequence
  derived and/or modified sequence opt6 from VP1__Norovirus_and/or_Norovirus-like__FJ515294
augaugauggcuucuaaagaugcaccacaaagcgcagauggcgcaagcggagcuggucaauuaguuccagaaguaaauacagcugacccacuaccaauggaaccuguagcugguccaaccacggcaguagcuacagcuggucaaguaaacaugauagaucccuggaucguaaauaauuuuguacaaaguccucaaggagaguucacaauuucaccaaauaauacuccuggagauauauuauuugaucugcaauuaggaccacauuuaaaucccuuucuaucucaucuaucgcaaauguauaacggauggguuggaaauaugagaguaagaauacuacuagcugguaaugcauucagugcaggaaaaauaaucgucuguugcguuccuccaggauucacuucaucaucauuaacaauagcacaagccacauuauuuccacauguaauugcugauguaaggaccuuagaaccaauugaaaugccacuugaagauguaagaaauguucuauaucacacaaaugauaaccaaccaacaaugagauuaguaugcauguuauauacuccucuaagaacugguggcggaucaggaaauucagacucauuuguaguagcaggaagaguauuaaccgcacccucuagugauuuuucauuuuuauuuuuaguuccaccaaccauagaacagaaaacaagagcauuuacaguaccaaacauaccauuacaaacacuaucaaacucaagauucccaucauuaauacaaggaaugauuuuaucaccagacgcaucacaaguaguacaauuucaaaacggaagaugcuuaauagacggacaauuacuaggaaccacacccgccacaucaggacaauuauuucgaguaagaggaaaaauaaaccaaggugcaagaacacuuaauuuaacagaaguagauggaaaaccauuuauggcauucgauucuccagcaccaguaggauuuccugauuuuggaaagugugacuggcauaugagaauaucaaaaaccccaaauaauacuucuucaggagauccuaugcgaagcgucgauguacaaacagauguccaaggguuuguuccacaucuaggaucaauucaauuugaugaaguauuuaaucauccaacuggagauuauauaggaaccauagaauggauaagucaaccuucuacuccaccugguacagauauaaauuuaugggaaauaccugauuacggaucaucuuuaucucaagccgcgaauuuagcucccccaguauucccuccaggauuuggagaagccuuaguuuacuucguaucagcauucccaggaccaaacaauagauccgcuccaaaugauguuccauguuuauuaccacaagaauauguuacucauuuuguaucagaacaagcaccaacaaugggagacgcagcauuacuacauuauguagacccagacaccaaccguaaucuaggugaauuuaaacuauauccaggaggauaucucacauguguaccuaaugguguaggcgcagggccacaacaacuaccucucaauggaguuuuucuauucguaucuuggguaucucgauucuaucaacuaaaaccaguaggaacugcuucaacugcaagauaa

SEQ ID NO: 34665 - RNA, 1617 nt, Artificial Sequence
  derived and/or modified sequence opt6 from VP1__Norovirus_and/or_Norovirus-like__KJ790198
augcgaauggcaucugaugaugcaaaaucagcaccaucagauuuagaaggagcaggacuugucccagccacagcagcacccuuaccaguagcuccuguagcaggagcacaagcagcagaaccauucgccggacaaauaaauguaauugacccuuggauauacacaaauuucguacaagcacccacaggagaauuuacuguuaguccaagaaauacuccaggugaaguuuuaguuaauuuagaaaucggaccuaacuuaaauccuuaucuacagcauuuagcacaaauguacaaugguuaugccggaggaguagaaguucaaguaauauuagcaggaaaugcauucacagccggcaaacuacuaugcgcccuaguaccaccaggauucccaacaaguaguauaacaccagcacaauuaacaauguuaccacauacuauaauagacguuagaacaacagacccuguuguaguucccaugccagacguuagaagaacacuuuggcaugaagucagaucaacuacagagcccuuaaugagauuaguuauaaugcuauacacacccaugcgagcaaacaguggaucagacgaagcauuuguaguaucaggaagaguuuuauccagaccagcaccugauuuuaauuucuuuuauuuaguaccaccaagaguagaagauacaguagaaccauuuucuuuaccugaucuacgaguagacgaaaugucaucauccagauggcaaaacccaguaguaauguuacaagcagauccuaaucaaaauauugcagcccacuggcaaaacggaagauguacuauaaauggagaauuacuaggaacaacaccaaggaaccaaucaugguuacuaagaaugagaggaucaguauuagcagcaccaggaggacaaaaagcaguaacaguuaauguagauuuaacagaacccgacggucaagcauuuucaguguuaaguggaaauccaggcccagaaggagucccagacuuucaagcaauuuauaacguacguaugucaacagccucaaccacugcaggacacacaguagcgacgaauggauauauugaacaaucaggauauacuccagcauuaggaacgcuaguuauucaaggaguagaucucucacaaguuccugcccucggaucugaaguaacuaugcaaguugucucuauugaccuaaaucauaauauggauccaacccguuuaccagacuauaauggagccggauuugaugguuccgucgcacuugccccacccuuaguaccaccauuaccaggugaaguacucuuaagauucacaacauuaccaauaacaaccucuagaggaagcucaguaucagcaacauuagauugugcauuaccagcagaauggauaacaugguuucuaguacacaauuucguaccacaaggagacgcagcacuucuaagauauagaaaccgaggcacuggacaaauucucuuugaauguaaauuauauaaagaaggcuuucuagccgucgcaggaguaucuacuagaacaguauucccuacaucagguguauucgaguuugucuccuggguaccagucuuuuaucaacuaacaccaguuggaucaucaggagcacgaaaaagauaa

SEQ ID NO: 34666 - RNA, 1617 nt, Artificial Sequence
  derived and/or modified sequence opt6 from VP1__Norovirus_and/or_Norovirus-like__KF306212
augaugauggcaucaaaagaugcaccucaaucugcagauggagcaucuggagcuggacaacuugucccagagguaaauacggcagauccacuaccuauggaaccagucgcuggaccaacuacagcaguagccacagcaggccaaguaaauaugauagacccauggaucguaaauaauuucguacaaucaccacaaggcgaauuuacgaucaguccaaacaauacuccaggugacauauuauuugaucuucaauuaggaccccauuuaaacccauuucuaucucauuuaucacaaauguauaauggcuggguagguaauaugcgaguaagaauauuacuagcaggaaaugcauuuucagcuggaaaaauuauuguauguuuugucccaccaggcuucacauccaguucucuuacaauugcucaagcaacuuuauuuccacauguuaucgcagacguaagaacccuagaacccauagaaaugccauuagaagacguaagaaauguauuauaucacacuaacgauaaucaaccaacaaugcguuuaguaugcauguuauauacaccauuaagaacagguggagguuccgguucauccgauucauuuguaguagcuggcagaguacuaacagcaccaucuucugauuuuucauuuuuauuucuuguaccuccaacaaucgaacagaaaacccgcgcauucacaguccccaauauacccuuacaaacauuaucuaauuccagauuuccaucacuuauacaagguaugauauuaucacccgacgcaucacaaguuguucaauuucagaacggcagauguuuaauagacggacaauuacuaggaacuacucccgccacaucaggccaauuauucagaguacguggaaaaauuaaccaaggagcaagaacauuaaaucuuacagaagucgauggaaaaccauuuauggcauuugacucaccagccccaguagguuuucccgauuucgguaagugugauuggcauaugagaauauccaaaacaccaaauaauacaucuaguggcgacccaaugagaagcguaucaguacaaacaaauguacaaggauuuguaccucaccuaggaucaauacaauucgaugaaguuuuuaaucacccuacaggagacuauauuggaaccauugaauggauaucacaaccaucaacaccaccugguacagacauaaauuuaugggaaauaccugacuacggcucaucacucucucaagcagcgaauuuagcaccacccguuuuucccccaggauucggugaagcccuaguauauuuuguuucugcauucccaggacccaauaaucgaucugcaccaaaugaugucccuugucuauuaccacaagaauacauaacacauuuuguaucagaacaagcaccaacuaugggagacgcugcauuauuacacuauguagauccagauaccaauagaaacuuaggagaauuuaaauuauauccaggaggauaucuuacauguguaccuaacggcgucggagcuggaccacaacaauuaccauuaaaugguguuuuucuauucguaucaugggugucccgauuuuaucaauuaaaacccguuggaacugcuucaacagcaagauaa

SEQ ID NO: 34667 - RNA, 1617 nt, Artificial Sequence
  derived and/or modified sequence opt6 from VP1__Norovirus_and/or_Norovirus-like__KM461694
augaaaauggccuccaaugacgcagcacccucaaacgacggcgcagcuaacuuaguuccagaagcaaacaaugaaguaauggcucuagaacccguugucggagccucuauagcugcaccaguaguaggccaacaaaauauaauagacccauggauuagagaaaauuuuguacaagcuccacaaggcgaauuuacaguuucaccacgaaacucaccaggagaaauguuauuaaaucuugaacuaggcccagaauuaaauccauaucuaucacacuuaucacgcauguacaacggauaugcaggagguaugcaaguacaaguagucuuagcaggaaaugcuuuuacagcaggaaaaauaauauucgcugcuguacccccucauuuucccguagauaauauaucugcagcacaaauaaccauguguccacauguaauaguagauguaagacaacuagaacccguacuuuuaccacuacccgauauucgcaaccguuucuuucauuacaaucaagaagauacaccuagaaugcgucuagucgcuaugcuauacacaccacuaagagccaauucaggagaagauguauuuacaguaucaugccgcguacugacccgacccgcaccagauuucgaauuuacuuucuuaguaccuccaaccgucgaaucaaaaacaaaaccauucacauuacccauccuuacauuaggagaauuaucaaauagccgauucccagcagcuaucgacaugcuauacacugaucccaacgaaagcauaguuguacaaccacaaaauggacgcugcacccuagacggaacccuccaaggaaccacacaauuaguaccaacacaaauaugcgcauucagaggaacacuaauuucacaaaacgcucgagcagcagaccuuacugacucaccucaacgagcaagaaaccacccacuacacguacaaguuaaaaaccuagacggaacucaauacgacccaacagaugauauaccugcaguacuuggagcaauagacuuuaaaggaacaguauucgggguagcaucccaaagagacgucucuggaacacaagaacaaggacauuaugcaacaagagcccacgaagcacauauagauacaacugauccaaaauaugcaccuaaacuaggaacaauauuaauaaaaucagaaucaacagacuucacaacuaaucaaccaauaagauuuacaccaguagguaugggugacaauaacuggcgacaaugggaauuaccugacuauuccgguucacuaacccuuaauaugaaccuagccccagcaguaaguccaucauuccccggagaacguauacuauucuuuagaucuaucguucccuccgccggaggauaugguucaggauacauagacugccuaauaccacaagaauggguacaacacuucuaccaagaagcagcaccaucucaaucugcaguagcauuaguuagauacguaaacccagacacuggacguaauauauucgaagcaaaacuacauagagaaggauuccuaacagucgcaaauucugguaauaauccaauaguagucccucccaauggcuauuucagauuugaagccuggguaaaccaauuuuacacauuagcauaa

SEQ ID NO: 34668 - RNA, 1614 nt, Artificial Sequence
  derived and/or modified sequence opt6 from VP1__Norovirus_and/or_Norovirus-like__AB039780
augaaaauggcuucaaacgaugcagcuccuucaaacgacggagcagcaggacucguaccagaaauuaaucaugaaguaauggcuauagaaccuguugcaggagcaucacucgcagcaccuguuguuggccaacuaaauauaauagacccuuggauaagaaauaauuucguacaagcgccagcaggagaauuuacaguuucuccuagaaaugcaccaggagaauuucucuuagaucucgaauuaggcccagaacuaaauccauaccucgcacauuuagcacgaauguauaacggacacgcuggcggaauggaaguccaaauaguuuuagcagguaaugcauucacagcuggcaaaauacuauuugcaguaauaccaccagguuucccauaugaaaauuuaucuccagcccaacuuacaaugugcccacacguagucguagacguccgacaauuagaaccaauauuacuaccaaugccagauauaagaaauacauucuuucacuacaaucaaucaaauggacccaaauuaagacuuguugcuaugcuauacacuccauuaagagcaaauaaugccggcgaagauguauuuacaguuucuugcagaguuuuaacaagacccucaccagauuuugaguucaacuuccuuguacccccaucagucgaaucgaaaacaaaagcauucacauuaccuauauuaaaaauuucugaaaugacaaacucaagauucccuauaccugucgaccaaauguacaccucaagaaaugaaaacauaguaguacaaccucaaaacggcagaguuacacuagacggugaauuacaaggaacaacaacacuucaacccguuaguauaugcggauuucguggaacccuucaaacaagacuagcagaucaaccaaauuauacauaucaaguacaccuagaaaaucuagacggaucaccagucgauccaacagaugaagucccagccccacuaggaacaccagauuuccaagcacaauuauuuggaguaauuucacaaagaucuuccgacaacgcaacacgagcacacgaagcaagaguaaauaccaacgaccccacauucgcaccacaaaucgcacaaguacgauucaaaucuccauccaaugacuucuuugauaaugaaccaauaaaauuuaccccaguaggaauaucuguagauucacaaaacuccuauaaucaaugguuacuaccacgcuacggaggccauuuaaccaauaauacacaucuugcaccaagcgucagcccgauguuuccaggcgaacaaauuuuauuuuucagaucauucaugccaggagcaucuggacacacagauggcgcuauagauugucuauuaccccaagaauggguagcucacuuuuaccaagaagcagcaacagcacaaacugauguagcauuaauucgauuuguaaauccugauacaggcagagucuuauuugaagguaaauuacacaaacaaggauucauaacaauuucaaauuccggagaccaucccauaguaaugccagcaaacggauacuuuagauuugaagccuggguuaaccaauucuauucauuagcaccagucggcacagguucaggcagaagaagaauacaauaa

SEQ ID NO: 34669 - RNA, 1614 nt, Artificial Sequence
  derived and/or modified sequence opt6 from VP1__Norovirus_and/or_Norovirus-like__AY038599
augaaaauggcaucaaaugaugcugcaccuucaucugauggagcugcaggcgucguccccgaaauaaaucaugaaguaauggcaauagaaccaguagcuggagccuccaucgcagcucccguaguaggucaacaaaacaucauagauccauggauaagaaauaauuuuguacaagccccagcuggugaauuuacaguaucccccagaaaugcaccuggagaauuuuuauuagauuuagaacucggaccagaccuaaacccauacuuagcacauuuagcuagaauguacaauggucaugccggaggaauggaaguacaaauaguacuagccggaaaugcuuucaccgcaggaaaaauuuuauuugcaguaauuccuccaggauuucccuaugaaaauuuauguccugcacaacuaacaaugugcccacauguuguugucgacguaagacaauuagaaccuguaauguuaccaaugcccgauauccgaaauacauuuuuccauuauaaccaagacggaggcccaaaauuacgauuaauagccauguuauauacaccacuacgagccaauaacucaggagaugauguauuuacaguuucaugucgaguauuaacacguccagcacccgauuucgaauuuacauuuuuaguacccccauccauugaaucaaaaacaaaagcauucacaauacccgucuuaaaaauaagugaaaugacaaauucaagauucccaguaccuguagaucaaauguauacaucaagaucagaagguauagucguacaaccacaaaauggucgugcaacaauagauggcgaauuacuaggaacaaccuuaguuaguccaguaucaguaugcaacuuuaaagguaacuuacaagcagaaguaccaggacaacaucaauuauaccaauuacaauuaaccaauuuagacgguucaccaauugauccuaccgaugacacaccagguccacuagguugcccagacuuuacuggauuacuuuacggaguugcaucccaaagaggaccaggagaugcaacucgcgcacaugaagcuagaauugacaccggcucagacacauuugcaccaaaaauaggucaaguuagauucuauaguacaucaucugacuuugaaacaaaccaaccuacccauuucacaccaauaggaauuuauauagaagguaauucaucagauuuuaaucaauggcaacuuccacgauacggaggucaucucgcaaauaacaaucaccuagcaccagcaguaaguccacuauuucccggugaacaaauacuauucuuuagaucauuuauaccaggagcauccggucacacuaauggugaaauggauugcuugcuaccacaagaauuuguucaacauuuuuaccaagaagcagccacagcacgaucugaaguagcacuauuaagauuuguuaauccugacaccgguagagcacuuuuugaaucaaaacuacauaaacaagguuuuaugacaauagcaucaucaggagaccauccaauaauaaugccaacaaacgguuauuucagauuugaagcauggguaaaucaauuuuacucacuagccccaguaggaacaggaucaggaagaagaagaauacaauaa

SEQ ID NO: 34670 - RNA, 1614 nt, Artificial Sequence
  derived and/or modified sequence opt6 from VP1__Norovirus_and/or_Norovirus-like__AY054299
augaaaauggcaagcaaugaugcagcuccaucaucagacggagcagcaggucuaguaccugaaauuaaucaugaaguaauggcaauagaaccaguagcaggagccucaauagcagcaccaguaguaggacaacaaaauauaauugauccuuggauaagaaauaauuuuguacaagcaccagccggagaauuuacagucucaccccgaaacgcaccaggagaauuuuuauuagaucuugaacucggaccagaucuuaaucccuacuuagcccaucuagcaagaauguacaauggccaugcaggaggaauggaaguacaaauaguccuagcaggaaaugcuuuuacagcugguaaaauacuauucgcaguaauuccuccagguuucccauaugaaaacuuaucaccagcacaauuaacuauguguccacauguuguugucgacguuagacaacuagaaccagucaugcucccaaugccagacauuagaaauacauucuuucacuauaaccaagauggaggaccucgacuucgauuaauagcaauguuauacaccccauuaagagcaaacaauucuggugaugacguauuuaccguaucauguagaguucuuacaagaccugcaccugauuuugaauuuacauucuuaguaccaccaucaauagaaaguaaaacaaaggcauucacaaucccaguccucaaaauaucugaaaugacaaauucaagauucccaguaccaguagaucaaauguacacaucacguucagaaggaauaguaguacaaccacaaaaugguagagcuaccauagacggagaacuuuuaggaacaacacucguauccccaguuucaguauguaauuuuaaaggaaacuuacaagcagaaguuccaggagaacaucaauuauaccaauuacaacuuacuaauuuagauggauccccuauagauccaacugacgauacuccaggaccauuaggaugcccugauuuuacaggauuacuauacggagucgcaucucaaagaggccccggagacgcaacaagagcccaugaagcuagaauagacacaggaucugauaccuaugcaccuaaaauaggucaaguuagauuuuacaguaccagcucaaauuucgaaagaaaucaaccuacucacuuuacacccaucgguauauacauagaaggaaacucaucugauuuuaaccaauggcaacucccacgauaugguggacacuuagcaaacaacaaucauuuagcacccgcuguaagcccucuauucccuggugaacaaauuuuauucuucagaucauuuauuccaggagcuuccggacacacaaauggagaaauggacugcuuauuaccacaagaauuuguacaacauuuuuaucaagaagcagccacagcccaaucagaaguagcauuacuaagauucguaaauccagacacuggacguguccuauuugaaucuaaacuucauaaacaaggauuuaugacaauugcaucaucuggagaucauccaaucauaaugcccacuaaugguuauuucagauucgaagccugggucaaucaauuuuauucauuagcaccaguaggaacaggcuccggacgccgaagaauacaauaa

SEQ ID NO: 34671 - RNA, 1614 nt, Artificial Sequence
  derived and/or modified sequence opt6 from VP1__Norovirus_and/or_Norovirus-like__AF195848
augaaaauggcuucuaacgaugcagcccccucaaacgauggugcagcaggauuagucccagaaauaaaccaugaaguaauggccaucgaaccagucgcaggcgcaucuuuagcagcacccguaguaggucaacuaaauauaauagauccauggauucgaaauaauuucguucaagccccagcuggagaauuuacagucucuccccgcaaugcacccggagaauuucuucucgaucuagaacucggaccagaauuaaauccauaccuagcacacuuagcacgaauguauaacggacaugcaggaggaauggaaguacaaauuguauuagcaggcaacgcauucaccgcaggaaaaauacuauuugcaguaauacccccaggauuccccuacgaaaaucuaucaccagcacaacuaacaauguguccccauguuguuguagacguuagacaauuagaaccuauccuauuaccaaugcccgauauaagaaacacauucuuucacuacaaucaaucaaauggcccaaaacgaagauuaguagcaaugcuauauacaccacuaagagccaacaaugcaggagaugaugucuuuacaguauccuguagaguacuaacaagacccucaccagacuucgaauuuaauuucuuaguucccccaucaguagagucaaaaacaaaagcauuuacacuaccaguuuuaaaaauaagugaaaugacaaauucgagauuuccaauaccaguagaccaaauguauacaagucgaaaugaaaacaucguuguucaaccacaaaacggaagaguaacacucgacggagaguuacaaggcacaacaacuuuacaaccuguaucaaucuguggauuucgaggaaccuuacaaacaagauuagcagaucaacccaacuacacuuaccaaguucacuuagaaaaucucgauggcucaccaguugauccaacagaugaaguacccgcuccucuaggaacaccagauuuccaagcacaauuauucggugucauaucucaaagaucuucggauaacgcaacccgugcacacgaagcaagaguaaacacaaaugacccuacauucgcaccucaaauagcacaaguaagauucaaaucaccaucaacagauuuuuccgauaaugaaccaauaaaauuuacuccuguaggaauaucagucgacucacaaaacucuuacaaucaaugguuacuaccacgauaugguggacaucuaacaaauaauacacaucuugcaccaucaguaucaccaauguuuccaggagaacaaauccuauucuucagaucauucaugccaggagcaggaggcuucacagacggagccauugauuguuuauuaccacaagaauggguagcucauuucuaccaagaagccgcaacagcccaaacagauguagccuuaauaagauuuguaaauccagauacaggaagaguucuauuugaagguaaauuacacaaacaaggcuucaucaccauaucaaacucaggagaccacccaauaguaaugccagcaaacggauauuuucgauucgaagcauggguaaaacaauuuuauucauuagcuccaguuggaacuggcucuggacgccgccgaguacaauaa

SEQ ID NO: 34672 - RNA, 1614 nt, Artificial Sequence
  derived and/or modified sequence opt6 from VP1__Norovirus_and/or_Norovirus-like__AB303927
augaaaauggcuucaaaugacgcaaauccaucagauggcucaacugcuaacuuaguaccagaaguuaacaaugaaguaauggcauuagaaccaguuguaggagcagcuauugcugcaccaguagcuggccaacaaaauguuauagacccauggauaagaucaaauuuuguucaagcuccggguggagaauuuacaguuucaccaagaaacgcuccaggagaaauauuaugguccgcaccacuaggaccugaccuaaauccauauuuaucacauuuagccagaauguauaauggauaugcaggcggauuugaaguucaaguaauucuagcuggaaacgcauuuaccgcaggcaaaauaauauucgcagccguaccacccaauuucccuacagaaggucuuucucccucacaaguaacaauguuuccucauauuaucguagacguuagacaacucgaaccaguacuaaucccacuaccagacguuagaaacaauuuuuaucauuauaaucaaucaaacgacucaacaaucaaacuaauagcaaugcuauauacaccacuuagagcuaacaaugccggagacgacguauuuacaguuucuugucgaguacuaacucgcccuagcccagacuucgauuucauauuucuaguuccaccaacaguagaauccagaacuaaacccuuuacaguuccuauauuaacuguagaagaaaugucaaauucaagauuccccguaccauuagaaaaacuauacacaggucccucuagugcauuuguaguacaaccccaaaauggacgauguacaacagauggaguccuguuagguacaacccaacuuucagcaguaaauauauguacauucagaggagacguaacacauauagcagguucacaugauuacacaaugaaccuagcaucacaaaacuggaacaauuaugaccccaccgaagaaauuccagcuccacuaggaaccccagacuuuguaggaaagauucaagguguuuuaacacaaacaacuagagaagauggaucaacacgagcucacaaagcaaccguuucaacaggaucuguccacuuuacaccaaaauuaggaucaguccaauauacuacagauacaaacaacgauuuccaaacuggacaaaauacaaaauucacacccguaggaguuauacaagauggauccaaccaucaaaaugaaccacaacaauggguauuaccaaauuacuccggacguacuggccauaauguacacuuagccccagcaguagcaccaacauuuccuggugaacaacuacuauucuuccgauccacaaugccagguuguuccggcuauccuaauaugaaccuagacugucuauuaccacaagaauggguacaacauuuuuaccaagaagcugcaccagcccaaucagauguagcauuacuaagauucguaaaucccgacacaggaagaguacucuucgaaugcaaauuacacaaaucaggauauguaacaguagcacacacaggaccacacgaucuaguuauaccacccaacggauacuuuagauucgauucuuggguuaaucaauucuauacacuagcaccaauggggaacggagcgggaaggagaagauaa

SEQ ID NO: 34673 - RNA, 1614 nt, Artificial Sequence
  derived and/or modified sequence opt6 from VP1__Norovirus_and/or_Norovirus-like__AY038600
augaaaauggcaucuaacgaugcaagcccaucagacggauccacagcaaauuuagucccagaagucaauaacgaaguaauggcacuagaaccgguagucggagcagcuauagcagcaccuguagcaggacaacaaaacguaauagacccauggauaagaaacaauuuuguacaagcaccaggaggagaauuuaccgucucaccuagaaaugcaccaggcgaaauacuauggucagcaccuuuagguccagaucuaaaccccuacuuaucccauuuagcaagaauguacaauggauaugcuggaggcuucgaaguacaaguaauauuagcagguaaugcuuucacagccggaaaaguaauauuugcagcaguucccccaaauuucccaacagaaggacuaucaccaucccaagucacaauguuuccacauauaauaguagauguccgacaacuagaaccaguauuaauuccccuaccugacguacgaaacaauuucuaucauuacaaccaaucaaacgauucaacaauuaaacuaauagccaugcuauauacaccccuaagagcaaacaaugccggagaugauguauucacaguaucuugcagaguacuaacuagaccaucaccagacuucgacuuuaucuuucuaguuccaccuacuguugaaucacgcacaaaaccuuuuacuguaccaauauuaacaguugaagaaaugagcaacagcagauucccaauaccauuagaaaaacuauauacaggaccaaguucagcauucguaguucaaccacaaaauggaagaugcacaacagauggaguacuauuaggaaccacacaauuaucagcaguaaacauuuguacuuucagaggagacguaacacacauagcaggcucccaugacuauauaaugaaucuagccucccaaaauuggaauaauuacgauccaacagaagaaauaccagcuccauuaggaacaccugacuuuguuggcaaaauucaaggaauguuaacacaaacaacccgugaagacggcucaacacgagcacacaaagcaacaguaucaacaggaucuguacacuucaccccuaaacuuggcuccguccaauacacaacagacacuaacaacgauuuacaaacuggacaaaacacaaaauuuacaccuguaggaguaauacaagauggcaacaaucaccaaaacgaaccccaacaauggguacuaccaaauuauucaggaagaacuggacauaauguacauuuagcuccagcaguugcaccaacuuucccaggagaacagcuauuauuuuucagaucaacaaugccaggcuguuccggcuacccaaauaugaacuuagauuguuuacuuccucaagaauggguacaacacuucuaucaagaagccgcaccagcccaaucagauguagcacucuuaagauuuguaaacccagauacaggacgcguccuauucgaaugcaaauuacacaaaucaggauauguaacaguagcucauacaggaccacacgaccuaguaauaccaccaaacggauauuuccguuuugacucauggguaaaccaauuuuacacacuagccccuauggguaauggugcuggacgaagacgauaa

SEQ ID NO: 34674 - RNA, 1614 nt, Artificial Sequence
  derived and/or modified sequence opt6 from VP1__Norovirus_and/or_Norovirus-like__AF080554
augaaaauggcaucaaacgacgcuaacccuucugauggaucaaccgcaaaucuugucccagaaguuaauaacgaaguuauggcccuagaaccaguuguaggagcagcaauagcagcacccguagcaggacaacaaaauguaauagauccauggauaagaaacaacuuuguacaagcaccuggaggugaauuuaccguuucuccaagaaaugcaccaggagaaauauuauggucugcaccacuaggaccugauuuaaauccauaucuuucacaucuugcaagaauguacaauggauacgcuggaggauucgaaguacaaguuauccuugcaggaaaugcauucaccgccggaaaaauaauauuugcagcagucccaccuaacuuuccaacagaaggacuaucaccaucucaagucaccauguucccacauauuauuguagauguacgccaacuagaaccaguuuuaaucccacuccccgauguaagaaacaauuucuaccacuauaaccaaucaaaugacucaacaauaaaacuaauagcaaugcuuuacacaccucuuagagcaaacaacgccggagaugacguauuuacuguuucaugccgcgucuuaacaagaccuucaccagacuucgacuuuauauucuuaguuccaccaacaguugaaucacgaaccaaaccuuucacaguuccaauacuuacaguagaagaaaugucaaauucacgauucccaauaccauuagaaaaauuauauacaggaccaucaucagcauuuguaguucaaccacagaauggaagauguaccacagacgguguacuacuaggcaccacacaacuaucagcaguaaacauauguacauucagaggcgacguuacacauauagcaggaucacaugauuauacuaugaaucuagccagucaaaauuggaacaauuacgacccaaccgaagaaauaccagcaccacuaggaaccccagauuucguaggaaaaauacaaggaguuuuaacacaaaccacaaaagaagacggaucuacucgugcccacaaagcaacuguauccacaggaucaguacacuuuacuccaaaauuaggaucaguucaauacacuacugauacaaacaacgacuuccaaaccggacaaaacacaaaauuuacuccaguagguguaauacaagacggaaauaaccaucaaaacgaaccacaacaauggguauuaccaaacuauucaggcagaacuggccauaacguacacuuggcaccagcaguagcaccuacauuuccaggagaacaauuacuauucuuuagaucaacuaugccaggcuguagugguuacccaaacaugaaccuagacugucuucucccucaagaauggguacaacauuuuuaucaagaagcugcuccagcccagagcgauguagcacuucucagauuugucaauccagacacaggaagaguacuuuuugaauguaaauuacauaaaucaggauacguaacaguagcucacacaggaccacaugauuuaguaauaccuccaaauggauacuucagauuugacuccuggguaaaucaauucuacacucucgcuccaaugggaaacggagcagguagaagaagauaa

SEQ ID NO: 34675 - RNA, 1614 nt, Artificial Sequence
  derived and/or modified sequence opt6 from VP1__Norovirus_and/or_Norovirus-like__AB294778
augaaaauggcaucuaaugacgccaaccccucagacggcucuacagcuaauuuaguuccagaaguaaacaacgaaguuauggcacuagaaccaguaguaggugcagcuauagccgcaccaguugcuggacaacaaaacguaauagauccauggauaagaaauaacuuuguacaagccccaggaggagaauuuacaguuagcccuagaaacgcaccaggagaaauccuauggucugcaccacuaggaccagaccuaaacccauauuuaucucaccucgcaagaauguacaauggauacgcaggaggauucgaaguacaagucauuuuagcugguaaugcauuuacagcuggaaaaauaauuuuugccgcagucccaccaaauuucccaacagaaggucuaucuccaucucaaguaaccauguuuccacacauuauaguagauguacgacaauuagaaccuguuuuaaucccacuuccagauguccguaacaauuuuuaucauuauaaccaaucaaaugacaguaccauuaaacuaauagccaugcuuuacaccccacuaagagcaaacaaugcuggcgacgauguauuuacaguaucaugcagaguacuaacaagaccaagcccagacuuugauuuuaucuuucucguuccucccacaguagaaucaagaaccaaacccuuuacaguuccaauauuaaccgucgaagaaaugaguaauucuagauuccccguuccauuagaaaaacuauacaccgguccaucaucagcauuuguaguacaaccucaaaacggucgaugcacaacagacggaguauuacuagguacaacacaauuaagcgcaguaaacauauguacauuuagaggcgauguaacacacauagccggcucacaugauuauacuaugaacuuagcaucacaaaauuggaacaauuaugauccaacugaagaaauaccagcaccccuagguacaccagauuucguagguaaaauacaaggaguauuaacccaaacaacacgcgaagauggaucaacaagagcacauaaagcuacaguuucaacgggaucuguacauuuuacaccaaaauuaggauccguccaauacacaacagacacaaauaaugauuuccaaacaggucaaaauacaaaauuuacaccaguuggaguuauacaagacggaaguaaccaccaaaaugaaccacaacaauggguauuaccaaauuacucuggcagaacaggacacaauguacaccuagcacccgcagucgcgccaacguuuccaggagaacaacuacucuuuuucagauccacuaugcccggaugcucuggauauccuaacaugaauuuagauugucuauuaccacaagaauggguacaacacuucuaccaagaagcagcaccagcacaauccgaugucgcacuccuaagauucguaaacccagauacaggaagaguacucuuugaaugcaaauuacauaaauccggcuauguaaccguugcacacacugguccccaugaccucgucauacccccaaacggcuacuuucgauucgauucuugggucaaccaauucuacacacuagcuccaaugggaaacggagcaggaagaagaagauaa

SEQ ID NO: 34676 - RNA, 1614 nt, Artificial Sequence
  derived and/or modified sequence opt6 from VP1__Norovirus_and/or_Norovirus-like__AB303922
augaaaauggcuuccaaugaugcaacaccaucagacggcuccacagcaaauuuaguacccgaaguaaauaacgaaguaauggcacuggaaccaguagucggagcagcaauagcagcccccgucgcaggacaacaaaacguuauagacccauggaucagaucaaacuuuguacaagccccaggaggugaauuuacaguuucaccacgaaaugcaccaggagaaauacucuggucagcaccacuaggaccagaccuaaacccauaccuaucacacuuagcaagaauguauaacggcuacgccggaggauuugaaguacaaguaauucuagcaggaaacgcauucacagcaggaaaaauaauauuugcagcaguaccaccaaauuuuccaacugaaggauugucaccaagucaaguaacaauguucccucacauaauaguugauguaagacaacuagaaccaguauuaauaccacuuccagauguaagaaacaacuuuuaccauuacaaccaaucaaacgacucaaccaucaaacuaauagcaaugcuuuauacaccacuccgugcaaacaaugcaggagacgacguuuucaccguaucaugcagaguccuaacaagacccucuccagauuucgacuuuauuuucuuagucccaccaacaguugaaucaagaacuaaaccuuuuacaguaccaauauuaacaguagaagaaaugucuaauucacgauucccaauaccauuagaaaaacuauauacaggaccauccucagcauuuguuguacaaccacaaaacggaagaugcacgacagauggcguacuacuaggaacaacccaacuaucugcagucaacauaugcacauucagaggagacguaacucacaucgcaggaucacacgacuacaccaugaacuuagcaucacaaaacuggaacaauuaugaucccacagaggaaauaccagcaccacuaggaacaccugacuucguuggaaaaauacaaggaguauuaacacaaacaacacgaggagauggaucaacaagagcucacaaagcaacaguaucaacaggaaguguccacuucacaccuaaacuaggaaguguccaauacacaacagauacaaauaacgauuuucaaacaggucaaaauacaaaauuuaccccuguaggaguaauccaagauggagacaaccaccaaaaugaaccacaacaauggguacuaccaaauuacagcggacguacaggacauaacguccaucuagcuccagcaguagcuccaacauucccaggagaacaacuacuauucuuccguucuacaaugccagguugcucaggcuauccuaacaugaaucuagacuguuuauuaccacaagaauggguucaacacuucuaucaagaagcagcaccagcccaaagcgauguagcacuucuuagauuugucaacccugauacuggaagaguuuuauuugaaugcaaauuacauaaaucuggauacguaacaguagcacacacaggcccucacgacuuaguuauaccaccaaauggauacuuccgauucgacucauggguaaaccaauuuuauacacuagcacccaugggaaacggagcaggccgccgcagauaa

SEQ ID NO: 34677 - RNA, 1614 nt, Artificial Sequence
  derived and/or modified sequence opt6 from VP1__Norovirus_and/or_Norovirus-like__AY532128
augaaaauggcuucaaaugaugcaaauccuagugauggaagcacagcaaaucuagucccagaaguaaacaaugaaguaauggcacuugaaccaguaguuggcgcagcuauugcugcaccaguagccggucaacaaaauaucauagauccuuggauccgcaauaacuucguacaagcacccggcggagaauuuacaguuucaccuagaaacgcaccaggagaaauauuauggucagccccauuaggaccagacuuaaauccauaccuaucucaucucgcccgcauguacaacggauacgcuggcgguuucgaaguucaaguaauauuagcaggcaaugcauucaccgcaggcaaaauaauauuugcagcuguacccccaaauuuccccacagaaggacuaucuccaucacaaguaacaauguuuccacauauaauaguagacguaagacaacuugaaccuguacucauaccacuaccagauguaagaaacaacuucuaucacuauaaucaauccaacgacaguacaauuaaacuuauagcaaugcuauauacaccauuacgagcaaacaaugccggugacgaugucuucacuguaucaugucgaguacuaacaagaccuucacccgauuucgacuuuauauuucuaguaccaccaaccgucgaaucuagaacaaaaccauuuacaguacccauauuaacaguagaagaaaugaguaauuccagauuuccuauaccauuggaaaaacuauauaccgguccaucuucugcauucguaguacaaccacaaaauggacgauguacaaccgacgguguacuauuaggaacaacacaauuaucagcagucaauauauguacauuuagaggagacguuacccauaucgcagguucucacgauuauacuaugaacuuagcaucacaaaacuggaauaauuaugauccaacagaagaaauaccagcaccucucggaaccccagauuuuguaggaaaaauacaagguauauugacacaaacaacuagagaagauggcucaacaagagcacauaaagcgacuguaagcacaggaucaguucauuuuacaccaaaacucggaucuguacaauauacaaccgacacaaauaaugacuuccaaacaggucagaauaccaaauucacaccaguuggaguuauacaagacggaaacaaccaucaaaaugaaccacaacaauggguuuuaccaucauauucaggaagaacaggacacaauguccauuuagcaccagcuguagcucccacauuuccaggagaacaacuacuauucuucagaucaacaaugccaggauguucaggauacccaaacaugaacuuagauugucuacuaccucaagaauggguacaacacuuuuaccaagaagccgccccagcacaaucugauguagcacuucuaagauuuguaaauccagauacaggucguguauuauucgaaugcaaacuacacaaaucuggauacguaaccguagcacacacaggaccucaugaucucguaauuccaccaaacggauacuuuagauuugacuccuggguaaaccaauucuacacauuagcaccuauggguaauggagcuggaagaagacguuaa

SEQ ID NO: 34678 - RNA, 1614 nt, Artificial Sequence
  derived and/or modified sequence opt6 from VP1__Norovirus_and/or_Norovirus-like__AY532113
augaaaauggcaucaaaugacgcaaacccaagugauggcuccaccgccaacuuaguaccagaagucaacaaugaaguaauggcauuagaaccaguuguaggagcugcaauagcugcgccaguagcaggacaacaaaacauaaucgauccauggauacgaaauaauuucguacaagcaccaggaggagaauuuacuguaucaccaagaaacgcaccaggagaaauacuauggucugcaccccucgguccagaucuuaauccauaccuaagccacuuagccagaauguauaauggauaugcaggaggauuugaaguacaaguuaucuuagcaggaaaugcuuucacagcagguaaaauaauauucgcagccguacccccuaauuuucccacagaaggauuaagccccucccaaguuacaauguucccacacauaauaguagaugucagacaacuagaaccaguacucauaccacuaccugacguacguaacaauuucuaccauuacaaucaaaguaacgacucaaccauaaaauuaauagcaaugcucuauacaccacucagagccaacaaugcaggagacgaugucuuuaccguuucaugccgaguccuaacacgacccucaccagacuucgacuuuauauucuuaguuccaccaacaguagaauccagaacaaaaccauuuacaguaccaauucuaaccguagaagaaauguccaacucaagauuuccaauaccuuuagaaaaacuuuauacuggaccauccucagccuucgucguacaaccacaaaauggucgauguaccacagauggaguauuacuaggaacaacacaacuuucagcaguaaauauuugcacauuccgaggugauguuacucacauagcaggaucucaugauuacacaaugaaucuagccucacaaaauuggaacaauuacgauccaacagaagaaaucccugcuccccuuggaacaccugacuucguaggcaaaauacaaggaauguuaacucaaacaacacgagaagacgguucaaccagagcccacaaagcuacaguaucuacaggauccguacacuuuacuccaaaauuaggcaguguacaauacacaaccgacacaaauaacgacuuccaaacaggacaaaauacaaaauucacuccaguaggaguaauacaagacggcaacaaucaucaaaacgaaccccaucaauggguacuacccaauuauuccggaagaaccggucacaacguacaucuagcuccagcaguagcaccaacuuuccccggcgaacaauuauuauucuucagaucaacaaugccaggauguucaggauauccaaacaugaauuuagacugccuauuaccacaagaauggguacaacauuuuuaucaagaagcagcaccagcacaaucugauguagcacuacuaagauuugucaacccagauacaggaagagucuuauuugaaugcaaacuacauaaaucaggauacguaacaguugcacauacugguccacaugacuuaguaauuccaccaaauggauauuuuagauucgauucaugggugaaccaauucuauacacuagcaccaaugggaaacggcgcaggcagaagaagauaa

SEQ ID NO: 34679 - RNA, 1614 nt, Artificial Sequence
  derived and/or modified sequence opt6 from VP1__Norovirus_and/or_Norovirus-like__EU078406
augaaaauggcaucaucagacgcaaauccaagcgauggaucagccgcaaaccuuguacccgaaguaaacaaugaaguaauggcauuagaaccaguaguaggagccgcaauugcagcuccaguagcuggccaacaaaauauaauagaccccuggaucagaaauaauuucguacaagcucccggcggagaauuuacuguaucaccaagaaaugcaccaggcgaaauacuuuggucagcaccauuaggcccagaccucaacccauacuuaucacauuuaucacguauguauaauggcuaugcaggaggauuugagguucaaguaauacuugcagguaaugcauuuacagcaggaaaaauaauuuucgccgcaguaccaccaaacuuuccaacugaaggcuuaucaccuucucaaguaaccauguuuccacauguaauaguugauguacgccaacuugaacccguucuaauaccauuacccgauguaagaaauaauuucuaucauuauaaccaagcccaugauccuacuauaaaauuaauugcaauguuauacacuccacuucgagcaaauaacgccggcgacgacguauuuaccguuucauguagaguauuaacacgacccucuccagauuuugauuuuauuuucuuaguaccacccacuguugaaucccgaacuaaaccauuuaccgucccaauucuaaccguagaagaaaugucaaauucuagauucccuauaccacuugaaaaacuauauacaggaccauccuccgauuuugucguacaaccacaaaacggacgauguacaacugauggaguacuacuagggacaacucaacucucugcagucaauauaugcaacuucaaaggagaugucacacauauagcaggaagucgagauuacagaaugaaucuaguaucacaaaauuggaauaauuaugauccaacagaagaaauaccugcuccacuaggaacuccugacuuucaaggaaaaauacaaggauuacuuacacaaaccacuggugcugaugguucaacaagagcucauaaagcaacaguaucuacaggagcagcaaauuuuacaccaaaacuuggaucuguccaauucaccacugacacagacaacgauuuucaaacaggacaaaauacuaaauuuacacccguaggaguuauucaagacggaucucaccaucaaaaugaaccucaacaauggguacuaccuaauuauuccggacgaacaguacauaacguacaucuagcacccgcaguagcacccacauuucccggagaacaauuauuauucuuucgaucaacaaugcccggauguuccggauauccaaacaugaauuuagacugcuuauuaccacaagaauggguaaugcacuuuuaucaagaagcagcaccagcacaauccgacguagcacuacuaagauuuguuaacccagacacaggacgaguauuauucgaauguaaacuucauaaagcggguuauaucacaguagcucauacaggacaacacgaucucguaauaccaccaaacggauauuucagauuugacucuuggguaaaucaauucuauaccuuagcaccaaugggaaauggcgcaggaagaagaagauaa

SEQ ID NO: 34680 - RNA, 1614 nt, Artificial Sequence
  derived and/or modified sequence opt6 from VP1__Norovirus_and/or_Norovirus-like__AF472623
augaaaauggcuucaaaugaugcaaauccaucagacggcucaacagcuaauuuaguaccagaaguaaacaacgaaguaauggcccuagaaccaguaguuggggcagcaauagcugcaccaguugcaggccaacaaaacauaauagauccauggauuagaaauaacuuuguacaagcaccaggaggcgaauuuacaguuucaccaagaaaugcacccggagaaauucuauggucagcaccacuuggaccagaucuaaauccauacuuaucacaccuagcaagaauguacaauggcuaugcaggaggauucgaaguacaaguaauacuagcaggaaaugcuuucacagcuggcaaaauuauauuugcagcaguaccacccaacuucccaaccgaaggauuaucacccucacaaguuacaauguucccacauauuauaguugauguaagacaacuagaaccaguauuaauaccacuaccagacguaagaaacaauuucuaucacuauaaccaaucgaacgacucaacaauaaaacuaaucgcaaugcuauauacaccacuaagagcaaacaacgcaggagacgacguauucacaguaucauguagaguauuaacaagaccaucaccagacuucgacuuuaucuuuuuaguaccuccuacugucgaaaguagaacaaagcccuuuacgguaccaauacuaacaguagaagaaaugucaaauagucgauuuccaauaccucuugaaaaacuauacacaggaccaucaucagcauucguaguccaaccucaaaauggacgauguacaacugacgguguccuacuaggaaccacacaacuaucagcagucaauauaugcaccuuuagaggagacguaacucacauagcaggaagucacgauuacacuaugaaucuagcaucccaaaacuggaacaauuaugauccaacugaagaaauaccugcaccauuaggaacaccugacuuuguuggaaaaauacaaggaauguuaacacaaacaaccagagaagauggaucuacaagagcccacaaagccaccguaucaaccggauccguacacuuuacaccaaaauuagguucuguacaauauacuacagauacaaacaacgacuuccaaacaggacaaaauacaaaauucacccccguaggaguuauacaagacggaaacaaccaccaaaaugaaccccaacaauggguacucccaaacuacucaggcagaacaggccauaacguucauuuagccccagcaguagccccaacuuuuccaggcgaacaauuacuauuuuuccgaucaaccaugcccggaugcucagguuacccaaacaugaaucuagacuguuuacucccccaagaauggguacaacauuucuaucaagaagcugcacccgcacaauccgauguagcacuucucagauucguuaauccagauaccggaagaguacuauuugaauguaaauuacacaaaucaggcuacguuacaguagcacauacaggcccucacgacuuaguaauaccaccaaauggauacuucagauucgauucauggguuaaucaauucuacacacuagcaccaaugggaaacggugccggaagaagaagauag

SEQ ID NO: 34681 - RNA, 1614 nt, Artificial Sequence
  derived and/or modified sequence opt6 from VP1__Norovirus_and/or_Norovirus-like__AF427114
augaaaauggccucuaacgacgcaaaccccuccgacggaucgacagcuaauuuaguaccagaaguaaauaaugaaguaauggcucuagaaccaguagucggagcugcuauugccgcaccaguagcaggacaacaaaacgucauagacccuuggauacgcaacaauuucguucaagcuccagguggagaauuuacaguuucaccacgaaaugccccaggcgaaauacuauggucugcaccacuaggaccugaucuuaauccauaucuaucacacuuagcacgaauguauaauggauacgcaggcggauucgaaguacaaguuauacuagcuggaaaugcuuucacagcaggaaaaaucauuuuugccgccguaccaccuaauuuccccacugaaggacuaucaccaucacaaguuacaauguucccacacauaauaguugacgucagacaacuagaacccguuuuaauaccacuaccagauguaagaaauaacuucuaccauuacaaucaaucaaaugacucaaccauuaaauuaauagcuaugcucuacacaccauuaagagcaaacaaugccggagacgaugucuuuacagcaucaugcagaguacuaacuagaccuaguccugauuuugacuucaucuuucuaguaccaccuacaguagaaucuagaacaaaaccauucaccguaccuauauuaaccguagaagaaaugucaaauucaagauuuccaauaccauuagaaaaacuuuauacaggaccuucaucagcauucguaguucaaccacaaaacggucgauguacaacagacggaguauuauuaggaacaacacaauuaucugcaguaaacauaugcacuuucagaggcgacguuacacacauagcaggaucacacgacuauacaaugaaccuagcuucacaaaacuggaacaauuacgacccaaccgaagaaauaccagcaccuuuaggcacaccagacuuuguagguaaaauacaaggaguacuaacacaaacaacaagagaagacggauccacaagagcacacaaagcaacugucucaacaggaucaguacacuucacaccaaaacuuggauccguacaauauacaaccgauacaaauaacgacuuccaaacaggacaaaauacaaaauuuacaccaguaggaguaauacaggacgguaguaaucaccaaaaugaaccacaacaauggguacuaccaaauuauucuggacgaacaggacacaauguacaccuagcucccgcaguagcuccaacuuucccaggugaacaacuacuauucuuuagaucaacaaugccaggcuguuccggauacccaaacaugaaccuagacugucucuuaccacaagaauggguacaacacuuuuaucaagaagccgcuccagcacaauccgauguagcacuauuaagauuuguaaacccagauacaggacgcguuuuauuugaauguaaacuacacaaaucaggauacguaacaguugcacauacagguccacaugacuuaguuauaccaccaaacggauauuuuagauuugauucauggguaaaucaauucuacacucuagcuccaauggguaacggagcagguagaagaagauaa

SEQ ID NO: 34682 - RNA, 1614 nt, Artificial Sequence
  derived and/or modified sequence opt6 from VP1__Norovirus_and/or_Norovirus-like__AY532114
augaaaauggcuucaaacgacgcaaauccaucugauggaucaacagccaaccuaguaccagaaguaaauaaugaaguaauggcucucgaaccaguaguaggagcagcaauagccgcuccuguagcaggacaacaaaauguaaucgauccauggauaagaaacaauuucguucaagcacccggaggagaauuuacaguauccccaagaaaugcaccuggagaaauacuuuggucagcaccacucgguccugauuuaaacccauauuuaagucauuuagccagaauguacaauggauacgcugguggauucgaaguacaaguaauccuagcaggaaaugcguuuacggcuggaaaaauaauauucgcagcuguacccccaaauuuuccaacagaaggauuauccccaucccaaguuacaauguuuccacauaucauaguugauguacgccaacuagaaccaguacuaauuccuuuaccagacguaagaaacaacuucuaucacuacaaucaaucuaacgacucaacaauaaaauuaaucgcaauguuauacacaccccuacgagcaaauaaugcaggcgaugacguauuuacugucucaugucgaguacuaacaagacccucaccagauuuugauuucauauuuuuaguuccaccuacuguagaaucaagaacaaaaccauucacuguaccaauacuaacaguagaagaaaugucuaauucaagauuuccaauaccauuagaaaaauuauauaccggaccaucaucagcauuuguuguccaaccacaaaacgguagauguacaaccgauggaguauuacuaggaaccacccaacuaagugcaguaaauauauguaccuuuagaggcgauguaacacauauagcaggaucacaugauuacacaaugaaccuagccucacaaaacuggaacaacuacgacccaaccgaagaaauaccugcaccuuuaggaacaccagauuuuguaggcaaaauacaagguaugcucacacaaaccacucgagaagacggaucuacuagagcacacaaagcaaccguaucaacagguucaguacauuuuacacccaaacuagguuccguacaauacacaacagauacaaauaacgauuuucaaacaggacaaaauaccaaauuuacucccguaggaguaauccaagacggaaacaaucaccaaaacgaaccucaucaauggguacucccuaauuacucuggaagaacaggccacaacguucaucuagccccugcuguagccccaacuuuccccggagaacaauuacuauuuuuccgaucaaccaugccuggaugcucaggauauccaaauaugaaccuagauuguuuacuuccccaagaauggguacaacauuuuuaccaagaagcagcaccagcccaaucagacguagcauuauuaagauucguaaauccugauacaggaagaguucuauuugaauguaaauuacacaaaucaggauauguuacuguagcacauacaggaccacaugacuuaguaauaccaccaaacggguacuuccgguuugauucauggguaaaucaauucuauacccuugcaccaauggguaacggagccggccgucgucgauaa

SEQ ID NO: 34683 - RNA, 1614 nt, Artificial Sequence
  derived and/or modified sequence opt6 from VP1__Norovirus_and/or_Norovirus-like__KF806505
augaaaauggcuuccaaugacgcaucaccaucugauggaucagcagcaaacuuaguaccagaagucaacaaugaagucauggcauuagaaccaguaguaggugccgcaauagcugccccaguagccggucaacaaaauguaauagauccauggauaagaaauaauuucguacaagcaccuggaggcgaauuuacaguaucaccaagaaacgcuccaggagaaauauuaugguccgcacccuuaggaccagacuuaaaccccuaccucucacaucuugcaagaauguauaauggauacgcaggaggcuuugaaguucaagucauucuagcuggcaaugcauucacagccggaaaaaucauauuugcagcuguaccaccaaacuucccaacugaaggcuuaucaccuucacaagucaccauguucccucacauaguaguugacguuagacaauuagaaccugucuuaauaccauuacccgaugucagaaacaacuuuuaccauuauaaucaauccaaagaccccacaauaaaauuaauagcuauguuauacacaccacuuagagccaauaaugcaggcgaagauguauuuacaguaucaugucgcguacuaacacgaccaucaccagacuuugauuuuauauuccuagucccaccaaccguagaaucaagaucuaaaccauuuacaguaccaauacuaacaguugaagaaaugacaaauucucgauucccaaucccucuggaaaaacuauuuacaggaccuucaggcgcauucguaguacaaccacaaaauggacgauguacaaccgaugguguauuauuaggaacuacucaauuaucuccaguaaauauauguaccuuuagaggagauuuaacacauuucacaggaacaucagaauaugcaaugaaccuagcaucccaaaacuggaacaacuaugauccaacagaagaaauaccugccccacuaggugccccagauuuuguaggaaagauuagaggaaugcuaacacaaacaacaagaagagacggaaguacaagaggacacagagccacacuaucaacaggaucagcucauuucacaccaaaauuaggaucaauaagauucuccacagauacaaauaaugacuucgaagcuggucaaaacacaaaauucacgccaguugguguguuucaagaaggagacaaucaccaaaaugaaccucaacaauggguucuaccuaauuacagcggagccacagcacacaacguacacuuagcaccagccgucgccccagcguucccaggagaacaauuacuauucuucagaucaacaaugcccggauguggaggauaucccaacaugaacuuagauugucuucuuccacaagaauggguacaacacuuuuaucaagaagcagcaccggcacaaucagauguagcacuacugagauuuguaaaccccgauacuucaagagucuuauucgaaugcaaacuacauaaaucaggauacguuacagucgcacauaccggccaacacgacuuaguuauaccaccuaaugguuacuuuagauuugacucauggguuaaucaauuuuacacauuagccccaaugggcaauggaacaggaagaagaagauaa

SEQ ID NO: 34684 - RNA, 1614 nt, Artificial Sequence
  derived and/or modified sequence opt6 from VP1__Norovirus_and/or_Norovirus-like__JQ478407
augaaaauggcaucuaacgaugcaucaccauccgaugguucuacagcaaaucuaguaccagaaguuaacaacgaaguaauggcauuagaaccaguagucggagcugcaauugcagcaccagucgcaggacaacaaaacguaauagauccauggauaagaaauaauuucguacaagcaccaggaggcgaauuuacagucagcccaagaaaugcaccaggagaaauucuauggucagccccucuaggaccagauuuaaauccauacuuaucacauuuagccagaauguacaacggauacgcaggaggauucgaaguucaaguuauauuagcuggaaacgcauucaccgcaggcaagauuauauucgcagccguuccaccaaauuuuccaacagaaggacuuucacccucucaaguaacuauguuuccucauauaauaguagacguacgccaauuagaaccaguccuaauaccccuaccagacguucgaaacaacuuuuaucacuacaaccaaucaaaugacagcacaaucaaauuaauagcaauguuauauacaccacuaagagcuaacaaugcuggagacgauguauuuaccguuucaugccgaguacuuacuagacccucaccugauuuugauuucauauuuuuaguaccaccaacaguagaaucuagaacaaagccauucacaguuccaauauuaacuguagaagaaaugucaaauucccgauuuccaauaccacuagaaaaacuauacacaggaccauccuccgcauuuguaguacaaccacaaaacggucgauguacaacagauggaguauuacuuggaacaacucaacuaucagcaguaaacauauguaccuucagaggagauauaacacauauagcuggcucacacgauuauacaaugaaccuugcaucacaaaauuggucaaauuaugacccaacagaagaaauaccagcaccacuagguacaccagacuuugucggaaaaauacaaggaauguuaacacaaacaacaagagaagauggaucaaccagagcucacaaagcaaccguaucuacuggcuccguccauuucaccccaaaacuaggauccguacaguauacaacagacacaaacaaugacuuccaaacaggacaaaacacuaaauuuacaccaguaggaguaauacaagacggcggaaaucaucaaaaugaaccacaacaauggguucuaccaaauuauuccggaagaacaggacauaacguacaccuagcacccgcuguagccccuacuuucccaggagaacaacuauuauucuucagaucuacaaugccaggaugcucaggauauccaaauaugaacuuagacugccuauuaccccaagaauggguucaacauuuuuaccaagaagcagcuccugcacaaucagacguagcauuacuucguuuuguaaauccagacacagguagaguauuauucgaaugcaaauuacacaaauccggauacguaacaguugcacauacaggaccucaugaccuaguaauaccaccaaauggcuacuuucgauucgauucauggguaaaccaauuuuacacuuuagcaccaaugggaaauggagcaggacgccgaagauaa

SEQ ID NO: 34685 - RNA, 1614 nt, Artificial Sequence
  derived and/or modified sequence opt6 from VP1__Norovirus_and/or_Norovirus-like__AB303923
augaaaauggcauccaaugaugcaaacccauccgauggaucaacugcuaacuuaguaccugaagucaacaaugaaguaauggcucuagaaccuguaguaggagccgcaaucgcagcaccuguagcaggucaacaaaauguaauagauccauggauaagaaacaauuuuguacaagcuccaggaggugaauuuacaguauccccuagaaacgcaccuggagaaauauuauggucagcaccacuaggcccagacuugaauccauauuuaucccaccuagcacgaauguauaauggcuaugccgguggauuugaaguacaaguaauauuagcaggaaaugcauuuacagcaggaaaaauaauuuuugcugcaguuccaccuaauuucccuacagaaggauuaucucccucucaaguaacaauguucccccauauaauuguagauguaagacaacuagaaccaguacuaauuccacuaccugacguaagaaacaacuuuuaucauuauaaucaaucaaaugacucaacaaucaaauuaaucgcaaugcuauauacacccuuaagagcaaacaacgcaggagaugacguauucacuguuuccuguagaguacuaacuagaccuucaccugacuucgauuucauauuucuaguaccaccaacaguagaaucaagaacaaaaccauuuaccguaccuauucuaacaguagaagaaauguccaacucacgcuucccaauacccuuagaaaaauuauacacaggaccaucuucagcauuuguaguucaaccacaaaauggcagauguacaacagacggaguccuacuaggaaccacacaacuuucagcuguaaacauauguaccuuuagaggugacguuacacauauagcaggcucccaugacuacacaaugaauuuagcaucucagaauuggaacaauuaugauccaacagaagaaauacccgcaccuuuaggaaccccugacuucguuggaaaaauccaaggaaugcuuacacaaacaacaagagaagacggaucaacaagagcacauaaagccacaguauccacaggauccguucacuuuacaccaaaauuaggaucuguacaauacaccacugauacaaacaaugauuuccaaacuggccaaaauaccaaauucacaccaguaggaguuauacaagacggcaacaaccaccagaaugaaccucaacaauggguacuacccaauuacucaggaagaacaggacacaauguacauuuagcacccgcuguagccccaacuuucccaggagaacaauuacucuucuuuagaucaacaaugccaggauguucuggauauccaaacaugaaccucgacugccuauuaccacaagaguggguacaacacuuuuaccaagaagcagcaccagcccaaucugauguugcacuacuaagauuuguuaaccccgauaccggacgaguacuauuugaauguaaacuacauaaaucuggauacguuaccguugcacacacaggcccccaugacuuaguaauacccccaaaugguuauuuuagauuugacucauggguaaaucaauuuuauacacucgcaccaaugggaaauggagccggaagacgacgguaa

SEQ ID NO: 34686 - RNA, 1614 nt, Artificial Sequence
  derived and/or modified sequence opt6 from VP1__Norovirus_and/or_Norovirus-like__AF427120
augaaaauggccaguaaugaugcaaacccuucagacggaucaacagcuaaccuaguuccagaaguaaacaaugaaguaauggcacuagaaccaguaguaggugcagcaaucgcagccccuguagcaggacaacaaaacguuaucgacccauggauacgcaauaacuuuguucaagccccuggaggagaauuuacaguauccccaagaaacgcaccaggagaaauauuaugguccgccccauuaggaccagaucuaaacccauauuuaucccacuuagcacgaauguacaauggauaugccgguggauuugaaguucaaguaauacucgcaggaaaugcauucacagcaggaaaaauaauauuugcugccguuccuccaaacuuuccaacugaaggacuaucuccaagccagguaacaauguucccccacauaauagucgacguaagacaauuagaaccaguuuuaauaccauuaccagacguucguaacaacuuuuaucacuauaaucaaucaaaugauuccaccauuaaacuuauagcuaugcuauacacuccacuaagagcaaauaacgccggagacgauguauuuaccguaucuugucgcguacucacuagaccuucacccgacuuugacuuuauauuccuaguaccaccaacaguagaaucuagaacaaaaccauuuacaguuccuauacuaacaguugaagaaaugucaaauucacgauuuccaauaccacuagaaaaauuauauacaggaccaucaagugccuucauaguacaaccucaaaacggccgauguacuacagacggaguauuacuuggaacaacacaauuaucagcaguuaauauauguaccuucagaggagacguaacacacauagccggaucacaugauuacacuaugaacuuagcuucccaaaacuggaauaacuacgauccaacugaagaaauaccagcaccacucggaacaccugacuucguuggaaaaauacaaggcaugcuaacccaaaccacaagagaagauggauccacccgcgcacauaaagcaacaguaucuacuggaaguguacacuuuacaccaaaauuaggaucaguucaauacacaacagauacuaauaaugacuuucaaaccggacaaaauacaaaauucacaccuguuggaguaauacaagauggaaauaaucaccaaaacgaaccacaacaauggguauuaccuaauuacucuggacguacaggacacaacguacacuuagcacccgcaguagcaccaacauuuccaggcgaacaacuacuuuucuucagaagcacaaugccuggcugcagcggauacccaaacaugaacuuagauugucuacuuccacaagaauggguacaacacuuuuaccaagaagcagcaccagcucaaagcgauguagcuuuacuaagauuuguaaacccagauaccggaagaguauuauucgaaugcaaauuacacaaaucaggcuacguuacaguagcacacacaggaccacaugaucuaguaauaccaccaaacggcuacuuccgauuugauucuuggguuaaucaauucuauaccuuagcaccaauggguaacggagcagguagaagaagauaa

SEQ ID NO: 34687 - RNA, 1614 nt, Artificial Sequence
  derived and/or modified sequence opt6 from VP1__Norovirus_and/or_Norovirus-like__AY532134
augaaaauggcaucaaaugacgcaaaccccucagacggaaguaccgcaaaccuagucccagaaguuaacaaugaaguaauggcauuagaaccaguaguaggcgcagcuauagcagcaccugucgcaggacaacaaaacauaauagauccuuggauaagaaauaacuucguacaagcccccggaggagaguucacaguauccccuagaaacgcuccuggagaaauauuauggucagcaccccuaggaccugaucucaacccauacuuaucacacuuagccagaauguauaacggauacgcaggaggauuugaaguacaaguaauccuagcaggaaacgcuuucacagcaggaaaaaucauauucgccgcaguaccacccaauuuucccacagaaggacuauccccaucucagguaacaauguucccacauaucauagucgacguuagacaacuagaaccaguucuaaucccauuaccagacguaagaaauaauuuuuaucauuacaaucaaucaaaugacagcacaauaaaauuaauugcuauguuauacacaccccuaagagcaaauaacgcaggagaugacguuuucacagucuccuguagagucuuaacacgaccuucacccgauuucgacuuuaucuuuuuaguuccaccaacaguagaaucaagaauaaaacccuuuacuguacccauacuuacaguagaagaaaugaguaacucaagauuucccaucccauuagaaaaacuauauacaggaccaucaucagccuuuguaguacaaccacaaaacggaagauguacaaccgauggaguacuauuaggaacuacacaauuaucagcaguaaacauaugcacauuuagaggugauguuacgcauauagcagguagucaugauuacaccaugaaccuugcaucucaaaauuggaacaauuacgacccaacagaagaaauaccagcaccacuaggaacaccagacuucguaggaaaaauacaaggagucuuaacacaaacaacuagagaagauggaagcaccagagcacauaaagcaacagucuccacuggaucgguacauuucaccccaaaacuaggcucaguucaauacacaacagauacaaacaaugacuuccaaacaggacaaaauacaaaauucacuccuguaggagucauacaagaugguaacaaccaucaaaacgaaccacaacaauggguauuaccuaacuacucuggucgcgcuggacacaauguacauuuagccccugcaguagcaccaacauucccaggcgaacaauuauuauuuuuccguucaacaaugccaggcuguucaggauauccuaacaugaaucuagauuguuuauuaccccaagaauggguacaacacuuuuaccaagaagcugcacccgcacaaucagacguagccuuauuaagauuuguaaauccagacacaggacgaguacuuuuugaauguaaauuacauaaaucaggauaugucacagucgcacauacaggcccacaugacuuaguaauaccacccaacggauauuuucguuucgacucuuggguaaaccaauucuaugcccuagcacccaugggaaacggagcaggaagaagaagauaa

SEQ ID NO: 34688 - RNA, 1614 nt, Artificial Sequence
  derived and/or modified sequence opt6 from VP1__Norovirus_and/or_Norovirus-like__AY532116
augaaaauggcaucaaaugacgcaaacccaucagacgguucuacagccaaccuaguuccagaaguuaacaaugaaguaauggcacuagaaccaguuguaggagccgcaauagcaacaccaguagcaggucaacaaaauguuauagacccauggauuagaaauaauuuuguacaagcccccggaggagaauuuacagucucaccaagaaaugccccuggagaaauccuauggucagccccuuuaggaccagaccuaaacccuuacuuaucucauuuagcucgaauguauaauggauaugccggaggauucgaaguacaaguuauucuagccggaaacgcauucacagcuggaaaaauaauauucgccgcaguuccaccaaauuuuccaacugaaggcuuaucaccuucacaaguuacaauguuuccccacauaauaguagacguaagacaacuagaaccaguauuaauuccgcuaccagacguaagaaacaauuuuuaucacuauaaucaaucaaaugacuccacaauaaaauuaaucgccaugcuauacacaccacucagagcaaauaacgcaggagacgauguauuuacaguaucaugcagaguucuaacaagaccaucacccgacuuugacuuuauauuucuaguaccaccaacuguagaauccagaacaaaaccauucaccguaccaauccuuacuguagaagaaaugucaaauaguagauuuccaauacccuuagagaaacuauauaccggucccucaucagcauucguuguacaaccacaaaauggacgaugcacaacagacggaguacuucuaggaacaacacaacuaucagcaguaaauaucuguaccuuucgaggagacguaacacauauugccggaucccacgauuacacaaugaaucuagcuucacaaaacuggaauaacuacgauccaacugaagaaauuccugcaccacuagguacuccggacuuuguuggaaaaauacaaggaauguuaacucaaacaacaagagaagacggaagcacuagagcucacaaagcaacuguaucaacaggaucaguacauuuuacaccaaaauuaggaucaguacaauauacaacagauaccaacaacgacuuccaaacaggacaaaacacaaaauucacaccaguaggagucauccaagaugguaauaaucaccaaaacgaaccacaacaauggguauuacccaacuacucaggaagaacuggccacaauguucaucuagcaccagcugucgcaccaacauucccaggagaacaauuauuauucuucagaucaaccaugccaggaugcucaggauacccaaacaugaaccucgacugucuacuuccacaagaauggguacaacauuuuuaccaagaagcagcuccugcacaaucagauguugcacuauuaagguuuguuaacccagauacaggcagaguacucuuugaaugcaaacuucacaaaucaggcuacguaacagucgcucacacuggaccacaugaucuaguaauacccccaaaugguuauuucagguuugacucuuggguuaaccaauuuuauacacuagcaccgaugggaaacggagccggaagacgacgauaa

SEQ ID NO: 34689 - RNA, 1614 nt, Artificial Sequence
  derived and/or modified sequence opt6 from VP1__Norovirus_and/or_Norovirus-like__AY532112
augaaaauggcaucaaaugaugccaauccaucagauggcucaacagcaaaccuaguaccugaagucaacaacgaaguaauggcacuugaaccaguuguaggugcugcuaucgcagcacccgucgcuggccaacaaaacauuauagauccuuggauacgaaauaacuuuguacaagcacccgguggagaauuuacuguuucacccagaaaugcaccaggcgaaaucuuguggucugcuccuuuaggaccagauuuaaacccauaucuaucucaccuugcacgcauguauaauggauaugcaggagguuucgaaguacaaguaauauuagcaggaaaugccuuuacagcugguaaaaucauauucgcagcaguaccaccuaacuuuccaacagaaggacuaucaccaucccaaguaacaauguucccccacauaauaguagacguacgacaacuagaaccaguacuuauacccuuaccagacguacgaaacaauuucuaucauuauaaucaaucuaaugauucuacaauaaaacuaauagcaauguuauauacaccauuacgagcaaacaaugcaggagacgaugucuuuacgguauccuguagaguacuaacucgcccgucaccagacuuugacuuuauauuuuuaguaccaccuacaguugaaucaagaacaaaaccauuuacugcaccaauacuaacugucgaagaaauguccaauucaagauucccaauaccccuagaaaaauuauacacuggucccucaucugcuuucgucguucaaccacaaaacgguagauguaccacagacggaguauuauuaggaacaacucaauuaucagcuguaaacauauguaccuuucgaggagauguaacacauauugcaggaucacaugauuacacaaugaaucucgcuucacaaaacuggaacaacuacgacccaacagaagaaauuccagcaccauuaggaaccccagacuuuguaggaaaaauacaaggaaugcuaacacaaacaacaagagaagauggaucuaccagagcccauaaagcaaccguaucaacuggaucaguacacuuuacaccaaaacuagguagcguacaauacacuaccgacacaaauaaugauuuccaaacaggacaaaauacaaaauucaccccaguaggaguaauacaagauggaaauaaucaccaaaaugaaccacaacaauggguccuuccaaauuauucaggacgaacaggacacaauguacauuuagccccagcaguagcaccaaccuucccaggugaacaacuacuauuuuucagaucaacaaugccuggauguucaggauauccaaauaugaaucuugacuguuuauuaccucaagaauggguacaacacuucuaccaagaagcugcacccgcacaaucagauguagcacuauuacgauucguaaacccagacaccgguagaguccuauucgaauguaaauuacacaaaucaggauacgucacaguugcucacaccgguccacacgauuuagucauaccaccaaauggauacuuccgcuuugacucauggguaaaccaauuuuauacacucgcaccaaugggaaacggagcaggacgcagacgauaa

SEQ ID NO: 34690 - RNA, 1614 nt, Artificial Sequence
  derived and/or modified sequence opt6 from VP1__Norovirus_and/or_Norovirus-like__KX514275
augaaaauggccagcaaugaugcuaauccauccgauggaucugcagcaaacuuaguaccugaaguaaacaaugaaguaauggcauuagaaccaguaguaggcgcagcaauagcagcuccaguagcuggacaacaaaauguaauugauccauggauacguaauaacuuuguacaagccccuggaggcgaguuuacagucucacccagaaaugcaccuggagaaauacuauggucugcaccacuaggaccagauuuaaacccauaccuaucacaccuagcccgaauguacaauggcuacgcuggugguuuugaaguacaaguaauauuagcaggaaaugcauuuaccgcaggcaaaauaauuuucgcagcaguaccaccuaacuucccaacugaaggacuaucucccucacaaguaacaauguuuccucacauaaucgucgacguacgacaacuagagccuguacuaauaccauuaccugacguaagaaacaauuucuaccacuauaaccaaucaaacgacucuacaauaaaauuaauagcaauguuauacacaccucuaagagcuaacaaugcaggcgacgaugucuuuacagucucauguagaguacuaacaagaccaucaccagauuuugacuucaucuuucuaguaccaccaacaguggaaucaagaacaaaaccuuucaguguaccaaucuuaaccguaggagaaaugaccaauucacgauuuccaauuaaucuagaacgcuuauucacaggaccaucuucagcaaauguaguacaaccacagaauggcagaugcaccauagauggagaacuucuaggaacaacacaauuaucaucaguuaauauauguacauucagaggagacguuacacauauaggaucuacucaccauuggacuaugaaccuagccucuccuaacuggaacaacuaugauccaacagaagaaacaccagcuccauuagguacaccagacuuuguaggaaaaauacacggaauguuaacacagacaacacaagaaaauggauccacacgugcacaucgagcaacaguauauguagguucagcagacuuuacuccaaaauuaggaaaaguacaauuugaaacagacacugaagacgacuuagcaauccgccaaaauacaaaauuuacacccgucggaguaauacaaucuuccgaccaucacagagacgaaccacaacaauggcgucuaccaaauuauuccggagcaaauacauuuaauguacaucuugcaccagcagucgcaccaaauuucccaggagaacaauuauuauucuuucguuccacacuuccaggauguggaggccaucccaauauggaucuugacuguuuacucccacaagaauggguccaacacuucuaucaagaagcagcacccgcacaaucagacguagcacuauuacgauuuguaaaucccgauacaucuagaguacuauuugaauguaaacuccauaaaucaggauacgucacaguagcucauacaggccaauaugaccuaguacuuccaucaaacgguuacuuccgauucgacucauggguaaaucaauuuuauacucuugcaccaaugggcaacggaacaggucgacgaagauaa

SEQ ID NO: 34691 - RNA, 1614 nt, Artificial Sequence
  derived and/or modified sequence opt6 from VP1__Norovirus_and/or_Norovirus-like__KF806510
augaaaauggcaucgaacgaugcuucaccuuccgauggaucagcagcaaaucuaguaccugaaguuaacaacgaaguaauggccuuagaaccaguaguuggugcagcuaucgcagcaccuguagcuggacaacaaaaugucauagauccauggauaagaaacaauuuuguucaagcaccuggaggagaauuuacaguaucaccaagaaacgcaccaggugaaauacuauggucagcaccauuaggaccagaucuaaaucccuaccuaucacaccuugcacgaauguacaacggcuacgccggaggauuugaaguccaaguaauauuagcagguaacgcguucacagcaggaaaaauaaucuuugcugcaguuccaccuaauuuuccaaccgaaggacuaucuccaucacaaguaacaauguuuccacauauagucgucgacguuagacaauuagaaccaguucuuauaccauuaccagauguaagaaauaacuuuuaucauuacaaucagucaaaagaccccacaauaaaacuaauagccaugcuauauaccccauuaagagcaaauaacgcuggcgaagauguauuuacuguaucuuguagaguauuaacaagaccuucaccugacuucgacuuuauauuucuugugccaccuacaguagaaucuagaucaaaaccauucaccguaccaauacuuacaguagaagaaaugacaaauucuagauuuccuauaccucuagaaaaauuauucacaggaccaucuggagcauuuguuguacaaccacaaaauggaagauguacaacugauggaguacuucuaggcacaacucaauuaucccccguaaauauaugcacuuuuagaggugaccuaacacauuuuacagguacaucagaauaugcuaugaacuuagcaucucaaaacuggaauaacuacgauccaacagaagaaauaccagcuccacuaggcgcuccugacuuuguaggcaaaaucagagguauguuaacacaaacaacaagacgagauggaucaacaagaggccaucgcgcaacacucucaacaggauccgcacauuuuacaccuaaacuuggaaauauaagauuuaguacagacacgaacaacgauuuugaagcaggacaaaauacaaaauucacuccaguaggaguauuucaagaaggagauaaucaccaaaaugaaccacaacaauggguacucccaaauuauucaggagcaacagcacauaacguacauuuagcaccagccguagcaccagcauucccaggagaacaacuauuauuuuucagaucaaccaugccuggauguggagguuaucccaacaugaacuuagacuguuugcuaccucaagaguggguacaacauuuuuaccaagaagcugcaccagcucaaucugauguagcauuacuacgauuuguaaauccagacacuucacggguucuauuugaauguaaauuacauaaaucaggauaugucacaguagcacacaccggucaacaugauuuaguuauaccaccaaacgguuauuuucgauuugauucauggguaaaucaauuuuauacacuagccccaaugggcaauggaacagguagaagacgauaa

SEQ ID NO: 34692 - RNA, 1614 nt, Artificial Sequence
  derived and/or modified sequence opt6 from VP1__Norovirus_and/or_Norovirus-like__EU078410
augaaaauggcaucaucugaugcaaacccaucagacggaucaaccgcaaaccuuguacccgaaguaaacaacgaagucauggcacuagaacccguugucggcgcagcuauagcagcaccaguagccggacaacaaaauguaauugacccauggauaagaaacaauuucguacaggcaccaggaggcgaauuuacaguaagcccucgaaaugcuccaggagaaauauuauggucagcaccacuaggaccagaccuaaauccauauuuaucacacuuagcacgaauguauaaugguuaugcuggcgguuucgaaguacaaaccauauuagccggaaaugcauuuacagcuggaaaaauaauuuucgcagcaguaccaccuaauuuuccaacagaaggacuaucacccagccaaguaacuauguucccacauaucauaguugacguaagacaacuagaacccguucucaucccacuacccgauguacgaaacaauuucuaucacuauaaucaaucaaaugacccaaccauaaaacuaauagcaaugcuuuacacaccauuaagagcaaacaaugcuggagacgauguauuuacaguuucaugcagaguucuuacaagaccuucaccagauuuugacuuuauauuuuuaguaccaccaacaguugaaucccgaacaaaaccuuucacuguuccuauuuuaacaguagaagaaaugucaaacucuagauuucccauaccauuagaaaaauuauauacaggaccauccagcgccuuuguaguacaaccacaaaaugguagauguacaaccgacgggguauuauuaggaacaacacaacuuagcgcaguuaacauauguacauuucguggagauguuacacacauugcuggaucucaugacuauacaaugaaccuagcuucacaaaauuggaacaauuaugacccaacugaagaaauaccagcaccuuuaggaacaccagacuuugucggcaaaauacaagguaugcuaacacaaaccacaagagaagacgguuccacuagagcacauaaagcaacaguaucaacaggaucaguacauuuuacaccaaaacucggauccguucaauacacaacagacacaaauaaugauuuccaagcaggacaaaauacaaaauucacaccagucggcguaauacaagacggaaacaaccaccaaaacgaaccccaacaauggguauuaccaaauuacucugggagaacaggacauaauguacauuuagccccagcaguagccccaacauucccaggagaacaauuacuauuuuucagaucaacuaugccuggauguucaggauacccaaauaugaacuuagacugucuauuaccacaagaauggguucaacacuucuaucaagaagcagcucccgcucaaucagauguagcuuuauuacgauucguuaaucccgauaccggaagaguauuauuugaaugcaaacuacacaaaucaggauacgucacuguagcacacaccggaccacaugaccuaguaauuccaccaaacggauacuuuagauuugauucuugggucaaccaauuuuauaccuuagcaccaaugggaaacggaacagguagaagaagauaa

SEQ ID NO: 34693 - RNA, 1614 nt, Artificial Sequence
  derived and/or modified sequence opt6 from VP1__Norovirus_and/or_Norovirus-like__AF427123
augaaaauggcauccaacgacgcaaauccaucagauggauccacagcaaaccuaguaccugaaguaaauaaugaaguaauggccuuagaacccgucguaggagcagcaaucgcagcuccaguagcuggacaacaaaauguaauagacccuuggauaagaaacaauuuuguccaagcucccggaggugaauuuacuguaucaccaagaaaugcccccggagaaauacuuuggucagcaccucuuggcccagacuuaaauccauaccuaucacauuuagcaagaauguauaacggauaugccggaggauucgaaguucaaguaauuuuagccggaaaugcauuuaccgcaggaaaaauaauauuugcagcaguaccaccaaacuuccccacugaagguuuaucaccaucacaagucacaauguucccacauaucauaguugauguccgucaauuagaaccuguauuaaucccauuaccugauguaagaaauaauuucuaucacuauaaccaauccaaugacucuacaauaaaauuaauagcaauguuauauacaccccuaagagcaaacaaugcaggagacgaugucuucacaguuucuugcagaguacuaacaagaccaucaccugacuuugauuucauauuuuuagucccaccaacaguugaaucccgaacuaaacccuuuaccguaccaauacuaacagucgaagaaaugucaaauucacgauucccaauaccacucgaaaaauuauauacaggaccaucaucagcauucguuguccaaccacaaaauggaagaugcaccacagacggaguucuauuaggaaccacacaacucucugccguaaacaucugcacauuuagaggagacguuacucauauagcaggaagucacgauuauacaaugaauuuagcaucucaaaacuggaacaacuaugacccaacagaagaaauacccgcaccacuaggaacccccgauuuuguuggaaaaauucaaggaguauuaacacaaaccacacgggaagacggaucaaccagagcucauaaggcaacaguaucaaccggaucaguacacuuuacaccuaaauuagguucaguacaauacacaacagauacaaauaauaauuuccaaacaggucaaaacacaaaauucacacccguaggcguuauacaagacggcaacaaucaucaaaaugaaccacaacaauggguauuaccaaauuauaguggacgaacaggacacaauguacacuuggcccccgcaguagccccaaccuucccaggagaacaauuacuuuucuucagauccacaaugccagguuguucaggcuacccaaauaugaacuuagacugucuacuaccacaagaauggguacaacacuuuuaucaagaagcagcuccugcacaaucagacguagcauuauuaagauuugucaacccagauacaggaagagucuuauucgaaugcaaauuacacaaaucaggauacguaacagucgcucauacagguccucacgacuuagucauacccccaaacgguuauuuucguuuugacuccugggucaaccaauucuacacauuagcacccaugggcaacggugcaggacgaagaagauaa

SEQ ID NO: 34694 - RNA, 1614 nt, Artificial Sequence
  derived and/or modified sequence opt6 from VP1__Norovirus_and/or_Norovirus-like__AY532135
augaaaauggcaucaaaugacgcaaauccaccagauggaucaacagcaaaucuaguaccagaaguaaacaacgaaguuauggcuuuagaaccaguaguaggagcagccauagcagcacccguagccggacaacaaaauauaauagaccccuggauacgaaacaauuucguacaagcacccggcggagaauuuacaguaucucccagaaacgcacccggagaaauacuauggucagcaccauuaggccccgauuuaaauccauauuuaucucacuuagcaaggauguacaacggauaugcugguggauuugaaguacaaguaauucuugccggaaaugcauucacagcaggaaaaaucauauuugcagcaguaccuccaaacuuuccaacagaaggauuaucuccaucacaaguuaccauguucccacacauuauaguagacguacgucaauuagaaccuguuuuaauaccacuacccgauguacgaaacaauuucuaucacuauaaucaaucaaaugacucaaccauaaaacuaaucgcaauguuauacacaccauuaagagcaaacaacgccggcgaugauguauucacaguaucuuguagaguuuuaacucguccaucaccugacuucgacuucauauuucuaguaccacccacaguagaaagcagaacuaaaccauuuacaguuccaauacuaacaguagaagaaaugucaaacucuagauuucccauaccucuugaaaaauuauauacagguccaucauccgcuuucguaguacaaccucaaaacggaagaugcacaacagaugguguccuuuuaggaacaacacaacuuucagcagucaacauauguacauuucguggcgauguaacacauauagcaggaucucaugauuacacaaugaacuuagcaucccaaaacuggaauaauuacgacccaacugaagaaauaccugccccuuuaggaacaccagacuuuguaggaaaaauacaaggcguuuuaacacaaacaacaagagaagaugguucaacaagagcccacaaagccacaguaucuacaggaucagugcauuuuacgcccaaacuugguucuguacaauauacaacagacacaaauaacgauuuucaaacaggacaaaacacaaaauucacgccaguaggcguaauacaagacgguaacaaucaccaaaaugaaccacaacaaugggucuuaccaaauuacucaggucgaaccggacacaauguacaucuagcacccgccguagcacccacuuucccuggcgaacaacuauuauucuucagaucuacuaugccaggaugcucaggauauccuaauaugaacuuagacugcuuauuaccacaagaauggguccaacacuucuaccaagaagccgcaccagcacaauccgacguggcauuauuacgauuuguuaacccagacacuggaagaguacuauucgaauguaaauuacacaaaucugguuacguaacagucgcccauacuggaccacaugaccugguaaucccaccaaacggauauuuccgauucgacucuuggguuaaucaauucuacacacuagcaccuauggguaauggugcaggacgacgcagauaa

SEQ ID NO: 34695 - RNA, 1614 nt, Artificial Sequence
  derived and/or modified sequence opt6 from VP1__Norovirus_and/or_Norovirus-like__AY532125
augaaaauggcaucuaaugacgcuaaccccucugacggaucaacagccaauuuaguuccagaaguaaacaaugaaguuauggcacuagaacccguaguaggcgcagcaauagcagcacccguagcuggacaacaaaauguaaucgauccauggauaagaaacaacuucguccaagcaccagguggagaguucacaguaucaccaagaaacgcaccaggagaaauacuuuggucugcaccacuaggaccugauuuaaauccauaccuaucacacuuagcuagaauguauaacggauaugcuggcggcuucgaaguacaaguaauacuagcaggaaaugcauucacagcaggaaaaguaauauucgcugcaguaccacccaauuuuccaacagaaggacuaucacccucacaaguaacaauguucccacauauaauuguugauguaagacaacuagaaccuguccucaucccacuaccagacguacgcaauaauuucuaccacuauaaccaaucaaaugauucaacuauaaaauuaauagcaauguuauauacaccucuuagagccaauaaugcaggagacgauguauuuacuguaucaugccgaguuuuaacaagaccaucaccagauuuugacuucauauuuuuagucccaccaacaguagaaagucgcacuaaaccuuucacaguaccaauacuaacaguagaagaaaugucaaacucacguuuuccaauaccauuagaaaaacuauacacaggaccaucuucagcauuuguaguucaaccacaaaaugguagauguacaacagauggaguacuacuagguacaacacaauuaucagcaguaaauauaugcacuuuuagaggcgacguaacacacauagcaggaucacaugauuacacuaugaacuuagccucacaaaacuggaauaacuacgacccaacagaagaaauaccagcaccacuaggcacaccagauuucguagguaaaauccaagguauguuaacacaaacaacaagagaagauggauccacaagagcucauaaagcaaccgucuccacaggaucuguccacuuuaccccaaaacuuggaucaguccaauacacuacugauacaaauaacgauuuccaaacaggacaaaauacuaaauuuacuccagucggaguuauacaagauggaaauaaccaccaaaacgaaccccaacaauggguccuuccaaauuauucaggcagaacaggacauaauguacaucuagcaccagccguugcuccaacuuucccaggcgaacaacuccuauucuuccgaucaacaaugccaggaugcaguggauaccccaacaugaauuuagacuguuuacuuccucaagaauggguacaacacuucuaccaagaagcagcaccagcacaaucagacguugcccuacuacgauucguaaauccagacacuggaagaguuuuauucgaauguaaacuucacaaaucuggcuauguaacaguagcacauacaggaccacaugauuuaguaauuccacccaacggcuacuuuagauuugacucauggguuaaucaauucuauacccuagcaccuaugggaaacggcgccgguagacgacgauaa

SEQ ID NO: 34696 - RNA, 1614 nt, Artificial Sequence
  derived and/or modified sequence opt6 from VP1__Norovirus_and/or_Norovirus-like__AJ277619
augaaaauggcuuccaacgaugcaaacccaucagaugguagcacagcaaacuuaguaccagaaguaaacaacgaaguuauggcacucgagccagucgucggugcagcaauagcagcaccaguugcaggacaacaaaauguaauagauccauggauacgaucuaacuuuguacaagcacccggaggagaauuuacaguaucgccuagaaaugccccaggagaaauucuauggagcgcaccauuaggucccgauuuaaauccauaccuuucgcaccuugcaagaauguauaacgguuacgccggaggccucgaaguccaaguaguauuagcagguaaugcauuuacagcaggaaaaauaauauucgcagcaguaccaccaaacuuucccacagaaggccuaucaccaucacaaguuacaauguucccucacaucaucguugacguuagacaacuagaaccaguauuaauuccacuucccgauguacguaauaauuucuaucauuacaaucaaucaaaugacucaaccauaaaauuaauagcaaugcuauacacaccauuaagagcaaaugaugcaggagacgauguuuucacaguaucauguagaguccuuacuagaccauccccagacuucgacuuuaucuuucuaguuccaccaacaguagaaucuagaaccaaaccauucacaguaccaauucuaacaguagaagaaaugucaaacucuagauuuccaauaccauuagaaaagcuauacacagguccaucuuccgccuucguaguccaaccacaaaaugguagauguacaacugacggaguucuucuaggaacuacacaauuaucugcagucaauaucuguacuuucagaggagacguaacucauauugcuggcucacaugauuacacaaugaauuuagcuucacaaaauuggaacaauuacgauccaacagaagaaaucccugcuccacuugguacaccugauuuuguaggaaaaauacaaggaaugcuaucucaaacaacaagaggugacgauucaacccgugcucacaaagcaacaguuucuacaggaucaguacauuuuacuccaaaacuaggaucuguacaauacaccacagauacaaauaacgauuucgaaacaggacaaaauacaaaauuuacaccaguuggaguuauacaagauggaaauaaucaccaaaacgaaccccaacaaugggucuuaccaaauuacucagguagaacuggacacaauguccaucuugcaccagcuguugcacccacauuccccggagaacaauuauuauucuuuagaucaacaaugccaggcugcuccggauacccaaacaugaacuuagacugucuacuaccacaagaauggguacaacauuucuaucaagaagcugcacccgcccaauccgacguagcucuauuaagauuugucaacccagacaccggacgaguauuauuugaauguaaauuacacaaaucagguuacguuacaguugcacacacaggaccacacgaucuuguaauuccaccaaacggauacuucagauuugacucauggguaaaccaauuauauacauuagcacccaugggaaacggugcagguagacgaagauaa

SEQ ID NO: 34697 - RNA, 1614 nt, Artificial Sequence
  derived and/or modified sequence opt6 from VP1__Norovirus_and/or_Norovirus-like__AF080556
augaaaauggcuucuaaugacgccaaucccucagaugguucaacagccaaccucguaccagaaguaaacaaugaaguaauggccuuagaaccugucguaggagcagcaauagcagcaccaguugcaggacaacaaaacguaauagauccauggauaagaaauaacuuuguacaagccccaggaggagaauuuacaguauccccuagaaacgccccaggagaaauauuaugguccgccccauuaggaccugaucuaaacccauaccucagucaccuagcaagaauguauaauggauacgcaggcggauuugaaguacaaguaauauuagccggcaaugcauuuacagcaggcaaaauaaucuuugccgcuguaccacccaacuuuccaacagaagguuuaucaccaucacaaguaacaauguuuccacauauuauagucgacguaagacaacuagaaccagucuuaauuccauuaccugacguacgaaacaacuuuuaccacuacaaccaaucuaaugacucuacuauaaaacucauugcuaugcuauauacaccccuaagagcaaauaaugcuggagacgacguauucacaguaucauguagaguauuaacaagaccuaguccagacuuugacuuuauauucuuaguacccccuacaguagaaucaagaacaaaaccauucacaguaccaauacuaacaguagaagaaaugucaaacaguagauucccaauaccacuagaaaaauuauacacaggccccucaucagcauuuguuguccaaccucaaaauggccgaugcacaacagauggaguauuauuaggaacuacacaauuaucagcaguaaacauuuguaccuuccgaggagacguaacacacauugcaggaucacaugauuacaccaugaauuuagcuucacaaaacuggaauaacuaugauccaacagaagaaauaccagcaccuuuaggaacaccagauuuuguaggaaaaauccaaggaauguuaacacaaacuacaagagaagauggauccacaagagcacacaaagcaacuguaucaacagguuccgugcauuucacaccuaaauuaggauccguccaauauacaaccgacaccaacaaugauuuucaagccggucaaaauacaaaauucacaccaguaggaguuauacaagauggaaauaaucaccaaaaugaaccucaacaauggguacuaccaaauuacuccggaagaacaggacacaacguucaucucgcaccagcuguugcaccuacauucccaggggaacaauuacuuuucuucagaucaacuaugccuggcugcagcggauauccaaauaugaauuuagacuguuuacucccccaagaauggguacaacacuuuuaucaagaagcagcaccagcgcaaucagacguagcuuuauuaagauucguaaauccagauacagguagaguacuauuugaaugcaaacuucacaaaucaggauacguuacagucgcacacacaggaccacacgaccucguaauaccaccaaauggauacuuuagauucgauucauggguaaaccaauuuuauacauuagcaccaauggguaauggagcaggacgaagaagauaa

SEQ ID NO: 34698 - RNA, 1614 nt, Artificial Sequence
  derived and/or modified sequence opt6 from VP1__Norovirus_and/or_Norovirus-like__AF080550
augaaaauggcauccaaugaugcaaaucccucagauggaagcacagcuaaucuaguaccugaaguuaauaaugaaguaauggcacuagaaccaguaguaggugcugccauagcagcaccaguagcaggacaacaaaacgucauugacccauggauuagaaauaauuucguacaagcaccaggcggcgaguucacaguuucaccaagaaaugcaccuggcgaaauauuauggucagcaccauuaggacccgauuuaaauccauauuuaucacaccuagccagaauguauaacggcuaugcaggcgguuuugaaguacaaguaauccuugccgguaaugcauucaccgcaggaaaaaucauauucgcugcaguaccaccaaauuucccaacagaaggacucucaccaucucaaguuaccauguuuccucacauaaucguugauguaagacaauuagaaccaguauuaaucccacucccagauguacguaauaauuuuuaucauuacaaucaaucaucugauucaacuauaaaauuaauagcuaugcuuuauaccccuuuaagagcaaacaaugcuggagacgacguauucacuguaucaugcagaguacucacuagaccauccccagacuuugacuuuaucuuuuuaguacccccuaccguugaaucaagaacaaaaccauucaccguuccaauacuaaccguagaagaaaugagcaacagucguuuuccaauaccacuagaaaaauuauauacagguccaucaagcgcauucgucguucaaccacaaaacggaagauguaccacagacggcguccuucuagguacuacacaauuaucagcuguuaauauauguaccuucagaggagacguaacucacauagccgguucacaugacuacacuaugaauuuagcaagucaaaauuggaauaauuacgacccaacagaagaaauaccagcaccucuaggaacaccagauuuuguuggaaaaauacaaggaaugcuaacacaaacaaccagagaagacgguucuacaagagcucauaaagccacagucucuaccgguucagugcacuucaccccaaaauuaggaucaguucaauacacuacagacacaaacaaugauuuucaaacuggacaaaauacaaaauuuacaccaguagguguuauacaagacggaaauaaucaucaaaaugaaccucaacaauggguacuacccaacuauagcggaagaaccggacauaacguacauuuagccccagcaguugcacccacauucccuggagaacaacuacucuucuuuagaaguacuaugccagguuguuccggcuacccaaacaugaaucuagauuguuuacuuccucaagaauggguacaacacuuuuaucaagaagcagcccccgcacaaucagauguagcauuauuaagauuuguaaacccagacacaggacguguauuauuugaaugcaaacuacauaaaucagguuacguaacaguugcucacacuggaccacaugaucuaguaauuccaccaaauggauacuuucgauucgauucauggguaaaccaauuuuacacauuagcaccaauggguaauggugcgggaagacgaagauaa

SEQ ID NO: 34699 - RNA, 1614 nt, Artificial Sequence
  derived and/or modified sequence opt6 from VP1__Norovirus_and/or_Norovirus-like__EU078407
augaaaauggcaucaaacgacgcaaaccccucagacggaucaacagcuaacuuaguucccgaaguuaauaacgaaguaauggcccuagaaccaguaguaggagcagcaauagcagcuccaguugcuggucaacaaaaugucauugacccauggauacggaauaauuucguucaagcaccaggaggagaauuuacugucaguccaagaaaugcaccaggcgaaauauuauggucagccccucuaggaccagaucuaaauccauaucuaucacacuuagcaagaauguauaauggauaugcaggagguuucgaaguacaaguaauucuugcaggcaaugcauucaccgcaggaaaaauaauuuuugccgcagucccaccaaacuucccaaccgaaggacuaaguccaucacaagucacaauguuuccucauauuauaguugauguuagacaacuagaaccuguauugauaccauuaccagacguacguaauaauuuuuaucacuauaaucaaucaaaugauucuacaauaaaauuaauagcaaugcuauacaccccacuaagagcaaacaacgccggugacgauguauuuacagucagcugcagaguuuuaacacgaccuucaccugacuucgacuuuauuuuucuugucccaccaacaguagaaucaagaacaaaaccauucaccgucccuauauuaaccguagaagaaaugucaaacucaagauuuccaauuccauuagaaaaauuauauacaggaccaucuucagcauucguaguacaaccacaaaauggaagaugcacaacagacggaguauuauuaggaacaacacaauuaucugcaguuaauauaugcacuuuucgaggugacguaacacauauagcaggaucacaugauuacacaaugaaccuagcaucccaaaauuggaauaacuacgacccaacagaagaaaucccagcaccauuagguacaccagacuuuguagggaaaauucaagguaugcuaacccaaacaacaaggggagauggaucaacacgagcccacaaagcaaccguuucuacaggcucaguccauuuuacuccaaaauuaggaucaguacaauuuacaacugacacuaacaacgauuuccaaacgggacaaaauacaaaauuuacaccagucggagucauucaagacggagacaaucaccaaaacgaaccucaacaaugggucuuaccaaacuacucagguagaacaggacacaacguacauuuagcacccgcaguugcaccaacauucccaggagaacaacuucuauucuuuagaucaacaaugcccggauguucagguuacccaaacaugaauuuagacugcuuacuaccacaagaauggguacaacacuuuuaccaagaagccgcaccagcacaauccgauguagcauuauuaagauuugucaacccagacacaggaagaguuuuauuugaaugcaaauuacacaaaucagguuacguaacagucgcacacacaggcccacacgauuuagucauaccucccaacggauauuuucguuuugacucaugggucaaucaauuuuauacacuagcaccuaugggaaacggaacuggcagaagaagauaa

SEQ ID NO: 34700 - RNA, 1614 nt, Artificial Sequence
  derived and/or modified sequence opt6 from VP1__Norovirus_and/or_Norovirus-like__AB083781
augaaaauggcuuccaaugaugcaaauccauccgacggaucaacagcuaaccuuguaccugaaguaaacaacgaaguaauggcauuagaaccaguagucggugcagccauagcugcuccaguagcuggacaacaaaauguaaucgauccuuggauaagaucaaauuucguacaagcaccaggaggugaauuuacuguaucacccagaaaugcaccaggagaaauauuauggucagcaccuuuaggaccagacuuaaacccuuaucuaucucaccuagcaagaauguacaauggauacgcaggagguuucgaaguacaaguuauacuagcaggaaaugcuuucacagcaggaaaaaucauauuugcugcaguaccucccaauuuccccacagaaggacuaaguccaucacaaguaacuauguuuccacauauaaucguagacguaagacaauuagaaccaguucuaauuccacuuccagauguaagaaauaauuuuuaccacuauaaccaaaguaaugacaguacaauuaaauuaauagccauguuauauacaccacuuagagcaaauaaugcaggagacgacguauucacaguaaguuguagaguauuaacuagaccaucuccagauuucgacuucauauuucucguuccuccaaccguagaaucaagaacuaaaccauuuacuguacccauauuaacaguugaagaaauguccaauuccagauuuccaauaccauuagaaaaauuauauaccgguccauccucagccuucguaguacaaccacaaaacggaagauguaccacagacggaguauuacuaggaaccacacaacucucugcaguaaauauaugcacacuacguggagacguaacucacauagcuggaucacaugacuacacaaugaaccuugcuucacaaaacuggaauaauuacgauccaacagaagaaauaccagcaccacuaggaaccccagacuucguaggcaaaauacaaggcauguuaucucaaacaacaagaggagacggaucuacacgagcccauaaagcaacuguauccacaggaucaguccacuuuacacccaaacuuggcaguguacaauacacaacagacacaaauaaugauuuugaaacaggacaaaauaccaaauucacaccugucggaguaauacaagauggaaauaaccaccaaaacgaaccgcaacaauggguacuacccaacuacucuggaagaaccggccacaauguucaucuagcaccagcaguagcccccacauucccaggagaacaacuacuauuuuucagaagcacaaugcccggcuguucagguuacccaaacaugaaccuugacuguuuacuuccacaagaauggguucaacacuucuaccaagaagcugcacccgcccaaucagauguagcauuacuccgauuuguaaauccugacacaggaaggguacuuuucgaaugcaaacuacauaaauccggauacguaacaguagcucacacaggcccacacgaucuaguaauuccuccaaauggcuacuuucgauuugauucauggguaaaucaauucuauacauuagcaccuaugggaaacggagcaggaagaagaagauaa

SEQ ID NO: 34701 - RNA, 1614 nt, Artificial Sequence
  derived and/or modified sequence opt6 from VP1__Norovirus_and/or_Norovirus-like__AF427122
augaaaauggcuucaaacgaugcuaauccaucagacggcucaacagcaaacuuagucccagaaguuaacaacgaaguaauggcacucgaaccuguaguaggagcagcaauugcagcaccuguagcaggccaacaaaaugucauagauccauggauacgaaauaacuuuguacaagcuccaggaggagaauuuacaguaucaccaagaaacgcaccaggagaaauacuauggucagcaccacuaggacccgauuuaaaccccuaucuaucacaccuagcucgaauguauaaugguuacgcaggaggauuugaaguacaaguaauuuuagccggaaaugccuucacugcaggaaaaauaauauucgccgccgucccaccaaacuuuccaaccgaaggacuaucuccaucacaaguaacaauguucccacauauuauaguagacguaagacagcuugaaccaguauuaaucccauuaccagaugucagaaauaacuucuaucacuauaaccaaaguaaugacucaacaauuaaauuaauugcaaugcuuuacacuccuuuaagagcaaacaaugcaggcgaugauguauuuacaguaucauguagaguacuaacacgaccaaguccagacuuugacuucauauucuuaguuccaccaacaguugaaucaagaacaaaaccuuucacaguaccaauacuaacaguagaagaaaugucaaauucaagauucccaaucccucucgaaaaacuauauacaggcccaucauccgcuuuugucguucaaccacaaaacggcagauguacaacagacggaguauuacucggaacaacaagacuaucggcaguaaauauauguacauuucgaggagauguaacacauauagcaggaucaagagauuacaccaugaauuuagcaucccaaaacuggaacaauuacgauccaacagaagaaauaccagcaccauuaggaacaccagacuucguuggaaaaauucaaggaguauuaacacaaaccaccagagaagauggaucaacaagagcacauaaagcaacaguaaguacaggaucaguacacuuuacaccuaaacuaggcucgguucaauacacaacagacacaaauaacgauuuucaaacaggacaaaacacaaaauucacuccuguaggaguaauacaagauggaaauaaccaucaaaacgaaccacaacaauggguauuacccaauuauucuggacgaacuggccacaacguccaccuagcuccugcagucgcaccaacauuuccuggugaacaauuacuauucuuucguucaaccaugccaggaugcuccggauauccaaauaugaaccuugacugccuacuaccacaagaauggguacaacauuuuuaccaagaagcagccccugcacaauccgauguagcacuauuacguuuuguaaaccccgauacaggaagaguacuauuugaauguaaauuacacaaaucagguuauguuacaguugcacauaccggaccacaugauuuaguaauaccaccaaaugguuacuuuagauuugauucuuggguaaaccaauucuauacauuagcgccuaugggaaauggcguaggaagaagaagauaa

SEQ ID NO: 34702 - RNA, 1614 nt, Artificial Sequence
  derived and/or modified sequence opt6 from VP1__Norovirus_and/or_Norovirus-like__AY532133
augaaaauggcauccaaugaugccaacccaucagacggaucuacagcaaacuuaguaccugaaguaaacaacgaaguaauggccuuagaaccaguugucggcgcagcaauagcagcaccaguugcaggacaacaaaaugucauagauccuuggauaagaaauaacuucguucaagcaccaggaggagaauuuacaguuucaccccgcaaugcaccaggagaaauacuaugguccgccccacuuucaccagauuuaaauccauacuuaucacaucuagccagaauguacaauggauacgcaggagguuucgaaguacaaguaauacuagcaggaaaugcauuuacagcuggaaaaauaauauuugccgcuguaccuccaaacuuuccaacagaaggcuuaucaccaucucaaguaacaauguucccacauauaaucguugauguaagacaacuagaaccaguauuaauaccacuacccgacguucgaaauaacuucuaccacuacaaucaaucaaaugacucaacaaucaaauuaauagcuaugcuuuauaccccucuccgagcaaauaaugccggcgacgauguauucaccguaucaugucgaguacuaacaagaccuucuccagacuuugacuucauauuuuuaguaccacccaccguugaaucucgaauaaaaccauucaccgucccaauauuaacuguagaagaaaugagcaacucucguuuuccaauaccauuagaaaaacuauauacaggaccaucaucagcauucguaguacaaccccaaaacgguagaugcacuacagacggagucuuauuaggcacaacucaauuaucugcaguaaauauuuguacauuuagaggugauguaacucacauagcaggaucccacgauuacacaaugaaccucgcaucacaaaauuggaauaauuacgauccaacugaagaaauaccagccccacuagguacaccagacuucgucggaaaaauacaaggaauguuaacacaaacaacaagagaagacggaucaacuagagcacauaaagcaacaguuuccaccggaucaguacauuucacaccuaaacuaggauccguacaauacacaacagacaccaauaacgauuuccaaacaggucaaaacacaaaguucacuccaguaggagucauccaagauggcaacaaucaucaaaacgaaccacaacaauggguacuacccaauuacuccgguagaacuggacacaacguacaucuugcaccagcaguagcuccaacuuucccaggagaacaacuucuuuucuuucgcucaacaaugcccggauguucaggcuauccuaacaugaauuuagacuguuuacucccacaagaauggguucaacauuuuuaucaagaagcugcacccgcacaaucagauguagcauuauuaagauuuguaaauccagauacaggacgaguacuauuugaaugcaaacuacauaaaucaggauacguaacaguugcacauaccggaccacaugaccuaguaaucccucccaauggcuacuuuagauucgauucauggguaaaucaauucuacacauuagccccuaugggaaauggagcgggaagaagacgauaa

SEQ ID NO: 34703 - RNA, 1614 nt, Artificial Sequence
  derived and/or modified sequence opt6 from VP1__Norovirus_and/or_Norovirus-like__AY532131
augaaaauggcaucaaaugaugcaaacccaagugaugguaguacagcaaacuuaguacccgaaguuaauaaugaaguaauggcucuagaaccaguaguaggugccgcuauugcagcccccguagcuggacaacaaaacauaauagacccauggauaagaaauaacuucguacaagcaccaggaggagaauuuacagucucacccagaaaugcaccaggcgaaauacuaugguccgcaccauuaggcccagacuuaaauccauaucuaucacauuuagccagaguauauaacggauaugcuggugguuucgaaguacaaguuauauuagcaggaaacgcauucaccgcuggaaaaaucauuuucgcagcaguacccccuaauuuuccaaccgaaggacuaaguccaucacaaguaacaauguucccccauauaauagucgacguuagacaacuagaaccaguucuaauaccacuaccagauguaagaaacaauuuuuaucacuacaaccaaucaaaugacucaaccauuaaacuaauagcuaugcucuacacaccucuaagagcuaacaaugcuggugaugauguauuuacaguauccugcagaguacuaacaagacccucaccagacuucgacuucauauuccuuguaccucccacaguagaaucaagaacaaaaccauucaccguaccaauacuaacagucgaagaaauguccaacucaagauuuccaauuccacuagaaaaauuauacacagguccaucaucugcauuuguaguacaaccacaaaauggaagauguacaacagaugguguucuauuaggaacaacacaauuaucagcaguaaacaucuguacauuuagaggagacguuacacacauagcaggaucccacgacuauacaaugaauuuagcuucacaaaacuggaauaauuaugaucccacagaagaaauaccagcaccucuaggaacaccagacuucguagggaaaauacaaggaauguuaacacaaacaacucgagaagacggaucaacaagagcacacaaagcaaccguauccaccggaagcguacacuucacaccaaaacuaggcuccguacaauauacaacagauacaaauaacgauuuucaaacaggccaaaauacuaaauuuacaccaguaggcguaauacaagacgguaacaaccaccaaaaugaaccacaacaauggguauuaccauccuacucaggcagaaccggccacaauguacacuuagcaccagccguugcaccaacauuuccgggugaacaacuauuauuuuuccgaucaacuaugccuggauguucagguuauccuaacaugaaucuagacuguuuauuaccccaagaauggguucaacacuucuaucaggaagcugcacccgcacaaucagacguagcacuacuuagauucguaaauccugauacaggaagaguauuauuugaaugcaaauuacacaaaucaggauacgucacaguagcacauacaggaccacaugacuuaguaauaccaccuaacggauacuuuagauuugacucaugggucaaucaauucuauacucuagcaccaauggguaacggagccggacguagaagauaa

SEQ ID NO: 34704 - RNA, 1614 nt, Artificial Sequence
  derived and/or modified sequence opt6 from VP1__Norovirus_and/or_Norovirus-like__AY532121
augaaaauggcaucuaacgacgccaauccauccgaugguucuacugcaaacuuaguaccugaagucaauaaugaaguaauggcauuagaaccugucguaggcgccgcuauagcagccccaguugcaggacaacaaaauguaaucgacccauggauucgcaauaacuuuguacaagcaccuggaggagaauuuacaguaucucccagaaaugcaccuggcgaaauauuauggucagccccauuaggacccgacuuaaauccauauuuaagccaucuagcacgaauguacaauggauacgcaggaggcuucgaaguacaaguaauacuugcagguaaugcauucacagccggaaaaguuauuuucgcagcaguaccuccaaacuuuccuacagaaggacuaucaccaucccaagucacaauguuuccucacauaauaguugacguaagacaacuagaaccuguccuaauaccacucccugauguuagaaauaauuuuuaccauuacaaccaauccaacgauucaacaauuaaauuaaucgcaaugcuauauacaccuuuaagagcaaauaacgcaggagaugacguauuuacaguaucauguagaguacucaccaggccauccccagauuuugacuuuauauucuuagucccaccaacuguagaauccagaacaaaaccauucacaguaccaauauuaacaguagaagaaaugucaaacucaagauuucccauaccauuagaaaaauuauacacagguccuucaucagccuuuguuguacaaccacaaaauggccgcuguacuaccgacggaguccuauuagguacaacacaacuaucagcaguaaauauaugcaccuuccgaggagaugucacccauauagccggaucacaugauuauacuaugaauuuagcuucacaaaacuggaauaacuacgacccuacugaagaaaucccagccccacuuggaaccccagauuucguaggaaaaauacaaggaacacucacacaaacaacaagagaagauggaucaacaagagcacauaaagccacuguuucaaccggaucaguacauuucacaccuaaauuaggaucaguccaauacacaacagauacaaacaaugacuuccaaacaggucaaaacacuaaauucacccccgucggugucauccaagauggaaauaaucaccaaaacgaaccucaacaauggguacucccaaauuauucaggaagaacaggacauaauguucacuuagcacccgcuguugccccaacauucccuggagaacaauuacuauuuuuccgaucuacaaugccaggcuguucaggcuauccaaauaugaaccuagauugccuacuaccacaagaauggguacaacauuucuaccaagaagcagccccugcacaauccgacguagcacuucucagauucguaaauccagauacaggacgaguacuauucgaauguaaacuacacaaauccggcuauguaacugucgcacacacaggaccacaugaccuagucauaccaccaaauggauauuuuagauucgauucauggauuaaccaauucuacacuuuagcaccuaugggcaauggagccggccgaagaagauaa

SEQ ID NO: 34705 - RNA, 1614 nt, Artificial Sequence
  derived and/or modified sequence opt6 from VP1__Norovirus_and/or_Norovirus-like__AY532115
augaaaauggcaucaaaugacgcaaauccaucagacggcagcacagcuaaccuaguaccagaaguaaauaaugaaguaauggcccuagaaccaguaguaggugcugcaauagcagcaccaguagccggucaacaaaaugucauagauccauggauaagaaacaacuuuguacaagcaccaggaggcgaauuuaccguauccccacguaaugcaccuggagaaauacuauggucugccccauuaggaccagaucuaaauccauauuuaucacauuuagcucgaauguauaacgguuacgcaggcgguuucgauguacaaguaauacuagcaggcaacgcauuuacugccgguaaaauaauauuugcugccguaccaccaaauuuuccuacugaaggacucucaccuucccaaguaacaauguuuccacacauaauagucgacguaagacaauuagaaccuguuuuaauaccacuaccagauguaagaaacaacuucuaucacuauaaccaaucaaacgacucaacaauaaaacuaauagcaaugcuuuacacaccacuaagagccaacaacgcaggcgaugauguauuuacaguaucauguagaguccuaaccagaccaucacccgacuucgacuuuauauuccuagucccucccacaguagaaucuagaacaaaaccauucacagucccaauauuaacaguugaagaaaugucuaauucaagauuuccaauaccauuagaaaaacuauauacaggcccaucaucagcauucguaguacaaccacaaaauggcagauguacaacagacggaguauuauuaggaacaacacaauuaucagcaguaaauauaugcacauuuagaggagacgucacccauauagcaggaucacacgacuacacaaugaaucuagcaucucaaaacuggaauaauuaugacccaacagaagaaauaccagcaccauuaggaacuccagauuuuguaggaaaaauacaaggaaugcuaacacagacaacaagagaagauggauccacacgagcccauaaagcaacaguaucuacaggaagcguacacuuuacaccaaaacuuggaucaguacaauauacaacagauacaaauaacgacuuucaaacaggucaaaauacuaaauucacacccgucggagucauacaagauggaaauaaucaccaaaacgaaccacaacaauggguucuaccaaauuacucaggacgaacaggacauaauguacacuuagcacccgcaguagcuccaacauucccaggagaacaacuacuauuuuucagaaguaccaugcccggauguucagguuacccaaacaugaaucuagacugccuauuaccacaagaauggguccaacacuucuaucaagaagcagccccagcucaaucagacguagcucuuuuacgcuuuguaaauccagacacaggccguguccuauuugaauguaaacuucauaaaaguggauacgucacaguagcacauacaggcccacaugauuuaguaauaccuccuaacggauauuuucgauuugauuccugggucaaccaauuuuacacauuagcaccaauggguaacggagcagguagacgcagauaa

SEQ ID NO: 34706 - RNA, 1614 nt, Artificial Sequence
  derived and/or modified sequence opt6 from VP1__Norovirus_and/or_Norovirus-like__KF806530
augaaaauggcuucuaaugaugcaucaccaagcgaugguucagcagcuaauuuaguaccagaaguaaacaacgaaguuauggcccuagaaccaguaguaggugcagcaauagccgcaccaguugcuggucaacaaaauguuauagauccauggauacgcaacaacuuuguacaagcaccaggaggagaguucacaguuucaccucgaaaugcacccggagaaauauuauggucagcaccccuugguccagaucuaaacccauaccuuucacacuuagcaagaauguauaauggauaugcuggugguuucgaaguacaaguaauauuagcaggaaaugcauucacagcuggaaaaauaauauuugcagcaguaccaccaaauuuuccaacagaaggauuaucccccagccaaguaacaauguuuccacacauaguaguugauguacgacaacuagaaccaguuuuaauuccacucccagauguucgaaauaauuucuaucacuacaaccaaucuaaagauccuacaauuaaacugauagcaaugcucuacaccccacuacgcgcaaauaaugcuggagaagacgucuuuacuguaucaugucguguccuaacaagaccaucaccagacuuugauuucauauuucucgucccaccuacaguagaauccagaucaaaaccauucacaguaccaauucuaacaguagaagaaaugacaaauagcagauucccaauaccucuagaaaaacuauucacaggacccagcggagcauuuguaguccaaccucaaaauggaagauguacaacugauggaguauuauuaggaacuacacaacucucuccaguaaauauaugcacauuccgaggugaucuaacacacuuugcaggaacacacgaauaugcuaugaacuuagcaucacaaaauuggaauaauuacgauccuacugaagaaauaccagcaccauuaggagcacccgacuuuguaggaaaaauaagaggaguucuaacacaaacaacuagacgagauggcagcacucgaggucaucgagcaacauuaucaacaggaucagcacacuucacaccaaaacuuggaucgauaagauuuucuacagauacaaauaacgauuuugaagcaggacagaacacaaaauuuacuccaguaggaguauuucaagacggagauaaucaucaaaaugaaccacaacaauggguucuacccaauuauucaggagcuacagcccauaauguacaucuagccccugcaguagcacccgccuuuccaggagaacaauuauuauuuuucagaucaacaaugccaggaugcucagguuaucccaauaugaauuuagauuguuuauuaccccaagaauggguucaacacuuuuaucaagaagcugcaccagcacaaucugauguagccuuacuaagauucguaaauccagauacaucaagaguccuauuugaauguaaacuucauaaaucuggauauguaaccguugcacauacaggucaacaugacuuaguaauaccaccaaauggauacuuccguuuugauaguuggguaaaucaauucuauacacucgcaccuaugggaaauggaacuggaagacgacgauaa

SEQ ID NO: 34707 - RNA, 1614 nt, Artificial Sequence
  derived and/or modified sequence opt6 from VP1__Norovirus_and/or_Norovirus-like__KF806513
augaaaauggcaucuaacgaugccuccccaucagauggauccgcagcaaauuuaguaccagaaguauccaaugaaguuauggccuuagaaccuguaguaggagcagcaauagccgcaccaguggcaggucaacaaaaugucaucgauccuuggauaagaaauaacuucguacaagcaccaggaggagaauuuaccgucucaccaagaaaugcaccaggagaaauacuauggucagcuccauuaggaccagauuuaaaucccuaccuaucacauuuagcuagaauguacaauggauaugcuggaggauuugaaguacaaguaauuuuagcaggaaaugccuucaccgccgguaaaauaauuuuugcagcuguaccaccuaacuuuccaaccgaaggauuaagucccucacaaguaacuauguucccacauauaguaguagauguacgacaacuagaaccaguucuuauacccuuaccagauguaagaaauaauuuuuaccacuauaaucaaagcaaagacccuacaauaaaauuaauagccauguuauacacaccauuaagagcuaacaacgcuggcgaagauguauuuacuguuucauguagagugcuaacacgaccaucaccugauuuugauuuuaucuucuuagucccuccaacuguagaauccagauccaaaccauucacaguacccauacuaacagucgaagaaaugacaaacagucgauuuccaauaccuuuagaaaaauuauuuacuggacccuccggagcauucguuguacaaccacaaaauggaagaugcacuacagauggaguauuacuaggaacuacacaauuaucaccagucaacauuuguacuuuucgcggagacuuaacucauuuuacuggcacuucagaauaugcuaugaacuuagcaucacaaaacuggaauaacuacgacccuacugaagaaauaccagcaccauuaggagcaccagauuucguaggaaaaauacguggaauguugacacaaacaacaagaagagaugguuccacaagaggacaucgagcaacacuaucaacaggaucugcacauuucacaccaaaauuagguucuauaagauuuucuacugauacaaacaaugauuucgaagccucacaaaauacaaaauuuacaccuguaggcgucuuucaagaaggugauaaucaucaaaacgaaccacaacaauggguacuaccaaacuauuccggcgcuacugcacacaacguccauuuagccccagccguugcaccagcuuuuccaggagaacaauuacuauucuuuagauccacaaugccaggaugugguggauauccaaauaugaaucuagauuguuuacuuccacaagaauggguacaacacuuuuaucaagaagcugcaccagcacaaagcgauguagcccucuuacgauucguaaauccagauacaucaagaguccuauucgaaugcaaacuacauaaaucaggauauguaaccguagcacauacaggacaacaugaucuaguuauaccacccaauggauauuucagauucgauucuugggucaaccaauucuauacccuagcaccaauggguaauggcacagguagacgcagauaa

SEQ ID NO: 34708 - RNA, 1614 nt, Artificial Sequence
  derived and/or modified sequence opt6 from VP1__Norovirus_and/or_Norovirus-like__AY741811
augaaaauggcaucaaaugaugcuaaucccucugacggaucaacagcaaaucucguaccugaaguaaacaacgaaguaauggcauuggaacccgucgucggagcagcaauagccgcacccguagccggacaacaaaauguuauagauccuuggauaagaaauaauuucguucaagcuccaggcggagaauuuacaguaucaccuagaaaugcaccuggugaaauacuuuggucugcaccacuaggaccagaccuaaauccauauuuaagucaucuagcaagaauguauaaugguuaugcaggagguuuugaaguacaaguaauucuugcaggaaaugcauucaccgcaggaaaagugauauucgcugccguucccccaaauuuuccaacagaaggacucucaccaucacaaguaacaauguuuccccauaucauaguugauguaagacaacuagaaccuguucucauaccacuaccagauguaagaaacaauuucuaucacuacaaucaaucaaaugauucaacaauaaaauuaauagcaauguuauauacaccacucaaagcaaauaaugccggagaugauguauuuacaguaucuugcagaguacuaacaagaccuucaccugacuuugacuuuauauuucuuguaccaccaacaguagaaucaagaacaaaaccuuuuacaguuccaauacuuacaguagaagaaaugucaaacucaagauucccaauaccauuagaaaaacuauauacaggaccaucaucagcauuuguaguacaaccacaaaacggcagaugcacaacugacgguguauuacucggaacaacccaacuauccgcgguaaacauauguacuuuuagaggagauguuacccauauagcagguagccaugacuauacuaugaaucuagcaucccagaauuggaacaacuacgacccaacagaagaaauaccagcuccauuaggaacaccagacuucguaggaaaaauccaaggaaugcuuacacaaaccacaagagaagacggaucaacaagagcucauaaagccacuguuucuacaggaucaguacauuucacacccaaauuaggaucuguucaauauaccacagacacaaacaacgauuuccaaacaggacaaaauacuaaauuuacaccaguagguguaauccaagacgguaacaaucaccaaaacgaaccacaacaauggguauuaccaaauuacucagguagaacaggacacaauguacacuuggcaccagcagucgcuccaacuuuuccaggagaacaauuacucuucuuuagaagcacuaugccaggauguucaggauauccaaauaugaaccuugacuguuuacucccacaagaauggguucaacacuuuuaucaagaagcagcacccgcacaauccgacguagcauuauuaagauuuguaaaucccgacacaggccgaguacuauucgaauguaaacuacacaaauccggauauguaaccguagcccauacaggcccccacgaccuaguuaucccaccaaacggauauuuccgauuugacucuugggucaaccaauucuacacauuagcaccuaugggcaacggagcaggccgacgaagauaa

SEQ ID NO: 34709 - RNA, 1614 nt, Artificial Sequence
  derived and/or modified sequence opt6 from VP1__Norovirus_and/or_Norovirus-like__AY532122
augaaaauggcauccaaugacgcaaauccauccgacggcuccacagcuaauuuaguacccgaaguuaauaacgaaguaauggcccuagaacccguaguuggagcagcuauagccgcacccguagcaggacaacaaaacguaauagaccccuggauaagaaauaauuuuguacaagcaccaggaggagaauuuacuguaucaccaagaaaugcaccaggagaaauauuauggucugcaccacuaggaccagaccuaaauccauaccucucacaccuugcccgaauguauaacgguuacgccgguggauucgaaguucaaguaauauuagcaggaaacgcauucaccgcaggaaaaguuauauuugcagcaguuccuccaaauuucccaacugaaggcuuaucaccaucacaagucacaauguucccacauauaaucguagacguccgucaauuagaaccuguucucauaccuuuacccgauguaagaaauaacuucuaccacuacaaucaaucaaaugacaguaccaucaaacuaauagcuaugcuauauacucccuuacgcgcaaauaaugcuggugaugauguauucacaguuucaugcagaguauuaacaaggcccucuccagacuucgauuuuauuuucuuaguaccaccaacaguagaaucaagaacaaaaccauuuacaguuccaauauuaacaguagaagaaaugucaaauucaagauucccuauuccauuagaaaaacuauauacaggaccuucaucagcauuuguaguacaaccccaaaaugguagaugcacaacugacggcguacuauuaggaacaacccaacucucagcaguaaacauauguacauuuggaggugacguaacacauauagcuggaagccacgauuacaccaugaaucuagcaucacaaaacuggaauaauuacgauccaacagaagaaauaccagcuccacuaggaacuccagauuucguagguaaaauccaaggaaugcuaacccaaacaacuagagaagauggcucaacacgagcucacaaagccacaguaucaacagguuccguccauuucacuccaaaauuaggaaguguucaauacacuacugacacgaacaaugauuuucaaaccggacaaaauacaaaauucacuccuguuggaguuauacaagacggcgauaaccaccaaaaugaaccacaacaaugggucuuaccaaauuacucaggaagaacuggacauaauguacaucuagccccagcaguugcaccaacauuuccaggagaacaacuacuauuuuucagaucaacaaugccuggauguucaggauauccuaacaugaaucuagauugccuauuaccacaagaauggguucaacauuucuaucaagaagccgcucccgcacaaagugaugucgcacuacuaagauucguaaauccagacacaggaagaguacuauuugaaugcaaacuacauaaauccggauacguaaccgucgcacauacagguccacacgacuuaguuauaccaccaaauggcuauuucagauuugauaguugggucaaucaauuuuauacacuagcucccaugggaaacggagcaggcagaagaagauaa

SEQ ID NO: 34710 - RNA, 1614 nt, Artificial Sequence
  derived and/or modified sequence opt6 from VP1__Norovirus_and/or_Norovirus-like__AY532120
augaaaauggccucaaacgacgccaauccuuccgacggaucuacagccaaccuaguaccugaagucaacaaugaaguaauggcuuuagaacccguaguuggagcagcaauagcagcaccaguagccggucaacaaaauauaauagacccauggaucagaaauaacuuuguacaagcaccaggaggagaauuuacagucuccccaaggaacgcaccaggagaaaucuuauggucagcaccuuuaggaccagaucuaaauccauaucuaucucacuuagcaagaauguauaacggauaugccggaggcuucgaaguacaaguuauccuagcugguaaugcauucaccgcuggcaaaauaauuuucgcagcuguaccaccuaauuuucccacugaaggauuaagcccaucacaaguaacaauguucccacauauaauaguagauguacgacaauuagaaccagucuuaaucccacuuccagacguucgaaauucauuuuaccacuauaaccaaucuaaugauuccaccauaaaauuaauagcaauguuauauacaccacuaagagcaaacaacgcaggagaugauguauucacugucucaugcagaguacuaacaagaccaucuccagauuucgacuuuauauuuuuaguaccucccacaguagaaucaagaacuaaaccauucacaguaccaauuuuaacaguagaagaaaugucuaauucuagauuccccauaccacuagaaaaauuauauaccggaccaucaucagcuuucguaguacaaccacaaaauggccgcugcaccacagauggaguccuacucggaaccacacaauuaucagcagucaauaucuguacuuucagaggugacguaacucacauagcaggaucccacgauuacacaaugaacuuagccucacaaaacuggaauaauuaugacccaacugaagaaauaccugcaccccucggaacccccgauuuuguaggaaaaauucaaggcaugcuaacacaaacaacuagagaagacggcuccacuagagcucacaaagcaacaguaucuacaggaucaguacacuucacaccaaaacucggaucuguacaauacacuacagacacaaauucggauuuucaaacaggacaaaauaccaaauucacuccuguaggaguaauccaagacggaaacaaccaucaaaacgaaccucaacaauggguuuuaccaaauuauucaggaggcacaggccacaacguccaucuagccccagcaguugcaccaacuuuuccaggugaacaauuacuauuuuuccgaucuacaaugccaggcugcucaggauacccuaauaugaaccucgacuguuacuccccacaagaauggguacaacauuuuuaccaagaagcagcacccgcccaauccgauguagcucuacuaagauuugucaaucccgauacgggccgaguuuuauuugaaugcaaacuacacaaaucaggauacguaaccguagcacacacuggaccucaugaucuaguaauuccaccaaacggcuacuucagauucgauucauggguuaaccaauucuauaccuuagcaccaauggguaacggagcaggaagacgacgauaa

SEQ ID NO: 34711 - RNA, 1614 nt, Artificial Sequence
  derived and/or modified sequence opt6 from VP1__Norovirus_and/or_Norovirus-like__AY532111
augaaaauggcaucaaaugaugccaacccaucugaugguucaacagccaaccuuguaccugaagucaauaacgaaguaauggcacucgaaccuguaguaggagcagcuauagcugcaccaguagcaggacaacaaaauguaauagauccauggauaagaaacaacuuuguacaagccccaggaggagaguuuacaguaucaccuagaaaugccccaggcgaaauacuuuggucugcaccauuaagcccagacuuaaauccauaccuaucacacuuagcaagaauguauaauggcuacgcaggaggauuugaaguucaaguaauauuagcaggaaaugcauuuacagccggcaaaauaaucuucgcugccguaccacccaauuuuccuaccgagggucuaucuccaucacaaguaaccauguuuccucauauaauaguagacguaagacaauuagaaccaguauuaauaccacuaccagacguaagaaacaauuucuaccauuacaaucaaucaaacgacucaacaauaaaacuaauagcaaugcuauauacaccauuaagagcaaauaacgcaggagaugauguauucacuguaucuugcagaguucuaaccagaccuuccccagacuucgacuucauauuuuuaguacccccuaccguagaaucacguaccaaacccuuuacagucccaauuuuaacaguagaagaaaugucuaauucaagauucccuauaccacuagaaaaacucuauacagguccaagcucagcuuuugucguucaaccacaaaacggaagaugcacuacagauggcguuuuauuaggaacaacucaacucucagcuguaaacauaugcacauuuagaggagacguaacacacauagcugguagccacgacuacacuaugaaccuagccagucaaaacuggaacaauuacgauccaacagaagaaauacccgcaccacuaggaacaccagauuuuguaggcaaaauacaaggaaugcuaacccaaacaacaagagaagauggaucaacuagagcacacaaagcaacaguauccaccgguucaguucacuucacaccuaaacuaggaucuguacaauacacaacagauaccaacaacgacuuccaaacaggacaaaauaccaaauucacaccuguaggaguuauacaagaugguaacaaccaucaaaaugaaccacaacaauggguacuaccaaauuacuccggcagaacaggacacaauguucacuuagcgccagccguagcaccaacauuuccaggagaacaacuucuauucuuccgaucaacaaugccuggauguuccgguuacccaaauaugaaucuagacugcuuacuaccacaagaauggguacaacacuuuuaucaagaagcugcacccgcacaaucugauguagcacuuuuacgcuuuguuaauccugacaccggaagaguacuauuugaaugcaaacuacacaaaucaggauauguuacaguagcacauacuggaccucaugacuuaguaauaccaccaaauggauacuucagauucgauucuuggguaaaccaaguauauacacuagccccaauggguaauggagcuggaagaagaagauaa

SEQ ID NO: 34712 - RNA, 1614 nt, Artificial Sequence
  derived and/or modified sequence opt6 from VP1__Norovirus_and/or_Norovirus-like__AF080558
augaaaauggcaucaaacgaugcaaauccaucugauggaucaacagccaaccuaguuccagaaguuaacaacgaaguuauggcauuagaaccaguaguuggagcagcuauugcagcaccaguagcaggacaacaaaauguuauagauccauggauacgaaauaacuucguacaagcaccaggaggagaauuuacagucucaccaagaaaugccccuggcgaaauauuauggucagcaccuuuaggaccagaccuaaauccauaccuuagccaucuugcaagaauguauaauggauacgcaggaggauuugaaguccaaguaauacuagcaggcaaugcauucacagcaggcaaaauuauauucgcugcaguaccaccuaauuucccaacagaaggguuaucaccaucacaaguaacuauguuuccacacauaauaguagauguuagacaauuagaaccaguuuuaaucccauuaccagacguaagaaacaauuucuaucauuacaaucaaucaaacgauucaacaauaaagcuaauagcaaugcuauauacccccuuaagagcaaauaacgcuggagacgauguauucacuguaucauguagaguacuuacaagaccauccccagacuuugauuucaucuucuuaguuccaccaacaguugaaucuagaacaaaaccauuuaccguaccaauacuaacagucgaagaaaugucuaacucuagauuucccauuccacuagaaaaacuauauacaggucccucaucugcauucguaguacaaccacaaaacgguagaugcacaacagacggaguauuauuaggaacuacacaauuaucagcuguuaacauauguacauucagaggagacguaacacacauagcaggcagucacgauuauacaaugaauuuagcaucccaaaauuggaacaacuacgacccaacagaagaaauaccagcaccacuaggaacaccagacuuuguaggaaaaauacaggguauguuaacccaaacaacuagaggagacggaucuacacgagcucauaaagcaacuguaucaacaggauccguacacuucacaccaaaacuuggcucuguucaauucacaacagacacaaacaacgauuuccaaacaggccaaaacacaaaauuuacaccaguaggagucacacaagacggagauaaucaccaaaacgaaccacaacaauggguauuaccaaauuacaguggcagaacaggacacaacguacaucuagcuccagcaguagccccaaccuucccaggagaacaacucuuauucuuuagaucaaccaugccagguugcagcggauacccaaacaugaauuuagauugcuuauuaccacaggaauggguucaacacuuuuaucaagaagcagccccagcacaaucagacgucgcucuacuaagauuuguaaauccagauacaggaaggguccuauuugaauguaaauuacauaaaucaggauauguaacaguagcacauacaggaccacacgaccucguaauuccaccaaacggauauuuucgcuuugacuccuggguaaaccaauuuuauacucucgcaccaaugggaaacggagcaggccgaagaagauaa

SEQ ID NO: 34713 - RNA, 1614 nt, Artificial Sequence
  derived and/or modified sequence opt6 from VP1__Norovirus_and/or_Norovirus-like__KF806508
augaaaauggcaucaaaugaugcaucuccauccgacggaucagcagccaaucuaguaccugaaguuuccaacgagguaauggcccuagaaccuguaguaggugcagcaauagcagcaccaguagcaggacaacaaaauguuauagacccuuggauaagaaacaauuuuguacaagccccaggaggagaauuuacagucucuccaagaaaugcucccggagaaaucuuauggucugcuccauuaggaccagauuuaaauccauacuuaucccauuuagcaagaauguauaaugguuaugcaggaggauucgaaguacaaguuauauuagcaggaaaugcauucacagcagguaaaauuauauuugcagcaguaccaccaaauuuccccacagaaggcuuaucccccucccaagucacaauguuuccucauauagucguagauguuagacaauuagaacccguccuaauacccuuaccugauguacguaauaacuucuaucauuacaaucaaucuaaagacccaaccauaaaacuuauagcaauguuguauacaccacuaagagcaaacaaugcuggugaagaugucuucacaguaucaugccgaguauuaaccagacccagcccagauuuugauuuuauauucuuaguuccaccuacaguugaaaguagaucuaaaccauucacuguaccuauacuaacaguugaagaaaugacaaauucaagauuucccauaccuuuagaaaaacuuuucaccgguccaagcggugcuuuuguuguacaaccacaaaauggccgcuguacuacagauggaguucuauuagguacaacucaacuaucaccuguaaacaucugcacauuuagaggagauuuaacucacuucacuggcacuucugaauaugcaaugaauuuagcaucacaaaauuggaauaauuacgauccaacagaagaaaucccagcaccauuaggagcaccagauuuuguaggaaaaauaagaggcaugcuaacacaaacaacaagacgagacggaucaacaagaggacaucgcgcaacacuauccacaggcucagcacacuuuacaccaaaacuaggaagcauaagauucucaacugauaccaauaacgauuucgaagcuggacaaaauacuaaauuuacucccgucggcauauuucaagaaggagauaaccaucaaaaugaaccacagcaauggguccuaccuaauuauucuggagcuacagcccauaauguacaccuagcaccagccguagcaccagccuucccuggagaacaacuuuuauucuuuagaucuacaaugcccggaugcgguggcuaccccaauaugaaccuagacugccuacuaccucaagaauggguacaacauuuuuaucaagaagcagcaccagcacaaucagauguagcucuauuacgauuugucaauccugacacaucaagaguccuauuugaauguaaauuacauaaaucaggauacguuacaguagcacauacaggacaacaugaucuuguuauuccuccaaacgguuauuucagauuugauucauggguaaaccaauucuauacgcuagccccaauggguaauggcacuggacgacgaagauaa

SEQ ID NO: 34714 - RNA, 1614 nt, Artificial Sequence
  derived and/or modified sequence opt6 from VP1__Norovirus_and/or_Norovirus-like__AF425766
augaaaauggcaucuaaugaugcuaauccuucugauggauccacagcaaauuuaguaccagaaguuaauaaugaaguaauggcauuagaaccaguaguaggagcugcaauagccgccccuguagcaggacaacaaaauguuauagacccuuggauuagaaauaacuuuauccaagcuccuggcggugaauuuaccgucucacccagaaacgcaccuggugaaauacuauggucagcaccauuagguccugauuuaaaccccuaucuaucucauuuagcaagaauguacaacggauaugcaggaggauucgaaguucaaguuauauuagcaggaaaugcuuuuacagccggaaaaauaauauuugcagcaguuccaccaaacuuucccacagaaggacuauccccaucucaaguaacaauguuuccacauauaauaguagacguacgccaauuagaaccaguauuaauaccacuaccugacguaagaaauaacuuuuaucacuacaaucaaucaaaugauuccacuauaaaauuaauagcuaugcuuuacacaccacuacgugcuaauaacgcuggagacgauguuuuuacaguuucaugucgaguauuaacccgaccuucaccagauuuugauuucauauuucugguaccaccaacaguugaauccagaacgaaaccuuuuacugucccaauacuaacaguagaagaaaugucuaacucuagauuccccauaccauuagaaaaacuauauacagguccuaguucagccuuuguaguucaaccccaaaauggacgauguacaacagacggaguacuauuagguacaacacaacuaucagccguaaacauuugcaccuucagaggagacguaacacauauagcaggaucacacgauuacacaaugaaccuagcaucccaaaacuggaauaacuaugacccaaccgaagaaauaccugcuccucuaggaacaccagacuuaguuggaaaaauacaaggaaugcuuacacaaacuacucgagaagauggaucuaccagagcucacaaagcaacaguuucuaccggaucaguacauuuuacaccuaaauuagguaguguacaauauacaacagacacuucaaaugacuuccaaaccggacaaaauacaaaauuuacuccaguaggaguuauccaagauggcaauaaccaccaaaacgaaccacaacaauggguauuaccuaauuauagcggaagaaccggucauaauguacaccuagcaccagcaguagcaccuacauuuccaggggaacaacuauuauucuucagaucaacaaugccagguuguagcggauacccaaauaugaaccucgacuguuuauuaccacaagaauggguacaacauuuuuaucaagaagcagcuccugcacaaagugauguugcacuacuaagauucgucaauccagauacuggacgaguuuuauuugaaugcaaacuucauaaaucaggauaugucacuguugcucauacaggaccccaugacuuagucauaccuccuaacggauacuuuagauucgauucauggguaaaccaauuuuauaccuuagcccccauggguaacggagcaggaagaagaagauaa

SEQ ID NO: 34715 - RNA, 1614 nt, Artificial Sequence
  derived and/or modified sequence opt6 from VP1__Norovirus_and/or_Norovirus-like__AJ583672
augaaaauggcuuccaaugacgcaaacccaucagauggaucaacagcaaaccucgucccugaaguuaacaacgaaguaauggcauuagaaccaguuguuggagcagccauagccgccccaguagcuggccaacaaaacguaauagauccauggauaagaaacaacuuuguacaagcaccagguggagaauuuacuguuuccccaagaaaugcaccuggagaaauacucuggucagcaccacucggcccagaucuaaauccauacuuaucacaucucgcaagaauguacaacggcuacgcugguggauucgaaguacaaguaauacuagcaggcaacgcauucacagcaggaaaaaccaucuucgcugcaguaccacccaacuuuccaacagaaggacuaucacccucucaaguaacaauguuuccacacauuauagucgauguacgacaaccagaaccaguauuaauaccuuuaccagauguaagaaauaauuuuuaccacuacaaucaaucaaacgaucccaccauaaaauuaauagccauguuauacacuccacucagagcaaacaaugcuggugacgaugucuuuacaguaucaugucgcguacuaacuagaccaucaccagacuucgauuucauauuucuaguaccuccaacaguagaaucccgaacuaaaccauuuacaguaccaauacuaacaguugaagaaaugaccaauaguagauucccaauaccauuagaaaaauuauucacaggcccuaguaacgcauuuguaguucaaccacaaaauggaagauguacaacugacggaguacuauuaggaacaacacaauuaagcccaguaaauauauguaccuuuagaggcgacgucacacauauugcaggcacucaugauuacacaaugaaucuagcaucucaaaauuggaauaacuaugaucccacagaagaaauaccagcaccacuaggaacaccugauuuuguaggaaaaauucaaggaguacuaucccaaacaaccagaggugauggcucgacuagaggacauaaagcaacuguuucaacaggauccguucauuucacaccaaaacuaggaucuguacaauauacuacagauacaaauaaugaccuagaagcaggacaaucaaccaaauuuacuccuguaggagucguacaagacggcaacaaucaccaaaacgaaccacaacaauggguacuuccaaacuauucaggaagaacaggacacaauguacaucuaguaccagcaguagcaccaacuuucccuggagaacaguuauuauucuuuagaucaacuaugccaggauguucaggauacccaaauaugaauuuagauuguuuacuaccccaagaauggguacaacauuuuuaccaagaagcagccccugcacaaucagauguugcacuucuucgcuucguaaaccccgauacaggaagaguacuauuugaaugcaaacuacauaaaucaggguacguaacaguagcacauaccggaccacaugauuuagucauaccacccaauggcuauuuuagauuugauucauggguaaaccaauucuacacauuagcucccaugggaaauggaacaggaagacgucgauaa

SEQ ID NO: 34716 - RNA, 1614 nt, Artificial Sequence
  derived and/or modified sequence opt6 from VP1__Norovirus_and/or_Norovirus-like__AY532119
augaaaauggcaucaucagaugccaauccaucagacgguucaaccgcaaaucuaguaccagaaguaaauaaugaaguaauggcauuagaaccagucguaggcgcagcaauagcagcaccuguagcaggacaacaaaauguaaucgaccccuggauaagaaacaacuucguccaagcaccuggaggugaauuuacaguaucaccacguaacgcaccuggcgaaaucuuaugguccgcaccacuaggaccagacuuaaaucccuaucuaagucaccuagcucgaauguacaauggauacgcaggaggauuugaaguccaaguaauuuuagcuggaaaugcauucacagcaggaaaaauaauauuugcagcaguaccaccaaacuucccaacugaaggauuaucaccuucucaaguaacaauguuuccucacauaauaguagacguaagacaacuagaacccguauuaauuccccuuccagacguaagaaacaacuucuaucauuauaaccaaucaaaugauucaacaauuaaacuuauagccauguuauacacuccccuuagggccaacaacgcaggagaugacguauuuacuguaucauguagaguucuaacuagaccauccccagauuuugauuuuauauuucuaguuccaccuacaguugaauccagaacuaaaccuuucacuguaccaauauuaacaguagaagaaaugucaaacucacgauucccaauacccuuagaaaaacuauauacagguccaucuucagccuucguuguucaaccacaaaacggcagauguaccaccgacggaguacuacuagguacaacacaacucuccgcaguaaauauuuguacauuuagaggagauguuacacacauagcuggaucucacgauuacacaaugaauuuagcaagucagaauuggaauaauuaugauccaacagaagaaauaccagcaccauuaggaacaccagacuuuguaggcaaaauacaaggaaugcucacccaaacaacaagagaagacgguucaacccgagcacacaaagcaacaguaucaacagguagcguucauuuuaccccaaaacucggcucaguacaauacacuacagauacaaauucugauuuccaaacaggacaaaauacaaaauuuacuccaguagguguaauccaagacggaaacaaucaccaaaaugaaccacaacaauggguauuacccaauuacucaggucgaacaggacauaacguacaucuagccccagcuguagcaccaacauucccaggcgaacaauuacucuucuuucgaucaacaaugccuggaugcucaggauacccaaauaugaauuuagacuguuuacuaccacaagaguggguacaacauuuuuaccaagaagcagcgccugcacaaucugauguagcauuacuaagauuugucaauccagauacaggaagaguacuauuugaguguaaauuacauaaaucaggauauguaacaguagcacacacugguccccaugacuuaguuauuccaccuaauggcuauuuuagauuugauucauggguaaaucaauuuuauacccuagcaccaaugggaaacggagcaggccguagacgauaa

SEQ ID NO: 34717 - RNA, 1614 nt, Artificial Sequence
  derived and/or modified sequence opt6 from VP1__Norovirus_and/or_Norovirus-like__AF080552
augaaaauggcaucuaaugacgcuaauccuucagauggauccacagcaaacuuaguaccagaaguuaacaaugaaguuauggccuuagaaccaguaguaggcgcagcuauugcugcaccagucgcuggacaacaaaacgucauagacccauggauucgaaacaacuuuguacaagcgccuggaggagaauuuacagucucucccagaaaugcacccggagaaauacuauggucugcaccauuaggcccagaucuaaauccauauuuaucacaucuugcacguauguauaacggauacgcaggaggauucgaaguacaaguaauucuagccgguaaugcauuuacagcaggaaaaauaauuuucgcagcaguuccacccaauuuuccaacugaaggacuaucaccaagucaaguaaccauguucccacauauaauaguagacguacgccaauuagaaccaguucuaauaccacucccagauguaagaaacaauuucuaucacuauaaucaaaguaacgacucaacaauaaaacuaauugccauguuauauacaccacuaagagcaaauaacgcaggcgacgacguuuuuaccgucucauguagaguacuaacaagaccaucaccagacuuugauuuuauauuucucguaccaccaaccgucgaaagcagaacaaaaccauuuacaguaccaauacuaacaguagaagaaaugaguaauucaagauuuccaauaccauuagaaaaacuauacacaggaccaucaucagcuuucguaguacaaccacaaaacggucgauguacaaccgacgguguauuauuaggaacaacacaacucucagcuguaaauauauguaccuuucgaggagauguaacacauauagcaggaucucaugauuauacuaugaaucuugccucacaaaacuggaauaacuaugauccuaccgaagaaauaccagcaccauuaggaacaccugacuucgucggaaaaauucaaggaaugcucacacaaacaacccgagaagauggaucaacacgugcacacaaagcaacaguaucaacggguuccguucacuuuacaccaaaacuaggaucaguacaauacacaacagauacuaacaaugacuuucaaaccggacaaaauacaaaauucacaccaguaggcguaauccaagacgguaauaaucaucaaaaugaaccccaacaauggguacuuccaaauuacucuggacguacaggccauaauguacaucucgcaccagccguagcuccaacuuuuccaggugaacaauuacuauucuuucgaucaaccaugccaggcugcagcggauacccaaacaugaaccucgauugccuacuaccacaagaauggguacaacauuuuuaccaagaagcagcucccgcgcaaucagauguagcauuauuaagauuuguaaacccagauacaggacgaguauuauuugaauguaaacuucacaaaucaggcuacguaacaguugcccacacaggaccacaugauuuaguaauaccuccaucagguuauuucagauuugauucuuggguaaaucaauuuuauacucuugcaccaaugggcaacggagcaggaagaagacgauaa

SEQ ID NO: 34718 - RNA, 1614 nt, Artificial Sequence
  derived and/or modified sequence opt6 from VP1__Norovirus_and/or_Norovirus-like__KX514177
augaaaauggcaucaaaugacgccaauccaucagacggaucugccgcaaauuuagucccugaaguaaacaaugaaguaauggcauuagaaccaguaguaggagcagcuauagccgcaccagucgcaggucaacaaaauguuauagacccauggauacguaauaauuucguacaagccccaggaggugaauuuacuguuucaccaagaaaugcaccuggcgaaauauuauggagugccccucuuggaccagauuuaaacccauacuuaucacaccuagcaagaauguauaauggcuaugcaggagguuucgaaguucagguaauacucgcugguaaugcauuuacagcagguaaaauaaucuucgcugcaguuccaccuacuuuucccacagaggguuuaucaccaucacaaguaaccauguuuccacacauaauaguagaugucagacaacucgaaccuguauuaauuccacuaccagaugucagaaauaauuuuuaccauuacaaucaaucuaaugauucuacaaucaaacucauagcaauguuauacacaccauuaagagcuaacaauccaggugaugacguauuuacagucucguguagaguacuaacaagaccaucacccgacuucgauuucauauuccuaguaccacccacugucgaaaguagaaccaaacccuuuucaguaccuauacuuacaguaggugaaaugaccaauucacgauuuccaguaaacuuagaacgacucuucacaggaccuucaagugccaauguuguacaaccacaaaacggaagauguacaauagacggagaacuccuaggcacuacacaacuuucauccguaaauaucuguacauuuagaggagauguaacacauaucggcacaacucaacauuggaccaugaaucuagcaucaccuaauuggaauaauuacgauccaaccgaagaaacacccgcuccauuaggaacaccagauuuuguuggaaaaauacauggaaugcuaacacaaacuacacaagaaaauggaucaacucgcgcucaucgagccacuguauaugucggauccgccaauuuuacuccaaaauuaggcaaaguacaauuugaaacagacacuggcgacgauuuagcuaucagacaaaauaccaaauucacuccaguugguguuauacaaucaucagaccaccauagagaugaaccacaacaauggcgauuaccaaauuacucuggugcaaauacauucaauguacauuuagcacccgcaguugccccaaauuucccaggagaacaacuacucuucuuuagauccacacuaccugguugcggaggccauccaaauauggaucuagacugucuacucccacaagaauggguucaacacuucuaccaagaagcagcaccagcacaaucagacguagcccuauuaagauucguaaacccagauaccucaagaguacuauucgaaugcaagcugcacaaaucaggauaugucacaguugcacauacaggacaauacgacuuaguacucccaucaaaugguuauuuuagauuugacucauggguaaaccaauuuuauacauuagcaccaaugggaaacggaaccggaagacgaagauaa

SEQ ID NO: 34719 - RNA, 1614 nt, Artificial Sequence
  derived and/or modified sequence opt6 from VP1__Norovirus_and/or_Norovirus-like__KF806514
augaaaauggcuucaaaugaugccucaccuucagauggaucugcagcuaaccucguuccagaaguuaauaacgaaguaauggcauuagaaccaguuguuggagcagcaauagcagccccaguagcgggacaacaaaauguaauagacccauggauaagaaauaauuuuguacaagcaccaggaggagaauuuacagucucuccaagaaaugcaccaggagagauuuuaugguccgcaccacuaggcccagauuuaaauccauaccuaucacaucuagcuagaauguacaauggauacgcaggagguuuugaaguacaaguaauauuagcagguaacgcauuuacagcagguaaaauuauauucgcugccguaccaccaaauuucccaacugaaggucuaucaccaucucaaguaacaauguuuccacauaucguaguagauguaagacaauuagaaccagucuuaauaccuuuaccagauguucgaaacaauuuuuaucauuauaaucaauccaaagauccaacuauuaaguuaauagccauguuauacacaccacuaagagccaauaaugcaggagaagauguuuucacaguaaguugccguguauuaacuagaccauccccagauuuugauuuuauauuucuaguuccacccacaguagaaucaagaucaaaaccauuuacaguuccaauauuaacaguugaagaaaugacaaauucacgauuuccaauaccauuagaaaaacuuuucacaggaccuucuggagcauuuguaguacaaccccaaaaugguagauguacaacugauggaguucuuuuaggaacuacacaauuaucuccuguaaacauaugcaccuuuagaggagauuuaacacacuucacugguacaucugaauaugcaaugaauuuagcaucucaaaacugggacaacuaugauccaacagaagaaauaccagcaccacuuggagcaccagauuuuguaggaaaaauaagaggaaugcucacacaaacaacccgccgugacgguucuaccagaggacauagagcaacacuuucaacagguuccgcacauuucacuccaaaauuaggaaauauaagauuuucaaccgauacaaauaacgauuuugaagcaggccaaaauacaaaauuuacaccagucggaguauuucaagaaggugauaaucaucaaaacgaaccccaacaauggguacuuccaaauuauuccggagcaacagcacacaacguacaccuugcuccagcaguagcuccagcuuuuccaggugaacaacuuuuauuuuucagaucaacuaugccaggaugugguggauaucccaauaugaauuuagauugcuuauuaccucaagaauggguucaacauuuuuaucaagaagccgcaccagcucagucugacguagcucuacucagauuuguaaauccagacaccucacgaguauuauuugaauguaaacuacacaaaucuggauacguuacuguagcacauacaggacaacacgaccucguaauaccaccaaaugguuacuucagauuugauagcuggguaaaucaauucuauaccuuagcaccaaugggaaauggaacuggacgaaggagauaa

SEQ ID NO: 34720 - RNA, 1614 nt, Artificial Sequence
  derived and/or modified sequence opt6 from VP1__Norovirus_and/or_Norovirus-like__AB303925
augaaaauggcaucaaaugaugccaauccuucagauggaucaacagcaaacuuaguaccagaaguaaacaaugaaguaauggcacuagaaccuguagucggagcagcaauagccgcaccuguagcuggacaacaaaauguuauagacccauggauacgaaauaacuuuguacaagcaccaggaggagaauuuacaguuuccccuagaaaugcaccaggagaaauuuuauggucagcaccuuuaggcccagacuuaaauccuuaccuaucucacuuagcccguauguauaauggauacgcugguggauucgaaguacaagugauccuagcaggaaaugcauucacagcaggcaaaaucauauuugcagccgucccaccaaacuuuccaaccgagggucuaucucccucgcaaguaacuauguucccacauauuaucguugauguuagacaacucgaaccagucuuaauaccccuaccagauguacgaaauaauuucuaucauuauaaucaaucaaaugacucaaccauuaaacuaauagcaaugcuuuauacaccauuaagagcaaacaacgccggugaugauguauuuacaguaucuugccgaguauuaacaagaccaucaccagauuuugacuuuauuuuucuaguaccaccaacaguagaaucuagaaccaaaccauucacaguaccaauacuaacaguagaagaaaugucaaacucuagauuuccaauuccacuugaaaaauuauucacaggaccaucaucagcauuuguaguacaaccccaaaauggaagauguaccacagacggaguauuacuaggaacaacacaauuauccgcaguaaauauaugcaccuucagaggagacguuacccauauagcaggaucucacgauuauacuaugaauuuagcaucucaaaauuggaauaacuaugauccaacagaagaaauacccgcaccauuaggaacacccgacuuuguaggaaaaauacaaggaaugcuuacccaaaccacucgugaagacggaucaacuagagcacauaaagcaaccguaucaacuggcucaguacacuuuacaccaaaauuaggaucuguacaauauacgacagacacaaauaacgauuuucaaacaggccaaaauacaaaauucacaccaguaggaguaauacaagauggaaacaaucaucaaaacgaaccacaacaauggguauuacccaauuacuccggucguacaggacacaauguacacuuagcuccagccguugcaccaaccuucccaggagaacaacuccuauucuuuagauccacuaugcccggaugcucaggauacccaaacauggaccuagauugucuauuaccacaagaauggguacaacauuuuuaccaagaagcagcacccgcacaaucagauguagcccuacuaagauuuguaaacccagacacaggaagaguacucuuugaauguaaacugcacaaaucagguuacguuacaguagcucacacagguccacaugaccuagucauaccgccuaacggcuacuuucgauuugacucauggauuaaccaauucuacacucuagcuccaaugggaaacggugcuggcagaagacgauaa

SEQ ID NO: 34721 - RNA, 1614 nt, Artificial Sequence
  derived and/or modified sequence opt6 from VP1__Norovirus_and/or_Norovirus-like__KF806534
augaaaauggcaucaaaugaugcaucuccaucagauggcucagcugcaaaucuaguaccagaaguaaauaaugaaguaauggcacuagaaccaguagucggagcagcuauugcagcaccuguagcaggacaacaaaacguuaucgauccauggauucgaaauaauuucguucaagcaccuggaggugaauuuacaguaucuccuagaaaugcaccaggagaaauacuauggagugcaccauuaggacccgauuuaaauccauaccucagucauuuagcaagaauguacaauggauaugcaggaggauuugaaguacaaguaauauuagcaggaaacgccuuuacagcaggaaaaauaauauuugcagcaguaccaccaaauuuucccacugaaggauuauccccuagccaaguaacuauguuuccucauauuguugucgacguaagacaauuagaaccaguacuaauaccucuaccugauguaagaaacaacuuuuaucauuauaaccaaaguaaagauccaacaaucaaauuaauagccaugcuauauacaccauuaagagccaauaacgcuggagaagauguauucacuguuucauguagaguauuaacacgaccuucaccugacuucgauuuuauauucuuagucccgccuacaguagaaagcagaucaaaaccauuuacaguccccauacuaacaguagaagaaaugacaaauucacgcuuuccaauaccucuagaaaaauuauuuacagguccaucauccgcuuuuguaguucaaccacaaaacggaagauguacaacagacgguguacuccucggcacaacccaauuaucuccagucaauaucuguacguucagaggagauuuaacccauuucgcaggaacaagcgaauaugcaaugaaucuagcaagucaaaauuggacaaauuaugauccuaccgaagaaauaccagcacccuuaggagcaccagauuuuguuggaaaaauacgaggaguucuuacacaaacaacaagaagagauggaaguacucgaggccauagagcaacauuaucaacugguuccgcacauuuuaccccaaaauuaggaucuauacguuuuuccacugauacaaauaaugauuucgaagcaggacaaaauacaaaauuuacucccguaggagucuuucaggauggugauaaccaucaaaaugaaccacaacaauggguuuuaccuaauuacuccggagccacagcacacaauguacauuuagcuccagcaguagcaccagcauuccccggcgaacaauuauuauucuuuagaucuacaaugccaggauguucaggauauccaaauaugaauuuagacuguuuauuaccacaagaauggguacaacauuucuaucaagaagcagcaccagcucaaucagauguugcacuacuucgauucguaaaucccgauacaucuagaguacuguuugaauguaaauuacacaaaucaggauauguaacaguugcacacacugggcaacaugauuuaguuauucccccaaacggauauuuucgauuugacucauggguaaaucaauuuuauacucuugcaccaauggguaacgguacaggacgaagaagauaa

SEQ ID NO: 34722 - RNA, 1614 nt, Artificial Sequence
  derived and/or modified sequence opt6 from VP1__Norovirus_and/or_Norovirus-like__KF806519
augaaaauggcaucaaacgacgcuucuccaucagacggaucagcagcaaaucuuguuccagaaguaaauaaugaaguaauggcauuagaaccuguaguaggagcaacaaucgcagccccugucgcaggacaacaaaauguaauagauccguggauacgcaauaauuuuguacaagcaccaggcggagaauuuacagucucuccacgaaacgcacccggagaaauauuauggucugcaccccuaggaccagaccuaaauccauaucuaucacacuuagcacgcauguacaauggauacgcaggaggauucgaaguacaaguuaucuuagccggaaaugcauuuacagcaggcaaaauaauauuugcagcaguaccaccaaauuucccaacagaagguuuaucaccaucacaaguaacuauguuuccccauauaguagucgacguaagacaauuagaacccgucuuaauaccauuaccugauguaagaaauaauuucuaucacuacaaucaaucaaaagauccaacuauaaaacuuauagccaugcuuuauacaccuuuacgagcaaacaacgcaggcgaagauguauuuacaguuucauguagaguauuaacuagaccuuccccagauuucgacuuuauauuccuaguaucaccuacaguagaaucaaggucaaaaccauuuacuguaccaauuuuaaccguagaagaaaugacaaauucaagauuucccauaccacuugaaaaacuauucacaggucccucaggagcauuugucguucaaccacaaaacgguagaugcacuacagaugguguucuauuaggaacaacacaauuauccccaguuaauaucuguacauuccgaggagaccuuacacacuuuacuggaacaucugaauaugcaaugaaucuagcuucccaaaacuggaacaauuacgauccaacagaagaaauuccagccccacuaggagccccagacuucguagguaaaauuagagguaugcuuacccaaaccacuagaagagacggcuccacaagaggacaccgagcaacucuaagcacagguuccgcacauuucacuccaaaacuaggaaacauaagauuuucaacagacacaaauaacgauuucgaagcaggacaaaacacaaaauucacaccagucggagucuuucaagaaggagacaaucaccaaaaugaaccacaacaauggguucuucccaauuauucaggagcuacagcacauaacguccauuuagcuccugcaguugcuccagcuuucccaggagaacaauuauuauucuuccgaaguacuaugccagguuguggagguuaucccaauaugaaucuagacuguuuacuaccacaagaauggguacaacauuuuuaucaagaagccgcaccagcacaaucagaugucgcucuacuuagauuugucaauccagauacaucaagaguauuauucgaauguaaauuacacaaaucuggcuacguaacaguagcacauacaggucaacacgaccuaguaaucccaccaaacgguuacuuuagauuugauucuuggguuaaccaauuuuacacacuugccccaaugggaaauggcacugguagaagaagauaa

SEQ ID NO: 34723 - RNA, 1614 nt, Artificial Sequence
  derived and/or modified sequence opt6 from VP1__Norovirus_and/or_Norovirus-like__AB303924
augaaaauggcuucaaaugacgcuaacccaucagacggaucaacagcaaacuuagucccagaaguaaacaaugaaguaauggcucucgaacccguaguaggagcagcuauagcagcaccugucgcuggucaacaaaauguaaucgauccauggaucagaaauaacuuuguccaagcaccaggaggagaauuuaccgucuccccacgaaaugcaccaggagaaauccuauggucagcuccauuaggaccagaccuaaacccauaccucucacaucuagcuagaauguauaacggauaugccggaggcuucgaaguacaaguaauauuagcugguaaugcauucacagcaggaaaaauaauauuugcagcaguacccccuaauuuuccaaccgaaggauuaucaccaucacaagucacaauguuuccucacauaauugucgauguacgacaauuagaaccaguacuaauaccauuaccugauguaagaaauaacuuuuaucacuauaaccaaaguaaugauucaacaauaaaacuuauagccauguuauacacuccauuaagagcaaacaaugcaggcgaugacguuuuuaccguauucuguagaguacuaacccgaccuucaccugauuuugacuucauauuucuuguuccaccaacaguugaaucaaggacaaaaccauucacaguaccaauucuaacuguagaagaaaugaguaacucaagauucccaauaccacuagaaaaacuauauacaggaccaaguuccgcuuucguaguccaaccacaaaauggaagauguacaacugacggagucuuacuaggcacuacccaacuaucagcuguaaauauaugcacuuucagaggcgacguuacacauauagccggaucacacgauuacacaaugaacuuagcaucacaaaauuggaacaauuacgaccccacugaagaaauaccagcuccauuaggaacacccgacuuuguagguaaaauacaaggaaugcuaacccaaaccacuagagaagauggaaguacaagagcucacaaagcuacagucucaacaggauccguacacuuuacaccuaaacuuggaucaguacaauauaccacagauacuaauaaugauuuucaaacuggacaaaauacaaaauuuacaccaguaggcguaauucaagauggaaauaaucaucaaaacgaaccacaacaauggguacuaccaaauuacaguggacgaacaggacacaauguacaccuagcccccgcaguagcaccaacauucccaggagaacaauuacucuuuuuccguucaaccaugcccggaugcucagguuauccaaacaugaacuuagacuguuuauuaccacaagaauggguacaacauuucuaucaagaagcagcaccagcacaauccgauguagcacuguuaagauuuguaaacccagacacaggucgaguccuauuugaauguaaauuacauaaauccggauauguaacugucgcacauaccgguccacaugaccuaguaaucccaccaaacggauauuuuagauucgauucauggguuaaucaauuuuauacacuagcaccaaugggcaacggagcuggaagacgaagauaa

SEQ ID NO: 34724 - RNA, 1614 nt, Artificial Sequence
  derived and/or modified sequence opt6 from VP1__Norovirus_and/or_Norovirus-like__DQ975270
augaaaauggcaucaaacgacgcuaacccaucugacggaucaaccgcuaaccuaguaccagaaguaaauaacgaaguaauggccuuagaaccaguaguaggagcagcaauagcagcaccaguagcaggccaacaaaacguaauagauccuuggauaagaaauaauuuuguccaagcaccaggaggugaauuuaccguaucaccacgaaaugccccaggagaaauauuauggucagcaccacucggaccagacuuaaauccauaccuaucccaccuagcucgaacauacaacggauaugccggaggauuugaaguacaaguaauacucgcaggaaaugcauucacagcuggaaaaaucauauuugcagcaguaccacccaacuucccaacagaaggacuaucaccuucacaaguaacuauguucccacauauaauaguagacguaagacaacuagaaccuguucuaauaccauuaccugacguaagaaacaauuuuuaucauuacaaucaaucaaacgauuccacaauaaaacuaauagcaaugcucuacacaccauuaagagcuaacaaugcaggagacgaugucuucacaguaucaugcagaguccucacacgaccuucacccgacuuugacuucaucuuucuaguuccaccaacaguagaaucaagaacuaaaccauuuacuguuccaauauuaacaguagaagaaaugucaaauucaagauuuccaauaccccuagaaaaacuauauaccggaccuuccucagcauuuguaguacaaccacaaaacggacgaugcacaaccgacggaguacucuuagguaccacacaauuaucagcagucaauaucugcaccuuccguggugacgucacacacauagcaggaagccacgauuacacaaugaaucuagcaucacaaaacuggaacaauuacgacccaacugaagaaauaccugccccuuuaggaacacccgacuuuguaggaaaaauccaaggaauguuaacacaaacaacaagagaagacggaagcacaagagcucauaaagcaacagucucgacaggaucaguacauuuuacucccaaacucggcuccguacaauacacaaccgauaccaacaacgacuuccaaacaggucaaaauacaaaauucacaccaguaggaguaauacaagaugguaacaaucaucaaaaugaaccccaacaaugggucuuaccaaauuacucaggaagaacaggacacaacguacacuuagcaccagcaguagccccaacauucccaggcgaacaauuacuauuuuucagaucuacaaugccuggcuguaguggcuacccuaauaugaaucuagacugucucuuaccacaagaauggguacaacauuucuaccaagaagcugccccagcacaaagcgauguagcuuuauuaagauuuguaaaccccgauacaggaagaguacuuuucgaaugcaaacuacacaaauccggauacguaacaguagcacauacaggaccacacgauuugguaaucccaccaaauggauacuucagauuugauuccuggguuaaucaauucuauaccuuagcaccuaugggaaauggugcaggaagaagaagauaa

SEQ ID NO: 34725 - RNA, 1614 nt, Artificial Sequence
  derived and/or modified sequence opt6 from VP1__Norovirus_and/or_Norovirus-like__AF414424
augaaaauggcaucaaaugaugcaaauccaucagacggaucuacagcaaauuuaguuccagaaguaaauaacgaaguaauggcucuugaaccaguaguaggagcagcuauagcugcaccaguagcuggacaacaaaacguuauagacccauggauaagaaauaauuuuguacaagcucccggcggagaauuuacaguaucuccacgaaacgcuccuggugaaauacuauggucagcuccacuaggaccagauuuaaauccauaucuaucacaccucgcaagaauguacaauggauacgcaggcggauucgaaguacaaguaauauuagcaggcaaugcauucacagcagguaaaauaauauucgcagcaguaccaccaaauuucccaacugaaggacuauccccaagccaagucacaauguuuccacacauaaucguagacguaggucaacuagaaccaguacuaauuccacuaccagauguaagaaauaacuucuaucacuacaaccaauccaacgauucuaccauaaaacuaauagcaauguuauauacaccacuuagagccaauaaugccggugacgacguauuuacaguaucuugcagaguauuaacuagaccaucaccugacuucgauuuuauauuuuuagucccaccaacagucgaaucuagaacaaaacccuuuaccgucccuauacuuacuguugaagaaaugucuaauucaagauucccaauaccauuagaaaaacuauacaccgguccaucaucggcauucguaguccaaccacaaaauggucguuguacaacagaugguguauuacuaggaaccacccaacuaucagcaguaaauauauguacauucagaggugacguaacucacauagcaggaucacacgauuauacaaugaauuuagcaucacaaaauuggaacaauuaugacccaaccgaagaaauaccugccccacuaggaaccccagacuucguaggaaaaauucaaggcguacucacccaaacaacacgggaagauggaucaacaagagcccacaaagccaccguaaguacaggcucuguacacuucacaccaaaacuaggaucuguccaauauacaaccgacacaaacaacgauuuccaaacaggacaaaacacaaaauucacccccguaggcgucauacaagacggaaauaaucaucaaaacgaaccacaacaguggguacuaccaaauuauuccggacgaacuggacauaacguacacuuagcaccagcaguagcaccgacauucccaggagaacaacuacuauucuuccgauccacaaugccaggauguuccggcuacccaaauaugaaccuugauugccuacuaccacaagaauggguccaacacuucuaccaagaagccgcacccgcacaaucagacguagcuuuacuaagauuuguaaauccagauaccggaagaguucuauuugaaugcaaauuacacaaaucagguuacgucacaguagcccauaccgguccacaugacuuagucaccccuccaaauggauacuucagauuugauucauggguaaaucaauucuacacuuuagcaccgaugggcaacggagcaggaagaagaagauaa

SEQ ID NO: 34726 - RNA, 1614 nt, Artificial Sequence
  derived and/or modified sequence opt6 from VP1__Norovirus_and/or_Norovirus-like__LC048964
augaaaauggccucaaaugaugcuaacccuuccgacggcucaacagcaaauuuaguaccagaagucaacaacgaagucauggcauuagaaccaguaguaggagcugcuauugcagcacccguagcaggacaacaaaauguaauagacccuuggauaagaucuaauuuuguucaagcccccggaggagaauuuacaguaucaccaagaaaugcaccuggcgaaauauuauggucugccccauuaggcccagauuuaaacccauauuuaucucauuuagcaagaauguacaauggauacgcaggaggauucgagguacaaguaauacucgcaggcaaugcauuuacugcaggcaaaauaauauuugccgcaguaccaccaaauuuuccaacagaaggccuuucccccucacaaguaacuauguuuccccauauaauaguagacguaagacaacuagaacccguacuaauaccauuaccugacguaagaaacaauuuuuaucauuacaaccaaucuaaugauucaacuauaaaacuaauagcgauguuauacacuccacuacgcgcaaacaacgccggagaugauguauuuacaguaucauguagaguccuaacaagacccucaccagauuucgacuuuauauuucucguaccaccaacuguagaaagucguacuaaaccuuucacugucccuauacuaacaguugaagaaaugucaaauucacgauuucccauaccacuugaaaaacuauauacaggacccuccuccgcauucgucguacagccacaaaacggacguuguaccacagacggcguauuacuaggaacuacacaacuaucagcaguaaauauaugcacuuuuaggggagacguuacacauauagcaggaucacacgacuacacaaugaaccuagcaucucaaaacuggaacaacuacgacccaacugaagaaauaccagcaccauuaggaacaccagacuuuguagguaaaaaccaagguuuauuaucccaaacaacaagaggagauggaucaacuagagcucacaaagccacaguaucaaccggaagcguucauuucacaccaaaacuaggaucaguacaauacacaacagauacuaauaaugauuucgaaacaggacaaaacacaaaauucacaccaguaggagucauccaagaugguaacaaucaccaaaacgaaccacaacaaugggcucucccaaauuacucuggacgaacaggacauaacguacauuuagcaccagcaguagcaccuaccuucccaggagaacaauuauuauucuuuagaucaacaaugccaggauguucagguuauccaaauaugaauuuagacuguuuauuaccccaagaauggguacaacacuuuuaccaagaagcagccccagcccaaucagacgucgcacuacuacgauuuguaaauccugacacuggcagaguacuauuugaauguaaacuacauaaauccggauacguaacaguagcacauaccggaccacaugacuuaguaauaccaccaaacggauacuuuagauucgacucuuggguaaaccaauucuauacccucgcaccuaugggcaacggagcaggcagacgaagauaa

SEQ ID NO: 34727 - RNA, 1614 nt, Artificial Sequence
  derived and/or modified sequence opt6 from VP1__Norovirus_and/or_Norovirus-like__AB684705
augaaaauggcuucuucagacgcaaacccaucagauggaucagcagcaaaccuuguuccagaaguaaacaacgaagugauggcacuagaaccaguagucggcgcugcaauugcugcuccaguagcaggucaacaaaacaucaucgauccauggauaagaaauaauuuuguucaagcaccuggaggagaauuuacaguaucaccaagaaaugcacccggagaaauacuuuggucagcaccucuaucacccgaucuaaacccauaccuaucucaccuaucaagaauguacaacggauaugcaggcggauucgaaguucaaguaauauuagcaggaaaugcauucacagcuggaaaagucaucuucgcugcaguaccaccuaacuuuccaacagaaggacuauccccaucacaaguaacaauguuuccacauauaauuguagacguaagacaauuagaacccguacuaauuccccuaccagauguacgaaauaauuucuaccauuauaaccaaacacacgauuccacauuaaaacuaauagcaaugcuauacacuccucuccgagcuaauaaugcuggagacgaugucuuuacuguaucaugcagagugcuaacaagaccaucccccgauuucgauuuuauauucuuaguacccccaacaguagaaucaagaacuaaaccuuucacaguaccaauauuaaccguagaagaaaugucuaauucaagguucccaauaccacuggaaaaacuauauacaggaccaucuucagcauuuguaguucaaccucaaaauggaagaugcacaaccgauggcguacuacucggcaccacacaacuuucagcaguuaauaucuguaacuucagaggcgacguaacaagagucggaaucucacacgauuacaccaugaauuuaguaucccaaaauuggaauaauuaugauccaacugaagaaaucccagcuccacuuggaaccccagauuucguagguaaaauccaaggacucuuaacacaaaccacaagagcagacuccucaacuagagcacacaaagcuacuuuaucuacuggaucaguacauuuuacaccaaaauuaggaucaguccaauucacaacagauaccaacaacgauuuucaaacaggucaaaacacaaaauuuaccccaguaggagucauucaagauucagaucaucaccaaaacgaaccucaacaauggguauuaccaaacuauuccggauccuccggccacaacguucaccuagccccugcaguagccccaacauuuccaggugaacaacuccuauucuuccgauccacaaugccaggcuguucagguuauccuaacaugaacuuagacugcuuauuaccacaagaauggguacuacacuuuuaccaagaagccgcaccagcacaaucagacguagcacuccuacgauuuguaaauccagauaccggaagaguuuuauucgaauguaaacuacauaaauccgguuacauaacaguagcacacacuggcccauacgauuuaguaauaccaccaaacggauacuuucgauucgacucuuggguaaaccaauuuuauacacucgcaccaauggguaacggaacaggcagaagaagauaa

SEQ ID NO: 34728 - RNA, 1614 nt, Artificial Sequence
  derived and/or modified sequence opt6 from VP1__Norovirus_and/or_Norovirus-like__KF806523
augaaaauggcaucaaacgaugcauccccuucugauggauccgcagcaaauuuaguccccgaaguaaauaacgaaguuauggcacuagaaccaguaguuggagcagcaauagcagcaccuguagcaggacaacaaaauguaauagauccauggauacgaaacaacuucguacaagcuccaggaggagaauuuacaguaucaccaagaaaugccccaggagaaauauuauggucagcaccacuuggaccagauuuaaauccauacuuaucacaucuagcaagaauguacaauggauaugcaggaggcuuugaaguccaaguaauauuagcuggcaaugcuuuuacagccggaaaaaucauauucgcagcugucccaccgaauuuccccacagaaggcuuauccccuucacaaguaacaauguucccacauaucguuguagacguaagacaacuugaaccaguauuaauaccacuaccagauguaagaaacaauuucuaucauuauaaccaaucaaaagaucccacaauuaaauuaauagcaauguuauauacaccccuaagagcaaauaaugcuggagaagacguauucacaguauccuguagaguacuuacuagaccaucgccagauuucgacuuuauauuccuugucuccccaacuguagaauccagaucaaaaccauuuacugucccaauauuaacuguugaagaaaugacuaacucacgauucccgauuccauuagaaaaacuauucacuggaccaucuggagccuuugucguccaaccacaaaaugguagauguacaacagaugguguacuauuagguacaacacaauuaucacccguaaauauuugcacuuucagaggagauuuaacacacuuuacagguaccuccgaauaugcuaugaaucuugcaucucaaaauuggaauaacuacgauccaacagaagaaauuccagcaccacuuggugcuccagauuucguaggaaaaauacgagguaugcuaacacaaacaacucguagagauggcucuacacguggucauagagcaacauuaucuacuggaucugcacauuuuacuccaaaacuaggaaacauuagauucaguacugacacaaacaaugacuuugaagcaggacaaaauacuaaauucaccccaguaggaguauuucaagaaggagauaaucaccaaaaugaaccacaacaauggguauuaccuaacuauucuggagcaaccgcacauaacguucaccuugcaccagcaguugcacccgcauuuccaggugaacaacuauuauucuuuagaucaacaaugccaggaugcggaggcuaucccaauaugaaucuagauugcuuauuaccacaagaauggguacaacacuuuuaucaagaagcagccccagcucaaucagaugucgcacuccuaagauuuguaaauccugacacuucaagagucuuauucgaaugcaaacuacauaaaucagguuauguaacaguagcacauacaggacaacaugauuuaguuaucccaccaaacggauacuucagauuugauucuuggguaaaccaauucuauacccucgcuccuaugggaaauggaacaggaagaagaagauaa

SEQ ID NO: 34729 - RNA, 1614 nt, Artificial Sequence
  derived and/or modified sequence opt6 from VP1__Norovirus_and/or_Norovirus-like__AY532129
augaaaauggcaucaaacgaugccaauccuuccgauggauccacagcaaauuuagugccagaagucaacaacgaagucauggcuuuagaaccaguuguaggggcagcaauugcagcucccguagcaggacaacaaaacguaauugaucccuggauccgcaauaauuucguucaagcacauggcggugaauuuacuguuuccccucgaaaugcaccaggugaaauuuuaugguccgccccauuaggcccagauuuaaaucccuacuuaucucaucuagcacgcauguauaaugguuaugcaggaggauuugaaguucaaguuauuuuagcuggaaaugcuuuuacagcagguaaaauaauauuugcagcaguuccuccaaacuuuccaaccgaaggauuaucuccaucacaaguaacaauguuuccccacauaauuguugacguacgacaauuagaaccuguauuaaucccucucccagauguaagaaacaacuucuaucauuacaaccaaucaaaugacucaacaauaaaacucauagcaaugcuauacaccccauuaagagcuaacaaugcaggagaugacguuuucacuguuucaugucgaguacuaacacgaccaucacccgauuuugacuucauauuuuuaguacccccaacagucgaaucaagaacaaaaccauuuacaguaccaauauuaacuguagaagaaaugucaaacaguagauuuccaaucccccuagaaaaauuauacacaggaccaucaucagcauucguaguacaaccacaaaauggacgauguacaacagauggaguuuuacucggaacuacucaacuaucagcagucaauaucugcacuuuccguggagauguaacacacauagcagguucgcacgauuauacaaugaaucuugcuucccaaaacuggaacuccuaugaccccacagaagaaauaccagcuccacucggcacuccagacuucguugguaaaauacaaggaauguuaacacaaacuacaagagaagaugguucaaccagagcucauaaagcuacaguaucaacaggauccguucacuuuaccccaaaacuaggaucaguacaauacacuacagacacaaauaaugauuuucaaacaggacaaaauacaaaauucacuccagucgguguuauacaagacggaaacaaccaucaaaaugaaccacaacaauggguuuuacccaauuauucaggaagaacuggacauaauguacaucuagcaccagcaguagcaccaacauucccaggugaacaauuauuauuuuucagauccacuaugccaggaugcucaggcuacccaaacaugaauuuagacugcuuacuaccacaggaauggguucaacauuuuuaucaagaagcagcaccagcacaauccgauguagccuuauuaagauucguaaauccugacaccggacgaguuuuauucgaauguaaacuccauaaaucaggauauguaaccguugcccacaccggaccacacgauuuaguaauaccaccaaauggauauuuucgauuugauucauggguuaaucaauucuacacauuagccccaaugggaaacggugcaggaagaagacgauaa

SEQ ID NO: 34730 - RNA, 1614 nt, Artificial Sequence
  derived and/or modified sequence opt6 from VP1__Norovirus_and/or_Norovirus-like__AY532124
augaaaauggcuucaaacgacgcaaauccaucagauggaucaacagcaaaccuaguacccgaaguaaauaaugaaguaauggcucuagaaccaguaguaggagcagccauagcagcaccaguagccggacaacaaaaugucauugacccuuggauacguaacaacuuuguacaagcaccuggaggagaauuuacaguaucuccaagaaacgcccccggagaaauauuauggucugcaccauuagguccagaccuaaauccauaucuaucucaccuugcacgaauguauaauggcuaugcaggaggauuugaaguacagguaauacuugcaagaaaugcauuuacagcaggaaaagucauauucgcagcaguaccacccaauuuccccacugaaggacuaagcccuucccaaguaacaauguuuccccacauaauuguagauguacgacaacuagaaccuguacuaauaccauuaccagauguuagaaauaacuuuuaccacuauaaccaaucaaacgacucaaccauaaaauuaauugccauguuauauacuccacuucgagcuaauaacgcaggcgaugacguauucacaguaucauguagaguacuaacaagacccucaccagacuuugacuuuauauuccuaguuccaccuacuguagaaucacgaaccaaaccauucacugucccaauacuuacaguagaagaaaugucaaacucaagauuccccauaccauuagaaaaacuauauacaggaccuucaucugcauucguuguccaaccacaaaacgguagaugcaccacagauggcguacuccuaggaaccacacaauuaagcgcaguaaauauuugcaccuuucguggagacguaacacacauagcaggaucacacgacuacacaaugaauuuagcaagucaaaacuggaacaauuaugauccaacagaagaaauaccagcaccacucgguacaccugacuuuguaggaaaaauucaagguauguuaacacaaacuaccagagaagauggcagcacacgugcucacaaagccacaguaucaacaggaagcguacauuucacaccaaaacuuggcucaguacaauauacaacugacacaaacaaugacuuucaaacaggacaaaacacaaaauucacaccaguuggaguaauacaagauggaaauaaccaccaaaacgaaccacaacaauggguacuacccaauuacucaggcagaacaggacauaauguacauuuagcuccagcaguagcaccaacauucccaggagaacaacuacuauuuuuccgaagcaccaugccaggauguucaggcuauccgaacaugaaccuagacuguuuauuaccucaagaauggguacaacacuuuuaucaagaagcugccccugcacaaucagauguagcacuacuaagauuuguaaacccagacacaggcagaguccuauuugaauguaaauuacauaaaucaggauacguaacaguagcacauacaggcccucacgaccuuguaauacccccaaauggauacuuccgauucgauucauggguuaaucaauucuauacauuagcaccuaugggaaacggugcaggacgaagaagauaa

SEQ ID NO: 34731 - RNA, 1614 nt, Artificial Sequence
  derived and/or modified sequence opt6 from VP1__Norovirus_and/or_Norovirus-like__KX514309
augaaaauggcuucuaaugaugcaaauccaucugauggaucagccgcaaaucucguaccagaaguuaacaaugaaguaauggcacuagaacccguagucggagcagcaauagcagccccaguagccggacaacaaaacguaauugaucccuggauaagaaauaauuucguacaagcaccaggaggagaauuuacaguaucaccaagaaacgcaccaggugaaauacuauggagugcaccucuaggucccgaucuaaauccuuaucucucacaccuagcacguauguauaauggcuacgcaggaggcuucgaaguucaagucauacuagcaggaaaugcauucacagccgguaaaaucauauuugcagcagucccaccaaauuuuccaacagaaggacuaucacccucacaagucacuauguucccucauauuauaguagacguuagacaauuagaaccaguccuaauaccauuaccugauguaagaaauaauuucuaccacuacaaccaaucgaacgauucaacaaucaaauuaauagcuauguuauauacaccuuuaagagcaaacaacccaggcgacgacguuuuuacaguaucauguagaguacucacuagaccaucaccugacuucgacuuuauauucuuaguaccuccaacagucgaaucaagaacuaaaccauucagcguuccuauucuaacaguuggagaaaugacuaacucaagauuuccaaucaaccuagaaagacuauucacaggaccaucgucugcaaauguaguccaaccucaaaacggaagauguacaauugacggagaauuauuaggaacaacacaauuaucaucuguaaauauuugcacuuucagaggagacguaacacauccaggaggaucaaaaauauacacaaugaacuuagcaucaccaaauuggaacaauuaugacccaacagaagaaauaccagcaccacuaggaacuccugauuuuguaggaaaaauacacgguaugcucacacaaacuacaaaaggugaaggaucaacuagaggacauagagcaacaguauacguaggaggagcaaacuucacaccuaaauuaggaaaaguccaauucgaaacagauacaggugaugacuuagcaauuagacaaaauacaaaauucacaccaguaggaguaauacaaagcucagaucaucauagagaugaaccccaacaauggagacucccaaacuauucuggagcaaauaccuucaauguacauuuagcaccagcaguugcuccaaauuuuccaggagaacaauuacucuucuuucgaaguacauuaccaggcuguggaggucacccaaacauggaucuggacuguuuacuaccacaagaauggguccaacacuucuaccaagaagccgcaccagcccaauccgauguugcauuauuaagauuuguaaauccagacacuagccgcguacuauucgaauguaaacuccacaaauccgguuacguuacuguugcccauacaggacaacacgaucuaguaauuccaccaaacggcuauuuuagauuugauucaugggucaaccaauucuacacauuagcaccaaugggaaacgguacagggagaaaacguuaa

SEQ ID NO: 34732 - RNA, 1614 nt, Artificial Sequence
  derived and/or modified sequence opt6 from VP1__Norovirus_and/or_Norovirus-like__KX514308
augaaaauggcauccucagaugccaaccccucagauggauccacggccaauuuaguaccagaaguaaacaaugaagugauggcauuagaaccaguagucggcgccgcuauagcugcaccaguagccggacaacaaaacgucauugacccuuggauacgaaacaauuucguacaagcaccaggcggcgaauuuacaguaucaccccgaaaugcaccuggagaaauauuauggucagcaccauuagguccugaucuuaacccauacuuaucucaccuagcaagaauguauaaugguuaugcugguggauucgaaguacaaguaauucuugcaggcaaugcauuuaccgcaggaaaaauaauauuugcagcaguaccacccaacuuuccuacagaaggucuaucaccaucacaaguaacaauguucccacacauuaucgucgacguuagacaacuagaaccaguacuaauaccacuaccagauguucguaacaauuucuaucacuacaaucaaucaaacgacucaaccauaaaacuuaucgcaaugcuauacacaccauuaagagcaaacaauccuggagaugaugucuuuacagucucaugcagaguacuaacaagaccuucaccagauuuugacuuuauauuucuaguaccaccaacaguagaaucuagaacaaaaccauucucuguaccaauacuuacagucggagaaaugacaaauucaagauuuccuauaaaucuagauaaacucuucacagguccaucuucugcaaacguaguacaaccacaaaacggaagauguacuauagacggagagcuauuaggaacaacccaacuaucaucaguuaacaucuguacauucagaggugacguuacucacaucggaucuacaagacacuggacaaugaaucuagcuucacccaacuggaacaauuaugauccaacagaagaaacuccagcuccuuuaggaacaccugauuuuguaggcaaaauacauggaaugcuaacccaaaccacacaagaaaacggcucaacaagagcucacagagcaacaguauauguaggaucagcagauuuuacaccaaaacuagguaagguacaauuugaaacagauacagaagacgaccucgccauaagacaaaauacaaaauuuacaccuguuggaguuauucaaucaucagaucaucacagagaugaaccacaacaauggagauuacccaauuacaguggagcaaauaccuuuaauguacaccuagcccccgcaguagcaccaaauuucccaggugaacaacuauuauucuuuagaucaacccuaccaggauguggaggccacccuaauauggacuuagauugcuuacuaccacaagaauggguacaacacuucuaucaagaagcagccccugcacaauccgauguugcauuauuacguuucguaaacccugacaccaguagaguucuauuugaaugcaaacuucauaaaucagguuacguaacaguagcacauacuggacaauaugaccuuguauuaccaucaaacgguuacuuuagauucgacuccugggucaaucaauucuacacauuagcaccaauggguaacgguacuggaagaagaagauaa

SEQ ID NO: 34733 - RNA, 1614 nt, Artificial Sequence
  derived and/or modified sequence opt6 from VP1__Norovirus_and/or_Norovirus-like__KX514283
augaaaauggcauccaacgacgcaaaucccagugacggauccgcagcaaaucuuguuccagaaguuaauaaugaaguaauggcccuagaaccaguaguuggugcagcaauagccgcaccaguugcaggacaacaaaauguaaucgaccccuggauacgaaauaacuuuguacaagcacccggaggagaauuuacagucucaccuagaaaugcaccaggagaaauacuuuggucagccccacucggaccagaucugaacccauaccucucucauuuagcgagaauguauaaugguuaugcugguggauucgaaguucaaguaauccuagcaggaaacgcauucacagcaggaaaaauaaucuuugcagcaguaccaccuaacuucccaacugaaggccuaucaccuucacaaguaacaauguuuccacacauaauaguagauguaagacaacuagaaccaguacuuauaccuuuaccagacguaagaaauaauuucuaucacuauaaccaaucuaaagacuccacaauaaaacuuauagcaaugcuuuauacaccacuacgagcaaacaaugcaggagacgauguuuuuacaguaucuuguagaguuuuaacuagaccaucaccagauuuugacuucauauuucuaguaccaccuacuguagaaucaagaucaaaaccauucuccguaccaguacuaacaguagaagaaaugaccaacuccagauucccuguaacacuagauaaacuauuuacaggaccaucaucaacuauuguaguacaaccacaaaaugguagaugcaugauugacgguguauuauuaggaacaacacaacuaucaccagucaacauuugcacuuucagaggagacguaacacauccaagagauucaacuauauacacaaugaaccuagcaucacccaauuggaauaauuaugauccaacagaagaaauaccagcaccacuagguacaccugacuucacaggaaaaauacaaggcauguuaacacaaacaacaaaaggagaagguucaaccagaggacauagagcaacaguuuauguuggcucagcagaauuuacacccaaauuaggaaaaguacgcuucgaaacagauacugaagacgaccuaguuauaagacaaaauacaaaauucacaccuguaggaguuauacaaucaucugaccaucauagagacgaaccacaacaauggagacuaccaaacuacucaggagcuaacacauucaauguacacuuagcccccgcaguagccccaaauuucccaggagaacaauuauuauucuuccgaucuacacucccuggauguggcggacauccaaacauggacuuagacuguuugcuaccccaagaauggguacaacauuuuuaccaagaagcagcaccagcacaaucagaugucgcccuacuccgauuugucaauccagacaccucaagaguucuauucgaauguaaauuacacaaaucaggcuauguuacaguugcccauacaggacaauaugauuuaguacucccuuccaacggcuauuuucgcuucgauucauggguaaaccaauuuuauacauuagcacccauggguaacggaacaggucgcagacgauaa

SEQ ID NO: 34734 - RNA, 1614 nt, Artificial Sequence
  derived and/or modified sequence opt6 from VP1__Norovirus_and/or_Norovirus-like__KX514194
augaaaauggcuucaucagacgcaaauccaagcgauggaucagcagcaaaucuaguaccugaaguaaacaacgaaguuauggcauuagaaccaguaguaggugccgcgauagcagcaccaguagcaggccaacaaaauguuauagauccuuggauacguaauaauuuuguacaagcaccaggaggugaauuuacuguaucaccacguaaugcucccggagaaauauuauggucagcaccucuagguccugacuuaaauccauaucucucacaucuagcacguauguauaauggcuaugccggaggauuugaaguacaaguaauauuagcaggaaaugccuuuacagccggaaaaaucauauuugcagcaguaccacccaccuucccaacagaaggucuaucacccucacaagucacaauguuuccacauauaauuguugauguaagacaacuagaaccaguacuaauaccacuaccugauguaagaaacaacuuuuaucauuauaaucaaucaaaugauucaacaauuaaauuaauagcaaugcuauacacuccucuucgagcaaauaauccaggagaugauguauucacaguaucuugucgagucuuaacacgaccuucacccgacuuugauuucaucuucuuagucccaccaacaguagaaucucgaaccaaaccauucucuguaccaauccuaacaguuggugaaaugacaaauagcagauuuccuauaaaucucgaacgacuauuuaccgguccuucaucagcuaauguaguacaaccucaaaacgguagauguacaauugacggagaauuacuuggaaccacucaauuauccucuguaaacauauguacauuuagaggagauguaacccauauuggaucaacacaucauuggacaaugaaccuagcauccccaaauuggaauaacuaugaccccacagaagaaacaccagcaccauuaggaacacccgauuucguagguaaaauccacggcauguuaacacaaacaacacaaggaaacggaucaacuagaggacauagagcaacaguuuaugucggauccgcagaguucacuccaaaacuaggaaaaguucaauuuaaaacagaaacagaucacgauuuagcaauacgucaaaauacaaaauucacaccuguuggagucauacaagaauccgaucaccauagagaugaaccacaacaauggcgacucccuaauuauucuggagcaaauacuuucaauguucauuuagcucccgcaguggccccaaauuuuccaggcgaacaauuauuauuuuucagaucuacauuaccuggcugcggaggacacccaaacauggauuuagauuguuuacuuccacaagaauggguacaacauuuuuaucaagaagcagcaccagcucaaucagauguagcacuauuacgauuuguaaacccagauacauccagaguauuauucgaaugcaaacuucacaaaucagguuauguaacaguagcacauacaggacaauaugauuuaguauuaccuaguaacggauacuuuagauucgauucuuggguuaaucaauuuuacacccucgccccaauggguaauggcacaggaaggagaagauaa

SEQ ID NO: 34735 - RNA, 1614 nt, Artificial Sequence
  derived and/or modified sequence opt6 from VP1__Norovirus_and/or_Norovirus-like__KY424340
augaaaauggccuccucagaugcaaauccaucagacggaucagcugcaaaccuaguaccugaaguuaacaacgaaguaauggcauuagaaccaguaguaggagccgcuauagcugcaccaguagcaggacaacaaaauauuauagacccauggauaagaaacaauuuuguacaagcuccaggaggagaauuuacuguaucacccagaaacgcuccuggagaaauacuuugguccgccccuuuaggcccagaucuaaaccccuaucuaucacaucuuucaagaauguauaauggauacgccgguggauucgaaguacaagucauauuagcaggaaaugcauucacagcaggaaaaguaauauucgcagcaguaccuccaaacuucccaacugaaggccuaucaccuucccaaguaacaauguuuccucacauuauaguagacguccgccaguuagaaccaguacuaauaccauuacccgaugucagaaauaacuuuuaucacuauaaucaaucacaugauucuacucuuaaauuaaucgcuaugcuuuacacaccauuaagagcuaauaacgcgggagaugauguauuuacugugucaugcagaguucuaacaagaccuucaccagauuucgauuucaucuucuuaguaccacccacaguugaaucuagaacaaaaccauucacaguuccaauauuaacgguugaagaaaugucaaacucccgcuuuccaauaccccucgaaaaacuauauacaggacccucauccgcuuuuguaguucaaccacaaaauggaagauguaccacagauggaguucuacuaggaaccacacaacuuagugcaguaaauauauguaauuuucgcggagauguaacacacaucguaggaucucaugacuacacuaugaaccuagcuucucaaaauuggagcaauuaugauccaacagaagaaaucccagcuccacuaggaacaccugacuucguuggaaaaauucaaggauuauuaacacaaacaacuagagcagaugggucaacacgugcacauaaagccacagucucaaccggaucuguacacuucacaccaaaauuaggcucaguacaauucaccacagauacaaacaaugacuuucaaaccggacaaaauacaaaauucacacccguaggaguaauacaagauggcgaccaucaccaaaacgaaccacaacaauggguucucccaaacuacuccggaagaacaggacacaacguccaucuggcaccagcuguagcuccaacuuuuccaggugaacaacuccuauucuuucgcagcaccaugcccgguuguucaggauacccaaacaugaaccuagauuguuuacucccucaagaaugggucuuacauuuuuaccaagaagccgccccugcacaaucagauguagcacuccuccgauuuguaaacccagauaccggaagaguacuauucgaauguaaauuacacaaaucaggauauauaacaguagcucauacaggaccauacgaucuaguaauaccaccaaacggcuauuuuagauucgauucauggguuaaucaauucuauacacucgcaccaaugggaaacggaacaggaagaagaagauaa

SEQ ID NO: 34736 - RNA, 1614 nt, Artificial Sequence
  derived and/or modified sequence opt6 from VP1__Norovirus_and/or_Norovirus-like__LC016606
augaaaauggcaucaaaugacgcaaguccaucagaugguucaacagccaaucuaguacccgaaguaaauaaugaaguaauggcacuagaaccaguagucggagccgcaauagcagcaccaguagcaggacaacaaaauguuauugauccauggaucagaaacaauuuuguccaagcaccaggaggagaauuuacaguaucuccaagaaaugcaccaggagaaauauuaugguccgcaccccuaggaccagauuuaaacccuuacuuaucucaucuagcacgcauguauaauggguaugcaggcgguuucgaaguacagguaauucuagcaggaaaugcauucacagcaggaaaaauuaucuuugccgcagucccaccaaauuucccaacagaaggauuaucaccuucucaagucacaauguuuccccacauaauaguagauguaagacaacuagaaccaguacuaauaccacuccccgacguaagaaauaauuuuuaucacuacaaucaaucgaaugauucaacaauaaaauuaauagcaauguuauauacaccacuaagagcuaauaaugcaggagaugauguauuuacaguaucaugucgaguuuuaacuagaccaucaccagauuuugauuuuauauuucuggucccuccaacaguugaaucacgaacaaaaccauuuacaguaccaauccuaacuguagaagaaaugacuaauucacgauucccaauaccucucgaaaaacucuuuacugguccuucuuccgcguuuguaguacaaccccaaaacggaagauguacaacugacggcguccuucuuggaacuacucaauuaucaccagucaauauaugcacauuuagaggugauguaacacacauauccgguacacauacauacagaaugaacuuagccucacaaaacuggaauaauuacgaucccaccgaagaaaucccugcuccacuaggaacuccugauuuugucgguaaaauccaaggaauguuaacucaaacaacaaaaggagacggaucuacaagaggacacaaagcaacaguaucaacaggaucagucgacuuuacaccaaaacuugguucaguacaauuugcaacagauacaaauaacgacuuugaaaccggacaaaauacucgauucacgccaguaggaguaauucaagauggaucagcacaucguaaugaaccucaacaauggguuuuaccagacuauucuggcaaaaccguucauaacguacauuuagccccugcagucgcaccuacauuuccuggagaacaauuauuguucuuucguucaaccaugccaggaugcucagguuaucccaauauggaucuugauuguuuacucccacaagaauggguccaacauuuuuaccaagaagcagcaccagcacaaucagauguagcacuauuaagauucguaaauccagacaccgguagaguauuauuugaauguaaauuacauaaaacaggauacguaacaguggcucauacaggccaacacgaccuaguaauaccuccgaauggauauuuuagauuugauucuuggguaaaucaauuuuacacacuugcaccaauggguaacggugcaggaagaagacgauaa

SEQ ID NO: 34737 - RNA, 1614 nt, Artificial Sequence
  derived and/or modified sequence opt6 from VP1__Norovirus_and/or_Norovirus-like__FJ537136
augaaaauggcauccucagacgcuaacccauccgauggaucagcagcaaacuuagucccugaaguaaacaaugaaguaauggcccuugaaccuguuguuggagcagcaauagcagcaccaguagcuggucaacaaaauauaauagaucccuggaucagaaacaauuuuguacaagcacccggaggagaauuuacaguaucaccuagaaaugcaccaggugaaauauuauggucagccccucuaggaccagaccuaaauccauaccuaucacauuuaucaagaauguacaauggauaugcaggaggauucgaaguacaaguaauauuagcaggaaacgcauucacagccggaaaaguaauuuuugcagcuguaccaccaaauuuuccuaccgaaggacuaaguccuucucaagucacaauguucccacauauaauaguagacguccgacaacuagaacccguacuaauaccucuucccgauguccgaaacaauuucuaccacuauaaccaaucacaugacucaacuuuaaaacucauagccauguuauacacaccuuuaagagcaaacaaugcaggagacgauguauuuacuguuucuuguagaguauuaaccagaccaucacccgacuuugacuuuauauuuuuagucccaccaaccguagaauccagaacuaaaccuuuuacuguaccaauauuaacaguagaagaaaugucuaacuccagauuuccuauaccacuagaaaaauuauauacaggaccuucaucagcauuugucguacaaccucaaaacggaagaugcacuacugacggaguacuccucgguacaacacaauuauccgcaguaaacauauguaacuuuagaggagacguuacacauauaguagguucacaugauuacaccaugaaucuaguaucccaaaacugguccaauuacgacccaacagaagaaaucccugcaccauuaggaacuccugacuucguaggcaaaauacaaggucuacuaacacaaacuacaagagcugauggcaguacaagagcacacaaagcaacaguaaguaccgguucaguacauuucacaccaaaacugggauccguccaauucacaacagauacaaauaacgauuuccaaacaggacaaaauacuaaauuuacuccaguuggcguaauacaagauggugaccaucaccaaaacgaaccacaacaauggguacuaccuaauuauucaggaagaacuggucauaauguacaccuugcaccagcaguagcaccuacuuuccccggugaacaacuuuuauucuuuagauccacuaugccagguuguucaggauauccaaauaugaaccuggacugucuauuaccacaagaauggguacuacacuucuaccaagaagccgcaccagcacaaucagauguagcacuucucagauuugucaacccagauacaggccgaguccuuuuugaauguaaacuucacaaaucuggauacauaacaguagcucauacaggaccauaugacuuaguaauuccaccuaaugguuauuuuagauuugacucauggguuaaucaauuuuauacauuagcaccaaugggaaauggaacaggucgacgacgauaa

SEQ ID NO: 34738 - RNA, 1614 nt, Artificial Sequence
  derived and/or modified sequence opt6 from VP1__Norovirus_and/or_Norovirus-like__AY532117
augaaaauggcaucaaaugacgcaaauccuucugacggaucaacagcaaaucuuguaccugaaguaaauaaugaagucauggcauuagaacccguuguaggagcagcaaucgcugcaccagucgcaggccaacaaaauguaauagauccuuggauaagaaauaauuuuguacucgguccauggggagaauuuacaguuuccccuagaaacgcaccaggagaaauauuauggucugcaccauuaggcccagauuuaaauccauauuuaucacaccuugcucgaauguauaacggauacgccggugguuucgaaguucaaguaauacuagcaggaaaugcauucacagcagguaaaauaauauuugcagcaguuccaccaaacuuuccuacagaaggcuuaucuccuucucaaguuacaauguucccucauauaauaguagauguaagacaacuagaaccaguuuuaauaccccucccagacguacguaacaauuuuuaucacuauaaucaaucaaaugacucuaccauuaaauuaauagcaauguuauauacaccccuuagagcaaacaacgcaggagaugauguauucacuguuucaugucgagucuuaacaagacccucaccagacuuugauuuuauuuuucuaguaccaccuacuguagaaucaagaaccaaaccauucacaguaccaauauuaacaguugaagaaaugucuaacucaagauuuccaauaccucuugaaaaacuauauacagguccauccagugcauuugucguacaaccacaaaauggacgcuguaccacagacggaguauuauuaggcacaacucaacuaucagccguaaacauauguacauucagaggagacguaacacacauagcaggaucccaugauuacacuaugaaccuagcaucucaaaauuggaauaauuacgacccaaccgaagaaauucccgccccacuaggaacaccugacuucguagguaaaauacaaggcguauuaacacaaacaaccagagaagacggaucaacucgagcucauaaagcaacagucagcacaggcucaguacacuucacaccuaaauuaggaucaguucaauacacaacagauacaucuaacgauuuccaaacaggccaaaauaccaaauuuacaccaguaggcguuauucaagacggaaacaaccaucagaaugaaccucaacaauggguacuaccuaauuacucuggaagaacuggacauaacguucaccuagcaccagcaguagcaccaaccuucccuggugaacaacucuuauucuucagaucaaccaugccaggauguucaggauauccuaacaugaacuuagauuguuuauuaccacaagaauggguacaacauuuuuaccaagaagcagcaccagcacaaucagacgucgcauuauuaagauuuguaaaucccgauaccggaagaguauuauuugaaugcaaauuacacaaaucaggauacguaacaguagcacauaccggaccuuacgacuuaguaauuccaccaaacgguuacuuucgauuugauuccuggguaaaucaauuuuauacacuagcacccaugggaaauggagcagguagacgaagauaa

SEQ ID NO: 34739 - RNA, 1614 nt, Artificial Sequence
  derived and/or modified sequence opt6 from VP1__Norovirus_and/or_Norovirus-like__KX514279
augaaaauggcaucaaaugaugcuaacccaucagacggaucugccgcaaaucuaguaccagaaguaaacaacgaaguaauggcuuuagaaccagucguaggagcagccauugcagcaccugucgcuggacaacaaaacguaauagaucccuggauacgaaauaauuuuguacaagcaccaggaggugaauuuacaguaucuccaagaaacgcuccaggagaaauacucuggucagccccacuaggaccagaccuaaauccauaucuaucucacuuagcacgaauguacaauggauacgcaggcggcuuugaaguacaaguaauacuagcaggaaaugcauuuacugcuggcaaaauaauauuugcagcaguacccccaacauucccaaccgaaggacuaucaccaucccaaguaacaauguuuccacacaucauuguagacguaagacaauuagaaccaguccucauaccacuaccagacguaagaaacaauuucuaccauuauaaccaaucuaacgauucaacaauuaaacuaauugcuauguuauacacaccacuacgagcuaauaacccaggagacgauguauucacaguauccugccgcguuuuaacacgcccaucaccagauuucgacuuuauauuccuaguaccaccaacaguugaaucaagaacaaaaccauuuuccguuccuauacuaacaguaggugaaaugacaaauucaagauucccaauaaaccuugaaagacuauucacuggacccucauccgccaauguaguucaaccacaaaacggcagauguaccauugacggagaauuacucggaacaacacaacucuccaguguuaauauaugcacauuccgcggagacguaacucaaauagguucuacacaucacuggacaaugaaucuagcaucaccaaacuggaauaacuaugauccaacagaagaaacaccagcaccauuaggaacccccgacuucguaggaaaaauucauggcauguuaacccaaacaacucaagaaaauggcucaacacgagcccaucgagcaacaguauacgucggaucagcugacuuuacuccaaaacuagguaaaguacaguucgaaacagacacagaagaugacuuagccauuagacaaaauaccaaauucacaccaguaggaguaauacaauccucugaucaucacagagacgaaccacaacaauggcgacuuccaaacuauucaggagcuaauacauuuaauguacaccuagcuccagccgucgccccaaauuuuccaggugaacaauuauuauucuuccgaucaacacuaccaggaugcggaggacauccaaacauggauuuagacugcuuacuaccacaagaauggguucaacauuuuuaucaagaagcagcuccagcacaaucugauguugcacucuuacgauuugucaauccugauacaaguagaguacuauucgaaugcaaacuacauaaaucaggauacguaacuguagcacauaccggacaauaugaucuuguauuaccuucuaauggauauuucagauuugauucauggguaaaucaauuuuacacauuagcuccaauggguaacggaacagguagacgaagauaa

SEQ ID NO: 34740 - RNA, 1614 nt, Artificial Sequence
  derived and/or modified sequence opt6 from VP1__Norovirus_and/or_Norovirus-like__LC016602
augaaaauggccucaaaugaugccucuccaucagauggauccacagcaaauuuaguuccagaagucaauaaugaaguaauggcguuagaaccaguaguuggagcagcuauagccgcuccaguugcaggacaacaaaauguaauagauccauggauaaggaauaauuuuguacaagcaccaggaggagaauuuacagucucuccaagaaaugcacccggagaaauauuaugguccgcuccauuaggaccagaucuuaauccuuacuuaucucacuuagcuagaauguacaauggauaugccgguggauucgaaguacaaguaauauuagcagguaaugcauuuacagcagguaaaauaauauuugcagcuguaccacccaauuuccccacagaaggauuaucaccaucacaaguaacaauguuuccacauauaauuguagacguaagacaauuagaaccaguauuaauaccucuacccgacguacgaaacaauuuuuaucauuacaaccaaucaaacgacucaacaaucaaacucaucgcaauguuauacacaccacuaagagcaaauaaugccggagacgaugucuuuacaguuucuugcagaguucuaacucgaccaucaccagauuuugauuuuauauuucuagucccaccaacaguagaaucaagaacaaaaccauuuacuguacccauucuaacaguagaagaaaugacaaauucuagauucccaauaccauuagaaaaauuauuuacaggcccaagcucagcuuuuguaguccaaccacaaaauggaagaugcaccacugacggaguacuacuuggaacaacacaauuaucaccaguaaacauaugcacuuuucgaggagauguuacccacauaucugguaccucuacuuaccgaaugaaccuugcaucacaaaauuggaacaauuaugaucccaccgaagaaauacccgcacccuuaggaacaccagauuucguaggaaaaauacaaggaaugcuaacacaaacuacuaaaggcgacgguucaacaagaggacacaaagcuacaguaaguaccggaucagucgacuucacucccaaacuaggaucaguacaauuugauacugacacaaacaaugaccuagaaacaggacaaaauacacgcuucacuccugucggaguaauacaagacggaucugcacauagaaaugaaccacaacaauggguauuaccugauuauuccggaagaacaguucauaauguacaucucgcaccagccguagccccaacauuuccuggcgaacaacuccucuuuuuccgaucaacuaugccagguuguucaggauauccaaacauggacuuagauugucuucuaccacaagaauggguacaacauuucuaucaagaagcagcaccagcucaauccgacguagcccuauuacgcuucguaaacccagauacaggccgaguauuauuugaaugcaagcuacauaaaacaggauacguaacuguugcacauacuggccaacacgaucuaguaauaccaccaaacggauauuuuagauuugauuccuggguaaaucaauuuuacacuuuagccccuaugggaaauggugcuggaagacguagauaa

SEQ ID NO: 34741 - RNA, 1614 nt, Artificial Sequence
  derived and/or modified sequence opt6 from VP1__Norovirus_and/or_Norovirus-like__AF145896
augaaaauggcaucuucugacgcaaauccuucagauggaucugcagcuaaccuugucccugaaguaaauaacgaaguaauggcuuuagaaccuguagucggcgcagcaauagcagccccaguagcuggacaacaaaauauaauagauccauggauacguaauaauuucguacaagcaccaggaggugaauuuacaguuucaccacgcaaugcuccaggagaaauuuuauggucugcuccuuugggcccagaucuaaacccauaccuaucccaucucucuagaauguauaacggauaugcaggagguuucgaaguccaaguaauauuagcaggaaacgcauucacagcaggcaaaguaauauucgcagcaguuccucccaauuuuccaacagaaggacuaucaccaagccaaguaacaauguucccacauauaauuguugauguuagacaacuagaaccuguauuaauaccacuaccagacguacgaaauaauuucuaucauuauaaucaaucucaugauucaacacuaaaauuaauugcaauguuauauaccccacucagggcaaacaacgccggugaugauguuuuuacaguuucuugucgaguacuaacaagaccaucaccagauuuugauuuuauauuucucguuccuccaacaguagaaucuagaacuaaaccauucaccguuccaauucuaacaguagaagaaaugucaaacucacguuucccaaucccuuuagaaaaacuauacacaggcccaaguucugcuuucguuguacaaccccaaaaugguagauguacaacugauggaguauuguuaggaacuacacaauuaucagcaguuaauauuuguaacuuccgaggugacguuacacauauuguuggcagucaugacuacacuaugaauuuagcaucucaaaacuggucuaacuaugauccaacugaagaaauaccugcaccauuaggcacuccagacuuuguaggaaaaauucaaggauuauuaacacaaacuacaagagcugauggaucuacuagagcucauaaagcaacugucuccacuggaucuguacacuucacgccaaaauuaggcucaguucaauuuacaaccgacacaaauaaugacuuucaaacaggacaaaacacaaaauuuacaccaguaggcguuauacaagauggagaccaucaccaaaaugaaccacaacaauggguauuaccaaacuacucaggaagaacaggacauaauguacaucuagcaccagcuguagcuccaaccuuuccaggagaacaauuauuauucuuccgaucaacaaugccaggauguaguggcuauccaaauaugaaucuagacuguuuauuaccucaagaauggguauuacauuuuuaucaagaagcugcuccagcacaaucagauguugcauuacuucgauuuguaaauccagauaccgguagaguacuauucgaauguaaacuccauaaauccggauauauaacuguugcacauacaggaccauuugauuuaguaauacccccaaauggauauuuucgauuugacucaugggucaaccaauuuuacacauuagccccuaugggaaauggaacaggaagaagaagauaa

SEQ ID NO: 34742 - RNA, 1614 nt, Artificial Sequence
  derived and/or modified sequence opt6 from VP1__Norovirus_and/or_Norovirus-like__AB684704
augaaaauggcauccucagaugcaaauccaucagacgguucugcagcuaacuuaguaccagaaguaaacaaugaaguaauggcacucgaaccuguagucggugcagcaauagcagcaccaguagcaggacaacaaaacauuauugauccuuggauucguaauaacuucguacaagcuccuggaggugaauuuacaguaucuccaagaaacgcaccaggagaaauacucugguccgcaccccuuucaccagauuuaaacccauaucuaucacaccucucacgaauguauaaugguuaugcaggcggauucgaaguccaaguuauacuugcaggaaacgcauucacugcagguaaaguaauauucgccgcaguuccaccaaacuucccaaccgaaggauuaucaccaucccaaguuacaauguuuccacauauaauaguugauguaagacaauuagaaccagucuuaauuccacuuccagauguacgaaauaauuuuuaccacuacaaccaagcccaugauucuacacuaaaauuaauagcaauguuauauaccccauuaagagcuaacaaugcaggagaugacguuuuuacaguaucuuguagaguucuuacuagaccauccccagacuucgauuuuauauuucuaguacccccuacuguagaaucuagaacuaaaccauucacaguacccauuuuaacaguugaagaaaugucaaacagcaaauuccccaucccacuagaaaagcuauacacaggaccaucaucagccuuuguaguacaaccacaaaaugguagauguacaacagacggaguauuacuaggaacaacccaacuaucugcaguaaauauauguaauuuuagaggagauguuacaagaguaggaacaucacacgauuacacuaugaaucuagucucucaaaacuggaacaauuacgaccccacugaagaaauaccugcuccucuaggaacaccagacuucguaggaaaaauacaaggauuauuaacacaaacaaccagagccgacggcucuacucgcgcacauaaagcuacaguauccacaggaucaguucacuuuacaccuaaauuaggauccguacaauucacaacagacacaaacaaugacuuugaaacaggacaaaauacaaaauucacacccguaggaguaauccaagacggcgaucaucaccaaaaugaaccucaacaaugggucuuaccuuccuacucaggaucuucaggacauaauguacaucuagcuccugcaguagcaccaacauucccaggcgaacaacuacucuucuuucgaucuacaaugccaggauguucaggauaucccaacaugaaucuugauugccuacuuccacaagaauggguacuacacuuuuaccaagaggcagcaccagcacaaucagacguagcauuauuaagauucguaaacccagacacagguagaguacuauuugaauguaaauuacauaaaucaggauacauaacuguagcucacacugguccauacgaucucguaaucccucccaacggauacuuccgauucgauucauggguaaaccaauuuuauacucuagcucccaugggaaauggaacuggaagaagacguuaa

SEQ ID NO: 34743 - RNA, 1614 nt, Artificial Sequence
  derived and/or modified sequence opt6 from VP1__Norovirus_and/or_Norovirus-like__JX401279
augaaaauggcaucaucagacgcaaacccaucagauggauccgcagcaaacuuaguuccagaaguaaacaaugaaguaauggcauuagaaccagucguuggugcugcaauagcagcucccguagcuggccaacagaacauaauagacccauggauacgaaacaacuucguacaagcucccggaggagaauuuacaguauccccacguaacgcuccaggagaaaucuuauggagugcaccacucggacccgaucuuaauccauaucuaucucaccuuucccgaauguacaauggauacgcaggaggcuucgaaguucaaguuauucuagcaggaaaugcauuuacagcaggaaaaguaauuuucgcagcaguuccaccaaauuuuccaacagaaggucuaucucccucacaagucacaauguucccucacauaauaguugauguacgacaacuagaaccagucuuaauaccacuuccagauguaaggaacaacuucuaccauuauaaucaagcucaugacucaacucuaaaacuuauagcuaugcuuuauacuccauugcgagcaaauaacgcaggagaugauguauuuacagucucaugcagaguacuaacaagacccucaccugauuucgauuucauauuccuaguaccaccaaccguagaaucaagaacuaaaccauucacaguaccuauauuaacaguagaagaaaugucaaacucucgauuuccaauaccauuagaaaaacuuuacacaggaccaucuucagccuucgucguacaaccacaaaauggcagauguacaaccgaugguguacuuuuaggaacaacacaacuaucagcaguuaauauauguaacuucagaggagacguaacaagagucggcacaucccacgauuauacaaugaaucuaguaucucaaaacuggaacaacuacgacccaaccgaagaaauuccagcaccacuaggaacaccagauuucguaggaaaaauucaaggacuauuaacacaaacaaccagagcagauggaucaacaagagcacauaaagccacaguaucaacaggaucaguacacuuuacaccaaaauuaggaucaguacaauuuacaacagauacugauaacgauuuccaaacgggacaaaacacaaaauuuacuccaguuggaguuauucaagauggagaucaccaccaaaaugaaccacaacaauggguacuaccuaauuacucuggaacauccggucauaauguacacuuagcaccagcaguagcaccagcauuccccggcgaacaacuuuuauuuuucagauccacaaugccaggauguucuggauacccaaacaugaauuuagauugucuacucccacaagaauggguacuacauuuuuaucaagaagccgcuccugcacaaucagauguugcauuacuaagauucgucaauccagauacagguagaguucuauuugaaugcaagcuacauaaaagcgguuacauaacagucgcacacaccggcccauaugacuuaguaauaccaccaaacggauacuuuagauucgacucauggguaaaucaauuuuauacuuuagcaccaauggguaacggcacagguagaagacguuaa

SEQ ID NO: 34744 - RNA, 1614 nt, Artificial Sequence
  derived and/or modified sequence opt6 from VP1__Norovirus_and/or_Norovirus-like__GQ389627
augaaaauggcaucaaaugaugcuaauccuucagauggaaguaccgccaaccuaguaccagaaguaaacaaugaaguaauggcacuagaaccaguuguaggcgcagccauagcagcaccaguagcaggucaacaaaaugucauagauccauggauaagaaauaacuucguccaagcaccaggaggcgaauuuacaguauccccaagaaaugcaccaggagaaauauuauggucugcuccucuaggaccagaucuaaauccauauuuaucacacuuagcucgaauguauaacggauacgcaggaggauucgaaguucaaguaauucuagcaggaaacgcauuuacugcuggaaaaauuauauucgcagcuguaccaccuaacuuuccaacagaaggcuuaucacccucacaaguuacaauguucccucauauaauaguagauguuagacaacuagaaccuguauuaauaccauuaccugacguaagaaauaauuucuaccauuacaaccaaucaaacgacucuacaauaaaacucauugcuaugcuauauacaccccuacgugcaaacaaugcgggagacgauguauuuacaguaucaugcagaguauuaacacgaccaucaccagacuuugacuucauauuuuuaguaccaccaaccguugaaucuagaacaaaaccauucacuguaccaauacuuacuguagaagaaauguccaauucaagauuuccuauacccuuagaaaaacucuauacaggaccauccucagccuuuguaguacaaccccaaaauggcagauguacaacagauggaguacuacuaggaacaacucaauuauccgcuguaaauauauguaccuuuagaggagacguaacacauauugcuggaucucacgauuauacaaugaaucuagcaucacaaaacugguccaauuacgauccaacagaagaaauaccugccccacuaggaaccccugauuuuguaggaaaaauacaaggaaugcuaacacaaacuacaagagaagacgguucuacaagagcacauaaagccacuguauccacaggaagcguacacuucacacccaaauuaggaucaguacaauauacaaccgauacaaauaacgacuuucagacaggacaaaauacaaaauucacaccgguuggcguaauccaagacggaaacaaucaucaaaacgaaccucaacaauggguacucccaaacuacucuggaagaacaggacacaauguacaccuugcuccagcuguagcgccaacauucccuggcgaacaauuacucuucuuucgaucaaccaugccaggcugcucuggauauccaaauaugaauuuagacuguuuauuaccacaagaauggguacaacacuuuugucaagaagcagccccagcacaauccgauguugcacuacuacgauucgucaauccagauacaggaagaguuuuauuugaauguaaauuacauaaaaguggauaugucacaguagcacauacaggaccacaugacuuaguaauaccucccaauggauauuucagauuugauucuuggguaaaccaauucuauacauuagcgccaauggguaacggagcaggacgacgaagauaa

SEQ ID NO: 34745 - RNA, 1614 nt, Artificial Sequence
  derived and/or modified sequence opt6 from VP1__Norovirus_and/or_Norovirus-like__AF425763
augaaaauggcuuccaaugacgcuaacccaucagaugguucaacagccaauuuaguaccagaaguaaacaaugaaguaauggcauuagaaccaguaguaggagcagcaaucgcugcucccguagcuggccaacaaaacguuauagacccauggauccgaaauaacuuuguacaagcuccaagaggagaauuuacaguuucccccagaaacgcaccaggagaaauauuauggucagcaccucuaggaccagaucuuaauccauaucuaucacacuuagcuagaauguacaacgguuaugccggaggauucgaaguacaaguaaucuuagcagguaaugcauucacagcaggcaaaauaauauucgcagcagucccaccaaacuucccaacagaaggacuuucuccaucacaagucaccauguuuccucacauuauaguagauguaagacaacuugaaccaguucuaauaccacucccagauguacgaaacaacuuuuaucacuacaaccaaagcaaugauucaacuauaaaauuaauagcaaugccuuauacaccauuaagagcaaauaaugccggugacgauguauucaccguaucuugcagaguauuaacaagaccaaguccugauuucgacuuuauauuccuaguaccaccuacugucgaaucacguaccaaaccauucacugucccaauauuaacaguagaagaaaugucaaacucaagauuuccaauaccccuagaaaaacucuauaccggaccaucaucagcauucguaguacaaccccaaaacggaagaugcacaacagauggaguauuacuaggaacaacacaacuaucagcaguuaacauaugcacauuuagaggagacguaacacauaucgcagguucacaugauuauacaaugaauuuagcaucccaaaacuggaauaacuaugacccaaccgaagaaaucccagcaccacuaggaacaccugauuuuguagguaaaauacaagguaugcuuacacaaacaacaagagaagauggauccacacgugcacacaaagcaacaguuucaaccggaucaguucacuuuacaccaagacugggaucaguacaauauaccacugauacaaacaacgauuuucaaacaggucaaaauacaaaauucacaccaguaggaguaauacaagacggcaacaaucaccaaaaugaaccacaacaauggguacuaccaaauuacagcggccgaacaggacacaacguacaccuagcaccagcaguagcaccaacguucccaggagaacaauuacuauucuucagaucaacaaugccaggcuguaguggauaccccaauaugaaccuugauugccuauuaccacaagaauggguccaacacuuuuaccaagaagcugcaccagcucaaucagauguagcacucuuacgauuuguaaacccagauaccggacgcguucuauucgaaugcaaacuucacaaaucaggcuauguaacaguagcacauacuggaccacaugacuuagucauacccccaaaugguuauuuuagauuugacucuuggguaaaucaauuuuauacacuagccccaauggguaacggagcaggccgcagaagauag

SEQ ID NO: 34746 - RNA, 1614 nt, Artificial Sequence
  derived and/or modified sequence opt6 from VP1__Norovirus_and/or_Norovirus-like__AY532127
augaaaauggcaucuaaugacgcaaauccaucagacggauccacagccaaccuaguuccugaaguuaacaacgaagucauggcauuagaaccaguuguaggcgccgccauagcggcaccuguagcaggucaacaaaauguaauagacccauggauaagaaauaauuuuguccaagcaccaggaggcgaauuuaccguuucaccacgaaaugcacccggugaaauacuauggucagcaccacuaggaccagaccuaaacccauacuuaucacacuuagcacgaauguacaacggauaugcaggaggauucgaaguacaagucauauuagcuggaaaugcuuucacagcaggcaaaauaauauuugcggcaguaccuccaaauuuuccaacagaaggacucucuccaucccaagucaccauguucccacauauaauaguagacguacgacaacuagaaccaguucucauaccauuacccgacggacgaaauaauuuuuaucacuauaaucaaucuaaugacucaaccauaaaauuaauagcaauguuauauacaccucuaagagcaaacaaugcaggagacgacguuuucacaguaucauguagaguauuaacaagaccuucaccagacuucgauuuuauauuucuuguuccaccaacaguugaaucaagaacaaaaccauuuacaguuccaauucuuaccguagaagaaaugucaaacucuagauuuccaauaccauuagaaaaacuauauacaggcccuucaucagcauucguaguucaaccucaaaacggaagauguacaacagacggaguauuauuagguacaacucaauuaucagcuguaaacauaugcaccuuuagaggagauguaacccauauagcaggaucacaugauuacacaaugaauuuagccucccaaaauuggaacaauuacgauccuacagaagaaauaccagcuccacuuggaacuccagauuucguaggaaaaauacaagguacuuuaacccaaacaacuagagaagacgguuccacucgcgcucacaaagcaacaguaucaacaggaagcguacauuuuacaccuaaauuaggaucagcacaauacacaaccgacacaaauaaugauuuccaaacaggacaaaauaccaaauucacccccguaggcguaauucaagacgguaauaaccaccaaaacgaaccacaacaauggguauuaccaaacuacagcggaagaacaggucacaauguacacuuagcaccagcagucgcaccaacauuuccaggagaacaauuacuauucuuucguuccaccaugccuggauguucuggauacccuaacaugaauuuagauugucuauuaccucaagaauggguacaacacuuuuaccaagaagcagccccugcacaaucugaugucgcacuccuuagauuuguaaacccagauacaggacgaguccuauucgaauguaaacuacacaaaucaggcuacguaacaguugcacauaccggaccacacgaccucguaauaccaccaaaugguuacuuuagauuugacaguuggguaaaccaauucuauacucuugcaccuaugggcaacggagcaggcagacgaagauaa

SEQ ID NO: 34747 - RNA, 1614 nt, Artificial Sequence
  derived and/or modified sequence opt6 from VP1__Norovirus_and/or_Norovirus-like__AY532118
augaaaauggcaucaaacgacgcaaaucccucagacggcucaacagcaaauuuagucccugaaguaaauaaugaagucauggcacuugaaccaguaguuggugcagcuauagcugccccagucgcaggacaacaaaauauaauagacccuuggauaagaaauaauuuuguucaagcaccuggaggagaauuuacagucucuccaaggaaugcaccaggagaaauauuauggucagcaccauuaggaccagaucuaaauccauacuuaucacaucucgcaagaauguauaacggauaugcaggaggauucgaaguccaaguaauauuagcaggaaaugcauuuacagccggaaaaauaauauuugcagcaguaccuccaaacuuucccacagaaggauuagguccaucucaaguuacaauguuuccccauauuauagucgauguaagacaauuagaaccaguucuaauaccccuaccagauguaagaaacaauuucuaccauuauaaucaaucaaacgacucuacaauaaaauuaauagccaugcuauacacuccacuaagagcaaacaacgcaggcgacgacguuuuuacaguaucaugucgaguauuaaccaggccaucaccagacuuugauuuuauauuuuuagucccaccaacaguugaaucacguacaaaaccauucacagugccaauacuaacuguagaagaaaugaguaauucuagauuuccaguaccccucgaaaaacuauauaccggaccaucaucugcauucguaguucaaccacaaaacggacgauguacuacagacggcguacucuuagguacaacacaacuaucugcuguaaauauaugcacauuccgaggagauguuacacauauagcaggaucuagagacuauacaaugaaucucgcaucacaaaacuggaauaacuacgacccaacagaagaaauuccugccccucuaggaacuccagauuuuguaggaaaaauucaaggaguccucacccaaacaacccgagaagacggcucaacuagagcucacaaagcaacaguuucuacuggaucuguccauuuuaccccaaaauuaggaagcguacaauacacaacagauacagacaaugauuuucaaacaggacaaaacacaaaauucaccccaguagguguaauacaagauggaaacaaccaccaaaacgaaccacaacaauggguauuaccaaauuacuccgguagacccggacacaauguacauuuagccccagccguagcuccaacauuucuaggagaacaauuauuauucuuuagaucaacaaugcccggauguucuggauacccuaauaugaauuuagacuguuuacuuccacaagaauggguacaacacuuuuaccaagaagcugcaccagcacaaucugauguagcccuacuuagauuuguuaauccagauacuggccgaguacuuuuugaauguaaauuacacaaguccggcuauguuacagucgcccauacaggaccacaugacuuagucauaccaccuaacgguuauuucagauucgacucuuggguuaaccaauucuauacacuagcaccaaugggaaauggagcagguagaagacgauaa

SEQ ID NO: 34748 - RNA, 1614 nt, Artificial Sequence
  derived and/or modified sequence opt6 from VP1__Norovirus_and/or_Norovirus-like__KX514326
augaaaauggcaucaaaugacgcaaauccaucagauggaucagcagccaacuuaguaccugaaguuaauaaugaaguaauggcacuagaacccgucguuggagccgcuauagcagccccaguagcaggacaacaaaaugucauagauccauggauucguaacaauuucguacaagcaccaggaggagaauuuaccguaucaccacgcaaugcaccaggagaaauacuauggucagcaccacuagguccagaucuaaauccuuacuuaagucaccuagcaagaauguauaauggauacgcaggagguuuugaaguacaaguaauacuagccggaaaugcauucacagcaggcaaaauaaucuucgcugcaguaccaccaaauuucccaacagaaggcuuaaguccaucacaaguuacaauguuuccacauaucauugucgacguaagacaacuagaaccaguucuuauaccacuuccagauguaagaaacaacuuuuaccacuacaaucaaucaaacgacucaacuauaaaacuaauagcaauguuauauacaccacuaagagcaaacaacccaggcgacgaugucuuuaccguuucgugcagaguuuuaacaagaccaucaccagacuucgauuuuauauuuuuaguacccccuaccgucgaaucaagaaccaagcccuuuucaguaccaauacuaacaguaggcgaaaugacaaauucaagauucccaauaaaucuagaacgacuauuuacaggaccaucaucagcaaacguuguacaaccccaaaauggaagauguacaaucgacggugaacuacuaggaacaacccaacuaucauccguaaacauauguacauuccgaggcgacgucacacaaauaggaucaacaaaacauuggaccaugaaccuagcaucuccaaauuggaauaacuaugacccaacugaagaaacaccagcuccauuaggaaccccugauuucgucggaaaaauacacggaaugcuaacacaaacaacacaagaaaacgguucaaccagagcacaccgagccacaguuuauguaggaggagcaaacuucacaccuaaacuaggcaaaguacaauuugaaacugacacuguagacgaucuagaaauaagacaaaauaccaaauucacuccaguuggaguaauacaaucaucagaucaccacagagaugaaccacaacaauggcgucuaccaaauuauucaggagcuaauacauucaauguacauuuagcucccgcaguugcacccaacuucccaggugaacaacuacuauucuuuagauccacucuaccaggaugcggaggacauccuaauauggaucuugacugccuauuaccacaagaauggguacaacacuuuuaucaagaagcagcacccgcacaauccgauguagccuuauuacgcuuuguaaaucccgacacaucuagaguacucuuugaauguaaauuacacaaaucuggcuauguaacaguagcacauaccggucaauaugacuuagucuuacccucaaauggauacuuucgauuugauucauggguaaaucaauucuacacauuagcaccuaugggaaauggcacaggaagacgaagauaa

SEQ ID NO: 34749 - RNA, 1614 nt, Artificial Sequence
  derived and/or modified sequence opt6 from VP1__Norovirus_and/or_Norovirus-like__KX514264
augaaaauggcuaguaaugacgcuaacccaagugauggauccgcagcaaaccuaguaccagaaguaaauaacgaaguaauggcucuagaaccaguuguaggagcagcuauagcagcaccagucgccggucaacaaaauguaauagauccauggauucgaaauaauuuuguacaagcccccggaggagaauuuacaguaucaccuagaaaugcaccaggagaaauacuauggucagcuccucucggaccugacuuaaauccauaucuaucccacuuagcaagaauguacaauggauaugccggcggauucgaaguacaaguaauacuagcaggaaaugcauuuaccgcuggcaaaauaauauuugcagcaguuccacccaacuucccaacagaaggacuaaguccaucacaaguaacaauguucccccauauuauuguagauguaagacaacuugaaccuguacucauacccuuaccagauguuagaaauaauuuuuaucauuauaaccagucaaacgacaguacuauaaagcucauagcuaugcuauauacaccucucagagcuaauaauccaggagaugauguauuuacaguaucaugcagagucuuaacuagaccuucuccagauuuugacuucauauucuuaguaccaccaacaguagaaucuagaacaaaaccauuuaguguuccaauauuaacuguaggagaaaugacaaauagcagauuuccuguuaaucuugaaagacucuuuacaggacccucaucagcaaacguaguccaaccccaaaauggaagauguacaauugacggagagcuauuaggaacaacacaauuaucaaguguaaauauauguacauucagaggagacguaacacauaucgguuccacacaucacuggacaaugaaucuagcaucaccaaacuggaauaauuaugauccuacagaagaaacacccgcaccccucggaacaccugauuuuguaggaaaaauacacggaauguuaacacaaacaacucaaggaucagguucaacaagagcacaucgcgcaaccgucuacguaggaucagcagaauuuacuccaaaauuaggaaaaguccaauuccaaacagaaacugaagaugaccuuguuauccgccaaaacacaaaauucaccccaguagguguaauacaagaaucagaccaccauagagaugaaccacaacaauggagacuuccuaauuacucaggugcaaauacauucaacguacaucuagcaccagcaguagcaccaaauuuuccaggugaacaauuauuauucuuucgaagcacaauaccuggauguggaggacacccaaauaugaacuuagauugccuuuuaccacaagaauggguacaacauuuuuaucaagaagcagccccugcacaaucagauguagcucuauuaagauucgucaauccagauacaucaagaguucuauuugaaugcaaacuacauaaaucaggauacguaacuguugcacauacuggacaacaugaccuaguaauaccaccaaacgguuauuucagauuugauuccuggguaaaccaauuuuauacauuagcaccaaugggcaacggaacagguagaaaaagauaa

SEQ ID NO: 34750 - RNA, 1614 nt, Artificial Sequence
  derived and/or modified sequence opt6 from VP1__Norovirus_and/or_Norovirus-like__KX514171
augaaaauggcaucuaaugaugcaaauccaucagacgguucagcagcaaaucuaguaccugaagucaauaacgaaguaauggcacuagaaccaguaguaggagcagcaauagcugcaccuguugcaggacaacaaaauguaauagacccuuggauccgcaauaauuuuguacaagcacccggaggagaauuuacaguaucacccagaaaugcaccuggcgaaauauuauggagugccccacuaggcccugauuuaaauccuuaucuuucccaucuagcuagaauguauaauggcuaugccgguggauucgaaguccaagucauauuagccggaaaugccuucacagcaggaaaaauaauuuucgccgcaguaccaccaacauuuccaacagaaggauuaucuccaucacaagucaccauguuuccacacauaauagucgacguuagacaacuagaaccuguacuuauaccauuaccugacguucgaaauaauuucuaucauuauaaucaaucaaacgacucaacaauuaaacuaauagcuaugcuuuauacaccauuaagagcaaauaacccaggagacgaugucuuuacaguaucaugccgaguauuaacacgacccucucccgacuuugauuucauauuucuaguaccacccacagucgaaagcagaacuaaaccauucucagucccaauuuuaacaguaggugaaaugacaaauucaagguuuccaguuaauuuagaacgacuauuuacaggaccaucaucagcuaauguaguucaaccacaaaaugguagaugcacuauagacggagaacuccuaggaacaacacaacuaucaucaguaaauaucuguacauucagaggagacguuacccauauaggaacaacacaacacuggaccaugaacuuagcauccccaaauuggaacaauuaugacccaacagaagaaacaccagccccauuaggcacaccagacuuugucggaaaaauacacggaauguuaacacaaacuacacaagguucaggaucaacacgagcucauagagcuacaguauacguaggaucugcagaauuuacaccaaaauuaggaaaaguaagauuugaaacagauacagaagacgaucuaguaauaagacaaaacacaaaauuuacaccagucggcguaauucaaucaagcgaacaucacagagacgaaccacagcaauggagauuaccuaauuauucaggagccaacacauuuaauguucauuuagccccugcaguugcuccaaauuuuccaggcgaacaacuauuauuuuucagauccacccuaccaggcugcggaggacauccaaauauggauuuagacugucuacuaccucaagaauggguacaacauuuuuaucaagaagccgcaccagcacaauccgacguagccuuacuaagauuuguaaauccagacacaaguagaguacuguuugaauguaaacuacauaaaucaggauacguuacagucgcacacacaggacaauaugaccuagucuuaccuuccaauggcuauuucagauucgauuccuggguuaaucaauucuauacacuugcacccaugggcaacggaaccggaagaagaagauaa

SEQ ID NO: 34751 - RNA, 1614 nt, Artificial Sequence
  derived and/or modified sequence opt6 from VP1__Norovirus_and/or_Norovirus-like__KX514170
augaaaauggcuucuaacgaugcaaaccccucagauggaucagcagcuaauuuaguaccagaaguaaauaaugaaguaauggcacuagaaccaguuguaggcgccgcaauugcugccccaguugcaggacaacaaaacguaauagacccauggauacgaaauaacuuuguacaagcaccaggaggugaauuuacuguuucgccaagaaaugcaccaggagaaauauuauggucagcacccuuaggaccagacuuaaauccauauuuaucacaccuagcacgaauguauaauggauacgcaggaggcuucgaaguacaaguaauauuagcaggaaaugcauuuacagcugguaagauaaucuucgcagcagucccucccacuuucccaacagaaggacuaagcccaucacaaguaacaauguuuccacauauaauuguagacguaagacaacuagaaccaguucuaauaccucuaccagacguaagaaacaauuucuaucauuauaaucaaucuaaugauaguacaauaaaacuaaucgcaauguuauauacaccauuacgagcuaauaauccaggagacgaugucuuuacaguuucaugucgcguuuuaacaagaccaucacccgacuuugacuuuauauuucuugucccaccaacaguagaaucacgaaccaaaccauuuucuguaccaauauuaacagucggagaaaugacaaauucaagauuuccaguaaaccucgaaagauuauuuacaggacccucaucagcuaauguaguacaaccucaaaacggaagauguacaauugacggagaauuauuaggaacuacacaauuauccucaguuaacauauguacauucagaggagauguaacacauauagguacaacucaacauuggauaaugaauuuagcaucacccaacuggaauaacuacgauccuaccgaagaaacaccagcgccacuaggcaccccagauuucguaggaaaaauacauggaaugcuuacacaaacaacacaaggcucuggcagcacuagggcacaucgagcaacaguauauguagguuccgcagaauuuacaccaaaacuaggaaaaguaagauucgaaacagauacagaagaugaccuugucauuagacaaaauaccaaauuuacaccuguaggagugauacaaucaucagaacaucaccgcgacgaaccccaacaauggagacuaccaaacuauucuggagcaaauacauuuaacguacaucuagcacccgcuguagcaccaaauuucccaggugaacaacuucuauucuuuagaucaacacuaccaggauguggcggacauccaaauauggacuuagauugucucuuaccucaagaauggguacaacacuuuuaccaagaagcugcacccgcccaaucagacguagcucucuuaagauucguaaauccagauacauccagaguuuuauuugaaugcaaacuucauaaaucuggcuacguaacaguugcacauacaggccaauaugaucucguacuaccaaguaauggcuacuucagauuugacucauggguaaaucaauuuuacacauuagcuccaaugggcaauggaacaggacgccgacgauaa

SEQ ID NO: 34752 - RNA, 1614 nt, Artificial Sequence
  derived and/or modified sequence opt6 from VP1__Norovirus_and/or_Norovirus-like__KF806533
augaaaauggcaucaaaugacgccucaccaucagacgguucugcagcuaaucucgucccagaaguaaauaaugaaguaauggcuuuagaaccaguagucggagcugcaauagcagcaccaguagcuggacaacaaaaugucauagauccuuggauaagaaauaauuucguacaagcgccaggaggagaauuuacaguuucccccagaaacgcaccaggagaaauacuauggucagcuccacucgguccagauuuaaauccauauuuaucacaccuagcuagaauguauaauggauaugcugguggauucgaaguacaaguaauauuagcagguaaugcauuuacagcaggaaaaauaauauucgcagcagucccaccaaacuuuccuacugaagguuuaucaccaucacaaguaacaauguuuccucauauaguaguagacguaagacaacuagaaccaguacucauuccuuuaccagauguacguaacaacuuuuaccauuauaaucaaucuaaagacccaacaauuaaauuaauagcuaugcuuuacacaccacuacgagcaaacaaugcuggagaagauguuuucacaguaaguugcagaguauuaacuagacccagucccgacuuugauuuuaucuuccuuguaccuccaacagucgaauccagaucaaaaccauuuacaguuccuauacuuaccguagaagaaaugacaaauucccguuuccccaucccuuuagaaaaacuuuuuacaggaccaucaucagcauuuguaguacaaccacaaaaugguagauguacaacagauggaguauuauuaggcacaacacaauuaucuccaguuaauauauguacauuucguggagaucuaacccauuuugcaggaacacaugaauaugcuaugaacuuagcaucacaaaauuggacaaacuaugaucccacagaagaaauacccgcuccauuaggcgcucccgauuuuguuggaaaaauaagagguguacuaacccaaacuacaagaggagauggcucaacacgaggacauagagcaacauuaucaacagguuccgcucauuucacaccaaaguuaggaucaguaagauuuucaacugauacaaacaaugauuuugaagcaggacaaaacacaaaauucacaccuguuggaguauuccaagauggagauaaucaccaaaacgaaccucaacaauggguauuaccaaacuacucaggagcaacagcucauaauguccauuuagcaccagcuguagcaccagcuuucccaggagaacaauuauuauucuuccguucaacaaugccaggauguucagguuauccaaauaugaaucuagacugucuucuaccacaagaauggguacaacauuucuaucaagaagcugcaccagcacaaucagauguugcauuauuaagauuuguuaauccagauacaaguagaguacuuuuugaauguaaauuacauaaaaguggauaugucacuguagcucauacuggacaacacgaucucguaauacccccaaauggcuauuuccgauucgacucauggguuaaccaauucuacacacuagcaccuaugggaaauggaacuggacgacgacgauaa

SEQ ID NO: 34753 - RNA, 1614 nt, Artificial Sequence
  derived and/or modified sequence opt6 from VP1__Norovirus_and/or_Norovirus-like__KF806528
augaaaauggcuucaaaugaugcaucuccaucugauggaucugcagcaaauuuaguaccagaagucaauaaugaaguaauggcauuagaaccaguaguaggugcagcuauugcagcuccaguagcaggacaacaaaacguaauagacccauggaucagaaacaauuucgugcaagcaccaggcggagaauuuacaguaagcccuagaaacgcuccaggagaaauacuauggucugcaccuuuaggucccgaucuaaacccauauuuaucccaccuagcacgaauguauaauggauaugcaggaggauuugaaguacaaguuauauuagcagguaaugcauuuacagcuggcaaaaucauauuugcggccguuccacccaacuuuccaacagaaggauuaucaccaucacaaguaacaauguuuccacauauaguuguagauguuagacaacuugaaccuguauuaauaccuuuaccagauguaagaaauaauuuuuaucauuacaaucaaucaaaagaucccacaauaaaacuuauagccaugcucuauacaccauuaagagcaaauaaugcaugggaagacguauuuaccguuucauguagaguacuaacacgaccaucaccugauuucgacuucauauuuuuaguaccaccuacaguugaaucacguaguaaaccauuuacuguaccuauacuuacaguagaagaaaugacaaacucacgauucccuauuccacuagaaaaacuauuuacuggacccuccggugccuuuguaguucaaccacaaaacgguagauguacaacagauggaguacuccuagguacaacacaacucucacccguaaauauauguaccuuuagaggagauuuaacccacuucgcaggaacucaugaauacgcaaugaauuuagccucacaaaacuggaauaauuaugaucccacugaagaaauaccagcuccucuaggagcaccagacuuuguaggaaaaauaagaggaguauuaacccaaacaacaagaagagauggcuccacaagaggucaccgagcuacacuaucaacagguucagcucacuuuacgccaaaauuaggaucaauacgauuuucaacagauaccaauaacgauuuugaagcaggacaaaauacaaaauucaccccaguuggaguauuucaagauggugauaaucaucaaaaugaaccacaacaauggguuuuaccaaauuauucuggagcaacagcucauaauguacaucuagcuccagcaguagcaccagcuuucccaggagaacaauuacuauucuucagaucaacuaugccagguugcucuggauauccaaauaugaacuuagacuguuuauuaccacaagaauggguucaacauuuuuaucaagaagcagcaccagcucaaucugacguagcauuauuacgcuuuguaaauccagauacaucacgagucuuauucgaauguaaauuacauaaaucuggcuacguaacuguugcacacacaggacaacaugaccuaguuauuccuccaaauggcuauuuucgcuuugacucauggguuaaucaauuuuacacauuagcaccaaugggcaacgguacagguagaagaagauaa

SEQ ID NO: 34754 - RNA, 1614 nt, Artificial Sequence
  derived and/or modified sequence opt6 from VP1__Norovirus_and/or_Norovirus-like__KF806527
augaaaauggcaucaaacgaugcauccccaagugacgggucagccgcaaauuuaguaccagaaguuaacaaugagguaauggccuuagaaccaguuguaggagcagcaauagcagcaccaguagcaggacaacaaaauguuauagauccauggauccgaaauaacuuuguacaagcaccaggaggagaguucacaguuucaccucgaaaugcaccaggugaaauacuauggucagcaccauuagguccagauuuaaauccauaccuuucacacuuagcaagaauguauaacggauaugcuggaggauuugaaguacaaguaauauuagccgguaaugcauucacagcaggaaaaaucauauuugcagcaguaccucccaauuuucccacagaaggcuuaucuccuagucaaguaacaauguuuccacacauuguaguagauguaagacaauuagaaccgguacuaauaccauuaccagauguucgcaauaacuucuaucauuauaaucaaaguaaagacccaacuaucaaauuaauagcaaugcuauacacaccacuaagagcaaacaaugcaggagaagacguauucacaguaucauguagaguauuaacaagaccaucuccagauuuugauuuuaucuuucuaguaccuccaacaguagaaucaagaucaaaaccauuuacaguaccaauacuaaccguagaagaaaugacaaauucaagauucccuauuccauuagaaaaauuauuuacagguccuucauccgcauuuguaguacaaccacaaaacgguagauguaccacagacgguguucuucuaggaacuacacaacuaagcccugucaauauaugcacuuucagaggagaccuuacacauuucgcaggaacaagcgaauaugcuaugaauuuagcaucccaaaacuggacaaacuacgauccaacugaagaaaucccugccccuuuaggcgcaccagacuucguugguaaaauucgagguguauuaacacaaacaacaagaggagaugguucaacaagaggccacagagcaacccuaucaacaggauccgcccauuuuacacccaaacuaggaucaguacgauuuuccacagacacaaauaacgacuuugaagcaggccaaaauacaaaauucaccccaguaggaguauuccaagacggugacaaucaucaaaacgaaccucaacaauggguucuucccaauuauagcggagcaacagcacacaauguacaucuagcaccagcaguagccccagcuuuuccaggagaacaacuucuauucuuccguuccacaaugccaggauguaguggauauccaaacaugaacuuagauugucuauuaccccaagaauggguacaacacuuuuaucaagaagcagcaccagcacaaucagacguagcccuacuacgauuugucaacccugauacuuccagaguauuauuugaaugcaaauuacauaaaucaggcuaugucacaguagcacacacuggacaacaugauuuaguaauaccaccaaacggauauuucagauucgacucuuggguaaaucaauuuuauaccuuagcacccaugggaaacggaacaggaagaagacgauaa

SEQ ID NO: 34755 - RNA, 1614 nt, Artificial Sequence
  derived and/or modified sequence opt6 from VP1__Norovirus_and/or_Norovirus-like__KX514261
augaaaauggcuucauccgacgcaaauccaucagacgguucagcagcaaaccuaguacccgaaguaaauaacgaaguuauggcauuagaaccaguaguuggagcagcaauugcugcucccguagcaggacaacaaaauguaauugacccauggauccgcaauaauuuuguucaagcaccaggaggagaauuuacuguuuccccucguaacgcaccaggugaaauucucuggucugcacccuuagguccagaucuuaacccauauuuaucacaccuagcacgaauguauaauggauaugccggcggauuugaaguacaaguaauacucgcuggaaaugcauuuacagcaggaaaaauaauauucgcugcaguaccaccaacauuuccuacugaaggauuaucaccaucucaaguaacaauguuuccacauauaaucgucgauguaagacaacucgaaccaguccuaauaccauuaccagauguaagaaauaacuucuaucauuauaaccaaucaaaugauucaacaauaaaacucauugcaauguuauauacaccucuuagagcaaacaacccaggagaugacguuuuuacuguuuccugcagagucuuaaccagaccaucaccagauuucgauuucaucuuucuaguaccaccaacugucgaaucaagaacuaaaccauuuucuguacccauccuaacaguuggagaaaugacaaauucaagauuuccaguaaacuuagagagacuauucacugggccauccucagcaaauguuguucaaccacaaaauggaagauguacaaucgacggagaacuauuaggaacuacccaacuaucaucaguuaacauaugcacauucagaggagauguuacacauauuggaucaacacaccacuggaccaugaacuuagcaucuccuaacuggaacaacuacgauccaacugaagaaacacccgcaccauuaggcacuccugacuucguaggaaaaauacacgguaugcuaacacaaacaacacaaggaucaggaucuacaagagcacauagagcgacuguauaugugggaagcgcagaauuuacaccaaaauuaggcaaaguccaauuccaaacagaaacagaagacgaucuaguaauucgacaaaauacaaaauucaccccagucggaguuauacaagaaucagaucaccaccgagacgaaccacaacaauggagacugccaaauuauucuggagcaaauacauucaauguacauuuagcuccagcaguagcaccaaacuucccaggagaacaauuauuauucuuuagaucaacccuaccagguuguggaggucacccuaauauggacuuagauugccuauuaccacaagaauggguccaacauuuuuaucaagaagcagcaccagcacaaucagauguugcauuacuaagauuuguuaauccagauaccagucgaguacuuuuugaauguaaauuacacaaaucaggauacgucacaguagcacauacaggacaauaugaccuuguacuaccaucuaacggcuacuucagauucgauagcuggguaaaccaauuuuauacacuagcaccaaugggaaacggaacagguagaagaagguaa

SEQ ID NO: 34756 - RNA, 1614 nt, Artificial Sequence
  derived and/or modified sequence opt6 from VP1__Norovirus_and/or_Norovirus-like__AB684720
augaaaauggcaucaucugaugccaauccaucagauggcaguacagcaaaucucguaccagaaguaaauaacgaagucauggcauuagaaccagucgucggagccgccauagcagcaccaguugcuggucaacaaaauguaaucgacccuuggauaagaaauaacuuuguucaagccccaggaggagaauuuacagucucaccuagaaaugcaccuggagaaauauuauggucugccccacuuggaccagauuuaaacccauaccuaucccauuuaucaagaauguauaacggauaugcugguggauucgaaguacaaguuauauuagcaggaaaugcauuuacugcaggcaaaauaauauucgcagcaguacccccaaacuuuccuacagaaggacuaucaccuucucaagucacuauguucccacauauaauaguagauguaagacaacuagaaccaguucuaauaccacuuccagacguaagaaacaacuucuaucacuauaaucaagcacacgacucaacuuuaaaacuaauagcaaugcuauacacacccuuacgagcaaacaaugcuggugaugaugucuucacugucuccuguagaguacuaaccagaccuagcccugacuuugacuuuauauuucuaguaccuccuacaguagaaucaagaacaaaaccauuuucaguaccaauauuaacuguagaagaaaugucaaacuccagauuuccaauuccucuagaaaaauuauauacaggacccucauccgcauuuguaguacaaccacaaaacggucgauguacaaccgauggagucuuacuaggaacuacucaauuauccgcaguaaauauauguaauuuucgaggagacguaacacauauuagagguagcagagauuacacaaugaaucuaguaagccaaaacuggaauaauuacgacccuacagaagaaauaccagcaccacuaggaacaccagacuuuguagguaaaauacaaggauuacuaacacaaacaacaagagccgacggaucaacacgggcacacaaagcaacuguaucaacaggauccguacacuucacaccuaaauuaggaucaguacaauucacaacagacacagauaacgauuuccaaacaggacaaaauacaaaauucacccccgugggcguaauacaagacuccgaccaucaccaaaacgaaccacaacaauggguauuaccaaacuauucuggugcaucaggacacaacguacauuuagccccagcuguagcccccacuuucccaggagaacaauuauuauucuuuaggagcacaaugccuggauguucuggauauccaaauaugaauuuagacugucuauuaccacaagaauggguauuacauuucuaucaagaagcagcaccagcacaaucagauguagccuuacucagauuugucaauccagauacaggcagaguuuuauuugaauguaaauuacacaaaucagguuauauaacagucgcacauacaggaccauaugauuuaguaauucccccuaauggcuacuuucguuucgacucauggguaaaucaauucuacacacuugcaccuaugggaaacggaacaggacgaagaagauaa

SEQ ID NO: 34757 - RNA, 1614 nt, Artificial Sequence
  derived and/or modified sequence opt6 from VP1__Norovirus_and/or_Norovirus-like__LC016605
augaaaauggcaucaaaugaugcauccccaucagaugguucaacagcaaaucuaguucccgaaguuaauaacgaaguaauggcauuagaaccagucguaggagcagcaauugcugcuccaguagccggacaacaaaauguaauagauccauggauuagaaauaauuuuguacaagcaccaggaggagaauuuaccguuucaccaagaaaugcaccaggagaaauauuauggucugcaccauuaggaccugaucuaaauccauauuuaucucaccuagcaagaauguauaauggauaugcuggaggauuugaaguucaaguaauauuagcaggcaacgccuuuacagcaggaaaaauaauauuugcagcaguaccucccaauuuuccaacugaaggacuuucaccaucacaaauaacaauguuuccacauauuauuguagauguucgccaauuggaaccuguuuuaaucccacuuccugauguaagaaacaauuucuaccauuauaaucaaucuaacgauucaacuauaaaacuuauagcuaugcuuuacacaccauuaagagcaaacaaugcuggugacgaugucuuuacaguuucuuguagaguccuuacuagaccaucaccagauuucgauuuuauauuccuaguaccuccuacaguugaaucuagaacaaaaccauuuacaguaccaauauuaacuguagaggaaaugacaaauuccagauuuccuauaccauuagaaaaauuauuuacaggucccuccucagccuucgucguacagccucaaaacggacgaugcaccacugauggcguauuacuugguacaacgcaauuaucaccaguaaauauauguacauuucgaggagacguuacacauauaccaggcacaagaaccuauagaaugaaucuagcaucacaaaauuggaacaauuacgacccaacugaagaaauacccgcacccuuagguacaccagacuuugucggaaaaauacaaggaauguuaacucaaacaaccaaaggugauggaaguacuagaggacauaaagcaaccguaagcacaggauccguagauuucacuccaaaauuaggaaguguucaauucgauacagauacaaacaaugauuuagagaccggucaaaauaccagauucacaccaguaggagucauucaagauggaucugcucaccgaaaugaaccacaacaauggguacuaccagacuauucaggaagaacaguucauaacguucauuuagcuccagcaguagcuccaacauucccuggagaacaauuauuauuuuucagaaguacaaugcccggauguucuggcuaucccaacauggaccuagauuguuuauuaccacaagaauggguacaacauuuuuaucaagaagccgcaccagcacaaucugaugucgcauuauuaagauucguaaauccagauacuggaagaguacuauuugaauguaaacuucauaaaacuggauaugucacaguagcccauacaggucaacacgauuuaguuauaccaccuaacggauauuuuagauuugauucauggguaaaucaauuuuauacauuagcaccaaugggcaauggagcaggaagaagaagauaa

SEQ ID NO: 34758 - RNA, 1614 nt, Artificial Sequence
  derived and/or modified sequence opt6 from VP1__Norovirus_and/or_Norovirus-like__KF806529
augaaaauggcuucaaaugaugcaucaccaucagauggaucagcagccaaucucguaccagaaguaaauaacgaaguaauggcacuugaaccaguuguaggugcagcaauagcagcaccaguagcaggucaacaaaauguaauagacccauggauacgaaauaauuuuguacaagcaccugggggagaauuuacaguaucacccagaaacgcaccaggagaaauauuauggucagcaccacuagguccagauuuaaauccauaccuaucucaucuugcaagaauguauaacgguuacgccgguggauucgaaguacaagucauucucgcaggaaaugcauucacagcaggaaaaauaauauuugcagcaguaccaccuaacuuccccacagaaggcuuaucaccaagucaaguaacaauguuuccacacaucguaguagauguaagacaauuagaacccguuuuaauuccuuuaccugauguaagaaacaacuucuaucauuauaaccaauccaaagauccaacaauaaaauuaauugcaauguuauauacaccacuuagagcaaacaacgccggugaagauguguuuaccgucucuugcagaguacuaacaagaccauccccagacuuugacuuuauauuccuagucccaccuacaguagaaucaagaucuaaaccauuuacagucccaauacuuacaguagaagaaaugacaaauagucgcuucccaauaccccuagaaaaacuauuuaccggaccaucaggugcauuuguaguacaaccccaaaauggaagauguacaacagauggaguacuauuaggcacaacacaauuaucuccaguuaauauauguacuuuuagaggagaccuaacacauuuugcagguacucaugaauacgcaaugaaccuagcgucacaaaauuggucaaauuacgauccaacugaagaaauaccugccccuuuaggagcuccagauuuugucggaaaaauuagaggaguauuaacacaaacaacaagaggcgaugguucuacaagaggacaucgcgcuaccuuauccacagguucagcacacuuuacaccaaaacuugguucuauaagauuuuccacagauacaaacaaugauuuugaagcaggacaaaauacaaaauucacaccaguuggaguauuccaagacggugacaaccaccaaaacgaaccccaacaauggguacuaccaaacuacucaggagcaacagcucauaauguacacuuagcuccugcaguagccccugcauuuccaggugaacaauuacuauuuuucagaucaacaaugccagguuguaguggcuauccugacaugaaucuagacuguuuacuaccacaagaauggguacaacacuuuuaucaagaagcagcaccagcacaaucagacguagcacuucuucgauuuguaaauccagacacaucuagaguacuauuugaauguaaacuucauaaaucugguuacguuacuguugcacauacaggacaacacgauuuagucauaccacccaauggauacuuuagauucgauucauggguaaaccaauuuuauacacuagcaccaaugggaaacgguacuggaagacgcagauaa

SEQ ID NO: 34759 - RNA, 1614 nt, Artificial Sequence
  derived and/or modified sequence opt6 from VP1__Norovirus_and/or_Norovirus-like__JX023286
augaaaauggcaucaucagacgcaaauccuucugauggaucugcagcuaauuuaguaccagaagucaauaacgaaguaauggcuuuagaaccaguaguaggagcugcaauugcagcacccgucgccggacaacaaaauauaauagacccauggaucagaaauaauuucguacaagcacccggaggugaauuuacaguaucuccacgaaacgcaccuggcgaaauacuuuggucagcaccacuuggaccagaucuaaauccauaucuaucacaucuaucaagaauguacaacgguuaugccgguggauuugaaguacaaguaauucuugcaggaaaugcauuuaccgcaggaaaaguaauauuugcugcaguaccaccuaauuucccaacugaaggucucuccccaucucaagucacaauguucccacacauaauagucgacguacgacaacuagaaccaguacuaauaccacuaccagauguuagaaacaacuuuuaccauuauaaccaagcacacgacucaacacuaaaacuaauagcaaugcuauauacaccauuacgagcaaauaacgcaggagacgacguauucacaguauccuguagaguacugacaagacccaguccagacuucgacuuuauauuuuuaguacccccaacaguagaaucaagaacaaaaccauuuacugucccaauucuaacuguagaagaaaugucaaauucaagauucccaaucccuuuagaaaaacuauacacaggaccaucaucagcuuucguaguacaaccacaaaacggcagaugcacuacugauggcguacuauuaggaacuacccaauuaucagcaguaaauauaugcaauuuucguggagauguaacaagaguuggcaucagucacgauuauacaaugaaccuaguaucacaaaacuggaauaauuaugauccaaccgaagaaaucccugcuccucuuggaacaccugacuucguaggaaaaauacaaggauuacuuacucaaacaacaagagcagauggaucaacuagagcucauaaagccacagucucaacaggaucaguacacuucacaccaaaacuaggauccguacaauuuacaacagauacuaauaacgauuuccaaacaggccaaaacacaaaauuuacacccguuggaguuauccaagauggagaucaccaccaaaacgaaccacaacaauggguacuaccaaauuauucaggcacuucaggacacaauguacauuuagcaccagcaguagccccaacauucccaggagaacaauuacuuuucuuuagaucaacaaugccuggaugcucaggauacccuaauaugaaccucgacugcuuacuaccacaagaauggguauuacacuuuuaucaagaagcugcacccgcacaauccgacguggccuuacuacgauucguaaauccugacacaggaagaguauuauuugaaugcaaacuacauaaaucugguuauauaacaguugcacauacaggcccauacgaccuaguaauaccuccaaauggcuacuuucgauuugauucaugggucaaucaauuuuauacacuagcgcccaugggcaauggaacaggccguagacgcuaa

SEQ ID NO: 34760 - RNA, 1614 nt, Artificial Sequence
  derived and/or modified sequence opt6 from VP1__Norovirus_and/or_Norovirus-like__FJ537137
augaaaauggcuucaaacgacgcaaacccaucagauggaucagcagcuaaccuuguaccagaaguuaauaacgaaguaauggcacuagaaccaguaguuggcgcagccauagcagccccuguagcaggccaacaaaauguaaucgacccauggauacgcaauaacuuuguacaggcaccuggcggagaauuuacaguaucaccaagaaaugcaccaggagaaauccuauggucugcaccuuuaggaccugaucuaaacccauaucuaucacacuuaucuagaauguacaacggauacgcaggaggauucgaaguacaaguaauacuagcaggaaacgcauucacagcaggaaaaguaauauuugcagccguaccacccaacuuuccaacugaaggacuaucaccaucacaagugacuauguuuccucauauaaucguagauguucgccaauuagaaccaguuuuaauaccccuaccugauguaagaaacaauuucuaccauuacaaucaagcacaugacucaacauuaaaauuaaucgcaauguuauacacccccuuaagagcuaauaaugccggugacgaugucuucacaguaucauguagaguccuaacucgaccaucaccagacuuugauuucauuuuucuuguacccccuacaguagaaucacgaacaaaaccauucacuguuccaauccuaacaguugaagaaaugucaaauucaagauuucccaucccacuagagaaacuauauacaggcccaucaucagccuucguaguccaaccacaaaauggaagaugcacaacagacggaguauuacugggaaccacacaauuauccgcuguaaacauauguaauuuuagaggagauguaacccauaucguuggcucccaugauuacacuaugaauuuaguaucacaaaacuggucaaacuacgacccaacugaagaaauaccagcaccauuaggaaccccugacuucguuggaaaaauucaagguuuauuaacacaaacaacucgcgcagacggaucaacaagagcacacaaagcaacagucucuacaggaucaguacauuuuauaccuaaacuaggaucuguacaauucacaacagauacaaacaaugacuuucaaacaggccaaaauacaaaauuuacaccugucggaguuauacaagacggcgaucaucaccaaaacgaaccacaacaauggguccuaccaaauuauucaggaagaacaggucacaauguccaucucgcaccagcaguagcaccaacauuuccaggagaacaacucuuauucuuucgaucaacaguuccaggaugcucaggcuacccaaauaugaacuuagauuguuuacuaccacaagaauggguaucucacuuuuaucaagaagccgcuccagcacaaucagauguagcccuccuaagauuuguuaauccugauacaggucgaguacuuuuugaaugcaaacuacacaaaucaggauacauuacuguugcccauacaggacccuaugacuuaguacuaccaccuaauggcuacuuuagauuugacuccuggguaaaccaauuuuauacauuagcaccaaugggaaauggcaccgguagacgacgcuaa

SEQ ID NO: 34761 - RNA, 1614 nt, Artificial Sequence
  derived and/or modified sequence opt6 from VP1__Norovirus_and/or_Norovirus-like__X76716
augaaaauggcuucaaacgaugccaauccaucugauggaucagccgcaaaucuaguaccagaaguaaauaacgaaguaauggcacuagaaccgguaguaggcgcagcaauagcagcaccuguagccggacaacaaaauguuauugaccccuggauaagaaauaacuuuguacaagcuccagguggagaauuuacuguaucaccaagaaacgcaccaggagaaauucuauggucugcuccuuuaggacccgacuuaaauccuuaucuaucucaccuaucaagaauguauaauggauaugccggaggcuucgaaguacaaguaauucuagcaggaaaugcauuuacugccggaaaaguuauuuuugcugcaguacccccaaacuuucccacagaaggcuuaucaccaucccaaguuacaauguuuccacauaucauaguagauguaagacaauuagaaccuguacuaauaccauuaccagacguaagaaauaacuucuaucacuauaaucaagcaaacgacucaacucucaaauuaauagcaaugcuuuauacuccccuaagagcuaauaaugcuggugaugauguauuuacuguuaguuguagaguauuaacccgaccaucuccagacuucgauuuuaucuuccuuguuccuccaacaguagaaucaagaaccaaaccuuuuacuguaccaguacuuacaguugaagaaaugucaaacucacgcuuuccaauaccauuagaaaaauuauauacagguccaucaagugcauucguaguacaaccacaaaacggcagauguaccacugauggaguacuauuaggaacaacacaauuaucugcuguaaauauuuguaacuucagaggcgacguaacacacauagcaggaucucacgauuacacaaugaauuuagcuucacaaaauuggucaaauuaugauccuacagaagaaauaccagcaccacuagguacaccagauuuuguagguaaaauacaaggacuauuaacacaaacaaccagagcagauggaucaacacgagcacacaaagcaaccguuucaacaggaucaguacauuuuacaccuaaacuuggaucaguacaauuuacuacagacacaaauaaugauuuucaagcaggccaaaauacaaaauuuacaccaguaggcguaauucaagacggagaccaccaccaaaacgaaccacaacaauggcuauuaccuaacuacuccggacgcacuggacauaacguacaucucgcccccgcaguagcccccacuuuuccaggagaacaacuauuauuuuucagaagcacaaugccaggauguuccggcuaccccaauaugaaucuagacugucuuuuaccacaagaauggguacuccacuuuuaucaggaagcugcaccagcucaaucugauguagcauuacuaagauucgucaacccugauacaggaagaguauuauucgaauguaaacuacauaaauccggauacauaacaguagcucauacagguccauacgaucucguauuaccaccuaauggauauuuucgauuugacucauggguaaaucaauucuauacauuagcaccaaugggaaauggaaccggaagaagacgauaa

SEQ ID NO: 34762 - RNA, 1614 nt, Artificial Sequence
  derived and/or modified sequence opt6 from VP1__Norovirus_and/or_Norovirus-like__KX514328
augaaaauggcuucaaacgacgcuaauccaucagauggcucugcagcaaaucugguaccagaaguaaacaacgaaguaauggcuuuagaacccguaguaggagcagcaauugcagcaccaguagcaggacaacaaaauguuauagacccauggauaagaaauaacuuuguacaagcaccagguggagaauuuacuguauccccaagaaaugcuccuggugaaauacuauggucagcuccauuagguccagauuuaaacccauauuuaucacaccuagcaagaauguauaauggauaugcuggaggauucgaaguacaaguaauauuagcaggcaaugcauucacagcaggaaaaauaaucuucgcagcaguaccaccaacauucccaaccgaaggacuaucaccaucucaaguuacuauguucccacacauaauaguagauguaagacaauuagaaccaguccuaaucccucuaccagauguacgcaauaauuucuaucacuauaaucaaucaaacgacucaacaauuaaauuaauagcaaugcuuuauacucccuuaagagccaacaauccaggagacgaugucuuuacaguaucaugcagaguacuaacuagaccaucgccugacuuugauuuuauauuccuuguaccaccaaccguagaaucaagaacaaaaccauuuagcguaccaauauuaacugucggugaaaugaccaacaguagauuuccaauaaauuuagaaagacuauucacaggaccuucaucagcaaauguaguccaaccccaaaacggacgcuguacaauugauggcgaacucuuaggaacaacacaacuaucaagcguuaacauaugcaccuuuagaggugauguaacacaaauuggaucaacuaaacauuggacaaugaauuuagcaucaccaaauuggaauaauuacgaccccacagaagaaacaccagcaccuuuaggaacaccagauuuuguaggcaaaauacacggaaugcuaacacaaacaacacaagaaaaugggucaacuagagcccacagagcaacagucuauguaggaggugcuaacuucaccccuaaacucggcaaaguucaauucgaaacugacacaguagaugaucucgaaauaagacaaaauacaaaauucacaccagugggcguaauccaaucaucagaucaucacagagacgaaccacaacaauggagauuaccaaauuauucaggagcaaauacauuuaauguacaccuggcaccagcagucgcacccaauuucccaggagaacaacuacuauuuuuccguucaacacuaccagguuguggcggacaucccaacauggauuuggauugccuuuuaccacaagaauggguacaacacuucuaucaagaagcagccccagcacaaucagauguagcauuauuaagauuugucaauccagacacaucacgaguccuauuugaauguaaauuacacaaaagcggauacguaacagucgcacauacaggucaauacgacuuaguacuaccgucaaacggauauuuucgauuugacucuuggguaaaucaauucuacacauuagcaccuaugggaaauggaacaggaagaagacgauaa

SEQ ID NO: 34763 - RNA, 1614 nt, Artificial Sequence
  derived and/or modified sequence opt6 from VP1__Norovirus_and/or_Norovirus-like__KX514201
augaaaauggcaucaucagacgcuaauccuagugauggaucagcagcaaauuuaguaccagaaguuaauaaugaaguaauggcacuagaaccuguugucggcgcagcaauagcagccccaguagccggacaacaaaauguaauagaccccuggauacguaauaacuucguucaagcaccaggaggagaauuuacaguaucaccaagaaacgcaccaggagaaauauuauggucagcuccauuaggcccagauuuaaauccauacuuaucucacuuagcaagaauguacaacgguuacgcaggaggguuugaaguacaaguaauacuagcagguaacgcuuuuacagcagguaaaaucaucuucgcagcugucccaccuacauucccaacagaaggauuaucuccaucccaaguaacaauguucccucacguaauagucgauguaagacaacuagaaccaguauuaauaccacuaccagacgucagaaacaacuuuuaccauuacaaccaaucaaaugauucuacaauaaaauuaaucgcaaugcuauacacaccacuucgugcaaacaauccaggagaugauguauuuacaguaucauguagaguacuaacaagaccaucucccgauuucgauuucauauuucuaguaccgccaacuguugaaagcagaacaaaaccauucucuguaccaauauuaacaguaggagaaaugacaaauucuagauucccaauuaacuuagaacgauuauucacaggaccaucaucagcaaauguuguacaaccacaaaauggaagauguacaauagacggugaauuacucgguacaacucaacuaucuagcguaaacauaugcacauuccguggagacguaacacauauaggauccacccaccauuggacuaugaacuuagcaucacccaauuggaacaacuaugauccaacagaagaaacuccagcaccauuagguacaccagacuucguaggaaaaauacauggcauguuaacacaaacaacucaaggcuccggcucuacacgagcacacagagcaacuguuuaugucggcucagcagaauuuacccccaaauuaggaaaaguucaauucaaaacagaaacagaucaugauuuaaccauacgacaaaacacaaaauuuacgccaguuggagucauucaagaaucagaucaucaccgagacgaaccccaacaauggagauuaccaaauuacucaggagcaaacacuuuuaacguccacuuagcaccagccguagcuccuaacuuuccaggagaacaacuacuauucuuuagaucuacacucccaggaugcgguggacacccaaauauggaccuagauuguuuacuaccucaagaauggguacaacacuuuuaccaagaagcugcaccagcucaaucagauguagcacuauuaagauuuguaaauccugacacgucaagaguacuuuuugaaugcaaacuacauaaaucuggauauguaacuguagcccauacaggccaauaugaccuaguacuacccucaaauggauauuuuagauuugauucauggguuaaccaauuuuauacuuuagcacccaugggaaacggcaccggacgaagaagauaa

SEQ ID NO: 34764 - RNA, 1614 nt, Artificial Sequence
  derived and/or modified sequence opt6 from VP1__Norovirus_and/or_Norovirus-like__AB985442
augaaaauggccucaucugacgccaauccaucugaugguucagcugcaaauuuaguaccugaaguuaacaaugaagucauggcacuugaacccgucguaggcgcagcuauagcagccccaguagcaggucaacaaaacauaauagauccauggauaagaaacaauuuuguacaagcaccuggaggagaguucacaguaucaccuagaaaugcaccuggagaaauauuauggucagcaccacuuggcccagauuuaaauccauacuuaucacauuuaucacgaauguauaacgguuacgcuggaggauucgaaguacaaguaauacucgccggaaaugcuuuuacagcaggaaaaguuaucuuugcagcaguaccuccuaacuuuccuacugaaggucuauccccaucccaagucacaauguucccacacauuauagucgacguaagacaacuagaaccaguucuaauaccauuaccagauguaagaaacaauuucuaucacuauaaucaaucacaugacuccaccuuaaaacucauugcaaugcuauacacuccuuuaagagcaaacaaugccggugacgacguauuuacaguauccugcagaguacuaacuagaccuucaccagauuuugacuuuauuuucuuaguaccaccuaccguagaaucaagaacaaaaccuuucacaguaccaauucuaacaguagaagaaaugucaaauucccgauuucccauaccacuugaaaaauuauauaccggaccaucuucagcauucgucguacaaccacaaaauggaagauguacaacagacgguguuuuacuagguacaacacaauuaagcgcaguaaauauauguaauuuuagaggagauguaacacauauaguaggaucccaugacuacacaaugaaucuagcuucacaaaacugguccaauuaugaucccacugaagaaauaccugcuccgcucgguacacccgacuucguuggaaaaauccaagguuuaagaacacaaacaacaagagcagauggaucaaccagagcacauaaagcuacuguaucuacugguucaguacacuuuacacccaaacuaggauccguacaauucacaacagacacaaacaacgauuuucaaaccggacaaaauacaaaauucacuccugucggagucauacaagauggugaccaucaccaaaacgaaccucaacaauggguacuaccaaauuacucaggacgaacaggccacaauguccaccucgcaccagcaguagcuccaacauuuccaggagaacaacuucuauucuucagaucaacaaugccaggaugcuccgguuacccaaacaugaaucuagacugucuucuaccucaagaauggguacuacauuucuaccaagaagcugcacccgcccaaucagacguagcacucuuacgauuuguaaauccagacacaggaagaguacuauuugaauguaaauuacauaaaucagguuauauaacaguagcacauacaggucccuacgacuuaguaauacccccaaaugguuauuuuagauuugauuccugggucaaucaauuuuauacauuagcaccaauggggaacgguaccggcagaagaagauaa

SEQ ID NO: 34765 - RNA, 1614 nt, Artificial Sequence
  derived and/or modified sequence opt6 from VP1__Norovirus_and/or_Norovirus-like__LC016604
augaaaauggcaaguaacgacgcaucaccaucagauggaucaacagcaaauuuagugccugaaguaaauaaugaaguuauggccuuagaaccuguaguuggcgcagcuauagcagcacccguugcaggacaacaaaauguaauugauccauggauaagaaauaauuucguucaagccccaggaggagaauuuacaguaucaccucgaaacgcacccggggaaauucucuggucagcaccccuaggucccgaucuaaacccuuauuuaucacauuuagcuagaauguauaauggauaugcugguggauuugaaguacaaguaauauuagcaggaaaugccuuuacagccggaaaaauaauauucgcagccgugccaccaaauuucccaacagaaggacuuuccccaucucaaguaacaauguucccacauauaauuguagauguacgucaacuugaaccaguauuaauuccacuaccagauguuagaaauaauuuuuaucauuauaaucaaucuaaugauucuacuauaaagcucauagcaaugcuauauacuccucuaagggcuaauaaugcaggagaugauguauuuacaguauccugcagaguacuaacacgacccucaccagauuucgauuucauauuucuaguacccccaaccguagaaucacgaacuaaaccauucacaguaccaauacuaacaguugaagaaaugacuaauucuagauucccaauaccauuagaaaaacucuuuacaggaccuucaucagcauucguuguacaaccucaaaauggacgauguacaacugacgguguauuauuaggaacaacacaacuaucuccagucaacauaugcacauuuagaggcgauguaacacauauaccugguaccagaacauacagaaugaauuuagccagccaaaauuggaauaacuaugauccaaccgaagaaauucccgcucccuuaggaacaccagacuucguagguaaaauacaagguauguuaacccaaacaacaaaaggugauggcucaacgcgaggacauaaagcaacaguuucuacaggaucgguagauuuuacaccaaaauuaggaucaguccaauucgauacugauacaaauaacgacuuagaaacaggacaaaauacaagauuuacuccagucggaguuauacaagacggauccgcccaucgaaaugaaccacaacaauggguauuacccgacuacuccggaagaaccguucacaauguacaucuagcaccagcaguagcccccacuuuuccaggagaacaauuauuauucuuccgcaguacuaugccuggauguuccggauauccaaauauggacuuagacugucuauuaccacaagaauggguacaacacuuuuaccaagaagcugccccugcacaaucagauguagcacuccuccgauuuguaaaucccgauaccggaagagucuuauuugaauguaaauuacacaaaacagguuaugucacaguagcacauacaggacaacaugauuuaguaaucccaccaaaugguuauuuucgauuugacuccugggucaaucaauucuauacuuuagcaccgaugggaaacggagcaggucgacgacgauaa

SEQ ID NO: 34766 - RNA, 1614 nt, Artificial Sequence
  derived and/or modified sequence opt6 from VP1__Norovirus_and/or_Norovirus-like__KF806532
augaaaauggcaucaaacgaugcauccccaucagacggaucagcagccaauuuaguacccgaaguaaauaacgaaguaauggcccuagaaccugucguaggcgcagcuauagcagcaccaguagcaggacaacaaaauguaauagauccauggauuagaaacaauuuuguccaagcuccuggaggagaauuuacugucucaccaagaaaugcaccuggagaaauacuauggucagcaccauuagggccugacuuaaacccauauuuaucacaccuagcuagaauguauaacggauacgccggagguuucgaaguucaaguaauauuagcagguaaugcauuuacggcuggaaaaauaauauuugcagcagucccaccuaauuuuccaacagaaggacuaucaccuucacaagucacaauguuuccacauaucguaguagacguaagacaacuagaaccaguauuaaucccacuaccagauguuagaaacaacuuuuaucauuauaaucaaucgaaagauccaacaauuaagcuaauagcaauguuauacacaccacuuagagcuaacaaugcaggcgaagacguauucacaguaucuuguagaguacuuacaagaccaagcccagauuuugacuuuauauuucuaguaccuccuacaguagaaucuagaucaaaaccauucacugucccaauauuaacuguagaagaaaugacuaacuccagauucccaaucccccuagaaaaacucuuuacaggaccuucuucagcauuuguaguccaaccacaaaauggaagaugcacaacagacggcguacuacuaggaacaacacaauuaucucccgucaauauauguaccuuuagaggcgauuuaacacauuuugcaggaaccucugaauaugcaaugaauuuagcaucucaaaauuggacaaauuacgaccccacagaagaaauuccugcaccacuuggugcaccagauuuuguuggaaaaauuagaggcguucuaacacaaacaacacgccgagauggaucaacuagaggacauagagcaacucuaucaacaggaucagcacacuuuacaccaaaacuaggaucaauuagauuuucaacagauacaaauaacgacuucgaagcuggacaaaauaccaaauucacaccagucggaguuuuucaagacggagauaaucaccaaaaugaaccacaacaaugggucuuaccaaauuauaguggugcuaccgcacauaacguccauuuagcuccugccgucgcaccagcauuucccggagaacaacuacuauuuuuccguucaaccaugccaggcuguuccgguuacccuaauaugaauuuagauuguuuacuaacccaagaauggguacaacacuuuuaucaagaagcagcaccagcucaaucagauguagcacuauuaagauuugucaauccugacacaucacgaguauuauuugaauguaaacuccauaaaucuggauacguaacaguagcacauacaggacaacacgauuuaguuauaccaccuaauggauauuuuagauuugacuccuggguaaaucaauuuuauaccuuagcaccaaugggcaacggaacugguagacgucgauaa

SEQ ID NO: 34767 - RNA, 1614 nt, Artificial Sequence
  derived and/or modified sequence opt6 from VP1__Norovirus_and/or_Norovirus-like__FJ537138
augaaaauggcaucaagugacgcaaaucccucagauggaagcgcagcaaaucuaguacccgaaguaaauaacgaaguaauggcauuagaaccuguaguaggcgcagcaauagcagcaccaguagcaggacagcaaaacguaauagacccauggauaagaaauaauuuuguacaagcuccaggaggagaauuuacuguaucacccagaaacgcccccggagaaauuuuauggucagcuccacugggaccagauuuaaauccuuaccuaucucaucuaucaagaauguauaauggauaugcaggaggauucgaaguacaaguuauacuagccggcaaugcuuuuacagcaggaaaaguuauauuugcagcaguaccucccaacuuccccacugaaggauuaagcccaucccaaguaacaauguuuccacauauaauaguagauguaagacaacuagaaccaguauuaauaccacuaccagauguaagaaauaauuucuaccauuacaaccaagcacacgauucaacacuaaaauuaauagcaaugcuauauacaccuuuacgcgcuaauaaugcaggcgaugauguguucacuguuucaugcagaguauuaacaagacccucaccagacuucgacuuuauuuuucuaguaccaccaacaguagaaucaagaacaaaaccauuuacaguaccaauacuaacuguagaagaaauguccaauucaagauucccaauaccauuagaaaaauuauacaccggcccaucaucagcauuuguaguucaaccacaaaauggaagauguacaacagauggaguacuauugggaacaacccaacucucagcuguaaauaucugcaauuuccgcggagacguaacaagaguuggaaucagccaugacuacacaaugaaucuuguaucacaaaacuggaauaauuaugauccuacagaagaaauacccgcaccauuaggaacacccgauuuuguaggaaaaauacaaggacuacuaacccaaacaacccgagcagacgguucuaccagagcacauaaagcaacagucucaacagguucaguccauuuuacacccaaauuaggaucuguucaauuuacuacagauacuaauaaugacuuccaaacaggacaaaacacuaaauuuacaccaguuggcguuauccaagauggagaucaucaucaaaaugaaccccaacaauggguacuaccuaauuauucaggaaccucuggacacaauguacaccuagcacccgcaguugccccaacauuuccaggugaacaauuacuauucuuuagaagcacaaugccuggauguucaggauauccuaauaugaaccuagauugcuuacuaccccaagaaugggucuuacauuucuaucaagaagcagcaccagcucaaucagauguugcauuacucagauucguaaacccagauacaggcagaguauuauuugaaugcaaacuacacaagucaggauacauaacagucgcgcauacaggaccauaugauuuaguaauaccaccaaauggauauuucagauucgacagcuggguaaaucaauucuauacauuagcaccaaugggaaauggcacuggaagaagaagguaa

SEQ ID NO: 34768 - RNA, 1614 nt, Artificial Sequence
  derived and/or modified sequence opt6 from VP1__Norovirus_and/or_Norovirus-like__AY030098
augaaaauggcauccucagacgcaaacccauccgacggaucaacagcaaaucucguacccgaaguaaauaacgaagucauggccuuagaaccaguuguaggagcagccauugcugcaccagucgcuggacaacaaaacauaauagacccauggauccgcaacaauuucguacaagcaccaggcggcgaauuuacugucucaccaagaaacgcuccaggugaaauccuauggucugcaccacuagguccagaucuaaauccauaucuaucucaucuuucaagaauguauaaugguuaugccgguggauucgaaguacaaguaauauuagcaggaaaugcauuuaccgcaggaaaagucauauucgcagcaguaccaccaaauuuuccaacagaaggacuaucaccaucucaaguaacaauguuuccucacauaauaguagacguacgacaacuagaaccaguuuuaauaccuuuaccagauguaagaaauaacuuuuaucauuauaaccaaucacaugacucaacacuaaaacuaauagcaaugcuauacaccccauuaagagcaaacaacgccggagaugauguauucacaguauccuguagaguccuaacaagaccaucacccgacuuugacuuuauauuccuaguacccccaaccgucgaaucccgaacuaaaccauuuacagucccaauacucacagucgaagaaauguccaacucucgauucccaauaccauuagaaaaauuguauacaggaccgaguucugcauucguaguccaaccacaaaauggucgauguacuacugacgguguauuacuagguaccacccaauuaucagccguaaauauuuguaacuuuagaggagacguuacacauauagucggaucucaugauuauacgaugaacuuaguaucccaaaauuggucaaacuaugauccaacagaagaaauaccagcaccacuaggcacaccagacuuuguaggaaaaauucaaggauuacuaacccaaaccacacgagcagauggaucaacuagagcccauaaagcaacaguaucaaccggauccguucacuuuacaccaaaauuagguuccguacaauucacuacagauacaaauaacgauuuccaaacaggucaaaacacaaaauuuacuccaguaggaguaauacaagacggagaccaccaccaaaaugaaccacaacaauggguacuaccagauuauucaggcagaacgggucacaauguucaccuagcaccagcaguagcuccaacuuucccaggagaacaacuacuauuuuucagaucuacaaugcccggaugcaguggauauccuaauaugaaccuagauugucuauuaccccaagaaugggucuuacauuuuuaccaagaagcagcuccugcacaaucagauguugcauuacuaagauuuguuaacccugauacaggacgaguucuuuucgaauguaaacuacacaaaucaggcuauaucacuguugcacauacagguccauacgaucuaguaauuccaccuaacggauacuuucguuuugauucaugggucaaucaauucuauacacuagcaccaaugggcaacgguacaggaagaagacgauaa

SEQ ID NO: 34769 - RNA, 1614 nt, Artificial Sequence
  derived and/or modified sequence opt6 from VP1__Norovirus_and/or_Norovirus-like__AY532130
augaaaauggcaucaaacgacgccaacccaucagacggaucaacagcaaaucuaguaccagaaguaaacaacgaaguaauggcacuagaacccguagucggcgcugcuauagcagcuccaguagcugggcaacaaaauauaauugauccauggauuagaaacaacuucguacaagcaccuggcggcgaauuuacugucuccccaagaaaugcuccaggagaaauauuaugguccgcuccccuaggaccagacuuaaauccauaucucagucaccuugcaagaauguacaauggauaugcugguggauucgaaguacaaguaauauuagcaggaaacgcaucaaccgcaggaaaaauaauauucgccgcaguaccacccaacuuuccaacagaaggacuuucaccaucucaagucaccauguuuccucacauaauuguagacguuagacaacuagaaccgguauuaauuccauuaccagauguacgcaacaauuucuaccacuacaaccaaucaaacgauucuacaaucaaauuaauagcaaugcuauacacuccauuaagagcaaauaaugcuggugacgacguauuuacagucucaugccgaguccuuaccagacccucaccagacuuugacuuuauauuucuaguaccaccaaccguagaaucuaggauaaaaccauuuacaguaccaauacuaaccguagaagaaaugucaaauucaagauuccccauaccucucgaaaaauuauauacaggaccaucaucugcauucguaguccaaccccaaaauggucgcugcacuacagacggaguacuauuaggcacaacucaacuaucugccguaaacauauguacauuuagaggagacguuacacacauagcaggcucacaugacuauacaaugaaccuagcaagccaaaauuggaauaacuacgauccaacagaagaaauaccagcaccauuaggcaccccagauuuuguaggaaaaauacaaggaaugcuaacacaaaccaccagagaagacggauccacaagagcucauaaagcaacaguaucaacaggauccgcacacuucacaccaaaauuaggaucaguacaauacacaacagauacaaacaacgacuuucaaacaggacaaaacaccaaauucacaccagucgguguaauucaagauggcaauaaucaccaaaacgaaccucaacaaugggucuuaccuuccuacucuggacgaacuggacauaauguacaucuagcaccagcaguagcaccaacguuuccaggagaacaauuauuauucuuccgcucaacaaugcccggaugcucaggauauccaaacaugaaucuagacugccuuuuaccacaagaauggguccaacacuuuuaccaagaagcagcuccagcacaaucagacguagccuuauuaagauuuguaaauccugauacaggaagaguuuuauucgaauguaaacuacacaaaucaggcuacguaaccguagcacacacaggaccacacgaucuuguaauaccuccuaacgguuacuuuagauuugauuccugggucaaccaauucuacacacuagcucccaugcgaaauggagcaggacgaagaagauaa

SEQ ID NO: 34770 - RNA, 1614 nt, Artificial Sequence
  derived and/or modified sequence opt6 from VP1__Norovirus_and/or_Norovirus-like__KX514286
augaaaauggcaucaucagaugcuaauccuuccgacgguucaacagcaaaccuaguacccgaaguaaacaacgaaguaauggcuuuagaaccaguaguuggagcagccauagcagcaccagucgccggacaacaaaauguaauagauccauggauaagaaauaacuuuguacaagcuccaggaggugaauuuaccguauccccuagaaacgcuccaggagaaauacuauggagcgcuccauuaggaccagacuuaaauccauaucuaucucaucuagcaagaauguauaauggauaugcagggggauuugaaguccaaguuauacucgcagguaacgcauucacagcagguaaaauuauauuugcagcugucccaccaacauuccccacagaaggacuaagcccaagccaagucacaauguucccucacauaaucguagacguucgacaguuagaaccaguauuaauaccucuaccagauguaagaaauaacuuuuaucauuacaaccaauccaacgauaguaccauaaaacuaauagcuaugcuauauaccccauuacgagcaaauaacccaggagaugacguauucacuguaucuugcagaguacucacacgaccaucuccagauuucgauuucauauuucuaguaccucccaccguagaaucaagaacaaaaccauuuucugucccaauucucacuguaggagaaaugacaaauucccgcuucccuauuaacuuagaaagauuauuuacaggaccuucaucugcaaauguaguucaaccacaaaaugguagaugcacuauagauggagaacuacuaggaacuacacaacuaucaucaguaaacauaugcacauuuagaggagauguaacucauauaggaaguacucaccacuggaccaugaauuuagcaaguccuaauuggaacaauuacgauccaacagaagaaacaccagcaccauuaggaacuccagauuucguaggaaaaauacauggaaugcuaacacaaacaacacaagaaaauggaucaacacgagcacauagagcaaccguauacguaggcagcgcagauuucacuccaaaauuagguaaaguacaauuugaaacagauacagaagaugaccucgcaauaagacaaaacacuaaauucaccccaguaggaguaauacaaucauccgaucaccauagagacgaaccucaacaauggcguuuaccuaauuauagcggagcaaauacauuuaacguacacuuagccccugcaguagcaccaaauuuucccggagaacaauuacuauuuuucagaucaacacuuccuggcugcgguggacauccaaacauggaucuagauugcuuauuaccacaagaauggguacaacauuucuaucaagaagcagcaccagcacaaucagauguugcuuuauuaagauucguaaauccagauacaucaagaguauuauuugagugcaaauuacauaaaaguggauaugucacagucgcucauacaggucaauacgaucuaguacuaccauccaauggcuauuuuagguuugauucauggguaaaucaauuuuacacacuagcaccaauggguaaugguacuggcagaagaagauaa

SEQ ID NO: 34771 - RNA, 1614 nt, Artificial Sequence
  derived and/or modified sequence opt6 from VP1__Norovirus_and/or_Norovirus-like__KX514202
augaaaauggcaucaucugacgcaaacccaucagauggaucagcagccaauuuagugccagaaguaaauaaugaaguuauggcauuagaacccguaguaggagcagcaauagcugccccaguagcaggacaacaaaauguaauagauccauggaucagaaacaacuuuguacaagcaccaggaggagaauuuacaguaucaccacgaaacgcaccaggagaaauccuauggucagccccacuaggaccugaccucaauccauauuuaucacauuuagcaagaauguauaaugguuacgcuggaggauucgaaguccaaguuauacuagccggaaacgccuucacugccggaaaaauuauauucgcugcaguuccaccaaccuucccaacagaaggccuauccccaagccaaguaacaauguuuccacacauaauaguugauguaagacaacucgaaccaguuuuaauaccauuaccagauguacguaacaauuucuaucauuauaaccaaucaaacgacucaacuauaaaacucauagcaaugcuguacacaccauuaagagcaaacaauccaggagacgauguauuuacaguuuccuguagaguacuaaccagacccuccccagauuuugauuuuauauuucuaguaccaccuaccgucgaaucacgaacaaaaccauucuccguaccaauauuaacaguaggugaaaugacaaauucaagauucccuauaaacuuagaacguuuauuuacagguccaucaucagcaaauguaguacaaccacaaaacggaagaugcacaauagacggagaacuucuagguacaacacaauuaaguucagucaacauauguacuuuuagaggcgauguaacacauauaggaaguacacaccacuggacuaugaacuuagcaucaccuaacuggaacaacuacgauccaacagaagaaacaccagcaccauuagguacaccugacuuuguuggcaaaauccacggaaugcucacccaaacaacccaaggaucaggcuccacacgagcacauagagcuacaguauacguaggaucagcugaauuuacaccuaaacuaggcaaaguacaauucaaaacagaaacagaucacgaccuaacaauucgacaaaacaccaaauuuacaccaguaggaguaauacaagaaucagaucaucacagagaugaaccacaacaauggagauuaccaaacuacagcggugcaaacacauuuaauguucaucuagcuccagcaguagcacccaauuucccaggagaacaacuccuauuuuucagaagcacacucccuggauguggaggucauccaaauauggaucuagacuguuuacuuccacaagaauggguacaacauuucuaucaagaagcagcaccagcccaauccgaugucgcacuauuaagauuuguuaauccagauacaucucgagucuuauuugaauguaaacuccacaaaucagguuauguaaccguagcucauacaggccaauaugaucuaguauuaccaaguaauggauauuuuagauuugauucaugggucaaucaauuuuacacucuugcaccuaugggaaacggaacaggcagacgaagauaa

SEQ ID NO: 34772 - RNA, 1614 nt, Artificial Sequence
  derived and/or modified sequence opt6 from VP1__Norovirus_and/or_Norovirus-like__DQ358208
augaaaauggcaucaaacgaugcaaauccaucagauggaagugcagcaaaccuaguaccagaaguuaauaacgaaguaauggcauuagaaccagucguaggugccgcaauagcagcaccaguagccggacaacaaaacguaauagaccccuggauaagaaacaauuuuguucaagcaccuggaggagaauuuacaguaucaccaagaaacgcaccaggagaaauacuauggucugccccauuagguccagauuuaaauccauauuuaagucaucuuucaagaauguacaacggauacgcaggagguuuugaaguacaagucauacuagcaggaaaugcauuuacugcuggaaaaguaaucuucgcagcuguaccaccaaacuuuccaacagaaggauuaucaccaucacaaguaaccauguuuccacauauaauuguagauguaagacaacuagaaccuguauuaauuccacuacccgacguaagaaacaauuuuuaucauuauaaucaagcaaaugauucaacauuaaaauuaauagcaaugcucuacacuccucuccgugcaaauaaugccggcgacgauguauuuacuguaucaugucgcguacuaaccagaccaucaccagacuuugauuuuauauucuuaguaccaccaacaguagaauccagaacuaaacccuuuacagucccuguauuaacagucgaagaaauguccaacucuagauuuccaauaccacuagaaaaauuauauacaggcccaucaucugcuuuuguaguacaaccacaaaaugguagauguacaaccgacggaguuuuacuaggaacuacucaauuaucagcaguaaacauuugcaacuuccgaggcgauguaacucacauagcaggaucacacgauuacaccaugaaucuagcuucacaaaauuggagcaauuacgauccaacagaagaaauccccgcaccacuaggaacaccagacuuuguagguaaaauacaaggacuccuaacacaaacaacaagagcagacggaucaacaagagcccacaaagcaacaguaucaacaggaucgguacacuuuacaccaaaacuagguuccguacaguucacaacagauaccaacaaugauuuccaagcuggucaaaauacaaaauuuaccccagugggcgucauacaagacggcgaccaccaucaaaacgaaccacaacaauggucucuuccuaacuauucaggaagaacaggacacaauguacauuuagcaccagcuguagcaccaaccuuuccaggagaacaacuacuauuuuuccgaucaacuaugccaggauguucaggauacccaaauaugaacuuagauuguuuacucccacaagaauggguauuacauuuuuaccaagaagcagcaccagcccaaucggacguagcauuacuacgcuucguuaauccagauacugguagaguauuauuugaaugcaaauuacauaaaucaggauacaucacuguagcacauacaggaccauacgacuuaguacuaccaccaaauggauauuucagauuugacuccuggguaaaucaauucuacacacucgccccaaugggaaauggaaccggacggcgcagauaa

SEQ ID NO: 34773 - RNA, 1614 nt, Artificial Sequence
  derived and/or modified sequence opt6 from VP1__Norovirus_and/or_Norovirus-like__AF414425
augaaaauggcaucuaaugacgcuaauccuuccgauggaucaaccgcaaauuuaguaccagaaguuaacaaugaaguaauggcauuagaacccguaguaggagcagccauagcugcaccaguagcaggccaacaaaacguaauagaucccuggauccgaaauaauuucguccaagcgccaggcggagaguucaccgcaucacccagaaacgcuccaggcgaaauccuauggucugccccauuaggaccugacuuaaacccauaucuuucacauuuagcaagaauguacaacggauacgcaggaggauuugaaguacaaguaaucuuagcaggaaacgcauucacagcaggaaaaaucauauucgcagcaguacccccuaauuucccaacagaaggauuaucgccaagccaagucacaauguuuccacacauaauaguagauguacgacaauuagaaccaguauuaauaccauuaccagauguucgaaacaauuuuuaucacuauaaccaaucuaacgacagcaccauaaaacuaaucgcaaugcuauacacaccucucagagcuaauaaugcaggagaugacguauucacagccucaugcagaguuuuaacacgaccaucacccgauuucgacuucauauuuuuaguaccaccuacaguugaaucaagaacaaaaccauucacagucccaauauuaacaguagaagaaaugucaaacucccgauuucccauaccacuagaaaaacuauauacaggcccaagcucagcuuuuguaguacaaccacaaucaggucgauguacaacagacggagucuuacuaggaacaacucaacuaucugcgguaaacauaugcacuuucagaggagacguuacacacauagcgggaagccaugauuacaccaugaaccuugcuucacaaaauuggaacaauuaugauccuacagaagaaauacccgcaccacuuggaacgccagacuuuguaggaaaaauucaaggaaugcuaacacaaacaacuagagaagauggaucaacaagagcacauaaagcaacaguuagcaccggaucaguacacuuuacaccaaaacuagguucaguacaauacacaacugacaccaacaaugauuuucaaacuggccaaaauacaaaauucaccccaguaggaguaauacaagacggcaauaaucaucaaaacgaaccacaacaauggguacuaccaaacuacucaggacgaacaggccauaauguacacuuagcaccagcaguugcaccaacauuuccaggagaacaacuacuauucuuuaaaucuacaaugccaggauguucuggauacccuaauaugaaucuugauugucucuuaccacaagaauggguacaacacuuuuaucaagaagcagcccccgcacaaagugacguagcauuauuacgauucgucaauccagauacaggucgaguccuauucgagugcaaauuacauaaaucaggcuacguaacaguagcacauacuggcccccaugacuuaguaauaccuccuaauggcuauuuuagauucgacucauggguaaaccaauuuuauacccuugcaccaaugggaaacggagcuggaagaaggagauaa

SEQ ID NO: 34774 - RNA, 1614 nt, Artificial Sequence
  derived and/or modified sequence opt6 from VP1__Norovirus_and/or_Norovirus-like__KX514348
augaaaauggcaaguaacgaugcuaacccauccgauggauccgcugccaauuuaguaccggaaguuaacaaugaaguaauggcacuagaaccuguaguaggugcagcaauagcagcacccguagcuggucaacaaaacguaauagaucccuggauuagaaacaacuuuguacaagcaccuggaggcgaguuuacagucucaccuagaaacgcaccaggagaaauuuuaugguccgccccacuagguccagauuuaaauccauaucucucacacuuagcaagaauguacaaugguuaugcugguggauucgaaguacaaguuauauuagcagguaacgccuuuacugcagguaaaauaauauucgcagccguaccaccuacauuuccaacagaaggauuauccccaucacaaguaacaauguuuccacauauaauaguagacgucagacaacucgaaccuguucuuaucccuuuaccagacguacgcaauaacuucuaccacuacaaucaaucaaacgacucuaccauaaaauuaauagccaugcuuuauacaccauuaagggcaaauaaccccggagaugauguuuucacaguaucauguagaguuuuaacaagaccaucuccagauuuugauuuuauauuucuagucccacccacagucgaaucucgcacuaaaccauuuucaguaccaauacuaaccguuggagaaaugacaaauagucgauuccccguuaauuuagaaagacuauuuacuggcccaucaucagcaaauguaguacaaccccaaaauggaagauguacaauagacggagaauuacuaggaaccacacaauuaucuucagucaacauuugcacauucagaggagacguaacccaaauaggaucuacaaaacauuggacaaugaaucuagcaucaccaaauuggaauaauuaugacccaacugaagaaaccccagcaccccuaggaaccccugauuucguaggaaaaauccauggaauguuaacucaaacaacacaagaaaacggauccaccagagcacacagagcaacaguuuacgucgguggagcaaauuuuacaccaaaauuaggaaaaguacaauuugaaacagauaccguagacgacuuagaaaucagacaaaacacaaaauucacaccaguagguguaauucaaucuucagaucaucacagagaugaaccacaacaauggguacuaccaucauauucaggaagagauacaccaaauguacauuuagcuccagcuguagcaccaaauuuuccaggagaacaacuacuuuucuuuagaucaacacuuccaggauguggcggacaucauaauauggauuuagauugccuuuugccacaagaauggguacaacacuuuuaucaagaagccgccccagcucaaagcgacguagcauuauuaagauucguaaaucccgacacaucacgaguacuauuugaauguaaacuacauaaaagcggauaugucacaguugcucauacuggacaauaugauuuaguacuaccaucaaacggauauuuuagauuugacucaugggucaaccaauucuauacauuagcacccaugggaaauggaacaggaagaagacgauaa

SEQ ID NO: 34775 - RNA, 1614 nt, Artificial Sequence
  derived and/or modified sequence opt6 from VP1__Norovirus_and/or_Norovirus-like__KX514287
augaaaauggcuucuuccgaugcuaacccuuccgauggcucagcagcaaauuuaguacccgaagugaacaaugaaguaauggcucuagaaccaguaguaggagcagcaauagcagcaccagucgcaggccaacaaaaugucauagacccauggauaagaaacaacuuuguacaagcaccagguggagaauuuacaguaucaccaagaaacgcaccuggcgaaauacuauggucagcaccucucggacccgaucucaauccauaucucucacaccuugcaagaauguacaauggauacgcaggagguuuugaaguccaaguaauccuugcuggcaaugcauuuacagcaggcaaaauaauauuugcugcaguucccccaacauucccaacagaagguuuaucaccuucacaaguaacaauguucccacacaucauaguagacguaagacaauuagaaccaguucuuauaccucuuccagauguacguaacaauuucuaucauuauaaccaaucaaaugacucaacaauaaaauuaauagcuaugcuauauacaccauuaagagcaaauaaucccggagacgacguauucacuguuaguugcagagucuuaacaagaccaucuccagacuuugauuucauauuucuaguuccaccaacaguagaauccagaacaaaaccauuuucagucccaauauuaacaguuggcgagaugacuaauucaagauuuccaauaaauuuagaaagauuauucacaggaccauccucagcaaauguaguacaaccccaaaacggaagauguacaauagacggagaacuauuaggaaccacacaauuaucuagcguaaacauauguacuuucagaggagauguaacucaaauaggcucaacccaccacuggacuaugaaucucgcaucuccaaacuggaacaauuacgacccaacagaagaaacaccagcaccauuagguacaccugacuuuguaggaaaaauucacggcaugcucacacaaacuacacaagaaaacggcucaacaagagcacauagagccacuguauacguuggaucagcugacuuuacacccaaauuagguaaaguacaauucgaaacagauacaggagacgaucuagcuauaagacaaaauacaaaauuuaccccaguuggaguaauucaaucaucugaucaucaccgagacgaaccacagcaauggagacuuccaaauuacuccggagcuaacacauucaauguacauuuagcacccgcaguagcaccaaacuucccaggugaacaacuacuauucuuuagaucaacacuaccugguuguggaggccauccaaauauggaccuugacuguuuauuaccucaagaauggguacaacauuuuuaccaagaagcagcaccagcacaaucugauguugcucuacuucgauucgucaauccagauacaucaagaguacuauuugaauguaaauuacacaaaucaggcuacguaacaguagcacauacuggacaauaugauuuaguauuaccaucuaauggauauuucagauuugauaguuggguaaaucaauuuuacacacuugcaccaaugggaaauggaacaggaagacgaagauaa

SEQ ID NO: 34776 - RNA, 1614 nt, Artificial Sequence
  derived and/or modified sequence opt6 from VP1__Norovirus_and/or_Norovirus-like__KX514183
augaaaauggcaucauccgaugcaaauccauccgaugguucagcugcaaacuuaguaccagaaguaaauaaugaaguaauggcccuagaaccaguaguaggagcagcaauagccgcaccuguugcaggacaacaaaauguaauagacccauggauaagaaauaauuuuguucaagcaccggguggugaauuuacuguuucuccaagaaacgcaccaggagaaauacuauggucagcaccauuagguccagaucuuaacccauauuuaucacacuuagcuagaauguacaauggcuaugcaggaggauucgaaguucaaguaauacuagcaggaaaugcauuuacagcaggaaaaauaauauuugcugcagucccaccuacuuuuccaacagaaggacuaucaccaucacaaguaacgauguuuccacauauaauaguagauguaagacaacuagaaccaguacuaauaccauuaccagauguacgaaacaacuuuuaucacuacaaucaaucaaaugacucaacaauaaaauuaauagcuauguuauauacaccacuaagagccaauaacccaggcgaugauguuuucacaguuucaugcagaguacucacacgaccuucuccagacuucgacuuuauauuccuaguacccccaacaguugaaucccgaacaaaaccuuucucaguaccaauauuaaccgucggagaaaugacuaauucuagauuuccaguaaaccuagaaagauuauucacaggaccaucaucagcaaacguuguacaaccacaaaacggacgaugcacaauugacggugaacuacuaggaacaacucaauuaucaucaguuaauauuuguacuuuccgaggagacguuacacacauuggaacaacccaacacuggacuaugaauuuggccucaccaaacuggaauaauuacgauccaacagaagaaacaccagcuccacuaggaacacccgacuuuguaggaaaaauacacgguaugcuaacucaaacaacacaagguucuggaucaacccgagcacauagagccacuguauacguaggaucugcagaauuuacaccaaaauuaggaaaaguaagauuugaaaccgacacugaagaugacuuagucauacgacaaaauacaaaauuuacaccaguuggaguaauccaaucaucagaacaucaccgagaugaaccacaacaauggcgacucccaaauuacucaggcgcaaauacauucaacguucauuuagcuccagcuguagccccaaauuuuccaggagaacaacuacuauucuucagauccaccuuaccaggauguggaggacauccuaauauggauuuagacuguuuacuaccccaagaauggguacaacauuuuuaccaagaagccgcuccugcacaaucugacguugcacuuuuacgauucguuaauccagauacuucaagaguacuauuugaauguaaacuucauaaauccgguuacguaacaguagcacauacaggacaauaugaucuuguucuuccaucaaaugguuauuucagauucgauucauggguaaaccaauucuauacauuagccccaaugggaaauggcacaggaagacgccgauaa

SEQ ID NO: 34777 - RNA, 1614 nt, Artificial Sequence
  derived and/or modified sequence opt6 from VP1__Norovirus_and/or_Norovirus-like__KX514174
augaaaauggcaucuaacgacgcaaacccuagcgauggaagcgcagcaaacuuagucccagaaguaaacaaugaaguuauggcauuagaaccaguaguaggugcagcuauagcugcgccagucgcaggacaacaaaacguaauagauccauggauucgcaauaacuuuguacaagcaccaggaggcgaauuuacaguuucaccaagaaaugccccaggcgaaauauuauggucugcaccacucggaccagaucuaaauccguaccuaucacaucuagcaaggauguauaacggauaugcuggaggauucgaaguacaaguaauauuagcaggaaaugcauuuacugcaggaaaaauaauauuugcagcaguacccccuacauucccaaccgaaggauuaaguccaagucaaguaacaauguucccacacauuauaguugacguacgacaacuagaaccaguccuaauaccacucccugauguaagaaauaacuucuaccauuauaaucaaagcaacgauucaacaauaaaacuaaucgcaaugcuuuacacaccccuaagagcaaacaauccaggcgacgauguauuuaccgucaguugcagaguacuaacaagaccuucaccugauuuugauuucauauuucuaguaccaccuacaguugaaucaagaacuaaaccauuuucaguaccuauacuaacaguuggcgaaaugacaaacucuagauucccaguuaacuuagaaaggcuauucacaggaccauccucagcaaacguaguacaaccacaaaauggaagauguacaauagacggagaacuauuaggaaccacacaacuaucaaguguaaacauauguacauucagaggagauguaacacacauuggcacaacccaacacuggacaaugaauuuggcaucaccaaacuggaauaacuacgacccaacagaagaaacaccagcaccucuagguacacccgacuucguaggaaaaauacauggcaugcuaacacaaaccacacaagguucuggaucaacuagagcacacagagcaacaguuuacguagguucagccgaauuuacacccaaauuaggcaaaguacgcuucgaaacagauacagaagaugauuuagucauacgacaaaacacaaaauuuaccccaguaggaguaauacaaucaucagaacaucauagagaugaaccacaacaauggagauuaccaaacuacucaggagcuaauacuuuuaacguacauuuagcucccgcagucgcaccaaacuuucccggagaacaauuauuauuuuucagaucaacacuaccagguuguggcggacacccaaauauggaccuugauugucuuuuaccacaagaauggguacaacauuuuuaccaagaagcagcaccagcccaaucagacguagcucuacuccgauuuguuaauccagauacaaguagaguacuuuuugaaugcaaauuacauaaaucaggauacguaacuguagcacauaccggacaacaugaccuaguaauaccaccaaacgguuauuuuagauucgauucauggguuaaccaauucuacacauuagcaccaaugggaaaugguaccggaagaaaaagauaa

SEQ ID NO: 34778 - RNA, 1614 nt, Artificial Sequence
  derived and/or modified sequence opt6 from VP1__Norovirus_and/or_Norovirus-like__KF429791
augaaaauggcauccagcgacgcaaacccuuccgauggaagcacagcaaaccuaguaccagaaguaaacaaugaagucauggcacuugaacccguuguaggugcagcaauagcugcacccguagccggccaacaaaacguaauagauccauggauuagaaacaacuuuguacaagcaccaggaggcgaauuuacaguuuccccaagaaacgcaccaggagaaauacuauggucagcaccacuuggcccagaucuaaacccauaccucucacacuuagcacgaauguauaauggcuacgcaggaggauucgaaguacaaguuauauuagcaggcaacgcauucaccgcaggaaaaauaaucuuugccgcaguaccaccgaacuuucccacagaaggacuaucuccaggacaaguaacaauguuuccucauauaauaguagacgugcgacaauuagaaccugucuuaauaccauuacccgacguuagaaauaauuuuuaucacuacaaucaaucaaacgauccaacuauuaaauuaguugcaauguuauauacuccacuacgagcaaacaaugcaggagaugacguauuuacagucucauguagagugcuaaccagacccuccccagauuucgacuuuauauuccuaguuccuccuacaauagaaucaaaaacuaaauccuucucaguaccaauacuaacaauagaagaaaugacaaacucaagauucccaauuccccucgaaaaacuauuuacaggaccaucauccacccuuguaguucaaccacaaaacggaagauguacaacagauggaguuuuauuaggaacuacacaauuaagcccaguaaacauaugcacuuuccgaggagauguaacacaaauaacuaacacacauaguuaugaaaugaacuuagcagcacaaaauuggaacucauacgauccuacugaagaaauacccgcaccauuaggaacacccgacuucguaggaaaaauacaagguguuuuaacacaaacaacaaaagaaaauggcaguacaagagcacacaaagcaacaguauacaccggcucaacaggauuuacaccaaaauuaggccgaguacaauuuguuacugauacagaccgcgacuuagaaaccaaccaagacacuaaauucacaccgguaggaguaauucaagacggagaugcccaccaaaacgaaccacaacaauggguauuaccaucauauuuaggaacuaauaaccacaacguacaucuagcaccagcaguagcacccaccuuccccggagaacaacuacuauuuuucagauccacaaugcccggauguucugguuacccaaacaugaaccucgauugcuuauuaccacaagaauggguacaauacuuuuaccaagaagcagccccugcacaaucagacgucgcauuauuaagauuuguaaacccagauaccggacgcguccuauuugaaugcaaacuacauaaauccggauacguaaccguagcacacacaggaagacacgacuuaguaauuccaccaaauggauacuuuagauucgacucauggguaaguccauuuuauacauuagcaccaaugggcaacggaacagguagacgaagauaa

SEQ ID NO: 34779 - RNA, 1614 nt, Artificial Sequence
  derived and/or modified sequence opt6 from VP1__Norovirus_and/or_Norovirus-like__AF427115
augaaaauggccucaaaugaugccaaccccucagacggaagcacagcaaauuuaguaccggaagucaauaaugaaguaauggccuuagaacccguaguaggagcagcaauagcugccccagucgcaggacaacaaaaugucauagacccauggauuagaaacaauuucguacaagccccaggaggugaauuuacaguaaguccacgaaacgcccccggcgaaauucucuggucagcaccauuaggacccgauuuaaauccuuaccuaucacaccuagcaagaauguacaaugguuacgcaggaggauucgaaguacaagucauucucgcuggcaaugcauuuacagcaggaaaaauaauauuugcugcuguaccacccaauuuuccaacagaaggccuaagccccucacaaguaacaauguucccucauauaauagucgacguaagacaauuagaaccaguuuuaauaccacuaccagauguacgaaacaacuucuaucauuacaaccaauccaaugacucaaccauaaaauuaauagccauguuauauacuccacuuagagcaaacaaugcaggcgacgauguauucacaguaucuugcagaguacuaacacguccuucaccagauuucgacuucauauuuuuaguaccuccaacuguagaaucacgaacaaaaccauuuacaauaccuauacuaacaggagaagaaaugucaaacucccguuuuccuaucccuuuagaaaaauuauacacaggcccaucuucagcauucguuguucaaccucaaaacggccgcuguaccacagacgguguauuauuaggaacaacacaacucucagccguuaauauauguaccuuuaaaggaaacguuauacauauagcuggcucucacgacuauacaaugaauuuagcaucacaaaauuggaacaauuacgauccaacagaagaaaccccagccccauuaggaacaccugacuuugucggaaaaauacaaggccuacuaacucaaacaacacgagaagauggaucaacaagagcccacaaagcaacaguuucagcaggauccguacacuucacaccaaaauuaggaucgguacaauacacaacagauacaaacaacgacuuccaaaccggacaaaauacaaaauucacuccaguaggaguaauacaagacggcaauaaucaccaaaacgaaccacaacaauggguuuuaccaaacuacaguggcagagcaggacacaauguucaucuugcaccagcagucgcaccuacauuuccaggugaacaacucuuauucuuuagaucaaccaugccaggaugcucaggauacccuaauaugaauuuagacuguuuauuaccacaagaauggguccaacacuuuuaucaagaagcugcuccagcccaauccgauguagcucuauuacgauuuguaaauccagacaccggaagaguauuauuugaaugcaaauuacacaaauccgguuacguaacuguagcacauacaggaccacaugacuuagucauuccucccaacggauacuuuagauucgacucuuggguuaaucaauuuuauacacucgcaccuaugggaaauggagcaggaagacgaagauaa

SEQ ID NO: 34780 - RNA, 1614 nt, Artificial Sequence
  derived and/or modified sequence opt6 from VP1__Norovirus_and/or_Norovirus-like__KX514314
augaaaauggcaucaaacgacgcaaacccaucugauggaucaacagccaauuuaguaccagaaguaaauaaugaaguaauggcauuagaaccaguuguaggugcagcaauagccgcucccguagcaggacaacaaaauguaauagauccauggauacguaauaauuucguacaagcaccaggcggagaauuuacaguaucaccacguaaugcaccaggagaaauccuauggucagcaccauuaggaccagaucuuaauccauacuuaucacaccucgccagaauguauaauggauacgcaggagguuucgaaguacaaguaauauuggcaggaaacgcauucaccgcuggaaaaauaauauucgcagcagucccacccaacuuuccaaccgaaggacuaucaccaucacaaguaacaauguuuccacacauuauaguagaugucagacaauuagaacccguacuaauacccuuaccagaugucagaaauaacuuuuaucacuauaaccaaucaaaugacuccacaauaaaauuaauagcuaugcuuuacacuccacuaagagccaauaauccuggagacgauguauucacaguauccuguagaguauuaacaagaccuuccccagacuucgacuucauuuuccuaguucccccaacuguugaaucaagaaccaaaccuuuuucuguaccaaucuuaacagucggcgagaugacaaacucacguuucccaauaaauuuagaaagacuauucacaggaccaaguucagcaaauguuguacaaccacaaaacggaagauguaccauagacggagaacuucuuggaacaacacaacuaucaucaguaaacauaugcacauuuagaggagacguaacacaaauaggaucuacaaaacacuggacaaugaauuuagccucuccaaauuggaacaauuaugacccuacagaagagacuccagcaccucuaggcacuccagacuuuguuggaaaaauacauggcauguuaacacagacaacacaagaaaacggaucaacaagagcacacagagcaacugucuacguaggaggagcaaacuucacaccaaaacuuggaaaaguacaauucgaaaccgacacaggagaugauuuagcaauaagacaaaauacuaaauuuacaccuguaggaguaauacaaucuucagaccaccauagagacgaaccucaacaauggagacuaccaaacuacucaggagcaaauacauucaauguacaucuagccccagcugucgcaccaaacuuuccaggagaacaauuacuauucuuuagaucuacacuaccuggaugcggaggacacccaaauauggacuuagacugucuauuaccucaagaauggguacaacauuucuaccaagaagccgcaccagcacaaucugauguagcucuauuaagauucguuaauccagauacuucccguguauuauucgaaugcaaauuacacaaaucaggcuacguaacaguagcucacaccggacaauaugaucuagucuuaccauccaacggauacuuucgauuugacuccuggguuaaccaauucuacacccuagcaccuaugggaaacggaacaggaaggagaagauaa

SEQ ID NO: 34781 - RNA, 1614 nt, Artificial Sequence
  derived and/or modified sequence opt6 from VP1__Norovirus_and/or_Norovirus-like__KX514208
augaaaauggcaucaucagaugcaaauccauccgacgggucagcagccaauuuaguaccugaagucaacaacgaaguuauggcacuagaaccagucguaggagccgccauagcagcaccaguagcaggucaacaaaauguaauagauccauggauaagaaauaauuuuguacaagccccagguggagaauuuacaguaucaccccguaaugcacccggagaaauacuuugguccgcacccuuaggaccugacuuaaacccauauuuaucccacuuagcuagaauguacaacggauaugcugguggcuuugaaguacaaguaauacuagcuggaaaugcauucacagcagguaaaauuauauucgcagccguacccccaacauuuccaacagaaggacuaucuccaucacaagucacaauguuuccacacauaauaguagacgucagacaauuagaaccaguauuaauaccccuaccagacguaagaaauaauuuuuaccacuacaaucaaucaaacgacuccacaaucaaacucauagcaauguuauauacaccucuacgagcuaauaauccaggugaugauguauuuacuguaucuuguagaguacuaacacgaccauccccugacuuugauuucaucuuccuaguaccuccaacaguagaauccagaaccaaacccuuuucuguaccaauauuaacuguaggagaaaugacaaacucucgauucccgauaaacuuagaacgacuauucacaggcccaucaucagcaaaugucguacaaccccaaaaugguagauguacaauagacggugaacuccuugguacgacccaauuaaguucaguuaacauauguacuuuucgcggagacguaacacauaucggaucaacacaucauuggacaaugaacuuagcaucaccaaacuggaacaacuacgauccaacagaagaaacaccagcccccuuaggaacaccugauuucguaggaaaaauccacggaaugcuaacacaaacuacacaaggaucaggaucuacuagagcacauagagcuacaguauauguaggcucagccgaauuuacaccaaaacuagguaaaguccaauucaaaacagaaacagaccacgaccuuucaauacgucaaaauaccaaauucacaccgguuggcgucauucaagaaagugaucaucauagagaugaaccucaacaauggagacuacccaacuacucaggagccaauaccuuuaauguucaccucgcuccagccguugccccaaacuuuccaggagaacaauuauuauuuuucagaucaacacuaccaggaugcggaggacacccaaacaugaauuuagauugccuacuaccccaagaauggguacaacacuuuuaucaagaagcugcaccagcacaaucagacguagcacuuuuaagauucguaaauccagauacaucuagaguacucuucgaaugcaaacuucacaaaucuggauacguaacaguagcacacacaggucaauacgaccucguuuuacccucaaacggauacuuuagauucgacuccuggguaaaccaauuuuacacuuuagcacccauggguaacggaacaggaagaaggagauaa

SEQ ID NO: 34782 - RNA, 1614 nt, Artificial Sequence
  derived and/or modified sequence opt6 from VP1__Norovirus_and/or_Norovirus-like__KX514206
augaaaauggcaucuucagaugcaaacccaucagacgguucagcagccaacuuaguuccugaaguaaauaacgaaguuauggcacucgaaccuguaguuggagcagcaauagcagcaccaguugcaggacaacaaaauguaaucgauccauggaucagaaauaauuucguacaagcacccggaggagaauuuacagucaguccacguaacgcaccaggagaaauacuauggucagcaccauuaggaccugacuuaaacccauaucucucacaucuagccagaauguauaaugguuacgccggaggcuucgaaguacaaguaaucuuagcagguaacgcauucacagcugguaaaauaauauuugcugccguaccgccaacauucccaacagaaggucucucaccaucccaaguaaccauguuuccacauauuauuguagacguuagacaauuagaaccaguauuaauaccacuccccgacgucagaaauaacuucuaccauuacaaucaaucaaaugacucaacuauaaaguuaaucgcaauguuauacaccccauuacgagccaacaauccaggagacgacguuuuuacaguaucaugcagaguacuaacaagacccucacccgauuucgauuucauuuuucuuguaccaccaacuguugaaucacgcacuaaaccauuuucaguaccuauacuuacuguaggagaaaugacaaauucaagauuuccaauaaacuuagaaagauuauuuacaggaccaucaucagccaauguaguccaaccacaaaacggcagauguacuauagauggugaacuacuuggaacaacucaauuauccaguguaaacauaugcacauucagaggagacguuacacacauaggcucuacucaucauuggacuaugaacuuagcaucaccuaacuggaacaacuacgauccaaccgaagaaacacccgcacccuuaggaacaccagacuuuguaggaaaaauacacggaaugcuaacacaaacaacacaaggaucagguuccacuagagcacauagagcaacaguauauguaggcuccgccgaauuuacaccuaaacuaggaaaaguccaauucaaaacugaaacugaucaugaucuaucuaucagacaaaacacaaaauucacaccaguuggaguaauucaagaaucagaucaucauagagaugaaccacaacaauggagauuaccaaacuauucaggugcaaacacauuuaacguacacuuagcaccagcaguagcucccaacuuuccuggagaacaauuauuauucuuucguucaacuuuaccaggaugcggaggacacccaaauauggaccuagacuguuuacuaccacaagaauggguucaacauuucuaucaagaagcugcaccagcucaaucagacguagcccuacucagauucguaaaucccgacacuucuagaguauuauucgaauguaaauuacauaaaucaggauauguaacaguagcacacacaggccaauacgacuuaguacuaccauccaauggauacuuucguuucgauuccuggguaaaccaauucuauacccuugcaccaaugggaaauggaaccggaagacgacgauaa

SEQ ID NO: 34783 - RNA, 1614 nt, Artificial Sequence
  derived and/or modified sequence opt6 from VP1__Norovirus_and/or_Norovirus-like__KX514198
augaaaauggccucaucagacgcaaauccaucagauggaucugcagcaaauuuaguaccagaaguaaauaacgaaguaauggcauuagaacccguagucggcgcagcuauagcagcaccuguagcaggacaacaaaauguaauagauccauggauaagaaauaacuuuguacaagcuccaggaggagaauuuacaguauccccuagaaaugcgcccggagaaauacuauggucagccccacuagguccugacuuaaauccauacuuaucucaucuugcacgaauguauaaugguuacgcaggcggcuucgaaguacaaguaauacucgcugguaaugcauuuacagcaggcaaaauaauuuucgcugcaguaccaccuaccuucccaacagaaggccuaucuccuucacaaguaacaauguuuccacauauaauuguagacguaagacaacuagaaccaguucuaauuccacuuccagacguuagaaauaacuuuuaucauuauaaccaauccaaugacucaaccauaaaauuaauagcaaugcucuacacaccacuuagagcaaauaacccaggagaugacguauuuacagucucguguagaguacuaacccgaccauccccagacuuugauuucauauuccuaguacccccaacaguugaaucuagaaccaaaccauucucagucccaauauuaacaguaggagaaaugacaaauucuagauuccccauaaacuuagaaagguuauuuacuggcccuucaucagccaacguaguccaaccucaaaacgguagauguaccauugacggagaacuacuuggaacaacccaauuaagcucaguaaacauuuguacauuuagaggugaugucacacauauaggaucaacacaucacuggacaaugaacuuagcaaguccuaacuggaacaacuaugacccaacagaagaaacacccgcaccucuaggaacaccagacuuuguuggaaaaauucacggaaugcuaacucaaacaacccaaggaucgggaucaacccgcgcacauagagcaacaguauaugucggauccgcagaauuuacaccaaaacuaggaaaaguacaauuuaaaacugaaacagaccaugaucuaacaacacgccaaaauacaaaauuuacuccaguuggaguaauucaagaaucagaccaccauagagacgaaccacaacaauggagacuaccaaauuacucaggagcuaauacauuuaauguucaucuagcuccugcaguagcaccaaacuucccuggagaacaauuacuauucuuuagaucuacacuaccaggauguggaggacacccaaacauggaccuagacugcuuacuuccacaagaauggguacaacacuuuuaccaagaagcagccccugcacaaucugauguagcacuauuaagauucguuaaucccgauacuucaagaguauuauucgaauguaaauuacacaaaucuggcuauguaacuguugcccauacaggacaauacgaucuuguauuaccaucaaauggauauuuuagauucgauucauggguuaaccaauucuauacauuagcuccaaugggaaauggaaccggccgacgacgauaa

SEQ ID NO: 34784 - RNA, 1614 nt, Artificial Sequence
  derived and/or modified sequence opt6 from VP1__Norovirus_and/or_Norovirus-like__KX514191
augaaaauggccucuucagacgccaacccaagcgauggaucagcugcaaaucucguaccagaaguaaauaaugaaguaauggcacuagaaccaguagucggagcugcuauagccgcaccuguagcaggacaacaaaauguaauugacccauggauacgaaauaauuuuguacaagcaccaggaggagaauuuacuguaucaccacgaaaugcaccuggagaaaucuuauggagugcaccucuuggaccagauuuaaacccuuaucuaucacaucuagcaagaauguauaauggauacgcaggaggauuugaaguacaaguaauauuagcaggaaaugcuuucacagcaggcaaaauuaucuuugcagcaguaccuccaacauuuccaacagaaggauuaucaccaucucaaguuacaauguuuccacauauaauaguagacguuagacaacuagaaccaguucuaaucccauuaccagauguaagaaacaacuuuuaucauuacaaccaauccaaugacagcacaauaaaauuaauugcuaugcuauacacacccuuaagagcuaacaacccaggcgacgauguauucacaguuaguuguagaguauuaacaagaccaucccccgacuuugauuuuaucuuuuuaguaccuccuacagucgaaucaagaacaaaaccauuuucuguacccauacuaacaguaggugaaaugaccaacucaagauuuccaguaaaucuagaaagacuauuuaccggcccaucaucggcuaauguaguacaaccacaaaacggaagaugcacaauagacggagaauuauuaggaacaacccaacucucaucuguaaacauauguacauuuagaggcgacgugacacacauaggaacaacaagacauuggacaaugaaucuagcaucaccuaacuggaauaauuacgauccaacagaagaaacuccagcuccccucgguacaccagauuuuguagguaaaauacauggaaugcuaacucaaacaacacaaggauccggaucaacacgggcacacagagcaacuguauauguaggaucagcagaauuuacaccuaaauuaggcaaaguacgauucgaaacagauacugaagacgaccuaguuauaagacaaaacacaaaauuuacaccaguaggaguuauacaaucaucugaacaccauagagacgaaccacaacaauggagacuuccaaauuacucaggcgcuaacaccuuuaauguacacuuagcaccagcaguagcaccaaacuucccaggagaacaauuacuauuuuucagaaguacucuaccuggcuguggaggucacccaaacauggaccuugacuguuuauuaccacaagaauggguccaacacuucuaucaagaagcugcacccgcacaaucagacguugcacuacucagauuuguaaauccagauaccucaaggguccuauuugaaugcaaacuacauaaauccggauauguaacaguagcacauaccggccaauacgaucucguccuaccaucaaacggauacuucagauuugauucuugggucaaccaauucuauacacuugcaccaaugggaaaugguacaggcagaagaagauaa

SEQ ID NO: 34785 - RNA, 1614 nt, Artificial Sequence
  derived and/or modified sequence opt6 from VP1__Norovirus_and/or_Norovirus-like__KX514187
augaaaauggccucaagugaugcaaacccuagugacggcagugcagcaaaccuuguaccagaaguaaacaacgaaguuauggcauuagaaccuguugucggagccgcaauagcagccccaguagcaggacaacaaaacguaauugauccauggauaagaaauaacuucguacaagccccaggaggagaauuuacaguaagcccuagaaaugcaccaggagaaauucuuuggucagcaccuuuaggaccagaccuaaacccauaucuaucucacuuagcaagaauguauaauggauacgcaggaggcuuugaaguacaaguuauacuagcaggaaacgcauuuacagcagguaaaauaauauucgccgcaguaccuccaacauuuccaacagaaggauuaucuccuucucaaguaacaauguucccacauauuauaguagacguuagacaacuagaaccaguuuuaauaccacuaccagacguaagaaacaauuuuuaucacuauaaccaaucaaaugauucaacaauaaaacuaauagcuaugcuauauacaccacuacgagccaauaacccaggagacgauguauucacaguaucaugcagagucuuaacccgacccucuccagacuuugacuuuauauuucuaguaccaccuacaguagaaucacgaacaaaaccauuuucaguuccaauauuaacaguaggagaaaugacaaauucaagauuuccagucaauuuagaacgccuauuuacaggaccaaguucugcuaacguaguacaaccacaaaacggccgcuguaccauagacggagaauuacuagguacaacucaacucucuucaguuaacauaugcacauuucgaggugauguuacacauaucggaacaacuagacacuggacaaugaaucuaguaaguccaaacuggaauaauuaugauccaacagaagaaacuccugcaccacuaggaacaccagacuucguaggaaaaauacauggaaugcuaacacaaacaacccaagguucuggcuccacuagagcacauagagcaacuguauauguaggcucugcagaguucacaccuaaauuaggaaaaguaagauuugaaaccgacacagaagacgacuuagucauacgacaaaauaccaaauuuacacccgucggugucauacaaucaucagaacaucauagagaugaaccucaacaauggagguuaccaaacuacuccggagcaaacacuuucaauguccacuuagcuccagccguagcaccaaauuucccaggagaacaacuccuuuucuucagaucuacauuacccggaugcggaggucacccgaauauggacuuagacuguuuacuaccacaagaauggguacaacauuuuuaccaagaagcagcuccugcacaaucagauguugcacuccuuagauuuguaaauccagacacaaguagaguauuauuugaauguaaauuacacaaauccggauacguuacgguagcucauacuggacaauacgacuuaguacuuccauccaacggauacuucagauuugauucauggguaaaucaauucuauacucucgcaccaaugggaaauggaacuggacgcagaagauaa

SEQ ID NO: 34786 - RNA, 1614 nt, Artificial Sequence
  derived and/or modified sequence opt6 from VP1__Norovirus_and/or_Norovirus-like__KX514180
augaaaauggcaagcucagaugcuaacccaucagacggaucagcagcuaacuuaguaccagaaguuaacaaugaaguaauggcccuagaaccaguaguaggugcagcaauagcagcaccaguagccggucaacaaaauguaauagacccauggauaagaaauaauuuuauucaagcuccuggaggagaauuuacaguuucacccagaaacgcaccaggagaaauacucugguccgcaccauuagguccagaucuaaauccauauuuaucccauuuagcaagaauguauaauggauacgcaggcggauuugaaguacaaguaauccuugcaggaaaugcauucacagcaggaaaaauaauauucgcugcaguaccaccaaccuuuccaacagaaggauuaucaccaucacaaguaacaauguucccacacauaauaguagauguacgucaacuagaacccguucucauaccauuaccagauguaagaaauaacuucuaucacuacaaucaaagcaaugauucaacaauuaaacuaauagcaauguuauauacaccccuaagagccaauaaucccggugaugacgucuuuacuguuucuuguagaguacuaacaagaccaucccccgacuucgauuuuauauuuuuaguaccuccaacaguagaaaguagaaccaaaccauucucaguuccuauauuaacagucggagaaaugacaaauuccagauuccccauuaaccuugaaagauuauucacaggcccaucuagcgcaaacguaguacaaccacaaaauggacgaugcacaauagacggcgaacuauuaggaacaacacaacuaucaucaguaaauauaugcacauucagaggagauguuacacaaauugguagcacccaacacuggacuaugaaucuagcuucaccaaacuggaacaauuacgacccaacagaagaaacaccagccccacucggaacaccagacuuuguaggaaaaauacacggaauguuaacacaaacuacacaagaaaacggcagcacaagagcacauagagccacaguauacguugguuccgcaaacuucacaccaaaacucggaaaaguucaauucgaaacagauacuggugacgauuuagcaauaagacaaaauacaaaauuuacuccaguuggcguaauacaaucaucagaccaucacagagacgaaccacaacaauggagauuaccaaacuacucaggagcaaacaccuuuaacguucauuuagccccagcuguagcaccuaauuuuccuggagaacaauuauuauucuuucgaucaacauuaccaggaugcggaggccacccuaauauggacuuagauugucuucuaccacaagaauggguucaacacuuuuaccaagaagcugcuccugcacaaucagacguagcauuauuaagauuugugaacccagauacaucuagaguucucuuugaauguaaauuacacaaaucuggauacguaaccguugcacauacuggacaauaugaucuaguucuaccauccaacggauacuuucgauuugacucuuggguaaaucaauucuacacauuagcaccaaugggaaacggaacugguagacgaagauaa

SEQ ID NO: 34787 - RNA, 1614 nt, Artificial Sequence
  derived and/or modified sequence opt6 from VP1__Norovirus_and/or_Norovirus-like__GU598213
augaaaauggcaucuaaugacgcuaacccaucagacggaaguacagccaacuuaguuccagaaguuaacaacgaaguuauggcccuagaaccaguaguaggagccgcaauagccgcaccagucgcaggacaacaaaacguuauugacucuuggauaagaaauaauuuuguacaagcaccagguggagaauuuacagucuccccaagaaacgcacccggagaaauacuaugguccgcaccacuaggaccugaucuuaaucccuauuuaucacaccuagccagaauguauaauggauaugccggaggauucgaaguacaaguuauccucgccggaaacgcauucacagcuggaaaaauuauauuugcagccguuccaccaaauuuuccaacagaaggauuaucaccaucacaaguaacaauguuuccacauauaauaguagacguacgucaauuagaaccaguauuaauaccuuuaccagauguacgaaauaauuuuuaucauuauaaucaaucaaaugauagcacaauaaaauuaauagcuauguuauauacaccacuacgagcaaacaaugcgggagaugacgucuuuacaguaucaugucgaguauuaacaagacccuccccugauuuugauuuuauuuucuuaguaccaccuaccguagaauccagaacgaaaccauuuacaguccccauuuuaacugucgaagaaaugucaaauucaagauucccaauuccacuagaaaaauuauacacaggaccaucaucugcauucguaguucaaccacaaaauggaagauguacaacagauggaguauuauuaggaacaacacaacucucagcuguaaauauuuguacauucagaggagacguaacacauauagcaggaucccaugauuacacaaugaauuuagcaucacaaaacuggucaaauuaugauccaacugaagaaaucccugcuccacuugguacaccagacuucguagguaaaauucaaggaaugcuaacacaaacaacacgagaagauggaaguacaagagcacacaaagcaacaguaucaacaggaucaguacauuuuacaccaaaacuuggaucaguacaauauacaacagauacaaauaacgacuuccaaaccggacaaaauacgaaauucaccccaguuggaguaauacaagaugguaauaaucaucaaaacgaaccucaacaauggguacuaccuaacuauucaggaagaacaggccacaauguacaccuagcaccagccguagcaccaacauucccaggagaacaacuuuuauuuuucagaucaacuaugccuggaugcuccgguuacccaaauaugaaucuagauugccuucuaccacaagaauggguacaacacuucugccaagaagcagcuccagcacaaucagacgucgcccuucuccgauuuguaaacccagauacagguagaguacuuuuugaaugcaaacuccacaaauccggcuaugucacaguagcacauacagguccacaugauuuaguaauaccuccaaacggauauuuucgauuugauucuuggguuaaucaauucuauacuuuagcuccaaugggaaauggagccggacguagaagauaa

SEQ ID NO: 34788 - RNA, 1614 nt, Artificial Sequence
  derived and/or modified sequence opt6 from VP1__Norovirus_and/or_Norovirus-like__KX514365
augaaaauggcauccucagacgcaaacccaucagauggaucaacagcuaaccuuguaccugaaguaaacaaugaaguaauggcauuagaaccaguaguaggagcagcaauagccgcaccuguagcaggacaacaaaauguaauagacccauggauaagaaauaauuuuguacaagcaccugguggugaauuuacaguauccccaagaaaugcaccaggugaaaucuuauggagugcaccacuaggacccgaucuaaauccauaccuaucucaucuagcacgaauguauaauggauacgcaggaggcuucgaaguacaaguaauauuagccggaaaugcauuuacagcaggaaaaauaaucuucgcugcagucccuccuacauuuccuacagaaggacuaucuccaucacaaguuacaauguuuccucauauaauuguagauguaaggcaauuagaaccaguauuaauacccuuaccugauguacgaaacaauuuuuaucacuauaaccaaucaaaugacucaacaauaaaacuuauagccaugcuauacaccccacuuagagcuaacaacccaggagacgacguauuuaccguaucauguagaguuuuaaccagacccucaccugacuucgauuuuauauuccuaguaccaccuacuguagaaagcagaacuaaaccauuuuccguacccauacuuaccguuggagaaaugacaaauaguagauucccaauaaauuuagaaagacuauucacaggaccaucaucagcuaacguaguacaaccacaaaaugguagaugcaccauagacggagaacuacuaggcacuacacaacuuucuucaguaaacauaugcacauucagaggugacguaacacaaauaagaucaacacaacauuggaccaugaaucuagcuucaccaaauuggaacaauuacgauccaacugaagaaacaccagcuccccuaggaacacccgauuucguaggaaaaauacacggcaugcuaacacaaacaacacaagaaaaugguucaacaagagcacacagagcaacuguauacguaggaucugcaaauuuuacuccaaaacuagggaaaguacaauucgaaacagacaccggagaugaucuagcaauacgacaaaauacaaaauuuacucccguaggaguaauacaauccagcgaucaucaccgagacgaaccacaacaauggagauuaccaaauuacucaggcgcuaacacauucaauguccauuuagccccagcugucgcuccuaauuuccccggagaacaacuacuauucuuuagaucaacacuaccuggaugcgguggacauccaaauauggaucucgacugucucuuaccacaagaauggguacaacacuuuuaucaagaagccgcaccagcacaaucagauguagccuuacuaagauuuguaaacccugauacuucaagaguauuauuugaauguaaauuacacaaaucaggauacgucacaguugcacacacuggacaauaugaccuaguauuaccaucuaacggauacuucagauucgacucauggguaaaucaauuuuauacacuagcucccaugggaaacggaaccggaagaagaagauaa

SEQ ID NO: 34789 - RNA, 1614 nt, Artificial Sequence
  derived and/or modified sequence opt6 from VP1__Norovirus_and/or_Norovirus-like__KX514304
augaaaaugguaucaaaugacgcuaauccaucagacgguucagcagcuaaucuaguucccgaaguaaauaacgaagucauggcacuagaaccuguagucggagcagcaauagcagcaccuguagccggacaacagaacguuauagaucccuggauccgcaacaauuucguacaagccccagguggugaauuuacaguaucaccaagaaacgcacccggugaaauacuauggucagcaccucuaggacccgaucuaaacccuuauuuaucacaucuagcacgaauguauaauggauaugcaggaggguuugaaguacaaguaauacuagcaggaaacgcauucacagcaggaaaaauaaucuuugcagcaguuccaccaacuuucccaacagaaggcuuaucacccagucaagucacaauguuuccacacauaauuguagauguuagacaauuagaacccguacuaauaccauuaccugacgucagaaauaacuucuaucauuauaaucaaucaaacgacuccacuauaaaacuaauagcgaugcuauacacaccauuacgagcaaauaacccaggugaugauguauucaccguaucuugucgaguauuaacaagaccauccccagauuuugacuuuauauuuuuaguaccaccaacagucgaaucaagaacaaaaccauuuucaguaccaauacuaacaguaggcgaaaugacaaacucuagauucccaauaaaccuagaaagacuauuuacaggaccaucaucggcaaauguaguacaaccucagaauggaagaugcacaauagacggagaauuacucggcacuacacaacuaucaucaguuaacauuuguaccuucagaggcgauguaacacaaauaggcucaaccaaacauuggacaaugaauuuagcaucuccaaacuggaauaacuaugauccuacagaagaaacuccagcaccauugggcacacccgacuuuguagguaaaauccauggaauguuaacacaaaccacacaagaaaauggaucaacaagagcacacagagcuacaguuuacguaggcggagcaaauuucacaccaaaauuaggaaaaguacaauucgaaacagauacaggcgacgaccuagcuauacgacaaaauacaaaauucaccccaguaggaguaauccaaucaucagaucaucauagagacgaaccucaacaauggcgacuucccaacuauuccggagcaaacacuuucaauguucaucucgcuccagcaguagcuccaaauuuuccuggugaacaauuauuauucuuuagaucaacacugcccggauguggaggacacccaaauauggaccucgauugcuuauuaccucaagaauggguacaacacuuuuaccaagaagccgcucccgcacaaucugacguagcauuacuaagauuuguaaacccagauaccucaagaguauuauuugaauguaaauuacacaaaucagguuauguaacaguagcacauacaggacaauacgacuuaguacuuccuucaaauggauacuuuagauucgauucauggguaaaucaauuuuacacacucgcaccaaugggaaaugguaccggacgaagacgauaa

SEQ ID NO: 34790 - RNA, 1614 nt, Artificial Sequence
  derived and/or modified sequence opt6 from VP1__Norovirus_and/or_Norovirus-like__KX514302
augaaaauggcuucaagugacgcaaauccaagcgauggaucagcagcaaauuuaguaccagaaguaaauaaugaagucauggcucucgaaccaguaguaggagcagcuauugcagcaccaguggcaggacaacaaaauguaauagauccauggauaagaaauaauuuuguacaagcaccuggaggcgaguucacaguaagccccagaaaugccccaggugaaauauuauggucagcaccuuuaggcccagaucuaaauccauaucuaucacacuuggcaagaauguauaacgguuaugcaggaggauucgaaguacaaguaauauuagcaggaaacgcauuuaccgcuggcaaaauuauuuuugcagcaguaccaccaacauuuccaacugaaggauuaucaccaucacaaguaacuauguucccccauauuauaguggauguaagacaauuagaaccuguauuaauaccguuaccagacguacgaaauaauuuuuaucacuacaaucaauccaaugacucaacuauaaaacuuauugcaauguuauauaccccacuuagagccaauaauccaggagacgacguauuuacaguaagcuguagaguacuaacuagacccucaccagacuucgauuuuaucuuucuaguaccaccuaccguugaaaguagaacaaaacccuuuucuguacccaucuuaacaguaggagaaaugacuaauaguagauuuccuauuaauuuagaacgacucuucacaggccccucauccgcuaacguuguacaaccacaaaauggaagauguacaauagauggagaauuacuaggcaccacucaacuaucuucagucaacauauguaccuuuagaggagauguaacacaaauuggaucaacacaacacuggacaaugaauuuagcuucaccaaauuggaauaauuaugauccuacugaagaaacaccagcaccauuaggaacuccagauuucgucgguaaaauacacggaauguuaacacaaacaacacaagaaaacggaucaacuagagcacauagagcaaccguauaugucggaggagcuaacuuuacacccaaauuaggacgcguacaauuugaaacugacacuacagacgauuuagaugcacaucaaaacacaaaauuuaccccaguugggguaauacaaucauccgaccaccacagagacgaaccucaacaauggcgacucccaaauuacuccggagcaaauaccuucaauguccauuuagccccagcaguagcaccaaacuucccaggagaacaacucuuauucuuccgauccacuuuaccuggcuguggaggacauccuaauauggauuuagauugcuuauuaccacaagaauggguccaacacuucuaucaagaagcagcaccagcacaaucugacguagcucuuuuaagauucguaaauccagacacaucuagaguucuauuugaaugcaaacuacauaaaaguggauacguaacuguagcacauaccggccaauaugaucuaguauuacccuccaacgguuauuucagauuugauucuuggguaaaucaauucuauacacuagcaccaaugggaaauggaacaggaagaagaagauaa

SEQ ID NO: 34791 - RNA, 1614 nt, Artificial Sequence
  derived and/or modified sequence opt6 from VP1__Norovirus_and/or_Norovirus-like__KX514207
augaaaauggcaucaucagacgcaaauccuucagauggaucugcugcaaaccuaguaccagaaguaaacaaugaaguuauggccuuagaaccaguuguaggagcagcuauaacagcaccaguagcaggacaacaaaaugucauugacccauggauaagaaauaacuuuguacaagccccaggaggagaauuuacaguuucaccaagaaaugcaccuggagaaauacuauggucagcaccacucggucccgacuuaaauccauaucuaucacacuuagcaagaauguacaaugguuaugcaggaggauucgaaguucaagucauucuagcaggaaacgcauuuacagcagguaaaauaauuuuugcugcuguaccaccaacauuuccaacugaaggauuaucucccucacaaguuacaauguuuccucacauaauaguagacguaagacaacuagaaccagucuuaauaccacuaccagacguuagaaauaacuuuuaucacuauaaccaaucuaacgauucaacaauaaaacugauagcuauguuauauacaccacuacgagccaauaauccaggagaugauguauucacagucucaugcagaguauuaacacguccaucuccugauuuugauuuuauauuccuagucccaccaacaguagaaucacgaaccaagccuuuuucuguaccuauauuaacaguaggcgaaaugacuaacucaagauuuccaauuaaucuagaacgucuuuucacaggaccaucaucagcuaacguaguacaaccacaaaauggaagauguacaauagauggagaauuacuagguacuacccaauuauccucaguaaauauauguacauuuagaggggacguuacacauauagguuccacacaucacuggaccaugaauuuaguaucuccaaacuggaauaauuacgauccaacagaggaaacuccugcaccacuuggcacaccagacuuuguaggaaaaauacauggaaugcuuacacaaacaacgcaaggauccgguucaacaagggcacacagagccacaguauauguuggaucagcagaauuuacuccaaaauuaggaaaaguacaauuuaaaaccgaaaccgaccaugaucuaucaauaagacaaaacacaaaauuuacucccguaggaguaauucaagaaucagaucaccaucgugaugaaccacaacaauggagacuaccaaacuauucaggagcuaaugcauuuaauguacaccuagcaccagcaguagccccuaauuuuccuggugaacaauuauuauucuucagaucuacacuacccggauguggaggacauccgaauauggacuuagacugccuacuaccacaagaauggguacaacacuuuuaucaagaagcagcuccagcacaauccgauguugcucuauuaagauuuguuaacccagauacaucaagaguauuauuugaaugcaaauuacauaaauccggauacgucacugucgcacacacaggccaguaugauuuagucuuaccaucaaacggauacuuuagauuugacuccuggguaaaucaauuuuauacacucgcaccaaugggcaaugguacuggaagaagaagauaa

SEQ ID NO: 34792 - RNA, 1614 nt, Artificial Sequence
  derived and/or modified sequence opt6 from VP1__Norovirus_and/or_Norovirus-like__KX514192
augaaaauggcaucaagugaugcaaauccaucugauggauccgcggcaaaucuuguaccugaaguuaacaaugaaguaauggcauuagaaccaguaguuggugcagcaauagccgcaccaguagcaggacaacaaaauguaauagauccauggauaagaaauaauuuuguacaagcaccuggaggagaauuuaccgucucaccuagaaaugcaccuggcgaaauucuuuggucagcaccauuaggcccagauuuaaacccuuauuuaucucaucuagcuagaauguauaacggauacgcaggagguuucgaaguacaaguaauauuagcaggaaacgccuuuacugccggaaaaauaauauucgcugcaguaccaccaacuuuuccaacagaaggauuauccccaagccaaguaacaauguucccacauauaaucgucgauguucgacaacuagaaccaguacucauaccacucccggauguaagaaacaacuuuuaccauuauaaucaaucaaacgauucaaccauaaaacuaauagcuaugcuauacacuccacuaagagcaaauaauccuggcgaugauguauuuacaguaucauguagaguacuaacuagaccaaguccagauuuugauuuuauauucuuaguaccaccaacaguagaaucuagaacuaaaccauuuucaguuccaauauuaacaguaggcgaaaugacaaacucaagauuuccuguuaaccuagaacgauuauuuaccggaccaagcucagccaacgucguccaaccacaaaaugguagaugcacaauagauggugaauuauuagguacuacacaauuaucaucaguaaauauauguacauuuagaggagacguaacacauaucggagcuaccagacauuggacaaugaauuuagcaagccccaauuggaauaauuaugacccaaccgaagaaacuccagcacccuuaggaacgccugacuuuguaggaaaaauucacggcaugcucacacaaacaacccaaggcucagguucaacaagagcccauagagcaacaguauauguuggaucagccgaguuuacaccaaaauugggcaaaguuagauucgaaacagacacagaagaugaucuggucaucagacaaaauacaaaauucacucccgucgguguaauucaauccucagaacaucacagagaugaaccccaacaauggagacuaccuaauuacucuggcgcaaauacuuuuaauguacaccuagcucccgcaguugcaccaaauuuuccaggagaacaauuauuauucuuucgauccacauuaccaggauguggcggacaccccaacauggacuuagacugcuuauuaccucaagaauggguucaacauuuuuaucaagaagcugcaccagcacaaucagauguugcuuuacuaagauuuguuaauccagauacaucaagaguccuauuugaauguaaauuacauaaaucaggauauguaacuguugcacauacaggacaauaugauuuaguauuaccuucaaauggauacuucagauuugauucaugggucaaucaauuuuauacacuagcacccaugggaaauggaacaggaagaagaagauaa

SEQ ID NO: 34793 - RNA, 1614 nt, Artificial Sequence
  derived and/or modified sequence opt6 from VP1__Norovirus_and/or_Norovirus-like__KF806525
augaaaauggcaucuaaugaugcuucuccaucagacgguuccgcagcuaacuuaguuccagaaguaaauaaugaaguaauggcacuagaaccaguaguaggcgcugcaauagcagcucccguagcaggucaacaaaacguuauagauccauggauacgaaauaacuuuguacaagcaccaggaggugaauuuacaguauccccaagaaaugcuccaggagaaauauuauggucugcaccauuaggaccagaccuuaauccuuaucuaucucaccuagcacgaauguauaacggauaugcuggaggauucgaaguccaagucauucuagcuggaaaugcauuuacagcaggcaaaauaauauuugcugcaguaccaccaaauuuuccaacagaaggucuuucuccaucacaaguuacaauguuuccccacauaguaguagauguaagacaacucgaaccgguacuuauaccauuaccagauguaagaaacaauuuuuaucauuacaaucaaucuaaagacccuacaauuaaacuuauagccaugcuauauacaccauuaagagccaacaaugcuggagaagaugucuuuacaguaucaugucguguacuaacaagaccaucuccagauuucgauuucauauucuuaguaccaccaacaguagaaucacgauccaaaccauuuacaguaccaauacuaacugucgaagaaaugacuuauucacgauuuccaauaccccucgaaaaauuauucacaggcccaucuucagcauucguaguacaaccacaaaaugguagauguacaacagacggcguacuacuagguacuacccaacuuucaccuguuaacaucuguacauuucgaggagauuuaacacauuuugcaggaacuucagaauacgcaaugaaccucgcaucccaaaacuggacaaauuaugacccaaccgaagaaauuccagcaccccuaggagcaccagacuucguuggaaaaauaagaggaguacucacacaaacaacuagaggagaugguucuaccaggggucauagagccacccuaucuaccggaucagcccacuucacaccaaaacuagguaguguacgcuuuuccacagauacuaauaaugauuuugaagcaggacaaaauacaaaauuuacaccaguaggaguuuuccaagauggagauaaucaucaaaaugaaccacaacaauggguauuaccaaauuacaguggagcaacagcucacaauguucauuuagccccagcaguagcuccugcauucccuggagaacaauuacuauucuuucgaucaacaaugcccggauguucaggauacccaaauaugaauuuagauuguuuauuaccacaagaauggguacaacacuuuuaucaagaagcagcgcccgcacaaucugacguagcccuauugagauuuguaaauccagauacuuccagagucuuauucgaauguaaacuccauaaaucaggauacgucacaguugcucauacaggacaacacgauuuagucauuccaccaaacgguuauuucagguucgauucauggguaaaccaauucuauacauuagcaccuaugggaaauggaacuggucgaagacgauaa

SEQ ID NO: 34794 - RNA, 1614 nt, Artificial Sequence
  derived and/or modified sequence opt6 from VP1__Norovirus_and/or_Norovirus-like__KC462195
augaaaauggcuucaaacgacacaauaccuucagauggcuccacagcaaaucuaguacccgaaguaaacaaugaaguaauggcauuagaaccaguaguaggagcugcuauagcagcuccgguagcaggacaacaaaacguaauagacccauggauacgaaacaauuuuguacaagcaccaggcggugaauuuacugugucaccaagaaaugcaccuggagaaauacuauggucaaugccuuuaucaccagauuuaaauccauauuuaucccaccuuagcagaauguauaacggauacgcaggcggcuucgaaguacaaguaauauuagccggaaaugcuuuuacugcuggaaaaauaauauuugcagcaauaccaccaaauuucccaacagacggucucuccccaucacaaguaacaauguuuccucacauaaucgucgacguuagacaacuagaaccaguucucauaccacuacccgacguccguaauaauuucuaucacuacaaccaaguaaacgacuccaccuuaaaauuaauagcaaugcuauauacgccccuuagagcuaauaaugcuggagacgauguauuuacaguaucauguagaguucuuacucgaccaucaccugauuuugacuuuauauuuuuaguaccaccaacaguugaaucaagaaccaaaccauuuacaguaccaauucucacaguagaugaaaugacuaauagcagauucccuacuccauuagaaagacuacauacagguccaaauaauucucuaguaguccaaccucaaaauggucgauguacuauugaugguguucuguuaggaacaacacaauuaucagcaguaaauauauguucuuuccgaggagacaguacaacccgagaaggucaaucucacgcuuauacaaugaauuuagcaucacaaaauuggacuaauuaugacccaacagaagauauaccagcaccacucggaacaccugauuuuguaggaaaaauaguagguauguuaucacaaaccacaagagaaaacucaucaacacgagcacacaaagcaacaguuucaacaggagaugcacauuucaugccaaaacuaggaucaguauuauucacuacagacacagaagaucuacaaaacggacaaaauacaagauuuacuccaguaggaguagcacaagauggagaaccucaccaaaaugaaccacaacaauggcgacuaccaaacuauucaggaacuccaggacauaauguccacuuagcaccaccagucgccccaaccuuuccaggggaacaacuacuguucuuuagaaguacuaugccuggaugcggagguuauccaaauauggaccuugacugcuuacuaccucaagaauggguaagacauuuuuaucaagaagcagcacccgcacaaucugacguugcuuuauuaagauuuguaaauccagauaccggcagaguauuauucgaauguaaauuacacaaagcaggauacauaacaguuucccauacaggcccauacgacuuaguaauuccaccaaaugguuauuucagauuugacucauggguaaaucaauuuuacgcacuagcuccaauggguaccggaacaggacgaagaagauaa

SEQ ID NO: 34795 - RNA, 1614 nt, Artificial Sequence
  derived and/or modified sequence opt6 from VP1__Norovirus_and/or_Norovirus-like__AF427116
augaaaauggcaucaaaugacgcaaacccaucagacgguucaacugcuaaucuuguaccagaaguuaacaacgaaguaauggcacuagaaccagucguaggagcggcaauagcagcaccaguagcaggacaacaaaauguaauagacccauggauacgaaauaauuucguacaagcccccggaggagaauuuacaguaucaccacgaaaugcaccuggagaaauacucuggucugcaccacucggaccagaccuaaauccauacuuaucucaccuagcuagaauguauaacgguuaugcuggcggcuuugaaguucaaguaauacuagccggcaaugccuuuacagcaggaaaaauaauuuuugcugcaguacccccaaacuuuccaacugaaggacucucaccaagucaaguaacgauguucccucacauaauaguagauguaagacaacucgaaccuguacuaauuccuuuaccagacguaagaaacaauuuuuaccauuacaaccaaucaaaugauucaacuauaaaauuaauagcuaugcuauauacuccacucagagcaaacaaugcuggcgacgacguauuuacuguuuccugcagaguucuaacuagaccaucaccagauuucgauuuuauauuucuaguuccaccaacagucgaaucuagaacaaaacccuuuacaauaccaauuuuaacaguugaagaaauguccaauucacgcuuuccaauaccacuugaaaaacuauacacagguccaucaucagcauuuguuguacaaccacaaaauggcagauguaccacagacggaguauuacuaggaacaacccaauuaucugcuguuaauaucuguacauuuagagguaacguaauacacauagcaggaucacaugauuauacuaugaaucuagcaucacaaaauuggaauaauuaugacccaacagaagaaaccccagcaccauuaggaacaagcgacuuuguaggaaaaauccaaggacuacuaacacaaacuacaagagaagacggaucaacaagagcacauaaagcuacagucucaacaggauccguacauuuuacuccaaaauuaggaucaguacaauauacuacagauacaaauaacgacuuccaaacaggacaaaauacaaaauucacuccaguaggaguaauacaagacgguaauaaccaccaaaacgaaccccagcaauggguccuuccaaauuauucaggcagagcaggccacaauguucaucucgcuccugccguagcuccaacauuuccaggugaacagcuacuauuuuuccgcucuacaaugccaggaugcucaggauacccaaacaugaacuuagacugcuuauuaccacaagaauggguacaacauuuuuaccaagaagcugcaccagcacaaucugacguggcuuuacuuagauuuguaaauccagauacagguagaguacuuuucgaauguaaauuacacaaauccggauacguaacaguagcacacacaggaccacaugaccuagucauaccaccaaacgguuauuuuagauuugacucuugggucaaccaauuuuacacccuagcaccaaugggaaacggugcagguagacgaagauag

SEQ ID NO: 34796 - RNA, 1614 nt, Artificial Sequence
  derived and/or modified sequence opt6 from VP1__Norovirus_and/or_Norovirus-like__KX514337
augaaaauggcaucaaaugacgcaaauccaagugauggaucggcugccaauuuaguaccugaaguaaauaaugaaguuauggcacuagaaccaguagucggugcugcaauagcugcaccaguagcaggccaacaaaacguaauugacccauggauacgaaauaauuuuguucaagcaccuggcggcgaauuuacuguaucaccacgaaaugcgccaggagaaauauuauggucugcuccauuaggaccugaucuaaauccuuaucuaucacacuuagcacguauguauaaugguuaugcuggugguuuugaaguacaaguuauacucgcaggaaaugccuuuaccgcugguaaaauaauauuugcugcagucccgccuaacuuuccaacugaaggacuaucaccaucacaaguaacaauguuuccacauauaauaguagauguaagacaauuagaaccaguuuuaauaccacugccagacguacgaaauaacuucuaccauuauaaucaaucuaaugauagcacaauaaaacuuauagcuaugcuauauacaccauuaagagcaaacaaugccggcgacgauguauuuacaguaucauguagaguauuaacaagaccaucaccugauuuugauuucaucuuucuaguuccaccaacaguagaaagucgcacuaaaccauucucuguaccaauacuaacaguaggugaaaugacuaauucucgcuucccaguaaacuuagaaagacuauucacaggaccaucauccgcaaauguaguucaaccacaaaauggacgauguacuauagauggagaacuuuugggaacaacacaauuaagcucuguaaauauuuguacauuuagaggagauguuacacaaauaggcgcaaccagacauuggacaaugaauuuagcaucuccuaauuggaauaauuaugauccaacagaagaaacaccagcuccauuaggaacucccgauuucgucgguaaaguucacggaaugcuaacacaaacuacucaaggaucaggaucaacaagagcacauagagcaacaguauacguaggaggagcugaauuuacaccuaaacuagguaaaguccgauucgaaacagauacagaagaugaucuaguaauuagacaaaauacaaaauuuacacccguaggagucauacaaucaucagaacaccaucgagaugaaccucaacaauggcgccucccaaauuauucaggcgcaaacacauuuaacguucaccuagcuccugcaguagcaccaaacuuccccggagaacaauuacuauucuuucgaucaacacuaccugguugcggaggacacccaaauauggauuuagacugucuauuaccacaagaauggguacaacauuuuuaucaagaagcagccccugcacaaucugauguagcacuuuuaagauuuguuaauccagauacaagcagaguacuauuugaguguaaauuacauaaaagcggauacguaacaguagcucacacaggacaacacgauuuaguaauacccccaaauggcuauuuuagauuugacagcuggguuaaccaauuuuauacauuagcaccaaugggaaauggcacuggaagaaaaagauaa

SEQ ID NO: 34797 - RNA, 1614 nt, Artificial Sequence
  derived and/or modified sequence opt6 from VP1__Norovirus_and/or_Norovirus-like__KX514255
augaaaauggcauccucugacgcaaacccuagugauggaucaacugcaaaccuagucccugaagucaauaaugaaguuauggcauuagaaccaguaguaggugcagcuauagcagcaccuguagcaggacaacaaaauguaauagacccauggauaagaaauaacuuuguacaagcaccagggggagaauuuaccguaucacccagaaaugcaccaggagaaauauuauggucagcaccauuaggcccugaucuaaauccuuacuuaucacacuuagcaagaauguacaacggauaugcuggaggauucgaaguccaaguaauccuagcaggcaaugcauucacugcaggaaaaauuauauucgcagcaguaccaccaacauucccaacugaaggauuauccccaucacaaguaacaauguucccacacauaauagucgauguaagacaacuagaaccaguacuaauaccauuaccagacgucagaaacaauuuuuaccauuacaaccaaagcaaugacaguacaauaaaacuuauagcaaugcuauacaccccauuacgagcaaacaauccaggagacgacguauucacagucucaugcagaguccuaacaagaccaucuccagauuucgauuuuaucuuccucgucccuccaacaguagaaucaagaacaaaaccauuuucaguacccauacuuacaguaggugaaaugacaaauucccgauuuccaauaaauuuagaaagacuauuuacaggaccaaguuccgccaacguaguacaaccacaaaacggaagaugcacaauagauggugaacuacucggaacaacacaauuaaguucaguaaauauaugcacauuuagaggagacguaacacauaucgguucaacccaucacuggacaaugaauuuagcaucuccaaacuggaauaauuaugacccaacagaagaaacaccagcaccacuaggcacaccagauuucguaggaaaaauccacggaaugcuaacacaaacaacccaagaaaaugguaguacaagagcccacagagcaacuguauacguagguucagcagauuuuacacccaaauuaggaaaaguacaauucgaaacugaaacagacuaugauuuagccaucagacaaaauaccaaauuuacaccaguagguguuauccaagaaucagaccaucacagagacgaaccacaacaauggagauuacccaauuacucaggagcaaauaccuucaauguucauuuagcacccgcaguugccccaaacuucccaggcgaacaauuauuauuuuuccgauccacauuaccaggauguggaggacacccaaacauggaccuagauugucucuuaccacaagaauggguacaacauuucuaucaagaagcagcccccgcacaaucagauguagcucuauuacguuucguaaacccagacacauccagaguacuuuuugaaugcaaacuacacaaguccggauacguuacuguagcucauacaggacaauaugaucuaguacuccccucuaacggauauuucagauucgauuccugggucaaucaauucuacacacuagcacccaugggcaauggcacaggaagacgaagauaa

SEQ ID NO: 34798 - RNA, 1614 nt, Artificial Sequence
  derived and/or modified sequence opt6 from VP1__Norovirus_and/or_Norovirus-like__KX514210
augaaaauggccuccucagacgcuaacccuagcgacggaucugcugcaaauuuaguaccagaaguuaauaacgaaguuauggccuuagaaccagucguaggagcugcaauugcagcuccaguagcaggucaacaaaacguaauagauccauggauaagaaacaauuuuguacaagccccagguggugaauuuacaguaucaccccgaaaugccccaggagaaauauuauggucagcaccccuagguccagacuuaaauccauaucuaucacaccuagcuagaauguauaaugguuacgccggaggauucgaaguacaaguaauauuagcaggaaaugcauucacagcagguaaaaucaucuucgcagcgguaccaccaacauucccaacagaaggacuaaguccaagccaaguaacuauguuuccacauauaauugucgaugucaggcaacucgaaccaguauuaauaccacuaccagacguuagaaauaauuuuuaccacuacaaucaauccaacgacucaacuauaaaacuaauugcaaugcuauauacaccccuaagagcaaauaacccaggugaugauguauucacuguaucaugccgaguacuaacaagaccaucuccagauuuugauuucauauucuuaguuccuccaacagucgaaucuagaacaaaaccauuuucaguuccaauauuaacuguaggcgaaaugacaaauucccguuucccaguaaauuuagaacgacuauuuacuggcccaucaucagcaaacgucguacaaccacaaaauggaagaugcacuauagauggugaauuauuaggcacuacacaacuuucauccguaaauauuuguacuuuuagaggugacguaacacacauaggaagcacacaucacuggacaaugaaccuugcaucuccaaacuggaacaacuaugaucccacugaagaaacuccugcaccccuaggaacaccagauuucguuggaaaaauacauggaauguuaacacaaaccacccaagguaguggaucaacaagagcacauagagcaacuguauauguaggauccgcagaauuuacuccaaaacucggaaaaguucaauuuaaaacagaaacagaccaugauuuaagcacaagacaaaauacuaaauucacaccgguagguguaauacaagaaucagaucaucaccgugacgaaccacaacaauggagacuaccaaauuauuccggagcaaauacauucaacguacaucuagccccagccguagcaccaaacuuuccuggugaacaauuauuauucuuuagaucaaccuuaccagguugcggaggacacccuaauauggauuuagacugccuacucccacaagaauggguacaacauuuuuaucaagaagcagcaccagcucaaucugauguagcauuacuaagauucguaaacccugacacaucaagaguauuauuugaauguaaauuacauaaaucaggcuaugucacuguagcccacacaggacaauacgaucugguuuuaccaucaaacggauauuuuagauucgauagcuggguuaaccaauuuuacacacuagcaccaaugggaaauggaacuggaagaagaagauaa

SEQ ID NO: 34799 - RNA, 1614 nt, Artificial Sequence
  derived and/or modified sequence opt6 from VP1__Norovirus_and/or_Norovirus-like__KX514182
augaaaauggcaucaucagacgccaauccaucagaugguucugcagcaaaccuaguaccagaaguuaauaacgaaguaauggcacuagaaccagucguuggagcagcaauugcugcaccugucgcuggucaacaaaacguaauugauccauggauaagaaauaacuucguacaagccccaggaggagaauuuacaguuaguccacgaaaugcaccaggagaaaucuuaugguccgcaccucuaggacccgacuuaaauccauaucuuucacaccuagcaagaauguauaauggauacgcuggaggcuuugaaguacaaguaauauuagcaggaaaugccuuuacagcaggaaaaauaauauuugcagcuguuccaccaacuuuuccaacagaaggucuaucuccuucacaaguaacaauguuuccucauaucauaguagauguucgacaacuagaaccuguacugauaccuuuaccagauguaagaaauaauuuuuaucauuacaaucaaucaaaugauucaaccauaaaacuaauagcaauguuauacacucccuuaagagcaaauaauccaggagaugauguauuuaccguuuccugccgaguccucacuagaccaucaccagacuucgauuuuauauuucuagugcccccaacaguugaaucuagaaccaaaccauuuucaguuccaauucuaacaguaggugaaaugacaaacagccgcuuuccagucaaccuagaacgauuauuuacuggacccucuucagcaaauguaguccaaccacaaaauggacgcugcacaauagauggcgaacuucuuggaacgacacaacuaucuucaguaaauauauguaccuuuagaggagaugucacacauauaggaacuacacaacacuggacaaugaauuuagcuucucccaacuggaauaacuacgauccuacagaagaaaccccagcaccacuaggaacuccagauuucguagguaaaauacacggaauguuaacacaaacaacacaaggcucaggcucaacaagagcacauagagcaacaguguauguaggaucugccgaauuuacaccuaaacuaggaaaaguaagauuugaaacagacaccgaagaugacuuaguaauacgucaaaacacaaaauucacaccaguagguguuauacaauccucugaacaucaucgagaugaaccacaacaauggagacuaccaaauuauucaggagcaaauacuuuuaacguacaucuagcuccagcaguagcuccaaauuuuccuggugaacaauuauuauucuuuagaucuaccuuaccaggauguggaggacauccuaauauggaucuagauugcuuacuaccccaagaauggguccaacauuuuuaucaagaagccgcaccagcacaaucagaugucgcccucuuacgcuucguaaauccagacacaucuagaguacuauuugaauguaaacuucauaaaagcggauacguuacaguagcacauacaggccaauacgaucucguauuaccuucaaauggauauuuuagauuugauucauggguaaaucaauuuuauacacuagcuccaauggguaauggaacuggacgaaaaagauaa

SEQ ID NO: 34800 - RNA, 1614 nt, Artificial Sequence
  derived and/or modified sequence opt6 from VP1__Norovirus_and/or_Norovirus-like__AF425764
augaaaauggcaucuaaugaugcaaaccccucagauggaagcacagcaaacuuaguuccagaagucaauaaugaaguaauggcauuagaaccagucguaggcgcagccaucgccgcaccaguagcaggacaacaaaauguaauagauccauggauuagaaacaauuucgugcaagcuccaggaggagguuucacaguaucaccaagaaacgcaccaggagaaauacuauggucagcuccacuagguccagaccuuaauccauacuuaagccacuuagcccgaauguauaauggauacgcuggcggcuucgaaguacaaguaauacuagcagguagcgcuucaacagcaggaaaaaucauauuugcagcaguaccaccaaacuucccaacugaaggauuaucaccuucacaagucacaauguuuccacacaucauaguagaugucagacaauuagaacccguacugauuccacuaccagacguacgaaauaauuuuuaccauuacaaccaaucuaaugauucuacuauaaaauuaauagcuaugcuuuacacuccacuuagagcaaacaacgccggugacgauguauuuacagucucaugucguguacuaacaagaccuucaccagacuuugauuuuauauuuuuagucccacccacagucgaaucuagaacaaaaccauuuaccguaccaaucuuaacugucgaagaaauguccaauucaagauuucccaucccacuagaaaaacuauauacaggaccuagcucagcauucguaguacaaccucaaaauggaagauguacaaccgacggaguacuauuaggcacaacacaacuaucagcaguaaauauauguacauucagaggcgaugucacacauauagcaggaucacacgauuauaccaugaacuuagcaucucaaaacuggaauaacuacgacccaacagaagaaauaccagcaccacuagguacaccagacuucgucggaaaaauucaaggaauguuaacacaaaccacaagagaagacgguucuacaagagcucacaaagcgacaguaucuacaggaucaguacauuuuacaccaaaacucggaucaguacaauauaccaccgauaccaauaacgauuuccaaacaggacaaaauacaaaauuuacacccguagguguaauacaagacggaaacaaccaucaaaacgaaccacaacaauggguauuaccaaacuacucuggcagaacaggacauaauguacacuuagcacccgcaguugcacccacauuuccaggagaacaauuacuauuuuuccgaucaaccaugcccggauguucaggauacccaaauaugaaccuugauuguuuacucccacaagaauggguacaacacuuuuaucaagaagcagccccugcacaaucggacguagcacuacuaagauucguaaauccagauacaggucgaguacucuuugaaugcaaacuucauaaaucaggcuauguaaccguagcacacacaggaccacacgaccuaguaauaccaccaaacggauauuuucgauucgacaguuggguuaaucaauucuauacacuugccccaauggguaauggagcagguagaagaagauaa

SEQ ID NO: 34801 - RNA, 1614 nt, Artificial Sequence
  derived and/or modified sequence opt6 from VP1__Norovirus_and/or_Norovirus-like__KX514355
augaaaauggcaucaucugacgcuaaucccucagacgguucuaccgcuaaccuaguuccagaaguuaauaaugaagucauggcauuagaaccaguagucggugcagcaauagcugccccaguagccggacaacaaaauguaauugacccauggaucagaaauaauuuuguccaagcaccaggcggugaauuuaccguuuccccaagaaaugcaccaggagaaauacuuuggagugcgccacuaggaccugaucuaaauccauaccucucacauuuagcaagaauguacaauggauaugccgguggauucgaaguacaaguaauauuagcaggaaacgcauucacugcaggaaaaauaauauucgcagcaguaccaccaacauucccaacagaaggcuuaagcccaucccaaguaaccauguucccacauauuauaguagauguaagacaauuagaaccaguauuaauuccuuuaccagauguaagaaacaacuucuaucacuacaaucaaucaaacgacucuacaauuaaacuuauagcaauguuauauacaccccuaagagcuaacaauccuggagacgauguauucaccguaucuugcagaguacuuaccagaccauccccagacuuugacuuuauauuucuaguaccaccaacaguagaaagucgaacaaaaccuuucucaguaccaaucuuaacuguaggagaaaugacaaacucaagauuuccaauaaauuuagaacgacuauuuacuggcccauccucagcaaaugucguacaaccacaaaacggaagauguacaauagauggcgaacuacuaggaacuacucaauuaucaucagucaauaucugcacauucagaggcgacguuacacaaauaggcucaacccaacacuggacaaugaaucuagcaucaccaaacuggaauaauuacgauccuaccgaagaaacaccagcuccacuaggaacaccagacuucguaggcaaaauacauggaauguuaacccaaacaacacaagaaaauggcucuacuagagcacacagagcaacaguauacguuggaggugcuaacuucaccccaaaauuagguaaaguacaauucgaaacagauacuucugacgacuuagcaauaagacaaaauaccaaauuuacuccuguaggaguaauucaaucuucagaucaucaucgcgaugaaccucagcaauggagacuaccaaacuacucaggagcaaauacuuucaauguccaucuagcaccagcaguagcuccaaacuuccccggagaacaacuccuauuuuucagaucuacacuuccaggaugugguggacauccaaacauggauuuagauuguuuacuaccacaagaauggguucaacacuuuuaccaagaagcugccccagcacaauccgauguagccuuauuaagauucguaaauccagauacaucuagaguauuauucgaauguaaacuucacaaaucuggauacguaacuguagcacauacuggacaauacgaccuuguacuaccauccaacgguuacuuuagauucgacucauggguuaaucaauuuuacacccucgccccaaugggcaauggaacaggcagaagacgauaa

SEQ ID NO: 34802 - RNA, 1614 nt, Artificial Sequence
  derived and/or modified sequence opt6 from VP1__Norovirus_and/or_Norovirus-like__KX514345
augaaaauggcaucaaaugaugcaaauccaucugacggaucagcagcaaauuuaguaccagagguaaauaacgaagucauggcauuagaaccuguuguaggugcagcaauagcggcacccguugcuggacaacaaaauguaauagauccauggauuagaaauaauuuuguacaagcaccaggaggagaauuuacaguaucuccacgaaaugccccaggcgaaauauuaugguccgcaccacuuggaccagaucugaauccauauuuaucacauuuagcucgaauguacaaugguuaugcaggaggcuuugaaguacaagucauccuagcagguaaugcauucacagcagguaaaauaauauucgcagcaguacccccaaauuuuccaacugagggauuauccccaucacaaguaacaauguuuccacauauaauuguagacguaagacaauuggaacccguuuuaauaccuuuaccagauguccgaaauaauuucuaucauuacaaucaaucaaacgauaguacaauaaaauuaauagcaauguuauauacaccauuacgagcaaauaaugcuggugaugauguuuucaccguaucauguagaguacucacacgucccucaccagacuuugauuucauauuucuaguaccaccaacaguugaaucuagaucaaaaccauucucaguaccaguauuaacaguugaagaaaugacaaauuccagauuuccaguaaaccuagaacgacuauuuacaggcccuucuucugccaauguaguccaaccacaaaacggucguugcacaauagauggagaguuauuaggaacaacacaguuaucaagcguaaauauauguacauuuagaggugauguaacucaaauaggagcaacuagacauuggacaaugaaucuagcaucacucaacuggaauaauuaugacccaaccgaagaaacuccagcaccccuaggaacaccagauuuuguuggcaaaauucauggaauguuaacacagacaacccaagguucagguucuacaagagcacaucgagcaaccguuuauguaggcgcagcagaauuuacgccuaagcuaggaaaaguacgauuugaaacagacacugaagaugacuuaguuauccgucaaaacacaaaauuuacaccaguaggcguaauucaaucaagcgaacaccacagagacgaaccccaacaguggagguuaccaaacuacucaggagcaaauaccuuuaacguccauuuagccccagcaguugcuccaaauuuucccggagaacaacuucuauucuuuagauccacauuaccagguugcggaggacacccaaauauggaucuagauuguuuauugccucaagaauggguacaacauuuuuaucaagaagcagcaccagcccaaucagauguugcauuacuacgauuuguaaauccagauaccucaagaguacuauuugaauguaaacuacauaaaucaggauauguaacuguagcacauacaggacaauaugauuuaguccucccuucaaauggauauuuuagauuugauaguuggguaaaucaauuuuauacguuagcaccaaugggaaauggaaccggaagaagaagauga

SEQ ID NO: 34803 - RNA, 1614 nt, Artificial Sequence
  derived and/or modified sequence opt6 from VP1__Norovirus_and/or_Norovirus-like__KX514204
augaaaauggcauccucugaugcuaacccuagcgaugguucugcagcuaaccuuguaccagaaguuaauaaugaaguaauggcacuagaaccaguaguaggagcagcaauagcagccccaguagcaggacaacaaaauguaauagauccauggauacgcaacaacuuuguucaagcaccuggcggugaauuuacaguaucaccaagaaaugcaccuggagaaaucuuaugguccgccccucucggaccagaucuaaacccuuauuuaucacauuuagcucgaauguauaacggauaugccggaggauuugaaguacaaguaauacucgcaggaaaugcauuuacagcaggaaaaauaauuuucgccgccguaccaccaacuuuuccuacugaaggauuaucuccaucacaaguaacaauguucccccauauaauaguagacguccgacaauuagaaccaguacuaauuccuuuaccagauguaagaaacaacuuuuaucacuauaaccaaucaaacgacucaacaauuaaauuaauagcuauguuauacacaccacuaagagcaaauaauccaggagacgacguauucacugucucaugcagaguauuaacaagaccuucacccgauuuugacuucauauuucuaguacccccuacaguagaaucaagaaccaaacccuucucaguaccaauacuuaccguaggagaaaugacaaacuccagauucccaauaaaccuugaaagacuauuuacaggccccucaucagcaaauguaguacaaccucaaaauggaagaugcacaauagauggugaacuauuaggaacaacacaacuaucuucaguaaacauauguacauuucgaggugacguuacacauauaggcucaacacaucauuggacuaugaaccuagcaucaccaaacuggaauaacuaugauccaacagaagaaacuccugcaccauuagguacaccagacuuuguugguaaaauacauggaaugcuuacacaaacaacacaaggaucagguuccacaagagcacaucgcgcaacaguauauguaggaggcgcagaauuuaccccaaaacuaggaaaaguccaauuuaaaacagaaacugaucaugauuuaucuauccgacaaaauacaaaauuuacaccaguaggaguuauacaagaaucagaccaccacagggacgaaccacaacaauggagauuaccaaacuacucaggcgcaaacacauucaauguacaccucgcaccagcaguagccccaaauuuccccggagaacaauuacuuuucuuuagaagcacucuaccaggaugugguggacaccccaauauggaucuagauugucuauuaccacaagaauggguacaacauuuuuaccaagaagcagcaccagcccaaagcgacguagcucuacuacgauuuguaaauccugauacaucuagaguucuauucgaauguaaacuucacaaauccgguuacguuacgguagcacauacaggucaguaugaucuaguacucccaucuaauggauacuuuagauuugauucuuggguaaaccaauucuauacucuagcuccaaugggcaacggaacaggucgaagaagauaa

SEQ ID NO: 34804 - RNA, 1614 nt, Artificial Sequence
  derived and/or modified sequence opt6 from VP1__Norovirus_and/or_Norovirus-like__KF712492
augaaaauggcaucaagcgaugcaaauccauccgacgggucuacugcaaauuuaguuccagaagcaaacaacgaaguaauggcccuagaacccguagucggagcagcaauugcagcaccaguagcaggacaacaaaauguaaucgacccauggauaagaaacaacuucguacaagcgccaggaggagaauuuacaguuuccccacgaaaugcacccggcgaaauauuauggucagcuccuuuaggcccagaucuaaauccauaccucucacaucucagucguauguacaacggauacgcaggaggauuugaaguucaaguaauucuugcaggaaacgcauuugcagccggcaaaaucaucuucgcagcaguaccaccaaacuuucccacagaaggacucucaccaucacaaguuacuauguucccccaccuaauaguagauguuagacaauuagaaccagucaugauaccucuaccugacauaagaaauaauuuuuaccauuacaaccaaucaaacgacccaacaauaaaacuaauagcaauguuauauacaccacuaagagccaacaacguuggugaugacguauuuacuguuucaugucgaguccuaacuagacccucacccgacuucgauuuuauauuuuuaguacccccaacagucgaaucaaaaaccaauccauucucaguaccaauauuaacaauagaagaaaugacaaacucacguuucccaauuccauuagaaaaacuauucacagguccauccucugcccuaguaguacaaccccaaaacgguagauguacaacagacggaguacuacuuggcacaacccaacucucuccagucaacauaugcacauuucgaggcgacguuacacauacaacaaaaacccacacauaucaaaugaacuuagcagcacaaaacuggaacucauacgauccaaccgaagaaauaccagcaccucuagguacacccgacuuuguaggcaaaauacaagguguacuaacacaaaccacuaaaggaaacggaagcacucgugcacacaaagcaacuguauauacaggcucagcagaauuuaccccaaaauuaggaagaauccaauuauucacagauacagacaacgaccuagaagcaaaucaaaacacaaaauucaccccagucggaguaauacaagacggagauacccaccaaaacgaaccacaacaauggguacuaccauccuacuccggaagaaacaaucauaacguacaccuagcaccagccguagcaccaacauuccccggagaacaacuauuauuuuucagauccacaaugccagguugcucaggauacccuaauaugaaucuagauugucuacucccacaagaauggguacaauacuucuaccaagaagcugccccagcacaaucagaugucgcauuacuaagauuuguaaauccugauacaggaagaguccuauucgaaugcaaacuacacaaaaguggauacguuaccguagcacacacaggacaucaugaucuauucaucccuccaaacggauauuucagauucgauucauggguuucccccuucuauacauuagcacccaugggaaacggaacuggaagacgcagauaa

SEQ ID NO: 34805 - RNA, 1614 nt, Artificial Sequence
  derived and/or modified sequence opt6 from VP1__Norovirus_and/or_Norovirus-like__DQ078829
augaaaauggcuucaaaugacgccaauccaucagauggaucagcagcaaaucuaguaccagaaguaaauaaugaaguuauggcauuagaacccguaguaggcgccgcaauagccgcaccaguagcaggccaacaaaaugucauagaccccuggauaagaaauaacuuuguccaagcaccuggaggagaauuuaccguauccccaagaaacgcuccaggagaaauauuauggucagccccucuaggaccagaccuuaauccuuacccaucucacuuagcuagaauguauaaugguuaugcaggaggauuugaaguucaaguaauauuagcaggaaaugcuuuuaccgcuggaaaaaucauauuugccgcaguucccccuaacuuuccaaccgaaggacuaucuccaucucaagucacaauguucccucauaucauaguagacguaagacaacucgacccaguauuaaucccaucaccagauguacgaaauaauuuuuaucauuacaaccaaucaaaugauucaacaauuaaacuuauagcuaugcuauauacaccauuacgagcaaacaacgccggugacgauguuuucacaguaucauguagaguucuuacaagaccaaguccggacuuugacuuuauauuccuuguacccccuaccgucgaaucaagaaccaagccauucacaguuccuauacuaacuguagaagaaaugaguaacucuagauucccuauacccuuagaaaaacuauacacagguccaucaucagcauucguaguacaaccucaaaaugguagauguacaacagacggaguacucuuagguacaacccagcuaucagcuguaaauauuugcacauuuagaggagacguaacccauauagcugguucucacgauuauacaaugaaucuagcuucacaaaauuggauaaauuaugauccaacagaagaaauaccagcaccacuaggcacaccagauuuuguuggaaaaauacaaggaaugcuaacacaaacuaccagagaagacggaucaacacgagcacauaaagccacuguaucuaccggauccgugcauuuuacaccaaaauuaggaucaguacaauacacaacagauaccaacaacgauuuucaaacaggacaagauacaaaauuuacaccaguuggagucauacaagacggaaacaaccaccaaaaugaaccacaacaauggguucuuccaaauuacagcggaagaacaggucauaacguacauuuagcaccagcaguagcaccuacuuuuccaggugaacaauuacuauucuuccgaucaacuaugccaggaugcucagguuauccaaauaugaauuuagauuguuuauuaccacaagaauggguacaacacuuuuaucaagaagccgcaccagcacaacccgacguagcccuauuaagauuugucaauccagauacaggaagaguuuuauuugaauguaaacuacacaaaucaggauauguaacaguagcccacacaggcccacaugacuuaguaauaccaccaaacggauauuuuagauucgauucauggguaaaccaauucuauacgcuagcuccaaugggcaacggcgccggccgacgacgauaa

SEQ ID NO: 34806 - RNA, 1614 nt, Artificial Sequence
  derived and/or modified sequence opt6 from VP1__Norovirus_and/or_Norovirus-like__KX514370
augaaaauggcaucaaaugacgccaauccauccgauggaucugcagcaaaucuaguacccgaagucaacaaugaagucauggcucuagaaccaguaguaggcgcagcaauugcagcaccuguagcuggacaacaaaauguaauagacccauggauucgaaacaauuucguacaagcaccaggcggggaauuuacuguuucccccagaaaugcaccuggagaaaucuuauggucagccccacucggaccugauuuaaauccauaucuaucacacuuagcacgaauguauaauggcuaugcaggaggauuugaaguacaaguaauacuagccgguaacgcuuuuacugcaggaaaaauaauuuucgcagcaguaccaccaacauuuccaacugaaggcuuaucaccaagucaaguuacuauguuuccacauauaauaguagacguaagacaacuagaaccaguacuaauaccacuuccagacguccgaaacaacuucuaccacuacaaucaaucaaaugauucuacaauuaaacuaaucgcaaugcuauauacaccauuaagagcaaauaacccgggugaugauguauucacaguaucauguagaguauuaacaagacccucaccagacuuugauuucauauuucuaguaccacccacuguagaaucucgaacuaaaccuuucagcguaccaauacuaacgguaggagaaaugacaaacucucgauuuccaguaaaucuugaaagauuauuuacaggaccaucuucagccaaugucguacaaccacaaaauggacgaugcacaaucgacggugaauuacucgguacaacccaauuaucaucaguuaauauuugcacauuucgaggcgauguaacacaaauuggagcaacccgacauuggacuaugaaucuagcuucaccaaacuggaauaacuacgauccaacagaagaaacuccugcuccauuagggacaccagacuuuguaggaaaaauacauggaauguuaacacaaacaacacaaggaucuggaucaacacgggcacauagagccacuguauauguagguggcgcagaauuuacaccuaaauuagguaaaguaagauucgaaaccgauacagaagacgaucuugucauaagacaaaacacaaaauucacuccaguaggaguaauccaaucuuccgaacaccauagagacgaaccucaacaauggagacuuccaaauuacuccggcgcaaacacauucaacguacacuuagcuccagcuguagcaccaaauuuccccggagaacaauuguuauuuuucagaucaacacuaccagguugcggaggacacccaaauauggauuuggacuguuuacuuccacaagaauggguacaacacuuuuaucaagaagcagcuccugcacaaucagacgucgcacuauuaagauuuguaaauccagauacaucaagaguucuuuuugaauguaaauuacauaaauccggauauguaacaguagcacauacuggacaauaugauuuaguauuaccaucuaacggcuacuuuagauucgacucauggguaaaucaauuuuauacauuagcgccaaugggaaaugguacaggacgacguagauaa

SEQ ID NO: 34807 - RNA, 1614 nt, Artificial Sequence
  derived and/or modified sequence opt6 from VP1__Norovirus_and/or_Norovirus-like__KX514332
augaaaauggcuucaucagacgcaaauccuucugacggaucaacagcaaaucuaguaccagaagucaacaaugaaguaauggcacuagaaccaguaguaggagcagccauugcagcaccuguagccggccaacaaaauguaauagaucccuggauaagaaacaauuuuguacaagcaccaggaggugaguucacagucucaccuagaaacgcaccaggagaaauacuauggucagcaccauuagguccagauuuaaauccauaucuaucucacuuagcccgaauguauaauggauacgccggcggauucgaaguacaaguaauacuugcaggaaaugcauuuacugcuggaaaaauaauauucgcugcaguaccaccaacauuuccaacagaaggacuaucaccaucccaaguuacaauguuuccacauauaauaguugacguacgacaacuagaaccaguacuaauuccauuacccgaugucagaaauaauuucuaccacuauaaccaauccaacgacuccacuauuaaacuaauagcuaugcuauacacacccuuaagagcaaacaauccuggagaugacguauucacaguaucaugccgaguacuaacuagaccuucuccagacuucgacuuuauauuucucguaccaccuacuguagaauccagaacaaaaccauuuucuguaccaauacuuacaguuggagaaaugaccaauucucgauuuccaauaaaucuagaacgacuauucacaggcccaucaucagcuaacguuguacaaccucaaaacggaagauguacaauagacggugaacuccuaggcacaacacaauuaucaucaguaaauauaugcacauuuagaggcgacguuacacaaauaggaucaacaaaacauuggacaaugaauuuagcauccccuaacuggaacaauuacgaucccacagaagaaacaccagcaccuuuagguacaccagacuuuguaggcaaaauacaugguauguuaacacaaacuacccaagaaaauggauccacuagagcacaucgcgcuacuguguacguaggaggagcaaacuuuacacccaaauuaggaaaaguucaauuugaaaccgacacaguagacgacuuagaaauaagacaaaacaccaaauuuacaccaguaggaguaauacaauccucagaucaucauagagacgaaccacaacaauggagacuaccaaauuauucaggcgcaaacaccuucaauguacaccuagcccccgcaguagcuccaaauuucccaggagaacaacuauuauuuuucagaucaacacuaccagguuguggaggucauccaaauauggaucuagacugucuauuaccacaagaauggguacaacacuuuuaucaagaagccgcaccagcccaaucagauguagcccuacuaagauucguaaaccccgauacaucaagaguucuauucgaaugcaaauuacacaaaucuggauacgugacaguugcccauacuggccaauaugaucuaguauuacccucaaacggauacuucagauucgacucauggguaaaccaauucuauacucuugcaccaaugggaaacggaacagguagaagaagauaa

SEQ ID NO: 34808 - RNA, 1614 nt, Artificial Sequence
  derived and/or modified sequence opt6 from VP1__Norovirus_and/or_Norovirus-like__KX514276
augaaaauggcuucaucagaugcuaauccaucagacggcucagcagcaaacuuaguaccagaaguaaacaaugaaguaauggcucuagaaccagucguaggagcugcuauagcagcuccaguugcaggacaacaaaacguuauagaucccuggauucgaaacaauuuuguccaagcaccugguggugaauuuacaguuagccccagaaaugcaccaggagaaauccuauggucugcaccucuuggaccugauuuaaacccuuauuuaagucauuuagcuagaauguacaacggauacgcuggaggauuugaaguucaaguaauauuagcuggaaaugcauucaccgcaggcaaaaucauauuugcagcaguuccaccuacauuuccaacugaaggccuuucaccaucacaaguaacuauguuuccacauauaauaguagaugucagacaauuagaaccuguacuaauaccacucccagacguaagaaauaacuuuuaucauuacaaucaaucaaacgauuccacaauuaaacucauugcaauguuauauacuccauuacgagcaaacaauccaggagacgauguauuuacaguuuccugcagaguauuaacaagaccaagcccagauuucgauuucauauuuuuaguuccaccaacaguugaaucucgaacaaaaccauucucagucccuauuuuaacuguaggagaaaugaccaauucccgauuuccaguaaaucuugaaagauuauucacaggcccaucaucugcuaauguaguucaaccacaaaauggaagauguacaauagauggagaacuucugggaacaacucaacuuucaaguguaaacauauguacauuuagaggagauguaacucauauugguacaacccaucauuggacaaugaaucuagcuucaccaaauuggaacaauuacgauccaacugaagaaacaccagcacccuuaggaacuccugacuucguaggaaaaauacauggaauguuaacucaaacaacucaaggaucagguuccacaagagcucaucgcgcaacaguuuauguagguucagcugaauuuacaccuaaacuuggcaaaguaagauuugaaacagacacugaagacgaccuaguaauacgacaaaauacaaaauuuacaccaguuggaguaauacaaucaucagaccaucauagagaugaaccacaacaauggcgcuuaccuaauuacucaggagcaaauacauuuaacguacaccucgcaccagcaguugcaccaaauuuuccuggggaacaauuacuuuucuuuagaucaacauuaccaggaugcggaggucacccuaauauggaucucgauugcuuacuuccacaagaauggguucaacauuuuuaucaagaagcagccccagcacaaucugauguugcucuccuaagauucguuaaucccgauacaucacgcguacuauuugaauguaaauuacacaaaucuggauauguaacagucgcccauacaggacaauaugaccuaguucuaccaucuaaugguuauuuucguuucgacuccuggguaaaucaauuuuacacauuagcaccaaugggaaauggaacaggacgaagacgauaa

SEQ ID NO: 34809 - RNA, 1614 nt, Artificial Sequence
  derived and/or modified sequence opt6 from VP1__Norovirus_and/or_Norovirus-like__KX514256
augaaaauggcaucuucagacgcuaauccaucagacgguucugcagcaaaucuaguaccagaaguaaauaaugaagucauggcucuagaaccaguagucggugcagcaauugcagcaccuguagcaggacaacaaaacguaauagacccauggauaagaaauaacuuuguucaagcaccuggaggugaauuuacugucaguccaagaaaugcuccuggagaaauauuauggagugcgccucuaggaccagacuuaaaucccuauuuaagccacuuagcaagaauguacaauggauacgcuggaggauucgaaguccaaguaauacuagcaggaaacgcauuuacagcaggcaaaauaaucuuugcagcaguuccuccuacuuuucccacagaaggacuaagccccucacagguaacaauguuuccucauauaauaguugauguuagacaauuagaaccaguauuaauuccacuaccugacgucagaaauaacuuuuaucauuauaaucaaucaaacgauucaacaauuaaauuaauagcuauguuauauacaccacuaagagcaaauaauccaggugacgacguauucacaguaucaugcagaguauuaacaagaccaucaccagauuucgauuuuauauuccuugugccaccaacaguagaaucccgaacaaaacccuucucaguaccaauacuuacaguaggcgaaaugacaaauucacgauuuccaauuaaccucgaaggacuauuuacuggaccaucuucagcaaauguuguacaaccacaaaacggaagaugcacaauugacggugaacuacucggaaccacacaacucucaucgguaaauauauguacuuucagaggagauguaacacauauagguucaacucaucacuggacaaugaaccuagcuucaccaaauuggaacucuuacgacccaacagaagaaacucccgcuccccuaggaacuccagauuuugucgguaaaauacauggaaugcuaacacaaacuacacaaggcaguggaucuacacgagcacaucgagcaaccguauaugucggaucagcagaauuuacaccaaaauuaggaaagguucaauuuaaaacagaaacaaaucacgauuuauccauuagacaaaacacaaaauucaccccaguaggcguaauacaagaaagugaucaucauagagacgaaccacaacaguggaggcuacccaacuauucaggcgccaacacauuuaacguacauuuagcuccagcagucgccccaaacuuuccuggagaacaauuacuauucuuucgaucaacuuuacccggaugcggaggacacccaaauauggaccuugacugccuauuaccacaagaauggguacaacacuuuuaucaagaagcagcaccagcacaaucagauguagcauuacuaagauuugucaauccugauaccucaagaguuuuauuugaaugcaaauuacacaaaucaggauauguaaccguagcacacacaggccaauacgaucuaguucuaccaccaaacgguuauuuuagauuugauucauggguaaaucaauucuauacacuugcaccaaugggaaauggaacugguagaagaagauaa

SEQ ID NO: 34810 - RNA, 1614 nt, Artificial Sequence
  derived and/or modified sequence opt6 from VP1__Norovirus_and/or_Norovirus-like__KX514209
augaaaauggcuucaagugaugcaaacccaucagacggaucagcagcaaauuuagucccugaaguaaacaacgaaguuauggcccuagaaccaguuguaggagcagccaucgcagcaccuguagcuggacaacaaaauguaauagaccccuggauacgaaauaacuucguacaagcacccggaggagaauuuacaguaucaccaagaaaugcacccggagaaauacuauggucagcuccauuaggcccagacuuaaacccuuauuuaucacacuuagcccgaauguauaacgguuaugcugguggauuugaaguacaaguaauacuugcaggaaaugcauuuacagcaggcaaaauaauauucgccgcaguuccaccaacauuuccaacagaaggacuaucaccaucacaaguaacuauguuuccucauaucauaguagauguacgccaacucgaaccaguuuuaauaccacuaccagauguaagaaacaauuuuuaucacuauaaucaauccaacgacucaacaauaaaacuaauagccaugcuauauacaccauuaagagcaaacaacccaggugacgauguauuuacgguuuccuguagaguuuuaacacgaccuucaccagacuuugacuuaauauuccuuguaccacccacaguagaaaguagaacaaaaccauuuuccguuccuauauuaaccguaggagaaaugacaaauucaagauucccaguaaaucuagaaagacucuucacaggacccucuagugccaauguaguacaaccccaaaauggucgauguacaaucgacggugaauuguuaggaacaacacaacuauccucuguuaacauuugcacauuucgaggagacguaacacacauaggaucaacccaccacuggacaaugaaucuugcaucaccaaacuggaacaauuacgacccaacagaagaaacacccgcuccauuaggaacuccagauuuuguuggaaaaauucacgguauguuaacucaaacuacccaagguucaggcaguacaagagcucaccgagcaacaguauauguaggauccgcagaauuuacaccaaaauuaggaaaaguccaauucaaaaccgaaacagaucacgaucuauccauuagacaaaauaccaaauucacaccaguuggaguaauacaagaaucagaccaucaucgagaugaaccacaacaauggcgacucccaaauuacucaggcgcuaacacauuuaauguucaccuugcaccagccguagcaccaaauuuuccaggagaacaauuauuauuuuucagaucaacauuaccagguugcggaggacacccaaacauggaucuagauuguuuacuaccacaagaauggguacaacauuuuuaucaagaagccgcaccagcacaaucagauguagcauuacuacgauuuguaaauccagauaccucaagaguacucuucgaauguaaacuacauaaaucaggauacguuaccguugcacacacaggacaauaugacuuaguucuuccaucaaacggauacuuuagauucgacuccuggguuaaccaauucuauacauuagcacccauggguaacggaacaggacgucgcagauaa

SEQ ID NO: 34811 - RNA, 1614 nt, Artificial Sequence
  derived and/or modified sequence opt6 from VP1__Norovirus_and/or_Norovirus-like__KX514205
augaaaauggcaucaucugacgccaauccaucagacgguucugccgcaaaucuaguacccgaaguaaacaaugaagucauggcuuuagaaccaguugucggagcagccaucgcugcacccguugcaggacaacaaaaugucauagauccauggauaagaaauaauuuuguacaagcaccagguggagaauuuacaguaucaccaagaaacgcaccaggugaaauacuauggucagcacccuuaggucccgaucuuaauccauacuuaucacaccuagcacgaauguauaacggauacgcaggaggcuucgaaguacaaguaauauuagcagguaaugcauucaccgcagguaaaaucauauucgcugcaguaccaccaacauuuccaaccgaaggauuaagcccaucucaaguaacuauguucccacauauaaucgucgacgucagacaauuagaaccaguauuaauaccauuaccagacguacgaaauaauuucuaccauuacaaucaaucuaaugauucaacaauaaaacuaauugcuauguuauauacaccacugagagcaaacaacccaggagaugacguauucacagucucaugucguguauuaacuagaccuucuccugacuuugacuuuauauuucuaguaccaccuacaguagaaucccguacaaaaccauuuagugucccaauauuaacugucggagaaaugacuaauucucgauuuccaaucaauuuagaacgucuauuuacaggaccuucaucagcaaacguaguucaaccacaaaacggaagaugcacuauagacggagaauuacuugguacaacacaacuaucaagcguuaauauauguacauuucgcggagacguaacucauauagguucaacccaccacuggacuaugaauuuagccucacccaacuggaacaauuacgauccaacagaagaaacaccagcacccuuagguacaccugauuuuguuggaaaaauccacggaaugcucacacaaacaacacaagguucaggcucaacucgcgcccacagagcaacaguauacguaggaggagcagaauuuacaccuaaauuaggaaaaguacaauucaaaacugaaacagaucacgacuuaucaauaagacaaaacacuaaauucacuccaguaggaguuauacaagaaagcgaccaucaucgagaugaaccacaacaauggcgacuuccuaauuauucuggagcaaacaccuuuaacguacacuuagcacccgcaguagcuccaaacuuuccaggagaacaauuauuauucuuuagaucaacacuuccaggaugcggaggacauccaaauauggauuuagacugucuacucccacaagaauggguacaacauuuuuaccaagaagcagcgccugcacaaucagauguagcauuauuaagauucguaaacccagacacaaguagaguacuuuuugaauguaaacuccauaaaucaggauacguaaccguagcucauacaggacaacaugaucuaguaauaccaccaaacgguuauuuuagauuugauucauggguaaaucaauucuacacuuuagcuccaaugggaaauggcacaggaagaagacgcuaa

SEQ ID NO: 34812 - RNA, 1614 nt, Artificial Sequence
  derived and/or modified sequence opt6 from VP1__Norovirus_and/or_Norovirus-like__KX514200
augaaaauggcaucauccgaugcuaacccuucagaugguucugcugcuaaccuaguaccugaaguaaauaaugaagucauggcauuagaaccaguaguaggagcugcaauagcagcaccaguagcaggacaacaaaacguaauagauccuuggauucguaauaauuucguacaagcaccaggaggagaauuuacaguauccccucguaaugcaccuggcgaaauauuauggucagcaccauuaggaccagauuuaaauccauauuuaucacaucuugcaagaauguauaacggauaugccggagguuucgaaguacaaguuauccuagcaggaaacgcauuuacugccggaaaaauaauauucgcagcaguaccacccacauuuccaacugaaggauuaucaccaucacaaguaaccauguucccacacauaauaguagauguaagacaacuagaaccaguauuaauaccauuaccagacguucgaaacaauuuuuaucacuauaaucaaucgaaugauucaacuauuaaacuaaucgcuaugcuauauacaccauuacgagcaaauaacccaggugaugauguauuuacaguaucauguagaguauuaacaagaccaucacccgacuuugacuuuaucuuucuaguuccaccuacaguagaaucuagaacaaaacccuuuucugucccuauucuaacaguaggagaaaugacaaacucaagauuccccauaaaccuugaaaggcuauuuacaggacccuccucagcuaauguaguacaaccacaaaacgguagaugcacaauagauggagaacuucuaggaacaacacaacuuuccccaguaaacaucuguacauuucgaggcgacguaacacauauaggaacaacaagacacuggacaaugaaucuagcaucaccaaacuggaauaauuaugauccuacagaagaaacuccagccccacuaggaacacccgacuucguaggaaaaauccacgguaugcucacucaaacaacacaaggaucaggauccacaagagcacauagagcaacagucuauguaggcuccgccgaauuuacaccaaaacucggaaaaguccaauucaaaacagaaacugaucacgaucucucaauacgccaaaauacaaaauucacaccaguaggcgucauccaaaaaucagaucaucauagagaugagccacaacaauggagacuaccaaacuacuccggugcaaauacuuuuaacguacaccuagcuccugcaguagcacccaacuuuccaggagaacaacuauuauucuuucgcucaacucucccuggauguggaggacacccuaacauggacuuagacuguuuacuaccccaagaauggguacaacauuuuuaccaagaagcagccccugcacaaucugauguagcacuacuucgcuuuguaaauccagauacuucacgaguauuauucgaauguaaacuccacaaaucaggauauguaacagucgcacauacaggccaauaugaucuaguauuacccucuaauggauauuuuagauuugauucuuggguaaaucaauuuuauacacuugcaccaaugggaaaugguacuggucgacgacgauaa

SEQ ID NO: 34813 - RNA, 1614 nt, Artificial Sequence
  derived and/or modified sequence opt6 from VP1__Norovirus_and/or_Norovirus-like__KX514196
augaaaauggcaucuucugacgcaaacccaagugacggaucagcagcaaaccuaguaccagaagucaacaacgaagucauggcauuagaaccaguaguaggagcugcaauagcagcaccaguagcuggucaacaaaacgucaucgacccauggaucagaaauaauuuuguacaagcaccugggggagaauuuacaguaucaccgagaaacgcaccaggagaaauauuauggucagcaccauuagguccagaccuaaacccauauuuaucucauuuagccagaauguauaaugguuaugccggaggauucgaaguacaagucauucuagcaggaaacguuuucacugcaggaaaaauaauauucgcagcaguaccacccacauucccaacagaaggacuaucacccucacaaguaacaauguucccccacauuauuguagacguaagacaacuugaaccaguauuaauaccuuuaccagacguacgaaacaauuucuaccacuauaaccaaucaaaugauucaacuaucaaacuaauagcaaugcuauacaccccauuacgcgcuaacaauccaggcgacgauguauucacaguaucauguagagucuuaacaagacccucaccagauuucgacuuuauauuuuuaguaccuccuacaguagaaucaagaacaaaaccuuucucaguaccaauauuaacaguaggagaaaugacuaauagcagauuuccaauaaauuuagaaagauuauuuaccggccccuccucagccaauguuguccaaccacaaaauggaagaugcacaauagauggugaacuuuuggguacaacacaauuaucauccguaaauaucuguacauucagaggagacguaacccauauaggaucuacacaccauuggacaaugaauuuagccuccccaaacuggaacaauuacgacccaacagaagaaacacccgcuccauuaggaacaccagauuuuguagguaaaauacauggcauguuaacacaaaccacucaagguuccgguucaacaagagcacauagagcaacagucuacguaggaggagcagaauuuacaccaaaacuaggcaaaguccaauuuaaaacagaaacagaccacgaucucacuauacgacaaaauacuaaauuuacuccaguuggaguaauacaagaaucugaccaucauagagacgaaccacaacaauggagacuuccaaauuacucaggugcaaauacauucaauguacaucuagcuccugcaguagcaccaaauuucccaggcgaacaacuacucuucuuuagaucuacacuacccggaugcggaggucacccaaauauggaccuagauugccuauuaccacaagaauggguacaacacuuuuaucaagaagcugcaccagcacaaucagacgucgcccuauuaagauucguaaauccagacacuucacgaguucuauuugaauguaaacuacauaaaucaggauauguuacaguagcccauacaggucaauacgaccuuguuuuacccucuaacggauacuucagauuugacucauggguaaaccaauucuacacacucgcaccuaugggaaauggaacuggacgaagaagauaa

SEQ ID NO: 34814 - RNA, 1614 nt, Artificial Sequence
  derived and/or modified sequence opt6 from VP1__Norovirus_and/or_Norovirus-like__AB985437
augaaaauggcuucaaaugacgcuaacccaucugacggaucagcagccaaccuaguaccagaaguuaauaaugaaguaauggcccuagaaccuguaguuggagcagccauagcagcaccaguagcuggucaacaaaacguaaucgauccauggaucagaaauaacuucguacaagcaccagguggugaauuuacuguaucaccaagaaacgcaccaggagaaaucuuauggucagcccccuuaggaccagaucuaaacccuuaucuaucucaccucaguagaauguacaacggguaugcaggcggauucgaaguacaagucauacuagcaggcaaugcuuucacugcaggaaaaguaauauucgcugcaguaccaccaaacuuuccaaccgaagguuuaucaccaucacaaguaacaauguuuccacacauaauaguagacguacgacaauuagaaccgguacuaauaccacuacccgauguuagaaacaauuuuuaucacuauaaccaagcacacgacuccacacuaaaacucauagcaauguuauacacaccacuucgugcaaauaaugcaggcgacgacguauucacaguaucaugccgaguacuaacaaggccaucaccagauuucgacuuuauauuucuaguaccaccaacaguagaaucuagaacaaaacccuuuacaguuccuauauuaaccguagaagaaaugucaaauucacgauuccccauaccacuagaaaaacuauauacaggaccuucaucagcauucguaguucaaccacagaacggcagauguacaacugauggaguauuauuaggaacaacacaauuaucagcaguaaacauaugcaauuuucgaggcgacguaacacacauaguaggaagccaugauuacacaaugaauuuaguuucacaaaauuggaacaauuacgacccaacagaagaaauacccgcaccuuuaggaacaccagacuuuguagguaaaauacaaggacuauuaacacaaacaacaagagcagacggaucaacaagagcccacaaagcaacagucuccaccggaucaguacacuuuacaccaaaacugggaucuguacaauucaccacagauacaaauaacgauuuucaaacaggacaaaacacuaaauucacaccuguaggaguaauacaagauggugaccaccaccaaaaugaaccacaacaauggguauuaccaaacuauucaggaacuucaggacacaauguacaucuugcacccgcaguagcaccaaccuuuccaggugaacaauuauuguucuuccguuccacaaugccaggcugcucagguuauccaaauaugaacuuagacuguuugcucccacaagaauggguacuccauuucuaucaagaagcugcuccggcacaaucagauguagcauuacuuagauuuguaaaccccgacacaggaagaguacuuuuugaauguaaauuacacaaaucaucauauauaacagucgcucauacuggaccauaugaucuaguaaucccacccaauggauacuuccgauucgacucauggguaaaccacuucuacacacuagcgccuaugggaaauggaacaggaggaagaagauaa

SEQ ID NO: 34815 - RNA, 1614 nt, Artificial Sequence
  derived and/or modified sequence opt6 from VP1__Norovirus_and/or_Norovirus-like__KF712494
augaaaauggcaucaucugacgcaaauccuucagacgguucuacagcaaauuuaguacccgaagcaaacaacgaaguaauggcauuagaaccggucguaggagcugccauagcugcacccguagcaggucaacaaaauguaauagaucccuggauacgaaacaacuucguacaagccccuggaggagaauuuacagucucuccaagaaacgcaccaggagaaguacuauggucagcuccauuaggaccagauuuaaacccauauuuaagccaucuagcuagaauguacaauggcuaugcaggaggauuugaaguacaaguaauauuagcaggaaacgccuuugcagcaggaaaaauaauauucgccgcagucccuccuaauuuuccaaccgaaggauuaucaccaagucaaguaacuauguuuccccauuuaauaauagauguaagacaauuagaaccaguaaugaucccauuaccagacguaagaaauaauuuuuaucauuauaaucaaucaaacgauccaaccauaaaauuaaucgccaugcuauacacuccguuaagagcaaacaacguaggagaugacguguucacugucucaugcagaguccuaacuagaccaucacccgauuuugacuucauuuuucuaguaccaccaacaguagaaucaaaaacaaauccuuucuccguacccauauuaacaauagaagaaaugacuaauucacgauucccaauaccacuagaaaaauuauucacaggaccaucuuccgccuuaguaguucaaccacaaaacggccgaugcacuacagacgguguacuauuagguacaacccaacuaucacccguuaacauuugcacauuccgaggcgacgucacccauauaacaaaaacucacucauaucaaaugaauuuagcagcccaaaacuggaacuccuaugacccaaccgaagaaauaccugcaccacuaggaacaccagacuucguuggaaaaauacaaggaguacuaacccaaacaacuaaaggcaauggauccacccgcgcccauaaagcaacuguuuacacuggcucuaccgaauuuacaccaaaguuagguagaauacaauuaguuaccgacacagacaaugaucuugaaacaaaccaaaauacaaaauuuacaccgguaggaguaauucaagauggcgauacacaccaaaaugaaccacaacaauggguccuaccauccuaucuaggaagaaauaaccacaacguccaccuagcaccagcaguugcaccuacauuuccuggugaacaauuauuauucuuuagaucaacaaugccaggaugcucaggauacccaaacaugaaucuugacugucuauuaccacaagaauggguacaauauuucuaucaagaagccgcaccagcacaauccgauguugcguuacuacgauucguaaacccugacacaggaagaguucucuucgaaugcaaacuacacaaaucaggauauguuacaguugcacacacaggacaucacgaucuauuuauuccaccuaauggauauuuccgauucgauucauggguaucuccauuuuauacucuagcaccaaugggaaauggcacaggacgucgcagauaa

SEQ ID NO: 34816 - RNA, 1614 nt, Artificial Sequence
  derived and/or modified sequence opt6 from VP1__Norovirus_and/or_Norovirus-like__KX514315
augaaaauggcaucaucugaugcaaaccccucugauggaucaacagcaaaucuaguaccugaaguaaacaaugaaguaauggccuuagaacccguaguuggagcagcuauagcagcaccaguugcaggacaacaaaauguaauagacccuuggauuagaaauaacuuuguacaagccccagguggagaauuuacaguauccccucgaaaugcccccggcgaaauacuauggucagccccacuuggaccagaucuaaauccauaucuaucacaucuagcacguauguauaauggauaugcaggagguuucgaaguucaaguaauauuagcaggaaaugcuuuuacagcaggaaaaauaauuuucgcugcaguaccaccaaacuuuccaacagaaggauuaucacccucucaaguaacuauguuuccucacauaauaguagacguaagacaacuagaaccaguauuaauuccauuaccagacgucagaaauaauuuuuaucacuacaaucaaucaaaugacucaacaauuaaacucauagcaauguuauauacuccacuaagagcuaacaauccaggugacgacguauuuacagucucauguagaguacuaacucgaccaucaccagacuuugauuucauauuuuuaguaccaccaacaguagaaucucgaacuaaaccauucucaguacccauauuaacaguaggagaaaugacuaacucaagauuuccaaucaaucucgaaagauuauuuaccggaccaucuagugcaaauguaguacaaccacaaaacggucgauguaccauugauggagaacuauuaggaaccacacaacucucaucagucaacaucuguacguuuagaggugacguuacacaaauaggaucaacaaaacacuggacuaugaaucuagcuucucccaacuggaacaacuaugaucccacugaagaaaccccugcaccacuaggaacaccugacuuuguaggaaaaauacauggaaugcuaacacaaacaacacaagaaaaugguucaaccagagcacacagagcuacaguauauguaggaggagcaaacuucacaccaaaacuaggaaaaguacaauuugaaacagacaccggcgaugauuuagcaauaagacaaaacacaaaauuuacaccuguaggcgucauacaaucaucagaccaucaccgagaugaaccacaacaauggagacuaccaaauuauucuggcgcaaacaccuucaauguacaccuagcaccagcaguagcaccaaacuuccccggagaacaauuacuauuuuucagauccacccuuccuggcugcggaggacacccaaacauggaucuugauugucuacucccacaagaauggguacaacacuuuuaucaagaagcugcacccgcucaaucagacgucgcccuccuaagauuuguaaauccagauacaucacgaguuuuauuugaauguaaauuacacaaaucagguuacguaacaguagcacauacaggacaauacgaucuaguauuaccaucaaaugguuacuuuagauuugacucauggguuaaucaauucuauacucuugcuccuauggguaacggaacaggaagaagaagauaa

SEQ ID NO: 34817 - RNA, 1614 nt, Artificial Sequence
  derived and/or modified sequence opt6 from VP1__Norovirus_and/or_Norovirus-like__KX514199
augaaaauggcaucaucugacgcaaauccaucagacggauccgcugcaaacuuaguaccagaaguaaacaaugaagucauggcccuagaaccaguagucggugcagcaauaguagcacccguagccggacaacaaaacguuauagauccauggaucagaaacaauuuuguccaagcaccaggcggagaauuuacaguaucaccaagaaaugcaccuggcgaaauauuaugguccgcaccuuuaggaccagauuuaaauccauaccuaucucauuuagccagaauguauaauggauacgccggaggcuuugaaguacaaguaauauuagccggaaaugcauucacugcaggcaaaauaaucuucgcagcaguaccaccaaccuuuccaacagaaggacuaucaccaucacaaguuacaauguuuccacauauaauaguagacguuagacaauuagaaccaguauuaauuccauuaccagauguaagaaauaauuucuaucacuauaaccaaucuaaugacuccacaauuaaauuaauagcaauguuauacacaccauuaagagcaaacaacccaggagaugaugucuuuacuguaucaugucgcguauuaacaagaccuaguccagauuuugacuuuauuuuccuaguucccccuacuguggaauccagaacgaaaccauuuucuguucccauauuaacaguaggugaaaugacaaauucacgauuuccuauaaacuuagaaagacuauucacaggaccuucaucugcaaacguaguacaaccacaaaauggaagaugcacuauagacggugaacuccucggcacaacacaauuaucaaguguaaauauauguaccuuuagaggagacguuacacauauaggaucaacccaucacuggacaaugaacuuagccuccccaaacuggaauaauuaugauccaacagaagagaccccugcuccauuaggaacaccugacuucguaggcaaaauacacgguauguuaacacaaacaacacaaggcucaggauccacacgagcacacagagcaaccguauauguuggaucagcagaauuuacccccaaacuuggaaaaguucaauuuaaaacagaaacagaucacgacuuaacaauaagacaaaauacaaaauuuacaccaguaggaguaauacaagaaucugaccaccacagagaugaaccccaacaauggagauuaccuaauuacucaggagccaacacauucaauguacauuuagcaccagcaguagcaccaaauuucccuggagaacaauuacuauucuuucgaucaacacuaccaggaugugggggacauccaaacauggaccuagauugucuauuaccacaagaauggguacuucacuuuuaucaagaagccgcuccugcacaaucagacguugcacuacuuagauuuguaaacccugauaccucucgaguauuauuugaauguaaacuacauaaaucaggauacguaacaguugcacauacaggucaauacgaccuaguuuuacccucaaauggauauuucagauucgauucauggguuaaucaauuuuacacauuagccccaauggguaauggaaccggaagacguagauaa

SEQ ID NO: 34818 - RNA, 1614 nt, Artificial Sequence
  derived and/or modified sequence opt6 from VP1__Norovirus_and/or_Norovirus-like__KX514176
augaaaauggcaucuucagaugcaaauccuucagacggaucagcagcaaauuuaguacccgaaguuaauaaugaagucauggcacuagaaccagucguaggagcugcaauagcagcaccaguagcuggccaacaaaaugucauagauccguggauaagaaauaauuuuguacaagcuccagguggugaauuuacaguauccccaagaaacgcaccaggagaaauacuauggucugcaccacuuggaccagauuugaauccauaucuaucacauuuagcacguauguauaacggauaugcaggaggauuugaaguacaaguuauacucgcuggaaacgcauuuacagcaggcaaaauaauuuucgccgcaguaccacccaccuucccaacugaaggacuaucaccaucacaaguuacaauguucccacauaucauuguagauguaagacaacuagaaccuguauuaauaccacuaccagauguaagaaauaauuuuuaccauuacaaucaaucaaaugauuccacaauuaaacuuauagcaauguuauauacaccccuaagggcuaauaauccaggugacgauguauuuaccguaucauguagaguauuaacaagacccucaccugacuuugauuuuaucuuucuaguaccacccaccguugaaucaagaacuaaacccuuuucugucccuauauuaacaguaggagaaaugacaaauucaagauuucccguaaacuuagaacgacucuuuacaggaccaaguucagccaacguaguccaaccacaaaauggaagauguacaauugauggcgaacuacuaggaacuacucagcuuucuucaguaaauauauguacauuuagaggagauguaaccagaauaggaacaacacaacacuggaccaugaauuuagcaucacccaacuggaacaacuaugacccaacagaagaaacaccagcuccacuugguacaccagauuucguaggaaaaauucacggaauguugacucaaacuacgcaaggaucaggcaguaccagagcucacagagcaacaguauaugucggaucagcagaauuuaccccuaaacuuggaaaaguacgauucgaaacagacacugaagacgauuuaguaauucgucaaaauacaaaauuuacaccaguuggaguaauacaaucaucagaacaucauagagaugaaccacaacaauggagauuacccaauuauuccggagcaaauacauuuaacguacaucuagcuccagcaguagcaccaaacuuuccaggggaacaacuacuauucuuucgaucaacauuaccaggaugcggaggacauccaaacauggacuuagauugcuuacuaccccaagaauggguccaacauuuuuaucaagaagcagccccagcccaaagugacguugcccuacucagauuuguuaauccagauacaucaagagucuuauuugaauguaaacuacacaaaucaggauacgucacuguugcgcauacuggacaauacgacuuaguuuuaccuuccaauggauauuuucgauuugauucuuggguuaaccaauuuuacacauuagcacccaugggaaacggaacuggaagacgacgauaa

SEQ ID NO: 34819 - RNA, 1614 nt, Artificial Sequence
  derived and/or modified sequence opt6 from VP1__Norovirus_and/or_Norovirus-like__KX514360
augaaaauggcaucuucagaugcaaacccaucagacggaucaacugccaacuuaguaccugaaguaaauaacgaaguaauggcacucgaaccagucgucggagcagcuauugcagccccugucgcuggacaacaaaauguuauagauccuuggauaagaaauaauuuuguacaagcaccaggaggagaauuuacugucucccccagaaaugcaccaggagaaauuuuauggucagcaccacuuggaccagaucuuaacccuuaccuaucacacuuagcccguauguauaacgguuaugccggcggauucgaaguacaaguaauauuagcaggaaaugcauuuacagcuggaaaaauaauauucgccgccguaccaccaacauuuccaacagaaggccuaucucccucacaaguaacuauguuuccccauauaauaguugauguacgacaauuagaaccaguacuaauaccacucccugauguaagaaauaacuucuaucacuacaaucaauccaaugauucuacuauaaaauuaauagcaauguuauacacaccucuaagagcaaacaacccaggagacgauguauuuacaguaucauguagaguauuaaccagaccauccccagacuuugauuuuauauucuuaguuccaccaacaguagaaucaagaacaaaaccauucucaguaccaaucuuaacaguaggugaaaugacaaauuccagauuucccauaaaccuagaacgcuuauuuaccgggccaucaucagcaaaugucguucaaccccaaaauggaagaugcacaauugacggagaacuauuaggcacaacacaauuauccucugucaacauauguacauuuagaggagacguaacacaaauaggaucaacaaaacauuggacaaugaauuuagccucuccuaacuggaacaacuaugacccaacagaagaaaccccugcuccucuagguacaccugacuuuguagguaaaauacacggaaugcuaacacaaacaacacaagaaaauggaucaacaagagcccauagagccacaguuuauguaggcggagcaaauuuuacacccaaacuaggaaaaguacaauuugaaacagauaccggagacgacuuagccauacgacaaaauacuaaauuuacacccgucggaguaauacaaucaucagaucaucauagagaugaaccccaacaauggagauuaccuaacuauucaggagcaaauaccuuuaacguacauuuagcaccagcagucgccccaaauuuuccaggggaacaauuauuauucuuccgaucaacacuucccggcugcggaggucaccccaacauggauuuagauugccuacuuccacaagaguggguacaacacuucuaccaagaagcagcaccagcccaaucagacgucgcuuuauuacgauucguaaauccagacacaucaagaguacuauuugaauguaaacuccacaaaucagguuauguaacaguagcucacacaggacaauacgacuuaguuuuaccaucaaauggauauuucagauucgacucauggguaaaccaauuuuacacacucgcacccaugggaaauggaacuggaagaagaagguaa

SEQ ID NO: 34820 - RNA, 1614 nt, Artificial Sequence
  derived and/or modified sequence opt6 from VP1__Norovirus_and/or_Norovirus-like__KX514347
augaaaauggcaucuaaugaugcuaauccaucagacggaucagccgcaaauuuaguaccagaagucaacaacgaaguaauggcauuagaaccaguaguaggagcagcuauagcagcacccguagcuggacaacaaaacguaauagauccauggauuagaaauaauuucguacaagcucccggcggugaauuuacaguuuccccaagaaacgcuccaggagaaauauuauggucagcuccauuaggaccagacuugaauccauaucuaagccaucuagcaagaauguauaaugguuaugcaggaggauucgaaguccaaguaauauuagccggaaaugcauuuacugcaggcaaaauuaucuuugcagcaguuccuccaaauuucccaacagaaggucucagcccaucacaagucacaauguuuccacauauaauuguagauguaagacaauuagaaccugucuuaauaccucuaccagaugucagaaauaacuuuuaccauuacaaucaaucaaacgauucaacuauaaaauuaauugcaauguuauauacuccauuaagagccaauaacgcaggagaugacguuuucacaguauccugcagaguuuuaacaagaccuucaccagauuucgauuucauauuucuagucccaccaacugucgaaucaagaucaaaaccauuuucuguacccguacuuacaguugaagaaaugacaaauagucgauuuccagccacacuagacaaacuuuucacagguccgucaucuacauuugucguacaaccacaaaacggacgcuguaugauagauggagucuuauuaggaacaacacaacuaucaccuguaaauauaugcacauucagaggcgauguaacacaaucuggcaacacuaaaauauauaccaugaacuuagcaucuccuaauuggaauaacuacgacccaacagaagaaauacccgcuccauuaggaacaccugauuucguaggaaaaauacauggaauguuaacacaaaccacccaaggaucaggcuccaccagagcucauagagcuacuguuuacguaggcggcgcagaauuuacaccuaaacuuggaaaaguaagauuugaaacagacacagaagaugaccuugucauacgucaaaacaccaaauuuacaccaguagguguaauacaaucaagugaacaucauagagaugaaccacaacaauggagacuuccaaacuauaguggagcaaacacauuuaacguacaucuagccccugcagucgcacccaauuucccaggagaacaauuacuauucuuuagaucuacauuaccuggauguggaggccacccuaauauggaccuugauugccuccucccucaagaauggguucaacauuucuaucaagaagcagccccugcacaaucugacguagcauuauuaagauuuguaaauccagacacuagcagaguauuauucgaaugcaaacuacauaaaucuggauacgucacagucgcacacacaggacaacaugacuuaguucucccaucaaauggcuauuucagauucgauaguuggguaaaucaauucuacacucuagcacccaugggaaacggaacaggacgcagaagauaa

SEQ ID NO: 34821 - RNA, 1614 nt, Artificial Sequence
  derived and/or modified sequence opt6 from VP1__Norovirus_and/or_Norovirus-like__AB684675
augaaaauggcauccucagacgccaacccgucagacgguucagcagcaaaucuaguuccagaaguaaauaaugaaguaauggcacuugaaccaguaguuggagcagcaauugcagcaccaguagcaggacaacaaaauauaauagauccauggauuagaaauaacuucguacaagcaccagguggcgaauuuacagucucaccuagaaaugcaccaggagaaauacucuggagugcaccuuuaggaccagacuuaaacccuuaccuuucccaccuaucaagaauguacaauggauacgccggaggauucgaaguacaaguaauacuagcaggaaaugcauucacagcuggaaaaguaauauucgccgccguuccgcccaauuuuccaacagaaggacucucaccgucccaaguaacuauguuuccccauauaauagucgacguacgacaauuagaaccuguacuaauaccccucccagacguacgaaauaacuuuuaucauuauaaucaagcacacgauucaaccuuaaaauuaauagcuaugcucuauacaccuuuaagagcaaauaaugcaggcgacgacguauuuacaguauccugcagaguauuaacaagaccaucaccagacuucgacuuuauauuucuagucccacccacaguagaaucaagaacaaaaccauuuaccguaccaauacuuacaguagaagaaaugucaaacaguagauuuccuauaccauuagaaaaacuauauacaggaccauccucagcuuuuguaguucaaccacaaaaugguagauguacaacagacggaguacuauuaggaacuacacaacuaucagcaguaaauauauguaauuuccuaggagauguaacacguguagguacaagucaugauuacacaaugaacuuagucucccaaaauugggacaacuaugacccuaccgaagaaauacccgcccccuuaggaacaccugauuuuguaggaaaaauucaaggucuacucacacaaacaacaagagcagauagaucaacaccagcccauaaagcaacaguauccacaggaucaguccauuucacacccaaacuaggauccguccaauucaccacagauacuaauaaugacuuccaaacuggccaaaauacaaaauuuacaccuguaggcgucauccaagauucagaucaccaucaaaaugaaccacaacaauggguacuaccaaacuacucuggaacaacaggacacaauguccauuuagcaccggcagucgcacccaccuucccaggcgaacaauuacuauucuuucgcguaacgaugccaggaugcucugguuacccaaacaugaauuuagauuguuuacucccccaagaauggguucuacauuuuuaucaagaagccgcaccagcacaaucagaugucgcccuauuacgauuuguaaauccagacacuggcagaguauuauucgaauguaaauuacacaaauccggauauauaacagucgcacauacaggaccauacgauuuaguaauuccaccaaauggcuauuuuagauucgauuccuggguaaaucaauuuuacacacuagcaccuaugggaaauggaacaggacgacguagauaa

SEQ ID NO: 34822 - RNA, 1614 nt, Artificial Sequence
  derived and/or modified sequence opt6 from VP1__Norovirus_and/or_Norovirus-like__KX514369
augaaaauggcaucauccgaugcaaacccaucagacgguucugcagcaaaucuagucccugaaguaaauaaugaaguaauggcccuagaaccaguaguaggugcagcaauagcagcaccuguagcaggucaacaaaauguaauagaccccuggauacgaaacaauuuuguacaagcaccuggaggagaauuuacaguaucaccaagaaaugccccaggugaaauauuauggucagcaccuuuagguccagaucuaaacccauauuuaagccauuuagcuagaauguauaauggauacgcaggaggauuugaaguacaagucauacuagcugguaaugcauuuaccgcaggaaaaauaauauucgccgcaguaccaccaacuuuucccacagaaggucuaucacccucacaaguaaccauguuuccacauauuauaguugauguucgacaacuugaaccaguacuaaucccuuuaccagauguucguaauaacuuuuaucacuauaaucaaaguaacgauucaacaauaaaacucauagcaauguuauauaccccacuacgagcuaacaauccuggcgacgauguauuuacaguuucuuguagagugcuaacaagacccucaccugacuucgauuuuaucuuucuaguaccaccaaccguugaaucacgaacaaaacccuucuccguaccuauacuaacuguuggagaaaugaccaacucaagauuuccaguaaauuuagaaagacuauucacaggaccaucaucugcuaauguuguucaaccacaaaacggucgauguacaauagacggagaauuauuaggcacuacacaauuaagcucaguaaauauaugcacauuucgaggagacguaacacaaauaggugcaacaagacacuggacaaugaauuuagcuucuccaaauuggaauaauuaugauccuacagaagaaacuccugcuccacucggaacaccugacuuuguaggaaaaauacauggaauguuaacacaaacaacacaaggcucaggaaguaccagagcucauagagcaacagucuacguaggaggugcagaauuuacaccaaaacucggaaaagucagauuugaaacagacacugaagacgauuuagucauacgacaaaauacaaaauucacaccaguaggagucauacaaucaucugaacaccacagagaugaaccacaacaauggagauuaccaaauuauucaggcgcaaauacauuuaauguacaucucgccccggcuguagcaccaaauuuuccuggagaacaauuacuauucuuucgaucaacucuaccaggaugcggaggucacccuaauauggauuuagacuguuuauuaccacaagaauggguacaacauuuuuaucaagaagcugcuccagcacaauccgauguggcauuacuacguuuuguaaauccagacacaucccguguauuauucgaaugcaaauuacacaaauccggauacguaacaguugcacauacaggccaauaugaccuuguauuaccuucuaauggauacuuucguuucgacucaugggucaaucaauuuuauaccuuagcaccuaugggaaacggaacaggacgacgaagauaa

SEQ ID NO: 34823 - RNA, 1614 nt, Artificial Sequence
  derived and/or modified sequence opt6 from VP1__Norovirus_and/or_Norovirus-like__KX514310
augaaaauggcaaguaaugacacuaacccaucugauggcuccgcagccaaucuaguaccagaaguaaacaacgaaguaauggcauuagaaccaguugucggagccgcaauagcagcuccagucgcuggacaacaaaauguaauagaccccuggaucagaaauaacuucguacaagcaccuggaggugaauuuacaguuucaccuagaaacgcaccaggcgaaauauuauggucagcaccauuaggaccagaucucaacccauauuuaucccacuuagcuagaauguauaaugguuacgcaggaggauucgaaguacaaguaauacuagcuggaaacgccuucaccgcagguaaaauaauuuucgcagccguuccaccuaauuuuccuacugaaggauuauccccaucacaaguaacaauguuuccacacauaauaguagacguaagacaacuagaaccaguacuaauaccacuaccagauguuagaaacaacuuuuaucacuauaaucaaucaaaugacucaaccauuaaauuaauagcaaugcuuuacacaccacuaagagcaaacaaugccggugacgauguuuucacaguuuccuguagagucuuaacaagaccuuccccagauuuugauuucauauuuuuaguaccaccuacuguagaaaguagaucuaaaccauucuccguaccaguauuaacuguugaagaaaugacaaauucacgcuuuccagcaacacucgacaaauuauucacgggcccaucuucaaccuuugucguacaaccacaaaacggaagaugcaugauugauggaguacuucuaggaacaacucaauuaucaccaguaaacauauguaccuuuagaggugacguuacacacccacgugacucuaaaauauacacaaugaaucucgcaagucccaacuggaauaacuacgacccaacagaagaaauaccagcaccccuaggcacaccagauuuuguaggaaaaauacaugguaugcuaacacaaaccacacaagaaaacgguucaacaagagcacacagagcaacuguuuauguaggaggagcaaauuuuacuccaaaauuaggaaaaguacaauuugagacagacaccggagaugauuuagcaauccgacaaaauacaaaauucacuccaguuggagucauacaaucauccgaccaccaccgugacgaaccacagcaauggagacuaccaaauuauucuggagcaaacacauuuaauguacaucuagcaccagcaguugcacccacauucccuggagaacaauuacucuucuuucgcucaacaauaccaggaugcggaggacacccaaacaugaaccuagauugucuuuuaccacaagaauggguacaacauuuuuaucaagaagcagcacccgcacaaucggaugucgcacuacuaagauuuguaaaucccgauacauccagaguauuauucgaauguaaauuacauaaaucagguuauguuacagucgcacauacuggucaauaugaucuaguacuaccaaguaacggauacuuucgcuucgacucauggguuaaccaauucuauacauuagcaccaaugggaaauggaacagguagaagaagauaa

SEQ ID NO: 34824 - RNA, 1614 nt, Artificial Sequence
  derived and/or modified sequence opt6 from VP1__Norovirus_and/or_Norovirus-like__KX514185
augaaaauggcaucauccgaugcaaauccuucagauggaucagcagccaaucuuguaccagaaguuaauaaugaaguuauggcucuugaacccguaguaggugccgcaauagcugcuccaguagcaggccaacaaaauguaauugauccauggauacgaaauaacuuuguacaagcaccaggaggcgaauuuacaguuucaccucgaaacgccccaggcgaaauuuuauggucagcaccuuuagguccagacuuaaacccauauuuaagucauuuagcacgaauguauaaugguuaugcuggcgguuuugaaguacaagucauccuagcuggaaaugcauuuaccgcaggcaaaauaauuuuugcagcaguaccuccaacauucccaacagaaggauuaucaccaucucagguuacaauguuuccccauauaauaguagauguacgucaacuugaaccagucuuaauuccguuaccagauguaagaaauaauuuuuaucacuacaaucaaucaaacgauucuaccauaaaauuaauagcaaugcuauauacaccccuaagagcaaauaauccuggagaugauguuuucacuguaucauguagaguccuaacuagaccaucuccagauuucgauuucaucuuucuaguuccacccacaguagaaucuagaacaaaacccuucagcgucccuaucuuaacaguuggagaaaugaccaauucaagauuuccaguaaaucuagaaagauuauuuacgggaccuucaucagcuaacguaguccaaccacaaaacggaagaugcacaauugauggcggacuucuaggaacaacacaacuaucaucaguaaauaucugcacuuuucgaggcgacgucacccacaucggaacaaccagacacuggacaaugaaccuugcaucaccaaacuggaauaacuaugauccaacagaagaaaccccagcaccucuugguacccccgacuuuguaggaaaaauacacggcauguuaacacagacaacacaaggaucaggaucaacaagagcccauagagcuacaguauauguaggaucagcugaauuuacuccaaaauuagggaaaguaagauucgaaacagacaccgaggaugaucuaguaauaagacaaaacacaaaauuuacaccuguagguguuauacaaucuucagaacaccauagagaugaaccacaacaauggagguuacccaauuauucaggagcaaacacuuuuaauguacacuuagccccagcaguagcaccaaauuucccuggagaacaacucuuauuuuucagaaguacacuaccuggauguggcggacauccaaauauggaccuagacuguuuacuaccacaagaauggguacaacacuucuaccaagaagcagcaccagcucaguccgauguagcuuuauuaagauuuguaaauccagauacaaguagagucuuauucgaauguaaacuucauaaaucagguuauguuacuguagcacauacaggccaauaugaucuaguauuaccauccaauggcuacuucagauuugacagcugggucaaucaauuuuacacacuagcaccaaugggaaaugguacagguagacgcagauaa

SEQ ID NO: 34825 - RNA, 1614 nt, Artificial Sequence
  derived and/or modified sequence opt6 from VP1__Norovirus_and/or_Norovirus-like__KX514181
augaaaauggcaucauccgaugcuaauccaucugauggcucagcugcuaaccuaguaccagaaguaaacaaugaaguuauggcucuugagccuguagucggggcagcuauugcagcacccguugcaggacaacaaaauguaauagauccauggauaagaaauaacuucguacaagcaccuggaggugaauuuacaguaucaccaagaaacgcacccggagaaauuuuauggucugcaccccuaggcccagauuuaaacccuuacuuaucacauuuagcaagaauguauaauggauacgcuggagguuuugaaguacaaguaauucuagcagguaacgcauuuacagcaggaaaaauaaucuucgcugccguuccacccacauuuccuacagaaggucuaagcccaucucaaguuacaauguucccucacauaauaguugacguaagacaauuagaaccaguacuaauaccauuaccagauguacgcaacaacuucuaccauuauaaccaaucaaaugacucaacaauaaaacuaauagcaauguuauauacaccacuaagagccaauaauccaggugaugauguauuuacagucaguuguagaguacuuacacgaccaucaccagauuucgacuucauauuucuaguaccaccaacaguugaaaguagaacaaaacaauucuccguacccauauuaacagucggagaaaugacaaacaguagauuuccaguaaaccuugaaagacuauuuacugguccaucaucagcaaacguaguacaaccacaaaaugguagauguacaauagacggagaauuauuagguacaacccaacuaaguucagugaauauauguacauucagaggugauguaacacauauaggaacaacaagacauuggacaaugaauuuggcaucuccaaauuggaauaauuaugauccaaccgaagaaacuccugcaccacuaggaacaccagacuucguaggcaaaauccacggaauguuaacacaaacaacccaaggaucugguucaacuagggcucauagagccacuguuuauguaggaucagccgaauuuacaccaaaacucgguaaaguuagauucgaaacagauacugaagaugacuuaguaaucagacaaaacacaaaauucacaccaguaggaguaauacaaucaucagagcaucauagagaugagccacaacaauggagacuaccaaauuacucuggcgcaaauacauuuaacguacaucucgcaccagcuguagccccaaacuuuccaggagaacaacuauuauucuuuagauccacacuaccaggauguggaggacauccuaauauggauuuagacugcuuauuaccacaagaauggguucaacauuuuuaucaagaagcugcacccgcacaauccgauguagcuuuauuaagauuuguaaauccagauacuucacgaguacuauuugaauguaaauuacauaaauccggauaugucaccguagcccauacaggacaauacgaucuaguucuuccaagcaacggauacuucagauuugacucuuggguaaaucaauuuuauacauuagccccaaugggaaacggcacaggaagaagaagauaa

SEQ ID NO: 34826 - RNA, 1614 nt, Artificial Sequence
  derived and/or modified sequence opt6 from VP1__Norovirus_and/or_Norovirus-like__KF712493
augaaaauggcaucuucagacgcaaacccaucagauggcucuacagcaaacuuagucccagaagccaacaacgaaguaauggcacuugaacccgucguaggagcagcuauagcagccccaguagcuggacaacaaaacguaaucgacccuuggauaagaaauaacuuuguacaagcaccagguggcgaauuuacaguauccccaagaaacgcacccggcgaaguucuaugguccgcaccucucggaccagaccuuaacccauacuuaucacaccuugccagaauguauaauggauaugcaggaggauuugaaguacaaguuauacuagccggaaacgcauucgccgcagguaaaauaauauuugcugcaguaccaccaaacuuuccaacagaaggccucucuccaucacaaguaacaauguuuccccaccucauaguugacguaagacaacuagaaccaguaaugaucccauuaccugacauacgaaacaauuucuaucauuauaaucaaucaaacgaucccacaauuaaacuaauagcaaugcuauacaccccucuaagagcaaauaacguuggagacgaugucuuuacaguuucuugccgaguucucacacgucccaguccagacuucgauuucauauuccuaguacccccaacaguagaauccaaaacuaauccauuuucagucccuauauuaaccauagaagaaaugacaaauucacgauuuccaauaccuuuagaaaaauuauuuacagguccauccucugcacuuguaguacaaccacaaaacggacgaugcaccacagacggaguauuauuaggcacaacacaacuuucaccaguaaacauaugcacauucagaggagauguaacccauacaacuaaaacccacacauaccaaaugaauuuagcagcacaaaacuggaacagcuaugacccaaccgaagaaauaccagcaccucuugguacaccagacuucguagguaaaauacaaggcguauuaacacaaacaacaaaagguaacggaucaacucgagcacauaaagccaccguauauacaggaggaguugaauuuacaccaaaacuaggacguauucaauuauuuaccgauacugauaaugaccuagaagccaaucaaaauacaaaauucaccccagucggaguaauacaagacggugacacacaccaaaacgaaccacaacaauggguucuaccaucauauucaggacgaaauaaucacaauguacaucuagccccugcaguagcaccgaccuucccaggcgaacaauuacuauuuuuccgaucuaccaugccaggcuguucaggauaccccaacaugaaccuagacugccuauuaccccaagaauggguucaauacuuuuaccaagaagccgccccugcacaaucugauguagcacuauuaagauuuguaaauccagacacagguagaguauuauucgaaugcaaacuacacaaaucaggauacguaacagucgcacauacuggacaccaugaccuauuuauaccaccuaacggauauuucagauuugacucauggguuucaccauuuuacacacuagcaccuaugggcaauggaacaggacgacgaagauaa

SEQ ID NO: 34827 - RNA, 1614 nt, Artificial Sequence
  derived and/or modified sequence opt6 from VP1__Norovirus_and/or_Norovirus-like__FJ411169
augaaaauggcaucaaaugaugcaaacccaagugacggcucaacagcuaaccuuguuccugaaguaaacaaugaaguaauggcacuagaacccguaguaggugcugcaauagccgcuccagucgccggacaacaaaauguaauagacccuuggauaagaaauaacuucguacaagcaccuggaggagaauuuacaguaucaccucgaaaugcaccaggugaaauucuuuggucugcaccacuugguccagauuuaaauccauaucuaucgcaccucgcacgaauguauaacggauacgcaggcgguuuugaaguacaagucauauuagcaggcaaugcauuuacagcaggaaaaauaauauuugcugcagucccuccaaacuucccaacagaaggucuuucaccaucacaaguaaccauguuuccgcacauaauaguagacgucagacaacuagaacccguucuaauaccccuaccggacguacgaaacaacuuuuaucacuauaaccaaagcaacgacucaacuauaaaacucauagcaaugcuauauacuccacuaagagcaaauaaugcaggagcugacguauuuacaguaucacgacggguauuaacacgaccaucaccagauuuugacuucauauucucaguuccuccuacgguugaaucacguacaaaaccauucacagucccaauauuaacagucgaagaaaugucaaauuccagauuuccaauaccucuugaaaaacucuauacaggaccaucaucagcauuuguaguucaaccacaaaauggaagauguacaacagauggaguccuauuagguaccacacaacuuucagccguuaauauauguacuuuucgcggagauguuacacauauagcaggcucacacgauuacacaaugaauuuagcaucacaaaauuggaauaacuacgauccaacugaagaaauaccagcaccauuagguacaccagacuucguagguaaaauacaaggaauguuaacacaaacaacaagagaagauggaucaacucgagcucacaaagcaacaguuucaaccggcucuguacacuuuacuccaaaacuaggauccguccaauacaccaccgauacaaauaaugauuuccaaacaggacaaaauaccaaauucacaccuguuggaguaauacaagaugguaauaaucaccaaaacgaaccacaacaauggguauuaccaaacuacucugguagaacaggucacaauguacaucuagcaccagccguugcacccacauuuccaggcgaacaacuauuauucuuuagaucuacuaugccaggauguuccggauacccaaacaugaacuuagauugucuacuaccucaagaauggguacaacacuuuuaccaagaagcagcaccagcacaaucggauguagcucuacuuagauuuguaaauccagauacagggagaguacuauuugaauguaaacuccacaaaucagguuauguuacaguagcacacaccggaccucaugauuuaguaauaccuccaaauggauacuuuagauuugauucaugggucaaccaauuuuacacauuagcaccaaugggaaauggagccggucguagacgauaa

SEQ ID NO: 34828 - RNA, 1614 nt, Artificial Sequence
  derived and/or modified sequence opt6 from VP1__Norovirus_and/or_Norovirus-like__AF427121
augaaaauggcaucaaaugaugccaauccuuccgauggaucaacagcuaacuuaguaccugaaguuaacaaugaaguaaugacucuugaacccguaguaggagcagcaauagcugcuccuguagcaggacaacaaaauguaauagauccuuggauaggaaauaauaucguacaagcaccaggaggagaauuuacaguaaguccuagaaaugccccuggugaaauuuuauggucugcaccauuaggaccagaccuuaauccauacuuaagccaucuagcuagaauguauaacggauacgcaggaggauucgaaguccaaguaauacuagccggcaaugcauucacagcuggaaaaauaauauuugcugccguaccaccaaacuuuccaacugaagguuuaucacccucucaaguaacagucuuuccucauauaauaguagauguucgucaacuagaaccaguacuaaucccacucccagaugucagaaauaauuuccaccacuacaaucaaucaaaugacucaacuauuaaacuuauagcaauguuauacacaccacuaagagcuaauaaugcaggagacgauguauuuacaguuuccugucguguauuaacaagaccaucacccgacuuugacuuuauauuucuaguaccaccuaccauagaaaguagaaccaaaccauucacuguaccuauacuaaccguagaagaaaugucuaacuccagauuuccuauaccacuagaaaaacuauauacugguccuucuucagcauuuguuguacaaccucaaaacggacgcuguacaaccgauggcguauuacucggaacaacucaacuaagcgcuguaaauauaugcacuuuuagaggagacguaacacauaucgcaggaucucaugacuauacaaugaaucuagccucacaaaauuggaacaacuacgaucccacagaagaaaucccagcuccauuagguaccccagacuuuguaggcaaaauacaaggaguacuaacacaaacaacuagagaagacggaucuacaagagcucacaaagccacaguuucgaccggaucuguacacuuuacaccaaaauuaggcucaguacaauauacaacagacacuucaaacgacuuucaaacaggacaaaauaccaaauucacucccguuggaguaauccaagauggaaauaaucaccaaaacgaaccacaacaauggguauuaccaaauuacucaggaagaacaggacauaauguucauuuagcuccagcuguagcaccaacauuuccaggagaacaacuucuauucuucagaucaacaaugccuggauguucaggauauccuaacaugaauuuagacuguuuacuaccacaagaauggguacaacauuucuaccaagaagcugcacccgcacaaagcgauguugcauuacuaagauucgucaauucugacaccggcagagucuuauucgaauguaaauuacacaaaucaggauacguaaccguagcacauacagguccacaugacuuaguaauaccaccaaauggauacuuuagauuugauucguggguaaaucaauuuuauacauuagcaccaaugggaaacggugcagguagaagacgauaa

SEQ ID NO: 34829 - RNA, 1614 nt, Artificial Sequence
  derived and/or modified sequence opt6 from VP1__Norovirus_and/or_Norovirus-like__KF429787
augaaaauggcuuccaaugaugcaacacccuccgacggcucaucagcuaaucuaguaccagaagcaaauaaugaaguuauggcccuagaacccguagcaggagcagcuauugcagcaccaguagccggacaacaaaacguaauugauccuuggaucagaaacaauuucguacaagccccaggcggagaauuuaccguaucucccagaaaugcaccaggugaaauacuuuggucagcaucauuaggaccagauuuaaauccauauuuaucucaccuaucacgaauguauaacggcuaugcaggcucauucgaaguacaaguaauauuagcuggaaaugcauuuacagcaggaaaaauaauauucgcugcaguuccaccaaacuuuagaacagaaggacuaucuccaucccaaaucacaauguuuccacauauuauaaccgauguuagacaacucgaaccggucuuaauaccauuaccagauauacguaauaauuuuuaucacuauaaucaaucaaaugauccuacaauaaaacuuauagcaauguuauauacaccauuacgagcuaacaaugcaggagacgauguauuuacaguaucaugccgcguauuaacacgaccaucuccagacuuugacuucauauuuuuaguucccccuacaguugaaucucgaacaaaaccauuuaguguuccuguacuaacaguagaagaaaugacaaauucuagauuuccaauuccauuagaaaaauuauuuacaggcccauccuccgcauucguuguacaaccacaaaauggacggugcacaacagacgguguauuacuaggaacaacacaacuaucacccguaaauauuugcacauucagaggagacguaaccagaaucgguaacucuagagaauaccgaaugaauuuagcuucauuaaacuggaauaauuacgauccaacugaagaaauuccugcaccuuuagguacuccagauuuugcaggaaaaauacaagguguacuaacacaaacaacacgacaugacggauccacuagaggacauaaagccacagucuauacaggaucagccggauuuacuccaaaacuuggaucaguacaauuuuccacggauacagauaacgaucuagaagcaaaccaaaauacacgauuuacacccguuggugucauacaagacgguaaugcccaucaaggagaaccccaacaauggguuuuacccaauuaugcaggaagagacggacauaacguacauuuagcaccagcaguagcaccaacauuuccuggcgaacaauuauuauuuuucagaucaacuaugccugguugcuccgguuaucccaauaugaaccuagacugucuacuaccgcaagaauggguacaacacuucuaccaagaaucagcaccagcacaaucagauguagcuuuacuuagguuuguaaauccagauacaggaagaguucuauuugaaugcaaauuacauaaaucaggauaugucacaguugcacacacaggaccucacgaucuuguaauaccaccaaauggauauuuucgauuugauucuuggguuaaccaauucuauacauuagcaccuaugggaaauggugccggacgccguagauaa

SEQ ID NO: 34830 - RNA, 1614 nt, Artificial Sequence
  derived and/or modified sequence opt6 from VP1__Norovirus_and/or_Norovirus-like__AB933728
augaaaauggcaucaaaugacgccaauccaucagauggaucagcagccaauuuaguaccagaaguaaauaaugaaguaauggcccuagaaccaguugucggagcugccauugcagcaccaguagccggccaacaaaauguaauagauccauggauaagaaauaauuuuguacaagccccugguggagaauuuacaguaucaccacgaaaugccccaggcgaaauacuaugguccgcaccacuuggcccagauuuaaacccuuaccuaucucaucuagccagaauguauaauggauaugcaggaggauuugaaguacaaguaauucuugccggaaacgcuuucaccgcaggcaaaaucaucuuugccgcaauaccuccaaauuuuccaacagaaggucuaucaccuucacaagucacaauguuuccacauauaguugucgauguaagacaacucgaaccaguucuuaucccacucccagacguaagaaauaauuuuuaccauuacaaucaaacaaaagaaucaacaaucaaauuaguugcaaugcuauauacaccacuuagagcaaauaacgcaggcgaugacguuuucacuguuuccugcagaguccuaacaagaccaucgccagacuuugauuucauauucuugguaccaccaucuguugaaucaagaacaaaaccauucacuguacccauacuaacuguagaagaaaugacaaacagucgauucccgauacccuuagaaagauuauuuaccggcccaucaucagcuuuuguaguucagccacaaaauggaagaugcacaacagaugguguucuacuaggaacuacccaacuauccccagucaacauauguacauucagaggcgauguaacuagaguaucaacaacacacguauaugaaaugaacuuagccucccaaaauuggaauaacuaugaccccacagaagaaguuccagcgccccuaggaacaccugacuucguagguaaaauacaaggaguuuuaacucaaaccaccagaacugacggaucaacacgagcccauaaagcaaccguaucaacaggagcagcagauuuuaccccuaaauuaggauccauaagauuugaaacaacuacaaacagagacuuagaaacacaccaaaauacaaaauucacaccaguaggaguuauacaagauggcgauaaucaucaaaaugaaccacaacaauggcgauuacccggauaugccggaagagaugcacauaauguacaucuagcaccagcaguagcaccuacauuucccggugaacaacucuuauucuuuagaucaacaaugccagguuguucagguuacccaaauaugaaucuagacugccuauuaccacaagaauggguacaacauuucuaucaagaagcugcaccagcacaaucugacgucgcuuuauuaagauuuguuaauccagacacaggaagaguacuuuuugaaugcaaauuacauaaaucaggauauuuaacuguugcucacacaggaccauacgaucuaguaaucccaccaaacggcuauuucagauucgauucauggguaaaccaauuuuacacauuagcuccaaugggcaaugguacaggcagaagaagauaa

SEQ ID NO: 34831 - RNA, 1614 nt, Artificial Sequence
  derived and/or modified sequence opt6 from VP1__Norovirus_and/or_Norovirus-like__KX514346
augaaaauggcaucaaaugacgcuaauccuagcgaugguucagcagcaaaccuaguaccugaaguaaauaacgaagucauggcauuagaaccagucguuggugcagcaauagccgcaccagucgcaggucaacaaaauguaauagacccauggauaagaaauaauuuuguccaagcuccaggaggcgaauuuacaguaucuccaagaaaugccccuggcgaaauauuauggucagcaccauuaggucccgaccuaaacccauaucuaucacaccuagcaagaauguacaaugguuaugcaggaggauucgaaguacaaguaauacuagcagguaaugcuuuuacugccggaaaaauaauuuucgcagcaguuccaccaacauucccaacagaaggauuaucuccaucacaaguaacaauguuuccacacaucauuguagauguucgucaacuugaaccaguacuaauuccacucccagauguaagaaauaauuuuuaccacuacaaccaauccaacgacucaacaauuaaauuaauugcuauguuauacacaccacucagagcuaacaauccaggagaugauguauucacuguaucuugccguguauuaacacgaccaucaccagacuuugacuuuaucuuucuagucccaccgacaguagaaucucgcacuaaaccauuuucaguaccuaucuuaaccguaggagaaaugacuaacucacgauucccuguaaaccuagaaagauuauuuacaggaccuaguucagcaaacguagugcaaccacaaaacgguagauguacaauagauggugaacuauuaggaacaacacaauuaucaucaguaaauauaugcacauuucgaggagacguaacacaaauaggauccacaaaacauuggaccaugaauuuagcuucaccaaauuggaacaacuaugauccuacagaagaaacuccugcaccacucgguacaccagauuucguaggaaaaauacauggcauguuaacacaaacaacacaagaaaaugguucaacaagagcacacagagcaacaguauacguaggcgguuccaauuuuacacccaaauuaggaaaagucccauucgaaacagauacaggagaugaucuugcuauacgacaaaauacaaaauuuacaccuguuggcgucauccaaucaucaggacaucaucgugacgaaccacaacaauggagacuaccuaauuauucaggagcaaacacauucaacguccauuuagcaccagcagucgcaccaaauuuuccaggagaacaacuccuauuuuucagaagcacacucccaggauguggaggccauccuaauauggaucucgacugccuauuaccacaagaauggguccaacauuuuuaccaagaagcagcaccagcacaaucugauguagcacuucuaagguuuguaaauccagauacaucaagaguucucuuugaauguaaacuacacaaaucagguuaugucacaguagcacacacaggacaauaugauuuaguucucccaucaaaugguuauuuuagauucgauucauggguuaaucaauuuuacacauuagcaccaaugggaaaugguacuggaagacgccgauag

SEQ ID NO: 34832 - RNA, 1614 nt, Artificial Sequence
  derived and/or modified sequence opt6 from VP1__Norovirus_and/or_Norovirus-like__KX514249
augaaaauggccucaucagaugcaaauccaucagauggauccgcugcaaaucuaguaccugaagucaacaacgaaguuauggcucuagaaccaguuguaggugcagcaauagcugcaccaguagcaggacaacaaaacguaauagacccauggaucagaaauaacuuuguacaagcccccggaggugaguucacaguuucaccaagaaaugcaccuggagaaauauuauggucagcaccacuaggcccagauuuaaaucccuauuuaagccauuuagccagaauguauaauggauaugcaggcggauuugaaguacaaguaauucuagcugguaacgccuuuacggcaggaaaaaucauauuugcagcaguacccccaacauuuccaaccgaaggacuauccccaucacaaguaaccauguuuccacauaucaucguagacguaagacaauuagaaccaguucuaauaccauuaccagaugucagaaauaauuucuaucauuauaaccaaucuaaugauagcacuauaaaacuaauagcaauguuauacacaccacucagagcuaacaaucccggagaugacguauuuacaguaucauguagaguauuaacaagaccaucuccagacuuugaccuaaucuucuuaguacccccaacaguagaaucacgaacaaaaccauucucuguaccuauacuaacaguaggagaaaugacaaacucuagauuuccaaucaauuuagaaggucuauuuacaggaccaucaucagcaaacgucguccaaccacaaaauggaagauguacuauagauggugaacuauuaggcaccacacaacuuucuucugucaauauauguacauucagaggagacguaacacauauaggaucuacacaucauuggacuaugaaucuugcaucaccaaacuggaacaacuacgauccaacagaagaaacuccugcaccacuaggaacaccagauuuugucgguaaaauacauggaaugcuaacacaaacaacacaaggaucugguucuacaagagcacauagagcaacaguauauguuggaggugccgaauuuacaccaaaauuaggaaaaguacaguuuaaaacagaaaccaaccacgaccuaucuauacgacaaaauacaaaauuuacacccguuggaguaauacaagaaucagaucaucacagagaugaaccacaacaauggagacuaccaaacuauucaggagcaaacaccuucaauguacauuuagcaccagcaguagcaccaaauuucccuggagaacaauuacuauucuuuagaucaacccuaccaggcugcggaggccacccaaacauggacuuggacugcuuacuuccccaagaauggguacaacacuuuuaucaagaagcagcacccgcacaaucagauguagcacuucuacgauucguaaaucccgauacaucucgaguacuauuugaaugcaaacuccacaaaucaggauacgucacaguagcacacacaggucaauacgacuuaguacuaccaucuaacggauacuuuagauuugacuccuggguaaaucaauucuacacacuugcaccaaugggaaacgguacaggaagaagaagauaa

SEQ ID NO: 34833 - RNA, 1614 nt, Artificial Sequence
  derived and/or modified sequence opt6 from VP1__Norovirus_and/or_Norovirus-like__KF429760
augaaaauggcaucaaaugacgcuacaccuucagacggaucaucugcaaaccuugucccugaaguaaacaacgaaguaauggcacuagaaccaguagcaggagcugccauagcagcaccaguggcaggacaacaaaauguaauugauccauggauuagaaauaacuuuguucaagcaccuggaggugaauuuacaguaucaccaagaaaugcaccaggugaaauauuauggucagcaucauuaggaccugaucuaaaccccuacuuaucccauuuaucaagaauguauaaugguuaugcaggcucauucgaaguacaagucauauuagccgguaacgccuuuacagcuggaaaaauaaucuuugcagcuguaccaccaaacuucagaacagaaggcuuaucaccaucacaaauaacgauguuuccacacauuauaacugacguuagacaacuagaaccagucuuaauaccacuaccagauaucagaaauaacuuuuaucauuauaaucaaucaaacgacccuacaauaaaauuaauugcaauguuauacacuccacuuagagcaaauaaugcaggcgacgauguauuuacaguauccuguagaguuuuaacuagaccaucacccgacuuugauuuuauuuucuuaguaccacccacaguugaaucuagaacaaaaccauucucuguuccuguacuuacaguagaagaaaugacaaauagcagauuuccaauaccacuagaaaaauuauuuacaggaccaaguuccgcuuuuguaguucaaccacaaaauggccgcuguacuacagaugguguauuacuaggaacaacucaacuaucaccaguaaacauauguacauuuagaggagauguaacucgaauagguaauucucgagaauaccgcaugaaucuagcaucacuuaacuggaacaauuaugaucccacagaagaaauaccugcaccacuaggaacaccagauuucgccgguaaaauccaaggcguauuaacacaaacaacaagacaugacggaucaacucgaggucauaaagcaacuguauacaccgguucagcaggcuuuacuccaaaauuaggcucaguacaauuuucaacugauacagauaaugaucuagaagcaaaucaaaauacacguuuuacaccaguaggagucauacaagauggaaaugcacaucaaggcgaaccucaacaauggguauuacccaauuacgcaggcagagauggacacaauguucaucucgcaccagccguagcaccuacauucccuggugaacaacuauuauucuucagaagcacaaugccaggaugcucaggauacccaaauaugaacuuagauugcuuauuaccacaagaauggguacaacauuuuuaccaagaaucagcuccugcacagucagacguugcacuacuaagauuuguaaacccagauacaggaagaguacuauuugaaugcaaacuccauaaaucuggauacguaacaguugcccauacagguccacacgaccuaguaauaccaccaaacggauauuuucgauuugacucauggguaaaccaauuuuauacccuagcaccuaugggaaacggagccgguagacgaagauaa

SEQ ID NO: 34834 - RNA, 1614 nt, Artificial Sequence
  derived and/or modified sequence opt6 from VP1__Norovirus_and/or_Norovirus-like__AB303929
augaaaauggcaucaaaugacgcaaaccccucagacggaucugcagcaaaucucgucccugaaguaaacaaugaaguuauggcuuuagaacccgucguaggugcugcaauagccgcaccagucgcuggacaacaaaacauaauugaccccuggauuagaaauaauuuuguacaagcaccaggcggagaauuuacaguaucuccaagaaaugcaccuggagaaauucucuggucugcaccacucggaccagaccuaaacccauauuuaucacacuuaucacgaauguauaacgguuaugcuggcggauuugaaguacaaguaauacuagcaggaaacgcuuucacagcaggaaaaguuaucuuugcagcaguaccaccaaacuuuccaacugaaggacuuucaccaucacaaguaacaauguuuccccauauaauaguagacguaagacaauuagaaccaguauuaauaccucuaccagauguaagaaacaauuucuaucauuauaaccaagcacaugauaguacacuaaaacuaauagcaauguuauacacaccacuacgagcaaacaaugcuggagacgauguauuuacaguaucauguagaguccuaacaagaccaucaccugacuucgauuucauuuucuuaguaccuccaaccguagaaucacgcacaaaaccauuuacaguaccaguauuaaccguagaagaaaugacaaacucacgcuucccaauaccacuugaaaaacuauacacaggccccucauccgccauaguaguacaaccccagaacggucgaugcaccacagacggaguauuacuagguacaacccaacucagcgccgucaacauaugcacuuuuaggggugaugucacacauauagccggaucacgaaauuacacuaugaaccucgcuucacaaaacuggaacaauuaugacccaacagaagaaauaccugcaccauuaggaacacccgacuuuguaggcaaaauacaaggauuacuaacacaaacaacaagagcagauggcucaacucgugcacacaaagcaacaguaucuaccgguucaguacacuucacaccaaaauugggaucuguacaauuuucaacagauacagacaacgauuuccaaccaggacaaaauacaaaauucacaccaguaggaguaauacaagauggcgaucgccaccagaacgaaccacaacaauggguauuaccagauuucucaggacgaaccggacauaauguacauuuagcuccagccguugcacccacauucccaggagaacaauuauuauucuuuagaucaacaaugccaggccgaucagguuaccccaauaugaauuuagacugcuuauuaccacaagaauggguuuuacauuuuuaucaagaaucagcaccagcacaaagugacguagcacuucuaagauuuguaaauccagauacaaauagaguauuauuugaauguaaauuacacaaaucaggcuacauuacaguagcacacacaggucaccaugauuuaauccuaccaccuaacgguuacuuuagauucgauucuuggguuaaccaauucuauacucuagccccaaugggaaauggagcaggucgaagacgauaa

SEQ ID NO: 34835 - RNA, 1614 nt, Artificial Sequence
  derived and/or modified sequence opt6 from VP1__Norovirus_and/or_Norovirus-like__KX514363
augaaaauggcaucaucagacgcaaacccaucagauggaucaacagcaaauuuagucccagaaguaaauaaugaaguuauggcacucgaaccaguaguaggagcagccauugcugcacccguugccggccaacaaaacgucauagauccauggauaagaaauaacuucguucaagcucccggcggagaauuuaccguaucaccaagaaaugcaccaggagaaauacucuggucagcacccuuagguccagaccuaaacccauauuuaucacaccuagcccgaauguacaacggauacgcaggaggauucgaaguacaagugauccuagcaggcaacgcauuuacagcaggaaaaauaauauucgcagcaguaccaccaacauuucccacagaagguuuaucacccagucaaguaacaauguuuccucacauaauaguagauguaagacaacucgaaccaguacuaauuccucuaccagacguaagaaacaacuuuuaccacuacaaccaaucuaaugauuccacaauaaaacuaauagcaauguuauacacaccacuacgagcaaauaauccaggagacgauguauucacaguaucaugcagaguucuaaccaggccaucaccagauuucgacuucauauuucucguaccaccaacaguugaaucaagaacaaaaccauuuucaguaccaauacuaacaguaggagaaaugacaaacucaagauuuccaaucaacuuggaaagacucuuuacaggaccauccuccgcaaacgucguacaaccacaaaauggacgaugcacaauagacggagaacuucuaggcacaacacaauuaucaucaguaaauauaugcacauuuagaggagacguaacacaaauaggcucuacccagcacuggaccaugaaucuagcaucaccaaacuggaauaauuacgauccgacagaagaaacaccagcaccacuagguacaccugacuuuguaggaaaaauacacggaaugcuuacacaaacaacucaagaaaacgguuccacucgagcacacagagcaacaguauacgucggaggcgcaaacuuuacaccuaaauuaggaaaaguacgauuugaaacagacacaggcgacgaucuagccauaagacaaaauacaaaauuuacuccagucggaguaauacaaucaagugaccaccacagagacgaaccacaacaauggagauuaccaaacuauucaggagcaaacacauucaauguacaccuagccccagcuguagcaccaaauuuccccggcgaacaauuauuauucuuuagaucaaccuuaccaggauguggcggacauccaaacauggaucuagacuguuuacucccacaagaauggguacaacacuuuuaccaagaagccgcuccugcacaaucggauguagcauuauuaagauuuguaaaccccgauacauccagaguauuauuugaaugcaaacuacauaaaucaggauacguuacaguagcacacacaggacaauaugacuuaguacuaccaagcaauggcuauuuuagauuugacucauggguaaaccaauuuuauacacuggcaccaaugggaaauggcacaggaagaagaagauag

SEQ ID NO: 34836 - RNA, 1614 nt, Artificial Sequence
  derived and/or modified sequence opt6 from VP1__Norovirus_and/or_Norovirus-like__KX514357
augaaaauggcuuccucagacgcuaacccuuccgauggcucugcagccaauuuaguaccggaaguaaauaaugaaguaauggcacuagaaccaguaguaggagcagcaauagcagcuccaguagcaggucaacaaaauguuauagauccauggauuagaaauaauuuuguacaagcaccaggaggagaauuuaccguaucaccaagaaacgcaccuggagaaauauuaugguccgccccacuagguccagaucuuaauccauauuuaucucacuuagcuagaauguacaacggauacgcuggaggauucgaaguacaaguaauucuagcagguaacgcuuuuacugcaggaaaaauaauauucgcagcaguaccuccaacauucccaacggaaggacuuagcccaucacaaguaacaauguuuccccauauaauaguugacguacgacaacuagaaccagucuuaaucccccuuccugauguucguaacaauuucuaccacuacaaucaaucaaacgacucuacaauuaaauuaaucgcuaugcuauauacuccuuuaagagcaaacaauccuggagacgaugucuuuacaguuucauguagaguucugacacgaccuucuccugacuuugacuuuauuuucuuaguaccuccaacaguagaaucaagaacaaaaccuuucucagucccaauauuaacaguuggagaaaugacaaacucaagauuuccaauaaaccuagaaagacuauuuaccggaccaucaucugcaaauguaguacaaccacaaaacggaagaugcacaauugacggagaacuacuagguacaacacaacuuuccucaguaaauauaugcacuuucagaggugacguuacccacauaggaucaacccaucauuggacaaugaaucucgcaucaccaaauuggaauaacuaugaccccacagaagaaacaccagcuccccuuggaacacccgacuuuguuggaaaaauacacggcaugcuaacacaaacaacucaaggaucaggaucuacaagagcucaccgcgccacaguuuauguagguucugcugacuuuacuccaaaauuaggaaaaguacaauucgaaaccgaaacagaccaugaccuagccauaagacaaaacaccaaauucacaccaguaggaguuauacaagaaucagacaaccauagagaugagccacaacaauggagacuaccaaauuacucaggagccaauacauuuaauguacaccuagcuccagcaguagcaccaaauuuuccaggugaacaauuacuauucuuuagauccacaauaccaggaugugguggucacccaaacaugaaucuugacugucuacuaccacaagaguggguacaacauuuuuaccaagaagcugcgccugcacaauccgacguagcacucuuacguuuuguaaacccagacacaucacguguucuauucgaaugcaaauuacauaaaucagguuacgucacaguugcucacacaggacaacaugauuuaguuauaccacccaauggauacuuucgauucgacucauggguaaaucaauucuauacacuagcaccaaugggaaacggcacaggaagaaaaagauaa

SEQ ID NO: 34837 - RNA, 1614 nt, Artificial Sequence
  derived and/or modified sequence opt6 from VP1__Norovirus_and/or_Norovirus-like__KX514240
augaaaauggcauccaacgaugcuaauccaucagacgguagcgcagcaaaccucgucccagaaguaaauaacgaaguuauggcucucgaaccaguagucggagcagcaauagcugcuccaguugcuggacaacaaaauguaauagacccuuggauaagaaacaacuuuguacaagcacccggaggagaauuuaccguaucaccacgaaaugcaccaggagaaauacucuggucagcuccauuaggcccagaccuaaacccauacuuaucacaucuagcaagaauguacaacggauaugcuggaggauucgaaguacaaguaauucuagccggaaacgcauuuacugcaggaaaaauaauauuugcagcagucccaccuaacuucccaacagaaggacuaagcccaucacaagucacuauguucccccauauaauugucgauguuagacaacuagaaccaguauuaauaccauuacccgauguacgaaacaacuucuaccacuacaaucaaucuaaugauuccacaauaaaacuaauugccauguuauacacuccucuaagagcaaauaaugccggugaugauguauucacuguaucaugcagaguauuaacaagaccaucacccgacuuugacuucauuuuccuugucccaccaaccgucgaaucaagauccaaaccauucucaguaccuguauuaacuguagaagaaaugaccaauucuagauuuccagcaacucuagauaaacucuuuacaggaccuucuucuacauuuguaguacaaccacaaaauggaagauguaugauugauggaguucuacuaggcacaacucaacuuucaccuguaaacauaugcacuuuuagaggagaugucacacauccaagagauucuccuauauauacaaugaauuuagcaucacccaauuggaauaauuaugauccaacagaagaaauaccugcaccccuaggaacaccugacuuuguagguaaaauacaugguaugcuuacacaaacuacacaaggaucuggcuccacacgagcacauagagcaacuguauauguaggaucagcagaauuuacaccaaaauuagguaaaguacaauuccaaacagaaacagaagaugauuuaguaauucgacaaaauacaaaauucacaccaguaggcguaauacaagaaucugaccaucauagagaugaaccucaacaauggguccuaccauccuauucaggacgagauacaccaaauguacaucuagcacccgcuguagcacccacauucccaggugaacaacuauuauuuuuccgaaguacaauuccagguuguggcggucaccccaauaugaaucucgacugcuuacucccacaagaauggguacaacacuuuuaucaagaagcagcaccagcccaaucagacguagcacucuuaagauucguaaaccccgauacaucucgaguucuauucgaauguaaacuacacaaaucagguuauguuacuguagcacauacaggacaacaugaccuagucauaccacccaauggcuacuuuagauucgauagcugggucaaucaauuuuauaccuuagcacccaugggaaauggaaccggccgaaaaagauaa

SEQ ID NO: 34838 - RNA, 1614 nt, Artificial Sequence
  derived and/or modified sequence opt6 from VP1__Norovirus_and/or_Norovirus-like__AF414417
augaaaauggccucaaaugaugcaaaucccagcgacggaucagcugcuaauuuaguaccggaaguaaacaaugaaguaauggcacuagaaccgguaguagaugcagcaauagcagcaccaguagccggacaacaaaauguaauagauccauggauuagaaacaacuucguacaagcaccaggaggagaauuuaccguuucuccuagaaacgccccuggcgaaauccuauggucugcaccauuaggaccagauccuaauccuuaucuaucacaccucucuagaauguauaauggauacgcuggagguuucgaaguucaaguaauucuagcuggaaaugcauucaccgcagguaaaguaauauucgcagcaguaccuccaaauuuuccaacagaaggauuaucaccuucacaaguaacaauguucccucacauuauuguugacguuagacaauuagaaccaaugcuaauaccauuaccugacguaagaaacaauuuuuaccacuauaaucaagcaaacgacuccacauuaaaauuaauagcaacacuauacacaccacuuagagcuaauaaugcuggagaugacguauuuacaguaaguugucgaguauuaacucgccccucuccggacuucgauuuuauuuuucuuguaccaccaacaguagaaucgcgcacaaaaccauucacaguaccaguucucacaguagaagaaaugucuaacucacguuucccaauaccauuagaaaaacuuuauacuggaccaaguagugcauuuguaguucaaccccaaaacgguagauguacuacagauggaguuuuacuagguacaacacaacucucagcaguaaacauaugcaauuuucgaggcgauguagcacacauagcaggaucacaugacuauacaaugaauuuagcuucccaaaauuggucuaacuacgauccuacugaagaaauaccugcaccauuaggaacuccugacuuuguaggaaaaauccaaggacuacuaacacaaacuacaagagcagacggacucacuagagcacauaaagcaacaguaucaacaggaucuguacauuuuacaccaaaacuuggauccguacaauuuacuacugauacaaauaacgauuuccaagcaggacaaaacacaaaauuuacuccaguagguguaauucaagauggagaucaucaucaaaaugaaccucaacaaugguuauuacccaauuacuccgguagaaccggucacaauguacaccuagcucccgccguagcgccaaccuuucccggagaacaauuauuauuuuuccgaucaacaaugccaggauguucaggauauccaaacaugaacuuagacugccuacuaccucaagaauggguauuacauuuuuaccaagaagcggcaccagcacaaagugacguagcacuucuaagauuuguaaauccagauaccggaagaguauuauuugaauguaaauuacauaaaucaggauauauaacaguagcucauacaggacccuacgaucuaguacuaccaccaaacggauauuuucgauuugacucauggguaaaccaauuuuauacacuugcacccaugggaaauggaaccgggcgacgaagauaa

SEQ ID NO: 34839 - RNA, 1614 nt, Artificial Sequence
  derived and/or modified sequence opt6 from VP1__Norovirus_and/or_Norovirus-like__KX514303
augaaaauggcauccagugacgcaaacccuucugauggcucaacagcaaaccuaguuccagaagucaauaaugaaguuauggcauuagaaccaguaguaggagcagcaaucgcagcaccagucgcaggccaacaaaauguuauugauccauggauaagaaacaacuuuguacaagcaccaggaggagaauuuacaguaucaccaagaaaugcuccaggagaaauauuauggucagcaccauuaggcccagauuuaaacccauauuuaucacauuuagcaagaauguauaacggcuacgcuggugguuucgaaguacaaguaauacuagcuggaaaugccuuuacagcaggaaaaauaauauucgcagcuguaccaccuacauuuccaacugaaggccuaagccccucacaaguuacaauguucccacauauaauaguagauguuagacaauuagaaccaguacuaauaccauuaccagauguaagaaauaauuucuaucauuacaaccaaaguaacgacuccacaauaaaacuuauagcaaugcuauauacaccauuacgagcuaacaacccaggagaugacguuuucacaguauccuguagaguauuaacaagaccuagucccgauuucgauuucauauuucuaguaccaccaaccguugaaucaagaacaaaaccuuuuagcguaccaauauuaacaguaggagaaaugaccaacucaagauuucccguaaaccuagaaagacuauuuacagguccaucaucugccaacguaguacaaccacaaaauggaagauguacaaucgacggagaauuauuaggaacaacacaauuauccucaguaaacauauguacuuuucguggagacgucacacaaauaggcucaacaagacacuggacaaugaaucuugcaucuccaaauuggaauaauuaugacccuacugaagaaacuccagcuccacucggaacaccagacuuuguuggaaaaauacacggaaugcuaacccaaacaacacaaggauccggaucaacaagagcacauagagccacuguauacguaggaucagcagaauuuacacccaaacuaggcaaaguacgauucgaaaccgauacagaagaugauuuaguaauacgacagaacaccaaauuuacacccgucggaguaauacaaucaagugaccaccaucgugaugagccucaacaauggcgauuaccuaacuacucaggagcaaauacauuuaauguacauuuagcaccagcaguagcaccuaauuucccaggagaacaauuacucuucuuuagaucaacauuaccuggaugcgguggacaucccaacauggaucuugauugucuauuaccacaagaauggguacaacauuuuuaucaagaagcagcuccugcacaauccgacgucgcacuucucagauucguaaauccagauacaucacgaguguuauucgaaugcaaacuacauaaaaguggauacguaacugucgcacauacaggacaauacgaucucguacuaccaucaaauggauacuuucgauuugauucauggguuaaccaauucuacacucuagcaccaaugggaaacggaacaggaagaagaagauaa

SEQ ID NO: 34840 - RNA, 1614 nt, Artificial Sequence
  derived and/or modified sequence opt6 from VP1__Norovirus_and/or_Norovirus-like__KX514273
augaaaauggcaucaucagacgcaaaccccagcgacggcagcaccgcaaaucucguaccagaaguuaauaaugaaguaauggcuuuagagccaguaguaggagcugcuauagcugcaccuguagcaggucaacaaaacguaauagauccauggauuagaaauaacuucguacaagcaccaggaggcgaauuuacuguuucaccuagaaacgcuccuggagaaaucuuguggucagcaccauuagguccagaucuuaauccauaucuaucucacuuagcccgaauguauaaugguuaugccgguggauuugaaguacaaguaauacucgcagguaaugcauuuaccgccggaaaaauaauauuugccgcaguucccccaacauucccaacagaaggauuaagucccucacaaguuacaauguucccacacauuaucguugacguaagacaacuagaaccuguauuaauaccauuaccagacguaagaaauaacuuuuaucauuauaaccaaucuaacgacucuacaauaaaacuaauagccauguuauacacaccauuacgagcaaacaaugcaggcgaugaugucuucacagucucaugcagaguauugaccagaccaucaccagauuucgauuucaucuuuuuaguaccacccacagucgaaucaagaucaaaacccuuuucagucccuguauuaacaguagaagaaaugacuaauucaagauuuccagcaacauuagauaaacuuuuuacaggcccaucuucaacauuuguaguacaaccacaaaauggacgauguaugauugacggcguuuuauuaggaacuacacaauuaucaccaguuaauauuuguacauuucgcggagacguaacacauccacgagacucaccuauauauacaaugaaucuagcaucaccuaauuggaacaacuaugauccaacagaagaaauaccagcaccauuaggcacuccagauuucacaggaaaaauacaagguauguuaacacaaacaacaaaaggagaaggaaguacaagaggacacagagcaaccguauauguaggcucugcugaauuuacaccuaaauuaggaaaagucagauuugaaacagauacagaagacgauuuaguuauaagacaaaauacaaaauucacaccaguuggaguuauacaauccagcgaucaccacagagaugaaccacaacaauggagauuaccuaauuauucuggagcaaauacauuuaauguacaucuugccccagcaguagcacccaauuuuccaggagaacaacuauuauucuuuagaucaacuuuaccuggcugugguggacauccaaauauggaccucgacuguuuacuaccacaagaauggguccaacauuuuuaucaagaagcagcacccgcccaaucugauguugccuuauuaagauuuguaaauccugauacaucaagaguacuuuuugaauguaaacuccauaaaucaggcuacguaacaguagcucauacuggacaauaugacuuaguauuaccaucaaaugguuauuuucgauucgacaguuggguaaaucaauuuuauacauuagcaccaaugggaaauggcacaggacgaagaagauaa

SEQ ID NO: 34841 - RNA, 1614 nt, Artificial Sequence
  derived and/or modified sequence opt6 from VP1__Norovirus_and/or_Norovirus-like__KX514323
augaaaauggcaaguaaugaugcaaauccaagcgauggaucagcagccaauuuaguaccugaagucaacaaugaaguaauggcacuagaaccaguaguaggagcagcuaucgccgcccccgucgcaggacaacaaaaugucauagauccauggauaagaaauaacuuuguacaagcuccaggaggagaauuuaccguaucaccacgaaaugcaccaggcgaaauuuuauggucagcacccuuaggaccagacuuaaauccauaccuaucucaucucgcaagaauguacaauggauacgccgguggauucgaaguccaaguaauacuagcaggaaaugcauuuacugcaggaaaaauaauauucgcagcagucccaccaaauuuuccaacagaaggacuaucacccucacaaguaacuauguucccucacauaauaguugauguacgucaacucgaacccgucuuaauaccauuaccagacguacgaaacaauuucuaucacuauaaucaaucaaaugacucaacaauaaaauuaaucgcaaugcuuuauacuccacuaagagcaaacaaugcgggugacgacguauucacaguuucaugucguguccuaaccagaccaucuccagacuucgacuuuauauuuuuaguaccaccuacaguagaaucaagaucuaaaccuuuuaguguaccaguauuaacaguugaagaaaugacuaauaguagauucccagcaacccuagacaaauuauucacuggaccaucuuccacauucguuguacaaccacaaaacggaagauguaugauugauggcguacuuuuaggaacaacccaacuauccccaguaaauauuuguacuuucagaggugauguaacacacccaggcaauuccaaaauauacacuaugaauuuagcaucuccuaacuggaacaauuacgacccaacagaagaaauaccugccccacuaggaacaccagacuucguaggcaagauacacgguauguuaacacaaaccacccaagaaaauggaucaacaagagcacaccgcgcaacaguuuacguaggaggagcaaacuucacaccaaaacuaggaaaaguacaauucgaaacagacaccggagacgaccuagcaauaagacaaaacacaaaauucacuccaguaggaguuauacaaucuucugaucaccacagagaugaaccacaacaauggcgcuuaccuaauuauucuggagcaaacaccuuuaauguacaccucgcaccagcaguugcuccaaauuucccaggugaacaauuauuauucuuucgaucaacaauaccuggaugcggcggacacccaaacaugaauuuagacugccuucuaccacaagaauggguacaacauuuuuaucaagaagcagcaccagcacaauccgacguagccuuacuccgauuugucaacccugauacaucccgaguauuauucgaauguaaauuacauaaaagugguuauguaacaguagcacauacaggucaacaugacuuaguaauuccaccuaauggauacuucagauuugauucuuggguuaaccaauucuacacacuagcaccuaugggaaacggaacuggaagaaaaagauaa

SEQ ID NO: 34842 - RNA, 1614 nt, Artificial Sequence
  derived and/or modified sequence opt6 from VP1__Norovirus_and/or_Norovirus-like__KX514364
augaaaauggcuucaucagacgcaaacccaucagauggcucuacagccaauuuaguaccugaaguaaauaaugaaguuauggcucuagaaccagucguaggagcagccauagcagcaccuguagcuggacaacaaaacguaauagacccauggauaagaaauaacuuuguccaagcuccaggaggcgaauuuacaguaucaccaagaaacgcaccuggcgaaauauuguggucugcaccacuagguccagauuuaaauccauaucuuucucacuuagcuagaauguauaauggauacgcaggaggauucgaaguacaaguuauacuagcaggcaacgcauuuacugcaggaaaaauaauauuugccgcaguaccucccacauuuccaacagaaggucuaucaccuucacaaguaacaauguuuccacauauuauaguagauguaagacaacuagaaccaguacuaauaccacuaccugacguaagaaacaauuuuuaucacuacaaccaaucaaaugauucuacuauaaaauuaauagcuauguuauacacaccucucagagcaaacaauccaggcgacgaugucuuuacaguuucaugcagaguacucaccagaccaaguccagacuuugauuucauauuuuuaguaccuccaacuguagaaucccgaacaaaaccauuuucaguaccaauccuaacaguaggagaaaugacaaauucccguuuuccaauaaaccuugaaagauuauucacuggaccaucauccgcaaauguuguacaaccacaaaauggacgauguacuauagacggcgaacuccuaggaaccacccaacuauccucuguaaacauauguacauuuagaggagauguaacacaaauaggaucaacaaaacauuggacuaugaaucuugcuucacccaacuggaacaacuaugauccaacagaagaaacuccagcaccauuagguacaccagauuuugucggaaaaauacacgguaugcuaacacaaacaacacaagaaaacggcucaacaagagcucaccgcgcuaccguauaugucgguggagcuaauuuuacaccaaaauuaggaaaaguucaauuugaaacagacacaggugacgauuuagcaauacgucaaaauacaaaauuuaccccaguaggaguaauccaauccucagaucaucaccgagacgaaccacaacaauggagguuaccaaacuacucuggggcaaacacauucaauguccaccuagcaccagcuguagcacccaauuuccccggagaacaacuauuauuuuuccguucaacacuaccaggauguggcggucauccaaauauggauuuagauugccuacuuccacaagaauggguucaacauuucuaucaagaagcagcaccagcccaaucugauguagcuccacuaagauuuguaaauccagauacaucccgaguacuauuugaauguaaacuucauaaaucaggauacguuacaguagcacauacaggucaauaugauuuaguacuucccucaaacggauauuuuagauuugacucauggguaaaccaauucuauacccuagcaccaaugggcaaugguacaggacgaagaagauaa

SEQ ID NO: 34843 - RNA, 1614 nt, Artificial Sequence
  derived and/or modified sequence opt6 from VP1__Norovirus_and/or_Norovirus-like__KX514338
augaaaauggcuucaaacgaugcuaauccauccgauggauccgcagcaaauuuaguaccagaagucaauaacgaaguaauggcauuagaaccaguaguaggagcugcaauagcagcuccuguagcuggacaacaaaacguaauagauccauggaucagaaauaauuuuguacaagcaccuggaggugaauuuacaguuaguccaagaaaugcaccaggagaaauacucuggagcgcuccacucggaccugacuuaaauccauaucuaucacauuuagcccguauguauaauggauaugcaggaggauucgaaguacaaguaauauuagcagggaacgcauuuacagccggcaaaauaauauuugcugcaguaccaccaaacuucccaacagaaggacuuucaccuagccaaguaacaauguuuccacauauaauaguagacgucagacaauuggaaccugucuuaauaccucuacccgaugucagaaauaacuuuuaucauuauaaucaauccaacgauucaacaauuaaauuaauagcaauguuauauacaccauuaagagccaauaacgcaggagacgacguauuuaccguaucauguaggguacuaacaagaccaucaccagauuuugacuuuauauuucuaguaccaccuacaguugaaucaagaucaaaaccauucucagucccaguuuuaacaguagaagaaaugacaaacuccagauucccugcaacacuagauaaacuuuuuacaggcccaucaucgaauuuuguaguacaaccacaaaauggaagauguaugaucgauggaguauuacucggaacaacucaauuaucaccaguaaauauaugcacauuuagaggagauguuacccaaaucgguucuacaaagcacuggacaaugaacuuagccucuccuaauuggaauaauuaugacccaaccgaagagacaccagcaccacucggaacaccagauuucguaggcaaaauucauggaauguuaacccaaacaacacaagaaaacggauccacaagagcacauagagcaacaguauaugucggaggagcuaacuuuacaccaaaacuugguaaaguccaauucgaaaccgacacaguagacgacuuagaaauaagacaaaacacaaaauucacaccaguuggaguaauacagaguucagaucaucaucgagacgaaccacaacaauggagacuaccaaauuauucaggagcaaauacauuuaacguacauuuagcuccagcaguagcacccaauuucccuggagaacaacuauuauuuuucagaucaacacuacccgguugcggaggacacccaaacauggauuuagacugucuucuaccacaagaauggguacaacauuuuuaccaagaagcugcacccgcucaaucagacguagcacuacuaagauuuguaaacccagauacaucaaggguacuuuucgaauguaaauuacauaaaucaggauauguaaccguagcacacaccggucaauaugaucuaguucuaccaagcaauggauacuucagauucgauucauggguuaaccaauuuuacacacuagccccaaugggaaacggaacaggaagaagacgauaa

SEQ ID NO: 34844 - RNA, 1614 nt, Artificial Sequence
  derived and/or modified sequence opt6 from VP1__Norovirus_and/or_Norovirus-like__KX514316
augaaaauggcauccuccgacgcaaacccuagcgauggaucaacagcaaaucuaguaccagaagucaacaacgaagucauggcucuagaacccguaguaggagcagcaauagcagcacccguagcaggccaacaaaaugucaucgaccccuggauucgaaacaauuuuguacaagcaccaggaggagaauuuacaguaucaccaagaaaugcuccaggagaaauccuauggucagcaccauuaggaccagauuugaacccauaccuuucucauuuagcaagaauguauaacggauaugccggaggauuugaaguacaaguaauacuagcagguaacgcuuuuacagcaggaaaaauaaucuucgcugcaguaccaccaacuuuuccaacagaaggauuaucaccaucacaaguuacuauguuuccacauaucauaguagauguuagacaauuagaaccaguuuuaauaccccuaccagacguaagaaacaauuuuuaccauuauaaucaaucaaacgacucaacaauaaaacuaaucgcaauguuauauacaccauuacgagcaaacaauccaggagaugauguauuuacaguaucaugcagaguacuaaccaggccaucacccgauuuugacuucauauuucuaguaccuccuacagucgaaucuagaucaaaaccauucuccguuccaguacuaacaguugaagaaaugacaaauucuagauuuccggcaacauuagacaaauuauucacaggacccucauccacauuugucguacaaccucaaaauggccgaugcaugaucgaugguguacuacuuggaaccacacaauuaucaccaguaaauauuuguacuuuucguggcgauguaacacacccaagagauucuaaaaucuauacaaugaaccuagcaucacccaacuggaauaacuaugacccaacagaagaaauuccagcaccacuaggcacaccagacuucguugguaaaauccaaggaauguuaacacaaacaacaaaaggagaaggaucaacaaggggucacagagcaacaguauauguaggaucagcaaauuacgcaccaaaacucggaagaguacaauucgaaacagacaccacagaugacuuagaugcacaccaaaauacuaaauuuaccccaguaggaguuauacaaucuucagaccaucauagagaugaaccacaacaauggagacuacccaauuacucaggagccaauaccuucaacguacaccuugcaccagcaguagcuccaaauuucccaggagaacaacuauuauucuucagaagcacccuaccaggcugcggaggacauccaaacauggauuuagacugcuuacuaccacaagaauggguacaacauuuuuaucaagaagccgcaccagcacaaucagauguagcauuacuaagauucguaaacccagauacaucuagaguucuauuugaaugcaaacuucauaaaucaggauacguaaccguugcacacacaggacaauacgaucuaguacuuccaucaaacggauacuucagauucgacucauggguaaaucaauucuauaccuuagcaccgaugggaaauggaaccggcagaaaacgauaa

SEQ ID NO: 34845 - RNA, 1614 nt, Artificial Sequence
  derived and/or modified sequence opt6 from VP1__Norovirus_and/or_Norovirus-like__KX514356
augaaaauggcaagcucagaugcaaaucccucagacggcagcgcagcgaauuuaguaccagaagucaauaacgaaguaauggcacuagaaccuguuguaggagccgcaauagcagcaccaguagcaggacaacaaaauguaauagacccauggauacgaaacaauuuuguacaagcaccaggaggugaauuuacuguaucaccacgaaacgcaccuggagaaauacuuuggucagcaccauuaggaccagauuuaaauccauaucucucacaucuagccagaauguauaauggauaugcuggaggauuugaaguacaaguaaucuuagcaggaaaugcauuuacagccggcaaaaucauuuuugcugcuguaccacccaccuuuccaacagaaggccuaagucccucacaaguaacaauguucccacauauaauaguagacguuagacaacuagaacccguauuaauaccuuuaccagacguucguaauaauuguuaucacuauaaucaauccaaugauaguacaauaaaauuaauagcaauguuauacacaccacuucgcgcuaauaauccaggugaugauguauucacaguaucauguagaguacucacuagaccaagucccgacuuugauuuuauauuccuaguaccaccgacaguagaaucacgcacaaaaccauucucaguaccaauacuaacaguaggagaaaugacaaauucacgauuuccaauuaaucucgaacgauuauuuacaggaccaucaucagcaaauguaguacaaccucaaaacgguagauguacaauagauggagaauuauuaggcacaacacaauuaucaaguguuaauauuugcacauuccgaggagacgucacccauauaggaucaacccaucauuggauaaugaaucuagcaucaccaaacuggaauaauuaugauccaacagaagaaacccccgcuccacuaggaacuccagauuuuguaggaaaaauacacggaauguuaacacaaacuacacaaggauccggaucuacucgagcacauagagcaacagucuauguaggcucagcugacuucacaccaaaauuaggaaaaguacaauucgaaacagaaacugaccaugaucuagccauuagacaaaauaccaaauuuacaccaguuggaguaauacaagaaucagaucaucacagagacgaaccccaacaauggcgauuaccaaacuauucaggagcaaauacuuuuaauguacacuuggcucccgcagucgcuccaacuuucccaggagaacaauuauuauucuuuagauccaccauuccaggauguggaggacacccuaacaugaaucuagauuguuuacuaccacaagaauggguacaacauuuuuaccaagaagcugcuccagcacaaucagacguagcuuuacuuagauuuguaaauccagacacuucucguguauuauucgaauguaaauuacacaaauccgguuauguuaccguagcucauacuggacagcacgaucuuguaauaccaccuaaugguuauuuccgauuugacucauggguuaaucaauuuuauacauuagcccccauggguaauggaaccggcagaaaaagauaa

SEQ ID NO: 34846 - RNA, 1614 nt, Artificial Sequence
  derived and/or modified sequence opt6 from VP1__Norovirus_and/or_Norovirus-like__KX514349
augaaaauggcaucaaacgaugccaaucccucagauggaucagcugcaaauuuaguacccgaaguuaauaaugaaguuauggcauuagaaccaguuguuggugcagcuauagccgcaccugucgcuggacaacaaaauguaaucgauccauggauuagaaauaacuuuguacaagccccaggaggugaauuuacaguauccccacgaaaugccccaggagaaauauuauggucugcuccccuagguccugacuuaaacccuuacuugagucacuuagcaagaauguauaauggauacgccggaggcuucgaaguacaaguaaucuuagcagguaaugcauuuacagcaggaaaaauaauauuugcugcaguuccuccaaacuuuccaacagaaggccuaucaccaucacaaguaacuauguucccucacauuaucguagauguuagacaauuagaaccaguauuaauaccauuaccagacguacgaaacaauuuuuaccauuacaaccaaucaaaugauaguacaauaaaauuaauagcuaugcuauauacuccuuuaagagcuaauaauccuggggacgauguauucacuguuucauguagaguacuaacaagacccucccccgauuuugacuuuauauuuuuaguaccaccuacaguagaaagcagaucaaaacccuuuucaguaccaguauuaacuguagaagaaaugacaaauuccagauucccagcaacauuagacaaauuauuuacaggaccuuccucaacauuuguaguacaaccacaaaacgggagaugcaugauagauggugucuuauuaggcacaacacaauuaucuccuguaaacauuuguacuuuuagaggagacguuacacaaucuggcaauaccaaaauuuacacaaugaauuuagccaguccuaacuggaauaauuaugauccuacagaagaaaucccagcaccacuaggaacuccagacuuuguagguaaaauucaagguauguuaacccaaaccacaaaaggugaaggaucaaccagaggacaccgugcuacuguuuaugucggaggagcggaauuuacuccaaagcuaggaaaaguaagauuugaaacagauacagaagaugaccuaguaauaagacaaaauacaaaauuuacuccaguaggaguaauccaaacauccgaaaaucauagagaugaaccacaacaauggagauuaccaaacuacucaggacgugauacaccaaauguacaucuagcacccgccguagcaccuacauucccuggagaacaauuauuauuuuuccgcucaacuauaccaggauguggaggccauccaaacaugaauuuagacugucuucuuccccaagaauggguucaacacuucuaccaagaagcagcaccagcucaaucagaugucgcauuauuaagauuuguuaauccagacaccucaagaguguuauuugaauguaaacuccauaaaucaggauauguaacaguugcacacacaggacaacacgauuuaguaauaccaccaaauggauauuuuagauuugauucauggguaaaucaauucuacacacuagcucccaugggaaauggaacgggaagaaaaagauaa

SEQ ID NO: 34847 - RNA, 1614 nt, Artificial Sequence
  derived and/or modified sequence opt6 from VP1__Norovirus_and/or_Norovirus-like__KX514217
augaaaauggcaucuaaugaugccaacccaucagacggaucagcagcaaaucucgugcccgaaguaaauaacgaagucauggcacuagaaccuguaguaggagcagcuauagcagcuccagucgcuggucaacaaaacgucauagauccuuggauaagaaacaauuucguucaagcccccggaggugaauuuacagucucaccaagaaaugcaccaggagaaauacuauggucagcucccuuaggcccagaccuaaacccauacuuaucccauuuagcacgaauguauaauggcuaugcaggaggauucgaaguacaaguaauacuagccggaaacgcuuuuacagcaggaaaaauaaucuucgcagcaguacccccuacauucccaacagaaggcuuauccccgucacaaguaacaauguuuccacauauuauaguagauguuaggcaauuagaaccagucuuaauuccacuaccugauguucgaaauaacuucuaucauuauaaccaaucaaaugauucuacaauaaaacuaauagcaauguuauauacuccucuaagagcaaauaacgcaggagaugacguauuuacagucucauguagaguauuaaccagacccucuccugauuuugacuuuauuuucuuaguaccaccuacugucgaaucaagaucaaaaccauuuuccguaccuguacuuacaguagaagaaaugaccaacagcagauucccagcaacacuagauaaacuauuuacaggcccaucauccaccuuugucguacaaccacaaaacggacgaugcaugauagacggugucuuauuaggaacuacacaauuaucaccuguaaacaucugcacauuuagaggagauguaacacauccaagagauucaccuaucuauaccaugaauuuagccucccccaacuggaacaauuaugauccaaccgaagaaauaccugcaccauuaggcacgccugauuucguaggaaaaauacaaggcaugcuaacacaaacaacccaaggaucaggaucuacaagagcacaccgagcaacaguauacguuggcuccgcagaguucacuccuaaacuaggaaaaguacaauuucaaacagaaacugaucaugaccuuguaauacgucaaaacaccaaauucacaccugucgguguaauacaagaaucugaucaucauagagaugaaccacaacaauggagacuuccaaacuauucaggugcuaauacauucaauguacauuuagcuccugccguagcucccaacuuuccuggagaacaauuauuauuuuuccgaucaacccuaccagguuguggcggacauccuaauauggaucuagacugcuuacuuccacaagaauggguacaacauuuuuaccaagaagcagcaccagcacaauccgacguagcuuuacuaagauucgucaauccagacacaucucgaguacuauuugaaugcaaacuacauaaauccggauauguaacaguagcacauacaggacaauacgacuuaguauuaccaucaaauggauauuuccguuuugauucauggguaaaucaauuuuacacacucgcaccaaugggaaaugguacaggaagaagacgguaa

SEQ ID NO: 34848 - RNA, 1614 nt, Artificial Sequence
  derived and/or modified sequence opt6 from VP1__Norovirus_and/or_Norovirus-like__KX514324
augaaaauggcauccagugaugccaacccaucagauggaucuacugccaaucuaguuccagaaguaaauaacgaaguuauggcucuagaaccaguuguaggagcagcaaucgcagccccagucgccggccaacaaaauguuaucgauccauggauacgaaauaacuuuguacaagcaccaggaggagaauuuacaguuucaccuagaaaugcacccggagaaauacuauggucugcaccacucggcccagacuuaaacccauaccuaucacacuuagcaagaauguauaacggauacgcaggaggcuucgaaguacaaguaauauuagccggaaaugccuucacagcaggaaaaaucauauuugcagcaguaccaccaacauucccaacagaaggucugucaccaucacaaguaacaauguuuccucacauaauaguugacguaagacaauuagaaccaguacuaauaccacuaccugauguucgaaacaauuucuaucauuauaaccaauccaaugacuccacaauaaaauuaauagcuaugcuauacacaccauuaagagcaaacaaccccggagaugacgucuuuacaguaucauguagaguuuuaacccgaccaucaccagauuucgauuuuauauuucuaguaccaccaaccgucgaaucaagaucaaaaccauuuucaguaccgguauuaacaguagaagaaaugacaaacucaagauuuccugccacucuagacaaacuuuuuacuggcccaucuuccacuuucguaguacaaccacaaaacgguagaugcaugauagacgguguauuacuaggcacaacacaauuauccccaguaaauaucuguacuuuuagaggagauguaacacauuccggaaacucuaaaauuuauacaaugaacuuagcaucaccaaauuggaacaauuaugacccaacagaagaaauacccgcaccacuaggaacaccagauuuugucggaaaaauacaaggaaugcuuacacaaacaacaaaaggagaaggaucuacaagaggucauagagccacaguauacguagguggugcaaacuuuacaccaaaauuaggcaaaguacaauuugaaaccgauacaguagacgaucuagaaaucagacaaaauacaaaauuuacaccagucggaguaauacaaucaagugaccaucacagagacgaaccacaacaauggagacuaccuaauuacuccggagcaaacacauucaauguucaccuagcaccagcuguagcaccaaauuuuccaggagaacaacuuuuauuuuucagaucuacuuuaccaggaugugguggucaucccaacauggaccuagacugccuauuaccacaggaauggguacaacauuucuaucaagaagcagccccagcacaaucagauguagcacuacuacguuucgucaauccugacacuuccagaguacuauuugaauguaaacuccauaaaucaggauacguaacaguagcacauacaggccaacacgaucuaguaauuccaccuaacggauauuucagauuugauuccuggguaaaccaauucuacacacuugcuccuaugggaaacggcacaggaagaaaaagauaa

SEQ ID NO: 34849 - RNA, 1614 nt, Artificial Sequence
  derived and/or modified sequence opt6 from VP1__Norovirus_and/or_Norovirus-like__KX514306
augaaaauggcaucaucagacgcaaacccaucagauggauccacagcaaacuuaguaccagaaguaaacaaugaagucauggcucuagaaccaguuguaggaguagccauagcagcgccuguagcaggacaacaaaaugucauagaucccuggauccgaaauaauuucguacaagcacccgguggagaauuuacagucucaccuagaaaugcaccuggcgaaauacuauggucugcaccacuaggaccugaucuuaauccauacuuaucucacuuagccagaauguacaacggauacgccggaggauucgaaguacaaguaauauuagccgguaacgcauuuacagccgguaaaauuauauucgccgccgucccaccaacauucccaacagaaggauuaucuccuagucaagucaccauguucccccauauaauaguagauguaagacaacuagaaccaguauuaauuccauuaccagauguaaggaacaacuucuaucacuauaaccagucaaaugacucuaccauaaaacuuauagcaauguuauacacuccacuccgagcaaacaacccaggugaugauguauuuauaguaucaugucguguccucacuagaccaucaccugacuucgauuuuauauucuuaguaccuccaacaguagaaucaagaaccaaacccuucucaguacccauauuaaccguuggagaaaugacaaacucacgauuuccaauuaaucuagaacgauuauucacaggcccaucaucugcuaauguaguacaaccccaaaacggaagaugcaccauagauggugaacuauuagguacaacucaacuaucaucagucaacauaugcacauuucgaggagauguaacacaaauagguucuacacaacauuggacuaugaauuuagcuucaccaaacuggaacaauuaugauccaaccgaagaaacacccgcaccuuuaggaacucccgacuuuguagguaaaauacaaggaaugcuuacccaaacaacucaagaaaacggauccacaagagcacacagagcaaccguauauguaggaggagcaaacuacgcucccaaacuaggaaaaguacaauucgaaacagacacaggagacgaucuugccauacgucaaaauacaaaauucacaccaguaggaguaauucaaucuucagaccaucaucgagacgaaccacaacaauggcgucuuccaaacuauucaggugcaaacacuuuuaacguccauuuagcucccgcaguagcaccaaauuucccuggagaacaacuuuuauucuuuagaucaacauuaccaggaugcgguggacacccaaauauggauuuagacuguuuacuaccacaagaauggguacaacacuuuuaccaagaagcagccccugcccaaucagauguaacauuacucagauuugucaauccagauacaucuagaguucuauuugaaugcaaauuacacaaaucaggauacguaaccguagcacauacaggacaauacgauuuagucuuacccucaaacggauacuuuagauuugacuccuggguaaaccaauuuuauacacuagcaccuauggguaauggcacaggaaggcgucgauaa

SEQ ID NO: 34850 - RNA, 1614 nt, Artificial Sequence
  derived and/or modified sequence opt6 from VP1__Norovirus_and/or_Norovirus-like__AB186063
augaaaauggcauccaaugacguuaauccaucagacggaucugccgcaaaccuaguaccagaaguuaacaaugaaguaauggcacucgaaccagucguaggagcagcuaucgcagcuccaguagcaggccaacaaaauauaauagacccauggauaagaaauaacuuuguacaagccccagguggagaauuuacaguauccccaagaaaugcaccuggagaaauccuauggucagccccacuuggcccagaccuaaauccauaucuaucacacuuaucaagaauguacaacggauaugcaggagguuucgaaguacaaguaauucuagcuggcaacgcauucacagccggaaaaguaauuuucgccgcaguaccacccaacuucccaacagaaggacuaucacccucacaaguaacaauguucccgcauauaauugucgauguaagacaauuagaaccagucuuaaucccauuacccgauguaagaaacaauuuuuaucauuacaaccaagcucaugauucaacacucaaauuaauagcaauguuauacacuccacuaagagccaacaaugcaggagaugauguauuuacaguauccuguagaguacuuacaagaccuucacccgauuuugacuucauauuuuuagucccuccuacagucgaaucacguacuaaaccauuuacaguccccguucuuaccguugaagaaaugacaaauucaagauuuccaauaccccucgaaaaauuauacacuggaccaucuagugcauucguaguucaaccucaaaacggcagauguacuacugacggaguacuacuuggaacaacacaacuauccgcugucaauauaugcacauuucgaggagauguuacacacauagcgggaucaagaaauuauacaaugaaucuagcaucccaaaacuggaacaauuacgacccaacagaagaaaucccagcaccuuuagguaccccagauuuuguagguaaaauacaaggacucuuaacacaaaccacacgcgccgacggaucaacaagagcucauaaagcaacagucucaacaggaucaguucauuuuacuccuaaauuaggaucaguccaauucuccaccgauacagauaacgacuuccaaccaggacaaaauacaaaauucacaccaguaggaguuauucaagacggagauagacaccaaaacgaaccacaacaauggguucuacccgauuauucaggaagaacaggacacaauguacaucuagcaccagcaguagcuccaacauucccuggagaacaacuauuauuuuuccgauccacaaugccuggauguucaggauacccaaacaugaacuuagauuguuuauuaccacaagaauggguacuucauuuuuaccaagaaucagcuccugcacaaucagauguagcauuacuuagauuugucaauccagauacaaaucgaguuuuauucgaaugcaaauuacacaaaucaggauauauaacuguugcacauacuggacaacacgacuuaauauuaccaccuaauggauacuuccgauuugauucuuggguuaaccaauucuacacacuugcaccaauggguaacggcgcagguagaagaagauaa

SEQ ID NO: 34851 - RNA, 1614 nt, Artificial Sequence
  derived and/or modified sequence opt6 from VP1__Norovirus_and/or_Norovirus-like__AF406793
augaaaauggcauccucagaugcaaacccaucagauggauccacagccaauuuaguaccagaaguaaacaaugaaguaauggcuuuagaaccagucguuggagcagccauagcaggaccaguagcagggcaacaaaauguaauugauccauggauacgcaauaauuuuguacaagcaccaggaggagaauuuacuguuagccccacaaaugccccaggugaaauauuauggucagcaccccucggaccagauuuaaaucccuacuuaucucauuuagcgagaauguacaauggauaugcugguggauuugaaguacaaguaauacuagcagguaaugcauuuaccgcaggaaaaauaauauuugcugcaguuccaccuaauuucccaacagaaggucuauccccaucccaaguuacaauguucccacacauuauaguagacguaagacaauuagaaccuguacugauaccacuacccgacgcaagaaacaauuuuuaucauuauaaucaaucuaaugauucaacaauaaaauuaauugcaaugcuauauacuccacuaagggcaaauaaugccggugaugauguuuucacaguaucauguagaguauuaacccgaccaucaccagacuucgauuuuauauuucucguuccaccaacaguagaaucuagaacaaaaccauuuaccguccccauucuuacagucgaagaaaugucaaauaguagauuuccaauuccauuagaaaaacuauacacaggaccaucaucaguuuuuguaguacaaccacaaaacgguagaugcacuacugacgguguacuccuaggaacuacacaauuaucagcaguuaauauuugcacauuuagaggagauguaacacacauagcagguucacaugauuauacuaugaacuuagcaagucaaaauuggaacaacuaugauccaacugaagaaaucccagcaccacuaggaacaccagacuuuguagguaaaauacaggguauguuaacacaaacaacaagagaagauggaucaacaagggcaacgaaagcaacaguaucaacaggaucuguacauuuuacaccaaaacuugguucuguacaauauacagccgauacaaauaaugauuuucaaacaggucaaaauacaaaauuuacuccagucggaguuauccaagauggcucaaaccaccaaaaugaaccccaacaauggguauuaacaaacuauucaggucgaacuggacacaauguacauuuagcaccagcaguagcaccaacauucccaggagaacaauugcuguucuuuagaucuacaaugccaggaugcucagguuaucccaacaugaaucuagauugucuguuaccucaagaauggguacaacauuuuuaccaagaagcagccccagcucaaucagauguggcauuacucagauuuguuaacccagauacaggucgaguccuuuucgaaugcaaacuacauaaaucuggcuauguaacaguagcucacacagguccacaugaucuagucauaccaccaaacggauacuuucguuucgacccauggguaaaucaauuuuacaccuuagcaccaaugggaaauggcgcaggaagaagaagauaa

SEQ ID NO: 34852 - RNA, 1614 nt, Artificial Sequence
  derived and/or modified sequence opt6 from VP1__Norovirus_and/or_Norovirus-like__KX514223
augaaaauggcaucuagcgacgcaaauccaagcgacggaucaacagcgaacuuaguaccagaaguaaacaaugaaguaauggcuuuagaaccaguaguaggagccgcaaucgcagccccaguagccggccaacaaaauguaauagacccauggauacgaaacaacuuuguacaagcaccaggaggugaauuuacuguaucaccaagaaaugcaccuggagaaaucuuauggucagcaccacuagguccagacuuaaacccuuaccuuucacacuuagcacgaauguauaacggauaugcaggaggauucgaaguccaaguaauucuugcaggaaaugcauucacagccggaaaaauaaucuucgcagcaguaccaccaacauucccuacagaaggauuaaguccaucacaaguaacaauguucccccacauaauuguagauguaagacaacuugaaccaguauuaauaccacuaccagacgucagaaauaauuucuaccauuacaaucaaucaaacgacucaacaauaaaacuaaucgcuauguuauauacaccacuaagagcaaauaaucccggugacgacguauuuacaguaucaugcagagucuuaacacgaccaucaccagacuucgacuuuauauuuuuaguaccuccaacaguagaaucaagaacaaagccauucucagucccaauauuaaccguaggagaaaugacaaauuccagauuccccaucaauuuagaacgucuauuuacuggaccaucaucagcaaauguuguacaaccacaaaacggcagaugcacaauagauggagaauuauuaggaacuacucaacucucaucaguuaauauauguacauucagaggagacgucacacauauuggcuccacacaucacuggacaaugaaucuagcaucccccaauuggaauaacuacgacccaaccgaagaaaccccugcaccuuuaggaacaccugauuuuguaggaaaaauccacggcauguuaacacaaacaacacaaggaucaggcuccacaagagcucacagagcuacaguauacgucggaucagcagacuucaccccaaaauuagguaaaguccaauuugaaaccgaaacagaucacgaccuugcaauaagacaaaauacaaaauucacacccguaggagucauacaagaaucugaucaucauagagaugaaccacaacaauggcgucuuccaaacuauucaggagccaacacauucaauguacauuuagccccagcaguagcuccaaauuucccagaugaacaacuacuauucuucaggucuacacuaccaggaugcggaggacauccaaacauggaucuugacuguuuauuaccacaagaauggguacaacauuuuuaccaagaagcagcacccgcucaaucagauguagcccuucuaagauucguaaacccugacacaucaagaguauuauucgaaugcaaacuacauaaaaguggauacgucaccguagcacacacaggacaacacgauuuagucauaccaccuaacggcuacuucagauucgauucauggguaaaccaauuuuacacauuagccccaaugggaaauggaacaggacgcaaaagauaa

SEQ ID NO: 34853 - RNA, 1614 nt, Artificial Sequence
  derived and/or modified sequence opt6 from VP1__Norovirus_and/or_Norovirus-like__KX514318
augaaaauggccucaaacgacgcaaacccaucagauggaucagccgcaaaccuaguaccagaaguaaauaaugaaguaauggcacuagaaccaguuguaggagcagcaauagcagcccccgucgcaggacaacaaaacguaauugauccuuggauuagaaauaauuucguucaagcuccaggaggagaguucacagucucaccacgaaacgcaccaggugaaauauuaugguccgcaccacuaggucccgacuuaaauccuuaucucucccaccucgcacguauguauaacggauacgcaggagguuuugaaguacaaguaauacuagcaggaaaugcauuuacagccgguaaaaucauuuucgcagcuguaccaccuacauucccaacagaaggacuaucaccaucacaaguaaccauguuuccacacauaauuguugacguuagacaauuagaaccagucuuaauaccacuaccugacguucgaaauaauuucuaucauuacaaucaaucaaaugacucaacgaucaaacuuauagcaaugcuauacacaccauuaagagcaaauaauccaggcgacgacguauucacagucucauguagaguccuaaccagaccaucaccagauuuugauuucauauuuuuagucccacccacagucgaaucaagaaccaaacccuucucuguuccuauucuaacaguaggcgaaaugacuaacucaagauuuccuguaaacuuagaacgccuauuuacaggccccucaucagcaaacguuguccaaccacaaaauggcagaugcaugauagacggaguauuacucggcaccacacaauuaaguccuguaaacauaugcacauucagaggagacguaacccauccuggaggaucaaaaauuuacaccaugaaucucgcaucaccaaauuggaauaauuacgauccaacagaagaaauaccugcaccauuaggaacaccagacuucguagguaaaauucacggcaugcuuacacaaacaacacaagaaaacggaucuacaagagcucauagagcaacaguauauguaggaggugcaaacuucaccccuaaacuaggcaaaguucaauucgaaaccgauacagaagaugaucuagcaauacgacaaaauacaaaauucacaccaguuggaguaauccaauccucagaccaucauagagaugaaccacaacaauggagacuaccuaauuacuccggaagagacaccccaaacguacaucuagcucccacaguagcaccuaacuuuccaggagaacaacuccucuuuuucagaucaacacuaccaggaugcggaggacacccaaacauggacuuagacuguuuauuaccacaagaauggguacaacacuucuaucaagaagcagcaccagcacaaucagacguaacacuauuaagauuuguaaauccagauacaagccgaguacuauucgaaugcaaacuucauaaaucaggauauguaacaguagcacauacuggccaacacgacuuaguaauaccaccaaaugguuacuucagauucgacaguuggguuaaccaauucuauacacuggcaccaaugggaaacggaacaggucgaaaaagauaa

SEQ ID NO: 34854 - RNA, 1614 nt, Artificial Sequence
  derived and/or modified sequence opt6 from VP1__Norovirus_and/or_Norovirus-like__AB186065
augaaaauggcuucaaaugauguaaauccaucagauggaucagcagcaaaccuaguaccagaaguaaacaaugaagucauggcauuagaacccguagucggagcugcaauugcugccccgguugcuggccaacaaaauaucaucgacccauggauuagaaauaacuuuguacaagcaccaggaggagaauuuacuguaucaccccgcaaugcaccaggugaaauucucuggagcgccccacuaggacccgauuuaaacccauauuuaucccaucuaucuaggauguauaacgguuaugcaggaggcuucgaaguacaaguaauucuagccggaaaugcauucaccgccgguaaaguuauauuugcugcuguacccccaaacuucccaacugaaggccuaucaccaucacaaguaacaauguucccacacauaauuguagacguuagacaauuagaaccaguacuaaucccauuaccagacgucagaaacaacuuuuaucauuauaaucaagcacaugauagcacauuaaaacuaauagcaauguuauacacaccacuaagagcaaauaaugccggcgaugauguauuuacaguaucaugccguguacuaacuagaccaucaccagauuucgacuuuauauuccuagugcccccaacaguagaauccagaacaaaaucuuucacuguuccuguauuaacaguagaagaaaugacaaacuccagauucccaauaccacuugaaaaacuauacacaggaccaucuucagcauucguaguacaaccacaaaauggaagaugcaccacagauggaguacuauuaggaacaacgcaauuaucugcaguaaauauuugcacuuucagaggugacguaacucacauagcaggaaguagaaacuauacaaugaauuuagcaucacaaaacuggaauaacuacgaucccacagaagaaaucccagcuccacuaggaauaccagacuucguaggaaaaauacaaggauuacuaacacaaacaacaagagcagacggaucaacaagagcacacaaagcaacuguauccaccgguucaguacauuuuacuccaaaacucgguucaguacaauucagcacagacacagauaaugauuuucaaccaggccaaaauacuaaauucacuccaguaggcguuauacaagauggagacagacaucaaaacgaaccacaacaauggguauuaccagauuauuccgguagaacaggacacaacguacaucuagcgccagccguagcuccaacauucccuggagaacaauuacuauucuuuagaucaacaaugccugguugcucaggauauccaaacaugaaucuugacugucuacuaccacaagaauggguccuacacuuuuaucaagaaagugcaccagcacaaucagacguagcacuucucagguuuguaaacccugauacaaaccgaguucuguuugaauguaaacuacauaaaucagguuacauaacaguugcacauacaggucaacacgauuuaauauuaccaccaaacggauacuuuagauucgauucauggguuaaucaauuuuauacacuggccccaaugggaaacggagcuggacgucgucgauaa

SEQ ID NO: 34855 - RNA, 1614 nt, Artificial Sequence
  derived and/or modified sequence opt6 from VP1__Norovirus_and/or_Norovirus-like__KX514307
augaaaauggcgucaucagacgcaaacccaucugacggaucaaccgcaaacuuaguuccagaaguaaacaacgaaguaauggccuuagaaccaguuguaggagcagcaauagcggcuccaguaguaggacaacaaaacguaauugacccguggauuagaaacaacuuuguacaagcaccaggaggagaguucacagucuccccaagaaacgcaccaggagaaauuuuauggucagcaccacuaggcccagaucuaaacccauaccuaucccaucuugcuagaauguauaacggauaugccggagguuucgaaguacaaguuauuuuagcuggaaaugcauuuaccgcuggaaaaauaauauucgcugcaguaccuccaacuuucccaacugaaggauuaaguccaucacaaguaacaauguuuccacacauaauaguagauguuagacaacuagaaccaguacuaauaccauuaccagauguacgcaacaauuucuaucacuauaaucaaaguaaugacuccacaauaaaacucauagcaaugcuauauacaccauuaagagcaaacaacccaggagaugauguauuuacaguaucauguagaguacuaacaagaccaucaccagacuuugacuuuauauuccuaguaccaccuacaguagaauccagaacaaaaccauuuucuguaccuauauuaacaguaggagaaaugacaaacucaagauucccaauuaacuuagaacguuuauuuacagguccaagcucagcaaauguuguacaaccucaaaacggaagauguaugauagacgguguauuacuagguacaacacaacucucaccaguaaacauaugcacauuuagaggagauguaacacauccaggaggaucaaaaauauacaccaugaaucuagcaucaccuaacuggaauaacuaugauccaacagaagaaacuccagcaccuuuaggaacaccugacuucgucggaaaaauacacgguaugcuaacacaaacaacacaagaaaacgguagcacaagagcccauagagcaacaguauauguagguggagcaaauuuuacaccaaaacuaggaaaaguacgcuucgaaacagacacaggagaugaccuagccauaagacaaaauacaaaauuuacaccaguaggaguuauacaaucaucugaccaucauagagaugaaccacaacaauggcgacuuccaaauuacucaggagcaaacacuuuuaacguucaucuagccccugcaguugcacccaauuuucccggagaacaacuucucuucuucagaagcacucuaccaggaugcggaggucaucccaauauggauuuagauugucuauuaccacaagaauggguacaacauuucuaccaagaagcugccccugcacaaucagacguugcauuacuaagauucguaaauccugauacaaguagaguauuauuugaaugcaaacuucauaaaucaggauauguuaccguagcacauaccggucaauaugaccuuguacuaccuucaaauggcuacuucagauuugauucuuggguaaaccaauuuuacacccuugcccccaugggaaacgguacaggaagaagaagauaa

SEQ ID NO: 34856 - RNA, 1614 nt, Artificial Sequence
  derived and/or modified sequence opt6 from VP1__Norovirus_and/or_Norovirus-like__LC048948
augaaaauggccucaucagaugcaaaucccucagacggaucagcagcuaauuuaguaccagaaguaaacaaugaaguuauggcauuagaacccgucguuggagcagcaauagcagcccccguagccggucaacaaaauauaauugauccauggauaagaaauaacuuuguacaagcaccagguggagaauuuaccguaucaccaagaaacgcaccaggagaaauacuauggucugcaccuuuaggcccugaucuaaauccuuaucuaagucaccuauccagaauguauaacgguuaugcaggcggauucgaaguacaaguaauacucgcaggaaaugcauucacagccggaaaaguaauuuucgcugcaguaccaccaaauuuuccaacugaaggucuaucaccaucccaaguuacaauguucccacacauaauaguugacgucagacaacuugaaccaguacuaauacccuuaccugaugucagaaacaauuucuaccacuacaaucaaucacacgacucaacccuuaaacuuauugcuguccuauauacaccacucagaaccaauaacgcaggcgacgacguauuuacaguaucauguagaguauuaacacgucccucuccagacuucgauuuuauauuccuaguacccccaacaguagaaaguagaacaaaaccuuucacuguuccuauauuaacuguugaagaaaugagcaacaguagauuucccauaccacuugaaaaauuauauacaggaccaucaucagcauuuguaguacaaccacaaaauggaagauguacaacagauggaguauuacucggaacaacacaacuuucugcaguaaauauaugcaauuucagaggagacguaacccacauaguaggcucacaugaaacaaccaugaauuuagcaucucaaaauuggucaaauuaugauccaacacagaaaauaccagcaccccuaggaacaccacacuuugucggaaaaauucaaggccuauuaacacaaacaaccagagcacacggauccaccagggcacauaaagcaacaguaucaaccggaucuguacacuuuaccccaaaauuaggauccguucaauucacuacagauacaaacaacgauuuccaaacaggacaaaauacaaaauucaccccagucggaguuauacaagauggcgaucaccaucaaaacgaaccacaacaauggguacuaccaaacuacucuggaagaacuggacacaacguacaucuagccccagcaguagcaccaacuuuuccaggagaacaauuacuauucuuucgaucaacaaugcccggauguucaggauauccuaacaugaacuuagacuguuuauuaccucacgaauggguacuacacuuuuaucaagaagcugcaccagcccaauccgauguagcacuucuaagauucguaaacccugauacuggacgaguacuauuugaaugcaaacuucauaaaucagguuacauaacaguugcacauacaggacccuuugaccuaggcauaccaccaaaugguuacuucagauuugacucauggguaaaucaauuuuauacauuagcaccaauggguaacgggacaggacgccgaagauaa

SEQ ID NO: 34857 - RNA, 1614 nt, Artificial Sequence
  derived and/or modified sequence opt6 from VP1__Norovirus_and/or_Norovirus-like__LC048908
augaaaauggcuuccucagacgcaaauccauccgacggaucagcagcaaacuuaguaccagaagugaauaaugaaguuauggcacuagaacccguuguaggugcagcaauagcugcacccguagcaggacaacaaaauaucauagacccuuggauaagaaauaacuucguacaagcaccagguggagaauuuacaguuucaccaagaaacgccccuggggaaauacuauggucugcuccauuaggacccgaucuaaacccuuauuuaucucaucuuucacgaauguacaacggauacgccgguggauucgaaguacaagucauacuagcaggaaaugcauuuacagcagguaaaguaauauucgcagcagucccaccaaauuuuccaacagaaggucuaucuccgucacaagucacaauguucccacacauaauaguagacguaagacaauuagaaccaguucuuauaccacuacccgacguacgaaauaauuucuaucauuauaaucaaucacaugacucuacucuuaaauuaauagcaaugcuauacacucccuuaagagcaaauaaugcuggagaugacgucuucacaguaucauguagaguauugacaagaccaucaccagacuucgauuucauauuuuuaguacccccuacagucgaaucccguacaaaaccuuucacaguaccaauauuaacagucgaagaaaugucaaacucucgauucccaauaccacuagaaaaacuauauaccggaccuaguucugcauucguaguucaaccccaaaauggacgauguacaacugacggaguauuacuugguacaacacaacucagugcaguaaauaucuguaacuucagaggcgacguaacucauauaguaggaucacaugauuauacaaugaaucuugcaucccaaaacuggucaaacuacgauccaacagaagaaaucccugcaccauuagguaccccagauuuuguaggcaaaauacaaggucuauuaacacaaacuacaagagcacauggauccacuagagcucauaaagccacaguaucuacuggaucaguccacuuuacaccuaaacuaggcucaguccaauuuacaacagauacaaacaaugauuuucaaacaggacaaaacacaaaauuuacuccaguaggaguaauccaagacggagaccaccaccaaaaugaaccacaacaauggguacuaccaaauuauucaggcagaacaggucacaauguucaucuagccccagcaguagcaccaacuuucccaggagaacaauuacuauucuucagaucaacaaugcccggauguucaggauacccaaacaugaaccuagacuguuuauuaccucaagaauggguauuacacuuuuaccaagaaacugcaccagcacaaccagacguagcucuacucagauucguaaacccagacacaucuagaguccucugcgaauguaaacucccaaaaagcggauauauuacaguagcacacacugguccauacgaccuuguaauuccacccaacggauacuuuagauuugauucauggguaaaccaauucuacacucuagcacccaugggcaauggaacaggacgccgcagauaa

SEQ ID NO: 34858 - RNA, 1614 nt, Artificial Sequence
  derived and/or modified sequence opt6 from VP1__Norovirus_and/or_Norovirus-like__KX514312
augaaaauggccagcucagacgcaaacccuucagacggauccgcagcaaaucuuguaccugaaguaaauaaugaagucauggcacucgaaccaguuguaggcgcagcaaucgcagcaccuguagcuggacaacaaaauguaaucgacccauggauacgaaauaauuuuguacaagcaccaggaggagaauuuacaguuucaccaagaaaugcaccuggagaaauacuuuggucagcacccuuaggaccagaccucaauccauaccuaucucauuuagcaagaauguauaaugguuacgccggaggauucgaaguacaagucauauuagcaggaaaugcauucaccgcuggaaaaauaauauucgcagcuguuccaccaacauuuccaacagaaggucuaagcccaucacaaguaaccauguucccacauauuauagucgacguaagacaauuagaaccaguucuaauacccuuaccagauguccgaaauaauuucuaucacuauaaucaauccaaugacucaacaauaaaauuaauagcaaugcuuuacacaccauuaagagcaaacaauccaggagacgauguauucacagucuccuguagaguauuaacuagaccaucaccagacuucgauuuuauauuccuaguucccccuacaguugaaucacgcucaaaaccauucucugucccaguacuuaccguagaagaaaugacaaauucacgauuuccagcaaccuuagauaaauuauucacagguccaucauccacuuucguaguacaaccacaaaauggcagaugcaugauagauggaguauuacuuggaacaacucaauuaucaccaguaaauauauguacauuuagaggugauguaacucauccaggcggaucaaaaauuuauacuaugaaucuugccucacccaauuggaacaauuaugauccaacagaagaaauaccagcaccauuaggaaccccagauuuuguaggcaaaauccauggaauguuaacacaaacaacacaagaaaaugguuccaccagagcacaccgagcaaccguauacguuggcggagccaauuuuacaccaaaauuaggaaaaguacaauucgaaacagacacaggagaugauuuagccauaagacaaaauacaaaauuuacuccaguaggaguaauacaaucauccgaucaccaccgagaugaaccacaacaauggagauuaccaaauuauaguggcagagauacaccaaacguacaucuagcuccagcagucgcaccaacauuccccggagaacaauuauuauucuuuagaagcacuauacccggauguggaggacacccaaauaugaaccuagauugucuacuaccucaggaauggguacaacacuucuaccaagaagcagcuccugcacaaucugaugucgcacuacuaagauuuguuaacccagacacaagucgaguacuauuugaauguaaauuacauaaaagcgguuacguaacuguagcacacacaggucaacacgaucuuguaauacccccaaauggauacuuucguuucgacucaugggucaaucaauucuacacauuagcaccaauggguaauggaacaggucgaaaaagauaa

SEQ ID NO: 34859 - RNA, 1614 nt, Artificial Sequence
  derived and/or modified sequence opt6 from VP1__Norovirus_and/or_Norovirus-like__KX514237
augaaaauggcaucaaaugaugccaauccgucugacggcucugcagccaaucuaguuccagaaguuaacaaugaaguaauggcauuagaaccaguuguaggugccgcaauugcugcaccagucgccggccaacaaaauguaauagauccauggauaagaaacaauuucguacaagcuccaggaggcgaauuuacaguaucaccacgaaaugcaccuggagaaauacuaugguccgcuccauuaggaccggaccuaaacccauacuuaucacauuuagcacgcauguacaauggauacgccggagguuuugaaguucaaguaauccuagucggaaaugcauuuacugccgguaaaauaauauucgcagcaguaccaccaaauuucccaacugaaggauuauccccaucucaaguaacaauguuuccucacauaauuguagauguacgucaauuagaaccaguacucauacccuuaccagacguaagaaacaauuucuaccauuauaaucaaucuaaugacucaacaauaaaacucauagccaugcuauauacacccuuaagagccaauaacgcgggagacgacguauucacaguuucaugccgagucuuaaccagaccaucaccugacuuugauuuuauauuccucguacccccaacagucgaaucacguucuaaaccauucaguguacccguauuaacaguagaagaaaugacaaauucuagauuuccagcuacacuugauaaacuauuuacugguccaucaucaacauuuguaguacaaccacaaaauggaagauguaugauugacggaguacuacuaggaacaacccaacucucaccagucaauauuugcacauuucgaggugauguaacacacccacgagauucuccaauauacacuaugaaccuagccucaccaaauuggaacaacuaugaccccacagaagaaauacccgcaccccuuggaacuccagauuucguuggaaaaauacaaggaauguuaacucaaacaacacaagguucuggaucaacaagagcacauagagcaacaguauacguuggauccgcugauuucacaccaaaacuuggaaaaguacaauuugaaacagaaacagaucaugauuuagcaauaagacaaaauacaaaauuuacaccaguagguguaauacaagaaucagaccaccaucgugaugaaccacaacaauggagauuaccuaauuauagcggagcaaauacauuuaacguacaccuagccccugccguagcaccaaacuucccaggagaacaauuacuauucuuccgaucaacacuacuaggauguggaggacauccaaauauggaccuagacuguuuacucccucaagaauggguacaacauuucuaucaagaagcagcuccagcacaaucagacguagcauuacucagauucguaaauccagauacuucaagaguacuauucgaguguaaauuacauaaauccggauauguuacaguagcucacacaggucaauacgaucuaguccuaccaucaaacggauauuuuagauuugauagcuggguaaaucaauuuuauacauuagcaccaaugggaaacggaacaggaagaagaagauaa

SEQ ID NO: 34860 - RNA, 1614 nt, Artificial Sequence
  derived and/or modified sequence opt6 from VP1__Norovirus_and/or_Norovirus-like__DQ419907
augaaaauggccucaaaugacgccucuccauccgacggaucaaccgcaaauuuaguaccugaaguaaacaaugaaguaauggcucuagaaccaguuguaggagccgcaauugcagcacccguagccggacaacaaaacguaauagauccauggauaagaaauuccucuguacaagcaccugguggcgaauuuacuguaucccccagagacgccccaggagaaauacucuggucugcuccccucggaccugaccuaaacccauauuuaucacauuuagcuagaauguacaacgguuaugcaggaggauucgaaguacaaguaaucuuagccggaaacgcguuuaccgcaggaaaaauaauuuuugcagcagcaccaccaaacuuuccaacagaaggacucucaccuucacaaguaacaauguuuccacacauaauagucggaguaagacaauuagaaccuguacuaauaccccuuccagacguaagaaacaauuucuaucacuacaaucaaucaaaugauuccacaauaaaauuaauagccauguuauauacaccuuuacgagcaaauaacgccggagaugacgucuuuacagucucuugucgaguacuaacaagaccaucaccugauuuugauuuuauuuucuuaguaccuccaacaguagaauccagaacaaaaccauuuacuguaccuauucuaacagucgaagaaaugaccaacucaagauucccuauaccccuagaaaauugcucaagaguucccgcaguaccacuaucuucuaaucauaaaaugcaauguacuacugauggaguuuuacuaggaacaacacaacuaucaccaguuaacauuuguacauuuagaggagacguuacucauauaccaggaaccagaacauacagaaugaauuuagcaucccaaaauuggaauaauuacgauccaacagaagaaauaccagcaccauuaggaaccccagacuucguaggcaaaauacaagguauguuaacacaaacaacuaaaggugauggcucaacaagaggacauaaagcaacaguuucuacaggaucaguugacuuuacaccaaaacuaggaaguguacaauuugcuacugacacagacaaugauuuugaaacaggucaaaacacaagauucacaccagucggaguaauacaagacggauccucuacucacagaaaugaaccucaacaauggguuuuaccugacuacucaggaagaaccguucauaauguacauuuagcaccagcaguagcaccuacauucccaggagaacaauuacuauuuuucagaucaacaaugccaggauguucaggauauccuaauauggacuuagauugcuuauuaccacaagaauggguacaacauuuuuaucaagaagcagcaccuucccaaucagacguagcacuucucagauuuguaaauccugauacaggcagaguuuuauucgaauguaaacuacauaaagcugguuauguaacaguagcccacacaggucaacaugaucuaguaauaccuccaaauggauauuucagauuugacuccuggguaaaucaauuuuacacucuagcaccaaugggcaacggagcaggaagaagacgauaa

SEQ ID NO: 34861 - RNA, 1614 nt, Artificial Sequence
  derived and/or modified sequence opt6 from VP1__Norovirus_and/or_Norovirus-like__JN975543
augagaaugagcgauggagcggcaccaaaagcaaacggaucagaagccucaggacaagaucucguacccacagcaguagaacaagcaguaccaauucaaccugucgcaggcgcugcauuagcggccccagcugcaggacaaaucaaccaaauugauccuuggauuuuucaaaauuuuguacagugcccauuaggagaauuuucaauaucuccaagaaacaccccaggugaaauucuauuugaucuggcauuaggcccuggauuaaacccuuacuuagcacauuuauccgcuauguauacagguuggguaggaaacauggaaguucaauuaguacucgccggaaaugcuuuuacagcaggaaaagucguaguagcuuuaguaccaccauacuuccccaaaggaucauuaacaacagcacaaauaacauguuuuccgcaugugaugugcgauguucgaacacuagaaccaauacaauuaccuuuauuagauguaagaagaguauuauggcaugcuacacaagaucaagaagaaucaaugagacuuguguguaugcuauacacaccauuaagaaccaauucaccuggggaugaaucauucgucguuucagguagauuauuaucuaaaccagccgcagauuuuaacuuugucuacuuaacacccccuauagaaagaacaaucuaccgaaugguagaucuaccuguuuuacaaccaagacucugcacacaugcacgauggcccgcaccaguauauggccuauuaguagauccaucucucccaaguaacccacaauggcaaaacggaagaguacauguugaugguacauuauuagguacuacaccuguaucaggaucauggguaagcugcuucgcagccgaagcagcauaugaauuucaaucuggaacaggagaaguugcaacauuuacauuaaucgaacaagauggaaccgcauauguuccuggugaucgugcagcaccauuaggguacccagauuuuucuggacaauuagaaauagaaguacaaacagaaacaacuaaagcaggggauaaacucaaaguaacaacauuugaaaugauacuuggaccuacuacuaauguugaccaagcaccauaucaaggaagaguauaugcaucaauaacagcaauggccucauuagacuuaguugacggccgcguacgagcaguuccaagauccauauacucauuucaagauguaauaccagaauacaaugacggacuccuaguaccauuagcaccuccaauaggaccauuccuuccaggagaaguccuauuacguuuuagaacauauaugcgucaauuagacacugcagacgcagcagccgaagcaauagauugugcacuaccacaagaauuuauaucaugguuugcaucaaacgcuuuuacaguucaaucugaagcacuguuauuaagauauagaaauaccuuaacaggucaauuacuauuugaaugcaaauuauacucagaaggauauauagcauuaagcuauucaggaaguggagcauuaacauucccaaccgaugguuucuuugaaguaguguccuggguuccacgucucuaucaauuagccucaguaggaaguuuagcaaccgguagauaa

SEQ ID NO: 34862 - RNA, 1614 nt, Artificial Sequence
  derived and/or modified sequence opt6 from VP1__Norovirus_and/or_Norovirus-like__JN975541
augagaaugagcgauggagccgcaccaaaagcaaauggaagcgaagcaucaggucaagaccuaguuccaaccgccguagaacaagcaguaccuauucaaccaguagcaggcgcagcacuugcagcaccagcagcaggacaaauaaaucaaauagacccauggaucuuucaaaacuuuguccaauguccauuaggagaauuuaguaucagccccagaaacacuccuggagaaauauuauucgauuuagcauuaggaccuggacuaaauccauauuuagcacauuuaagcgcaauguauaccggauggguaggaaauauggaaguacaguuaguuuuagcaggaaaugcauucacugcaggaaaaguaguaguagcauuaguaccaccguauuuuccaaaagguuccuuaacaacagcacaaaucacaugcuuuccccauguaaugugugacguccgaacacuagaaccaauacaauuaccacuacuagauguaagaagaguauuauggcaugcaacccaagaccaagaagaaucaaugagauuaguauguauguuauauacuccucuccgaacuaacagucccggagacgagucauuuguaguuaguggaaggcuacuuagcaaaccagccgcugacuuuaauuuuguauaucuaacaccaccuauagaacguacaauauauagaaugguugauuuaccaguauuacaaccucgacucuguacccaugcaagauggccagcaccaguauacgguuuauuaguugacccaagucuucccaguaauccacaauggcaaaauggaagaguucacguggacggaacauuauuaggaacaacacccguaagcggaucauggguauccuguuuugcagcagaagccgccuacgaauuucaauccggaacuggcgaaguagcaaccuuuacuuuaaucgaacaagauggaacugcauauguaccaggagaucgugcugcaccacuaggcuacccugauuucuccggucaauuggaaauagaaguccaaacagaaacaacaaaaacaggagauaaauuaaaaguaacaacauuugaaaugauuuuaggaccaacaacaaauguagaccaagcaccuuaucaagguagaguauaugcaucuauaacagcagcagcaucauuagaucuuguagacggaagaguuagagcagucccaagaagcauauauucuuuucaagaugcaauaccagaauauaaugacggacuauuaguaccacucgccccaccuaucggaccuuuucuaccaggugaaguacuauuaagauuucgaacuuauaugagacaacuagauacagcggaugcagcagcugaagcaauugacugugcauuaccccaagaauuuauaucaugguucgccucaaaugcauucacaguacaaucagaagcucuauuacuacgauauagaaauacauuaacaggacaacuccucuucgaaugcaaauuauauucugaaggauauauagcauuaucauauaguggaucuggugcauuaacauuuccaaccgaugguuucuuugaaguaguaucauggguuccacgacuuuaucaauuagccucaguaggaucacuagcaacaggucgauaa

SEQ ID NO: 34863 - RNA, 1614 nt, Artificial Sequence
  derived and/or modified sequence opt6 from VP1__Norovirus_and/or_Norovirus-like__KF113526
augagaauguccgauggagcagcaccaaaagcaaauggaucagaagcaucaggacaagacuuaguaccaacagcuguagaacaagcaguaccaauacaaccaguagcuggugcaaguuuagcagcccccgcagcuggacaaaucaaucagauagauccauggauauuucaaaauuucguacaauguccacuuggagaauuuucaauaucucccagaaauacaccuggagaaauauuauuugacuuagcuuuaggaccuggacuaaacccauacuuagcacaccuaucagcuauguauacaggcuggguagguaauauggaaguacaauuaguccucgccgguaaugcauuuacagccggaaaaguaguaguagccuuaguuccucccuacuuuccaaaaggaucccuaacugccgcccaaauaacauguuuuccacauguuaugugugacguaagaacacuagaaccaauccaacuuccauuauuggauguucgccgaguauuauggcacgccacacaagaucaagaagaaaguaugagauuaguguguaugcuauacacaccucuacgaacaaauucuccuggugaugaauccuuuguaguaucuggaagacuccucuccaaacccgcagcagauuuuaauuuuguauacuuaacaccaccaauagaaagaacuauuuauagaaugguagacuuacccguucuacaaccaagauuauguacacacgcuagauggccugcaccaguauauggauuauuaguugacccaucauuaccuuccaauccucaauggcaaaauggaagaguucauguagauggcacacuauuaggaacaaccccuguaucaggaucuuggguuaguuguuuugcagccgaagcagcauaugaguuucaaucaggaacuggagaaguagcaacuuuuacucucauugaacaagauggaucugcauauguaccuggagauagagcagccccuuuagguuauccagauuuuucaggacaacuagaaauagaaguucaaacagaaaccacaaaagcaggagauaaacuaaaagugacaacauucgaaaugauccuuggaccuacaacaaacgucgaucaagcaccauaccaaggaagaguauacgcaucauuaacagcugcagccucacuagauuuaguagauggacgaguaagagccguaccuagaucuauuuauggauuucaagaccaaauccccgaauacaacgacggacuucucgucccauuagcaccaccaguagggccauuucuaccaggagaacuauuauuaagauuuagaacauacaugagacaaauagacucagcugaugcagcagcagaagcaauagauugugcauuaccucaagaauuuaucucaugguuugcaaguaacgcuuucacaguucaaucagaagcauuacuacuaagauauagaaauacacuaacuggucaacuauuauucgaauguaaacuuuauucagaaggauauauugcacuuucuuacucaggauccggaccucuaacauuucccacagauggauucuuugaaguaguaaguugggucccuagacuauaucaauuagcaucugucggaagccuagcaacaggaagauaa

SEQ ID NO: 34864 - RNA, 1614 nt, Artificial Sequence
  derived and/or modified sequence opt6 from VP1__Norovirus_and/or_Norovirus-like__KF113527
augagaaugucugauggagccgcaccaaaagcuaauggaucagaagcaucaggacaagauuuaguaccuacugcuguugaacaagcaguaccuauccaacccguagccggugcuucacuagcagcuccugcagcuggacaaauaaaccaaauagauccauggauuuuucaaaauuuuguccaauguccauuaggagaauuuucaauuucuccacgaaaugcaccaggagaaauacucuuugaucuagcacucggcccaggauuaaacccuuauuuagcucauuuaucugccauguacacuggauggguaggcaauauggaaguucaauuaguauuagcuggcaacgcauucacagcaucuaaaguaguaguagcacuuguuccuccauauuuuccaaaagguucuuuaacaacagcgcaaauuaccuguuucccacauguuaugugugauguaagaaccuuagaaccuauacaacuaccuuuauuagauguaagaagaguauuauggcacgccacccaagaucaagaagaauccaugagacucgugugcaugcuuuacacuccauuaagaacaaauucaccaggugacgagucuuucguuguuagugguagacuauuaucuaaacccgcagcagauuuuaauuuuguauauuuaacaccaccaauagaaagaacaauauauagaaugguagaccuaccaguacuccaaccaagguuauguacucaugcaagauggccagcuccaguauauggucuauuagucgacccaucuuuaccaucuaacccucaauggcaaaaugguagaguacacguagaugguacucuuuuaggaacaacaccaguaucugguucauggguaucauguuucgcagcugaagcagcauaugaauuucaaucuggaacaggagaaguagcaacuuucacauuaauagaacaagauggaucagcuuauguaccuggagaccgagcagcaccacuaggauauccagacuuuuccggucaacuagaaauagaaguacaaacagaaacaaccaaagcaggagauaaauuaaaaguuacuacauuugaaaugauauuaggaccaacaacaaauguagaccaagcaccauaucaaggaagaguauaugcaucacuuacagcugcagcaucacuugaccuagucgauggaagaguaagagcaguaccucguucaaucuacgguuuucaagaucaaaucccagaauauaaugacgguuuauuaguuccccucgcaccuccaguagguccuuuucuaccaggagaacuauuacuacguuuuagaacuuauaugagacaaauugauucagccgaugcagcugcagaagcaauagauugugcacuaccccaagaauuuauaucaugguuugcuucuaacgcauucaccguucaaucagaagcauuauuacuaagauauagaaauacucuuacuggacaauuacuauucgaauguaaauuauacucagaagguuacauagcauuaucuuacucuggaucuggaccacuaacuuucccaacagauggauuuuucgaaguaguaucauggguaccaagauuauaccaauuagcaucuguuggaucauuagcaacuggcagauaa

SEQ ID NO: 34865 - RNA, 1614 nt, Artificial Sequence
  derived and/or modified sequence opt6 from VP1__Norovirus_and/or_Norovirus-like__KM458057
augagaaugagugauggugcggcuccaaaagccgacgguucagaagccucaggacaagauuuagucccaacugcaguugaacaagcuguaccaauacaaccaguagcuggcgcagcacuagcugcaccagccgcaggccaaauuaaucaaauugacccuuggaucuuccaaaacuuuguucaaugcccauuaggagaauuuucaauaaguccacgaaauaccccaggugaaauuuuauucgacuuagcucuaggacccggauuaaauccauaucuagcacaccuuagugcaauguacacaggaugggucgguaauauggaaguacaauuaguccuagcaggaaaugcauuuacugcuggcaaaguaguuguagcauuagucccaccauauuuuccuaaaggaucauuaacaacagcacaaauaacauguuuuccucauguaaugugugauguaagaacacuugaaccuauacaauuaccucuacuugauguaagacgaguacuguggcaugccacacaagaucaagaagaaucaaugcgccuaguauguauguuauauacucccuuaagaaccaauucaccaggagacgaaucauuuguuguuucaggaagauuauuaucaaaacccgcagcagauuuuaauuuuguauaucuuacuccaccaauugaaagaacaauauauagaaugguugauuuaccuguaauucaaccccgacucugcacucaugcaagauggccagcaccaguauauggucuauuaguugacccuagcuuaccaagcaacccacaauggcaaaauggaagaguucacguagauggaacacuauuaggaacaacuccuguuucagggucaugggucucaugcuuugcugcagaagcagcauacgaauuucaaucaggaacaggacaaguugcuacauuuacauuaauagaacaagacggcuccgcauauguaccaggagauagagcagcaccacuaggcuauccagacuucucaggacaacucgaaauagaaguacaaacugaaacaacuaaaacaggugauaaacuaaaaguaacaacauuugaaaugauacucggaccaaccacuaauguggaccaagcaccauaccaagguaaaguauuugcaagcauaacagcagcagcaucacucgauuuagucgauggcagaguucgagcagucccaagaucaauauauggauuucaagauguuauaccagaauauaacgacggacuauuaguaccacuagcacccccaauaggcccauuuuuaccuggagaaguacuauuacguuuuagaacuuauaugagacaacucgacacagcugacgccgcugcugaagcaaucgauugugcauuaccccaagaauuuauaucaugguuugcauccaauguauuuacuguacaaucagaagcauuauuauuacguuauagaaauacauuaacaggacaacuacuauucgaauguaaacuauauucugaagguuacauagcacuuaguuauucaggaagcggaccauuaacauucccaacagauggauucuuugaaguuguaagcuggguaccaagauuauaucaauuagcaucuguugguucacuagcaacaggaagauaa

SEQ ID NO: 34866 - RNA, 1614 nt, Artificial Sequence
  derived and/or modified sequence opt6 from VP1__Norovirus_and/or_Norovirus-like__AB662855
augaaaauggcaucaaaugaugcagcaccauccacagauggagcggcagguuuaguaccugaaucuaauaacgaaguaauggcauuagaacccguugcaggagcagcucuugcagccccgguuaccggacaaacaaacauaauagacccuuggauucgagcaaauuucguacaagcaccaaauggagaauuuacagucucaccaagaaaugcaccaggugaaguauuacuaucacuagaauuaggaccagaacuaaauccauacuuagcucacuuagcaagaauguauaacggucaugcaggaggaauggaaguacaagucauguuagcaggaaacgcauuuacagcaggaaaauuaguuuuugcagcggucccuccacauuuucccgucgaaaauuuaucuccucaacaaauaaccauguuuccacauguuauaauugauguacgaacuuuagaaccaguauuauuaccauuaccagauguaagaaauaacuucuuucauuacaaucaaaaagacgacccaaaaaugagaauaguugcaauguuauauacaccauuaagaaguaauggcucaggagaugacguauuuacaguaucuuguagaguuuuaacaagaccaagucccgauuuugauuuuacauacuuaguuccaccuacaguagaaaguaaaaccaaaccauuuacauuaccaauacuuaccuuaggugaacuaucuaauucaagauucccaguaucuauagaucaaauguauacaucaccuaaugaaguuauaucaguacaaugucaaaauggacgauguacucuagauggagaauuacaaggcacuacacaacuccaaguaucaggcauaugcgcuuuuaaaggcgaaguaacagcucaucuucacgauaaugaucaucuauacaauguaacaauaacaaaucuuaauggcucuccauuugauccgucugaagauguaccagcuccacuaggaguaccagauuuucaaggacgaguauucggaguaauaucacaaagagauaaacaaaacgcugccggacauaacgaaccagcaaacagaggacaugacgcaguaguaccaacauauacagcccaauacacaccaaaauuaggccaaguucaaauuggaaccuggcaaacagaugaucuacaaguaaaucaaccaguaaaauuuacaccaguaggauuaaaugauaccgaacacuucaaucaauggguagucccaagauaugcgggagccuuaaauuuaaauacaaauuuagcucccucuguugcaccagucuuuccaggagaacguuuauuauuuuucagaucauauauuccucuuaaagguggauaugguaauccugcaauagauugccuucuaccacaagaauggguacaacauuuuuaccaagaagcagcuccaucaaugucagaaguagcacucguaagauauauaaacccagacacagguagagcccuuuuugaagccaaauuacacagagcagguuuuaugacaguuucaucaaacacgagugcaccaguaguuguacccgccaacggauauuuccgcuuugauucauggguuaaucaauucuacagccuagcaccaauggguaccggaaauggauaa

SEQ ID NO: 34867 - RNA, 1614 nt, Artificial Sequence
  derived and/or modified sequence opt6 from VP1__Norovirus_and/or_Norovirus-like__AB809997
augaagauggcuuccaacgacgccgcacccucaaacgacggcgcagccagccuaguuccagaagccauuaacgaaacaaugccauuagaacccguugcaggagcaucaauugcagcaccaguagcaggacaaacaaacaucauagaccccuggaucagaacaaauuucguacaagcaccaaauggagaauuuacaguaaguccaagaaacucuccuggagaaauccuauuaaaucuagaacuaggacccgaccuaaacccuuaucuagcacaccuaucaagaauguauaauggcuaugcaggaggaguugaaguacaaguauuacucgcaggaaaugcauuuacagcuggaaaaauacucuucgcagcaauaccaccaaacuucccuguugauaugauaucuccagcucaaauaaccauguuaccacaucuaauaguagacguacgaacacucgaaccaauaaugauaccucuuccagauguaagaaaugucuuuuaucauuucaacaaccaaccucaaccaagaaugagacuuguagcaaugcuauacacacccuuaagaucaaacggaucaggagacgacgucuucacaguuucuugccgaguacuaacaagaccaacucccgacuuugaauuuaucuacuuaguaccaccaucaguugaaucaaaaacaaaaccauucacacucccaauacuuaccauaucagaacuaacaaacagucgauuuccaauacccauugaacaacuauauacugccccaaacgaaaacaacguaguacaaugucaaaacggaagauguacacuagacggagaauuacaaggaacaacacaacucuuaucuucagcaguauguucauacagaggucguacaguugcaaacagcggugacaauugggaccaaaacuuauuacaauuaacuuaucccuccggcgcaucauacgauccaaccgacgaaguaccagcaccacuagguacccaggauuucucaggcauccucuauggaguacuuacccaagacaaugaaagagaaggaaccggagaagccaaaaaugcaaaaggaguauauauauccacaacauccggaaaauuuaccccaaaaauaggaucaaucggauuacacucaauaacagaaaacguacaucccaaccaacaaagccgauucacaccuguaggugucgcacaaaaugaaaacaccccauuccaacaauggguuuuaccacacuaugcaggagcauuagcauuaaacacaaauuuagcacccgcaguagcaccaacauucccaggagaacaauuacuauucuuucguuccagaguaccauguguucaaggccucagaggacaagaugcuuucauugauuguuuacucccucaagaauggguaaaucacuuuuaccaagaagcagcacccucacaagcagauguugcacuaauaagauauguaaacccugacaccggacgaacguuauuugaagcaaaauuacaccgauccggauuuauaacagucagccacacuggagcauacccauuaguaguaccaccaaauggacauuucagauuugacucuuggguaaaucaauucuauucuuuagcaccaaugggaacagguaacggauaa

SEQ ID NO: 34868 - RNA, 1614 nt, Artificial Sequence
  derived and/or modified sequence opt6 from VP1__Norovirus_and/or_Norovirus-like__AB810001
augaaaauggccucuaaugacgcagcaccuucaaaugacggagcagcuagcuuaguaccugaagcaauuaaugaaacuaugccucucgaaccaguagcuggugcaucuauagcugcaccuguugcaggacaaacuaauauaauagacccuuggauucggacaaacuucguucaagcaccaaacggagaauuuaccguaagcccaagaaauucacccggcgaaauuuuacucaaccuagaacuugguccagauuuaaauccauaucucgcacaccuuucacguauguacaacgguuaugcaggagguguagaaguccaaguauuacuagcaggaaacgcauuuacagcuggaaaaauacucuucgcagcaaucccuccaaacuuucccguagacaugauaucuccagcacaaaucacaaugcuaccucacuuaauaguagauguacgaacauuagaaccaauaaugauaccacuucccgauguaagaaauguauuuuaucacuuuaacaaucaaccacaaccaagaaugagacucguagcaaugcuauacacuccacuaagaucuaacggcucaggagacgauguauuuacaguuuccugccgaguauuaacuagaccuacacccgacuuugaauuuauauaucucguaccaccuuccgucgaaucaaaaacaaaaccauuuacacuaccaauacuaacuauaagugaauuaacaaauucaagauuuccuauaccaauagaacaauuauacaccgcaccaaaugagaauaauguaguacaaugccaaaaugggagauguacacuagauggcgaauuacaaggaacaacacaacuacuaucaucagcuguauguucauaucgcgguagaacagucgcaaacucaggagacaauugggaccaaaaccuauuacaacuaacauauccuucaggugcaucauaugacccaaccgacgaaguaccagcaccuuuaggcacacaagacuuuuccggcauucuguacggaguauuaacacaagauaauguaucagaaggaacaggugaagccaaaaaugcaaaaggaguauauauuucuacaaccucugguaaauucacaccaaaaauaggauccauaggauuacauucuauaacagaaaauguacauccaaaucaacaaucccgauucacuccaguaggaguugcacaaaaugaaaauacuccuuuccaacaguggguacuaccucacuaugcuggagcacucgcccuaaacacaaacuuagcaccagcaguagcaccaacauuuccaggcgaacaacuacuuuucuuuagaucucgcguaccaugcguucaaggauuaagaggacaagaugcauuuauagacugucuacuaccccaagaauggguaaaccacuucuaucaagaagcagcaccaucucaagccgauguugcacuaauaagauacguaaauccagacacaggaagaacuuuauucgaagcaaaacuacacagaucaggauuuauaacaguaucucacacaggagccuacccauuaguagucccaccaaauggacacuuuagauucgauucuuggguuaaccaauuuuacagucucgcaccaaugggcacaggcaauggcuaa

SEQ ID NO: 34869 - RNA, 1614 nt, Artificial Sequence
  derived and/or modified sequence opt6 from VP1__Norovirus_and/or_Norovirus-like__AB809992
augaaaauggcuucaaacgacgcugccccaucaaacgacggagcagcaucucuagucccagaagcuauaaacgaaacuaugccacuagaacccguagcaggagcaucaaucgcagcacccguagccggccaaaccaauauaauagacccauggauacgcacaaauuucguccaagccccuaacggagaauuuacaguaucaccacgaaacucuccaggagaaauauuacuaaaucuagaauuaggaccugaucuaaauccauaccuagcacaucucucaagaauguacaacggauacgccggaggaguagaaguucaaguauuacuagcaggaaaugcauuuacagcuggcaaaauacuauuugcagccauaccaccaaauuuuccagucgauaugauaucaccagcccaaauaacuaugcuaccucacuuaauagucgacguaagaaccuuagaacccauaaugauaccucuaccugauguacgaaaugucuuuuaccauuucaacaaucaaccacaaccaagaaugagacuuguagcaaugcuauauacaccucuaagaucaaacggaucaggcgaugauguauucaccgucucaugcagagucuuaacaagaccaacacccgacuucgaauuuaucuacuuaguaccaccauccguugaaucaaaaacaaaaccauuuacccuaccaauacuaacaauaucagaacuuaccaacuccagauuccccaucccaauugaacaacuauauacagcaccaaacgaaaacaaugugguacaaugucaaaacggaagaugcacacuagauggugaacuacaaggaacuacacaacuauuauccucagccguaugcucauaccgaggacgaacagucgcaaauucaggugacaacugggaccaaaaucuacuacaacuaacuuacccaucaggagcaucauacgaccccacagacgaaguuccagcaccacuaggaacccaagacuuuucaggaauacuauacggggucuuaacacaagauaacguaucugaaggaacaggagaagcuaaaaacgcaaaaggcgucuauauaucaacaacaucuggaaaauucacacccaaaaucggaucaaucggauuacacucaauaaccgaaaauguccauccuaaucaacaauccagguuuacaccagucggaguagcacaaaacgaaaacacaccauuucaacaauggguauuaccccacuaugccggugcauuagcccuaaauaccaaucuagcacccgcuguagcacccaccuuuccuggagaacaacuacuauucuuucgaucaagaguuccaugcguacaaggauuaagaggacaagaugccuuuauagauugcuuauuaccacaagaaugggucgaucauuucuaucaagaagcagcaccaucucaagcagaugucgcuuuaauaagauacguuaauccagacacaggaagaacauuauucgaagcaaaauuacaucgcucaggauucauuacaguaucacacacaggcgcauacccccuaguagucccaccaaacggacacuucagauuugauuccuggguaaaccaauuuuauuccuuagccccaaugggcacagguaacggauaa

SEQ ID NO: 34870 - RNA, 1611 nt, Artificial Sequence
  derived and/or modified sequence opt6 from VP1__Norovirus_and/or_Norovirus-like__AY130761
augaaaauggcaucaaaugacgcuacuccuagcgacgauggagcagcuggcuuaguaccugaaauuaauaacgaaguaauggcacuagaaccaguagccggugcaaguauagccgccccuguaguuggacaacaaaauauaauagacccauggauaagaaacaacuucguacaagcuccugcaggcgaauuuacagucucacccaggaacuccccaggugaacucuuacuagaucuagaauuaggaccagaacuaaaccccuaucuagcacaccuugcacgaauguacaauggacacgcaggaggaauggaaguacaaauaguauuagcaggaaaugcauuuacugcaggaaaaauauuauucgcagcaauaccaccaucauucccguacgaaaauuuaaguccugcacaacuaaccaugugcccacacguuauaguagauguccgccaauuagaaccuguacucuuaccaaugccugauaucagaaacguuuucuaucauuacaaccaaaacaauucaccaaaauuaagauuaguagcaaugcuauacacacccuuaagagcaaacaauucaggugacgauguuuuuacaguuucauguagaguccuuacacgacccucaccagacuuucaauucacauuuuuagucccaccaaccgucgaaucaaaaaccaaaaauuuuacacuaccaguacucagaguauccgaaaugacaaauucaagauuucccguuguauuagaccaaauguauacaucuagaaacgaaaauauaauaguccaaccccaaaacggaagaugcacaacagacggagaacuucucggaacaacaacauuacaaucaguauccauauguaauuuuagagguacaaugcaagcaaaacuaaacgaacaaccaagauaucaauuacaacucaccaaccuugacggaucaccuauagacccaacagaugauaugccugcaccacuuggaacacccgacuuucaagccaugcuauacggaguagcaucucaaagaucaucaagagauaacgcaacacgagcucacgacgcacaaauagacacugcaggcgacacuuucgcuccaaaaauaggacaaguaagauuuaaaucaucuucagacgauuucgaucuccaugauccaacaaaauucaccccaaucggaguaaacguagacgaucaacaccccuuucgucaauggucacuaccuaacuauggaggccauuuagcacuaaacaaucacuuagcuccagcuguaaccccacucuuuccaggagaacaaauauuguucuuucgaucucauauaccuucagccggaggacauacagacggagcuauagauugucuacugccucaagaguggauagaacauuuuuaccaagaagcagcacccucucaaucagacauagcucuagucagauuuauaaauccagauacaggacgaguauuauuggaagcaaaacuacauaaacaaggcuuuuuaacaguagcagcaucaggagaucacccaauaguaaugccuacaaauggauauuuuagauucgaagcaugggucaacccauucuacacauuagcacccguaggaacagguucgggacguagaagaauacaauaa

SEQ ID NO: 34871 - RNA, 1611 nt, Artificial Sequence
  derived and/or modified sequence opt6 from VP1__Norovirus_and/or_Norovirus-like__KF806495
augaaaauggcuaguaaugaugccaacccaucagaugguucugcugccaauuuaguaccagaaguaaacaaugaaguaauggcauuagaaccuguaguuggagcugcaaucgccgccccaguugcaggacaacaaaacguaauugacccuuggauaagaaauaauuucguacaagcaccuggaggagaauuuacuauaucacccagaaacgcuccaggagaaauuuuauggucagccccauuaggcccagacuuaaauccauauuuaucccaucuugcacgaauguacaacgguuaugcugguggauuugaaguacaaguuguacuagcuggaaacgcauuuacagcagguaaaauaauauucgcagccguaccaccaaauuucccaacagaaggauuaucaccaucacaagucacaauguuuccacacauaauuguugacguaagacaacuugaaccuguucuuauaccauuaccagauguaagaaauaacuuuuaucauuacaaccaaucaaacgacaguacaauaaaauuaaucgcaaugcuauacacuccacucagagcaaauaaugccggugacgacguauuuacaguauccuguagaguauuaaccagaccaucaccagacuuugacuuuauauuuuugguaccaccuacaguagaaucaagaacuaaaccuuucacaguacccguacuaacuguagaagaaaugacaaacuccagauucccuauaccauuagaaaaauuauucacuggacccucaucagcauuugucguacaaccacaaaacggaagauguacuacugacgguguauuacuuggaacuacacaacuaucugcaguuaacaucuguacauucagaggcgauguuacacauguauccgauaaaacauucgcaaugaaccuugccuccccaaauuggaauaauuaugaucccacagaagacauucccgcaccacuaggaacuccagauuuuguaggacgaauacaugguaugcuaacacaaacaaccagacgagacggagcaacaagaggacauaaagcaacaguaucaacaggaggagccgacuuuacuccuaaacucggaucaguaagauauauaacugauaccacagacgaucuugaaguucgagaaaauacaaaauucacaccuauagguguccuacauucaucaggcgaacauagagcagaaccugaucaauggagacuaccagaauauucaggccgaaauguacauaauguacaucucgcgccugcugucgccccaacuuuuccaggagaacaacuauuauuuuucagaagugcacuaccaggauguggcgguuauccaaacacagaucuugauuguuuauuaccccaagaauggguacaacacuuuuaucaagaagcagcuccagcacaauccgauguugcauuauuaagauucguuaaucccgauaccggacgaguauuauucgaaugcaaacuacacaaaucaggcuauguaacaguugcacauacugguccacaugaucuuguaaucccaccaaauggcuauuuuagauuugauaguuggguaaaucaauuuuauacauuagcuccaaugggaaauggaacuggacgaagaagauaa

SEQ ID NO: 34872 - RNA, 1611 nt, Artificial Sequence
  derived and/or modified sequence opt6 from VP1__Norovirus_and/or_Norovirus-like__KF806503
augaaaauggcaaguaaugacgcaaacccaucagaugguucagcagcaaacuuaguaccagaaguaaauaacgaaguuauggcauuagaacccguuguuggagcugcuauugcggcaccaguagcaggacaacaaaauguaauagacccauggauaagaaauaauuucguucaagcacccggaggagaauuuaccauaucaccaagaaacgcaccaggagaaauauuauggucagcuccuuuaggcccagacuuaaacccauaucuaucacaucuagcuagaauguauaauggauacgcaggaggauucgaaguacagguaguacuagcgggaaaugcauucacagcuggaaaaauaauauuugccgcaguaccaccaaacuuucccacagaaggacuaucaccaucacaaguaacuauguucccacacauaauagucgauguuagacaacuagaaccaguacuaauaccccugcccgauguuagaaacaauuuuuaucacuauaaccaaagcaaugacucaauaauaaaauuaauagccauguuguauacuccacuucgagcaaauaaugcgggugacgauguauuuacaguuucauguagaguacuaacaagaccaucaccagauuucgauuucauauucuuaguaccucccaccguagaaucaagaacaaaaccauuuacaguaccaguacuaacaguagacgaaaugacaaauucaagauucccaauaccacuagaaaaacuauucacaggacccucaucagcauucguaguucaaccccaaaacgguagauguacaacagacggaguauuacuaggcacaacacaacugucagcaguaaacauauguacauuccgaggagaugucacacauguuucagauaagacauuugcaaugaaccuagcaucaccaaauuggaacaacuaugacccaacagaagaaauuccagcaccacuuggaacaccugauuucguaggaagaauacacggaaugcuaacccaaacaacaagaagagauggagcaacaagaggacacaaagccacaguaaguacaggaggagccgacuucacaccaaaacuaggaucaguaagauauauaacagacacaacagaugauuuagaaguaagagaaaacacaaaauuuaccccuauaggaguuuuacauucaucaggcgaacauagagcugaaccugaccaauggagacuuccagaauauucuggaagaaauguacauaauguacaccuagcuccugcaguagcaccuacauuuccaggagaacaacuacucuucuuuagaagugcacuaccaggaugugguggauacccaaauacagauuuagauugcuuacucccacaagaauggguacaacauuuuuaucaagaagcagcuccagcacaaucagauguagcacuucuuagauucguaaauccagacacuggacgcguacucuucgaaugcaaauuacacaaaucaggauaugucacaguugcacauacaggaccacacgaucuagucaucccuccaaacggauacuuccgauucgacaguuggguaaaucaauuuuauacuuuagcaccaaugggcaauggaaccggcagaagacgauaa

SEQ ID NO: 34873 - RNA, 1611 nt, Artificial Sequence
  derived and/or modified sequence opt6 from VP1__Norovirus_and/or_Norovirus-like__KF712506
augaaaauggcuagcagugaugcaaauccaucagacggaucaacagcaaaucuaguaccagaagcaaacaaugaaguaauggcacuagaaccuguaguaggagcagcaaucgcugcaccaguagcaggacaacaaaauguaauagacccauggauuagaaauaacuucguacaagcaccaggaggagaauuuacuguaaguccucggaacgcaccuggagaaguacucugguccgcaccuuuagguccagacuuaaaccccuaucuaucacauuuagcacgcauguauaauggauaugcaggaggcuucgaaguacaagucauauuagccggcaaugccuucgcagcaggaaaaauaauuuucgccgcaguaccuccaaauuuuuccacugaaggacuauccccaucacaaguaacaauguucccacauuuaauagucgacguaagacaauuagaaccaguuaugauaccucucccagauaucaggaauaauuucuaucacuauaaucaaucaaaugacccuacaauaaaacuaauagcaaugcuauacacaccauuacgagcaaacaacguaggagaugacguauucacaguaucaugucgcguauuaacaagaccaucaccugacuucgauuucauauuuuuaguaccaccuacagucgaaucaaaaacaaauccauuuucaguaccaauuuuaacaauagaagaaaugacaaacuccagauucccaauuccauuagaaaaacucuuuacaggacccucauccgcccuaguaguucaaccacaaaauggucgaugcacaaccgauggcguauuacuaggaacaacacaacuaucuccagucaacauauguacauuucgaggagacgucacccacacaacaaaaacacacacauaccaaaugaaccuagcagcucaaaauuggaacucuuacgauccaacugaagaaauaccugcaccacuugguacuccagacuuuguaggaaaaauacaaggagucuuaacacaaaccacaaaagaaaacggaucuacucgagcacacaaagcaacaguauacacaggaaccguagaauuuacuccaaaacucggcagaauacaacuauucacagauaccgauaacgacuuagaagcaaaucaaaauaccaaauucacuccaguaggaguaauacaagauggcgaccaccaaaacgaaccacaacaauggguauuacccuccuacucuggaagaaauaaccacaauguacacuuagccccagcaguggcaccaacuuucccaggagaacaacuauuauucuucagaucaacuaugcccgguugcucaggauauccaaacaugaaucuagacuguuuacuaccucaagaauggguacaauauuucuaccaagaagcagcaccagcacaaucagacguagcacuccuaagauucgucaauccagauacaggacguguuuuauucgaaugcaaauuacacaaaucaggcuauguaacaguagcccacacaggacaucacgauuuaguuauaccaccaaauggauacuuucgcuuugacucauggguaucuccauucuacacucuagcaccaaugggcaacggaaccggaagaagaagauaa

SEQ ID NO: 34874 - RNA, 1611 nt, Artificial Sequence
  derived and/or modified sequence opt6 from VP1__Norovirus_and/or_Norovirus-like__KF712507
augaaaauggcaucaucagacgcaaauccauccgacggaucaacagccaaccuaguacccgaagcaaacaaugaaguaauggcauuagaaccaguagucggagcagcgauagcagccccuguagcaggacagcaaaaugucauagaccccuggauaagaaacaauuuuguacaggcuccagguggagaauuuacagucucuccuagaaaugcaccaggugaaguauuauggucugcuccacuaggaccagaccucaacccauaccuaucacaccuagccagaauguauaauggauacgccggcggcuucgaaguucaagucauacuagcaggaaaugcuuuugcagcugguaaaauuaucuuugcagcaguaccaccaaauuucucaaccgaagguuuaucucccucacaaguuacaauguucccacacuuaauagucgacguaagacaacuagaaccagucaugauaccccuaccagauauaagaaacaauuucuaucacuacaaucaaaguaaugaccccacaauaaaacuaaucgcaaugcuuuacacuccuuuacgagccaauaacguaggugacgauguauuuacaguuucauguagaguacuaacaagaccuuccccagauuuugacuucauauuucuaguuccuccuacaguagaauccaaaacuaaccccuucucaguuccuauauuaacaauagaagaaaugacaaacucaagauuuccaaucccacucgaaaaauuauucacagguccauccuccgcacucguaguacaaccccaaaauggaagaugcaccacagauggaguauuacucgguacaacacaacuaucaccaguuaacauauguacauuuagaggagaugucacacacacaacuaaaacucacacauaccaaaugaaucuagcagcacaaaauuggaacuccuaugacccaacugaagaaaucccagcccccuuaggaacaccagacuucguuggaaaaauccaagguguacuaacacaaacaacaaaagguaacggcucaacaagagcucauaaagcaaccguauauaccgguacagucgaauuuacaccaaaauuaggaagaauacaacuauucacagauacagauaacgacuuagaagcaaaucaaaauaccaaauucaccccaguagguguaauacaagacggagaccaucaaaaugaaccacaacaauggguacuaccuucauauucaggaagaaauaaucauaacguacaccuugcaccagccguugcccccaccuuuccaggagaacaauuauuauucuuucgaucuacaaugcccggaugcucaggauauccaaauaugaaucuagacuguuuauugccacaagaauggguacaauauuucuaucaagaagcagcuccugcacaaucugauguagcacuucuaagauucguaaacccagauacaggccgcguauuauucgaaugcaaauuacauaaaucaggcuauguaacuguugcacauacuggacaucacgacuuaguuauuccaccuaauggcuauuucagauuugauucauggguuucaccauuuuacacacucgcaccaaugggcaauggcacaggccgucgaagauaa

SEQ ID NO: 34875 - RNA, 1611 nt, Artificial Sequence
  derived and/or modified sequence opt6 from VP1__Norovirus_and/or_Norovirus-like__JX401281
augaaaauggcaucuaaugaugcaaauccaucagauggaucagcagcuaaccuuguuccagaaguaaauaacgaaguaauggcacuagaaccaguagucggugccgccauagcagcacccguugcuggccaacaaaacguaauagauccauggauacgaaacaacuuuguacaagccccuggaggagaauuuacuguuagccccagaaacgccccaggagaaauacuauggucuaugccacuaagcccagaacuaaauccauaccucagucauuuauccagaauguauaaugguuacgccggaggauucgaaguacaagucauauuagcagguaaugcuuuuacugcugguaaaauuauauucgccgcuauuccacccaauuuuccaacagacggauuaucaccuucacaaguaacuauguucccacauauuaucguagauguaagacaauuagaaccaguauuaaucccuuuaccagacguuagaaacaauuuuuaucacuauaaucaagcaaacgauuccacacuaaaacuaauagcaaugcuauauacaccacuacgagcaaacaaugccggugaugacguauuuacaguaucaugccgaguacucacaagaccauccccagauuuugauuuuaucuuucuaguaccaccaacugucgaaucuagaacaaaaccuuuuacagucccaaucuuaaccguagaugaaaugacaaauucuagauuucccacucccuuagaaaaacuucacacuggaccaaacaacucaauaguaguccaaccucaaaacggaagaugcacuauagacgguguauuacuaggaacaacucaacuuagcacaguuaauauuuguaauuuucgagguucaacuacaagagcaggacaaucucacgcuuacacaaugaaucuaguaucacaaaacuggaauaauuaugaucccacugaagaaauaccagcuccacuuggaacaccagacuuuguaggaaaaauaguuggaaugcuuagucaaacaacacgagaaaacucaucaacaagagcacauaaagcaacaguaucaacaggcgaugcacauuucacacccaaaucuggaucuguccuauuuacaacagauacagacgaccuacaaaauggccaaaauacuagauuuaccccaguagguguugcucaagauggugaaccacaucaaaacgaaccccaacaauggcgucuucccaauuacucaggaacaccaggucauaauguucacuuagcaccuccaguugcaccaacauuuccaggagaacaacuuuuauucuucagaucuaccaugccaggaugcggagguuacccaaauauggaucuagauugccuacuaccccaagaauggguccgacauuuuuaucaagaagcagcaccagcccaauccgacguagcacuauuacguuuuguaaaccccgacacaggaagaguauuauuugaaugcaaacuacauaaagccggauauauaacaguaucacacacuggcccauacgaucucguuauaccuccaaauggauacuucagauuugauucauggguaaaucaauucuacgccuuagcaccaaugggcacaggaacaggaagacgcagauaa

SEQ ID NO: 34876 - RNA, 1611 nt, Artificial Sequence
  derived and/or modified sequence opt6 from VP1__Norovirus_and/or_Norovirus-like__KF806526
augaaaauggcuagcaaugaugccucuccauccgauggaagugcagcaaaucuaguuccagaaguaaauaaugaaguaauggcuuuagaaccaguaguaggugcugcaauagcagcaccuguagcaggucaacaaaauguaauagacccuuggauacguaacaaauuuguucaagcaccaggaggagaauuuacaguaucuccaagaaaugcaccaggugaaauacuauggucugcaccucuaggaccagauuuaaauccauauuuaucacauuuagcacgaauguacaauggauaugccgguggauucgaaguacaaguaauccuagcaggaaaugcauucacagcaggaaaaauaauauuugcagcuguuccacccaauuuuccaaccgaaggacuaucaccaucccaaguuacaauguuuccucauauaguaguagauguaagacaauuagaaccaguuuuaauaccacuaccugacguuagaaauaauuuuuaucauuauaaccaaucuaaagauccaacaaucaaacucauagcaauguuauauacaccauuacgagcaaauaacgcaggcgaagacguauucacaguuucaugccgaguauugaccagaccaaguccugacuucgauuucauauucuuaguaccucccacaguagaaaguagaucaaaaccuuucaccgugccuaucuuaacuguugaagaaaugacaaacagcagauuuccaauuccacuagaaaaauuauuuacaggaccuucaggagcauuuguaguucaaccacaaaauggaagauguacaaccgacggaguauuacuaggaacuacacaauugagucccgucaauauaugcacauuccgaggcgaucuaacacauuucgcagguacccaugaauacgcuaugaacuuagcaucucaaaauuggaauaauuaugacccaacagaagaaauaccagccccacucggugcaccugauuucguaggaaaaauaagaggaguacuaacacaaacaacaagaagagacggaucaacaagaggucauagagcuacccucucaacagguucugcacauuuuacaccaaaauuaggaucaauaagauuuucaacagauacuaacaaugacuuugaagcuggacaaaauacaaaauucacaccaguaggagucuuucaagacggagauaaucaccaaaaugaaccacaacaauggguacuaccuaacuauucaggagcaacagcccauaauguccaucuugcacccgccguagcaccagcauuucccggagaacaauuauuauucuuuagauccacuaugccaggcuguucagguuauccaaacaugaauuuagacugcuuacuaccacaagaauggguacaacauuuuuaccaagaagcagcucccgcacaaucagauguagcacuucuacgauuuguaaauccagauacaaguagagucuuauucgaauguaaacuacauaaaucaggcuauguaacuguagcucauacuggccaacaugacuuaguuauaccuccaaauggauauuuccgcuuugacagcuggguuaaccaauuuuauaccuuagcaccaaugggaaauggcaccggacguagauaa

SEQ ID NO: 34877 - RNA, 1611 nt, Artificial Sequence
  derived and/or modified sequence opt6 from VP1__Norovirus_and/or_Norovirus-like__KF806500
augaaaauggcaaguaaugaugcuaacccuuccgaugguagugccgcaaaccuuguaccagaaguuaauaaugaaguaauggcacuagaaccaguaguaggagcagcaauagcagcaccaguagcuggacaacaaaauguaauagacccauggauacgaaauaauuuuguacaagcaccuggaggagaauuuacuauaucuccaagaaaugcaccaggcgaaauacuuuggagugcuccauuaggaccugacuuaaacccauaucuaucucacuuagcaagaauguauaauggauaugcaggaggcuucgaaguacaaguaguuuuagcaggaaaugccuucacagcaggaaaaguuauuuuugcugcaguaccaccuaauuucccuacagaaggauuaucuccuucacaaguaacaauguucccucauauaauaguagauguaagacaacuagaaccaguacucauaccuuuacccgacguaagaaauaauuuuuaccacuauaaccaaucaaaugauucaacaauuaaacuuaucgcuaugcucuacacaccauuaagagcaaauaacgcaggcgacgauguauuuacaguauccugcagagucuuaacacgaccaucaccugauuucgacuuuauauucuuaguaccacccacaguagaaucaagaaccaaaccauuuucuguacccguacuaacaguagaagaaaugacgaacucuagauuuccaauaccacuagaaaaacucuuuaccggaccauccucagcauucguaguacaaccccagaacggccgaugcacaacagauggaguacuccuaggaacuacacaauuaucugcagucaauaucuguaccuuuagaggagacguaacgcacguagcaggagauacauuugcaaugaaucuagcuucauuaaacuggaauaauuacgauccaacagaggaaacuccugcaccacucggaacaccagauuucguuggcagaauacauggcaugcuuacacaaacaacaagaagugacggcgcuacaagagcacauaaagcuacaguaucaacuggaggugcagauuucacaccuaaauuaggcuccguaagauauucaacagacacaucaucagaucucgaaguaagagaaaacacaaaauuuacuccaauugguguauuacauucaucaggaggacauagagcagaaccugaucaauggagacuaccagaauauuccggaagaaacguacacaauguccacuuagcacccgcaguagcuccaaccuuuccuggagaacaauuauuauuuuucagaucaacaaugccaggaugcggaggauacccaaacauggauuuggauuguuuauuaccccaagaauggguacaacauuuuuaccaagaagcagcaccagcacaaucagauguugcacuacuaagauucguaaauccugauacaggucgaguuuuauuugaauguaaauuacacaaaucaggauacguaaccgucgcccauacaggaccacaugauuuaguuauaccaccuaauggauauuucagguucgauucauggguaaaccaauuuuauacauuagcaccaaugggaaacggaaccggaagaagaagauaa

SEQ ID NO: 34878 - RNA, 1611 nt, Artificial Sequence
  derived and/or modified sequence opt6 from VP1__Norovirus_and/or_Norovirus-like__KF806498
augaaaauggcaagcaaugaugcaaauccuagcgacggaucagcagcaaauuuaguaccagaaguaaauaaugaaguaauggcauuagaaccuguuguaggagccgcuauagcagcaccugucgccggucaacaaaauguaauagauccauggauacguaauaauuuuguacaagcucccgguggagaauuuaccauaucaccacgaaaugcaccaggagaaauauuauggucagcaccauuaggaccagaucuuaauccauauuuaucccaccuagcaagaauguacaacggauaugcuggaggauucgaaguacaaguaguuuuagcaggaaaugcauuuacagcaggaaaaauaauuuuugcugcaguaccuccaaauuuuccuacagaaggacuaucaccaucacaaguaacaauguuuccacauaucauagucgauguacgccaacuagaaccaguacuaauaccucuaccagauguuaggaauaacuuuuaucauuauaaucagaguaaagacucaacgauaaaacuaauugcaauguuauauacaccucuacgagcaaacaaugcaggagaugacguauuuaccgucucaugucgaguauuaacuagaccaaguccugacuuugauuucauauuuuuaguaccacccacagucgaaaguagaacaaaaccauuuucaguccccguauuaaccgucgaagaaaugacaaauucacgauucccaauuccacuugaaaaacuauuuaccggaccuuccucugcauuuguaguccaaccucaaaacggaagauguacaacugauggcguauuauuaggaacaacccaauuauccgccguaaacauuugcacauuuagaggcgauguuacccauguagccggagacacauuugcuaugaauuuagcaucauuaaauuggaauaauuaugauccaacugaagaaacaccagcaccacuaggaacccccgauuucguaggacgaauccacggaaugcucacucaaacuacaagaucagauggagcaacucgagcacauaaagcaacaguauccaccgguggagcagauuuuacccccaaauuaggaucaguuagauacucaacagauacauccucugaucuagaaguuagagaaaacacaaaauuuacaccaauugguguacuacacucaucaggaggacauagagcagaaccagaccaauggcgacuacccgaauauucaggacgaaauguacauaauguacaucucgcuccugcaguagcaccaacauucccaggagaacaacuacuauucuuuagaucaacaaugccuggaugugguggcuauccaaauauggaucuagauugucuuuuaccacaagaauggguacaacacuuuuaucaagaagccgcaccagcacaaagcgacguagcacuuuuaagauuuguaaacccugauacaggacgaguauuauuugaaugcaaacuucacaaaaguggauacguaacuguagcucacacaggaccacaugauuuagucauacccccaaacggauauuucagauuugauucuuggguaaaccaauucuauacuuuagcaccaaugggcaacggaacuggaagaagaagauaa

SEQ ID NO: 34879 - RNA, 1611 nt, Artificial Sequence
  derived and/or modified sequence opt6 from VP1__Norovirus_and/or_Norovirus-like__KF429768
augaaaauggcauccucagaugcaaacccuucugacggaucaacagcuaacuuagucccagaagcaaacaacgaaguuauggcauuagaaccaguaguaggugcagccauugcagcaccaguagcuggacaacaaaacguaauagacccauggauaagaaacaauuuuguacaagccccaggcggagaauuuacaguauccccuagaaaugcaccuggagaaguauuauggagugcaccacuaggcccagauuuaaacccauauuuaucucaucuagccagaauguauaauggauacgccggaggauuugaaguccaaguaauacuagccggaaaugccuuugcagccggaaaaauaauauucgcagcaguaccuccaaacuucaguacagaagguuuaucaccaucccaaguaaccauguucccccaccucaucguagacguaagacaacucgaaccaguaaugauaccacucccagauauaagaaauaauuuuuaccauuacaaucaaucaaacgacccaacaauuaaauuaauagcaauguuauauacuccacuacgagcaaacaacguaggagacgacguauuuacagucucaugcagaguacuaaccagaccaucaccagauuuugauuuuauauuccuaguuccaccaaccgucgaaucaaaaacaaaucccuucucaguuccaauauuaaccauagaagaaaugacaaacuccagauuuccuauuccacuagaaaaacuauucacugguccaaguucagcccuuguuguacaaccacaaaacggaagaugcacaacugacgguguuuuacuagguacuacacaauuaucaccuguuaauauauguacauuuagaggcgacguaacacauacaacuaagacacacacauaccaaaugaaucuagcagcacaaaauuggaacucauacgauccaacagaagaaacuccugcaccucucggaacaccagacuuuguagguaaaauacaaggcguauuaacacaaacaaccaagggaaauggauccacaagagcacacaaagcuacaguauauacuggcacaguugaauuuacucccaaacuaggucgcauucaacuauucaccgacacugauaaugacuuagaagcaaaucaaaacacaaaauucacaccugucggaguaauacaagacggagaucaccaaaaugaaccucaacaguggguuuuaccaucauacucaggaagaaauaaccauaacguacacuuagccccagcaguagcuccaacuuucccaggugaacaauuacuauucuuuagaucaacaaugccaggaugcucuggauaucccaacaugaaucuagacuguuuauuaccucaagaauggguacaauauuucuaucaagaagcagcaccagcacaaucagacguagcuuuauuaagauucguaaaccccgauacaggaagaguacuauuugaaugcaaacuucacaaaucaggauauguaacaguagcucauacaggccaucacgaccuaguuauaccaccuaaugguuauuucagauucgauucauggguauccccauucuacacacuugcaccaaugggaaauggaacaggacguagaagauaa

SEQ ID NO: 34880 - RNA, 1611 nt, Artificial Sequence
  derived and/or modified sequence opt6 from VP1__Norovirus_and/or_Norovirus-like__KF806496
augaaaauggcuucaaaugaugcaaauccaucagauggauccgcagcaaauuuaguacccgaaguuaacaacgaaguaauggcacuugaaccaguaguaggugcagcuauagcugcaccaguagcaggacaacaaaacguuauagauccauggauaagaaauaacuucguacaagcacccggaggugaauuuaccauaucaccaagaaaugcaccaggagaaauucucuggucagcucccuuaggaccagauuuaaauccauaucuaagccaccuagcacgaauguacaaugguuaugcaggagguuuugaaguacaaguaguucuagcagguaaugcuuuuacugccggcaaaauaauauucgcagcaguaccaccaaacuuuccaacagaaggauuaucaccuucacaaguaacaauguuuccacauauaauaguagauguuagacaauuagaaccaguauuaauaccuuuaccagauguuagaaacaacuuuuaucauuauaaucaaagcaaagacucaacaauuaaacucauagcaauguuauacacaccauuaagagcuaacaaugcaggagaugauguauuuacaguuucuugucggguauuaacucgacccucaccagauuuugauuucauauuuuuagucccaccuacuguagaaucaagaacaaaaccauucuccguaccuguacuaacaguugaagaaaugacaaauucaagauucccuauuccacuugaaaaauuauuuacagguccaucaucagcuuucgucguacaaccccaaaacggcagauguacuacagauggaguauuacuagguacaacacaauuaucagccguaaauauauguaccuuccguggcgauguaacccacguagcaggagauacauuugcaaugaacuuagcaucauuaaauuggaauaauuaugauccuacagaagaaacaccagcaccacuaggaacccccgacuuuguugguagaauacauggaaugcuuacacaaacaacacgaucagauggagcuacuagagcacacaaagcuacaguaucaaccgguggugcugacuuuacaccaaaauuaggaucuguaagauacucaacagauacauccggagaucuagaaguuagagaaaauaccaaauucacaccaauuggaguacuacauagcucaggagagcgacgugcagaaccugaacaauggagacuaccugaauacucuggcagaaacguacauaauguacaucuagcaccagcaguagccccaacauuuccaggagaacaacuccuauucuuucgaaguacaaugccaggaugcggaggauauccaaauauggauuuagauuguuuauuaccucaagaauggguucaacauuuuuaucaagaagcugcaccagcacaaagugauguagcauuauuaagauucguaaauccagauaccgguagaguauuauucgaauguaaacuacauaagucaggauauguaacagucgcacacacagguccccacgacuuagucauaccuccaaaugguuauuucagauuugauucauggguuaaucaauucuauaccuuagcuccaaugggaaauggaaccggacguagaagauaa

SEQ ID NO: 34881 - RNA, 1611 nt, Artificial Sequence
  derived and/or modified sequence opt6 from VP1__Norovirus_and/or_Norovirus-like__KF806499
augaaaauggcaucuaacgaugccaauccauccgauggaucagcagccaauuuaguaccugaaguaaacaaugaaguaauggcacucgaaccaguuguaggagcagcaauagcagcaccaguagcaggacaacaaaauguaauagauccauggauacgaaauaauuucguacaagcaccugguggugaauuuacgauaucuccaagaaaugcaccaggagaaauccuuuggucagcuccacuaggacccgauuuaaacccuuaucuuucacaccuagcacgaauguauaaugguuaugcaggaggauuugaaguacaaguuguucuagccggaaacgcauucacagcaggaaaaauaauauucgcagcaguaccacccaauuucccuacagaaggacuaucuccaucccaaguaacuauguuuccacauauuauaguagauguuagacaacucgaacccguacuaauaccauuacccgauguaagaaauaauuuuuaucacuauaaucaaucaaaagacuccaccaucaaauuaauagcaaugcuauauacaccacuacgagcaaauaaugcaggagacgacguuuuuacaguaucuuguagaguacuaacaaggccaucuccagauuucgauuuuauauuucucguuccaccaacugucgaaucaagaacuaaaccauucagcguaccaguauuaacaguagaagaaaugacaaauucaagauuuccaauaccucuagaaaaauuauuuacgggacccuccucugcauucguuguacaaccacaaaacggucgauguacaacagaugggguucuuuuaggaacaacucaauuaucagccguaaauauauguacuuuccgcggagacguaacucacguugcuggugauacauucgcaaugaaucuugcaucacuaaauuggaauaacuaugauccaacugaagaaacucccgcaccacucggaacaccugauuucguaggaagaauacauggcaugcuaacucaaacaacaagaucugauggagcaacacgagcacauaaagcaacaguaagcacuggaggcgcagauuucacgccaaaacucggaucaguccgauacucaacagauacauccuccgaccuagaaguuagagaaaauacuaaauucacaccuauaggaguucuacacucaagcggaggacaucgcgccgaaccagaucaauggcgacuuccagaauauucaggcagaaauguacauaacguucauuuagcaccagcaguagcaccaacauucccaggcgaacaacuauuauucuuuagaucaacaaugcccggauguggcggcuauccaaauauggacuuagauugucuauuaccacaagaauggguacaacauuuuuaucaagaaacagcacccgcccaaucagauguagcucuacuaagguuuguaaauccugauacaggcagaguauuauuugaauguaaacuucauaaaucaggauauguaacaguagcacacacuggaccacaugauuuagucauaccaccaaauggauauuuuagauuugacuccuggguaaaucaauuuuauacauuagcacccauggguaacgguacuggaagaagacgauag

SEQ ID NO: 34882 - RNA, 1611 nt, Artificial Sequence
  derived and/or modified sequence opt6 from VP1__Norovirus_and/or_Norovirus-like__KF806497
augaaaauggcaucaucagaugcuaauccaucugacggaucagcagcaaaccuaguuccagaaguaaauaacgaaguaauggcacuagaaccuguuguaggagcagcuauagcagcacccguugcaggucaacaaaauguuauagacccauggauucguaauaauuucguacaagccccagguggcgaauuuacuauaaguccaagaaacgcuccuggagaaauacuauggucugcaccacugggaccagauuuaaacccauauuuaucacauuuagcacgaauguauaauggauaugcaggagguuuugaaguacaaguaguacuagccgguaaugcauuuacagcaggaaaaauuauauuugcagcagucccaccaaauuuuccuacugaaggacuaucacccagccaaguaacgauguuuccacacauaauaguagaugucagacaacuagaaccaguacuuauuccauuaccagauguaagaaacaauuuuuaucauuacaaucaaucaaaagauagcacaauaaaauuaaucgcaauguuauauacaccacucagagcaaauaaugcaggagaugaugucuuuaccguuucuuguagaguauuaacaagaccuucaccugauuuugauuuuauuuuucuuguuccucccacaguugaaucaagaaccaaaccauuuucaguaccagucuuaacugucgaagaaaugacaaauucaagauuucccauuccacuagaaaaacuauuuacagguccaagcucagcuuuuguaguacaaccgcaaaauggacgaugcacaaccgauggaguacuacuaggaacuacucaauuauccgcugucaacauauguacauucagaggagauguaacacauguagcaggagauacuuuugcaaugaauuuagcuucacuaaauuggaauaauuacgauccuacagaagaaaccccugcaccauuaggaacaccagauuuuguuggacguauacauggaauguuaacacaaaccacaagaagugauggugcaacacgcgcucauaaagcuacaguauccacuggaggagcagacuucacaccaaaauuagguaguguaagauauucaacagauacuucaagcgacuuagaaguacgcgaaaauacaaaauucacaccaauaggaguauuacauuccucaggaggacacagagcagaaccagaucaauggagacuuccugaauacucagguagaaauguacauaauguacaccuagcuccugcagucgcaccaacauuuccaggagaacaauuacucuucuuuagaucaaccaugccaggauguggcggauauccaaauauggaccuagauugcuuacuaccacaggaauggguacaacauuuuuaccaagaagcagcaccagcacaaucagacguagcacuccuaagauuuguuaacccagauacaggaagaguauuauuugaauguaaacuacacaaaucagguuacguaaccguagcucacacuggaccacaugauuuaguaauaccaccaaauggauauuucagauucgauucauggguaaaucaauuuuauacucuagcaccaaugggaaaugggacaggacgacgaagauaa

SEQ ID NO: 34883 - RNA, 1611 nt, Artificial Sequence
  derived and/or modified sequence opt6 from VP1__Norovirus_and/or_Norovirus-like__JN699046
augaugauggcaucaaaagaugcaucuccaucagcagacggagcuaauggagcaggacaauuaguaccagaaguaaacaaugccgaaccacuaccccuagacccuguugcuggagcauccacagcauuagccacagcuggucaaguaaauaugauugauccauggauauuuaauaacuuuguacaagcaccccaaggcgaauuuacaauuucaccaaauaauacaccaggugauauauuauuugaucuucaacuaggcccucaucuuaauccuuuucuagcgcaucucucacaaauguacaacggauggguaggaaauaugcgaguaagaguuauacuagcaggaaaugcauucacagcaggaaaaguaauuauauguuguguaccaccaggauuucaauccagaacuuuaucuaucgcucaagcuacucuauuuccccauauuauagccgauguaagaacauuagaaccaauagaaaucccauuagaagauguucguaauacccuuuaccacacaaacgauaaucaaccaaccaugcgacuucucuguauguuauacacaccuuuaagaaccggcggagguucaggaggaacagaugcauuugucguagcaggaagaguacuaacauguccaagcucagauuuuaauuucuuauuucuagucccaccaacaguagaacagaaaacaagaccuuuuucaguaccuaauauaccuuuacaauuauuaucaaauucacgaguaccaaaucuaauacaaucaaugguacuauccccagaucaagcacaaaacguacaauuucaaaacgguagauguacaacugauggucaacuacuaggcacuacgcccguauccgucucucaaauauuaaaauuucgaggaaaaguaucagcuggcaguagaguaauaaauuuaacagaauuagauggauccccauucuuagcauuugaagcacccgcaccaacaggauuuccagacuuaggaacauccgauuggcauguugaaaugucucuuaauucaaauucucaauccucugguaacccaauacuauuaagagauauacaaccaaacagcucugauuuuguuccccaucucggaucuguaucaguuaccacagcaauagauguagcuggagauuauacaggaacaauacaauggacuucacaaccuucuaacguuacaccagucccagaugucaauuuuuggacaauaccucaauauggaucaaaucuagcagaagcaucccaacuagcaccaguaguauacccuccaggauuuggcgaagcaauaguauauuucaugucaccaauaccaggaccaaauacagcacauaaaccuaaccuuguacccugucuuuuaccacaagaauuuguaacucauuuuguuucugaacaagcaccuucaaugggugaagccgcacucguucacuauguagauccugauaccaacagaaauuuaggagaauuuaaauuauauccugaagguuuuauaaccuguguaccuaacggcaccggcccucaacaacuaccucuaaacggaguauuuguauuugccucauggguauccagauuuuaccaacuaaaacccguaggaacagccucaucagcacguuaa

SEQ ID NO: 34884 - RNA, 1611 nt, Artificial Sequence
  derived and/or modified sequence opt6 from VP1__Norovirus_and/or_Norovirus-like__AM263418
augaugauggcuucuaaagaugcaagcccaucugcugauggagcaaauggagcuggacaacucguaccugaaguaaauaacgcugaaccacucccacuugauccaguagcaggcgccucuacagcacuagccacagcaggacaaguuaauaugauagaccccuggauauuuaacaacuucguucaagcaccacaaggugaauucacuaucucaccuaacaauacaccaggagacaucuuauuugauuuacaacuaggaccacauuuaaauccuuuucucgcacacuuaucacaaauguauaauggauggguagguaauaugagaguaagaguuauuuuagcaggcaaugcauuuacagcaggcaaaguaauaguauguuguguaccaccagguuuucaaagucguacacuaucaauugcucaagcaacauuauuuccucacauaauagcagauguaagaacauuagaaccaauugaaaucccauuagaagauguacgaaauacuuuauaucauacaaacgauaaucaaccaacuaugagacuauuauguaugcuauacacaccauuacgaacaggaggaggaucagguggaacugaugcauuugucguagcuggccgugucuuaacuugcccauccucagacuucaauuucuuauuuuuaguaccaccaacuguagaacaaaaaacacgcccauuuucaguuccaaauauaccucuucaauuauuaucuaacucacgcguacccaauuuaauccaaucaauggucuuaucuccugaccaagcucaaaauguacaauuucaaaauggaagauguacuacagauggacaauuauuaggaaccacuccuguauccgucagucaaauucuaaaauuccguggcaaagucucugcagguuccagaguaauaaauuuaacagaacucgauggauccccuuuuuuagcauuugaagcaccagcaccaacaggauuuccagauuuaggaacuuccgacuggcauguagaaaugucccuaaacucaaauucacaaucauccggaaauccaauccucuuaagagauauccaaccaaacucuucagacuucguaccccaucuuggaucaguagcuguaacaacagccauagacguugcaggagauuauacaggaaccauacaauggacaucccaaccuucuaacguaacaccgguaccugauguaaauuucuggacaauaccacaauauggaucaaauuuagcugaagcaucucaauuagcaccaguaguauauccaccaggauuuggugaagcaauagucuauuuuaugucaccaaucccuggaccaaauaccgcacacaaaccaaaucuaguucccuguuuacuuccacaagaauuuguaacccacuuugucucugaacaagcacccucaaugggcgaagccgcauuaguacauuaugucgauccagacacaaauagaaaccuaggagaauucaaacuuuaucccgaaggauucauaacaugcguaccaaaugguacaggaccacaacaauuaccauuaaacggcguauuuguuuuugccucauggguuucacgcuuuuaucaacuuaaacccguugguacagcauccagcgcccgcuaa

SEQ ID NO: 34885 - RNA, 1611 nt, Artificial Sequence
  derived and/or modified sequence opt6 from VP1__Norovirus_and/or_Norovirus-like__KT732278
augaugauggcauccaaagaugcaacuccaucagcagauggagcaaauggagcaggccaauuaguaccagaaguuaauaaugcagaaccucuaccauuagacccaguagcuggugcaucaacagcuuuagcaacagcaggacaaguaaauaugauagauccuuggauauuuaacaacuucguccaagcuccucaaggagaauuuacuaucucaccaaauaauacaccaggugacauccuauucgaucuucaauuaggaccucacuuaaauccauucuuagcacauuuaucucaaauguauaauggaugggucggaaauaugagagucagagucauacucgcaggaaaugcauucacugcagguaaaguaauuauaugcugcguaccucccggauuucaaucuagaacauuaucaauagcucaagccacacuuuucccacauauaauagcagauguaagaacauuagaaccaauagaaauaccauuagaagauguaagaaauacauuauaccacacaaaugacaaucaacccacuaugagacuauuaugcauguuauacacaccccuacgaacugguggaggcucaggaggaacagacgcauucguaguagcaggcagaguauuaaccucacccuccccagacuucaauuuccuauuuuuagucccaccaacaguugaacagaaaacuagaccauucaguguucccaauauaccauuacaacuacuaucuaauucacgaguacccaaucucauacaauccaugguauuaucuccagaucaagcacaaaauguucaauuccaaaauggaagaugcacaacugauggucaacuauuaggaacaacuccaguuucagucucacaaauacucaaauuucguggaaaaguaucugccggaucuaaaguuauaaauuugacagaauuagacggaaguccuuuccuugcuuucgaagcacccgcaccuacuggauuucccgaccuuggaacaucagacuggcauauagaaaugucacuuaacucaaacagucaaucaagcggaaauccaauuuuacucagagauauucaaccaaacaguagcgauuucguuccccaccuuggaucaguugcaguaacaacagcaauagauacagcaggagacuacacugguaccauucaauggacaucacaaccaucaaauguaacaccaguuccagauguaaauuucuggacaauaccacaauacggaagcaauuuagccgaagccucacaacuugccccaguuguauauccacccggcuucggagaagcgauaguauauuucaugucaccaaucccuggaccuaauacugcacauaaaccaaaccuaguaccaugucuacuaccacaagaauuuguaacacauuuugucucugaacaagcuccaucaaugggugaagcagcuuuaguacauuauguugacccugacacuaaccgaaauuuaggugaguucaaacuauaccccgaaggcuucaucacaugcguuccuaauggaacaggcccacaacaacuaccacucaacgguguauucguuuuugcaaguuggguaagccgauuuuaucaacuaaaaccaguuggcacugcaaacucagcaagauaa

SEQ ID NO: 34886 - RNA, 1611 nt, Artificial Sequence
  derived and/or modified sequence opt6 from VP1__Norovirus_and/or_Norovirus-like__KT732277
augaugauggcaucaaaagaugcaacaccuucugcagacggagcaaacggagccggacaauuaguaccagaaguuaacaaugcagaaccucuaccauuagauccaguugccggagcuucuacagcacuagcaacagcaggacaaguaaacaugauagaccccuggauauuuaauaauuucguacaagccccacaaggcgaauuuacuauaucaccaaauaacacacccggagauaucuuauucgaucuacaacuuggaccccaccuaaacccuuuucuagcacaccuaucucaaauguacaacgguuggguuggaaacaugagaguacgaguaauuuuagcugguaacgcauucacagccggaaaaguaaucauauguugcguaccuccagguuuccaauccagaacuuuaucaauagcccaagcaacucucuuuccacacauuauagccgauguaagaacucuugaaccaaucgaaauaccauuagaagacguaagaaauacacuauaccauacuaaugacaaucaaccaacaaugagacuacuauguaugcuauacacaccauuacgaaccggcggaggaucuggaggaaccgacgccuuuguaguagccggacgcguacuaacaucacccucaccagacuucaauuuuuuauuccuaguaccucccacaguagaacaaaaaacacgcccauuuuccguaccuaacauaccauuacaacuccuaucaaacucacgaguaccaaauuuaauacaauccaugguaccaucuccagaccaagcucaaaauguacaauuccaaaacggaagauguacaacugacggacaauuacuaggaacaacacccguuucaguaucacaaauccuaaaauuuagaggaaaaguuucugcaggaucaaaaguaauaaauuuaacagaauuagacggaaguccauucuuagccuucgaagcaccagcuccaaccggauuucccgaccucgguacauccgauuggcacauagaaaugucauuaaauucuaauucucaaucaaguggaaauccuauauuauuaagagacauccaaccaaacuccucagauuucguaccccaucuaggcuccguugcaguaacuacagccaucgacacagcaggcgauuacacaggaacaauacaauggacaucacaacccucaaauguuacaccaguaccagauguaaauuucuggaccauaccucaauacggaucuaaccuagcagaagcaagccaauuagcaccagucguauacccaccugguuucggcgaagcaauagucuauuucaugucaccaauaccaggaccuaacacugcacauaaaccuaaucuuguaccuugucuuuuaccccaagaauucgucacucauuucguauccgaacaagcaccuucaaugggagaagcagcucuaguccacuacguagauccugacacaaauagaaaccuuggagaauuuaaauuauacccagaaggauuuauuacaugcguaccaaacgguacuggaccucaacaauuaccacuaaacgguguauuuguauuugcaucaugggucucaagauuuuaccaauugaaaccuguagguacagcaaauucagcccguuaa

SEQ ID NO: 34887 - RNA, 1611 nt, Artificial Sequence
  derived and/or modified sequence opt6 from VP1__Norovirus_and/or_Norovirus-like__KJ402295
augaugauggcaucuaaagaugcacccucaucagcagacggugcaaacggagcgggacaauuagugccagaaguaaacaaugcugaaccauuaccucuugauccaguagcuggagcaucaacagcucuagcaacagcaggacaagucaauaugauugaccccuggaucuucaauaauuuuguccaagcaccacaaggagaauuuacaauaucaccaaacaauacaccaggagacauacuauuugaccuacaacuuggaccacauuuaaaucccuuucuagcacaucuaucccaaauguauaacggauggguaggcaauaugcgaguucgaguuauacuugcgggaaacgcauuuacagcaggaaaaguuaucauauguuguguccccccagguuuccaaagccgcacacuuucaauugcacaagcaacauuauuuccucauauuauagccgaugucagaacauuagaaccaauagaaaucccccuugaagauguuagaaauacauuauaccacacaaacgauaaccaaccaacaaugagacuacuauguaugcuauacacuccacuaagaacuggcgguggaucaggaggaacagaugccuuugucguagcaggacgaguacuuacaugcccuucaucugacuuuaauuuuuuauuccucgucccaccaacaguagaacaaaaaacucgaccuuucucagucccaaacauaccccuucaauuacuaucaaacucacgaguacccaaccuaauccaaucuaugguauuaucacccgaucaagcacaaaauguucaauuccaaaacgguagauguacaacagacggacaacuucucggaaccacacccguaagcgugucucaaauacuaaaauucagaggcaaaguaucagcuggcagcaaaguaauuaauuuaacugaacuagacggaucacccuucuuagcauuugaagcaccagcacccacaggauucccagauuuaggaacauccgacuggcacgucgaaauguccuuaaacuccaacucucaaucuucagguaacccaauacuccuaagagauauucauccaaacucaagugaauucguaccccaucuaggaucuguuugcguaacugcagccauugaagucgcaggcgacuauacaggaacuauacaauggaccucacaaccuucaaauguuacccccguaccagaugucaauuucuggacaauaccacauuacggaagcaaccuagcagaagcuucacaacuagcaccaguuguauauccccccggcuuuggagaagcaauaguauauuucaugucuccaauaccuggaccaaauacagcacauaaaccaaaccuaguaccauguuuacucccacaagaauucguaacccauuucguaucagaacaagcuccaucaaugggagaagcagcacuaguacauuacguagacccagacacaaauagaaaccuaggcgaauuuaaacuuuauccagaagguuuuauuacaugcguaccaaauggaacaggaccccaacaacuaccacuaaauggcguauucguauuugcuucauggguaucccguuucuaccaauuaaaaccaguuggaacagcaucaucugcccgauaa

SEQ ID NO: 34888 - RNA, 1611 nt, Artificial Sequence
  derived and/or modified sequence opt6 from VP1__Norovirus_and/or_Norovirus-like__AF414406
augaugauggcaucaaaagaugcaucaccuagugcugacggcgcuaacggagcaggacaauuaguaccagaaguaaauaaugcagaacccuuaccauuagacccaguagcuggagcuucuacagcacuagcaacagcaggacaaguuaauaugauagauccauggauauuuaacaauuuuguccaagcaccgcaaggcgaauuuacuauaucaccuaauaauacacccggagauauuuuauuugacuuacaauuaggaccacacuuaaauccuuuccuagcacaucuaucacaaauguauaauggauggguaggaaauaugagaguaagaguuaucuuagcaggaaaugcauucacugccggaaaaguaauaguauguugcguuccaccagguuuucaauccagaacauuaaguauagcacaagcaacauuauuuccacauauaauagccgauguccgaacacuagaaccaauagaaaucccacuagaagacguuagaaauacuuuauaccauacaaaugauaaucaaccaaccaugagauuacuaugcauguuauacacaccacuucgaacaggcggaggcucgggugguacugacgcuuucguaguagcaggaagaguucucacuugcccaucaucugacuuuaauuuucuauuucuagucccaccaacaguagaacaaaaaaccagaccauuuucagucccaaauauaccccuacaauuacuauccaacucacguguaccuaauuuaauucaaucaaugguaccuucaccagaucaagcacaaaauguacaauuccaaaauggaagaugcacaacagauggacaacuacuuggaacaacacccguaucaguaucacaaaucuuaaaauucagaggaaaaguaucugcuggcucacgaguaaucaacuuaacagaacuugacggaucaccauucuuagccuucgaagcaccagcgccaacaggcuuuccagaucuaggcaccucagauuggcauguagaaaugucccuaaauucaaauucucaaucaucagguaacccaauucuauuaagagauauacaaccaaauucaucagauuuuguuccacaucuuggaucaguagcaguuacuacugcaauagauguagcaggagauuauacaggaaccauucaauggacaucccaaccuucaaauguaacaccuguaccagacguuaauuuuuggacaauaccacaauacggaucuaaccuagcugaagcuucacaacuugcaccagucguauacccuccaggauuuggagaagcaauagucuauuucaugucaccuaucccaggccccaauacggcacauaaaccaaauuuaguaccacgacuauuaccacaagaauuuguuacucauuucguauccgaacaagcacccucuaugggagaagcagcuuuaguccauuauguagacccagauacuaacagaaacuuaggagaauuuaaacuauacccagaaggauuuguuacauguaugcccaauggaacaggaccacaacaacuuccacuaaacgguguauucguauucgcauccuggguaucaagauuuuaucaacuaaaaccugucggcacagcaucuucagcacgauaa

SEQ ID NO: 34889 - RNA, 1611 nt, Artificial Sequence
  derived and/or modified sequence opt6 from VP1__Norovirus_and/or_Norovirus-like__AB039774
augaugauggcaucaaaagaugcaacaccaucagcagacggagccaacggagcaggacaacuaguaccagaaguaaacaaugcugaaccacucccauuagacccuguagcaggagcuucaacugccuuagcaacagcaggucaaguaaacaugauagauccuuggauauuuaauaauuuuguucaagcaccacaaggugaauuuacaauaucaccaaauaacacaccaggagacauacuauuugaccuacaacuuggaccccacuuaaauccauuuuuagcacaucuaucacaaauguauaacggaugggucgguaacaugagaguuagaguuauacuagcagguaacgcauuuacagcaggaaaagucauaauauguuguguccccccaggauuccaaucccgaacucuaucaauagcacaagcuacacucuuuccccauguaauagcagauguacguacacuggaaccccuagaaauaccacuagaagacguaagaaacacauuauaccauaauaaugacucacaaccaacaaugagacuuuuauguaugcuuuauacccccuuaagaacaggaggaggcucagguggaacagaugcauuuguuguagcaggaagaguacuaacauguccaagcccugauuuuaacuuucuuuuccuaguuccaccuacaguagaacaaaaaacaagaccauuuucuguaccaaauauuccacuacaaaaucucucuaacucuagaguuccaucccucauucaauccaugguauuaucaaacgaccacgcacaaacaguacaauuccaaaacggaagauguaccaccgauggccacuuacuaggaaccacucccguaucagcaggucaacuaaugaaauuuagaggcaaagucacaucaggaucaaaaguauuaaaucuaacugaacuagauggaaguccuuuccuugcuuuugaagcacccgcuccugcaggauuuccagaucuugguaaaugugacuggcacguagaaaugucccuauaucaagacaauaaccaugcagauccaauaguacuacaugcaaucgaaccaaauucuucuucuuucguaccacacuuaggauccgucuccuucaaagaaaauguuaauguugcaggagauuauguauguacaauacaauauacaucaccaccaucagauccgcacaaucccaacgcagacguugacuucugguccauucccgacuacggauccaaccuugcagaagcuagccaacucgcaccaguaguauauccucccggcuuuggagaagcaauaguauauuucaugucuagaguuccaggauggaacagaacuaacagauuaaaucuuguacccugcuuacucccacaagaauuuauaggacacuucguaucagaacaagcaccagcaauaggcgaagcagcucucuuacauuacguagacccagacacaaacagaaacuuaggugaauuuaaacuauaucccgaaggauuuauaacuugcguaccaaacgguaccggaccacaacaacuaccauuaaauggaguuuucguauucucuucauggguaucaagauuuuaucaauuaaaaccaguaggaacagcaagucuagcucgcuaa

SEQ ID NO: 34890 - RNA, 1611 nt, Artificial Sequence
  derived and/or modified sequence opt6 from VP1__Norovirus_and/or_Norovirus-like__KP064095
auggccucuaaagaugcaccacaaagcgcagauggagcuucaggcgcaggacaauuaguuccugaagucaauacagcugauccacuuccuauggaaccaguagcaggaccaacaacugcaguugcaacagccggccaaguuaauaugauagauccuuggauaguaaauaauuuuguacaaucuccacaaggcgaauuuacaauaucuccuaauaauaccccaggagauauccuauucgaccuacaauuaggaccccaucuuaauccauuccuuucacacuuaucacaaauguauaauggcuggguuggaaacaugagagucagaauauuacuagcaggaaacgcuuuuuccgcuggcaaaauaauagugugcuguguuccaccuggauuuacaucaucuucucuaacaauagcucaagcaacacuauuuccacacguaauugcagaugucagaacauuagaaccaaucgaaaugccuuuagaagauguaagaaauguccuuuaucauacaaaugacaaucaaccaacuaugagacuuguauguaugcuauacacaccccuaagaacaggcggaggaucgggcaauucugacucuuuuguggucgcaggaagaguauuaacagcccccucaucagauuuuucauuccuuuucuuaguuccaccuacuauugaacaaaagacaagagccuuuacuguuccaaauauaccucuacaaaccuuaucaaacucaagauuuccaucacuuauacaaggaaugauacuaucaccugaugcuucucaaguaguccaauuucaaaauggccgaugccuaauagauggacaauuacuaggaacaacaccagcaacaucaggucaauuauuucgaguccgaggaaaaauuaaccaaggugcaagaacacuaaaccucacagaaguagauggaaaacccuuuauggcauuugauucuccagcuccuguaggauuuccugacuuuggaaaaugugauuggcauaugcgaauauccaaaacuccaaauaauacaucaucaggagauccaaugagauccguaucaguucaaaccaacguacaaggauuuguaccucauuuagguucuauacaauuugacgaagucuuuaaccacccaacaggugacuauaucggaacaauugaauggauaucucaaccaucaacacccccaggaacagauauuaaccuaugggaaauacccgacuacggauccucacuaucacaagcagcaaaccuugcaccaccagucuuucccccaggauuuggugaagcauuaguauauuuuguaucagcauuucccggcccaaauaaucgaucagcacccaaugacgucccaugcuuauuaccacaagaauauauaacacauuucgucucagaacaagcuccaacaaugggagacgcagcucuacuacacuauguagacccagacacuaauagaaaucuaggugaauuuaaauuauauccgggugguuaucuaacauguguaccuaacgguguaggugcaggcccucaacaauuacccuuaaauggaguuuuucuuuuuguauccuggguaucaagauuuuaccaacuaaaaccaguaggaacagcuucaacugcucgauaa

SEQ ID NO: 34891 - RNA, 1608 nt, Artificial Sequence
  derived and/or modified sequence opt6 from VP1__Norovirus_and/or_Norovirus-like__AB045603
augaaaauggcaucaucagacgcugccccauccaaugacggagcagcaggauuaguaccugaagcaaacaaugaaacaauggcacucgaaccuguagccggugcaucgauugcagcacccuuaacuggacaaaacaauauaaucgacccauggauuagauuaaacuucguucaagcaccaaacggagaauuuaccguaagccccagaaacucaccuggugaaguacuuuuaaacuuagaauuaggaccagaacuuaauccauauuuagcacaccuaucaagaauguacaacggauaugccggagguguagaaguucaaguccuucucgccggaaacgcauucacagcaggaaaauuaguauucgcugcaguaccaccacacuuuccucuagaaaacauaucaccaggacaaauaacaauguuuccacauguaauaauagacguuagaacuuuagaaccaguacucuuaccccuccccgacguccgaaauaauuucuuucacuacaaucaacaaaacgaaccacguaugcgccuuguagcuauguuauacacaccacuaagaucaaauggcucuggagaugacguauuuacaguuucaugcagaguauuaacaagaccaucucccgacuucgauuucaauuaccuuguaccaccuacaguugaaucaaaaacaaaaccuuuuacauuaccaauauuaacaauuggcgaauuaacaaacucacgauuccccguuccaauagaugaauuauauacaucaccaaacgaaagucuaguuguacaaccccaaaauggaagaugcgcacuagauggcgaacuccaagguacaacacaacuacuacccacagcaauaugcuccuucagagguagaauaaaccaaaaaguuucaggagaaaaccacguauggaauaugcaaguaacuaacauaaauggaacucccuucgacccaacagaagacguuccagcuccauuaggaacccccgauuuuucaggaaaacuauuuggaguauuaucacaaagagaccacgacaaugccugcagaucccacgaugcaguaauagcaacaaauucagcaaaauuuacuccaaaauuaggagcaauccaaauaggaacuugggaagaagaugacguacauauaaaucaaccaacaaaauuuacacccgucggacuauuugaaaacgaagguuucaaucaauggacacuaccaaacuauucuggagcccuuacucuaaacaugggacuagcaccaccuguggcuccaacauucccaggagaacaaauacuauuuuucagaucacauaucccauuaaaaggaggaguagccgaccccguaauagauugucuauuaccacaagaauggauacaacaccuuuaucaagaaucagcaccaucacaaagugaugucgcauuaauccgauuuacaaacccagacacaggacgaguauuauucgaagccaaacuacauagaucuggcuacauaacaguagcaaauaccggaucuagacccauaguaguaccagcaaacggcuauuuucgauucgacucuugggucaaccaauucuauucacuagcaccaaugggaacaggaaauggaagacgacgaguacaguaa

SEQ ID NO: 34892 - RNA, 1608 nt, Artificial Sequence
  derived and/or modified sequence opt6 from VP1__Norovirus_and/or_Norovirus-like__AF397905
augaaaauggcaucaucagacgcagcaccaagcaaugauggagcagcuggucuagugccagaagcaaauaacgaaacaauggcacucgaaccaguagcaggagcaucaauagccgcuccucucacaggacaaaauaacauaaucgauccauggauacguuuaaacuuuguacaagcuccaaacggcgaguucaccguaucuccuagaaacucaccaggugaaguauuacuuaacuuagaacuaggaccagaacuaaauccuuaucuugcacaucucucaagaauguacaauggauaugcaggaggaguugaaguacaaguccuucuugcaggaaaugcuuuuacugcagguaaauuaguuuuugcagcaguaccaccccauuuuccucuagaaaauauaucucccggucaaaucacaauguuuccucacguaauuaucgacguaagaacauuagaaccaguucuauuaccacuaccugacguaagaaauaauuucuuucauuauaaccaacaaaacgaaccaagaaugagauuaguagccaugcuauacacaccacuucgaucaaacggaagcggcgaugacguuuuuacuguuucauguagaguucucaccagaccuucaccagauuuugacuuuaauuaccuaguaccuccaacaguagaaucuaaaacaaaacccuuuacauuaccaauauuaacuaucggagaauuaacuaacucaagauuucccguacccauagacgaacuauacacauccccaaacgaauccuuagucguacaaccacaaaacggcagaugugcacuugacggagaacuacaaggaacaacacaacuacuuccaacagcuauaugcucauuuagagguagaauaaaccagaaagucuccggagaaaaccacguauggaacaugcaaguaacaaacauaaacggaaccccauucgaucccacagaagacguuccagcaccguuaggaacaccugacuuuuccgguaaauuguucgguguacuuucucaaagagaucacgacaaugccugucgaucccacgaugcaguaauagcaacaaauucagcaaaauucacacccaaacucggcgcaauacaaaucgguaccugggaacaagacgacguacauaucaaccaacccacaaaauuuacaccaguaggauuauucgaaaaugaaggauuuaaucaauggacauuaccaaauuauucaggagcacuuacacuaaacaugggacuagcaccaccaguagcaccaacauucccaggagaacaaauccuauucuuuagaucacauauaccacuaaaaggaggcguagccgauccagucauugacugucuauuaccacaagaauggauacaacacuuauaucaagaaucagcaccaucacaaucugauguagcccuaauccgcuuuaccaauccagauacaggcagaguccuauuugaagcaaaauuacacagaucaggauacauaacaguugcaaauacuggaaguagaccaauuguuguaccagcaaauggcuauuucagauucgauuccuggguaaaucaauucuauucuuuagcuccaaugggaacaggaaauggaagaagaagaguucaauaa

SEQ ID NO: 34893 - RNA, 1608 nt, Artificial Sequence
  derived and/or modified sequence opt6 from VP1__Norovirus_and/or_Norovirus-like__AF414420
augaaaauggcuaguucagaugcagcacccagcaacgacggagcagccggccuaguaccagaagcaaauaaugaaacaauggcacuagaaccaguagcaggagccucaauugcagcuccauuaacaggucaaaacaauauaauagacccauggauaagauuaaauuuuguacaagcaccaaacggagaauuuacagucucuccacguaauuccccuggagaaguacuauuaaaccuagaauuaggccccgagcucaacccauaccuugcacauuuaucuagaauguauaauggauaugccggugguguagaaguacaaguacuucuagcagguaaugcauuuacagcagguaaauuaguauuugcagcaguacccccacacuucccacuagaaaauauuaguccaggucaaauagcaauguucccacacguaauaauagauguaagaacauuagaaccaguauuacuaccucuuccagacguacguaauaacuuuuuccacuauaaucaacaaaaugaaccaagaaugcgacucguagccaugcuauauaccccacuaagauccaauggauccggcgaugaugucuuuacaguaucaugcagaguccuuacacgaccaucuccugauuucgacuucaauuaucucguaccacccacuguagaaucaaaaacuaaacccuuuacacuacccauccuuaccauaggagaauuaacaaauucucgauuccccguacccauagacgaacuauauacuuccccaaaugaaagccuaguaguacaaccucaaaauggaagauguguauuagauggcgaacuacaaggaacaacacaauuauuaccaacagccauuugcucauuccgagguagaauaaaucaaaaagucucaggagaaaaccacguuuggaauaugcaagucacaaauauuaauggaacaccauuugacccuaccgaagacguaccugcaccacucggaacaccagacuuuuccggaaaauuauucggaguacuaucccaaagagaccaugauaaugccuguagaucacacgaugccguaauagcaaccaauucagcuaaauuuacacccaaauuaggagcaauacaaauaggcacaugggaagaagaugacguacauauaaaccaaccuacaaaauuuacaccaguaggucuauucgaaaacgaaggauuuaaccaauggacccuccccaauuacucaggugcacuuacucuaaacaugggauuagcaccaccaguagcucccacauuuccaggagaacaaauacucuuuuucagaagucauauaccacuaaaaggaggcgucgcagauccaguuauagacugcuuauuaccucaagaauggauucaacauuuauaccaagaaucagcaccuucucaaucugauguugccuuaauaagauuuacaaauccagauacagguagaguacuuuucgaagcaaaauuacauagauccggauauauuaccguagcuaacacuggaucaagacccaucguaguaccagccaauggauacuuuagauucgauagcuggguaaaucaauuuuacucccuugcaccaaugggaacaggaaacggccgacgaagaguacaauaa

SEQ ID NO: 34894 - RNA, 1608 nt, Artificial Sequence
  derived and/or modified sequence opt6 from VP1__Norovirus_and/or_Norovirus-like__AF427119
augaaaauggcaucuucagacgcagcaccaucuaaugacggugcugcaggucuagucccagaagccaauaaugaaaccauggcacuagaaccaguugcaggagcuuccauagccgcaccucuaacaggacaaaacaauguaauagaccccuggauaagacuaaauuuuguacaggcaccaaauggcgaauuuacagucucaccuagaaauagcccuggagaaauucuccuaaauuuagaacuaggucccgaacuaaauccauaccuagcacacuuaucaagaauguauaaugguuacgcaggagggguugaaguacaagucuuauuagcagguaacgcauucacugcagguaaauuaguauucgcagcaguaccaccccauuuuccauuagaaaacauaucccccggucaaauuacuauguucccacacguaaucauagaugucagaacacuugaaccuguacuauuaccacuaccagaugucagaaacucauucuuucacuauaaccaacaaaaugaaccccgaaugagauuaguagcuaugcuauauacaccauuaagaucaaauggaucaggagaugauguauuuacaguaagcuguagaguucuaacuagaccaucaccagauuuugacuucaauuaccuagucccaccuacuguagaauccaaaacaaaaccuuuuacacuaccaauauuaaccauaggugaauuaacuaacuccagauuuccagcaccaauagacgaauuauauacgucaccaaacgaaucucuuguaguucaaccucaaaacggaagaugcgcacuagacggagaacuacaaggaacaacccaauuauuaccaacagccauauguucauuccgaggcagaauaaaccaaaaaguauccggugaaaaccacaucuggaauaugcaaguaacaaauacaaacgguacuccauucgauccuacagaagauguaccagcaccauuaggcacaccagauuuuucugguagauuauuuggcguuuuaucacaaagagaucaugauaaugcuuguagaucccaugacgcaguaauugcaacaaacucagcuaaauucacaccaaaauuaggugcuauacaaaucggaacuugggaagaagaugauguacauauaaaucaaccaacaaaauuuacaccaguaggauuauuugagcacggagacuuuaaucaauggacauuaccaaauuauuccggagcucuuacacuaaauaugggauuagccccaccagucgcaccaacauucccaggagaacaaauucuauucuuccgaucacacauaccacuaaaaggaggaguagcagacccaguaaucgauuguuuacuaccacaagaauggauucaacaucuuuaucaagaauccgcaccgagucaauccgauguagccuuaauacgcuuuacaaacccugacacaggacgaguacuauucgaagcaaaacuccauagaucuggauauaucacagucgccaauacaggaagcagaccaauaguuguaccagccaauggauauuucagauuugacagcuggguaaaucaauucuauucacuagcuccaaugggaacuggaaacggaagaagaagaguacaauga

SEQ ID NO: 34895 - RNA, 1608 nt, Artificial Sequence
  derived and/or modified sequence opt6 from VP1__Norovirus_and/or_Norovirus-like__AB044366
augaaaauggccucaagcgacgcagcaccaucaaacgauggcgcagcaggccuaguaccugaagccaauaaugaaacaauggcucuugaacccguagccggugcaucaauagccgcaccguuaacaggacaaaacaacauaauagacccauggaucagacuaaauuuuguacaagccccaaauggagaguucacaguaucaccacgaaauucucccggagaaguauuauuaaaucucgaacucggcccugaacuuaauccauaccuagcacacuuaucaagaauguauaaugguuaugcuggaggaguagaaguccaaguacuauuagcaggaaaugccuuuacagcugguaaacuuguauuugcagcaguaccaccccauuucccucuagaaaacauaucuccuggacaaaucacaauguuuccacauguaauaaucgaugucagaacauuagaaccuguacuauuacccuuaccagacguacgcaacaacuuuuuccacuacaaccaacaaaaugaaccaagaaugcgauuaguagcaaugcuauacacaccacugagaucuaacggaucuggcgaugauguauucacaguaucaugcagaguauuaaccagacccucuccugacuucgacuuuaacuaccuuguaccaccaacaguagaaucaaaaacaaaacccuucaccuuaccaauacucacaauaggagaacuuacaaacucuagauuuccaguaccaauagacgaauuauacacaucaccaaaugaaucauuaguaguacaaccacaaaacggaagaugugcauuagacggagaacuacaaggaacuacacaauuacuacccacagcaauauguucuuuuaggggaagaauaaaucaaaaaguuagcggagaaaaccacgucuggaauaugcaaguaaccaauauaaauggaacaccuuuugacccaacagaagacguaccagcacccuuaggaacucccgacuucuccgguaaauuauuuggaguacuaucccaacgagaccaugauaacgcauguagaagucaugaugcaguaaucgcaacaaauucagcaaaauucacgccuaaacuaggagcaauacaaauagguacaugggaagaagacgacguucauauaaaucaaccaaccaaauucacacccgucggacuauucgaagauggaggauucaaucaauggacacuaccaaauuauucuggcgcauuaacacuaaauaugggacuggcaccuccuguagcacccacauucccaggcgaacaaauacucuuuuucagaagccauauaccacuuaaaggaggaguagcagaucccguuauagacugccuauuaccacaagaauggauacaacaccuauaccaagaaucagcaccaucacaaucagauguagcauuaauaagauucacaaacccagauacaggacgaguauuauucgaagcaaaacuacacaggucuggcuacauaacaguagcaaacacuggaucaagaccaauuguaguaccagccaacggauauuucagauuugauucauggguaaaucaauucuauucauuagcuccaauggguaccggaaauggaagaagaagaguacaauaa

SEQ ID NO: 34896 - RNA, 1608 nt, Artificial Sequence
  derived and/or modified sequence opt6 from VP1__Norovirus_and/or_Norovirus-like__AB032758
augaaaauggcaucaaacgaugcagcuccauccaacgauggugcagcaggccuagucccugaagcaaauaacgaaacuauggcgcuugaaccaguugcaggagcaucaauagccgcaccacuaacaggacaaaacaauauuaucgacccauggauaagauuaaauuucguacaagcuccaaauggagaauuuacagucucaccacgaaacucuccaggagagguacuuuuaaaccuugaacuaggaccagaacucaacccauaccuagcacaucuaaguagaauguacaacggauacgcuggaggaguagaaguccaagucuuacuagcaggaaaugcauucacagcaggaaaauuaguauuugcagcagucccuccacauuucccauuagaaaauauaucaccaggacaaauaacaauguuuccacaugucaucaucgauguaagaacauuagaaccaguauuauuaccacuacccgauguuagaaauaacuuuuuccacuauaaucaacaaaacgaaccaagaaugagauuaguagcgauguuauauacuccucuacgaucaaauggaucaggcgaugacguauuuacaguaucuugucgaguauuaacacgaccaucaccugauuuugauuuuaacuaccuaguacccccaacccuagaaucaaaaacaaaaccauuuacauuaccgauacuaacaauaggugaacuaaccaauuccagauuuccaguaccaauugaugaacuauacacaucuccaaacgaauccuuaguagugcaaccacaaaauggacgaugcgccuuagacggagaacuccaaggaacaacacaacuucuacccacagcaauuuguuccuucagaggccgaauaaaucaaaaaguaucaggagaaaaucauguauggaacaugcaaguaacaaauauaaacgguacuccauuugacccuacaggagauguuccagcaccacuagguacaccagauuucucgggaaaacuauucggaguauuaucccaaagagaccaugacaaugcuugccgaucacacgaugcaguaauagcaacaaauucagcuaaauuuacuccuaaacuaggagcaauacaaauaggcacaugggaagaagaugauguacauauaaaucaaccaacaaaauucacaccuguaggacuauucgaaaaugaaggcuuuaaccaauggacacuaccaaauuacucaggagcacuaacauuaaacaugggacuagcaccacccgucgcaccaacauucccaggagaacaaauauuauucuuucgaucucauauaccacuuaaaggcggaguagcugacccagucauagacugucuauuaccacaagaauggauacaacaucuauaccaagaaucagcaccaucucaaucagauguagcauuaauaagauuuaccaauccagauaccggacgaguacuauucgaagcuaaacuacacagaucaggauacauaacaguugccaauacagguucucgaccaauaguaguucccgcaaacggauauuuuagauucgauacauggguaaaucaguucuacucucuagcuccaaugggaacagguaauggcagaagacgcguucaauaa

SEQ ID NO: 34897 - RNA, 1608 nt, Artificial Sequence
  derived and/or modified sequence opt6 from VP1__Norovirus_and/or_Norovirus-like__AB039775
augaaaauggcaucaucagaugcagccccaucaaaugauggcgcagcaggauuaguuccagaagcaaauaaugaaacaauggcacuagaaccaguugccggugcaucuauagcagcaccacucaccggucaaaauaauauaauugacccauggauacgauuaaauuuuguacaagccccaaacggagaauuuacaguaucuccaagaaacucaccaggugaaguauuacuaaaucuugaacuaggacccgaacuuaaccccuaucuugcacauuuaucccgcauguauaauggauaugccggcggaguagaaguacaaguucuauuagcuggaaacgcauucacugcaggaaagcuagucuucgcagcaguaccuccacauuuuccacuagaaaauauaucaccaggacaaauaacaauguuuccccauguaaucauagauguacgaacacuagaacccguauuacuaccucuuccagauguaagaaauaacuucuuucauuauaaccaacaaaacgaaccaagaaugagauuaguugcaaugcuauauacuccucuaagaucaaacggaaguggagacgauguauucacaguaucaugccgaguauuaacaagaccaucaccagacuuugacuucaauuacuuagucccaccaacagucgaaucaaaaacaaaaccauuuaccuuaccaacccuaacuauaggagaauuaacuaacucaagauuuccaguaccuauagaugaauuauauacaucaccuaaugaaagccuaguaguccaaccacaaaauggaagaugugcuuuagacggagaauuaagaggaacaacacaacuacuaccaaccgcaaucugcccuuuuagagguagaauaaaucaaaaaguaucaggugaaaaucacgucuggaacaugcaaguuacaaauauaaauggaacaccauucgauccaacugaagaugucccagcaccacuaggaacaccagacuuuaguggaaaauuauuuggaguacuaucccaaagagaucacgauaacgcauguagaucacacgacgcaguuauugcaaccaauagcgcuaaauuuacuccaaaacucggagcaauccaaauaggaacaugggaagaagacgacguccauauaaaucaaccuacaaaauucacaccuguaggacuauuugaaaacgaaggauucaaucaauggacacuaccuaacuauucaggagcauuaacauuaaacaugggauuagcuccaccagucgccccuacauuuccaggagaaagaaucuuauucuuuagaagccacauaccauuaaaaggaggaguagcagacccaguaauugauuguuuacuacaccaagaauggauacaacaccucuaucaagaaucagcaccuucucaaucagacguagcacuaauacgauuuacaaacccagauaccggacguguacuauuugaagcaaaacuacacagaucaggcuacauaacaguagcaaauacaggaaguagaccaauaguagugccugcaaacgguuacuucagauucgacaguuggguuaaccaauuuuauucauuagcaccaauggguacaggaaauggaagaagacguguacaauaa

SEQ ID NO: 34898 - RNA, 1608 nt, Artificial Sequence
  derived and/or modified sequence opt6 from VP1__Norovirus_and/or_Norovirus-like__AF414418
augaaaauggcaucaaaugaugcagcaccaucuaaugauggagccgcaggucucguaccagaaguaaauaaugaaacaauggcucuugaaccaguagcuggugcauccauagccgcuccacuaacaggacaaaauaauguaauagaucccuggauaagaaugaauuucguucaagccccaaacggcgaauuuaccguaucccccaggaacucacccggagaaauacuuuuaaaucuugaauuaggcccaggucuaaauccauuccuagcacacuugucccgaauguacaacggauaugcaggagguguugaaguacaaguacuauuagcaggaaacgcauucacagcuggcaagcuaguauuugcagcuauuccaccacauuuuccuauagaaaaccuauccccuggacaaauaacaauguuuccacacguaauaauugacguacgaacauuagaaccaguacuauuaccauuaccugacgucagaaacaacuucuuucacuauaaucaagaaccagaaccaagaaugagacucguagcaaugcuauauacaccauuacgaucaaauggaucaggagaugacguauuuacagucuccugcagaguccuuaccagaccaagucccgauuucgacuucaauuacuuaguaccacccacuguagaaucaaaaaccaaaccauucacauuaccaauauuaaccauaggagaacuaucaaauucacgauuccccgcuccaauagacgaacuuuauacaucuccuaaugaaggauuaguuguacaaccacaaaauggaagaucaacacuugauggagaacuacuaggaacuacucaauuaguacccucaaacauaugcucacuaagaggaagaauaaaugcccauuuauccgacaaucaacauagauggaacaugcaagucacaaaugcaaauggcacgccauuugacccuacagaagacgucccagcacccuuaggaacuccagauuuucuagcaaacauauacggaguaaccucccaaagaaacccagacaacacuuguagagcucacgauggaauauuagcaacauggucaccaaaauucacuccaaaauuaggcucugucguucuagguacaugggaagauagagauuucgauaucaaccaaccaacaagauuuacaccaguaggacuuuaugacacagaccacuucaaucaaugggcauuaccaaacuauuccggugcuuuaacccuaaauaugaaccuagccccuuccgucgcaccacucuuuccaggcgaacaacuauuauuuuuccgaucacauauaccauuaaaaggaggcacauccaauggcgcaauagauugccuccuaccacaagaauggguacaacacuuuuaucaagaaucagcaccuucaucaacugauguugcauuaaucagauacacaaacccugauacaggacgaguauuauuugaagcaaaacuucauagacaaggauucauaacuguagcaaacucaggaucaagaccaauuguaguaccaccgaauggcuacuuuagauuugacucuuggguaaaucaauuuuauucacuagcuccaaugggcacagguaauggaagacgaaggguccaauaa

SEQ ID NO: 34899 - RNA, 1608 nt, Artificial Sequence
  derived and/or modified sequence opt6 from VP1__Norovirus_and/or_Norovirus-like__AF425769
augaaaauggccagcaacgacgccgcacccucaaaugacggagcagcaggacucguacccgaaguuaauaacgaaacaauggcacuugaaccaguagcaggcgccucuauagccgcaccacuaaccggccaaaacaauguaauugacccauggauccgaaugaauuucguacaagcaccaaauggagaauuuaccguaucaccaagaaauucaccaggcgaaauacucuuaaauuuagaauuagguccagaacuaaauccauuucuugcacaccucucaagaauguacaauggauaugcaggaggaguagaaguucaaguauuacuagcagguaaugccuuuacagcagguaaacuuguuuuugcagcaauaccaccccacuuccccauagaaaauuuaucuccaggacaaauaacaauguuuccccacguaauaauugauguaagaacacuagaaccaguauuacucccucuuccagacguaagaaauaacuuuuuccauuauaaucaagaaccugaaccaagaaugcgcuuaguugcuaugcuauauacccccuuaagaucuaauggcagcggagaugacguauucacuguaucaugucgaguacuaaccagaccaucuccugauuucgauuuuaauuaucuaguaccacccacaguagaaucaaagacaaaaccauucacauuaccaauauuaacuauaggcgaauuaucuaauucaagauucccagcuccaaucgaugaauuauacacaucaccuaaugaaggauuaguaguucaaccucaaaauggcagaucaacucuagacggagaauuacucggaacaacacaauuaguaccuucaaauauaugcucucuaagaggaagaaucaaugcccacuuaucugacaaucaacaucgauggaacaugcaagucacaaacguaaauggaacaccauuugacccaacagaagacguuccagcaccauuaggaacucccgacuuccuagcaaauauauacggcguaacuucacaaagaaauccugauaacacauguagggcacacgauggcauucuagcuacauggucaccaaaauucacacccaaacuaggaucaguuguacuaggaacuugggaagaucgugauuucgacauaaaucaaccaacaagauucacucccguaggauuauacgauaccgaucacuucaaccaaugggcucugccaaauuacaguggagcccuaacguuaaacaugaauuuagcaccuucugucgcaccacuauuuccaggagaacaauuacuuuucuuucgcucucacauuccauuaaaaggagguacaucaaacggagcaaucgauugccuacuaccacaagaauggguccaacacuucuaucaagaaucagcaccaucaucaacagacguugcacuaauaagauacacuaacccagauacaggcagaguacuauuugaagccgaauuacacagacaaggauuuauaacuguagcuaacccaggaucaagaccaauaguaguaccaccaaaugguuauuuuagauucgauaguuggguaaaucaauuuuacucacuagcaccaaugggaacaggaaauggcagaagacgaguacaauaa

SEQ ID NO: 34900 - RNA, 1608 nt, Artificial Sequence
  derived and/or modified sequence opt6 from VP1__Norovirus_and/or_Norovirus-like__AF414421
augaaaauggcuucaaaugaugcagcuccuucaaaugauggagcagcuggucuugugccagaaguuaauaaugaaacaauggcacuugaaccuguagcaggagcaucaauagccgcacccuuaacaggucaaaauaacguaauagauccauggauaagaaugaacuucguacaagcaccuaauggcgaauuuacaguaucaccuagaaacucaccaggagaaauacuccuaaaucucgaauuaggaccagaacuaaauccauuccuagcacaccuuucaagaauguauaacggauacgcaggcgguguugaaguacaaguacuacuagcaggcaacgccuucacagcuggaaaauuaguauuugcagccaucccaccccauuucccaauagaaaaccuuaguccuggacaaauaacuauguucccacacguaauuauagaugucagaacucuugaaccaguacuacuaccacuccccgacguacgaaauaauuucuuccacuacaaucaagaaccugaacccagaaugcgauuaguugcaaugcuauauaccccacuaagaucaaacggauccggcgacgacguauuuacagucucaugucgcguauuaacucgacccucaccugauuuugacuucaauuaucuuguaccuccaacuguugaaucaaaaacaaaaccuuuuacuuuaccaaucuuaacuauaggagaacucucaaauagcagauucccugcaccaauugaugaauuauacacaagcccaaacgaaggauuagucguucaaccacaaaaugguaggccaacauuagauggcgaauuauuaggaacaacccaauuaguaccaucaaauauaugcucacuacgaggaagaauaaaugcacaucuaucagacaaucaacauagauggaauaugcaagugacaaaugcaaauggaacaccuuuugacccaacagaagacgccccugcaccccuaggaacacccgauuuccuugccaacauauacggaguaaccucacaacgaaacccugauaacacauguagagcacacgauggaauacuagcuacauggucaccaaaauuuacaccaaaacuaggauccguaguacuugguacuugggaagaccgggacuuugacauaaaucaaccaaccagauucacaccaguuggauuauaugauacggaucauuuuaaucaaugggcacuaccaaacuauucaggcgccuuaacacuaaauaugaacuuagcuccauccguugcaccccuauuuccuggcgaacaauuauuauucuuuagaucacacauacccuuaaaaggcggaacauccaacggcgcaauagauuguuuacuaccacaagaauggguacaacauuuuuaucaagaaucugcacccuccucuaccgaugucgcucuaauacguuacacaaacccagauacugguagaguccuuuucgaagcaaaauuacacagacaaggauuuauaacugucgcaaacucaggaucacguccaaucguagucccaccaaauggauacuuuagauuugacucauggguaaaccaauucuacucacuugcacccaugggaacugguaacggcagacguagaguacaauaa

SEQ ID NO: 34901 - RNA, 1608 nt, Artificial Sequence
  derived and/or modified sequence opt6 from VP1__Norovirus_and/or_Norovirus-like__AF414416
augaaaauggcaucaaacgaugcagcaccaucaaacgacggagcagcuggucuaguuccugaagucaauaacgaaacuauggccuuagaaccuguagccggagcaucaauugcagcaccacuaacaggacaaaauaauguaaucgauccauggauaagaaugaacuuuguacaagcaccaaauggagaauuuacuguaucacccagaaacucaccuggagaaauacuacuaaaccuagaauuaggaccagaauuaaacccuuuccuagcacauuuaucaagaauguacaacggauaugcaggaggaguagaaguacaaguauuacucgcagguaaugccuucacugcugguaaauuaguuuuugcagcaauaccuccacauuucccgaucggaaacuuaucaccaggacaaauagcaauguuuccacacguaauaauagacguaagaacauuagaaccagucuuauuaccauuaccagacguaagaaauaacuuuuuccauuacaaucaagaaccagaaccacgaaugcgucuaguagccaugcuauauacaccucuaagauccaaugguucuggagaugacgucuuuacaguauccugcagaguacuaacaagaccaucaccagacuucgauuuuaauuaucuuguuccacccaccguagaaaguaaaacaaaaccauuuacacuaccaaucuuaacaauuggugaacuaucaaacucuagauucccuguaccuauagaugaacuauacacuucaccaaacgaaggauuaguaguacaaccucaaaauggaagaucaacccucgauggcgaacuuuuaggaaccacacaacuuguacccucaaacauuuguucacuucguggacgaauaaaugcucacuuaucagacaaucaacaucguuggaacaugcaaguaacaaaugccaauggcacaccauucgacccaacugaagacguaccagcaccauuagguacaccagacuucuuagcuaacauauauggaguaacaucacaaagaaacccugacaauacaugcagagcacaugauggcauacuugcuacauggucaccaaaauuuacaccaaaauuaggcucaguaguacuagguacaugggaagaucgcgauuuugacauaaaccaaccaacuagauuuacucccguaggacuauacgacacagaccauuuuaaccaauggguauuaccuuauuauucaggugccuuaacccuuaauaugaaccuugcaccaucuguagcaccacuauucccaggagaacaauuacucuucuuuagaucucauguaccauuaaaaggaggaacaucaaauggagcaauugauugucuucuuccacaagaauggguccaacauuucuaccaagaauccgcaccaucaucaacagauguagcacuaauuagauacacaaacccagauacaggaagaguacuauuugaagccaaacuacauaggcaaggauuuauaacuguagccaacucaggaucaagaccaauaguagucccaccaaauggauauuucagauuugauuccuggguuaaccaauuuuacucacuagcucccaugggaaccggaaauggcagacgacguguacaauga

SEQ ID NO: 34902 - RNA, 1608 nt, Artificial Sequence
  derived and/or modified sequence opt6 from VP1__Norovirus_and/or_Norovirus-like__AF414419
augaaaauggcaucaaaugaugcugcacccucaaacgacggcgcagcaggccuaguaccagaaguaaacaaugagacuauggcauuagaacccguagcuggagcaucaaucgcagcuccacuaacaggacaaaauaauguaauagauccuuggauuagaaugaauuucguccaagcaccaaauggagaauuuacuguaucuccaagaaauucgccaggagaaauauuauuaaaccuagaauuaggaccagaacuaaaucccuuccucgcacaucuuucacgcauguauaauggauaugcuggagguguagaaguacaaguauuauuagcaggaaaugcauucacagcaggaaaauuaguauuugcagcaauuccuccacacuuucccaucgaaaaccuaucaccuggccaaauaacaauguucccucacguaauaauagauguaagaacacuagaaccagucuuacuaccacuccccgacguaagaaauaauuucuuucacuauaaucaagaaccagaacccagaaugcgucuaguagccaugcuauacacaccauuaagaucaaauggaucaggagaugauguguuuacagucucaugcagaguauuaaccagaccaucaccagacuuugacuucaauuauuugguaccuccaacuguagaaucaaaaacuaaaccuuuuacauuacuaauauuaacuauaggagaauuaucaaauucccguuucccagcaccaauagaugaauuauauacaucacccaacgaaggccuaguaguucaaccacaaaacggacguucaacacuagauggagaacuccuaggaacuacacaacuuguacccucuaacauaugcucacuaagaggccgaaucaaugcacaccuuucagacaaccaacaccgauggaauaugcaaguaacuaacgcaaacggcacaccauucgacccaacagaagacguaccugcaccacuaggaacaccagauuuucuagcaaauauauacggaguaacuucucaaagaaacccugauaauacauguagagcucacgauggaauccuagccaccuggucuccaaaauuuacaccuaaauuaggcucuguaguucuaggaaccugggaagauagagauuuugacaucaaucaaccugcacguuucacacccguuggcuuauacgacacagaccacuuuaaucaaugggcacuuccuaauuauuccggagcccuaacauuaaacaugaaucuugcaccaucuguugcaccuuuauuuccaggagaacaacuuuuauucuucagaucucacaucccauuaaaaggagguacuuccaacggcgcuauagacugcuuacucccacaagaauggguccaacauuuuuaucaagaaucagcucccucaagcaccgauguagcauuaauucguuauaccaacccagauacaggaagaguccuauuugaagcaaaacuucaucgacaagguuuuauuacaguagcuaacucuggaucaagaccaauaguuguuccaccaaacggauacuucagauuugauucauggguaaaccaauucuacuccuuagccccaaugggaacaggcaaugguagacgaagaguucaauaa

SEQ ID NO: 34903 - RNA, 1608 nt, Artificial Sequence
  derived and/or modified sequence opt6 from VP1__Norovirus_and/or_Norovirus-like__AF425767
augaaaauggccucaaacgaugccgcaccuucaaaugauggcgcugcaggcuuaguaccugaaguaaacaaugaaacaauggcauuagaaccagucgcaggagcauccauugcagcuccucuuacuggccaaaacaauguuauagacccauggauaagaaugaauuucguacaagcaccaaauggcgaauuuacagucucaccaagaaacucaccaggagaaauauuacuaaaccuagaauuaggaccagaauuaaacccauucuuagcccaccuuucacgaauguacaacgguuaugccggaggaguagaaguacaagugcuacuugccggaaacgcauuuacagcaggaaaauuaguauuugcagcaauaccaccccauuuccccauagaaaaccuaucuccaggucaaauaacuauguuuccacauguuauuauugauguccgaaccuuagaaccaguauuacuaccacucccagacguaagaaauaacuucuuucauuauaaccaagaucccgaaccuagaaugagauuaguagcaaugcuauauacaccucuaagaucaaauggcucaggagacgacguauucacugucucaugucgaguacuaacaagaccaucaccagauuucgauuucaauuauuuaguaccuccaacagucgaauccaaaacaaaaccauuuacauuaccaauucuaacaauaggcgaacucucuaauagccgauuucccgccccaauagacgaacuuuauacaucucccaacgaaggauuaguaguacaaccacaaaacggagguucaacucuagauggagaacuacuagguacaacacaauuaguaccaucaaauauuugcucacuaagaggaagaauuaacgcucaucuuucagauaaccaacauagauggaacaugcaaguaaccaaugucaauggcacaccauuugaccccacagaagacguaccagcaccucucgguacaccagacuuuuuagcaaauaucuauggaaucacuucccaaagaaacccagauaauacaugcagagcacaugauggaauauuagcaacauggucaccaaaauuuacaccuaaacucggcucaguaguccuuggaacaugggaagauagagauuuugauaucaaucaaccaacaagauucacaccugucggacuauaugacacagaucacuuuaaccaaugggcacuaccuaauuauucaggagcauuaacauuaaacaugaaccuagcaccaucaguagccccacucuuucccggagaacaacuacuauucuuucgaucccauauaccauuaaaaggagguacaucuaacggagcaauagauugccuacuuccacaagaauggguucaacauuuuuaccaagaauccgcacccuccuccacugacguagcacuaauaagauauacaaacccagacacaggcagaguucuauucgaagcaaaacuacaccgacaaggauucauaacaguagccaacuccggaucccgccccauuguaguaccaccaaaugguuauuucagauucgauucauggguaaaucaauuuuauucacuagcaccaaugggaacuggcaacggaagacgccgaguacaauaa

SEQ ID NO: 34904 - RNA, 1608 nt, Artificial Sequence
  derived and/or modified sequence opt6 from VP1__Norovirus_and/or_Norovirus-like__DQ093065
augaaaauggcaucaaacgaugcagcuccuucaaaugauggagcagcaggccuuguaccagaaguaaauaaugaaaugauggcccuagaaccaguagccggagcuucaauagcugccccacuaaccggacaaaauaauguaauagauccauggauaagaaugaauuuuguacaagcaccaaauggugaauuuacuguaucaccacgcaacucaccaggugaaauuuuacuaaaccuagaauuaggacccgaacuaaauccuuuccuagcacauuuauccagaauguauaacgguuaugcaggagguguugaaguacaaguauuacuagcagguaaugccuuuacagcaggaaaauuaguuuuugcagcaaucccacccagauuuccaauugaaaauuuauccccaggacaaauaacaauguucccccacguaauaauagacguacgaacacuagaaccaguacucuuacccuuacccgaugucagaaauaacuucuuucacuacaaccaagaacccgaaccgcgaaugagauuaguagcuaugcuauacacaccacuacgaucaaacgggucuggagaugauguauucacuguuagcugcagaguauuaacuagaccauccccagauuuugacuucaacuaucuaguaccaccaaccguagaaucaaaaaccaaaccauuuacacuaccuauacuaacaauaggagaacuuucuaauucaagauuuccagcuccaauagaugaacuuuacaccuccccaaacgaaggauuaguaguucaaccucaaaaugguagaucaacucuugauggagaauuacuaggaacaacccaauuaguaccuucaaauauauguucucuaagaggacgaaucaaugcacaucuuccagacaaucaacauagauggaacaugcaaguaacaaaugcaaacgguacaccauuugacccaacagaagacguacccgcaccacuuggaacccccgauuuucuagcuaacauauacgguguaaccagccaacguaaucccgacaauacauguagagcucacgaugguauacuagcaacauggucaccuaaguuuaccccaaaauuagguucuguaguacuaggaacaugggaagauagagacuucgauauaaaccaaccuaccagauuuacuccaguaggucuuuaugacacagaucauuuuaaccaaugggcauuaccaaacuauucaggugcauuaacuuuaaacaugaacuuagcaccauccgucgcuccuuuauuuccaggagaacaauuacuauuuuuccgaucacauauaccucuaaaaggugggacuucuaauggcgccauagauugucuacucccccaagaauggguacaacauuuuuaccaagaaagugcaccuucuucuaccgauguagcauuaauaagauauacuaauccagauacaggucgaguacuauuugaagcaaaacuccauagacaagguuucauaacagucgcaaauucaggcaguagacccaucgucguaccacccaacgguuacuuuagauuugacucauggguaaaucaauuuuauuccuuagcucccauggguacuggcaauggaagaagaagaguccaauag

SEQ ID NO: 34905 - RNA, 1608 nt, Artificial Sequence
  derived and/or modified sequence opt6 from VP1__Norovirus_and/or_Norovirus-like__KJ194507
augaaaauggcuucaaaugaugccgcaccaucaaacgauggagccgccggccuagucccagaaguaaacaaugaaacaauggcucuugaacccguagcaggagcauccauugcagccccacuaaccggucaaaauaacgucauagaucccuggauuagaaugaauuucguccaagcaccuaauggagaauuuacaguauccccaagaaauucuccaggagaaguacuacuaaaccuagaauuaggaccagaauuaaacccauuccuagcucaccuaucaagaauguauaauggauaugcaggcggaguagaaguacaaguacucuuagcaggaaacgcuuuuacugcagguaaauuaguauucgcugcuauaccaccccauuuucccuuagaaaaccuaucucccggucaaauaacaauguuuccacauguaauaaucgauguaagaaccuuagaaccaguccuacucccgcucccagacguaagaaauaacuucuuucacuauaaucaacaaccagaacccagaaugagauuaguagcuauguuauauacaccccuacgaucaaauggcuccggagacgauguauucacaguaucaugcagaguauuaacaagaccaucuccugacuucgauuucaauuacuuaguuccaccuacagucgaaucuaaaacaaaaccauuuaccuuacccauauuaacaauaggcgaacuauccaacucaagauucccaguuccaauagaugaauuauacacaaguccuaaugaagguguuguaguacaaccacaaaacggaagaucaacacuugauggugaauuauuaggaacaacacaauuaguacccucuaauaucugcgcacuaagaggaagaauaaaugcacaaguaccagaugaccaucaccaauggaacuuacaaguaacaaacacaaauggaacaccuuuugauccuaccgaagacguacccgcaccauuaggaacaccagacuuccuugcaaacauauaugguguaaccucacaaagaaauccaaacaacacuuguagagcacacgauggcguuuuagcaacauggucaccaaaauucacaccuaaauuaggcucagucguacuaggaacgugggaagaaucugaucuagaccuaaaucaaccaacccgauuuacucccguuggauuauucaacaccgaccacuuugaccaauggguacuuccaaauuacagcggccgcuuaacauuaaacaugaaccuagccccaucaguauccccacucuuuccaggagaacaaauauuauucuuccgaucacacauaccacuaaaaggaggaacaucagacggcgcaauagauugcuuacuaccacaagaauggauacaacauuuuuaucaagaaucugcuccuucacccacagacguagcccucauacgauauacuaaccccgacacaggaagaguauuauucgaagcaaaauuacaccgucaaggauucauaacuguagcaaacucaggaucacguccaauuguaguaccgccaaauggauauuuuagauucgauucauggguaaaucaauucuauucauuagcaccaaugggcacagguaauggacggagaagaguucaauaa

SEQ ID NO: 34906 - RNA, 1608 nt, Artificial Sequence
  derived and/or modified sequence opt6 from VP1__Norovirus_and/or_Norovirus-like__KP064099
augaaaauggcaucaaacgaugcagcucccucuaaugauggagcugccggucuaguuccagaaguaaauaaugaaacaauggcuuuagaaccuguugccggagccuccauugcagcaccacuaaccggacaaaauaacguaauagauccuuggauccgacuaaauuuuguacaagcuccaaauggagaauuuacagucucaccuagaaacucacccggagaaguacucuuaaauuuagaacuagguccagaacuaaauccuuauuuagcacaucuaucucgaauguacaauggauaugcaggagguguugaaguucaaguacuacucgcuggaaaugcuuuuacagcagguaaauuagucuuugcagcagucccaccacacuucccccuagaaaacaucucuccuggacaaauaaccauguuuccacauguaauaauagacgucagaacacuagaaccaguauugcuaccauuacccgacguacgaaauaacuucuuucacuauaaccaacaaaaugaaccacguaugagauuaguagcaaugcuauauaccccauuaagaucaaacggaucuggcgacgacguauucacaguaucauguagaguacuuacaagaccaucaccagauuucgauuuuaacuaccuaguaccaccaacaguagaaucuaaaacuaaaccauuuacccuaccuauacuuacaauuggagaauuaacaaacucaagauuccccguaccaauagacgaauuauacacaucaccaaacgaaucauuagucguucaaccacaaaauggaagaugcgcacuagauggagaacuacaaggcacaacucaacuacucccaacagccauauguuccuucagaggaagaauaaaucaaaaagucucaggagauaaucauguauggaauaugcaaguaacuaauauaaaugguaccccauuugauccaaccgaagauguaccagcaccccuuggaacucccgacuuuuccggaaaacucuucggaguauuaucacaaagagaucaugauaaugcauguagaucacacgaugcuguaauagcaacagauucagcaaaauucacaccaaaauuaggagcaauccaaauagguacaugggaagaagacgauguccauauaaaucaaccuacaaaauuuacuccaguaggacuuuuugagagagaagguuuuaaucaauggacgcuaccaaacuauucaggagcuuuaaccuuaaauaugggucuagcaccuccuguagccccaaccuuuccaggcgaacaaauauuauucuuuagaagucacauaccacucaaagguggcguagcagauccaguuaucgauugccuauuaccacaagaauggauacaacaucuauaucaagagucugccccaucacaaacagacguagcacuaauaagauucacuaaucccgauaccggcagaguauuauuugaagcaaaauuacaucgaucaggauauauaacaguagcaaacacaggaucucgaccaauaguaguaccugcaaacggauacuuuagauuugacuccuggguaaaucaauuuuacucacuagcaccaaugggaacaggaaauggaagaagaagaguacaauaa

SEQ ID NO: 34907 - RNA, 1608 nt, Artificial Sequence
  derived and/or modified sequence opt6 from VP1__Norovirus_and/or_Norovirus-like__AB303926
augaaaauggcaucaaacgaugcaacaccaucagacggaucaacagcuaaucucguaccugaaguuaauaaugaaguaauggcucuugaaccaguaguaggcgcagcaauagcagcaagaguagcaggacaacaaaauguaauagauccauggauaagaaauaauuucguucaagcgccaggaggagaauuuacaguuuccccaagaaacgcccccggagaaauauuguggucagcaccacuaggucccgaucuaaauccauaucuaucccaccuagcuagaauguauaacgguuaugcaggcggcuuugaaguacaaguaauauuagcaggaaaugcuuuuacugcaggaaaaauaauuuuugcagccguuccuccaaauuucccaacagaaggacuaucaccaucacaaguaacaauguuuccucauauaauuguugauguuaggcaauuagaacccguauuaaucccccuuccagacgugagaaacaacuuuuaucacuauaaccaaucuaaugauuccaccauuaaacuuauugcaauguuauacacuccucuaagagcaaauaaugcaggagaugauguauuuaccguauccugcagaguacuaacacguccuucaccagauuuugauuuuauauuccuuguaccaccaacaguugaaucuagaacaaaaccauuuacaguaccuauauuaacaguugaagaaaugucaaacaguagguuuccaguaccuuuagaaaaauuauacacagguccuagcucugcauuuguaguacaaccucaaaauggucguugcaccacagauggcguacuacucgguacaacacaacuuucagcaguaaauaucugcacauuuagaggugacgucacucauauagcaggaucacacgauuacacaaugaauuuagcaucacaaaauuggaacaauuaugauccaacagaagaaauaccagcaccauuaggaacaccagauuucgucgguaaaauacaaggcguacuaacucaaacaacacgagaagauggaucaacacgagcacauaaagcaacaguaucaacugguucaguacauuucacaccaaaacuagguucaguacaauauacaacagacacaaauaaugacuuucaaacuggucaaaauacaaaauuuacaccuguaggaguaauacaagauggaucuaaccaucaaaaugaaccgcaacaauggguacucccaaauuacuccggucguacuggacacaauguucauuuagcaccagcuguugcacccacauucccuggagaacaacuuuuauuuuucagaucaacaaugccaggcuguucaggcuacccaaauaugaauuuagacugucucuuaccacaagaauggguacaacacuuuuaccaagaagccgcaccagcacaaucugauguagcgcuauuacgauuuguuaacccagacacuggacgaguucuauuugaauguaaacuacauaaauccggguauguuacuguagcacacacagguccacaugacuuaguaauaccaccuaacggcuacuuuagauucgacagcugggucaaucaauucuauacacuagcuccaaugggaaacggagcaggucgauaa

SEQ ID NO: 34908 - RNA, 1608 nt, Artificial Sequence
  derived and/or modified sequence opt6 from VP1__Norovirus_and/or_Norovirus-like__KU985166
augaaaauggcuucaucugaugcaaauccuucugauggauccaccgcaagccuaguaccagaaguaaauaacgaagucauggcacuugaaccagucguaggcgcagccauagccgcacccguagcaggacaacaaaacguaauagaucccuggauucgaaauaauuuuguucaagcaccaggaggcgaguuuacagucucaccacgaaaugcaccuggagaaauauuauggucagcuccauuaggaccagacuuaaacccauacuuaucacaccuagcacguauguacaacggauacgcaggcggauuugaaguacaaguuauucuagcagguaacgccuucacagcaggcaaaauuaucuuugcagcaguaccaccaaacuucccaacagaaggacucucaccaucacaaguaacuauguucccacacauaauaguugaugugcgacaacuagaaccaguauuaauaccauuacccgacguaagaaauaauuuuuaccacuauaaccaauccaacgauucaacaauuaaacuaauugcuaugcuauacacaccucuaagagcaaauaacgcaggcgacgacguauuuacaguaucaugcagaguauuaaccagaccaucuccagauuuugauuuuauauuccuaguaccaccuacuguagaaucaagaacaaaaccauucucaguuccaauauuaacaguagaggaaaugaccaacagucgauucccaauaccacuagaaaaauuauucacaggacccagcucaacauucguuguacagccacaaaacgguagauguaccacagauggaguacuacuaggaacaacacaauuaucgcccguaaacauauguacauucagaggaggaauaacacgaauaggacaauccgaaucauauaaaaugaacuuagcaucacaaaauuggaauaacuaugacccaaccgaagaaauaccagcuccauuaggaacaccagacuuuaaaggccgaauuagaggauuacuaacacaaacaacuaaaggagcagguucaacaagaggucacaaagcaacuguacuaacaggcggaucagauuuuacaccuaaacuaggaacaguccguuucgacacaaaaucaaucgauuucgaaaauaaucaaaacacaaaauuuacaccaguaggaguaguacaagacggaaacaaucacgaugaaccaacccaauggguacuaccaaacuauucaggucccgauacucacaacguacaccuagcaccagcaguagcaccaacauucccaggagaacaauuauuauucuuucgcucuacaaugccuggauguucaggauacccaaaaauggaauuagauugccuauuaccacaagaauggguccaacacuuuuaccaagaagccgccccagcacaaacagacguagcauuacuacgauucguaaaccccgacacagguagagucuuauucgaauguaaauuacauaaaucugguuacguaacagucgcccauacaggcgaccaugaucuuguaaucccaccaaacggauacuuccgauucgacucauggguaaaccaauuuuauacacuagcccccauggguaacggaacaggaagacgcagauaa

SEQ ID NO: 34909 - RNA, 1608 nt, Artificial Sequence
  derived and/or modified sequence opt6 from VP1__Norovirus_and/or_Norovirus-like__JN699045
augaugauggcaucaaaagacgcaccaacaucuccagauggcgcaucaggugcaggucaauuaguuccagaagcaaauacugcagaacaaauaucaauggauccuguagcaggagccaguacagcuguugcuacagcaggacaaguuaauaugauagauccuuggauauuuaauaauuuuguccaagcaccccaaggagaauuuacaauaucaccgaauaauacuccuggcgauauacuauuugaucuccaacuaggaccacaucuaaacccauuccucgcacaccuaucucaaauguauaaugguuggguaggaaauaugagaguaagaauacuacuugcaggaaaugcuuuuacugcugguaaaauaauaauauguuguguuccaccaggauuugacgcgagaauauuaacaauugcccaagcaaccuuauuuccacaccuaauagcugauguaagaacacuugaaccaguagaauuaccacuagaagauguucguaauguacuauuccauaauucaucccaaccacaaccaacaaugagauuaguugcaaugcuauauacaccacuacgcacaggugguggcucaggcggaacagaugccuuuguuguagcuggcagaguacuaacauguccagccccagacuuuucauucuuauuuuuaguuccuccauccguagaacagaaaacucgaguauuuuccguaccaaacgucccucuuaaagaucuuucuaacucacgaguaccaguacccauacaaggaauguucaugucaccagaugucaaucaauccguccaauuucaaaauggacgaugucaaauagauggacaacuacaaggaacuacaccugucucauuaucccaauuauguaaaauucgaggaaaaacaucauccaaugcacgaguacuaaaucuuucagaagucgaugguacaccauuuauaccuuuagaaucaccagcacccguuggcuuuccagauuuaggcggaugugacuggcauguaaauuucaccuuccaagcacaaaaccaagaucccucacaaucaguaacauucgcuacaaaugaugcaucauuuguaccauacuuagguucuauauccccacauaauggaggcgauuuucacuccggagauauaauaggaucacucggauggauuucagcaccuucagacuccucacaacuaaauguuuggacaauaccaaaauaugguucaucacuuccugacguaacacauuuagcuccagcaguguucccaccugguuuuggugaaguuauccuauauuuccauucaacuuuuccugguucaggccaaccaggacaacuacaaguaccaugucuucuuccacaagaauuuauaacacauuuuugcaaugaacaagcuccuauagcaggagaagcagccuuacuucauuauguagauccagacacaggaagaaaucuaggcgaguucaaauuauauccugauggauuuaugacuuguguuccaaacucaguauccucagguccacaaacuuuaccuauaaauggagucuuuguuuucguauccuggguuucacguuuuuaccaauuaaaaccaguaggcacagccucagcagcaagacgacuauaa

SEQ ID NO: 34910 - RNA, 1608 nt, Artificial Sequence
  derived and/or modified sequence opt6 from VP1__Norovirus_and/or_Norovirus-like__EF547395
augaugauggcaucaaaagacgcaccaacaucuccagacggagccucaggugcaggucaauuaguaccagaagcaaacacagcagaacaaauuucaauggauccaguagcaggagcuucuacugccguagcaaccgccggacaaguuaauaugauagacccauggauauuuaauaacuuuguacaagcaccacaaggagaauucaccauuucuccaaacaauacaccaggagacauauuauuugaucuucaauuaggaccacaucuaaaucccuuccuagcacaucuuucucaaauguacaauggauggguaggaaauaugagaguacguauacuacuugcagguaaugccuucacagccggaaaaauaaucauauguugcgugccuccaggauucgaugcucgaauacuaacaauagcgcaagcaacccuuuucccccaucuaauagcagacguacgaacuuuagaaccuguagaacuaccauuagaagauguaagaaacgucuuauuccauaauucaucacaaccucaaccuacaaugagauuaguugcuaugcuuuacacaccauuaagaacuggaggagguucuggaggaaccgacgcauuuguaguagcaggaagaguacuaacauguccugccccagauuuuucauuuuuauuucucguacccccaagcguagaacaaaaaacacgagucuuuucaguaccaaacguuccauuaaaagaucuaucaaauucacgaguuccuguaccuauucaaggaauguucaugucaccagaugucaaucaaucaguacaauuucaaaauggccgaugucaaauagacggacaauuacaaggaacaacuccaguaagucuaucacaauuauguaaaauucgaggaaaaacaucaagcaaugcaagaguacuaaaccuuucagaaguugacggauccccauuuauaccacuagaaucucccgcuccuguagguuuucccgaucuuggcggaugugacuggcauguaaauuuuacauuccaagcacaagaccaagauccaucacaaucaguuacguuugcaacaaaugacgcaucauuuguacccuauuuagguucaauaucaccccauaauggaggagauuuucacucuggagacauaauaggaucccuagguuggauuucagcaccaucagauagcucacaauuaaauguauggacuauaccaaaauauggaucaucauuaccugacguaacacaccuagcaccagcaguauuucccccaggauucggagaaguuauacuuuauuuuuacucuacuuucccuggaucuggacaaccaggacaacuacaaguacccuguuuauuaccacaagaauuuauaacacauuuuuguaaugaacaagcaccuaucgccggagaagcagcauuacuacacuacguagauccagacaccggaagaaacuuaggagaauuuaaacuuuauccagacggauuuaugacauguguaccaaauuccguaaguucaggaccacaaacauuaccaauaaacggaguauuuguauucgucucaugggucuccagauuuuaucaauuaaaaccaguaggaaccgccuccguagcaagacguuuauaa

SEQ ID NO: 34911 - RNA, 1608 nt, Artificial Sequence
  derived and/or modified sequence opt6 from VP1__Norovirus_and/or_Norovirus-like__AY502008
augaugauggcuagcaaagaugcuccaacuucaccugacggagcuucaggagcaggacaauuaguuccagaagcaaacacagccgaacaaauuaguauggacccuguagcuggugcaagcacugcaguugcuacagcaggccaaguaaauaugaucgauccuuggauauuuaauaauuuuguacaagcaccacaaggagaauucacaauaucucccaacaauacaccuggcgacauacuauucgauuuacaacuaggcccacaucuaaauccuuuuuuagcacaucuaucacaaauguauaauggauggguaggaaauaugagaguacgaauacuauuagcaggaaaugccuucacagcaggaaaaauaauaaucuguuguguuccuccaggauuugacgcaagaauauuaacaauugcucaagcaaccuuauucccacauuuaauagccgaugucagaacacuagaaccaguagaacuuccauuggaagauguaagaaaugucuuauuucacaauaguucacaaccucaaccaacaaugagauuaguagcaaugcuuuacacuccauuacgaaccggaggaggaucaggaggaacagacgccuuuguaguagcuggucgaguauuaacauguccugccccagauuucucauuuuuauuuuuagucccaccuucagucgaacaaaaaacacgcguauucucagucccaaacguaccauuaaaagauuuaucaaacucacgaguaccuguuccaauacaaggaauguuuaugucucccgauguuaaucaaucaguacaauuccaaaacggaagaugucaaauagauggacaacuacaagguacaacaccaguaucccuuagccaauuauguaaaauaagagguaaaacaucaucaaacgcacgaguacucaaucucucagaaguagauggaucaccuuuuauuccccuagaaucuccugcuccaguaggauucccagacuuaggugguugugacuggcauguuaauuuuacuuuucaagcccaagaucaagauccuucucaaucuguaacauuugcaacaaaugacgcauccuucguaccauaccuaggaucaauaucaccacauaacggaggagauuuucacucaggagacauaauaggcucauugggauggauuucugcuccgucagauagcucacaacucaacguauggacuauuccuaaauauggaucaucauuaccagauguuacucauuuagcuccagccguauucccaccggguuuuggagaaguuauauuauauuucuauucaacauucccuggaucaggacaaccaguacaacuacaagucccuuguuuacuaccacaagaauucauaacacauuucuguaacgaacaagcaccuauugcaggugaagcagcuuuacuucauuacguugauccagauacaggaagaaaucuaggcgaauucaaacuauacccugauggauuuaugacaugugucccuaauuccguaucuucuggaccacaaacuuuaccaauaaaugguguauuugucuucgucucauggguaucuagauuuuaucaauuaaaaccaguaggaacagcaucaguagcaagaagauuguaa

SEQ ID NO: 34912 - RNA, 1608 nt, Artificial Sequence
  derived and/or modified sequence opt6 from VP1__Norovirus_and/or_Norovirus-like__AY502007
augaugauggcuucaaaagacgcaccaacaucaccugacggugccucaggagcuggacaacucguaccagaagcaaacacagcugaacaaauaucaauggauccuguugcaggcgcuucaacagcuguagcaacagccggucaaguaaacaugauagauccauggauauuuaacaauuuuguacaagcaccacaaggagaauucacaauaucuccaaauaauacaccaggcgauauauuauuugaucuccaacuaggaccccauuuaaauccauuucuagcacacuuaucacaaauguauaacggauggguuggcaauaugcgaguccgaauauuauuagcaggaaacgccuuuacagcaggaaaaauaauaauaugcuguguaccuccuggauucgacgcacgaauucuaacaauagcccaagcaacucuuuuuccccauuuaauagcagacguacgaacuuuagaaccaguagaauuaccacuagaagacguacguaacguauuauaucauaacucaucucaaccacaaccaacaaugagacuagucgcaauguuauauacaccccuacgcaccggaggaggaucagguggaacugaugcauuugucgucgcaggucgaguacuaacuuguccugcaccagacuucagcuuuuuauuucuaguuccacccagcguagaacaaaaaacaagagucuuuucuguaccaaacauaccuuuaaaagaucuaucaaacucuagagucccaguuccuauacaaggaauguuuaugucaccagauguaaaucaaucaguucaauuccaaaaugguagaugucaaauagacggacaacuacaaggaacaacaccugucaguuuaucucaauuauguaaaauaagaggaaaaacaucaucaaaugcacgaguacuuaaucuaucagaaguugacggaaccccauuuguuccacuagaaucaccugccccagucgguuuuccugaucuaggaggaugcgauuggcauguaaauuuuaccuuucaagcacaaaaucaagauccaucucaaucagucacauuugcaacaaaugaugcuucauucgucccuuacuuaggaucuauuucaccacacaacgggggugauuuucacgcaggagauauaauagguagccuaggauggauaucugcucccucagauaacacacaauuaaauguauggacaauaccaaaauacggaucaucacuccccgauguaacccauuuagcuccugccguauuuccaccugguuucggugaaguuauauuauacuucuacucaacauuuccagguucaggccaaccaucccaacuucaaguaccaugucucuuaccccaagaauuuauaacucacuucugcaacgaacaagcuccuauagcaggugaagcugcccuacuccacuaugucgacccagauacuggccgaaaucuaggagaauuuaaacuauauccugacggcuuuaugacaugcguucccaauaguguaucaucaggaccccaaacucuaccaaucaauggaguauucguauucguaucuuggguuucucgauuuuaucaauuaaaaccagucggaacugcaucagccgcaagaagauuauaa

SEQ ID NO: 34913 - RNA, 1608 nt, Artificial Sequence
  derived and/or modified sequence opt6 from VP1__Norovirus_and/or_Norovirus-like__KC998959
augaugauggcaucuaaagacgcaccaacaucaccagauggagcaucuggagcuggucaauuaguuccagaagcuaauacagcagaacaaaucucaauggaccccguagcaggcgcaucaacagcaguagcaacagcaggacaaguaaacaugauugauccauggaucuuuaauaauuuuguacaagccccucaaggugaauuuacaauuucuccuaauaauaccccaggcgauauacuuuuugaccuucaacuugggccacaucuaaaucccuuucuagcgcauuuaucucaaauguacaauggaugggucggaaauaugagaguaagaauucuauuagcaggcaaugccuuuacugcaggaaaaauaauuauuuguuguguaccaccuggauuugacgcacgaauauuaacuauagcccaagcaacauuguuuccacauuuaaucgcagauguaaggacacuagaaccaguugaacuaccuuuagaagauguuagaaauguacuauaucacaauagcucucaaccucaaccaacaaugcgccuaguugcaauguuauacacaccccucagaacagguggcgggucugguggaacagaugccuucgucguagcuggaagaguguuaacauguccugcaccagauuuuucauuuuuauuccuagucccaccaagugucgaacaaaaaacuagaguauucucuguaccaaacauaccacuaaaagaccucucaaauucacgcguaccuguaccuguacaaggaauguucaugucaccugauguaaaucaaucaguacaauuucaaaaugguagaugucaaauagauggacaacuucaaggaaccaccccaguaucucuaucacaauuaugcaaaauuagaggaaaaacuuccucuaaugcaagaguauuaaaucuaucagaaguugacgguacuccuuucauuccccuagaaucaccagcaccaguagguuuuccugauuuaggcggaugcgacuggcaugugaauuuuacauuucaagcacaagaucaagacccaucacaauccguuacauucgcaacaaaugaugcaaguuucgucccauauuuaggaucuaucucuccucauaacggaggagauuuccaugccggagacauuauagguucauuagguuggauaucagcaccaaguggaaauucacaauuaaacguaugggcaauaccaaaauauggaucaucacuaccagacguuacacauuuagccccagcuguauuucccccaggauuuggcgaaguaauuuuauacuuuuauucgacuuuuccuggaagcggacaaccaucacaacuacaagucccaugucuauuaccacaagaauuuauaacacauuucugcaaugaacaagcaccaauagcaggagaagcugcacuacuccauuauguagauccagauacaggaagaaacuuaggcgaauuuaaacuuuaucccgauggauuuaugacuuguguaccuaacucagucucaucuggaccacaaacauuaccaaucaauggcgucuuuguuuuuguuucauggguuuccagauuuuaucaauuaaaaccagucggaacagcaucagcagcacgacgacuauaa

SEQ ID NO: 34914 - RNA, 1608 nt, Artificial Sequence
  derived and/or modified sequence opt6 from VP1__Norovirus_and/or_Norovirus-like__GQ856464
augaugauggcaucaaaagaugcuccaacaagcccugacggugcuucaggcgcuggacaacucguaccagaagcaaauacagcugaacaaauuuccauggauccuguagcaggagcaucaacugcaguugcaacugcaggacaaguaaauaugauugauccuuggauuuucaauaauuuuguacaagcuccacaaggugaauuuacaauaucaccuaacaauacaccaggagacauauuauuugauuuacaacuuggcccacaucuaaaccccuuucuugcacaucuaucucaaauguauaacggaugggucggaaauaugagaguaagaauauuacucgcuggcaacgcauucacagcuggcaaaaucauaauauguuguguaccuccaggauucgaugcaagaauacuaacaauugcacaagccacccuauucccacaucuaauagcagauguaagaacacuagaaccaguagaacuuccacuugaagacguaagaaauguucuuuaccacaauagcucacaaccccaaccuacuaugagacuuguugcuauguuauauacuccacuaagaacaggaggaggcucuggcggaacagaugcauuuguaguagcagguagaguacuaacguguccugcaccggauuuuucuuuucuauuuuuaguaccaccaucaguagaacagaaaacuagaguauucucagucccaaacauaccauuaaaagaucucucaaacucccgaguaccaguacccauccaaggaauguucaugucacccgacguaaaucaaucaguccaauuccaaaauggaagaugccaaauagauggacaauuacaaggcacaacaccaguaucccuaucacaauuauguaaaauaagaggaaaaacaucaucuaacgcaagaguacuaaauuuaucagaaguagauggaaccccauuuauaccccuugaaucacccgcacccguuggauucccagaucucggagguugugacuggcauguuaauuuuacauuucaaacacaagacagagauccaucacaaucugucacuuuugcuacaaaugacgcauccuucguaccuuauuuagguucagucucaccacauaauggagaaggauuucaagccggugacauuauaggaucacuaggcuggauuucagcaccaagcgauaauucacaauuuaacgucugggcuauaccaaaauauggaucaucucuaccugacguuacacauuuagcaccagcaguauucccuccaggauucggagaaguaauccuauauuuuuauucaacuuucccaggaucaggucaaccaucacaauuacaaguaccauguuuauuaccacaagaauuuauaacucauuucuguaaugaacaagccccaauagcaggagaagcugcucucuuacauuacgucgacccugauacuggaagaaaucuuggagaauuuaaauuauauccagauggauucaugaccugcguaccaaacucaguaucauccggcccacaaacacuacccauaaauggaguauuuguauuuguuucauggguaucaagauucuaccaacuaaaaccuguagguacggcaucagcagcacgacgauuauaa

SEQ ID NO: 34915 - RNA, 1608 nt, Artificial Sequence
  derived and/or modified sequence opt6 from VP1__Norovirus_and/or_Norovirus-like__GQ856463
augaugauggcaucaaaagaugccccaacaucuccagacggagcaucuggcgcuggucaacucguuccagaagcaaauaccgcagaacaaauaucaauggauccuguugcuggagcuucaacagcagucgcaacagcaggacaaguaaauaugguagaucccuggauauuuaacaauuucguacaagcaccacaaggagaauuuacaauaucacccaauaauacccccggagacauacuauucgaucuacaacuaggaccacacuuaaauccauuucuugcccaucuaucacaaauguauaacgguuggguuggcaauaugagaguuagaauauuguuagcuggaaacgcauuuacagcaggaaaaauaauaaucuguuguguaccuccuggauucgacgcuagaauacuaacuauugcacaagcaaccuuauuuccacaucuaauugcagauguaagaacauuagaaccaguagaacucccuuuagaagacguucgaaauguucuauaucacaauuccucccaaccucaaccaacaaugcgcuuaguagccaugcuauacacaccucuaagaacaggugguggauccggcgguacagacgcauucguuguagcaggacgcguacuuacuuguccagcaccugacuucucauucuuauuuuuaguaccaccaucaguugaacaaaaaacuagaguauucucaguaccaaauauaccacuaaaagauuuaucaaauucccgaguaccugucccaauucaaggaauguuuaugucaccagauguaaaccaaucaguacaauuucaaaaugguagaugccaaauagacggacaacuucaaggaacaacaccagucucauuaucucaauuaugcaaaauucgagguaaaacuucuucaaaugcaagaguuuuaaauuuaucagaaguagauggaacucccuuuauaccccuagaaucaccagcaccaguagguuuuccagauuuagguggcugugacuggcauguaaauuucacauuucaaacucaagauagagacccuagucaaucaguuaccuucgcaacaaaugaugcauccuuuguaccauauuuaggaucaguaucaccacauaauggugaaggauuucaagccggagacauaauaggaucauuaggauggauaucagcaccaagcgacaauucucaauuuaauguaugggcaauuccuaaauacggaucaucauuaccagacguaacacauuuagcaccagcaguauuuccaccaggauucggagaagucauuuuauauuuuuacucaacauucccaggcagcggucaaccaucacaauuacaagucccauguuuacuuccacaagaauucauuacacauuuuuguaaugaacaagcaccuauagcaggugaagcugccuuacuacauuacguugacccugacacaggaagaaacuuaggagaauuuaaauuauauccagauggauuuaugacuugcgucccuaauucaguuucuucaggcccacaaacuuuaccaauaaauggaguauuugucuuuguaucuuggguaucaagauucuaccaauuaaaacccguaggaaccgcuucagcugcaagaagacuuuaa

SEQ ID NO: 34916 - RNA, 1608 nt, Artificial Sequence
  derived and/or modified sequence opt6 from VP1__Norovirus_and/or_Norovirus-like__KM036372
augaugauggcuuccaaagaugcaccaacuucaccagacggagcaucuggagcgggucaauuaguaccagaagcaaauacagccgaacaaauaucaauggauccaguugccggugcuucaacagcuguagcaacagcuggacaaguaaauaugauagauccuuggauauucaacaauuucguacaagcuccacaaggcgaauuuacaauaaguccaaacaauacaccuggugacauuuuauuugaucuccaacuaggaccacaucuaaacccauuccuagcacaucuuucacaaauguauaauggauggguuggaaauaugagaguuagaauacuuuuagcuggcaaugcauuuacagcaggaaaaauaauuauauguugcguaccuccuggauuugacgcaagaauauuaacuauagcucaagcuacauuauucccacaccuuauagcugacguuagaacauuagaaccuguagaauuaccacucgaagauguuagaaauguauuauaucauaauucaucacaaccccaaccuacuaugcgacucguagcaaugcuauauaccccauugagaacuggcggaggaucuggaggaacagaugcuuuuguugucgcuggaagaguauuaaccugcccagcaccugacuuuucauuucuauuuuuaguaccaccaucaguagaacaaaaaacaagaguuuuuucuguaccaaacauaccauuaaaagaucuaucaaauucaagaguucccguucccguacaaggaauguuugucucuccagauguaaaucaaucuguacaauuucaaaacggaagaugucaaauugacggucaauuacaagguacaaccccuguaaguuuaucacaauuguguaaaauaagaggaaaaacaucuucaaaugcaagaguacucaauuuaucugaagucgacggaacuccauuuauaccucuagaaucgccagcuccaguagguuucccagaucuaggaggaugcgauuggcauguaaauuuuacauuccaaacacaagauagagauccaucacaaucaguaacauuugccacaaaugaugcaucauuuguuccauacuuaggaucaguaucaccacauaauggagaaggcuuccaagcuggugacauaauaggaucccuaggauggaucagcgcaccaucagacaacucccaauuuaauguaugggcaauaccaaaauaugguucaucacuucccgauguaacacaccuagcaccagccguauucccaccuggauuuggagaaguaauauuauacuuuuauucaaccuucccugguucuggucaaccaucucaacuccaaguaccauguuuacuaccacaagaauuuauuacucauuuuugcaacgaacaagcgccuaucgcaggcgaagcagccuuacuccauuacguagauccugauacaggaagaaauuuaggagaauucaaauuauauccagauggauucaugacuugugucccuaacucaguaaguucagguccacaaacccuaccaauaaaugguguuuuuguauuuguaagcuggguuucucgauuuuaucaauuaaaacccguagguacagccagcgcagcaagacgccuuuaa

SEQ ID NO: 34917 - RNA, 1608 nt, Artificial Sequence
  derived and/or modified sequence opt6 from VP1__Norovirus_and/or_Norovirus-like__AF538678
augaaaauggcaucaaaagaugcaccaccauccccugauggugcaucuggagcaggacaauuaguuccagaaguaaauacagcagaucaaauaucuauggaucccguagccggugccaguacagcagucgccacagcaggacaaguaaauaugaucgauccauggauauucaauaauuuuguacaagcaccccaaggagaauuuacuauaucuccaaauaauacuccaggugacauccuuuuugaucuccaacucggaccacauuugaacccauuucuagcacaccuaagccaaauguauaacggauggguaggaaauaugagaguacgaauauuauuagcaggaaaugcauuuacagcuggaaaaauaauaauauguugcguacccccaggauucgacgcaagaauucuaaccauagcacaagcaacucuauuuccacauuuaauagcagacguaagaacauuagaaccaguugaacuaccuuuagaagacguaaggaacguauuauaucauaacucgucccaaccacaaccaacuaugagauuaguagcuauguuauauacuccuuuaagaacuggcggaggaucagguggaaccgaugcuuucgucguugccggacgcgucuuaacaugcccugcuccagauuuuuccuuccucuuccuaguuccaccaagcguagaacaaaaaacacgaguauucucaguaccaaauauaccacuaaaagauuuaucuaacucaagaguaccaacacuaauacaagguauguuuguaucacccgacgucaaccaaucaguacaauuucaaaauggaagaugccaaauugacggacaacuucaagguacaacuccaguaucucuaucucaauuauguaaaauuagaggaaaaacaucuucaaauacacgaguucuaaaccucagugaaguugauggaaccccauucguuccuuuagaauccccagcaccaguaggauuuccagauauuggcggaugugauuggcacguaggcuuuacuuuugaagcgagagaccaagacccaucacaaaauguaacauuugcaacuaaugauucuucuuuuguaccauacuuaggaucaauaucuccacacaacggagauggauuucauucaggagacauaguaggaucacucgauuggauuuccgcucccucagauggaucugcacuagacguaugguccauacccaaauauggaucaucucuuccagacguaacacaucuagcaccuguaguauucccuccaggcuuuggugaagucauacuauauuuucauucuaaauuuccaggauccggacccacugauaaacucagaguaccuugccuaaugccucaagaauuuaucacacacuuuuguaacgaacaagcaccaauagcaggagaagcugccuuacuacauuacgucgauccugauacuggcagaaauuuaggagaauuuaaauuauauucagacggauuuaugacauguguuccuaauucaauaucuucaggcccccaaacacuuccaauaaacggcguauucguauucguaucauggguaucaagauuuuaucaauuaaaaccuguaggaacagcaucagcugcaagaagacucuaa

SEQ ID NO: 34918 - RNA, 1608 nt, Artificial Sequence
  derived and/or modified sequence opt6 from VP1__Norovirus_and/or_Norovirus-like__KC294198
augaugauggcaucaaaagaugcaccaacaucuccagacggugcaucaggagcuggccaauuaguaccagaagcaaacacugccgaacaaauuucuauggauccaguagcaggagcaucaacagcaguugcuacagcaggacaaguaaauaugauugauccauggauauuuaauaauuuuguacaagcuccacaaggugaauuuacaauaucaccaaauaauacuccuggagacauauuauuugauuuacaacuuggcccccaccuaaaucccuuuuuagcucaccuuagccaaauguauaacggauggguaggaaauaugaggguaagaauauuacuagcagguaaugcauucaccgcuggaaaaaucauaauauguuguguaccaccaggcuuugacgcacgaauauuaacaauagcacaagccacacucuuuccacaccuaauagcagauguaagaacacuagaaccuguagaacucccucuagaagacgucagaaacguauuauuucauaauuccucacaaccacaaccaaccaugagauuaguugcaauguuauauacaccucuacgaaccggcgguggaucugguggcacugaugcauuuguaguagcuggcagaguacucacauguccagcaccugauuuuucuuuucuauuucucgugccaccaucaguagaacagaaaacaagaguuuucucaguaccuaauauaccccucaaagauuuaucaaauucacguguaccaguaccuguacaaggaauguuuaugucuccugauguaaaccaauccguucaauuucaaaacggaagaugccaaauugacggacaacuacaaggaacuaccccaguaucacuuucacaauuauguaaaauaagaggaaaaaccucaucuaaugcucgaguauuaaaccuaucagaaguugauggaacaccauucaucccauuagaaucgccagcaccaguaggauuuccagaccuuggcgguugcgacuggcacguaaauuuuacauuucaagcacaaaaucaagauccaucacaaucaguaacauuugcuacaaacgacgcauccuuuguaccauauuuagguuccauaucaccacauaacggaggagacuuccaugcaggcgacauuaucggaucacugggauggauuucagcaccuuccgauaacucucaauuaaaugucuggacaauaccaaaauauggaucaucucuaccugauguuacacauuuagcacccgcaguauucccaccugguuucggagaaguuaucuuauauuucuacucaacauucccugguucaggucaaucgucacaauuacaagucccaugccuauuaccacaagaauuuaucacacauuuuuguaaugaacaagcuccaauagcaggagaagcagcacuauuacacuauguagauccagacacaggucgaaauuuaggagaauuuaaguuauauccagacggcuuuaugacaugcgucccaaauucuguaucaucuggaccacaaacauuaccaauaaaugguguauuugucuuugucucaugggucucaagauuuuaucaacuaaaacccguaggaacagcaucugcagcaagaagacuauga

SEQ ID NO: 34919 - RNA, 1608 nt, Artificial Sequence
  derived and/or modified sequence opt6 from VP1__Norovirus_and/or_Norovirus-like__KT732280
augaugauggcaucaaaagaugccccaacuucaccugauggagcaucaggagcaggacaacuaguuccagaaguaaauacagcagaccaaauaucaauggaccccguugcaggugcaucaacugcaguagcuacagcaggccaaguuaauaugaucgacccauggauauucaacaacuuuguacaagcaccacaaggagaauuuacaauuucaccaaauaauacacccggugacauacuauucgaccuucaacuagguccucauuuaaauccauuuuuagcacaccuaucucaaauguacaacggauggguaggaaauaugcgaguacgaauacuuuuagcaggaaaugccuuuacagcaggaaaaauaauaauauguuguguaccaccuggauuugaugcaagaauauuaacuauugcacaagcaacauuauuuccacacaugauugcagauguacguacauuagaaccaguagaacuaccacuagaagauguucguaauguacuauaucauaauucuucacaaccacaaccuacuaugagacuuguagccauguuauauacgccucuacgaaccggcggagguucaggaggaaccgaugccuuuguuguagcaggucgaguacucacauguccagcaccagauuuuucauucuuauuuuuaguacccccaucuguagaacaaaaaacaagaguuuuuucaguccccaauaucccacuaaaagacuuaucaaauucuagaguuccaacuuuaauacaaggaauguuuguauccccagauguaaaucaaucaguacaauuucaaaaugguagaugucaaaucgauggacaacuacaaggaacaacaccaguaucuuuaagucaacucuguaaaauccgaggcaaaacaucuucgaacgcaagaguacuuaaucuaucagaaguggauggaacacccuuuguaccacuagaaucccccgcaccaguaggauuuccagaccucggaggaugcgauuggcacguaggauuuacuuuugaagcacgagaccaagauccaucacaaaacguaacauuugcuacaaaugauucuagcuuuguaccauaucuuggaucaauuucaccacauaauggagacggauuccauucaggagauauaauuggaagcuuagacuggauuucugcaccaucagacggcucaacacuagacguauggucaauaccaaaauauggaucuuccuuaccugacgucacccaucuagcaccagcaguauucccacccgguuucggagaaguaauccuauauuuccauucaaaauucccaggaucaggaccuacagacaaacuucgaguuccaugccuuauaccccaagaauuuaucacacauuuuugcaacgaacaagcuccaauugccggugaagcugcauuacuacauuacguagacccagauacuggaagaaauuuaggagaauuuaaacuauauccagauggauuuaugacaugcguaccuaacuccauauccucaggaccucaaacacuaccaacaaacgguguguuuguauucguaucauggguaucaagauucuaucaacuaaaaccaguuggaaccgccucuauggcaagaagacuauaa

SEQ ID NO: 34920 - RNA, 1608 nt, Artificial Sequence
  derived and/or modified sequence opt6 from VP1__Norovirus_and/or_Norovirus-like__LC101822
augaugauggcguccaaagacguaccuacuucaccagacggagcuucaggagcuggacaauuaguuccagaaguaaauacagcagaucaaauaucaauggauccaguugcuggagcauccaccgcuguagcaacagcuggacaaguaaauaugauagacccuuggauauucaauaacuuuguucaagcaccccaaggugaauuuacaauaucccccaauaauacaccaggagauauuuuauuugauuuacaacucggaccacauuuaaauccauuucuagcacaccuaucucaaauguauaauggauggguaggaaauaugcgcguuagaauauugcuagcaggaaaugcauucacagcaggaaaaauuauaauauguugcguaccuccugguuucgaugcgagaauacucacaauugcacaagcaacauuauuuccacauuuaauugcagauguacgaacuuuagaaccaguugaacuaccauuagaagauguccgaaauguacuuuaccauaauagcucacaaccacaaccuacaaugagacuugucgccauguuauauacaccauuaagaacagguggcgguuccggaggaacagaugcauuugucguugcaggccgaguacuaacuugucccgccccagauuuuuccuuucuauuuuuaguaccaccuucaguagaacaaaaaacuagaguauucucaguaccuaacauacccuuaaaagacuuauccaauucaagaguaccaacuuuaauacaaggaauguucguaucuccagauguuaaucaaucuguacaauuucaaaauggacgaugucaaauagacggacaauuacaaggaaccacuccaguaucucuaagucaacuauguaaaauaagagguaaaaccucaucaaauacacgaguauuaaaucuaagcgaagucgacggaacaccauucguacccuuagaaucuccagcucccguuggauuuccagauauaggaggaugcgauuggcauguaggauuuacuuuugaagcuagagaccaaggacccucacaaaacguaacuuuugcaacuaaugacucaucuuucguacccuacuuagguucaauuucaccacauaacggagauggauuucacucuggugacauaaucggaucauuagacuggauaucagccccaucugaugguucagcucuagacguauggucuaucccaaaauauggaucaaguuuacccgacguaacucauuuagcacccgcuguauuuccaccagguuuuggagaaguaauacuauauuuucauucuaaauuucccggcucaggaccaacagauaaauuaagagucccaugucucaugccccaagaauucaucacacauuuuugcgacgaacaagcuccaauagcaggugaagcagcauuauuacauuauguagauccagaugcaggaagaaaccuaggagaauuuaaacuauauccagauggauuuaugaccugcguaccuaacagcauaucaucuggaccucaaacccuaccaauaaauggaguauucguauuuguaucuuggguaucaagauuuuaucaauuaaaaccaguagguacugcaucaauggcaagacgacucuaa

SEQ ID NO: 34921 - RNA, 1608 nt, Artificial Sequence
  derived and/or modified sequence opt6 from VP1__Norovirus_and/or_Norovirus-like__KP407451
augaugauggccucuaaagacgcaccaaccucucccgacggagcaucaggagcuggacaauuaguaccagaagcuaauacagcugaacaaauaucaauggauccagucgcaggagcuucaacagcuguagcaacagcuggacaaguaaauaugauugauccuuggauauuuaauaauuuuguacaagcuccacaaggagaauuuacaauaucaccaaauaacacaccaggagauauauuauucgauuuacaacucggaccacaccuuaauccauuucucgcucaccuaucccaaauguacaaugguuggguaggaaauaugcgaguaagaauacuauuagcagguaaugcuuuuacugcaggcaaaauaauuauauguuguguaccacccggauucgaugcacgaaucuuaacaauugcacaagcaacacuuuuuccacaccuaaucgcugacguacgcacacuagaaccagucgaacuaccauuagaagacguaagaaauguacuauaucauaauucaucacaaccacaacccaccaugcgacucgucgcaauguuauacacuccauuaagaacaggaggaggaucaggaggaacagacgcauuuguaguugcagguagaguacuaacuuguccugcuccagacuuuucauuucuauucuuaguaccacccucuguagaacagaaaacaagaguauuuucaguuccaaauauaccauuaaaagaucuaucaaacagccgaguaccuguacccauacaagguauguucaugucacccgacguuaaucaauccguacaauuccaaaaugguagaugucaaauagauggucaacuucaagguacaaccccaguaucuuuaucacaauuauguaaaauacgcgguaaaacaucuucuaaugcaagaguacucaaucuaagugaagucgauggaacaccauuuauuccauuagaaucaccagcuccaguaggauuuccagacuuaggaggcugugacuggcacguaaauuuuuccuuccaaacucaagauagagauccaucucaaucugucacauucgcuacuaaugacgcauccuuuguaccauacuuaggaucaguauccccacauaauggugaaggauuucaagcuggagacauaaucggaucauuaggauggaucucagcaccaucagacaauucacaauucaauguaugggcuauaccaaaauauggauccucucuaccagauguaacccauuuagcuccagccguauuucccccaggauuuggcgaaguaauacuauauuucuauucaacauuuccaggaagcggucaaccuucacaacuacaaguaccaugucuccuaccacaagaauuuauaacacauuuuugcaaugagcaagcuccaauagccggugaagcagcacuauuacacuauguagauccugacacaggacgaaaucugggugaauuuaaacucuaucccgauggcuuuaugaccugcgucccuaauaguguaaguucuggaccacaaacacuaccuauaaauggaguuuuuguuuuuguaucuuggguaucccgauuuuaucaacuuaaaccuguuggaacagccucagcagcaagaagauuauaa

SEQ ID NO: 34922 - RNA, 1608 nt, Artificial Sequence
  derived and/or modified sequence opt6 from VP1__Norovirus_and/or_Norovirus-like__LN854564
augaugauggcauccaaagacgcaccaacaucaccugauggagccucuggagccggccaacuuguaccagaagcaaauacugcugaacaaauaucuauggaucccgucgcaggagcuucaacagcugucgcaacugcaggacaaguaaauaugauugacccuuggauuuuuaauaacuucguacaagcaccacaaggagaguucacuauauccccaaauaauacacccggagauauuuuauucgauuuacaauuaggaccacauuuaaacccauuucuagcucauuuaucucaaauguauaaugguuggguagguaauaugcgcguaagaauacuauuagcuggaaaugcuuucacagcuggaaaaaucauaauaugcuguguuccaccaggauucgacgcaagaauacucacaaucgcacaagcuacacuauucccacaccuaauagcagauguucgaacccuagaaccaguagaacuaccacuagaagaugucagaaacguucuauaucauaauucuucacaaccacaaccaacuaugagauuagucgcaaugcuauauacaccauuacgaacaggaggaggaucagguggcacugaugccuuuguaguagcaggacgaguauuaacuugcccagcaccagauuuuucauucuuauuuuuaguacccccuaguguagaacagaaaacaagaguuuuuagcguaccaaauauaccacuaaaagaucuaaguaauucccgaguaccagucccaauacaaggaauguuuaugucaccagacguaaaccaaucaguacaauuccaaaacgguagaugucaaauagauggacaacuacaagguacaacuccaguuucacucucucaauuauguaaaauucguggaaaaacaucauccaaugcacgaguauuaaaccuaucugaaguugacggaacaccauuuauuccauuagaaucuccagcaccaguaggauuuccugaccuagguggaugugacuggcaugucaauuuuacauuccaagcucaaaaucaagacccaucacaaucuguaaccuuugcaacaaacgacgcaucauuugucccauaucuuggaucaauaucaccacauaauggcggagacuuccaugcaggcgacauaauaggaucacuagguuggauuucagcuccaucagauaauucucaacucaauguauggacaauaccaaaauauggaagcucucuaccagauguuacucauuuagcuccagcaguauuucccccaggauuuggugaaguuauacuauacuuuuauucaacauuuccaggaagcggacaaccaucacaacuccaaguacccuguuuacuaccccaagaauuuaucacucacuuuuguaaugaacaagcaccaauagcuggagaagcagcauuauuacauuauguugauccagacacaggacgcaacuuaggagaauuuaaacuauaucccgauggcuuuaugacuugcguaccaaauuccguaucaucagguccacaaaccuuaccaauuaacggaguuuuuguuuuuguaucaugggucucucguuuuuaccaacuaaaaccaguaggaacagcuucagcagcaagacgccuauaa

SEQ ID NO: 34923 - RNA, 1608 nt, Artificial Sequence
  derived and/or modified sequence opt6 from VP1__Norovirus_and/or_Norovirus-like__JQ388274
augaugauggcuaguaaagacgcaccaacaaguccagauggagcauccggugcaggccaauuaguaccagaagcuaacacagcagaacaaauuucaauggauccaguagcuggagcaucuacagccguugcaacugcaggacaaguaaacaugauagacccuuggauauucaacaacuucguccaagcaccacaaggugaauuuaccauaucaccaaauaauacuccaggugauauuuuauuugaucuucaauuaggaccacaucucaacccauuuuuagcacauuuaucacaaauguauaauggauggguaggaaauaugagagucagaauacuacuagcaggaaacgcauucacugcgggaaaaauaauaauaugcuguguuccaccagguuuugaugcaagaauuuuaacaauagcacaagcaacacuauucccucaucuaauugcagauguacguacauuagaaccaguagaacuaccuuuagaagauguucgaaacguccuuuaucacaacuccagucaaccacaaccaacaaugcgcuuaguagcaauguuauacacaccacuaagaacugguggggguucaggugguacagaugcauuuguaguugccggacgaguuuuaacaugucccgccccugacuucucauuucucuuucucguaccaccaucuguagaacagaaaacccggguuuucuccgucccaaauauaccuuuaaaagaucuauccaacucacgagucccuguacccguacaaggaauguuuaugucuccagacgucaaucaaucaguacaauuccaaaacggacguugucaaauagauggacaacuccaagguacaacaccaguaucacuaucacaacuuuguaaaauaagaggaaaaacaagcucuaacgcaagaguacuaaaucuaucagaaguagacggaacucccuuuaucccauuagaaaguccagcuccaguaggauuuccugaucuaggcggaugugacuggcacguuaacuuuacauuucaagcucaaaaccaagauccuucacaauccgugacauuugcaaccaaugaugcaucauucguaccauauuuaggaucaaucucaccccacaauggaggcgauuuucaugcaggcgauauaauuggcucacuagguuggauauccgcuccuagugauaauagucaacuuaacguauggacaaucccaaaauaugguucaucucuaccagacguaacacaucucgccccugcaguauuuccaccaggauuuggagaaguaauacucuauuucuacagcacauuuccaggcucaggacaaccaucacaacuacaaguaccuugucugcuaccccaagaauuuauaacccauuucugcaaugaacaagcacccauagcaggagaagcagcauuauuacacuauguagacccagauacaggacgaaauuuaggagaauuuaaacucuauccagauggauucaugacaugcguacccaacucuguaucauccgguccacaaacauuaccaauuaacggaguuuuuguauucguaucauggguaucacgcuuuuaucaacuaaaaccaguuggaacugcaucugcagcaagaagauuauaa

SEQ ID NO: 34924 - RNA, 1608 nt, Artificial Sequence
  derived and/or modified sequence opt6 from VP1__Norovirus_and/or_Norovirus-like__KP027330
augaugauggcaucaaaagacgccccaacaagcccagauggagcaucaggagcaggacaacuaguaccagaaguaaauacugcugaucaaauaucuauggaucccguagcaggugcuucuacggcuguagcaacagcaggucaagucaacaugauagaucccuggauuuuuaauaauuuuguacaagcuccacaaggagaauuuacaauaucaccaaauaauacaccaggagauauccuauucgaccuacaacuuggaccacaucuaaauccauuuuuagcucaccuaucccaaauguauaauggcuggguaggcaauaugagaguuagaauuuuauuagcuggaaacgcuuuuaccgccggaaaaauaaucauauguugcguaccacccgguuucgaugcaagaauucuaacaauagcacaagcuacauuauucccacacaugauagcagauguaagaacauuagaaccaguagaacuuccucucgaagauguacguaauguauuauaccauaauagcagucaaccucaaccaacaaugcgauuaguagcaaugcuauauacaccauuaagaacaggugguggauccgguggaacagaugcauuuguaguagccggaagagucuuaacauguccagcaccagacuuuucauucuuauuuuuaguuccacccaguguagaacaaaaaacacgagucuuuucaguuccaaauauaccacucaaagaucuaucaaauucaagaguaccaacccuaauacaaggaauguucguaucaccagauguaaaucaaucaguacaauuccaaaauggccgaugccaaauagauggucaauuacaaggaacaacaccuguaucauuaucacaacuauguaaaauucgaggaaaaacuuccucaaacgcaagagucuuaaaucucucagaaguugauggaacuccuuuuguacccuuagaaucaccagcaccaguuggcuuucccgauuuaggagggugugauuggcauguaggauuuacauuugaagcaagagaucaagauccaucacaaaauguaacuuucgcaacaaacgauucaucuuuugucccuuaccuuggaaguauaucaccccacaacggugauggguuucauucaggagauauaauugguucuuuagacuggaucucagcaccaucagauggauccacacuagauguauggucaauaccaaaauauggaagcucacuaccagauguaacacaccuagcacccgcaguuuuuccaccagguuuuggagaaguuaucuuauacuuccacucuaaauuuccuggaagcggcccaacugacaaacuacgaguaccaugccuaauaccucaagaauucauaacacacuuuugcaaugaacaagcccccauagcaggagaagcagcuuuauuacacuauguagauccagauacaggcagaaaucuaggagaauuuaaacuauauccagacggcuauaugacauguguaccuaauucaauuuccucaggaccacaaacacuaccaacaaaugguguauuuguuuuuguaucuuggguaucaagauucuaucaacuaaaaccaguugguacagcaucuauggcucguagauuauaa

SEQ ID NO: 34925 - RNA, 1608 nt, Artificial Sequence
  derived and/or modified sequence opt6 from VP1__Norovirus_and/or_Norovirus-like__AF093797
augaugauggcaucaaaagaugcacccccaaguccagauggagcuuccggagcaggacaauuaguaccagaaguaaauacagcagaccaaauaucaauggauccaguagcuggugcaucaacagcaguugcaacagcaggucaaguaaauaugauagacccauggauauuuaacaacuucguacaagcuccacaaggcgaauuuacaauaucacccaauaacacaccuggagacauacuauucgaccuacaauuaggaccacauuuaaauccauuuuuagcacaccuaucacaaauguacaauggauggguaggaaacaugagaguuaggauauuacuagcaggaaaugccuucacagcuggaaaaguuauaauauguugcguuccuccaggauuugacgcaagaauacucacuauagcccaagcuacuuuauuuccccaucuaauagcugacguacgcacauuagaaccaguagaauuaccacuugaagauguacgaaauguacuauaccauaacucuucacaaccacaaccaacuaugcgauugguugcaaugcuauacacaccucuacgaacuggaggugguucagguggaacagaugcuuuuguagucgcaggaagaguacuaacaugcccagcaccagauuuuucuuuucuauuucuuguaccuccaagcguugaacagaaaacaagaguauuuucaguacccaacauaccauuaaaagaucuuucaaauucuagagucccaacacuaauucaaggaauguuuguuaguccagauguuaaucaaaguguacaauuucaaaacggacgaugccaaauagauggacaacuacaaggaaccacucccguaucauuaucccaacuauguaaaauaagaggacgaacuucauccaacacaagaguauuaaaucuaucagaagucgauggaacaccauuuguaccacuagaaucaccagcaccaguugguuuuccagacauaggaggcugugauuggcauguugguuucacauuugaagcacgagaucaagacccaucucaaaauguuaccuucgcaaccaaugauucaucauuuguuccauauuuaggcucaauaucuccacauaauggugacggauuucacuccggagacauuaucggaagucuagauuggauaucagcaccuuccgauggaucugcauuagauguuuggucaauaccuaaauauggaaguucauuaccugauguuacacauuuagcaccagcuguuuuuccuccuggauuuggagaaguuauacucuacuuccauucaaaauucccaggaucaggaccaacagacaaauuaagaguuccaugucuaauaccacaagaauuuauuacacacuuuuguaaugaacaagcuccaaucgcuggugaagcagcacuauuacacuacguagauccugauacagguagaaauuuaggagaauuuaaacuauaucccgaugguuucaugacaugcguaccaaauucuauuucaucagguccacaaacacuaccaauaaauggaguuuucgucuuuguauccugggucucuagauuuuaccaauuaaaaccuguagguacagcaucagcagcaagaagacuauaa

SEQ ID NO: 34926 - RNA, 1608 nt, Artificial Sequence
  derived and/or modified sequence opt6 from VP1__Norovirus_and/or_Norovirus-like__AB810006
augaaaauggccucaaaugacgcugcucccucuaaugauggagcugcaagucuuguucccgaagcaauuaacgaaacaaugccauuagaaccaguagcaggggcaucaauagcagcuccaguagcaggacaaacuaauauaauugauccauggauccgaacaaacuuuguccaagcaccuaacggagaauuuacugucucacccagaaacucuccaggagaaauauuacuaaaucuagaacucggucccgauuuaaaucccuauuuagcacaccuuuccagaauguauaacggcuacgccggaggaguagaaguacaaguauuacuugccggaaaugcauucacagcuggaaaaauauuauucgcagcaauacccccaaacuuucccguagauaugauaucaccagcccaaauaaccauguuaccacacuuaauuguugaugucagaacuuuagaaccaauuaugauaccauuacccgaugucagaaauguauucuaccacuuuaacaaucaaccccaaccuagaaugagauuaguugcaaugcucuacacaccacuaagaucaaacggauccggcgaugaugucuuuacaguaucauguagaguacuaacucgaccaacaccugauuuugaauuuauauacuuaguaccaccaagcguagaaucaaaaaccaagccauuuacacuaccuauuuuaacaauuucugaacuaaccaacucucgcuuuccaaucccaauagaacaauuauauacagcaccaaaugaaaauaauguuguacaaugccaaaacgguagaugcacccuagacggagaacuucaaggaaccacacaacuucuuucaagugcuguauguagcuauagaggcagaacuguagcuaauagaggcgacaacugggaccaaaauuuauuacaacucacuuaccccucaggugcaucuuacgaucccacugacgaaguaccagcaccauuaggaacucaagauuucucuggaaucuuauacgguguauuaacacaagacaauguaucagaaggaacaggagaagccaaaaaugcaaaaggaguauauauaaguacuacuucaggaaaauucacaccaaaaaucggaucaauaggacuacauucaauaacugaaaauguacauccaaaccaacaaucucgauucacacccguaggaguugcacaaaacgaaaacacacccuuccaacaauggguauuaccucacuaugcaggcgcacuagcauuaaauacaaaccuagcaccagcaguagcccccacauuuccaggcgaacaacuacuuuucuuuagaucaagaguaccaugcguacagggacuaagaggacaagacgcauuuaucgauuguuuauuaccacaagaauggguaaaccacuuuuaucaagaagcagcacccucccaagcagacguagcacuuauacguuacgucaacccagauacaggaagaacgcuauuugaagcaaaacuacacagaucaggauucauaacaguaucacacacaggcgcauacccucuagucguaccuccaaauggaccauucagguuugauuccuggguaaaucaauucuacucacuagcaccaaugggaacaggauaa

SEQ ID NO: 34927 - RNA, 1605 nt, Artificial Sequence
  derived and/or modified sequence opt6 from VP1__Norovirus_and/or_Norovirus-like__LC101825
augaugauggcaucuaaagaugcaacaccuucagcugauggagcaaauggagcuggacaauuaguaccugaaguaaacaaugcagaaccccuaccucuagauccaguugcuggugcauccacagcauuagcaaccgccggacaaguaaacaugauugaccccuggauauuuaauaauuuuguacaagcaccacaaggcgaauuuaccauaucuccaaauaauacuccaggagacauacuauuugaccuacaauuagguccacaucuaaauccauuuuuagcacauuuaucccaaauguauaaugguuggguaggaaacaugcguguucguguuauucuagcaggaaaugcuuucaccgcaggcaaaguaauaauaugcuguguuccaccagguuuccaaucaagaacauuaucaauagcucaagcuacauuauuuccacauguuauagccgauguaagaaccuuagaaccucuagaaaucccacuagaagauguacgaaacacauuauaccacaauaaugacucacaaccaacuaugcgucucuuaugcaugcuauauacaccccuaagaacuggcggcggaucaggaggaacagaugcauucguaguagccggacgaguuuuaacuugucccuccccugauuuuaauuuccuuuucuuaguaccaccuaccguugaacaaaagacaagaccauucucaguuccgaauauaccacuacaaaacuuaucuaauucaagaguucccucauuaauacaaucaaugguacuaucaucagaccaugcacaaacuguccaauuucaaaacggacgaugcaccacagauggccaucuauuagguaccacaccuguaucaucaggucaacuaaugaaauuccgaggaaaagucacccccggaucaaaaguauuaaauuuaaccgaauuagacggaagccccuuucuagcuuuugaaccaccagcacccgcaggcuuucccgaucuaggcaaaugugacuggcauauugaaaugagccuauaucaaguaaauaaucaagacaauccaauaguacuacgagcaauagaacccaauuccuccucuuuuguaccacaucuagguucagucucuuuuaaucaaaauguagacgcugcaggagauuaugucuguaccauacaauacacaucuccaccaucaaauucacacgacgcugacguagauuuuuggucuauaccugauuacggaaguaaccuagccgaagcaucacaauuagcaccaguaguuuauccaccaggauuuggagaagcaauuguauacuuuaugucacgaguaccuggauggaauaggacuaaucgacuaaacuuagucccauguuuauuaccucaagaauuuauaggacauuuugucucugaacaagcaccagcuauaggagaagcagcacuucuccauuacguagauccagauacuaaucgcaauuuaggagaauuuaaacuuuauccagaaggauuuauaacauguguaccuaacggaacaggaccacaacaacuuccacuuaauggcguauucguauuuucaucauggguaucaagauuuuaucaauuaaaaccuguaggaaccgcuucauccgcaagauag

SEQ ID NO: 34928 - RNA, 1605 nt, Artificial Sequence
  derived and/or modified sequence opt6 from VP1__Norovirus_and/or_Norovirus-like__AB081723
augaugauggcuuccaaagacgcacccaccucuccagauggagccucuggugcaggacaacuuguaccugaagccaauaccgcagagcaaauuucaauggauccaguagcaggagcuuccacagcuguagcaacagccggacaaguuaauaugaucgacccauggauauuuaauaauuuuguucaagcuccacaaggugaauuuacuauaucuccaaacaauacaccaggugacauacucuuugauuuacaauuaggaccccauuuaaacccauuuuuagcacacuuaucacaaauguacaauggauggguaggaaacaugagaguaagaauauuacuagcuggaaaugcauuuacugcaggaaaaauaauaauauguuguguuccaccaggcuuugacgcacgcauacuaacaauagcacaagcuacucuuuuuccucaucuuauugcagauguacguacacuagaacccguagaauuaccauuagaagacguaagaaauguucuauaucauaauuccucacaaccacaaccuacaaugagauuaguagcaaugcuauauacuccuuuaagaacugguggcggaucuggaggaaccgaugcauuugucguugcugguagaguuuuaacauguccugcaccagacuucuccuuuuuauuucuaguuccaccaucaguagaacaaaaaacacgaguauucucuguaccaaauauuccacuaaaagauuuaucuaauuccagaguucccguaccaauucaagguauguucaugucaccagauguaaaccaaucaguacaauuccaaaacgguagaugccaaauugauggacaacuucaagguacuacuccaguaucauuaucacaacuauguaaaauuagagguaaaacaucaucaaaugcaagaguacucaaucuaucagaaguagacggcacaccauuuauuccuuuagaaucuccagcaccaguaggauuucccgaucuuggaggaugcgacuggcauguuaauuuuacuuuucaagcacaaaaucaagacccaucacaaucaguaacauuugcaacuaacgacgcaucauuuguuccauaccuuggaucaauaaguccccauaacggcggagacuuccacgcaggugauauaauaggaucuuuaggauggauaucagcaccaucagacaacacacaacucaacgucuggacaauaccaaaauauggaucaucauuacaaaugucuuuaacauuacaucuauuauguucaccaagguuaugggaaguaauacuauauuucuacucuacuuuuccagguucaggacaacccucccaauuacaaguucccugucuuuuaccccaagaauuuauaacacauuucugcaacgaacaagcuccuauugcaggugaagcugccuuauuacacuauguugauccugauacaggucgcaaccuaggcgaauucaaacuauauccugaugguuucaugacauguguaccaaauucuguaucauccggaccacaaacacuaccaauaaauggaguauucgucuucgucucaugggucucacgauucuaucaacuuaaaccuguaggcacagcuucagcugcucgacgcuuauaa

SEQ ID NO: 34929 - RNA, 1605 nt, Artificial Sequence
  derived and/or modified sequence opt6 from VP1__Norovirus_and/or_Norovirus-like__JN005886
augaugauggcuucuaaagaugcaccaucaaauauggauggaacaucuggagcuggucaguuaguccccgaaguaaaugcagcagaaccauuaccacucgaaccaguaguuggugcagcuaccgcagcagccacagcaggacaaguaaaucuaauagauccuuggauaaugaauaacuuuguacaagcaccagaaggugaauuuaccauaucuccaaauaauacaccaggagacauauuauucgacuuacauuuaggaccccaccuaaauccauuucuacaacaccuaucacaaauguacaauggaugggugggaaauaugagaguaagaguuaugcuugcuggaaacgcauucaccgcuggaaaaauuauaauaugcuguguaccuccuggauucgcaucucaaaauauaucaauaggacaagcaacuauguucccacaugucauugccgauguaagaguacuagaaccaauagaaauaccauuagacgaugucagaaauguauuauuucauacaaacgaaaauagaccaacuaugagauuacucuguaugcuauauacaccauuaagagcugguggugcaagcucagguacagauccauucguaauagcaggaagaguauuaaccuguccaucaccagauuucaauuuccuauucuuaguuccaccuucaguagaacagaaaaccagacaauuaacaguaccaaauaucccauuaaauaacuuagcuaacucaagaguaccagcaaugauaaauaaaaugacaguuucaacagaccaaaaucaagucguucaauuucaaaacggacguugcacacuugaaggacaauuauuaggaacaacaccaguaucugcaucccaaguagcuagaauaagaggaaaaguauuuucuacagcaucaggaaaaggcuuaaaucuaacagaacuagauggaacaccauaucaugccuuugaaucacccgcuccauuagguuucccagauauaggagccugugauuggcauguauccacauuuaaaguagaucaaaaucuaucaggugacccaaugagccgacuugauguaaaacaaaaugcaccauuugcaccucaccuaggaucaauagaauuuacaucagaucaagauccaacaggugaucaacuaggaacauuagcauggguauccccaucuacaucaggagcacgcgucgauccuuggaaaauaccuuccuauggaucaacaguuacagaauccacucacuuagcaccaccaauuuuuccaccuggauuuggugaagccauagucuacuuuaugucugacuucccaauaguaucaggaaauacagcacaaguaccuuguacauuaccacaagaguucguaucacauuuuguagaacaacaagcgccugucagaggagaagcugcacuucuucauuacguagacccagacacccauagaaaucuaggagaauuuaaacucuacccugauggcuuuauuacuugcgucccaaacacaggaggagguccacaaaauuuaccuacaaauggaguauuuguauuuucaucauggguaucccgauauuaucaauuaaaaccggucgggaccgcagggccagcacgaagacuauaa

SEQ ID NO: 34930 - RNA, 1605 nt, Artificial Sequence
  derived and/or modified sequence opt6 from VP1__Norovirus_and/or_Norovirus-like__AB758449
augaugauggcuucuaaagacgcacccucaaauauggacgguacaucaggugcuggacaauuagucccugaaguaaaugccgcugaaccuuuaccauuagaaccaguaguaggagcagcaacugcagcugcaacagcaggacaagucaaccuuauagauccuuggauaaugaauaauuuuguacaagcaccugaaggagaauuuacuauaucaccgaauaacacaccaggcgacauauuauuugaccuucaacuuggaccccaucuaaacccuuuucuacaacacuuaucacaaauguauaauggauggguaggaaauaugcggguaaggguaauguuagcugguaaugcauucacagcaggaaaaauuauaauuuguugcguaccaccuggauuugccucacaaaauauaagcauaggacaagcaacaauguuuccacauguaauagcagaugucagaguccucgaaccuaucgaaauaccacucgaugauguaagaaacgucuuauuucauaccaaugaaaacagacccaccaugcgacuauuauguauguuauauacaccauuaagagcaggaggcgcauccucaggcaccgacccauuuguaauagcuggaagaguauuaacuuguccaucucccgacuuuaauuucuuauuuuuaguuccaccaucaguugaacagaaaacaagacaauuaacaguaccuaauauaccauuaaacaacuuagccaauucaagagucccagcuaugauaaacaaaaugacaguuucaacagaucaaaaucaagucguucaauuucaaaauggaagauguacacuagaaggacaauuauuaggaacaacaccagucucagcaucacaaguagcucguauaagaggcaaaguauucucaacagcauccggaaaaggauuaaauuuaacagaacuagauggaacacccuaucaugcauucgaaucaccagcuccuuuaggauuuccagauaucggagcuugugacuggcauguuucaacauuuaaaguagaucaaaauuuauccggagauccaaugucacgcuuagauauaaaacaaaacgcaccuuucgcaccucauuuaggaucuauagaguucacaucagaucaagaaccaacaggugaccaauuaggaacauuagcaugggucaguccaucaacaagcggagcuagaguagauccauggaaaauaccuaguuacggauccacaguaacugaaucaacacauuuagccccuccaauuuucccacccgguuucggagaagcaauagucuauuuuaugagugauuuucccauuguaucagguaauacagcccaaguuccuugcacacuaccacaagaauuuguaucacauuuuguagaacaacaagcaccaauccgaggagaagcagcacuauuacauuauguagaucccgacacccaucgcaauuuaggagaauuuaaauuauauccagacggauuuauuacaugcguaccaaauaccggagguggaccacaaaaucuaccuauuaauggaguauuuguuuucucauccuggguaagucgauauuaccaacuaaaacccguaggcaccgcuggaccagcaagaagacucuaa

SEQ ID NO: 34931 - RNA, 1605 nt, Artificial Sequence
  derived and/or modified sequence opt6 from VP1__Norovirus_and/or_Norovirus-like__KX907729
augaugauggcuuccaaagacgcaccaucaaacauggauggaacaucaggagcaggacaauuaguaccagaaguuaaugcagcugaaccucuaccacuagaacccgucguaggugccgcaacagccguagcaacagcaggacaaguuaauuuaauugauccauggauuaugaauaauuuuguacaagcaccagaaggagaauuuacaauaucaccaaauaauacaccaggagauauauuauucgauuuacaauuaggaccucauuuaaauccauucuuacaacauuuaucacaaauguauaauggauggguuggaaauaugagagucagaguuaugcuagcaggaaaugcuuucacagcaggaaaaauaauaauauguugcguaccaccaggauucgcaucacaaaacauuucaauuggacaagccacaauguuuccacauguuauagcagauguaagaguacuagaaccaauugaaauaccacuagaugauguacguaacguauuauuucauacaaaugaaagucgacccacuaugcgauuguuauguaugcuauauacuccauuaagagcaggaggagcaucaucagggacugauccauuuguaauagcagguagaguauuaacaugcccaucaccugauuuuaacuucuuauuuuuaguaccuccaucaguagaacaaaagacaagacaacuaacaguaccuaauauuccauuaaauaacuuagcaaauucccgaguaccagcaaugauuaauaaaaugacaguaagcacugaucaaucucaaguaguccaauuucaaaauggccguuguacuuuagaaggccaauuauuaggcacaacuccaguuucagcaucacaagucgccagaauaagaggaaaagucuucucaacugcaucuggaaaaggauuaaacuuaacagaauuagaugguacaccauaccaugcauuugaaucccccgcaccacuuggauucccagauauuggugcaugugacuggcauguauccacuuuuaaaguagaucaaaacuuaucuggagauccaaugagccgucuagauauaaaacaaaaugcacccuucgcaccacaucuagguucaauagaauuuacuagcgaucaagaaccaaccggagaucaauuaggaacauuagcauggguuaguccuucuacauccggagcaagaguagauccuuggaaaaucccaucauauggaucaacaguaacagaaucuacacauuuagcuccaccaauauucccucccgguuuuggcgaagcaauuguauacuucaugucagauuuuccaauaguuucagguaauacagcccaagucccuugcacucuuccucaagaauuugucucacauuucguugaacaacaagcaccaauaagaggugaagccgcacuucuccauuauguagacccagacacacauagaaauuuaggagaauuuaaacuauaucccgauggauuuauaacauguguaccaaauacagguggagguccacaaaaucuaccaauaaacgguguauucguauuuucuuccuggguuuccagauauuaucaauuaaaaccaguaggaaccgcaggacccgcuagacgauuauaa

SEQ ID NO: 34932 - RNA, 1602 nt, Artificial Sequence
  derived and/or modified sequence opt6 from VP1__Norovirus_and/or_Norovirus-like__JN899243
augaugauggccucuaaagaugcaccauccaacauggacgguacauccggagccggacaacuagucccagaaguaaacacugcagaaccacuccccuuagaaccaguaguaggagcagcaacugccgccgcaacagccggacaaguaaaucuaauagaucccuggauuaugaauaacuuuguacaagcaccugaaggagaauuuacaauaucaccuaacaauacuccuggugauaucuuauuugaucuaagacuaggaccucaccuaaauccauuuuuacuacaucuaucucaaauguauaaugguuggguuggaaacaugagaauaagaguaaugcuagcaggaaaugcauucucugcagguaaaaucauuauauguuguguaccuccaggcuucgaaucacaaaauauaagcauaggacaagcaacaauguuuccucacguaauagcagacguaagaguacuugaaccaauagaaauuccccuagaugauguacgaaacguuuuauaccauacaaaugagaauagaccaacaaugagauuacuuuguauguuauacacaccauuaagagcaggaggagccucuucaggcacugauccauuuguuaucgcuggaagaguccuaacaugcccugcaccagacuuuaauuuuuuauucuuaguaccaccaucaguagaacaaaaaacacgucaauuaacaauuccaaauauacccuuaaauaaccuagcaaauagcagaguuccagcaaugauaaacaaaauggcagucucagcugaccaaaaucaaguaguacaauuucaaaacggcagauguacccuugaaggacaacuacuaggaacaacaccagucagcgcaaaucaagucgcaagaauaagaggcaaaguuuuuucuacaaauucuggaaccggacuuaacuuaacagaaacagacggcacaccauaccaugcauucgaaucacccgccccacuagguuuuccagacaucggagacugugacuggcacguauacgcauuuaaagucaaucaaaauacaggagacccaauguauagauuggacaucacacaaggaaauucauucgcaccacaucucggcucuauagaauuuacaucugaucaacacccaucaggcgaucaacuaggaacacuaacauggaucuccccacuuaauaaugcaagcagaguagacccauggaaaauuccauccuaugguucuacauuaacagaauccacuaauuuagcaccaccaauauuuccaccuggauucggagaagcuauaguauacuuuaugucugacuuuccaauaguaucgggaaacacaacccaaaucccaugcacauuaccucaagaauuuauaucuucauucguagaacaacaagcaccaauuagaggagaagcagcauuauuacauuacguagacccagacacccacagaaaucuaggcgaauuuaaauuauacccagacggauuuauaacauguguaccaaauacuggaggcggcccacaaaaccuacccuccaacggagucuuuauauucucuucuuggguaucaagauauuaucaauuaaaaccagucggaacagcaggaccagcaagacgacuauaa

SEQ ID NO: 34933 - RNA, 1602 nt, Artificial Sequence
  derived and/or modified sequence opt6 from VP1__Norovirus_and/or_Norovirus-like__AB810004
augaaaauggcauccaacgacgcagccccauccaacgauggugcagcaucucuaguacccgaagcaauuaacgaaacaaugccauuagaaccagucgcaggagcaucaauagcagcuccagucgcaggacaaacaaacauaauugauccauggauaagaacaaauuucguccaagcaccaaauggcgaauuuacaguaucaccacguaacucacccggagaaauacuauuaaacuuagaauuaggaccagaccuaaacccuuaccuugcacauuuaucaagaauguauaauggcuacgcaggaggaguagaaguacaaguucucuuagccggaaaugcuuucaccgcuggaaaaauucuauuugcagcuauuccaccuaauuucccaguagacaugauuucaccagcccaaauaaccauguuaccacacuuaauuguagauguacgaacacuagaacccauaaugauaccacuaccagacguuagaaauguauuuuaccauuuuaacaaccaaccacaaccaagaaugagacucguugccauguuauacacaccacuucguuccaacggaucaggugaugacguauucacaguaucaugccgaguacuaacacgcccaacacccgauuucgaauuuauauacuuaguaccaccaucagucgaaucaaaaacaaaaccauucacacuacccauucuaacaaucucagaacuaacaaacucacguuucccaauaccaauagaacaauuauacacugcaccuaaugaaaacaauguaguacaaugccaaaauggucgcugcacacucgacggagaacuacaaggaacaacacaauuacuaucuucagcgguaugcucauacagaggaagaacaguugcaaaccgaggagauaacugggaucaaaacuuauuacaauuaacauauccaucuggagcaucuuaugacccaacagacgaaguaccugcaccauuaggaacacaagacuucucuggaaucuuauauggcguuuuaacucaagauaaugucucagaaggaacuggagaagcgaaaaacgccaaaggagucuauauaucaacaacaagcggaaaauucacaccaaaaauaggcucaauuggacuacauucuauaacagaaaacguccaccccaaucaacaaucccgguuuacaccaguaggaguugcucaaaaugaaaacacaccauuccaacaauggguauuaccacauuaugccggagcgcuagcucuaaauaccaaccuugcaccagccguagcaccaacauuccccggagaacaacuauuauuuuucagaucaagaguuccauguguacaagggcuaagaggacaagacgccuuuauagauuguuuacuaccacaagaauggguaaaucacuucuaccaagaagcagcaccaucacaagcagauguagcacuaauaagauauguaaacccagauacaggaagaacuuuauuugaagcgaaacuacauagaucagguuucauuaccguaucacauacaggagcauacccacucguaguacccccaaauggccacuuuagauuugacucauggguuaaccaauuuuauagccuagccccaaugggauag

SEQ ID NO: 34934 - RNA, 1602 nt, Artificial Sequence
  derived and/or modified sequence opt6 from VP1__Norovirus_and/or_Norovirus-like__JN183163
augaugauggcaucaaaagaugcaacuccuuccgccgauggagcaaccggagccggucaacuaguuccagaaguaaauacagcugacccgauccccauugauccaguagcaggaucaucuacagcucuagccacagcaggacaaguaaaucuaauagauccauggauaauaaauaauuucguacaagcaccacaaggagaauucaccauaucaccuaacaauacaccaggagacguucuauucgacuuacaacuaggcccucaccuaaauccauuucuaucucauuuaucacaaauguauaacggauggguaggaaauaugagaguuagaguaguauuagcagguaaugcauucacagcuggaaaaguaaucauauguugcguacccccugguuuucaaucaagaaccuuaucuaucgcacaagccacacucuuuccacacguaauagccgacguucgaacacucgauccaguagaaguuccacuagaagauguacgaaacguauuauaucauaauaaugauacccaaccaacaaugcgucuucuaugcaugcucuauacaccucuaagaacaggaggagcaucaggugguacagauucuuucguuguagccggacguguauuaacaugucccggaccagauuuuaauuucuuauuucuaguacccccaacaguagaacaaaaaacaagacccuucacagucccaaauauaccacuaaaauauuuauccaacucucguauuccaaaccccauagaaggaaugucacuuucaccagaccaaacacaaaacguacaauuucaaaauggacgcuguacaaucgauggacaaccauuaggaaccacacccgucucaguaucacaauuaugcaaauucagaggaagaauaacaucaggacaacgagucuuaaaccucaccgaacuagacgguaguccauucauggcauucgccgcacccgcaccagcugguuuuccugacuuagguaguugcgauuggcauauagaaaugucaaaaauacccaacuccagcacccaaaacaauccaauaguagucaacucuguaaaaccaaacucacaacaauuuguaccacaccuuucuucaaucacccucgacgacaauguuucaucaggaggugauuauauaggaacaauucaauggacuucaccuccauccgacucagguggagcaaacaccaauuuuuggaaaauuccagauuacggaagcucucuagcagaagcaucccaacuagcaccagcuguauauccuccaggauucaaugaaguaauaguauauuuuauggcaucaauaccuggccccaaucaaucaggaucaccuaacuuagucccuugucuacuaccacaagaauauauaacacauuucauuuccgaacaagcaccaauacaaggagaagcagcauuauuacauuacguagauccugacacaaacagaaacuuaggcgaauuuaaauuguauccuggaggauacuuaacaugcguuccaaauucuucuucaaccggcccacaacaauuaccucuagauggaguauucguauucgcaagcugggucucucgcuuuuaucaacuaaaaccagucggaacagcauaa

SEQ ID NO: 34935 - RNA, 1599 nt, Artificial Sequence
  derived and/or modified sequence opt6 from VP1__Norovirus_and/or_Norovirus-like__EU373815
augaaaauggcauccaaugacgccuccccaagcucagacggaucagccaaucuuguaccugaaauaaacaaugaaguaauggcccuagaaccuguagcaggagcagcaauugcagcacccguggccggacaacaaaauauaauagacccuuggauuagaaauaacuucguacaagcaccaggaggagaauuuacaguaaguccaagaaaugccccuggagagguacucuuaaaucuaccuuuaucacccgauauaaauccuuauuuagcacauuuaucacgaauguauaacgguuacgccgguggcguagaaguagaaguuguacucgcuggaaaugcauuuacagcaggaaaaauaauuuucgcugcagucccaccaaauuuuccaccugaaaaucuaagcccgagccaaauaacuaugcucccucacauaauaguagacguacgacaauuagaaccaguaagaauaccacucccagauguacgaaacaauuucuaucacuauucacgagaaaacgacucaaccuuaagacucguagcaauguuauacacaccccuuagagcuaacaaugcuggugacgauguauucacaguaucaugcagaguuuuaacaagaccaucaccagacuuugacuuuauuuuucuaguuccacccacaguugaaucaaaaucuaaaccauucacaauaccaauauuaacaauagaggaaaugacuaacucuagauuuccagcaccauuagaaaugaugacaaccggaccaagucacgacaucguuguccaaccucaaaacggacgauguacaaucgacggaguacuauuaggaacuacacaacuaucaccaguaaacauaugcucaaugagaggaguaccuacaaaaagaaccaauggcacagauaacugcuucguacaacuugaaaauccuaauggaucagcauaugaccccacugaagauauacccgcaguacuaggcucaccagacuucguaggugaauuuuauggaacaauaacccaacgcucaccaaacaacucaacaagagcacauccauucacucucaauaccgguucuccaagauauacaccaaaaauaggauccguggauauccauguaacagacguagacgaccuaaaugaccaugaaccaguaaaacuaacaccaguaggauuaucaggauccuccggaagcauacaccaauggcaauuaccaaauuauucaggaguagcuacacacaauaugcaucuagcaccauccgucgcaccauuauuuccaggcgaacaaauacuauuuuuccgaucaacuguaccaggaugcggaggauauccaaacacaaacaucgacugccuaauaccacaagaauggguccaacacuuuuaccaagaaggagcaccagcaagaacagauguagcauuauuacgauuuauaaauccagauacaggucgaguauuauuugaauguaaacuacauaaacauggauuuauaacaguagcauacucaggaaaucaugacuuaguaaugccaccuaauggauacuucagauuugaaucauggguaaaccaguuccauacauuagcaccaaugggaacagguagagccgaagaauaa

SEQ ID NO: 34936 - RNA, 1599 nt, Artificial Sequence
  derived and/or modified sequence opt6 from VP1__Norovirus_and/or_Norovirus-like__KC473547
auggcuucaaaagaugcuccaacaaguccagacggugccucuggagcuggacaauuaguaccugaagcaaacacagcagaacaaauaucaauggacccaguagcuggagcaaguacugcaguagccacugcaggacaaguaaacaugaucgaucccuggauauuuaauaauuuuguacaagcaccccaaggagaauuuacaauuucacccaacaauacuccaggagacauuuuauuugacuuacaacuugguccucauuuaaauccauuuuuagcacaccuaucucaaauguauaauggauggguagguaacaugcgaguacgcauucuacuagccggaaaugcauuuacagcuggcaaaauuauaauauguugugucccacccggauucgacgcaagaauuuuaacuauagcacaagccacuuuauucccacacuuaauagcugauguuagaacguuagaaccuguugaauuaccacuagaagauguaagaaacguuuuauaccauaauuccucacaaccacaaccaacaaugagauuaguugccaugcuauacacuccacuaagaacuggcggagguucuggugguacagaugcauuuguaguagcaggucgaguccuaacauguccagcuccagauuuuucauuucuuuuucuaguaccaccauccguugaacagaaaacacguguauucucaguaccaaauaucccucuaaaagaucuaucaaacucacgaguaccaguaccuauacaaggaauguuuaugucccccgauguaaaucaaucaguucaauuucaaaacggaagaugccaaaucgauggacaauuacaagguacaacuccaguaucauuaucacaauuauguaaaauaagaggaaaaacaaguucuaacgcucgaguacuaaaucuuucagaaguugauggcacaccauuuauaccauuagaaucaccagcaccaguugguuuuccagaucuagguggaugugauuggcacguaaacuuuucuuuucaaacccaagauagagauccuucacaaucaguaaccuuugcuacuaacgaugcaucauucguaccauacuuaggaucagucucuccacauaacggcgaaggauuucaagcaggcgauauaauaggcucuuuaggguggauauccgccccaucggauaauucccaauucaacguuugggcaauaccaaaauauggauccucauuacaaaugucaccuauauuauuauuauuauguucacccagauuaugggaaguaauauuauacuuuuacucaaccuuuccuggaucuggucaaccuucucaauuacaagugccaugucuauuaccacaagaauuuauaacacacuucuguaaugaacaagcaccuauugccggugaagcagcacuauuacauuauguugauccagauacaggcagaaauuuaggagaauuuaaauuauauccagacggauuuaugacaugcguaccaaacucaguaucaucugguccacaaacucuaccaauaaacggcgucuucguauuuguuucauggguaucaagauuuuaccaacuaaaaccuguugguacagcauccgcagcaagacguuuauaa

SEQ ID NO: 34937 - RNA, 1599 nt, Artificial Sequence
  derived and/or modified sequence opt6 from VP1__Norovirus_and/or_Norovirus-like__GQ266692
augaaaauggccucuucagaugcaaacccuucagacggaucaacagccaacuuagucccugaaguuaauaacgaaguaauggcauuagaacccgucguaggagcagccauagcagcacccguagccggccaacaaaacguuauagauccauggauuagaaacaacuuuguccaagcaccaggaggagaauuuacuguaucuccuagaaaugcaccaggcgaaauauuaugguccgccccacuaggaccagaucucaauccauaucuaucacacuuagcuagaauguauaacucauacgccgguggauucgagguacaaguaauauuagcaggaaaugcauucacagcaggaaaaaucauuuucgcagcaguacccccuaauuuucccacagaaggacuaucaccuucacaaguaaccauguuuccacauauuauaguagacguacgacaauuagaaccaguuuuaauaccucuaccugacgucagaaacaacuuuuaucauuacaaccaaucaaaugacccaacaauaaaacuaauagcaaugcuauacacuccccucagagccaacaaugcuggagaugauguauuuacaguuucaugucgaguuuuaacaagacccucccccgacuuugacuucauauucuuaguuccaccaacaguagaaaguagaacaaaaccuuuuucagucccaauauuaaccguagaagaaaugacaaauucaagauuucccauaccauuagaaaaacuuuucaccgguccauccuccgcauuuguaguacaaccacaaaacggaagauguacaacagacgguguacuauuaggaacuacucaacuauccccaguaaauauauguacuuuuagaggagauguaacucauauagcaggcacacaagaauacacaaugaauuuagcaucccaaaauuggaauaacuacgauccaacagaagaaauccccgccccacuaggaacaccagauuuuguaggaaaaauacaaggaguacuaacacaaacuacacgaagagauggguccacacgaggacauaaagcaacaguuucuacaggaucaguucaauuuacuccaaaacuuggacgcauacaauucucaacagauaccucaaacgauuucgaaaccggacaaaauacacgauucacaccuguaggcguaguacaagacgguagcacaacucaucaaaaugaaccacaacaauggguccuuccaaacuauucaggaagagacucucauaauguccacuuagccccugcaguugcaccauccuuuccaggagaacaacucuuauucuuuagaucaacuaugcccggauguuccggauacccaaauaugaaucuugacugccuuuuaccacaagaauggguacaacacuucuaccaagaagcagcuccagcacaaagugacguagcauuauuaagauucgucaacccagauacaggaagaguacuauucgaguguaaacuacauaaaagcgguuauguaacagucgcacacacaggucaacaugaccuaguaaucccaccaaacggauauuuccguuucgacucauggguaaaucaauuuuacacucucgcuuccauggcaacauaa

SEQ ID NO: 34938 - RNA, 1599 nt, Artificial Sequence
  derived and/or modified sequence opt6 from VP1__Norovirus_and/or_Norovirus-like__GQ266693
augaaaauggcaucuaacgacgcaaacccaucagauggcucaacagcaaaucucgucccugaaguaaauaaugaaguaauggcacuagaaccaguugucggagcagcaaucgccgcaccaguagccggacaacaaaauguaaucgauccauggauaagaaauaauuucguacaagcaccagguggagaauuuacaguaucaccacgaaaugcaccaggugaaauauuauggucugcaccucuaggacccgaccuuaacccuuaucuuagucauuuagcaagaauguauaacucuuacgcuggaggauuugaaguccaaguaauacuagcuggcaaugcauuuacagcaggaaaaaucauauuugccgcuguuccaccaaacuuccccaccgaaggauuaucucccucacaaguaacaauguuuccucacauaauagucgacgucagacaacuagaaccaguuuuaauaccacuaccugacguaagaaacaauuucuaucauuauaaccaaucgaaugacccuacuauaaaauuaaucgcaaugcuauauacaccauuaagagccaacaaugcuggugacgacguuuucacaguaucuuguagaguacuaacaagaccuuccccugacuucgauuuuauauuucuuguaccaccaacaguagaaucucgaacaaagcccuucucaguuccaauacuuacaguagaagaaaugacaaauuccagauucccuauaccacuagaaaaauuauuuacuggacccaguucaacauucguaguccaaccccaaaaugguagauguacaacugacggugucuuauuaggaaccacacaacuuucaccaguaaauauauguacuuuuagaggagauguuacacauauagcuucaacuagaguauacacuaugaaucucgcuucacaaaacuggaauaauuacgaccccacagaagaaauaccagcaccacuaggcacaccagacuuuguagguaaaauccaaggaguauuaacacaaacuacaagaggagacggaucaacacgaggacacaaagcaaccgucagcacagguucugucgaauuuacacccaaacuuggaagaauacaauucucaacagauacaucaaaugauuucgaaacaggccaaaauacacgauucacaccaguuggagucauucaagacggcaacacaacccaucaaaacgaaccucaacaaugggcacucccaaauuacaguggaucaggaucacauaacguccaccuugccccagcaguagccccuucuuuccccggagaacaacuauuauucuuuagaucuacaaugcccggaugcucaggauaccccaacaugaauuuagaaugucuacuaccucaagaauggguacaacauuuuuaucaagaagcagcacccgcacaaucugacguagcauuauuaagauuuguaaacccagauaccggacguguccuauucgaauguaaauuacacaaaucuggauacguaacugucgcacacacuggacaacacgacuuaguuauuccaccaaacggauacuucagauucgacucuuggauaaaucaauucuacacacuagcaucaauggcuacuuaa

SEQ ID NO: 34939 - RNA, 1599 nt, Artificial Sequence
  derived and/or modified sequence opt6 from VP1__Norovirus_and/or_Norovirus-like__EU004673
augagaaugucagauggagcugcaccaaaagcuaguggguccgaagcaucaggucaagaucuuguaccuacugcagucgaacaagcaguuccaauacaaccaguugcaggagcugcacuagcagcaccagccgccggacaaauaaaucaaauagauccauggauauuucaaaauuuuguccaguguccacuaggagaauuuucuauuucaccuagaaauacaccaggagaaauauuauuugaccuagcauuaggaccaggccuaaauccauacuuagcacauuuaucugcuauguacacaggaugggucggaaauauggaaguucaacucguacuagccggcaaugcauuuacagcaggaaaaguaguagucgcauuaguucccccauacuuuccaaaaggaucccuaaccacagcacaaauaacauguuuuccucauguaaugugcgauguuagaacccuagaaccaauucaauuaccuuuacuagauguacgucggguuuuauggcacgcaacacaagaucaagaagaaucaaugagauuaguuuguaugcuauauacaccucuuagaacuaauuccccaggugacgaaucuuuuguaguuucaggaagacuauuaucuaaaccagcagcugacuuuaacuuuguauacuuaacuccuccuauagaaagaaccauuuacagaaugguagauuuaccuguacuacaaccuagauuauguacacaugcacgauggccagcaccaguauaugguuuauuaguagauccaucauuaccaucaaauccacaauggcaaaauggaagaguacauauagacggaacacuauuaggaacaacuccaguaucaggaucauggguauccuguuuugcagcagaagcugcauaugaauuucaaucaggaacaggagaaguugcaacauuuacauugaucgaacaagauggcucagcauaugucccaggagacagagccgcuccauuagguuauccagacuuuaguggacaauuagaaauagaaguacaaacagaaacaacaagagcuggagauaaacuaaaaguaacuacuuuugaaaugauacuuggaccaacaacaaauguagaccaagcaccauaucaaggaagaguauacgcaucccuaacagcagcagcaucccuugaucuaguagauggacgcguaagagcuguaccucgaucaauauauagcuuucaagacguucuaccugaauauaaugauggucuauuaguuccucuugcaccaccaauaggaccuuucuuacccggcgaaguauuacuaagauuucguacauauaugagacaagucgauuccucagacgcagcagcagaagcaauagacugugcacuaccccaagaauuuguaucaugguuugcaucuaaugguuuuacuguacaaucugaagcauuauuauuacgcuaucgaaauacauuaacaggacaacuauuauuugaauguaaauuauacucagaagguuauaucgcuuuaucuuauucaggcucuggaccauuaacuuucccaaccgauggauucuuugaagucguaucauggguaccuagauuauuucaacuagcaucuguugguucauaa

SEQ ID NO: 34940 - RNA, 1599 nt, Artificial Sequence
  derived and/or modified sequence opt6 from VP1__Norovirus_and/or_Norovirus-like__AB601769
augagaaugucugauggagcagcgccaaaagcuaacggaucagaagcaucaggccaagauuuaguauuaacagcuguugaacaagcaguuccaauacaaccagucgcaggagcagcauuagcagcaccagcugcaggucaaauaaaucaaauagacccauggauauuucaaaauuucguacaauguccauuaggugaauuuucuauaaguccuagaaauacaccaggagaaauacuauuugaucuagcuuuagguccaggauuaaauccauaccuagcucaucuaucagcaauguacacaggauggguagguaauauggaaguacaauuaguauuagcagguaaugcauuuaccgcaggaaaagugguaguagcauuaguuccuccauauuuuccaaaaggaucacuaacuacugcacaaauuacauguuucccucacguaaugugugacgucaggacacuugaacccauacaauuaccuuuacuagauguaagaagaguacuauggcaugcuacucaagaucaagaagaaucaaugagauuaguaugcaugcuauauacaccacugagaacuaauagcccaggugaugaauccuuugucgucucaggucguuuacuaucaaaaccagcagccgauuuuaauuucguuuaucuaacuccaccuauagaaagaaccauauacagaauggucgauuuaccuguacuucaacccagacuuuguacacacgcuagauggccagcuccagucuauggacuucucguugauccuagucuaccuucaaauccacaauggcaaaacggccgaguacauguagauggaacauuacuaggcacuacaccaguaucaggcucauggguaucuuguuuugcagcagaagccgcuuaugaauuucaaucugguacaggcgaaguagcaacauucacucucauagaacaagauggaucagcauauguaccaggugaaagagcagcuccacuagguuauccagauuuuucaggucaguuagaaauagaaguacaaacagaaacaacuaaaagaggugaaaaacuuaaaguaaccacauucgaaaugauacuaggaccaacaacuaauguagaucaagcaccauaucaaggacgcguauaugcaaguuuaucagccgcugcaucauuagauuuaguagauggucguguaagagcaguaccacguucaauauacggauuccaagauguaauaccagaauacaaugauggacuacucguaccucuagcaccaccaauaggaccauuuuuaccaggugaagucuuauuaagauucaggaccuauaugcgucaaguggacucaucagacgcagcagcugaagcaauugauugugcuuuaccacaagaguucguaucaugguuugccucaaaugguuuuacaguacaaucugaagcauuauuauuaagauaucgaaacacacuaacuggacaauuacuauuugaauguaaauuauacucugaaggauauauagcccuuucauauuccggaucuggaccccuaaccuuuccaacugaugguuucuucgaaguuguaucauggguuccuagauuauaccaauuagcuucagucggcaguuaa

SEQ ID NO: 34941 - RNA, 1599 nt, Artificial Sequence
  derived and/or modified sequence opt6 from VP1__Norovirus_and/or_Norovirus-like__EU004676
augagaaugucagauggggcagcuccaaaagccaacggauccgaagcaaguggucaagauuuaguaccaaccgcaguagaacaagcaguacccauacaaccaguagcaggagccgcauuagcugcuccggcugcaggacaaauaaaucaaauagacccauggauuuuccaaaauuuuguacaauguccauuaggugaauuuucuauuucaccaagaaauacaccaggcgaaauacucuuugauuuagcucuaggaccuggauuaaauccauauuuagcucauuuaucagccauguauaccgguuggguaggaaacauggaaguacaauuaguacuagccggaaaugcuuuuacagcaggaaaaguaguaguugcccuaguaccaccauauuuuccaaaaggaagccuaacaacagcacaaauaacauguuucccucacguaaugugugauguaaggacuuuagaaccaauacaauuaccccuauuggauguaagacgagucuuauggcaugcaacacaagaucaagaagaaucuaugcgucucguaugcaugcuauauacaccacuuagaacaaacucaccuggugaugaaucuuuuguaguaucaggaagacuauuaucgaaaccagcaccagacuuuaauuuuguauaucuaacuccaccgauagaacgaacaauauaccgaaugguagauuuaccaguacuacaaccaagauuauguacacaugcaagauggccugcaccaguauauggacuauuaguagauccaucgcuaccaaguaauccacaauggcaaaauggacguguccaaguagaugguacacuauuaggaacaacuccaguaucaggaucauggguauccuguuucgcugcagaagcugccuacgaauuucaagcaggaacaggagaaguaguaacauuuacaaugaucgaacaagacggaagugcauauguaccuggagauagagcugcaccauuaggauauccagacuuuucaggucaacucgaaauagaaguacaaacugaaacaacaaaaacaggagauaaauuacgaguaacaacauuugaaaugauauuaggaccaacaacuaacgucgaccaagccccuuaucaagguagagcuuaugcaucacuuacagcagcagcaucacuugaccuaguagauggaagggucagagcaguaccaagaagcauauauaguuuucaagacgaacuaccagaauauaacgauggauuauuaguaccacuagcaccaccacuaggaccauuuuuacccggcgaaguauuauugcgauuuagaacauacaugagacaacuagauacagcugaugcagcagcacaaccgauagauugugcuuuaccacaagaauuuauaucaugguuugcaaguaauaauuuuacaguacaauccgaugcacuccucguacgauauagaaacacauuaacuggacaauuauuauuugaagcuaaacuauacucagaagguuacauagcuguaucauauaguggaucaggcccucuaacuuuuccaaccgauggcuuuuucgaaguaguaucauggguaccaagauuauuucaauuagcaaguguagguucauaa

SEQ ID NO: 34942 - RNA, 1599 nt, Artificial Sequence
  derived and/or modified sequence opt6 from VP1__Norovirus_and/or_Norovirus-like__JQ237823
augcgaauguccgauggcgcugcaccaaaagcaaauggaagugaagcauccggacaagauuuaguccccacugcaguagaacaagcaguaccaauacaaccaguagcaggagcugcuuuagcagcacccgcagcaggacaaauuaaccaaauagacccauggauauuucaaaauuucguacaauguccauuaggugaauuuucaauaucaccaagaaauacuccaggagaaauucuauucgauuuagcuuuagguccuggacuuaaucccuauuuagcacaucuuucagcaauguacacuggcuggguaggcaauauggaagugcaauuaguuuuagccggaaaugcauuuacagcaggaaaaguaguuguugcucuaguuccaccauacuuccccaaaggauccuuaacaacugcacagaucacaugcuuuccacacguuaugugugauguaagaacccuugaaccaauacaauuaccucuauuagauguucgaagaguauuauggcaugcaacacaagaccaagaagaaucuaugagacucguauguauguuauauacuccauuaagaaccaacuccccaggcgacgaaucauucguagucucagguagguuauuaucuaaaccagcuccagauuuuaauuucguauaucucacaccaccaauagaaagaaccauauaucgaaugguagaccuaccaguauuacaaccaagacucuguacacacgccagauggccagcaccaguauauggucuauuaguagauccaucauuaccaaguaacccacaauggcaaaacggaagaguacaaguagacggcacuuuauuaggaaccacaccaguaucaggaucuuggguaucauguuuugcagcagaagcagccuaugaauuucaagccggaaccggugaaguuguaacauucacaaugauagaacaagauggaucugcuuauguaccuggagaucgagcugccccauuaggauauccagauuuuucuggucaacuagaaauagaaguacaaacagaaacgacaaaaacuggugauaaauuaagaguuacuaccuucgaaaugauauuaggcccaacaacaaacguagaccaagcuccauaccaagguagagcuuaugcuagccucacagcagcugcaucauuagaucuaguagauggacgagucagagcagucccaagaucaauauacucuuuucaagaugaauuaccugaauauaaugauggaguauuaguaccuuuagccccuccccuaggaccuuuucugccaggagaaguauuauuaagauuuagaacuuauaugcgacaacuagauacagcugacgcagcugcucaaccuauagauugugcacuaccacaagaauuuauuucuugguuugcaaguaauaauuuuacaguucaaucugaugcacuauuaguaagauaucguaacacguuaacaggacaauugcucuuugaagcuaaacuauauucagaaggauacauagccguaucauauaguggaucaggaccauuaacauucccaacagacggauucuucgaggugguaucauggguaccaagacuauuucaauuagcaucuguagguucauaa

SEQ ID NO: 34943 - RNA, 1599 nt, Artificial Sequence
  derived and/or modified sequence opt6 from VP1__Norovirus_and/or_Norovirus-like__DQ223043
augcgcaugucagauggugccgcaccuaaagccaaugguucagaagcauccggccaagauuuaguaccaacagcaguugaacaagcuguaccuauucaaccaguugcaggagcagcccuagcugcuccugcagcuggucaaauaaaccaaauagauccauggaucuuccaaaacuucguacaaugcccucuaggugaauuuucaauaucaccacgaaauacaccaggugaaauucuuuucgauuuagcacuaggcccaggauuaaaucccuauuuagcacacuuaucugcuauguauacaggauggguaggcaauauggaaguccaacuuguauuagcaggaaacgccuuuacagcuggcaaaguagucguagcccuaguaccaccauacuuucccaaaggaagccuaacaacagcacaaauuacuuguuucccacacguuaugugcgacguaagaacucucgaaccaauccaauuaccauuacuagacguaagaagaguccuauggcaugccacacaagaucaagaagaauccaugagacuuguauguaugcuuuauacaccacuaagaacaaauagcccaggugacgaaucauuuguaguuuccggacgcuuauuaucaaagccagcaagugauuuuaauuuuguauaucucacaccaccaauagaaagaacaauauacagaaugguggaucucccggucuuacagccaagauuauguacucacgcacgauggccagcaccaguauaugguuuauuaguagacccaucacuaccauccaauccucaauggcaaaacggaagaguacacguagaugguacauuauuagguacgaccccaguuucagguucguggguaaguuguuuugcagcugaagcagcuuacgaauuucaaucaggaacaggagaaguagcuacauucacaaugauagaacaagauggauccgcauacguacccggagaucgagcagcuccauuaggcuauccagauuucucaggacaacuggaaauagaaguucaaacugaaacaacaaaaacaggagauaaauuaaaaguuacaacuuuugaaaugauacuuggaccaaccacaaauguagaucaagcaccauaucaagguagagcauaugcaucacuuacagcagcagcuucauuagauuuaguagauggaagaguaagagcaguucccagaucaguauauucauuccaagaugaauuaccagaauacaaugauggacuauuaguaccacucgccccaccucuagguccauuuuuaccaggugaaguacuccuacgauuuagaacauauaugagacaacuagauacagcagaugccucagcacaaccaauagacugugcacuaccacaagaauuuauaucuugguucgcaucaaauaauuuuacaguccaaucagaugcacuauuagugcguuauaggaacacacuaacaggacaauuauuauuugaagcaaaacuauacucagaaggauauauugcaguuucuuauucaggaucuggaccacuuacuuucccaaccgauggauucuuugaaguuguuucauggguaccaagacuauuucaacuagccucaguagguucauaa

SEQ ID NO: 34944 - RNA, 1599 nt, Artificial Sequence
  derived and/or modified sequence opt6 from VP1__Norovirus_and/or_Norovirus-like__JX048594
augagaaugucugauggagcagcaccaaaagcaaacggaucagaggcuucuggacaagaucuaguaccuacagcagucgaacaagcaguaccaauacaacccguugcuggagcugcauuagcugcaccagcagcaggccaaauaaaucaaauagauccauggauauuccagaauuuuguucaauguccauugggcgaauuuucaauaucaccucgaaauacaccaggagaaauacuauuugauuuagcccuaggaccuggauuaaacccauauuuagcucacuuaucugcaauguauaccggauggguagguaauauggaaguacagcuaguacuugcaggaaaugcauuuacagcugguaaagucguuguagcgcuaguaccaccauacuuuccaaaaggcucauuaacaacugcucaaauaacauguuuuccccacguuaugugcgacguaagagcuuuagaaccaauacaacuaccauuauuagacguuagacgaguacuauggcacgcaacucaagaccaagaagaaucaaugcgcuuaguuuguaugcuauauacuccauugagaacuaauucaccuggagacgaaucuuuuguagucucaggacgacuucuaucaaaaccagcagcagauuuuaacuuugucuaucuaaccccaccgauagaaagaacaauauauagaauggucgaucuuccugucuuacaaccccgucuauguacacaugcaagauggcccgcuccaguuuauggucuauuaguugauccaucacucccuaguaauccacaauggcaaaauggaagaguccauguugacggaacuuuacuaggaacaaccccaguuuccggaucuuggguaucaugcuuugcugcagaagcagcuuaugaauaccaaucagaaguaggagaaguagccacauuuacuuuaauagaacaagaugguucagcauacguacccggcgauagagcugcuccauuagguuaucccgauuauucaggucaacuugagauagaaguucaaacagaaacaacaaaaacuggagauaaacuuaaaguaacaaccuuugacaugauacuugguccaacuacaaacguagaucaaguaccauaccaaggcaaaguauacgcaucauuaacaacagcaucaucacucgaucucguagaugguagagcaagagccguaccacgaucaguauauaguuuucaagacgucuuaccagaauauaaugauggacuuuuaguuccuuuagccccuccacuuggaccuuauuuaccuggagaagucuuauuaagauuuagaacuuauaugagacaauuagacacagcugaugcagcagcucaaccuauugauugugcacuaccacaagaauuuauaucaugguuugcaucuaauaacuuuacuguacaaucagaugcacuuuuaauaagauaucgaaacacacuaacaggucaauuacuauucgaagccaaauuauauucagaaggguauauagccgucucauauaguggauccggaccacuuacauucccaaccgauggcuucuuugaaguuguaucauggguuccaagacuauuucaacuagccuccguaggaucauaa

SEQ ID NO: 34945 - RNA, 1596 nt, Artificial Sequence
  derived and/or modified sequence opt6 from VP1__Norovirus_and/or_Norovirus-like__GQ266691
augaaaauggcaucaucagacgcaaauccaucagauggcucuaccgccucuuuagucccagaaguaaacaaugaaguaauggccuuagaacccguaguaggagcagcaauugcagcaccugucgcaggacaacaaaauguuauagaucccuggauacgaaacaacuuuguacaagcuccaggcggagaauuuacaguaucaccacgcaaugcaccuggagaaauacuauggagugcaccucucggaccagaucucaauccauaucuaucacacuuagcacgaauguauaauggauacgcaggagguuuugaaguacaaguuauuuuagcaggcaaugcauuuacagccggaaaaauuauauucgcagcaguaccaccaaacuuuccaacagaaggcuuaucacccucucaaguaacaauguucccacacauaauaguagacguaagacaauuagaaccaguacuaauaccauuaccagacgucagaaacaauuucuaucacuauaaccaaucaaacgacccuacaauaaaacuuauagcuauguuauacacaccacuaagagcaaacaaugcaggagaugauguauuuacagucucauguagaguacucacgagaccaucuccagacuucgacuucauauuuuuaguacccccaacaguagaauccagaaccaaaccauucucaguaccuauauuaacaauagaagaaaugacuaauucacgauuuccaauaccacuagaaaaacuauuuacaggaccaucuucagcauucguaguacaaccacaaaacggaagauguacaaucgaugguguucuauuaggaacuacacaacuaucacccgucaacaucuguacauuucgaggagacguaacacauauugaaggaucaaaaguauacacaaugaauuuagcaucacaaaacuggaauaauuaugauccaacagaagaaauaccugcaccacuagggacuccagacuuuaaaggacgaauccaaggaguauuaacacaaacaacacgaucagacggaucaacacgcggacacacagccacaguaaguacuggaucagcugaauuuacaccuaaacuaggucgaauacaauucucaacagauacaaauaacgauuucgaaacaggacaaaacacuaaauucacuccaguuggaguaguccaaaacggaucaacaacccaucaaaaugaaccacaacaaugggaacuuccagacuacaguggaagaggaauacauaacguacacuuagcucccgcaguagcaccaaccuauccuggugaacaaauacuauucuuucguucuacaaugcccgguuguucaggauacccuaacaugaaccucgauugcuuacuuccacaagacuggguaagacacuucuaccaagaagcagcucccgcacaaucagauguagcacuucuaagauuuguaaauccagacacaggaagaguuuuauuugaauguaaauuacauaaauccggauacguaacaguagcacauacgggucagcacgaucuaguaauaccuccaaauggcuauuuccgcuucgauuccugggucaaucaauuuuacacuuuagcccccaugggcuag

SEQ ID NO: 34946 - RNA, 1596 nt, Artificial Sequence
  derived and/or modified sequence opt6 from VP1__Norovirus_and/or_Norovirus-like__GQ266690
augaaaauggcaucaucagacgcaaauccaagugacgguucaacagcaaacuuaguuccagaaguuaacaaugaaguaauggcauuagaaccaguagucggagcagcuauagcugcaccaguagccggacaacaaaacguaaucgauccauggauaagaaacaacuucguacaagccccaggaggagaauuuacaguaucccccagaaaugccccuggagaaauccuauggucagcaccacuaggaccugaucucaauccauaucuaucacaucuugccagaauguauaacucauaugcaggaggcuuugaaguucaagucauacuagccggaaacgcauuuacagcaggcaaaauaauauuugcagcaguuccaccaaacuuuccaacagaaggacuaucucccucacaaguuacaauguucccacacaucauaguugauguacgccaacuagaaccaguacucauaccauuaccagauguacgcaacaauuucuaccacuauaaccaaucaaacgaucccacaauaaaacuaaucgcaauguuauauacaccccucagagcaaacaacgcuggugaugauguauuuaccguaagcuguagaguccuaacaagaccaucaccugacuuugacuuuauauucuuaguacccccaacuguugaauccagaacaaaaccuuuuucaguuccaauauuaacaguugaagaaaugacaaauucccgcuuuccaauaccauuagaaaaacucuuuacagguccaucauccgcauuuguuguacaaccccaaaacgguagaugcaccacugacggaguacuauuagguacaacacaacuaucuccuguaaauaucugcacauuuagaggagauguuacacacauagcaggaacucaagaauacacaaugaaucuagcaucacaaaacuggaauaacuacgauccaaccgaagaaauaccagcuccuuuaggaacacccgauuucguuggccgaauacagggaguauuaacacaaacaacuagaagagauggaucuacaagaggacacaaagcaacuguaaguacagguucuguacauuuuacaccaaaauuaggacguauacaauuuucaacugauacuucaaacgauuucgaaacaggacaaaauacaagauuuacaccaguuggaguaguacaagauggaggaacuacacaucaaaaugaaccccaacaauggguauuaccaaacuacucaggaagagauggacauaacguucauuuagcuccagccguagccccaucguuccccggagaacaaaucuuauuuuucagaucuacaaugccaggaugcucaggauauccaaauaugaaucuagacugcuuauuaccacaagaauggguacaacauuucuaucaagaagcagcaccagcucaaucugacgucgcccuacuaagauucguaaacccugauacaggcagaguacucuucgaauguaaauuacauaaaucaggauacguaacaguagcucauaccggacaacacgacuuaguaauaccuccaaauggauauuuuagauuugauaguuggguaaaucaauuuuacaccuuagcaccaaugggauaa

SEQ ID NO: 34947 - RNA, 1596 nt, Artificial Sequence
  derived and/or modified sequence opt6 from VP1__Norovirus_and/or_Norovirus-like__JN183164
augaugauggccucuaaagacgccccaacaaauauggauggaaccucaggagcuggccaacuaguaccagaaguaucaacagcagaacccauaucuauggaaccagucgcaggagcugcaacugcagcagcuacugccggacaagucaauaugauagauccauggaucaugucaaauuauguacaagcaccccaaggugaauucacaauaagcccaaauaauacuccaggugacauuuuauuugacuuacaacuuggcccacaucuaaaucccuuccucucacaucucgcacaaauguauaacggcuggguaggaaauaugaaaguuagaguucuacuugcagguaaugcauuuacagcuggaaaaauuauaauaucaugcguaccaccaggauuugcagcucaaaacguaucuauugcacaagcaacaauguucccacaugucauugcagacguaagaguauuagaaccaauagaagucccauuagaagauguaagaaauguauuauuucauaacaacgacucaacaccaacaaugagacucaucugcauguuauauacuccauuaagagcuucagguucaagcucuggaacugauccuuuuguaauagcaggaagaguacuuacuuguccaucaccagacuuuaauuuucuauuuuuagucccacccaaugucgaacaaaaaacaaaaccauucucuguaccaaauuuaccauuaaacguacuaucaaauucaagaguaccaaguuuaaucaaaucaaugaugguuucucaagaucauggucaaaugguccaauuucaaaacggacgaguaaccuuagauggacaacuucaagguacaacaccaacuucugcuucacaauuaugcaaaauacgagggacaguguaucaugcaacaggaggucaaggccucaauuuaacagaaauagacggcacaccuuaccaugcauucgaaucuccagcaccaauaggauucccagacuuaggagaaugcgacuggcacauuaacgcaucaccagcuaacgcauuuacagauggaaguauaauacacagaaucgauguagcacaagauucaacauuugcuccacauuuaggaacaauucauuauaccaaugccgacuauaacgcuaauguaggucuaauaugcucauuagaaugguuaucuccuccaucuggaggagcaccuaaaguaaaccccugggcaauuccaagauacggaucaacauuaacagaagcagcacaauuagcacccccuauuuauccaccuggauucggagaagcaauaguauucuuuaugucagauuuuccaauugccaaugguucagauggccuaaguguaccauguacaauaccacaagaauuugugacucauuuugucaacgaacaagcacccacaagaggagaagcagcuuuauuacacuacguagauccagauacacacagaaauuuaggagaauuuaaauuauauccugaagguuucaugacuuguguaccaaauucuucaggaagugguccacaaacauuaccaauaaauggaguuuuuacuuucauaucuuggguauccagauucuaucaacucaaaccaguaggaacuuaa

SEQ ID NO: 34948 - RNA, 1596 nt, Artificial Sequence
  derived and/or modified sequence opt6 from VP1__Norovirus_and/or_Norovirus-like__AB809995
augaaaauggcaagcaacgacgcugcaccaagcaacgauggcgcagcaucuuuaguuccagaagcaauaaacgaaacaaugccacuugaaccaguagcaggagcauccauugcagcaccaguagcaggacaaacaaacaucauagauccuuggauacgaaccaacuucguccaagcaccaaacggugaauuuacuguaucaccacgaaacuccccaggagaaauacuacucaaucuagaauuaggcccagaccuaaauccauaccuagcacacuuaucaagaauguauaacgguuacgccgguggaguugaaguacaaguacuccuagcaggaaacgcauucacagcagguaaaauauuauucgcagcaauaccaccaaauuuuccaguagacaugauaucaccagcccaaaucacaaugcuaccacacuuaauaguagacguaagaaccuuagaaccaauaaugaucccuuuaccugacguaagaaacguauucuaucauuuuaauaaucaaccucaaccacgaaugagauuaguugcaauguuauauacaccauuacgaucaaaugguucaggcgaugacgucuuuacuguaucaugccgcguauuaacaagacccacaccugauuuugaauuuaucuaccuaguaccuccaucuguagaauccaaaacuaaaccauucacccuacccauauuaacuauaucagaauuaacuaacucaagauucccuaucccaauagaacaacuauauacagccccuaacgaaaauaauguaguccaaugccaaaacgguagaugcaccuuagacggagaacuacaaggcaccacacaauuacucuccagcgcaguaugcuccuaccgcggcagaaccguagcaaacucaggagacaacugggaccaaaaucuacuacaauuaacauacccauccggcgccagcuaugaccccaccgaugaaguaccagcuccauuaggcacacaagacuucagcgggauauuauacggaguucuaacacaagacaaugucucagaagguacaggugaagcuaaaaacgcaaaaggaguuuauauaucaaccacaucuggcaaauucacuccaaaaauaggauccauaggacuacacucaauaacugaaaauguacauccaaaucaacaaucaagauucacaccaguaggaguugcacaaaacgaaaacacaccauuucagcaauggguacuaccccauuacgcaggagcauuagcauuaaauacaaaucuugcucccgccguagcccccacauuuccaggagaacaacuacuauucuucagaucaagaguaccaugcguucaaggacuacgaggucaagacgcauucauagacugccuauuaccacaagaaugggucaaccauuuuuaccaagaagcagcaccaucacaagcagacguagcccuaauacgauacguaaauccagacacuggaagaacuuuauucgaagcaaaauuacaucgaaguggauucauaaccguaucucacacaggagcauacccacucguuguuccacccaacggccacuucagauuugacucauggguaaaccaauuuuauucccuagcuccuuaa

SEQ ID NO: 34949 - RNA, 1593 nt, Artificial Sequence
  derived and/or modified sequence opt6 from VP1__Norovirus_and/or_Norovirus-like__KT732275
augaaaauggcaucaaacgacgcugcaccaucaaaugauggagcugccggccuaguaccugaaggaaacaacgaaacacucccacuagaaccaguugcaggagcagcaaucgcagcaccagucacuggacaaaacaauauaauagauccauggauaagaacaaauuuuguucaagcaccaaauggagaauuuaccgucucaccacgaaauuccccuggagaaauacuacuaaaucuagaacucggaccagacuuaaauccuuaucuagcacaucuuucaagaauguauaacgguuacgcagggggaguagaaguacaaguacuauuagcaggaaaugcauucacagcaggcaaaauuuuauuugcagccguuccaccaaacuuuccuguagaauuuuuaucuccagcacaaauaacaaugcuaccucacuuaaucguugauguuagaaccuuagaaccaauaaugauaccccuacccgacguaagaaacacauuuuuccacuacucaaaucaaccuaacucucgaaugagacucguugcaauguuguacacuccacuacgaucaaauggaucuggagacgauguauucacagucucaugucguguacucacucgcccuacuccagacuuugaauuuacauaucuuguacccccaucaguugaaucaaaaacaaaaccauuuucucuacccauauuaaccuuaucugaauuaaccaacucacguuuuccaguaccuauagacucacuuuuuacagcacaaaauaauguauuacaaguccaaugccaaaauggucgcuguacucuugauggagaauuacaagguacaacacaacuacucccaucaggaauaugugcauucagaggaagaguaacagcucaaauuaaucaaagagaucgcuggcauaugcaacuccaaaaucuaaauggaacaacauacgacccaaccgaugauguaccagcuccccuuggcacaccagauuucaaaggcguaguuuucggcaugguaucacaaagaaacguuggaaacgacgcaccaggauccacaagagcacaacaagccuggguaucuacauauucaccucaauuuguaccaaaauuaggaucaguaaaucuacgaauaucugacaaugaugauuuccaauuucaacccaccaaauucacaccaguaggaguaaaugacgaugaugauggccauccauuuagacaaugggaacucccaaacuauuccggagaacuuacuuuaaacaugaaucuagcaccucccguagccccaaauuuucccggugaacaacuauuauucuuuagauccuucguuccuuguucaggaggcuauaaccaaggaauaauagauuguuuaauaccacaagaauggauacaacauuucuaccaagaauccgcaccaucacaauccgacguugcuuuaauaagauauguaaauccagauacaggaagaacuuuauuugaagcaaaacuacauagaaguggauacauaacuguagcucauucaggcgauuauccuuuaguaguaccugcaaauggacauuuuagauucgauucauggguaaaucaauuuuauucacuagcucccauguaa

SEQ ID NO: 34950 - RNA, 1593 nt, Artificial Sequence
  derived and/or modified sequence opt6 from VP1__Norovirus_and/or_Norovirus-like__AB809998
augaaaauggcauccaaugaugcugcacccucuaaugacggugcagcuucucuaguuccagaagcuauaaacgaaacaaugccccuagaacccguagcaggagcaucaaucgcagcaccaguugcaggacaaacaaacauaauagauccauggauaagaacaaauuucguacaagcaccuaacggagaauuuacaguaucucccagaaauucaccuggagaaauauuacuaaauuuagaacuaggaccagauuuaaauccauaucuagcacaccuuucaagaauguauaauggcuaugccggcggagucgaaguacaaguacuauuagccggcaaugcauuuacugcaggaaaaauauuauuugcugcaauaccaccaaacuucccaguggacaugauaucaccagcccaaauaacaaugcuaccgcaucuaaucguagacguaagaacacuagaaccaauuaugauaccacuacccgacguaagaaacguuuucuaccacuucaacaaccaaccacaaccaagaaugagacuuguagcaaugcuauauacaccacucagaucaaacgguucaggugacgacguauucacaguaucaugcagaguauuaacacgaccaacaccagauuucgaauuuauuuaccuaguaccaccauccgucgaaucaaaaaccaaaccauucacacuaccuauauuaaccauuucugaacuaacaaacagccgauuccccaucccuauagaacaacuauauacagcaccaaaugaaaacaacguaguucaaugccaaaauggaagauguacauuagacggagaacuacaaggaaccacucaacuauuaucuucggcagucuguucauauagaggaagaacuguugcaaacucaggugauaauugggaucaaaaccuauuacaacuaacuuacccauccggugcaucauaugacccaacagaugaagucccagcaccuuuaggcacgcaagacuucaguggaauauuauacggaguauuaacccaagacaauguaagugaagccacaggagaagcuaaaaacgcaaaaggaguauauauaucaaccacuucuggaaaauuuacuccaaaaauaggcuccaucggacuccacucaauaacagaaaauguacacccaaaucaacaaucaagauucacacccguaggaguagcacagaaugaaaauaccccauuucaacaauggguacuuccacacuacgcaggagcucuagcacuuaauacuaauuuagcaccagcaguagccccaaccuuuccaggagaacaauuacuauucuucagaucaagaguccccugcguccaaggauuacgaggaagagaugcauuuauagacuguuuauuaccccaagaauggguaaaccauuucuaucaagaagcagcaccaucccaagcagacguagcacucauacguuauguuaauccugacacaggaagaacacuuuuugaagcuaaauuacauagaucagguuuuauaacagucucucacacuggcgccuacccauuaguuguaccaccaaacggacauuuuagauuugauucauggguaaaucaauuuuacucacuagccuga

SEQ ID NO: 34951 - RNA, 1593 nt, Artificial Sequence
  derived and/or modified sequence opt6 from VP1__Norovirus_and/or_Norovirus-like__AB809984
augaaaauggcaucaaacgacgcagcuccaucaaacgacggagcagcaucacucguaccugaagcuauaaacgaaacaaugccacuagaacccguagcaggagcaucaaucgcagcaccuguagcaggucaaacaaacauaauagaccccuggauacgaacaaacuuuguacaagcaccaaacggcgaauuuacagucucaccucgaaacucacccggcgaaaucuuauuaaauuuagaacuaggacccgauuuaaaucccuaucuagcccauuuaucaagaauguacaauggauaugccggaggaguagaaguacaaguccuacuugcgggaaacgcuuucaccgcaggaaaaauacuauucgcagcaauaccaccaaauuuccccgucgacaugauaucuccagcccaaauuacaaugcucccacaccucaucguagacgucagaacucuagaaccaauaaugauaccacuaccagaugucagaaacguauucuaucacuuuaacaaccaaccucaacccagaaugagacuuguagcuaugcuauacacucccuuaagaucaaacggaucaggugacgacguauuuacaguaucauguagaguauuaacacgaccuacuccagauuuugaauuuauauaucuaguaccacccuccguugaaucaaaaacaaaacccuuuacacuaccuauacuaacaauaucagaacuaacaaacucaagauuucccauacccauagaacaacuauacacagcgccaaaugaaaacaauguaguccaaugucaaaacggaagauguacucuagacggagaacuacaaggaacaacucaacuuuuaucuuccgcaguaugcucauaccgaggaagaacaguugccaacucaggagacaacugggaccaaaacuuacuucaauuaaccuauccaucaggagccucauacgaccccacugacgaaguaccagcaccacuaggcacacaggacuucucaggaauacuauacgguguauuaacccaagacaauguaucagaaggaacaggugaagccaaaaaugcuaaaggcguuuacauuuccacaacaucaggcaaauuuacaccaaaaauaggaucaauuggcuuacacucaaucaccgaaaauguucacccaaaucaacaaucaagauuuacaccaguaggaguagcacaaaaugaaaacacaccauuccaacaauggguucuaccacauuacgcuggagccuuagcccuaaauaccaaccuagcaccggcaguugcuccaaccuuuccuggagaacaacuacucuuuuucagaucacguguaccaugcguacaagguuuaagaggacaagaugcauuuauagacugucuacuuccacaagaauggguaaaccacuuuuaccaagaagcagcaccuagucaagcagacgucgcccuaauaagauauguaaacccagacacaggucgcacauuauucgaagccaaacuacacagaucuggauuuauaacuguaucccauaccggagcauauccccuaguagucccaccaaacggccauuucagauucgauucuuggguaaaccaauucuauucccuagcauaa

SEQ ID NO: 34952 - RNA, 1590 nt, Artificial Sequence
  derived and/or modified sequence opt6 from VP1__Norovirus_and/or_Norovirus-like__KT732276
augaaaauggcaucaaaugaugcagcccccucaaacgacggugcagcaggccuagugccggaagguaacaaugaaacacuaccauuagaaccaguagcuggugcagcaauagcagcaccuguaaccggacaaaacaauauaauugacccuuggaucagaacaaacuuuguacaagcaccaaacggagaauuuacaguauccccuagaaacaguccaggugaaauauuacuaaaucuugaacuaggaccagaucucaacccauaucuagcacaucuaucaagaauguauaauggauacgcaggaggaguugaaguacaaguacuguuagcaggaaacgcauucacagcaggaaaaauauuauuugcagccgucccaccuaauuuuccgguagaauuucuaucaccagcacaaauuacaauguuaccucaccuaaucguagacguaagaacccuagaaccaauaaugauaccgcuuccugauguccgaaauacauucuuucauuauuccaaucaaccaaacuccagaaugagauuaguagccaugcuauauacuccacuaagaucaaacggaucaggugaugauguauucaccgucaguugcagaguucuaacacgacccacaccugacuucgaauuuacauacuuaguuccuccaucuguagaauccaaaacaaaaccuuuuucacuuccaauacuuacauuaucagaauuaacuaauuccagauucccaguuccaauagauucacucuuuacagcacaaaacaauguauuacaaguccaaugccaaaacggaagauguacacuagacggagaacuacaaggaacaacucaauuacuaccuucaggcauaugugcauuuagaggcagaguaacugcacaaauaaaccaaagagaucgauggcacaugcaauuacaaaauuuaaacggaacaacauaugaccccacagaugacgucccagcaccccuuggaacaccagacuuuaaaggaguuguauucggcaugguuucacaaagaaacguaggaaaugacgcaccaggcagcacacgagcccaacaagcauggguaucuaccuauucaccacaauuuguuccaaaauuaggaaguguuaaccugaggauaucugacaaugacgauuuccaauuucaaccaacaaaauuuacaccuguagguguaaaugacgaugacgacggccauccauuuagacaaugggaacuaccaaacuacucuggcgaauuaacauuaaauaugaaccuagcacccccaguugccccaaacuucccuggagaacaacuucuauucuuucguucuuuuguaccauguucaggaggauauaaccaaggaaucauagauugucucauaccacaagaauggauacaacacuucuaucaagaaucagcaccaucacaaucugacguagcauuaauccguuacguaaaucccgauacuggacgaacauuauuugaagcaaaacuacacagaucuggcuacauaacuguagcccauucaggugacuacccucuaguaguuccagccaauggccauuuccguuucgacuccuggguaaaucaauuuuauucuuuagcacccuaa

SEQ ID NO: 34953 - RNA, 1590 nt, Artificial Sequence
  derived and/or modified sequence opt6 from VP1__Norovirus_and/or_Norovirus-like__AB810009
augaaaauggcaagcaaugaugccgcaccaucuaaugacggagccgcaucucuagucccagaagcaauaaacgaaacaaugccacuugaaccaguugcaggagcuagcauagccgcuccaguugcaggacaaacuaauauaauagacccauggauucgaacaaacuucguacaagcaccaaauggagaauuuacagugucaccaagaaauucaccaggcgaaauacuucuaaaccuagaacuagguccugaccuaaauccauauuuagcacauuugucaagaauguauaauggcuaugcuggugguguugaaguacaaguucuauuagcaggaaacgcauucacagcaggaaaaauucuauucgcagcaaucccuccuaauuuuccaguugacaugauaucaccagcccagauaacaauguuaccacauuuaauaguagauguaagaacauuagaaccaauaaugauuccucuaccagauguacgaaacgucuuuuaucauuuuaauaaucaaccacaaccaagaaugagacuuguagccaugcuauacacaccacuaagaucaaacggcucaggagaugacguauucaccguuucuuguagaguacuuacaagacccacaccagacuucgaauuuauauaccuaguacccccuagcguagaaucaaaaacaaaaccauucacauuaccaauauuaaccauaagcgaauuaacaaacucaagauucccuauacccauagaacaauuauauacagcuccaaacgaaaacaacguaguucaaugucaaaacggacguugcaccuuagauggugaacuacaaggcacaacacaauuacucucaucagcaguaugcucauaccgcggucgcacaguagcaaaccgaggagacaacugggaucaaaaccuccuacaacuaacauacccaucuggagcauccuacgauccuacagaugaaguuccagcaccacuaggaacucaagauuuuucagggauacucuauggcguauuaacacaagauaacguaucagaaggaacaggagaagcuaaaaacgcaaaaggaguauauauaaguacaacaucaggaaaauucacucccaaaauaggcucaaucggucuucacagcauuacagaaaauguucacccaaaccaacaauccagauuuacaccaguaggaguagcacaaaaugaaaauacaccauuccaacaauggguucuaccacacuacgcaggcgcauuagcauuaaauaccaaucuagcaccagcuguagcacccaccuuuccaggagaacaauuacuauucuuucguagccgaguaccuuguguacaaggccucagaggccaagacgcauuuauugacugccuacuuccacaagaauggguaaaucacuuuuaccaagaagcagcaccaucacaagcagauguagcauuaauaagauauguaaauccugacacaggucgaacucuauucgaagccaaacuacacagaucaggauuuauuacaguaucacacacaggagcauauccccuaguaguaccaccaaacggccauuucagauucgacucaugggucaaucaauuuuauuccuuauaa

SEQ ID NO: 34954 - RNA, 1590 nt, Artificial Sequence
  derived and/or modified sequence opt6 from VP1__Norovirus_and/or_Norovirus-like__KM461690
augaaaauggcaucauccgaugcagcuccauccaaugauggagcagcaaaucuaguuccagaagccaacaacgaaguaauggcuuuagaacccguaguuggagcaucuauagcagcaccaguuguaggacaacaaaacauaauagaucccuggauacgagaaaacuuuguucaagcuccccaaggagaauuuacaguuucuccacgaaauucuccaggagaaauguuauuaaauuuagaacuagguccagaacuuaauccauacuuaucacacuuaucacgaauguacaacgguuacgcaggaggaaugcaaguucaaguaguacuagcaggaaacgcauuuacugcagguaaaauaauauuugcagcaguaccaccccauuuccccguagaaaacaucucagcggcucaaauuacaaugugcccacauguaauaguggauguuagacaauuagaaccaguauuacuaccauuaccagauauaagaaaucgauucuuccauuauaaucaggaaaacaccccuagaaugcgauuaguagcaaugcuuuauacaccucuuagagcaaauucaggagaggacguauuuacaguaucauguagaguauuaacuagacccgcaccagauuuugaauuuacuuuccuaguuccuccaacaguugaaucaaaaacaaaaccauuuacauuaccuauauuaacauuaggugaacuaucuaauaguagauucccagcaccaauagauaugcuauauacagacccaaaugaaggcauuguuguacaaccacaaaauggcagauguacauuagacgguacacuucaaggaacgacucagcuaguaccaacacaaauaugugcauucagaggaacccuuauaggacagacaucuagaucaucagacucaaccgauucugcuccaagaagaagagaucacccauuacauguacaacuuaaaaaucuagauggcacacaauacgacccaacagaugaaguaccagcuguacuaggagcaauagacuuuaaaggaacaguuuuuggugucgcaucacaaagagaugucucgggacaacaagucggagcaacaagagcacaugaaguacauaucaauacaacagauccacgauacacaccaaaacuaggaucuauacuaaugcacucagaaucagaugacuuuguaacuggacaaccaguaagauuuacaccaauaggaaugggagacaacgauuggcaucaaugggaacuaccagauuauucaggucgauuaacacuaaauaugaauuuagccccugcaguugcuccugccuuuccuggagaacgaauacuuuucuuuagaagcauaguuccaucagcaggaggauauggaucaggacaaauagacugccuaauaccacaagaauggguacaacauuuuuaccaagaagcagcaccaagccaaucagcaguagcucuaauaagauacguuaauccugauacaggaagaaauauauucgaagcuaaauuacauagagaagguuuuauaacaguugcaaauucaggaaauaaucccauaguaguacccccaaauggauauuuuagauuugaagcauggguaaauuaa

SEQ ID NO: 34955 - RNA, 1587 nt, Artificial Sequence
  derived and/or modified sequence opt6 from VP1__Norovirus_and/or_Norovirus-like__JN400618
augaaaauggcaucaucagacgcaaacccauccgauggaucaacagcaaauuuaguuccagaaguaaacaaugaaguaauggcacucgaaccaguaguaggagcagcuaucgcugcaccuguagcaggacaacaaaacguaauagacccauggauaagaaauaauuucguacaagcccccggaggugaauuuaccguaucaccaagaaacgcaccaggagaaauauuauggucagccccuuuaggucccgaucucaauccuuaucuaucacauuuagcacgaauguacaacggauaugcaggcggauucgaaguccaaguaauuuuagccggcaacgcauuuacagcaggaaaaauaauauucgcagcaguaccaccaaacuucccaacagaaggacuaagcccaucacaaguaacaauguucccacacauaauaguugauguaagacaauuagaaccuguacucaucccacuuccagacguacgaaacaauuuuuaucacuauaaccaaagcaaugauucaacuauuaaauuaauagcaaugcuauacacaccauuacgagcaaacaaugcaggagacgauguuuuuacaguuuccuguagaguacuaacaagaccaucaccaagauuugaaucaagaacaaaaccauucucaguaccuguacuaacagucgaagaaaugacuaacucaagauuucccauuccacucgaaaaacuauucacagguccaagcucagcauucguaguacaaccacaaaacggcagauguaccacugacggaguacuauuaggaacaacacaauuaucaccaguuaacauauguacauuucgaggcgauguuacucauauucccggaucaagaaacuacacaaugaauuuagcaucacaaaacuggaacucuuacggcccaacugaagaaauaccugcaccacucggcacaccagacuuuguaggcaaaauucaaggaguauuaacccaaacaacaagaacuaacggauccacacguggucacaaagcaacaguauacacaggaucagcagacuuuucacccaaauuaggcaggguucaauucgcuacagauaccgauaacgauuucgaaaccaaucaaaacacaaaauucaccccagucggaguuauacaagacgguucaacaacaccaaggaaugaaccucaacaauggguucuaccaucauauagcggacgaaacauacauaacguucauuuagccccugcaguagcacccaccuuuccaggagaacaacuauuauucuuuagaaguaccaugccagguugcagcggcuaucccaauauggaucuagauugucuucuaccucaagaauggguacaauacuucuaucaagaagcagcccccgcccaaucugauguugccuuauuaagauuuguuaacccagacacaggaagaguacuauucgaaugcaaauuacauaaauccggauauguaacaguagcucauacaggacaacacgaucuuguuauacccccaaaugguuauuuuagauuugauucaugggucaaucaauuuuacacacuagcuccaauggguaauggaacaggacgaagaagauaa

SEQ ID NO: 34956 - RNA, 1587 nt, Artificial Sequence
  derived and/or modified sequence opt6 from VP1__Norovirus_and/or_Norovirus-like__JQ653095
augaaaauggccucaaacgacgccgcaccaucaaaugauggagcugcaggccuaguaccugaagucaauaacgaaacuauggcauuagaaccaguagcaggagcaaguauagcagcuccacucacaggacaaaauaacguuauagauccauggauuagauuaaacuuuguacaagcccacaauggagaauuuacuguuucaccaagaaauucaccaggagaaguccuucuuaacuuagaauuaggaccagaacuuaacccuuaccuagcccauuuaucaagaauguauaauggauacgcaggaggaguugaaguacaaguacucuuagccggaaacgcauuuacagcaggaaaauuaguauuugcagcaguaccaccacauuuuccucuggaaaacauaucaccaggacaaauuaccauguuuccucauguaauaauagacguccgaacauuagaaccaguucuauuaccacuuccagacguucgaaauaacuuuuuccacuacaaccaacaaaacgaaccccgaaugcgauuagucgcaaugcuauauacaccccuaagaagcaacggcucaggagaugacguauucaccguaucuuguagaguuccaaccagaccaucaccugauuucgauuuuaauuaccuaguacccccaaccgucgaaucaaaaacaaaacccuucacacuccccauuuuaacuauaggagaauuaacaaauucaagauucccaguaccaauagaugaacuauauacaucuccaaacgaauccuuaguaguacaaccacaaaauggacgaugugcauuagacggagaacuacaaggaacuacacaacuacuacccacugccauaugcagcuuucgcggaagaauaaaucaaaaaguaucaggagaaaaucauguauggaauaugcaaguuacaaauauuaauggaacacccuucgacccuacagaagacguaccugcuccauuaggaacaccagauuuuucaggaaaauuauucggcguccuaucccaaagagaccaugauaaugcaugcagaucacacgacgccgugauagcaacaaauucagcaaaauuuacaccaaaauuaggagcaauacaaaucggaacuugggaacaagacgacguccacauaaaccaaccaaccaaauuuacuccuguagguuuauuugaauccgaaggauuuaaucaauggacuuuaccaaacuacucaggagcacucacaccuaacaugggacuagcaccaccaguagcaccaacauucccaggugaacaaauucuuuucuuuagaucccacauuccucuuaaaggaggaguagcagauccaguaauagauugccuugucccccaagaauggauacaacauuuauaucaagaauccgcaccaucccaaacagauguagcauuaauaagauuuacaaaucccgauacaggacgaguccucuucgaagcaaaacuacauagaucaggauauauuacaguagcuaacacagguucccguccuauagucguaccagcaaauggauacuucagauucgauucuuggguaaaucaauuuuauucauuagcacccgucggaacaggauaa

SEQ ID NO: 34957 - RNA, 1587 nt, Artificial Sequence
  derived and/or modified sequence opt6 from VP1__Norovirus_and/or_Norovirus-like__JN183161
augaugauggcaaguaaagaugcucccucaaauauggacggaacaucuggagcagggcaacucguaccugaaguaaaugcugcagaaccacuuccccuagaaccaguaguaggagcugcaaccgcagcagcaacagcuggacaaguuaaucucauagauccauggauaaugaauaacuucguacaagcuccugaaggagaauuuacuauuucacccaauaauacaccaggagacauacuauucgaucuucaccuuggaccacaucuaaacccauuuuuacaacaucuaucccaaauguauaauggcuggguuggaaacaugagaguucguguaauguuagcaggaaaugcuuuuacagcaggaaaaauuauuauaugcugcguaccaccagguuuugcuucucaaaacauuuccauaggacaagcaaccauguucccacauguuauagcagauguacgaguucuagaaccaauagaaauaccuuuagaugacgucagaaauguauuguuucacacaaaugaaaauagaccaacuaugcgccuucuaugcauguuguacaccccuuuaagagcaggaggugcaucaagugguaccgacccauuuguaaucgcaggaagaguauuaacuugccccgcaccagauuucaacuuucuuuucuuaguaccacccucaguagaacagaaaacuagacaacuaacaguacccaauauaccucuaaauaauauggcaaauuccagaguaccagcaaugauaaacaaaaugacaguaucaucagaucaaaaucaaguaguacaauuucaaaacgguagauguacauuagaaggucaauuacuagguacaaccccaguuuccgcaucacaaguugccagaauacgcggaaaaguauuuucaacagcaucaggaaaaggcuuaaaucuaacugaauuagacgguacaccauaucaugcauuugaaucacccgcaccacuaggauuuccagauauaggagcuugugauuggcauguuuccacauuuaaaguagaucaaaaucuaagcggugauccaaugucaagauuagauauuaaacaaaaugcaccauuugcuccacaccucggaucuauugaauuuacaucagaccaagacccaacaggugaucaauuaggaacauuagccuggguaucacccucuacaucaggaacaagaguugauccauggaaaauaccaaguuacggaucaacagucacagaaucaacacaccucgcacccccaauauuucccccaggauuuggagaagccauaguauacuucaugucugauuucccaauaguaucuggaaacacagcacaagucccauguacucuuccacaagaauuuguaucucauuuugucgaacaacaagcaccaauacgaggagaagcagcacuacuacauuaugucgauccagauacacaucgcaauuuaggagaauuuaaacuauaucccgacggauuuauaacauguguaccaaauacaggcgguggaccccaaaaccuacccacuaauggcguauuuguauuuucuucauggguauccagauauuaccaauuaaaaccaguaggaacagcauaa

SEQ ID NO: 34958 - RNA, 1587 nt, Artificial Sequence
  derived and/or modified sequence opt6 from VP1__Norovirus_and/or_Norovirus-like__KT906670
augaaaauggcuuccaacgacgcugcacccuccaacgacggagcagccggcuuaguaccagaaggaaacaaugaaacacuaccauuagaaccagucgcaggagccgcaauugcagcaccaguaacuggacaaaacaauauaauagauccauggauaagaacaaauuuuguucaagccccaaauggugaauuuaccguaucaccuagaaauucgccuggagaaauauuacuaaaccuugaauuagggccagaucuuaauccauaucuagcacaccucucacgaauguacaacggauacgccgguggaguagaaguccaaguauuacucgcaggaaaugccuuuacagcuggaaagauuuuauuugcagcaguaccaccaaauuucccaguagaauuuuuaucuccagcacaaauaaccaugcucccacaccuuauaguugauguaagaacauuagaaccaauaaugauaccauuaccugauguaagaaacacuuucuuccauuacucaaaucaacccaacucacgaaugcgcuuaguagcaaugcuauauaccccacuacgcuccaacggaucaggagacgauguauuuaccguaucaugcagaguauuaacaagaccaacaccugauuuugaauuuacauaccuaguaccaccauccguagaaucaaaaacaaaaccauucucacuucccaucuuaacacucucagaauuaacaaauucacgcuuuccagucccaauagacucacuauuuacagcccaaaacaauguacuacaaguacaaugucaaaauggaagaugcacuuuagauggagaauuacaaggaacaacacaauuacuaccauccggaauaugugcauuucgaggaagaguaacagcacaaauaaaccaaagagacagauggcacaugcaauuacaaaaucuaaauggaacaacuuacgauccaacagaugacguuccugcaccauuaggaacacccgauuucaaaggagucguauuuggaaugguaucucaacgaaacguagguaaugacgcuccagguucuacucgugcacaacaagcaugggucucaacuuauucuccucaauuuguaccaaaauuaggaucaguaaaucuacguauaucagauaaugaugauuuccaauuccaacccacaaaauuuacaccaguaggaguaaaugacgacgaugauggucacccauuuagacaaugggaacuaccuaacuauuccggcgaacuaaccuuaaacaugaaucucgcaccaccaguagcaccaaacuucccaggagaacaacuauuauucuuucguucauuuguuccuuguucugguggauauaaccaaggaauaauagauugucuaauuccacaagaauggauacaacauuucuaccaagaaucagcuccaucacaaucugauguagcacuaaucagauauguaaacccagacacaggccgaacauuauuugaagccaaacuacauagaucaggauauauaaccguagcacacucaggggacuauccucuaguaguaccagcaaacggacauuuccgcuucgauucuuggguaaaucaauucuauucacuagcauaa

SEQ ID NO: 34959 - RNA, 1587 nt, Artificial Sequence
  derived and/or modified sequence opt6 from VP1__Norovirus_and/or_Norovirus-like__KT906671
augaaaauggcaagcaaugaugcagcaccaaguaaugauggagcagcagguuuaguuccagaaggaaauaaugaaacauuaccacuagaaccaguagcaggagcagcaauagcugcaccagucacaggacaaaauaacauaauagauccauggauaagaacaaauuuuguacaagcaccaaacggagaauuuacaguaucuccucgaaauucaccaggagaaaucuuauuaaaucuagaacuaggaccagauuuaaaccccuauuuagcacaccuaucacgaauguauaacggauaugcuggcggaguagaaguacaagucuuauuagcaggcaacgcauuuacagcaggaaaaauacuuuuugcagccguaccaccaaauuuucccgucgaauuucucucaccagcucaaauaacaauguuaccucaucuaauaguugauguaagaacccuagaaccaauaaugaucccacuaccagacguccgaaacaccuuuuuccauuauucaaaucaaccaaacucaagaaugagauuaguagcaauguuauacacaccauuaagaucaaacggaagcggagaugauguauuuaccguaucauguagaguauuaacaagaccaacaccagacuuugaauuuacauacuuaguuccaccuucaguagaaucaaaaacuaaaccuuucucacuaccaauauuaacacucucagaacuaacuaauucacgcuucccaguccccauagacucacuauuuacagcacaaaauaauguauuacaaguacaaugucaaaauggucgaugcacauuagauggagaacuacaaggaacaacacaacuacuaccaacuggaauaugugcauuucgaggucgaguaacagcacaaauaaaccaacgagacagauggcauaugcaauuacaaaauuuaaauggaaccaccuaugacccaaccgacgauguaccagcaccacuugguacuccugauuucaaaggaguaguuuuuggcaugguaucucaaagaaacguaggaaacgacgccccagguagcacaagagcucaacaagcauggguaucaacauauagcccacaauuuguccccaaacuaggaucuguaaauuuaagaaucucugauaaugacgauuuucaauuccaaccaacaaaauuuacaccuguaggaguuaacgacgaugacgacggacauccauuuagacaaugggaacucccaaauuacuccggugaauuaacgcugaauaugaaccuagcaccaccagucgcaccaaacuuuccuggcgaacaacuauuauucuuuagaucauuuguaccuuguuccggcggauauaaucaaggaauaauagauugccuaauuccccaagaauggauacaacacuuuuaucaagaaucugcuccaucacaaucagacguagcacuaauacguuauguaaacccagauacagguagaacauuauucgaagccaaacuacacagaucuggauacauaacuguagcccauuccggagauuauccucuaguaguaccagcaaacggacauuuccgauuugacaguuggguuaaccaauuuuacuccuuagccuaa

SEQ ID NO: 34960 - RNA, 1587 nt, Artificial Sequence
  derived and/or modified sequence opt6 from VP1__Norovirus_and/or_Norovirus-like__AB810013
augaaaauggcaucaaacgacgccgcccccucuaacgacggagcagcuucucucguuccagaagcuauaaacgaaaccaugccacuagaacccgucgcuggagcuucaauugcagcaccaguagcaggacagacaaacauaauagacccauggauaagaacaaauuucguacaagcaccaaauggagaauuuaccgucucaccacgaaacucuccaggagaaaucuuauuaaaucuugaauuaggaccagacuuaaacccauaccuugcccaucucucaagaauguacaauggauaugcugguggaguagaaguacaaguauuacuagcaggaaacgcauucacagccggaaaaauacucuuugcugcaauaccaccaaacuuuccaguagauaugauauccccugcacaaauuacaauguuaccacaccuaauaguagacguaagaacauuagaaccaauaaugauuccuuuacccgacguaagaaaugucuuuuaccauuucaacaaucaaccucaaccaagaaugcgacucguagcaaugcuauauacaccacuaagaaguaacggaucaggcgacgauguuuuuacaguaucaugccguguucuaacaagaccuaccccagauuuugaauuuauauaucuuguaccaccaucaguagaaucuaaaacaaaaccauuuaccuuaccaauacucacaauaucagaacuaacuaauucacgauuuccaauuccuaucgaacaacuauacacagcaccaaaugaaaacaaugucguacaaugucaaaacgguagauguacauuagacggagaacuacaaggcacaacccaauuacuaucuucugcagucuguuccuauagaggaagaacaguagcaaaccguggagauaauugggaccaaaaucuauuacaauuaaccuacccaucaggagcaucauacgacccaaccgaugaaguaccugcaccacuaggaacucaagacuucucaggcauacucuacggaguuuuaacacaagauaauguaucagaagguaccggagaagccaaaaaugcaaaaggcguauauauaucaacaacaagugguaaauucacuccuaaaauagguucaauaggcuuacacucaauaacagaaaauguacacccuaaccaacaaucaagauucacaccuguaggaguugcacaaaaugaaaauacccccuuucaacaauggguuuuaccacacuaugccggugcauuagcacucaacacuaaucuagcaccagcagucgcuccaacauucccaggcgaacaacuucuauucuuccgcucaagaguaccuugcguucaaggauuacguggccaagacgcauuuauugacugucuacuaccacaagaaugggucaaucauuuuuaccaagaagcagccccaucacaagcugauguagcacuaauaagauauguaaauccagacacuggaagaacucucuucgaagcaaaauuacaucgaucaggauucauaacaguuagucauacaggagcauacccccuaguaguuccaccgaacggccauuuuagauucgauagcugggugaaucaauuuuauucuuaa

SEQ ID NO: 34961 - RNA, 1584 nt, Artificial Sequence
  derived and/or modified sequence opt6 from VP1__Norovirus_and/or_Norovirus-like__EU096510
augaaaauggcaucaaaugacgcaaacccauccgauggaucaaccgcuaaucuuguuccagaaguaaacaaugaaguaauggcacucgaacccgucguaggugccgcaauagccgcaccuguagccggucaacaaaaugucauugacccauggauacgaaauaauuuuguacaagcacccggaggagaauuuacaguaucaccaagaaacgcaccaggagaaauauuauggucagcaccacuugguccagaucuaaauccuuacuuaucucaccuagcaagaauguauaacggauacgcaggaggauucgaaguacaaguaauacuagcaggcaacgcauuuaccgcaggaaaaauaauauucgcugccguaccaccaaacuuuccaacagaaggacuaucaccaucacaaguaacaauguucccccacauaauaguagauguaagacaacuagaacccguacuaauuccauuaccagauguaagaaauaauuuuuaucacuauaaucaaucaaaugacccaacuauaaaauuaauagccaugcuauacacaccuuuaagagcuaacaacgcuggagacgacguauuuaccguaucaugcagaguauuaacacguccaagccccgauuuugacuuuauauuccuaguaccaccaacaguagaaucaagaacaaaaccauucacaguaccaauacuaacaguugaagaaaugacaaauucacgauuuccaauuccccuagaaaaauuauuuacaggaccaucaggagcauuuguuguacaaccucaaaacggaagauguacaacugacggaguacuauuagguacaacacaguuaucaccaguaaauaucuguaccuuccgaggagauguaacacauaucgcaggaacccacaauuacacuaugaaucuugccucacaaaacuggaauaauuacgacccaaccgaagaaauuccagcaccauuaggaacaccagacuuuguaggaagaauacaaggaauguuaacacaaacaaccagaggugaugguucaaccagaggccacaaagcaacuguaucaaccggagacguucacuucacccccaaacucggaucaauccaauuuaacaccgauaccaacaaugacuucgaaaccggacaaaacacaaaauuuacucccguaggaguaguacaagauggaaacggcacacaucaaaacgaaccacaacaaugggucuuaccaucauauuccggucgcacuggacauaacgcacacuuagccccugcaguagccccaacauucccaggagaacaacuuuuauucuuuagaucaacuaugccaggaugcucagguuauccaaacaugaauuuagacugcuuacuaccacaagaauggguccaacauuuuuaucaagaagccgcucccgcacaaucagacguagcacuccuacgauuugucaauccagacacaggaaggguuuuauucgaauguaaauuacauaaaucagguuauguaacaguagcacacacaggacaacacgaucuugucauacccccaaauggauacuuuagauuugacucauggguaaaucaauucuacacacuauaa

SEQ ID NO: 34962 - RNA, 1584 nt, Artificial Sequence
  derived and/or modified sequence opt6 from VP1__Norovirus_and/or_Norovirus-like__EU096513
augaaaauggccagcaacgaugcaaacccaucagacgguucugccgccaaccuaguaccagaaguaaauaaugaaguuauggcacuugaacccguuguaggagccgccauagcagcccccguagcaggccaacaaaauguaauugaucccuggauaagaaauaauuuuguacaagcaccaggcggugaauuuacaguaucuccaagaaaugccccaggagaaauauuauggagugcaccacuaggaccagaccuaaauccauauuuaucacauuuagcaaggauguauaacgguuaugcaggaggauuugaaguacaaguaauacuagcaggaaaugcguucacagcaggaaagaucauauucgcagcaguaccaccaaauuuuccaacagaaggcuuaucaccaucacaaguuaccauguucccucauauaauaguagauguaagacaauuagaaccaguauuaauaccacuuccagauguaagaaacaacuuuuaucacuauaaccaaucaaacgacuccacaauaaaauuaauagcaauguuauacacacccuuaagagcaaacaaugcuggcgaagauguauucacagucucauguagaguauuaacucgacccucaccagauuuugacuuuauauuuuuaguuccuccaacaguagaaucaagaacaaaaccauucacgguuccuauacuaacaguagaagaaaugacaaauucucguuucccaauacccuuagaaaaauuauuuacaggacccucaggugcuuuuguaguacaaccucaaaacggaagauguaccaccgacggcguacuucucggaacaacucagcuaagcccaguuaacauuugcacauucagaggugacguaacacacauagcaggaucaagaaacuacacaaugaacuuagccucacuuaacuggaacaacuacgaucccacugaagaaauaccagcaccacuaggaacaccagacuucguagguaaaauacaaggagucuuaacccaaacaacaaaaggagacggaucaacaagaggacacaaagccacaguauacaccggaucugcaccauucacaccaaaacuuggaucaguccaauucucaacagauacagaaaacgauuuugaagcacaucaaaauacaaaauucaccccuguaggagucauacaagauggaucaacaacacauagaaaugaaccucaacaauggguauuaccaucauauucugggagaaauguacacaacguacacuuagcaccagcaguagcaccuacauucccaggugaacaacuacuauucuuucgaucaacaaugccagguugcucaggcuaucccaauauggaucuagauugucuauuaccacaagaauggguacaacauuuuuaucaagaagccgcaccagcacaaucagacguagcacucuuaagauucguaaauccagacacaggaagaguccucuucgaaugcaaacuccauaaaagugguuacguaacuguagcacauacaggacaacaugacuuaguaauaccuccaaauggauacuuuagauucgacaguuggguaaaucaauuuuacacccuauaa

SEQ ID NO: 34963 - RNA, 1584 nt, Artificial Sequence
  derived and/or modified sequence opt6 from VP1__Norovirus_and/or_Norovirus-like__EU096514
augaaaauggcaucaaaugacgcaaacccauccgauggaagcgcagccaacuuaguaccagaaguaaacaaugaaguuauggcacuagaaccagucguaggagcagccauagcugcaccuguagcaggucaacaaaauguuauagaucccuggauacguaauaacuuuguacaagcaccaggaggugaauuuacuguauccccaagaaacgcucccggagaaauauuauggucugcaccucuaggaccagaucuaaauccauaccuaucacaccuagcaagaauguauaauggauacgcuggcggauuugaaguacaaguaauccuagcaggaaacgcauuuacugcaggcaaaauaauuuuugcagcaguaccaccaaauuuuccaacugaaggauuaucuccaucacaaguaacaauguucccacacaucauaguugacguaagacaacuagaacccguucucauaccauuaccagacguacguaauaauuucuaucacuauaaucaaucuaacgacuccaccauaaaacuuaucgcaaugcuauacaccccucuuagagcaaacaacgcaggagaagauguuuucaccguaucauguagaguacucacuagaccaucaccagauuuugauuuuaucuuuuugguaccaccaacuguagaaucuagaacaaaaccauucacugucccuauauuaaccguagaagaaaugacaaauucacguuucccaauaccacuagaaaaacuauucacaggaccauccggugccuuuguaguacaaccacaaaauggaagauguacaaccgacgguguacuacucgguacaacacaauuauccccaguaaauauauguacauuccgaggagacguaacacauaucgcaggaucaagaaauuacacuaugaaucuagcuucacuuaacuggaacaauuacgacccaacagaagaaauaccagcaccgcuaggaacaccugacuuugucgguaaaauacaaggaguacuuacacaaacaacaaaaggagauggaucaacaagaggccauaaagcaacaguuuauacaggauccgcuccauuuaccccuaaacuaggcucaguacaauucucuacagauacagaaaacgauuucgaaacacaucaaaauacaaaauucacucccguaggagucauacaagacggaggaacuacucauagaaaugaaccacaacaauggguacucccuucauauucuggacgaaauguacauaacguacacuuagccccggccguagccccaacauucccaggagaacaacuauuauucuuuagaucaacaaugccagguugcucaggauauccuaauauggaccuagauuguuuacuaccacaagaauggguacaacacuuuuaccaagaagcugcaccagcacaaucugacgucgcacuuuuaagauuuguaaauccggacaccggaagaguacuuuuugaauguaaauuacauaaaucaggauauguaacugucgcccauacuggacaacaugaucuaguaaucccaccaaauggcuacuucagauuugauucauggguaaaucaauucuacacacuauaa

SEQ ID NO: 34964 - RNA, 1584 nt, Artificial Sequence
  derived and/or modified sequence opt6 from VP1__Norovirus_and/or_Norovirus-like__EU096512
augaaaauggcaucuaacgaugcaaacccaucagauggaagugcagccaacuuaguaccagaaguaaacaaugaaguaauggcuuuagaaccuguuguaggugcagcaauagcugccccuguagccggacaacaaaaugucauugaccccuggaucagaaauaauuucguacaagcaccaggaggagaauuuacuguaagcccccgcaacgccccuggagaaauacuauggucugcuccccucggaccugaccuaaauccauacuuaucucacuuagcccgaauguauaacggauaugcaggaggauuugaaguacaaguuauacuagcuggaaaugcuuuuacagcaggaaaaaucauauuugcugccguaccaccaaacuucccaacagaaggacuaucaccaucucaaguaacaauguucccccacauaauagucgacguuagacaacuugaaccaguacuaauaccacuccccgacguaagaaauaauuuuuaucacuacaaucaaucuaaugauucaaccauaaaacucauagcaaugcuauacacaccacuacgagcaaacaacgcaggagaagauguauucaccguaucauguagaguuuuaacuagaccaucaccagacuuugauuuuauauucuuaguuccacccaccgucgaaucaagaacuaaacccuucacgguaccuaucuuaacaguggaagaaaugaccaacucacgauuuccaauaccuuuagaaaaacuauuuacaggaccaucaggcgcauucguaguacaaccccaaaacggacgauguacaacugacggaguauuauuaggaacaacacaauuaucacccguaaauauauguacauuccgcggagacgucacacacauagcuggaucaagaaacuauacaaugaacuuagcauccuuaaauuggaauaauuaugauccuacagaagaaauaccagcuccccuagguacaccugacuuugucggaaaaauacaaggugucuuaacacaaacaacaaaaggagauggcuccacaagaggccacaaagccaccguauauacaggaagugcaccauuuacaccaaaauuaggaucaguacaauucucaacagacacagaaaacgauuuugaaacacaccaaaauacaaaauucacaccaguugguguuauacaagauggauccacaacccaccguaaugaaccacaacaauggguacuaccaucauacucaggucgaaauguacauaauguacacuuggcaccagccguagcaccuacauuuccaggagaacaacuauuauucuuuagaucaacaaugccagguugcuccggcuacccaaauauggaccuagacugccuacuaccccaagaauggguacaacacuucuaucaagaagcagcacccgcacaaucagauguugcacuacuaagauucguaaacccagacacaggaagagucuuauucgaauguaaacugcacaaaaguggauauguuacuguagcacacacaggacaacacgaucuaguaauaccaccaaauggcuacuuuagauucgauucuugggucaaccaauucuacacauuauaa

SEQ ID NO: 34965 - RNA, 1581 nt, Artificial Sequence
  derived and/or modified sequence opt6 from VP1__Norovirus_and/or_Norovirus-like__KU311161
augaugauggcuucaaaagaugcuccaucuaauauggauggaacaucaggugcaggucaacuuguccccgaaguuaaugcagcagaaccccuaccauuagaaccaguaguaggagccgcaacagcugcagcaacagccggacaaguaaauaugauugaccccuggauaaugaacaauuuuguccaagcuccagaaggagaauuuacaaucucaccaaauaacacaccaggagauauacuauuugauuuacgccuaggcccacacuuaaauccauucuuacuacauuuaucacaaauguacaauggauggguaggaaacaugcgaguacgcguuaugcuagccggaaaugcuuucucugcaggaaaaaucauaauauguuguguaccuccagguuuugaaucacaaaauauuucaauaggacaagcaacaauguuuccacauguaauugcagauguaagagucuuagaaccaauagaaguaccacuagaugacguaagaaauguacuuuuucacacuaaugaaaauagaccaacuaugagauuacuauguaugcuuuacacaccucuuagagcugguggagcaucaucaggaacagacccuuucguaauagcaggacggguuuuaacaugcccggcaccugacuuuaauuucuuauuuuuaguaccaccaucagucgaacagaaaacuagacaacuaacaauaccaaacauaccucuaaauaauuuagcaaacucaagaguacccgcaaugauaaacaaaaugacuguaucagccgaccaaaaccaaguuguucaauuccaaaacggaagauguacauuagaaggucaacuauuaggaacaacucccguaucagcaaaccaaguagccagaauuagaggcaaaguauuuucaacaaauucugguacuggauuaaauuuaacagaaguugauggaacaccauaucaugccuuugaauccccugcaccuuuaggauucccagauauaggaaauugugauuggcacguauacgcauucaaaguaaaucaaaauacaggugacccaauguauagauuagauauaacccaaggaaacucauuugcaccucaucuaggaucaauagaauuuucaucagaaaaucauccaucaggagaccaacuaggaacauuaaccuggauaucaccauuaaacaaugcuucaagaguagacccauggaaaauacccacauauggaucaacacucacagaaucaaccaaucuagcuccaccaauauuuccaccaggauuuggagaauccauaguauacuucaugucugauuuccccauaguaucaggaaacacagcucaaauaccauguacauuaccgcaagaauuuguaucaucauuuguagaacaacaagcacccaucagaggagaagcagcuuuauuacauuauguagacccugauacacacaggaacuuaggagaauuuaaauuguauccagaugguuuuauaacauguguuccaaauacaggagguggaccccaaaaucucccaucaaauggagucuucgucuuuagcagcugggucucaagauauuaucaauuaaaaccaguaggaacauaa

SEQ ID NO: 34966 - RNA, 1581 nt, Artificial Sequence
  derived and/or modified sequence opt6 from VP1__Norovirus_and/or_Norovirus-like__KX907730
augaugauggcaaguaaagaugccccauccaacauggauggaacaucuggugcuggccaauuaguaccagaaguaaacgcugccgaaccauuaccauuggaaccaguaguaggagcagcaacagcaguagccacugcaggacaagucaacaugauugauccuuggauaaugaacaauuuuguacaagcacccgaaggugaauuuacaauaucaccaaauaauacaccaggagauauacucuucgauuuaagacuuggaccacauuuaaauccauucuuacuacaccucucacaaauguacaauggcugggucggaaacaugagaguaagaguuaugcucgcaggaaacgcauucuccgcaggaaaaauaaucauaugcuguguaccuccuggauuugaaucacaaaauauuucaauaggucaagccacaauguuuccccauguaauagcugauguacgaguacuagaacccauugaaguaccucuugaugacguaagaaauguauuauuucauacaaacgaaaaccguccaacaaugagauuacuaugcauguuauacacaccacuaagagcaggaggugcaaguuccggaacagaucccuuuguaauagcaggaagagucuuaacauguccugcaccugauuuuaacuuuuuauuucuaguaccaccaucaguagaacaaaaaacaagacaauuaacuaucccuaauauaccucuaaauaacuuagcaaacucaagaguaccugcuaugauaaauaaaaugacuguaucugcugaucaaaaucaaguaguacaauuccaaaacggacgaugcacuuuagaaggacaauuacuaggaacaaccccaguaagcgccaaucaaguagcaagaauacguggaaaaguuuucucaacuaauagcggaacuggcuuaaaccucaccgaagucgacggaacaccauaucacgcuuuugaaucaccugcuccacuuggauuuccagacauaggaaauugugacuggcauguauaugcauuuaaaguaaaccaaaauacuggagaccccauguauagauuagacauaacacaaggaaauuccuucgcaccucaucucgguucaauugaauucucaucugaaaaucaccccucaggcgaccaacucgguacauuaacauggauaucuccacuaaauaacgccucaagaguagauccauggaaaauaccaacauauggauccacacuaacagaauccacaaaucuagcaccaccaauauuuccaccaggcuucggagaagcaauaguauauuucaugucugauuuuccaauaguaucaggaaacacagcucaaauaccaugcacuuuaccucaagaauucguaagcucauucgucgaacaacaagcuccaauacguggagaagccgcauuauuacacuauguagauccagacacacauagaaaucuaggcgaauuuaaacuauauccagacggcuucauuacauguguaccaaacacuggaggaggcccacaaaauuuacccucaaacggaguauucguuuucucauccuggguaucuagauacuaccaacuaaaaccagucggaacuuaa

SEQ ID NO: 34967 - RNA, 1581 nt, Artificial Sequence
  derived and/or modified sequence opt6 from VP1__Norovirus_and/or_Norovirus-like__EU096507
augaaaauggcaucaaacgacgcaaacccaucagaugguucgacugcaaaccucguaccugaagucaauaaugaagucauggcacuagaaccaguaguaggagcagcaauagcugcaccaguagcuggacaacaaaacguaaucgauccuuggauucgaaacaacuucguacaagcuccaggaggagaauuuacuguaucaccaagaaaugcccccggagaaauacucugguccgcaccacuuggaccagaucuaaauccauacuuaagccauuuagccagaauguauaaugguuacgcuggugguuucgaaguacaaguaauuuuagcagguaaugcauucacagcuggaaaaauaaucuucgcugcgguaccaccaaacuuuccaacagaaggacuaucaccaucacaaguaacaauguucccucacauuauaguagacguaagacaauuagaaccuguacuaauuccacuacccgacguacgaaacaauuucuaccacuauaaccaaaguaaugacagcacaauaaaauuaauagcaauguuauacacaccacuuagagcuaacaacgcgggagacgaugucuucacaguuucauguagaguucuaaccagaccaucaccugacuuugacuucauauuucuaguuccaccaacuguagaaucacgaacuaaaccauucaccguaccaauacuaaccguugaagaaaugucuaacucaagauuuccugucccacuagaaaaauuauauacaggaccaucaagcgcauuuguuguucaaccacaaaacggaagaugcacaacagacggaguacuauuagggacaacacaacuuucagcagucaacauauguacauuccgaggagacguaacacauauagcaggaucucaugacuauacuaugaaucuagcaucacaaaacuggaauaacuacgaccccacagaagaaaucccugccccacuuggaacaccagacuuuguuggaaaaauucaagguguacuaacacaaacaacccgagaagauggcucaaccagagcccauaaagcaaccgucucaacuggaucuguacauuuuacaccaaaacucggaucaguacaauauacaacagauacuaacaaugacuuucaaacaggacaaaauacaaaauuuacaccaguaggaguaauacaagacggauccaaucaccaaaacgaaccacaacaauggguuuuaccaaacuacuccggacgaaccggacauaauguccaucuagcaccagccguagcccccacauuuccaggagaacaauuauuauucuuccgaucaacaaugccagguugcuccgguuacccaaacaugaacuuagacugucuacuaccacaagaauggguacaacacuuuuaucaagaagcagccccagcacaaucugauguagcucuacuaagauuuguaaauccagauacuggaagaguauuauuugaauguaaacuccacaaauccgguuauguaaccguagcccauacggguccccaugaccuaguaauuccaccuaacggauacuucagauuugacucauggguaaaucaauucuauacacuauaa

SEQ ID NO: 34968 - RNA, 1581 nt, Artificial Sequence
  derived and/or modified sequence opt6 from VP1__Norovirus_and/or_Norovirus-like__AB810007
augaaaauggcuucaaaugaugcagcacccuccaacgauggugccgcaucccuaguaccagaagccauaaaugaaacaaugccauuagaaccaguugcaggagcauccaucgcugcaccuguagcgggacaaacaaauauaauagauccauggauaagaacuaauuuuguccaagcacccaacggagaauuuacagucucaccaagaaauagcccuggagaaaucuuacuaaacuuagaauuaggaccagaucuaaacccauacuuagcacaucuuucaagaauguauaacggauacgcaggcggaguagaaguacaaguacuuuuagcaggaaaugcauucacagcaggaaaaauacuauucgcagcuaucccaccaaacuucccaguagacaugauauccccagcacaaauaaccauguuaccucaccuaauuguugacguacgaaccuuagaaccaaucaugauuccuuuaccagacguaagaaacguauuuuaucauuuuaauaaucaaccccaaccaagaaugagacucgucgcaaugcuauauaccccacuacgaucaaauggaucuggagacgauguuuuuacaguuucauguagaguacuaacaagaccaacaccagacuuugaauuuauuuauuuaguaccaccaucaguagaaaguaaaaccaaaccauucacacuaccaauauuaacaauuucagaauuaaccaacucaagauucccaaucccaauugaacaacuauacaccgccccaaaugaaaauaauguuguacaaugccaaaauggcagauguacauuagacggagaauuacaaggaacaacacaacuacucucaucagcuguauguuccuacagaggaagaaccguagcuaauagaggagacaacugggaucaaaaucuacuucaacuuacauacccaucaggagccucauaugacccaacugacgaaguaccagcaccuuuaggcacacaagacuucucaggcauacuauacggaguauuaacacaagacaacgucucagaaggcacaggagaagcuaaaaacgcaaaaggcguauacauaucaacaacaucaggaaaauucacacccaaaauaggaucaauuggacuccauuccauaacagaaaauguacacccaaaccaacaaucacgauuuacaccaguaggcguagcacaaaacgaaaauacuccauuucaacaauggguacuaccacacuacgcaggggcacuagcuuuaaacacaaaccuagccccagcuguugcuccuacauucccaggcgaacaauuacuuuucuuuagaucaagaguaccaugcguacaaggacuaagaggacaagaugccuuuauugacugccuuuuaccacaagaguggguaaaccacuucuaccaagaagcagcuccaucucaagcagacguagcacuaauaagauauguuaauccugacacaggacguacacuauucgaagcuaaauuacaccguucuggauucaucacuguaucacauacaggcgcauauccccuaguaguuccaccaaauggacauuucagauucgauucaugggucaaucaauucuga

SEQ ID NO: 34969 - RNA, 1581 nt, Artificial Sequence
  derived and/or modified sequence opt6 from VP1__Norovirus_and/or_Norovirus-like__AB809989
augaaaauggccucaaaugacgccgcaccaucuaacgacggagcagccucuuuaguaccagaagcaauaaaugaaaccaugccacuagaaccagucgcaggagccucaauagcagcuccaguugccggucaaacaaauauaauagauccauggaucagaacaaacuucguucaagcaccaaacggcgaauuuacaguaagccccagaaauucaccaggagaaauacuacuaaaucuagaauuaggaccagaccuaaacccauacuuagcacaucucucuagaauguacaauggauacgcaggaggcguagaaguacaaguccuacuagcaggcaacgcauucaccgcaggaaaaauacuuuucgcagcaauaccaccaaacuucccaguagacaugauaucaccagcacaaauaacuaugcuaccacaucucauugucgauguucguacguuagaacccauaaugauaccacuaccugaugucagaaacguauucuaucacuucaauaaucaaccucaacccagaaugagguuaguagcaaugcuauauacaccacuccgaucuaauggauccggagacgauguauucacaguaucuugcagaguacuaacacgaccaacaccagacuucgaguucauauacuuagucccuccaucuguagaaucaaaaacaaaaccauucacauuaccuauucucaccauaucagaauuaacaaauucaagauuuccaauaccaaucgaacaacuauacacagcaccaaacgaaaauaacguaguacaaugccaaaacgguagaugcacauuagacggagaacuacaaggaacaacacaauuacuaucaucagcagucuguucauacagaggaagaacagucgcuaacucaggagauaacugggaucaaaauuuacuacaauuaaccuacccaucaggagcuagcuacgacccaaccgacgaaguaccagccccacuaggaacccaagauuuuucaggaaucuuauauggaguacucacacaagacaacguaucugaaggaacaggagaagccaaaaacgcaaagggcguauacauaucuacaacaucaggaaaauucacaccaaaaauaggcucaauuggacuccacucaauuacagaaaacguacacccuaaccaacaauccagauucacacccgucggagucgcacaaaacgaaaacacaccauuccaacaaugggucuuaccccacuacgcuggugcauuagcacuaaacaccaaucuagcacccgcaguagcccccaccuuuccaggcgaacaacugcuuuucuuuagaucccgugucccauguguccaaggccucagaggacaagacgcauucauagacugccuucucccacaagaauggguuaaucauuuuuaccaagaagccgcgccaucacaagcugauguagcauuaauaagauacguaaauccagauacaggaagaacacuauucgaagcuaaauuacacagaucaggcuucauaacaguaucacacacaggagcauacccucuagucguuccaccaaacggccacuucagauuugacuccuggguaaaccaauuuuaa

SEQ ID NO: 34970 - RNA, 1581 nt, Artificial Sequence
  derived and/or modified sequence opt6 from VP1__Norovirus_and/or_Norovirus-like__AB810000
augaaaauggcaucaaaugacgcagcaccaucgaacgacggcgcagcaucccucguaccagaagcaauaaacgaaacuaugccacuagaaccaguagcaggagcaucaauagcugcaccugucgcaggucaaacaaacauaauagacccauggauaagaacaaacuucguucaagcacccaauggagaauuuacaguaucaccacgaaacucaccaggagaaauacuauuaaaccucgaacuaggcccagaucuaaacccauauuuagcacauuuaucaagaauguacaauggcuacgcaggaggaguagaaguacaaguacuauuagccggaaacgccuucacagcaggaaaaauucuauucgccgcaauaccuccuaacuuccccguagauaugauaucacccgcacaaauaacaauguuaccacaucuaauaguagauguaagaacccuagaaccaauaaugaucccacuaccagauguacgaaauguauucuaucacuuuaauaaucaaccccaacccagaaugcgucuaguagcuaugcuauacacuccauuaagauccaauggaagcggcgacgaugucuucaccguuaguuguagaguucuaaccagacccacuccagauuuugaauuuauauauuuaguaccaccaucaguugaaucuaaaacaaaaccuuucacccuaccaauuuuaacaauaucagaauuaacuaacucaagauucccaauaccaauagaacaauuauacacagcaccaaaugaaaacaaugucguccaaugccaaaacggccgaugcacccuugacggugaacuacaaggaacaacacaauuauuaucuucagcaguauguucauacagaggacgaacaguagccaacucaggagacaauugggaccaaaaccucuuacaacuaacuuaucccucaggagcaagcuaugauccaacagacgaaguaccagcaccacuaggaacccaagacuucucaggaauauuauacggcguacuaacccaagauaacguaucagaagguacaggagaagccaaaaacgcaaaaggagucuacauuucaacaacuuccggaaaauucacaccaaaaauaggauccauuggacuacacuccaucacagaaaacguacacccaaaccaacaaucucguuucacaccuguaggcguagcacaaaacgaaaauacacccuuccaacaauggguucuaccucacuaugcaggagcacuagcauuaaauacuaaccuagccccugcagucgcaccaacauuuccaggagaacaauuacuauucuuuagaucaagaguaccaugcguucaaggacuaagaggccaagaugcauucauagacugcuuacucccucaagaaugggucaaccauuucuaucaagaagcagcacccucacaagcagauguugcacuaauaagauauguuaauccagacaccggaagaacacuauucgaagcuaaauuacaccguuccgguuucauuacaguaucacauacaggaguauaucccuuagucguaccaccuaauggacacuucagauuugauuccuggguuaaucaauuuuga

SEQ ID NO: 34971 - RNA, 1575 nt, Artificial Sequence
  derived and/or modified sequence opt6 from VP1__Norovirus_and/or_Norovirus-like__AB809999
augaaaauggccucaaacgacgcagcaccaucaaacgauggcgcagcaucccuaguaccagaagccauaaaugaaacaaugccacuugaaccaguugcaggagcuucaauagcagcaccaguagcaggacaaaccaauaucauagauccauggauacgaacaaauuuuguucaagcaccaaauggugaguuuacuguaucaccaagaaauucccccggcgagaucuuauuaaacuuagaauuaggcccagaccuaaacccauacuuagcacaccuuucucgcauguacaaugguuacgcaggaggcguagaaguacaaguauuauuagcaggcaacgccuuuacagcagguaaaaucuuauucgcagcaauaccacccaacuuucccguagauaugauauccccagcacaaaucacaaugcuaccacaucuaauaguagacguaagaacuuuagaaccaauuaugauuccauuacccgauguaagaaacgucuucuaucacuuuaauaaccaaccccaaccaagaaugcgacuuguagccaugcuauacacaccacuaagaucaaacggaucaggcgacgauguauucacaguuuccugucgugucuuaacaaggccaacaccagauuuugaauuuauuuaccuugucccacccucaguagaaucuaaaacaaaauccuucacauuaccuauacuaacaaucucagaacuaaccaacuccagguuuccuacaccuaucgaacaacuauacacagccccaaacgaaaacaauguuguccaaugccaaaacgguagauguacauuagauggugaacuacaaggcacaacacaacuacuaucuucagcuguuuguucauaccguggaagaacaguagcaaacucaggagauaauugggaccaaaacuuauuacaacucacauaccccucaggagccucauaugauccuacagacgaaguaccagcaccacuaggcacacaagacuucucaggaauacuauauggagguuuaacacaagauaacguauccgaagguacaggagaggccaaaaaugccaaaggaguauacauaucuacaacaucagguaaauuuacaccaaaaauaggaucaaucggacuucauuccauuaccgaaaauguacacccuaaccaacaaucaagauucaccccuguaggcguagcacaaaacgaaaacacaccauuccaacaauggguauuaccacacuacgcaggcgcacuagcacuuaauacaaacuuagccccugcaguagcacccacauuccccggugaacaacuacuauucuuccgcucaagaguaccaugcguacaaggccuaagaggacaagacgcauucauagacugucuacuaccacaagaaugggucaaucauuucuaccaagaagcagcaccuucucaagcagacguugcacuaauaagauacguaaauccagacacaggacguacacuauuugaagcaaaacuacaucgauccggauucauaacaguaucacacacuggagcauacccauuaguaguuccaccaaacggccacuuuagauuugacucauggguaaauuaa

SEQ ID NO: 34972 - RNA, 1572 nt, Artificial Sequence
  derived and/or modified sequence opt6 from VP1__Norovirus_and/or_Norovirus-like__FJ692501
augaugauggcauccucagaugcaacaccuccaagugaaggcgcuacaaaccuuguaccagaagucaacacucaaguaguaccacuagaaccaguagcaggagcagcagcagcagccccauuuacuggacaaaauaacguaauagaucccuggauauuccaaaauuuuguacaagcaccucaaggagaauuuacaguaucuccaagaaauacaccaggugaaauucuuuuacgaauaccauuaggaccaaauuuaaauccauuccuagcucacuuaucucgaauguauaaugcauggguaggaggaauggaggcagaaaugauacucgcagguaaugcauuuaccgcaggaaaacuacuaauaguagcauuaccaccaggauucgaagcaacucaauuaaccccagcucaagccacugcguucccacacguaauagcagacguacguacuuuagaaccaauacccauuccauuaccagauauaagaaacguacuauuucauuacaauggugauccuaccccuaccauacaaauaguaguuaugcuauauacaccuuuacguacaaauggcaauggagaugauguuuucacaguaucaggacgacuuuuaacacgcccagcaccggauuucucauucagcuuccuuguaccaccuaccguagaacagaaaacaagacccuuuacacuaccuaauuuagcaguaucagaccuaucaaacucaagauuuccagcaccaguaaacauccuaagagcagauccaaauacaacccuagcacucgacuaucaaaauggaagauguaccuuagacggagcacuacagggcacaacaccaacaaacucauccuuccuaggauaccucagaggaaccgucgacagagucaacucagaccaaguucacguacaucuaagagaaccaaauggagacccauuucaauuaggacucccagguccccaagguguaccagauuacagagcaacacuagauauauauguagauugggaaaauaaaaaccauggaaaucccugcgaaggaaccuuaaauaccggaucccaaaccgaauacacacccggguuaggaacuuuaacauucaauaaaacaucuggagauacaccagaacaaggagauccuguaauaaugcgucuaguagcauuuagaucuaauuuaacagaccaauuaccagcauauaauggagcauucggucaaggagaaaaccuagcacccccaguaucaccaccaguaccgggcgaaguuuuucuacaauuuggaucuagauauacaagauuaggagaaagggaauuagccguucaaugccuacuaccaucagaauggauaacacacuuuuauucugaagccgcaccaauacaaggagaagccaugcugcuaagauauguacaaccggaucuaggaagaauacuauucgaagcaaaacucuauaaagaaggcuuuguaacaguugccgguggaacaaauccaguuacauuuccaauagauggcacauuuguagcuguaucuuggguaucucgaaauuuuguacucaguccuaugggaucaggacaagggcgaagacgauaa

SEQ ID NO: 34973 - RNA, 1572 nt, Artificial Sequence
  derived and/or modified sequence opt6 from VP1__Norovirus_and/or_Norovirus-like__FJ692500
augaugauggcaucuucagacgcaacuccuccauccgaaggcgccacaaaucuaguuccagaaguaaacacacaaguaguuccauuagaacccguagcaggcgcagcugcagcugcaccauucacaggccaaaauaauguaauagacccuuggauauuucaaaauuuuguacaagcaccacaaggagaauuuacaguaucaccccgaaacaccccaggagaaauuuuacuaagaauaccacuaggaccaaaucuaaacccuuuuuuagcacauuuaucuagaauguauaacgcaugggucgguggcauggaagcugaaaugauauuagcaggaaacgcguucacugcuggaaaacuuuuaauuguagcauuaccaccaggauuugaagcuacacaacuaacuccagcacaagcuaccgcauucccacacguuaucgcagacguacgcacacuagaaccaaucccaauaccauugccugauauacggaauguauuauuucacuauaauggugacccaaccccaaccauacaaaucgucguuaugcuauauacacccuuaagaacaaauggaaacggagaugauguuuuuacgguaucaggaagacuauuaacaagaccagcaccagauuuuucuuucucauuucuaguaccaccaacaguagaacaaaaaacacguucuuuuacauuaccuaacuuagcuguuuccgaucuaucaaauucuagauuuccagcaccuguuaacauacuuagagcugacccaaacacaacauuagcacuagauuaccaaaacggucguuguacucuagauggcgcauuacaaggaacaacuccaaccaauucaucauucuuaggauaccuucgaggaacuguagauagaguaaauucagaccaaguucacguccaucuaagagaaccaaacggcgauccauuccaacuaggauuaccaggaccacaaggaguaccagacuaucgagccacauuagacauauacguugauugggaaaacaaaaaucacgguaauccaugugaaggaacauuaaauacagguucucaaacagaauacacuccaggucuaggaacucuaacauuuaauaaaacaucuggagacacaccagaacaaggagauccaguaauaaugagauuaguagcuuuccguucaaaucuuacagaucaauuaccagcauacaacggagcauuuggucaaggugaaaauuuagccccaccagucucaccaccuguuccaggagaagucuuucuacaauucggaagccgauauacaagacuaggagaaagagaacucgcuguacaaugcuuauuaccauccgaauggauaacucauuuuuacucagaagcagccccuauacaaggagaagcuaugcuacuaagauauguacaaccagauuuaggaagaauacucuuugaagcaaaacuuuauaaagaagguuuuguuacaguagcaggaggaaccaacccaguaacauucccaauugacggaacauuuguagcuguuucauggguaucacgaaauuuuguauuaucaccaaugggaucaggucaaggacgcagaagauaa

SEQ ID NO: 34974 - RNA, 1572 nt, Artificial Sequence
  derived and/or modified sequence opt6 from VP1__Norovirus_and/or_Norovirus-like__AB031013
augaugauggcaucaaaagacgcaacaucuucaguagauggagcuucaggagcuggccaauuaguuccagaaguuaaugcuuccgacccacuagccauggauccuguagcagguaguucuaccgcaguagcaacagccggacaagucaaucccauagacccuuggauaauaaacaauuuuguacaagccccacaaggagaauuuacaauuucaccuaacaacacaccuggcggagucuuauuugaucucucuuuaggaccacauuuaaacccauuuuuacuacaucuaucucaaauguacaacgguuggguaggaaauaugagaguaagaauaauguuagcaggaaaugcuuuuacugcagguaaaauuauaguaucauguauuccaccaggcuuuggcucacauaaucuaacaauagcucaagcaacauuauuuccacacguaauagcugaugucagaacucuagacccaauagaaguaccauuagaagauguaagaaauguacuauuucacaacaaugaccgaaaccaacaaacuaugcgauuaguuugcauguuauacacaccauuaagaacaggcggaggaaccggagacucuuuuguaguugcaggaagagugaugacauguccuucuccugauuucaauuuucuauuucuuguaccaccaacaguagaacagaaaacuagaccauuuacauuaccuaaucuaccacuuucuucacuuucaaauucaagagcaccccuacccauaucaggaaugggaauaucgccugauaauguacaaucaguacaauuccaaaacggaagaugcacacuagacggacgcuuaguagguacaacaccaguaucauuaucucacguugcaaaaauacgaggaacaucuaacggaacuguuauuaauuuaacagaacuagacggaacaccauuucauccuuucgaaggacccgcuccaauagguuuuccagauuuaggaggaugugauuggcauauaaauaugacucaauuuggucauucuucucaaacacaauacgacgucgacacaacacccgauacauucguaccacaccuaggauccauacaagcaaaugguauagguucaggaaauuauauaggaguuuuaucauggguaagucccccuucacauccaucuggaagucaaguagaucuauggaaaauaccaaauuauggaucaucaaucacugaagcuacacaucuagcucccucaguauauccaccaggauuuggagaaguuuuaguauuuuucaugucgaaaauaccaggaccaggcgcauauucuuuaccgugucuauuaccacaagaauauauaucucacuuagcaucugaacaagcuccaaccguaggagaagcagcuuuacuccacuacguagauccagauacagguagaacuuuaggagaauuuaaagcauaucccgauggauuucuaacauguguaccaaauggagcauccuccgguccacaacaacuaccaauaaauggaguauuuguauuugucucauggguaucaagguucuaccaauuaaaaccaguagguacagcaaguucagcuagauaa

SEQ ID NO: 34975 - RNA, 1572 nt, Artificial Sequence
  derived and/or modified sequence opt6 from VP1__Norovirus_and/or_Norovirus-like__KU253442
augaugauggcuucaaaagacgcgacaucaagcguagacggugcgucaggagccggccaacuuguaccugaaguaaaugcaucugacccauuagcaauggauccaguagcagguucuucaacagcuguagcuacagcaggacaagucaauccaauagacccauggauaauaaauaacuucguacaagcuccucaaggagaauuuacaaucucuccaaacaauacaccaggugauguauuauucgaucuaucucuaggaccacaucuaaacccauuuuuacuucacuuaucacaaauguauaaugguugggucgguaauaugagaguuagaauaauguuagcaggaaaugcuuuuacagcaggaaaaauaauuguaagcugcauaccaccaggauuuggaucucacaaccuaacuauagcacaagcaacuuuauucccacacguaaucgcagacguaagaacgcuugaucccauagaaguuccccucgaagacguaagaaacgucuuauuucauaacaacgaucguaaccaacaaacaaugagauuaguaugcaugcuauacacaccauuaagaacaggagguggaacuggagauucuucaguaguagcaggaagaguaaugacuugcccaucaccagauuuuaacuuucucuuuuuaguuccaccaacuguagaacagaaaacacgaccuuuuacacuuccaaaucuucccuuaucaucauuaucaaauucacgagcaccacuuccuauuucauccauggggauaucuccagauaacguacaaucuguacaauuacaaaacgguagauguacauuagauggaagauuaguaggaacuaccccaguaagucuaucccacguugccaaaauucgaggaaccucuaauggaacagccauaaaucuaacagaacuagaugguaccccuuuccauccuuuugaagguccagcaccaauuggauuaccugacuuagguggcugugacagacauauaaauaugacacaauuuggccacucaucccaaacacaacaugaugcagauacaacaccagacacaucaguaccacauuuagguucuauacaagcaaauggaauagguucaggaaacuacguaggaguauuaucauggaucucaccuccaucacauccuucagguucccaaguagaucuuuggaaaauucccaauuauggaagcucaauaacugaagcaacacaucuagcacccagugucuauccaccaggauuuggagaaguauuaguauuuuucaugagcaaaaugccuggacccggagcauacaaucuaccuugccuacuaccacaagaauacauaucacauuuagcaucagaacaagcaccuaccguaggagaagccgccuuauuacacuauguugacccagauacagguagaaacuuaggugaauuuaaagcauauccagacggauuccuaacuuguguaccuaauggagccucaucuggaccacaacaacuaccuauaaauggaguauucguauuuguaucuuggguuucucgauuuuaucaauuaaaaccaguaggcacagcaucaucagcacgcuaa

SEQ ID NO: 34976 - RNA, 1572 nt, Artificial Sequence
  derived and/or modified sequence opt6 from VP1__Norovirus_and/or_Norovirus-like__EF547392
augaugauggcauccaaagacgcaacaucauccgucgacggugccucuggugcaggacaacucguucccgaaguaaacgcaucagauccuuuagcaauggacccaguugcaggaucaaguaccgcuguagcuaccgcaggacaagucaauccuauagacccuuggauaaucaauaacuucguacaagcaccacaaggagaauuuacaauaucaccaaauaacacaccaggugauguauuauucgaucuuuccuuaggaccacaccuuaaucccuuucuauuacacuuaucccaaauguacaacggauggguuggaaauaugcguguacguauaauguuagcaggaaaugcauuuacagcuggaaaaauaauuguaucuuguauaccaccaggauuuggaucacacaaccuaacaaucgcacaagcaacauuauuuccacauguaaucgcagacguaagaacacuagacccaauagaaguccccuuagaagauguccguaauguacuuuuucacaauaacgauagaaaucaacaaacaaugagauuaguauguaugcuauacaccccauuacgaacaggaggcggaacuggagauucauuuguaguagcaggaagaguaaugacuugcccuucaccagacuuuaauuuccuauuucuuguaccaccaacuguagaacaaaaaacuagaccauuuacacuaccaaauuuacccuuaucuuccuuaucaaauuccagagcuccauuacccaucucaggaauggguauaucucccgauaauguacaaucuguacaauuccaaaauggaagauguaccuuagacggacgacucguuggaacaacacccgucucuuuaucacauguagcuaaaauacgaggcacaucuaauggaaccguuauaaaucucacagaauuagauggaacuccauuccaucccuuugaaggaccagcaccuauaggauuuccugaucuaggaggaugcgauuggcacauaaacaugacacaauuuggccauucaucacaaacacaauaugauguugauaccacaccagauacauucguaccacaccuaggaucaauccaagcaaauggagucucaucaggcaauuacauaggcguacuuuccugggucucucccccaucacacccauccggaucucaaguagauuuauggaaaauaccaaauuacggaucauccauaacagaagcuacacaucuagcaccauccguuuaucccccuggauucggagaaguauuaguauucuuuaugucaaaaauaccaggucccggugcauauucccuuccaugcuuauuaccacaagaauacaucucucaucuagcaucugaacaagccccaacaguaggagaagcagcauuauuacacuauguugacccagacacaggacguaaccuuggagaauucaaagcauauccagaugguuuucucaccuguguuccaaauggagcuucaucaggaccacaacaauuaccaauaaacggaguauucguauucgucuccuggguaucacgauuuuaccaauuaaaaccaguaggaacagcuucuacagcaagauaa

SEQ ID NO: 34977 - RNA, 1572 nt, Artificial Sequence
  derived and/or modified sequence opt6 from VP1__Norovirus_and/or_Norovirus-like__KT943503
augaugauggcuucaaaagaugcaacuucaaguguugauggagcaucaggagcaggucaauuaguaccugaaguaaaugcuucagauccuuuagccauggaucccguagcaggaagcucuacagcaguagcaacagcaggacaaguuaauccuauagauccauggauaauaaauaacuucguacaagcuccucaaggagaauuuacaauaucaccuaacaacacaccuggugauguauuauuugauuuauccuuagggccucaccuuaacccauuuuuauuacacuuaucucaaauguauaaugguugggucggaaauaugagagucagaauuaugcuugcuggcaaugcauucacagcuggaaaaaucauaguaucauguaucccuccuggauuugguucccacaaccuaacaauagcacaagcaacacuauuuccucacguaauugcagacguuagaacacuugacccuaucgaagucccacuagaagacguuagaaauguucucuuccacaauaaugaucguaaucaacaaacuaugcguuuaguauguauguuauauacaccacuaagaacaggaggagguacaggagauucauucguaguagcuggaagaguuaugacauguccaucuccugacuucaauuuucuuuucuuagucccaccuaccguagaacagaaaacacguccauuuacacuuccaaaucuaccacuaaguucauuaaguaauucccgagcaccauuaccaauaucuucaaugggaauuucaccagauaauguucaaucaguacaauuucaaaauggcagauguacauuagauggaagacuuguuggaacaacaccaguauccuuaucacauguagcuaaaauacgaggaacuucaaacggcacaguaauaaacuuaaccgaauuagacggaacaccauuccauccuuuugaaggacccgcaccaauugguuuuccagaucuaggaggaugugauuggcauauaaauaugacacaauuuggacauucaucccaaacccaauaugauguagauacaacaccagauacauuuguaccucaccuaggaucuauacaagcaaauggaauuggcucaggaaacuacguaggaguccuaucuuggaucucaccuccuucucacccaucuggcucacaaguugaucuauggaaaauaccaaacuauggaucuaguauuacagaagcaacucauuuagcaccaucaguauauccuccaggauuuggugaaguucuaguauucuuuauguccaaaaugccaggacccggugcauauaaucuaccaugucuacucccacaagaauauauuucccaucuagcuucagaacaagcaccuacuguuggagaagcagcucuuuuacauuauguagauccagauaccgguagaaacuuaggagaauuuaaagccuauccagacggauuuuuaacaugcguaccaaauggugcuucuucuggaccacaacaauuaccaauaaauggaguauuugucuuuguaucauggguaucacgauuuuaucaauuaaaacccguugguacagcuucaucagcaagauaa

SEQ ID NO: 34978 - RNA, 1572 nt, Artificial Sequence
  derived and/or modified sequence opt6 from VP1__Norovirus_and/or_Norovirus-like__AY502016
augaugauggcaucaaaagaugcaacaucaaacguagauggagcaucuggagccggacaauuaguacccgaagcaaacacaucagauccauuagcaauggauccagucgcaggaucuucaacagcaguagcaaccgcaggacaaguaaauccaaucgauccuuggauaauuaauaacuuuguccaagcaccacaaggugaauuuacaauaucucccaauaauacuccaggagacguuuuauucgaucuaucacuagguccacaucuaaauccuuuccuauuacacuuaucacaaauguacaacggauggguaggaaauaugagaguaagaauaaugcuagcaggcaacgcauucacagcaggaaaaauaauagucucaugcaucccaccaggauucggaucacacaaccuuacaauugcucaaucaacacuauucccacacguuaucgcugacguaagaacucuagaccccauagaaguaccacuagaagauguaagaaauguacuuuuccacaauaacgaucgaaaucaacaaacaaugagauuaguaugcauguuauauaccccauuaagaacagguggaggaacaggcgauaguuucguaguagccggaagaguaaugacauguccaagcccagauuucaauuuucucuuucucguucccccuaccguagaacaaaagacaagaccauuuacauuaccaaauuuaccacuaucuucauuaucaaacucacgcgcaccacuaccaauaucuucuaugggcauaucaccugauaacguacaaucgguacaauuucaaaacggaagauguacucuagauggacguuuaguaggaaccacuccuguaucacuaucucaaguagcaaaaauacgagguacaucaaauggaacuguuaucaaucuaacagaauuagauggaacaccuuuucauccauuugaaggcccagccccaauagguuuuccagaccuuggaggaugugauuggcacguaaacaugacucaauuuggccauucgucacaaacacaauucgaugucgauaccacuccagaaaccuucguaccacauuuagguucaauccaagcuaacggaguaggaucaggcaacuacauaggaguacucucauggauaaguccuccaucucauccaaguggaucacaaguagaucucuggaaaauucccaacuauggaagcucaauaacagaagcaacacaucuagcaccaucaguauucccaccaggcuuuggugaaguauuaguauucuucaugucaaaaaucccaggaccaggcgcuuacaaucuuccauguuuacucccucaagaauacauaucccacuuugccagugaacaagcacccacugucggagaagcagcacuauuacauuacguagauccagauacaggaagaaauuuaggagaauuuaaagcauaucccgauggauucuuaacauguguaccaaauggcgccuccuccggcccucaacaauuaccaauaaauggaguauucgucuucguaucauggguaucuagauucuaucaacuaaaaccaguaggaacagcaucauccgcaagauaa

SEQ ID NO: 34979 - RNA, 1572 nt, Artificial Sequence
  derived and/or modified sequence opt6 from VP1__Norovirus_and/or_Norovirus-like__KU253446
augaugauggcaucaaaagaugcuaccuccuccguagauggagcuucaggugcaggacaacuaguuccagaaguaaacgcaucagacccacuagcaauggaccccguugcaggaucaucaacagcaguugcuacugcaggacaagucaauccaauagaucccuggauuauaaauaacuuuguacaagccccacaaggcgaauuuacaauaucuccaaauaauacuccaggugauguauuguuugaucucucauuaggaccucauuuaaauccauucuuacuucaccuuucccaaauguauaacggauggguagguaauaugagaguuagaauuaugcuugcaggaaaugcauuuaccgcaggcaaaauuauaguaucuuguauaccacccggauuuggaucacauaauuuaacaauagcucaagcaacacuuuucccucacguaauagcagauguuagaacauuagauccuauagaaguaccauuagaagauguccgaaacguccuuuuccacaacaacgaucguaaccaacaaacaaugagacuugucugcauguuauacacaccauuaagaacaggcggaggcaccggcgacuccuuuguaguggcuggacguguaaugacauguccauccccagacuuuaauuuucuauuucuaguaccaccaacuguagaacaaaaaacuagaccauucacucucccaaaccuaccauuaaguucacucucaaauucaagagcaccauuaccaauuucauccaugggaauauccccugauaacguacaaucuguucaauuccaaaauggaagauguacauuggauggacgucuaguaggcacaacaccaguaucauuaagucacguagcuaaaauaagaggcacaucaaacggaacuguuauaaaucucacugaacuagauggaacaccauuucauccauuugaagguccagcacccauaggauuuccagaucuaggagguugcgauuggcacauaaauaugacacaauucggacauuccucccaaacccaauacgacguagacacuacaccagauacauuuguaccacauuuaggaucuauacaagcaaaugguauaggaucaggcaauuauguaggaguacuaucauggauaucccccccaucccauccaaguggaucacaaguagauuuauggaaaauaccaaauuacggaaguucuauuacagaagcaacacaucucgcaccaucaguuuauccaccaggauuuggugaaguucuaguauuuuuuaugaguaaaaugccaggacccggagcauacaacuuaccauguuuacuaccucaagaauacauaagccaccuagcaucagaacaagcaccuacaguaggagaagcagcauuguuacauuacguagauccagauacaggaagaaauuuaggagaauucaaagcauauccagauggcuuuuuaacauguguaccaaauggagcuucuucugguccucaacaauuaccuauuauaggaguauuuguauucguaucauggguaucaagauuuuaucaacuaaaaccuguaggaacagcaucaagugcccgauaa

SEQ ID NO: 34980 - RNA, 1572 nt, Artificial Sequence
  derived and/or modified sequence opt6 from VP1__Norovirus_and/or_Norovirus-like__KU253445
augaugauggcaucaaaagaugcuacaagcucaguugauggagccucaggcgcuggacaacuaguacccgaaguuaacgccucagauccacuagcaauggauccagucgcaggauccuccacugcuguagcuacagcuggacaagucaaccccauagacccauggaucauaaauaauuucguacaagcaccacaaggagaauuuacuauaucuccaaacaauacaccuggugaugucuuauuugaccuuucauuaggaccacaucuuaacccauuucucuuacaucuuucacaaauguauaacggaugggucggaaauaugagaguaagaauaaugcuugcaggaaaugcuuuuacagcuggaaaaauaauuguaucuuguauacccccaggauuuggaucacauaauuuaacaauugcacaagcaacucuauucccacauguuauagcagacguuagaacacuugacccaauagaaguaccucuugaagaugugcgaaacgucuuauuucauaauaacgaucgcaaucaacaaaccaugcgacuuguaugcaugcuauacaccccacuucgaacuggaggcggaacaggagauucauuugucguagccggaagaguuaugacuuguccuucaccagacuuuaauuuucuauuccuuguacccccaacaguagaacaaaaaacacgaccuuuuacacuaccaaaucuaccacuaucaucacuuucaaacucccucgcaccacuaccuauaucuucuaugggaauaucuccagacaacguacaaucaguacaauuucaaaauggucgauguacauuagauggcagauuaguagguacaacaccaguaaguuuaucacacguagcuaaaauaagaggcacaaguaacggaacuguaauaaaucuaacugaacuagauggaacaccuuuccauccauuugaaggacccgcaccuauaggcuuucccgauuuagguggaugugacuggcacauaaacaugacacaauucggacauucaagccaaacccaauacgauguagacacaacaccugauacauucguaccacacuuaggaucaauacaagcaaauggaauaggcucaggcaauuauguuggaguacuaucauggauuucaccaccuucacacccaucuggaucacaaguagauuuauggaaaaucccaaauuacggaucaucaauuaccgaagcuacacaucuagcuccauccgucuauccaccuggauucggugaaguacuaguauuuuuuaugucaaaaaugccaggaccuggagcauauaauuuaccauguuuauuaccgcaagaauauauaucucauuuagcaucagaacaagcaccaaccguaggugaagccgcacuucuacauuauguugacccagauacaggaagaaaccuaggagaauucaaagcauaccccgauggauuccucacuuguguaccaaauggagcaucaucaggaccacaacaauuaccaaucaacgguguauuuguauuuguauccuggguaaguagauuuuaucaacuaaaaccaguaggaacagcauccuccgcacgauaa

SEQ ID NO: 34981 - RNA, 1572 nt, Artificial Sequence
  derived and/or modified sequence opt6 from VP1__Norovirus_and/or_Norovirus-like__KF039735
augaugauggcaagcaaagacgcuacaucaucuguugauggagcaucaggagcaggucaacucguaccagaaguuaacgcaucagauccacuagcuauggauccaguagcagguucuucuacagcuguagcaacuacaggacaaguaaacccuauugacccauggauaauaaauaauuuuguacaagcaccacaaggagaauuuaccauaucaccaaauaauacaccaggugauguccuauuugauuuaucacuagguccacauuuaaauccauuucuauuacauuuaucacaaauguauaauggcuggguugguaauaugagaguacguaucaugcuagcaggaaaugccuuuacugcaggcaaaauaaucguaucuuguaucccaccagguuuuggaucacacaauuuaaccauagcacaagcuacccuauucccacacgucauugcagauguaagaacucuagauccaauagaaguaccauuagaagacguuagaaacguccuuuuccauaauaaugauagaaaucaacaaacaaugagacucguauguaugcuauacacaccauuaagaacaggaggcgguacaggagauucauuuguaguagcaggucgaguaaugaccugcccauccccagacuuuaauuuucuauuccugguaccacccacaguagaacagaaaacacgcccauucacauuaccaaacuuaccccuauccucauuaucuaacucaagagcaccauuaccaauaucaucuaugggaauaucaccugauaacguucaauccguucaauuucaaaauggccgauguacauuagacggacgacuuguagguacaacacccguuucucuaucucauguugccaaaauuagaggaacaucaaacggaacaguaauaaaccuaaccgaacuagauggaacaccauuucaucccuuugaaggacccgcuccuauuggauuccccgaucuuggugguugugauuggcauauaaauaugacacaauuuggucacucaucccaaacacaauacgauguugauaccacaccagauacauuuguaccccacuuaggaucaauucaagcaaaugggaucgguucaggcaacuacguaggaguacuaucauggauaucuccaccaucucacccaucugguagucaaguagaucuuuggaaaauaccaaacuacgguucaucuauaacagaagcuacucacuuagcuccaucaguauauccuccaggauuuggcgaaguauuaguauucuuuaugucuaaaaugccagguccaggcgcuuauaauuuacccugcuuauuaccacaagaauacauaucacauuuagcaagugaacaagcgccaacaguaggagaagcagcuuuacuacauuacguugacccugacacuggcagaaaucuaggagaauuuaaagcauauccugauggcuuucuaacuuguguaccaaauggagcaucaucaggaccacaacaacuaccuauuaauggaguauuuguauuuguaaguugggucuccagauuuuaucaauuaaaacccguuggaacagcaucaucagcuagguaa

SEQ ID NO: 34982 - RNA, 1572 nt, Artificial Sequence
  derived and/or modified sequence opt6 from VP1__Norovirus_and/or_Norovirus-like__KF039732
augaugauggccuccaaagacgcuacaucuucaguugauggagcaucaggagcaggacaauuaguaccagaaguaaaugcaagugauccacucgccauggauccaguagcaggaaguucaaccgcaguggcaacagcuggucaaguaaauccuauagaucccuggauuauaaauaacuuuguacaagcuccacaaggagaauuuacuauaucaccuaacaauacaccaggagauguauuauuugaucuaucucuaggaccccauuuaaauccauuccuauuacaccuuucucaaauguacaauggauggguaggaaauaugagaguucgaauaaugcuagcagguaacgcuuuuacagcaggcaaaauaauagucucauguauaccaccagguuuuggaucccacaacuuaacaauagcacaagcuacauuauuuccacauguaauagcagauguuagaacacuagacccuauagaaguuccccuagaagacguaagaaauguacuauuucauaauaaugauagaaaucaacaaacuaugcguuuaguauguaugcuauauaccccucuacgaacaggugguggaacaggagacucauuuguaguagcaggaagaguaaugacaugcccaucaccagauuuuaacuuccuuuuucuaguaccaccaaccguugaacaaaagacuagacccuucacauugccaaaccuaccacuaucaucauuaucaaacucuagagcuccacucccaauaucaucuaugggaaucucaccagauaacguacaaucaguccaauuccaaaacggaagauguacauuagacggacgauuagucggaacaaccccaguaucauuaucucaugucgccaaaauacgcggcacaucaaacgguacagucauaaaucuaacagaauuagauggaacucccuuccauccuuuugaaggaccagcacccauaggcuuuccugaccuagguggaugcgacuggcauauaaauaugacacaauucggacacucuagucaaacccaauaugacguagauaccacaccuguuacauucguaccacaccucggaucuauacaagcaaacggaauaggaucuggaaacuacguaggaguauuauccuggauaucuccacccucucauccuucugguucacaaguugaucuauggaaaauuccuaauuauggaucaucaauaacagaagccacacaucuugcuccauccguuuaucccccugguuuuggagaaguucuaguauucuuuaugagcaaaaugccaggaccgggugcauauaaucuaccauguuuacuuccucaagaauacauaucacacuuagcaucugaacaagcaccuaccgucggugaagcagcucuacuacacuauguugauccagauaccggaagaaauuuaggagaauuuaaagcauacccagauggcuuuuuaacauguguaccuaauggcgcuucaucagguccacaacaacuaccaaucaauggcguauuuguuuuuguauccuggguuucucgauuuuaucaacuaaaacccguaggcacagcaucuucagcaagauaa

SEQ ID NO: 34983 - RNA, 1572 nt, Artificial Sequence
  derived and/or modified sequence opt6 from VP1__Norovirus_and/or_Norovirus-like__KF039734
augaugauggccagcaaagaugcaacaucaucaguagauggagcuucaggagcaggucaauuaguaccugaagucaaugcuucagacccucuagcaauggauccaguagccgguucaucaacagcaguagccaccgcuggacaaguaaauccaauagauccauggauaauaaauaacuucguacaagcaccucaaggagaauuuaccauuucucccaacaacacaccaggcgaugucuuauucgaucuaucauuaggaccacacuuaaauccauuucuacuacauuuaucucaaauguauaacggauggguagguaauaugagaguaagaauaauguuagcaggcaaugcauucacagcaggcaaaauaauuguuucaugcauuccuccaggauuuggaucacacaaccuaacuauagcacaagcuacacuauuuccucacguuauagcagacguacgaacauuagauccaauagaaguaccauuagaagacguacgcaacguauuauuccacaauaacgauagaaaucaacaaacaaugagauuagucugcauguuauacacuccauuacgaacaggaggaggcacaggagacagcuuuguaguagcaggaagaguaaugacauguccaucaccagacuucaauuuucuauuucuaguaccaccaacaguagaacagaaaacacguccuuucacacucccaaacuuaccauuauccucccuaucaaacucacgagcaccauuacccauaucaucaaugggcaucucaccugauaacguccaaucaguacaauuccaaaacggucgauguacauuagauggcagauuaguagguaccacacccguuucauuaucccaugucgcaaaaauaagaggaacaucuaauggcacaguaauaaaccuaacagaacuagacggaacacccuuucaccccuuugaaggaccagcacccauagguuuucccgaucuaggaggcugugauuggcacauaaacaugacucaauucggacauucaucacaaacccaauacgauguugacaccacaccagacacauuugucccacaucuaggauccauucaagcaaauggaaucggaaguggaaauuacguaggaguguuaucuuggauaucaccuccuucaagaccuucaggaucacaaguugacuuauggaaaauaccuaauuacgguucauccauaacugaagcuacacauuuagcaccaucaguuuauccucccggauuuggagaagucuuaguauuuuucauguccaaaaugcccggaccaggcgcauacaacuuaccaugucuacuaccacaagaauauauaucucaucuagccucagaacaagcaccaacagucggugaagcagcacuacuacauuauguagacccagacacagguagaaaccuaggugaauuuaaagcauaccccgauggcuucuuaaccugcguaccaaacggagccuccucagguccucaacaauuacccauuaauggaguauucguauucguuucauggguaucaagauucuaccaauuaaaaccaguagguaccgccucauccgcaagauaa

SEQ ID NO: 34984 - RNA, 1572 nt, Artificial Sequence
  derived and/or modified sequence opt6 from VP1__Norovirus_and/or_Norovirus-like__KF039729
augaugauggccaguaaagacgcaacaucaaguguagauggagcaucaggagcaggacaacuuguaccagaaguaaaugcaucugauccauuagcaauggauccagucgcaggaucuucgacagcaguagcaacagcaggacaaguaaauccaauagacccauggauaauaaauaacuuuguucaagcaccacaaggggaauuuacuauuagcccuaacaauaccccgggugauguuuuauucgaucuaucauuaggaccacaucuaaauccauucuuauuacaucuaagccaaauguauaauggauggguuggcaacaugagaguaagaauaauguuagccggaaacgcauucacugcuggaaaaaucauuguaucuugcauaccaccaggauucggcagucacaaccuaacaauagcacaagcuaccuuauuuccacauguaauugcagacguacguacacuagauccaaucgaaguaccucuagaagacguuagaaacguacuauuucauaauaaugaucgaaaucaacaaacuaugcgauuaguuugcauguuauauacaccacucagaacaggaggaggaacaggagauucauucguagucgcuggaagaguaaugacauguccuucuccagacuucaauuuucuuuuucuaguucccccaacaguagaacaaaaaacacgaccauucacacuaccuaaucuaccauuaucuucucuaucuaauucaagagcuccacuucccauaucauccaugggaauaucacccgauaacguacaaucaguacaauuucaaaacggccgauguacucuagacggaagauuaguaggaacuaccccaguaucacuaucacaugucgcuaaaauacgcggaacuucaaauggaaccguaaucaaucuaaccgaauuagacggaacuccauuccauccauuugaaggaccugcaccaauaggauuuccagaucucggaggaugcgacuggcacauaaauaugacucaauuuggacacucaucucaaacacaauaugacguagacacaacuccagauaccuuuguaccacaucuuggauccauacaagccaacggaguaggaucuggcaacuacguuggaguacucucuuggauaucaccaccaucucacccaucagguucucaaguagauuuauggaaaauacccaauuauggauccucaauaacagaagcuacacauuuagcaccuucaguauauccaccaggcuucggcgaaguacucguauuuuuuaugucaaaaaugccaggacccggcgcuuacaauuuaccauguuuauuaccacaagaauacauaucacaucuagccucagaacaagcaccuacaguuggugaagcagccuuauuacauuaugucgaucccgauacuggacguaaccucggcgaauucaaagcuuaucccgauggauuuuuaacauguguaccuaauggagcaucaucugguccacaacaacuaccuauaaauggaguauucguauuuguaucauggguaucaagauuuuaucaacuaaaacccguagguacagccuccucagcaagauaa

SEQ ID NO: 34985 - RNA, 1572 nt, Artificial Sequence
  derived and/or modified sequence opt6 from VP1__Norovirus_and/or_Norovirus-like__KF039737
augaugauggcaucaaaagacgcuacaucaaguguagacggagcaucaggugcaggacagcuaguaccugaaguaaaugcaucagauccacuagcaauggauccaguagcaggaucaucaacagcuguagcaacugcaggacaaguaaauccaauagacccauggauaauaaauaacuuuguacaagcaccacaaggugaauuuacuauaucaccuaauaauaccccaggagauguacuauucgaccucucacuaggaccacauuuaaacccauuuuuacuacaccuuagccaaauguauaacgguuggguaggaaauaugcgagucagaaucaugcuagcaggaaacgcauuuaccgcaggaaaaauaauugucucauguauuccaccaggauuuggaucucauaauuuaacaaucgcccaagcaacacuauucccacauguuaucgcagacguacgaacacuagauccuauagaaguaccauuagaagauguacgaaacguauuauuccauaauaaugauagaaaucaacaaaccaugagauuaguauguauguuauacaccccacuccgaacaggaggaggaacaggugauagcuuuguaguugccggccguguuaugacaugcccaucaccugauuuuaauuuucucuuucuaguuccaccuaccguagaacagaaaacacgccccuucacucuaccaaaccuuccacuaucaucucuaucuaauucaagagcaccacuuccaauauccucaaugggaauaucaccugauaacguccaaucaguacaauuccaaaauggaagauguacacuagacggacgcuuaguaggaacuacccccgucucauuaucacauguagcaaaaauaagaggcacaucuaauggcacaguaaucaauuuaacugaauuggauggaacaccauuccauccauuugaaggacccgcaccaauaggauuuccagauuuagguggaugcgacuggcauauaaacaugacacaauucggacacucuucccaaacacaauacgauguaaauaccacaccugacacauuuguaccucaccuaggcucaauccaagcaaacggcauagguucaggaaauuauguugguguauuaaguuggauaaguccaccaucucaccccuccggcucacaaguagaucuauggaaaauuccaaacuacgguucaucaauaacagaagcuacacacuuagcuccaucuguauauccaccuggauucggagaagucuuaguauucuuuaugucaaaaaugccagguccaggagcauauaaccuaccuugccuauuaccacaagaauacauaucacaucuagccucagaacaagcaccaacaguaggagaagcagcuuuauuacauuacguagaccccgacacuggacgaaaccuuggagaauuuaaagccuauccagauggauuucuaacuugcguacccaacggagcaucaucaggcccacaacaauuaccuaucaauggcguauucguuuucgucuccuggguuucaagauucuaccaacuaaaaccaguugguacagcuucaagcgcaagauaa

SEQ ID NO: 34986 - RNA, 1572 nt, Artificial Sequence
  derived and/or modified sequence opt6 from VP1__Norovirus_and/or_Norovirus-like__KF039731
augaugauggcuucaaaagacgcaacaucaucagucgacggagccucaggagcaggacaauuaguuccagaaguaaaugcaucagauccucuagcaauggauccuguugcagguucauccacagcuguagcaacagcaggacaaguuaaucccauagaucccuggaucauaaauaacuucguacaagcaccacaaggagaauuuaccauaucuccuaauaauacuccuggagacguuuuauucgaucuaucauuaggaccacacuuaaauccauuuuuacuacauuuaucacaaauguacaaugguuggguuggcaacaugagagucagaauaaugcuagcuggaaacgcauucacagcaggaaaaauaauaguaucaugcauuccaccagguuuuggaucucacaaucugacaauagcccaagcaacacuauuuccacauguuauagcugauguccgaacacuagaucccauagaaguacccuuagaagauguaagaaaugucuuauuucauaauaaugauagaaaucaacaaacaaugcgauuaguuuguaugcuauauacaccuuuaagaacaggaggagguacuggagauucuuuuguaguagcaggacgagucaugaccugccccucaccugauuucaacuuccuauucuuaguacccccuacuguugaacaaaagacuagacccuucacacuaccuaacuuaccacuaucauccuuaucuaacucccgagcaccauuaccuauuucaucuauggggauaucuccagauaacguacaaucaguccaauuucaaaacgguagauguacauuagacggaagauuaguuggaaccacucccguuucacuaucacauguugcaaaaauaagaggaacuucuaacggcacaguaauuaaucuaacagaauuagacggaaccccauuccauccuuucgaaggacccgcaccuauuggauuuccagaucuuggaggaugugauuggcauauaaacaugacccaauucggccauucaucacaaacacaauacgauguagauacaacacccgauauuuucguaccacauuuaggaucuauucaagcuaacgguauaggaaguggaaauuauguaggaguacuaucuuggauaucaccaccaucacauccuucaggcucacaaguagaucuauggaaaauaccuaacuauggaucaucaauaacagaagcuacacaucucgcaccauccguauacccaccaggauucggagaaguauuaguauucuuuaugucuaaaaugccaggcccaggcgcauauaaucuacccugucuacucccacaagaauacauaucacaucuagcaucugaacaagccccaacaguaggagaagcugcacuauuacacuacguagacccagacaccggucgaaaccuaggcgaauuuaaagcauauccugauggauuuuuaacauguguaccuaauggagcuucaucaggaccacaacaauuacccaucaauggaguauuuguauucguaucauggguuucuagauuuuaccaacuaaaaccaguaggcacagccucauccgcuagauaa

SEQ ID NO: 34987 - RNA, 1563 nt, Artificial Sequence
  derived and/or modified sequence opt6 from VP1__Norovirus_and/or_Norovirus-like__KT732279
augaugauggcuucaaaagacgcaacuuccucaguagauggagcauccggagcaggacaacuuguaccugaaguaaaugcaucagacccucuagcuauggaccccgucgcuggaucaucaacagccguagcaacagcaggacaagucaauccaaucgaccccuggauuauuaauaacuucguacaagcuccacaaggagaauuuacaauuucaccaaauaauacuccaggagauguacucuuugauuuaucauuaggaccccaccuaaacccauuuuuacuacacuuaucacaaauguauaacggauggguaggaaauaugagaguaagaauaaugcuagcaggcaacgcauuuacagcaggcaaaaucauaguaucaugcauuccaccgggauuuggaucacacaaucuaacaauugcacaagcuacauuauuuccacacguaauagcagacguuagaacuuuagaucccauagaaguaccucuagaagacguaagaaauguucuauuccauaauaaugauagaaaccaacaaacuaugagacuuguauguaugcuauacacaccacucagaacaggcggaggaacaggagauagucuaguaguugccggaagaguaaugacuugcccuucaccugauuuuaacuuucuauucuuaguaccaccaacaguagaacagaaaacacgacccuuuacccuuccaaacuuaccacuaucaucauuaucuaauucacgagcacccuuaccaauaucuggaaugggaauaucaccugauaacguacaaucaguccaauuucaaaauggaagauguacuuuagauggcagauuagucggaacuacaccaguaucacuaagccauguagcaaaaauaagagguacaucaaauggaacaguuauuaaccuaacagaauuagacggaacaccauuccauccuuucgaaggacccgcuccuauaggauuucccgaucuaggaggaugcgauuggcauauuaauaugacacaauucggccacucaucucaaacacaauacgauguagauacaacaccugauacauuuguaccacauuuaggauccauacaagcaaaugguauaaacucuggcaauuauauaggaguacuaucauggguaaguccaccaucacaccccagugguucacaaguugaucuauggaaaauaccaaauuacggaucuucuaucacugaagcaacacaucuagcacccucuguuuuuccuccaggcuuuggagaaguuuuaguauucuuuaugucuaaaauaccuggaccaggugcauacucucuaccauguuuauuaccacaagaauauauaucacaccuugccucugaacaagcacccacaguaggugaagcugcauuauuacacuacguagaccccgacacaggaagaaacuuaggagaauuuaaagccuacccagaugguuucuuaaccugcguuccuaauggugccucaucugguccccaacaauuaccaauuaacgguguauuuguauucgucaguugggucucuagauucuaccaacuuaaaccuguaggaacagcaucauaa

SEQ ID NO: 34988 - RNA, 1563 nt, Artificial Sequence
  derived and/or modified sequence opt6 from VP1__Norovirus_and/or_Norovirus-like__FJ384783
augaugauggcaucaaaagacgcaaccucuucaguagacggagccucaggagcaggacaacucguaccagaaguuaaugcuucagauccauuagcaauggaucccguagcaggaucuuccacagccguagccacagcaggacaaguaaauccaauagauccauggauaauuaauaacuuuguacaagcaccacaaggagaauucacuauaucaccaaauaacaccccaggugauguuuuauuugaucuuucauuaggcccacauuuaaaccccuuuuuacuucauuuaagccaaauguauaauggauggguagguaauaugagaguucgcauuauguuagcaggaaaugcauuuacagcaggaaaaauuauaguuucaugcauuccacccggauuugguucucauaaccuuacuauagcucaagcaacccucuucccacauguuauagccgacgucagaacucuugauccuauagaaguaccauuagaagauguaagaaauguacuuuuucacaacaaugaucguaaccaacaaacaaugagauuaguauguaugcucuauacaccauuaagaacuggaggaggaacaggugauucuuucguaguugcaggaagaguaaugacuuguccauccccagauuucaauuuccuauucuuaguaccaccaaccguagaacaaaaaacacgucccuuuaccuuaccaaaucucccucuaucaucccuauccaacucaagagcaccuuuaccaauuucaggaaugggaauuucaccagacaauguacaaucaguacaauuccaaaauggacguuguacucuagauggaagacuuguaggaaccacacccgucucauuaucacauguugcaaaaauacguggaacaucaaacggaacaguaauaaauuuaacagaauuagauggaaccccauuucacccauuugaaggaccagcaccaaucgguuuuccagaucuuggaggaugugauuggcacauaaauaugacucaauucggacacucaucacaaacccaauaugacguugauaccacaccugauaccuucguaccacauuuagguucaauacaagcaaaugguauaaacucaggaaauuauauaggcguauuauccuggguaaguccaccaucccaucccucugguucccaaguagauuuauggaaaauuccaaauuauggaucaucaauuaccgaagcaacacaccuagcacccuccguuuuuccaccaggcuuuggcgaaguauuaguauuuuuuaugucaaaaaucccaggaccaggcgcauauucucuaccaugucuuuuaccacaagaauauauaucacaucuagcuucagaacaagcuccaacaguaggagaagcagcacuacuacauuauguagauccagauacagguagaaaucuuggagaauuuaaagccuauccugauggauuuuuaacauguguaccaaauggagcaucuucaggaccacaacaauuaccaauaaacgguguauuuguauucguaucauggguauccagauuuuaccaacuuaaaccuguaggaacagcaucuuaa

SEQ ID NO: 34989 - RNA, 1563 nt, Artificial Sequence
  derived and/or modified sequence opt6 from VP1__Norovirus_and/or_Norovirus-like__EU085522
augaugauggcuucaaaagacgcaacaucuucuguugacggugcaucaggagcaggacaauuaguaccagaaguaaaugccucagauccacuagcaauggauccagucgcuggaagcucuacagcaguagccacugcuggacaaguaaauccaauagauccauggauaauaaauaacuuuguacaagcuccacaaggagaauuuacaauaucaccaaauaauacaccuggugauguccuuuucgaccuaagucuagguccucaucuaaaucccuuucuacuacaucuaucacaaauguauaacgguuggguaggaaauaugcguguuagaaucauguuagcaggcaacgcuuucacugcaggaaaaauaauaguaucauguaucccaccaggauucgguucacacaauuuaacaauagcucaagcaacacuauuuccacauguuauagcagauguuagaacuuuagacccaauagagguuccccuagaagauguaagaaauguacuuuuucauaauaacgauagaaaucaacaaacaaugagacuuguauguaugcuauauacaccauuacgcacugguucuggaacaggagacucauuugucguagccggucgaguuaugacaugcccaucaccugauuuuaauuuucucuuucuaguaccaccuacaguugaacaaaaaacacgaccuuucacacuaccaaacuuaccauuauccucacuaaguaacucuagagccccauuaccaauuucaggaauggguauaucuccagacaacguucaaucaguccaauuucaaaacgguagauguacuuuagaugguagacuaguagguacuacuccaguuucccuaucacauguagcaaaaauucgaggcaccucaaacgguacaguuauaaaucuaaccgaacuagauggaacaccauuucaccccuuugaagguccagcuccaauaggauucccagaucuuggaggaugcgauuggcacauaaacaugacucaauucggucauucaucccaaacucaauacgacguagacacuacacccgauacauuuguaccacaccucggaucaauacaagcaaauggaauaaacucaggaaauuauauuggcguauuaucuuggguaucaccaccaucacacccaucaggaagucaaguagaccuauggaaaauuccaaauuacggaucauccaucacagaagcaacacaucuagcaccaucagucuucccaccgggcuuuggagaaguauuaguauuuuucaugucaaaaauaccuggaccaggagcauacucacuaccuugucuauuaccacaagaguauauaucacauuuagcuucugaacaagcuccaacaguaggcgaagcagcucuucuacauuauguagauccagacacaggacguaacuuaggugaauuuaaagcuuauccugauggauucuuaacuuguguuccaaauggagcaucuucugguccacaacaauuaccaaucaauggaguauuuguuuucguauccuggguuucaagauuuuaucaacuaaaaccaguaggaaccgcuucauaa

SEQ ID NO: 34990 - RNA, 1563 nt, Artificial Sequence
  derived and/or modified sequence opt6 from VP1__Norovirus_and/or_Norovirus-like__L23828
augaugauggcaucaaaagacgcuacuuccucaguagacggagcuucagcaucuguacaauuaguaccagaaguaaacgcuucagauccacuagcaauggacccaguagcaggaucuucaacagcugucgcuacagcaggccaagucaauccaauagauccuuggauaaucaacaauuucguacaagccccacaaggagaauuuacaauauccccaaauaacacaccaggcgauguacuauuugauuuaucacuagguccucauuuaaacccauuuuuacuucaccuaucccaaauguauaauggauggguaggaaacaugagaguaagaauaaugcuagcaggaaaugcauuuacagcaggaaaaauaauaguaucauguauuccaccaggcuuuggaucacaacaauuaacaauagcacaagcaaccuuauuuccacacguuauagcagauguaagaacauuagaucccauagaagucccacuagaagauguacguaauguacuauuccauaauaacgaucgaaaucaacaaacaaugagauuaguauguaugcuauauacaccuuuaucuacaggaggcggaacaggugauucuuuuguuguagcaggacgaguuaugacuuguccuucgccagauuuuaauuuccuauuucuaguaccaccaacaguagaacagaaaacucgaccauuuacauuaccaaaucuuccucucucaucccuaucaaacucacgagcuccucuaccuauauccggaauggguauaucucccgauaauguacaaaguguacaauuucaaaauggaagauguacuuuagaugguagauuaguaggaacuacaccuguuucucuaucccauguagcaaaaauaagagguacaucaaauggcacaguaauaaaucuaacagaacuagauggcaccccuuuucauccauuugaaggaccagcaccaauaggauucccagacuuagguggaugugacuggcacauuaauaugacucaauuuggacauucaucacaaacucaauacgauguagauacuacaccugauacuuccguuccacauuuagguucaauacaagcaaauggaauuggaucaggaaauuacauaggcguacuaucauggguuuccccuccaucccauccuucagguagucaaguagaccucuggaaaauaccaaacuauggauccucaauuacugaagcaacacaccuagccccuucaguuuauucaccaggauuuggagaaguuuuaguauucuuuaugucuaaaauacccggccccggaggagauaguuuaccaugcuuauuaccacaaggauauaucucccaucuagcauccgaacaagcaccaacaguaggagaaggcccacuauuacauuauguagauccagauacagaucgaaauuuaggagaguucaaagcauacccagauggauuuuuaacauguguuccuaauggagcaucaucugguccacaacaacuaccaauaaauggaguauucguauuuguaucuuggguaucuagauuuuaucaacuuaaaccaguaggaacugcaucauaa

SEQ ID NO: 34991 - RNA, 1563 nt, Artificial Sequence
  derived and/or modified sequence opt6 from VP1__Norovirus_and/or_Norovirus-like__KX764843
augaaaauggcaucuaacgaugcagcaccaucaaacgacggagcugcaggauuaguuccagaaggcaacaaugaaacacugccacuagaaccagucgcuggagcagcaaucgcggcaccaguuaccggccaaaacaacauaauugauccauggauacgaacaaauuucguacaagccccuaacggagaauuuaccguaucuccaagaaacucaccaggagaaguuuuauuaaaucuagaauuaggacccgaucuaaauccauaucucgcccacuuauccagaauguacaacggauacgcaggaggcgucgaaguccaaguucuucuagcuggcaaugcauucaccgccggaaaaauauuauucgcagcaguaccaccaaauuuucccguagaauuucuaucaccagcccaaauaacaauguuaccacacuuaaucguagacguucguacucuugaacccauuaugauaccucucccagauguaagaaauacauucuuucacuauuccaaucaacccaacagcagaaugagauuaguagcuaugcuauacacaccucuaagauccaacgguuccggagaugauguuuuuacuguaaguuguagaguacuaacacgaccaacaccagauuuugaauuuacauaucuaguucccccuucaguugaaaguaaaaccaaacccuuuucauuaccuauuuuaacauuaucugaacuaacaaauucaagauuucccguaccaauugacucacuauuuacagcacaaaauaacguccuacagguacaaugucaaaauggacgauguacauuagauggagaauuacaaggaacaacacaacuacuacccucaggaauaugcgcauuuagaggaagaguuacagcacaaauaaaccaaagagauagauggcacaugcaacuacaaaauuuaaacggaacaacauaugacccuaccgaugacguucccgcaccauuaggaaccccagauuucaaaggugugguauucggaaugguuucacaaagaaacguaggaaacgacgcuccagguucuacaagagcacaacaagcauggguaucaacauauagcccccaauucguaccaaaacuaggaucuguuaaucuucgaauaucagauaacgacgacuuccaauuccaaccaacaaaauuuacaccaguaggaguuaaugaugacgacgauggccacccauucagacaaugggaauuacccaauuauucaggcgaauuaacccuaaauaugaaucuagccccaccaguugccccuaacuuucccggugaacaacuacuuuucuuuagaucauuuguaccauguaguggaggauacaaucaaggcauaauagauugccuaauaccacaagaauggauacaacauuucuaccaagaguccgcuccaucacaaucagauguagcauuaauaagauacguaaacccagacacaggaagaacacuauuugaagcaaaacuacacagaucagguuauauaacaguugcacauucuggcgauuauccauuaguaguacccgcaaacggacacuucagauuugacgcuugguaa

SEQ ID NO: 34992 - RNA, 1563 nt, Artificial Sequence
  derived and/or modified sequence opt6 from VP1__Norovirus_and/or_Norovirus-like__KX764841
augaaaauggcuuccaaugaugcagccccaucaaaugauggagcagccggauuaguaccagaaggcaauaaugaaacacucccacuggaaccagucgccggugcagcuaucgcugcuccaguaacaggacaaaauaauauaauagauccauggauacgaacaaauuuuguccaagcaccaaauggagaauuuacaguaucaccccgaaauucaccaggcgaaauacuauuaaaucuagaauuaggucccgauuuaaaucccuaucuugcacacuuaucaagaauguauaaugguuacgcaggaggaguagaaguacaaguauuauuagcaggaaaugcauucacagcagguaaaauacuauucgcagcaguuccacccaauuucccaguugaauuucuauccccagcccaaauaacaaugcuaccccaccuaauaguagacguaagaacacuugaaccaaucaugauuccccucccugacguaagaaauacuuucuuccacuacucaaaucaaccaaacagccgaaugcgauuaguagcaaugcuauauacaccacuaagaucaaacggcucuggcgacgacguauucaccguuucuuguagaguauuaacacgaccaacaccagacuuugaauuuaccuacuuagucccuccaucaguugaaucaaaaaccaaaccauuuucacuacccauccuaacauuaucugaacuuacaaacucucguuucccagucccaauagacucacuauuuacugcucaaaacaacguccuccaaguacaaugccaaaacggacgaugcacucuugauggagaacuccaaggaacaacacaacuacuaccaucggguauaugugcauuucgcggacguguaacagcacaaauaaaccaaagagauagauggcgaaugcaauuacaaaauuuaaauggaacaacauaugauccuacugaugacguuccagccccacuaggaacacccgauuuuaaaggcguuguauucggaauggucucucaaagaaacgucggcaaugacgcaccagguucaacucgagcacaacaagccuggguaucuacauauucaccacaauuuguaccaaaacuaggaucaguuaaccuacgaauaucugauaaugacgauuuucaauuucaaccaacaaaauucacuccaguaggaguaaaugaugaugacgacggacauccauuucgccaaugggaauuaccaaauuauucuggcgaauuaacacucaauaugaacuuggcaccaccaguagccccuaacuuuccaggagaacaauuauuauucuuucgcucauucguuccauguucaggcggauauaaucaaggaauaauagauuguuuaauaccacaagaauggauacaacauuuuuaucaagaaucugcaccaucacaaucagauguugcauuaauaagauacgucaaucccgacacuggaagaacacuauucgaagcaaaacuacacagauccggauauauuacuguagcacauucuggaggauacccucuaguaguaccagcaaacggacauuuuagauuugaaucaugguaa

SEQ ID NO: 34993 - RNA, 1563 nt, Artificial Sequence
  derived and/or modified sequence opt6 from VP1__Norovirus_and/or_Norovirus-like__KX764840
augaaaauggccucaucagacgcagcaccaucaaaugauggagccgcuggacuuguuccagaaggaaacaaugaaacauuaccuuuagaaccaguagcaggcgcagcaauagcagcaccugucacaggacaaaacaacaucauagacccauggauacgaacuaacuuuguacaagcaccuaacggagaauuuaccgucagcccccgaaauucaccaggagaaauccuucuaaaccucgaauuaggaccagacuuaaacccauaucucgcacacuuauccagaauguauaacggcuaugcuggaggaguagaaguacaaguacuauuagcuggaaaugcauucaccgcuggaaaaauauuauuugcagccguuccacccaacuuuccaguagaauuucuaucaccagcucaaauaaccaugcuaccacauuuaauuguagacgucagaacucuagaaccuauaaugauaccacuaccagauguacgaaacacauucuuccauuauagcaaccaaccaaacuccagaaugcgccuuguagcuauguuauacacaccacuaagauccaauggcucuggugacgaugucuucacaguaucaugcagaguauuaacacgaccaacaccagacuucgaguucacauauuuaguucccccaucaguagaaaguaaaacaaaaccauucagucuaccuauauuaacacuauccgaacuaacaaauucuagauucccaguaccaauagacucucuauuuacagcacaaaauaauguauuacaaguacaaugucaaaaugguagauguacauuagauggagaauuacaaggaacaacucaacuacuaccaucaggaaucugcgcuuucagagguagagucacagcacaaauuaaucaacgagauagauggcacaugcaauuacaaaaucucaauggaaccaccuaugacccaacagaugauguacccgcacccuuaggcacaccagauuucaaaggaguaguauucggaaugguaucacaacguaacguaggaaaugaugcaccaggauccacacgagcgcaacaagccuggguuucaacauacucaccccaauucgucccaaaacuaggaucagucaauuuacguauuucagauaaugaugacuuccaauuucaaccaacuaaauuuacaccagucgguguaaacgaugaugacgacggucauccauuuagacaaugggaacuaccaaauuacaguggugaauugaccuuaaacaugaauuuagcaccaccaguagcaccaaacuucccaggugaacaauuacuauuuuuccgauccuucguaccauguucaggaggauauaaccaagguauaauagauugcuuaauaccacaagaauggauacaacauuucuaucaagaaucagcuccaagccaauccgacguagcucuaauacgauauguuaauccagauacuggcagaacucuauucgaagcuaaacuacaucgaucugguuauauaacuguagcacacucaggagauuauccucuaguaguaccagcaaauggacauuuuagauuugauucuugguaa

SEQ ID NO: 34994 - RNA, 1563 nt, Artificial Sequence
  derived and/or modified sequence opt6 from VP1__Norovirus_and/or_Norovirus-like__KT864687
augaaaauggccucaaaugacgcagcaccaucuaaugacggugcagcuggucuuguaccagaaggaaauaacgaaacauuaccauuagaaccaguugccggugcagcaauagcagcaccaguaacaggacaaaauaauauaauagacccauggauuagaacuaacuucguucaagcuccaaacggagaauuuacaguauccccacgcaacucacccggcgaaauauuauuaaaccuagaauuaggaccagauuuaaaucccuacuuagcccaucuaucuagaauguauaacggauaugcugguggaguugaaguacaaguacuauuagcagguaacgcauuuacugcaggaaaaauauuauuugcagcaguaccaccaaacuuucccgucgaauuuuuaucacccgcacaaauuacaaugcuaccacaccuaauaguagacguaagaacacuagaaccaaucaugauaccuuuaccagauguucggaacacauuuuuccauuauucaaaucaaccaaacagcagaaugcgucuaguagcaaugcuauacacaccauuaagaaguaacggaucaggagacgauguauucacaguaucaugucgcgucuuaacaagaccuacacccgauuucgaauuuacauauuuaguacccccuucagucgaaucaaaaacaaaacccuucucccuaccuauauuaacacuaucagaauuaaccaauucaagauucccaguaccaauagacucucuauuuacggcucaaaauaacguauuacaaguacaaugucaaaauggacgaugcacacuagauggcgaacuacaaggcacaacacaauuacucccaucaggaauaugcgcauuucgugguagaguuacagcacaaauaaaccaaagagaccgauggcacaugcaacuucaaaauuuaaauggcacaacauacgauccuacggaugacguuccagcaccacuaggaacaccagauuucaaaggcgucguauuuggaaugguaucacaacgaaauguagguaacgaugcaccaggcucaacaagagcacaacaagcauggguaucaacuuauucaccacaauuuguaccuaaauuaggaucaguaaauuuacgaauaagugacaaugaugauuuucaauuccaaccaacuaaauuuacuccaguaggaguaaaugaugacgacgacggacauccauuccgacaaugggaauuaccaaacuacucaggagaauuaaccuuaaacaugaauuuagcaccucccgucgcacccaauuuuccaggugaacaauuauuauucuuucgaaguuuugucccaugcucagguggauauaaucaaggaauuauugacuguuuaauuccacaagaauggauacaacacuucuaucaagaauccgccccaucucaaucugacgucgcacuuauaagauacguaaacccugacacaggaagaacauuauuugaagcuaaacuacaccggucaggauauauaacaguagcacacucaggagauuauccucuaguugucccagccaacggacauuucagauucgaaucaugguaa

SEQ ID NO: 34995 - RNA, 1563 nt, Artificial Sequence
  derived and/or modified sequence opt6 from VP1__Norovirus_and/or_Norovirus-like__KX764842
augaagauggcaucaaaugacguagcaccaucaaaugacggugcagcaggauuaguaccagaaggaaacaaugaaacacucccacuagaaccaguagcaggagcagccauagcagcaccaguaacuggucaaaauaauauaauagacccauggauacguacaaauuucguacaagcaccuaauggagaauuuacagucucaccccgcaacucaccaggugaaaucuuacuaaauuuagaacuuggaccugauuuaaauccuuaccuagcucaucuaucacgaauguacaacggauacgccgguggaguagaaguacaagucuuauuagcuggaaaugcuuuuacugcaggaaaaauacuauucgcagcaguaccuccaaauuuucccguagaauuucuaaguccagcacaaauaacaauguuaccacaucuaaucguagauguuagaacacucgaaccaaucaugauaccacuaccagauguucgaaacacauucuuucacuauucaaaccaaccuaauucuagaaugagauuaguagcuaugcuauacacaccauuaagaucaaacggaucaggugacgauguauucacaguaucaugucgaguuuuaacuagaccaacaccugauuuugaauuuacauaucuagucccaccaucaguugaaucaaaaacaaaaccauucucgcuuccaauacuaaccuuaucagaacuaacaaauucucgcuucccaguaccaauagacucucuauuuacugcacaaaacaacguuuuacaaguacaaugccaaaauggaagaugcacauuagacggagaauuacaaggcacaacacaacuauuaccaucuggaauaugugcauuucgaggucgaguuacagcucaaauaaaucaacgugaucgcuggcacaugcaauuacaaaaucucaauggaaccacauacgaccccaccgacgacguaccagcaccccucggaacuccagacuuuaaaggaguagucuucggaauggucucacaaagaaacguagguaacgaugcuccaggauccacaagagcucaacaagccugggucucuacuuacucaccacaauuuguaccaaaauuaggcucaguuaauuuaagaauuucugauaacgacgacuuccaauuccaaccaacaaaauuuacaccaguaggagucaaugaugaugaugauggccauccauucagacaaugggaacucccuaauuauucaggagaacuuacauuaaauaugaaucuagcaccacccgucgcucccaauuuuccuggcgaacaacuauuauucuuccgaucauuuguacccuguucaggaggcuauaaucaaggaauaauagacugcuuaauaccacaagaauggauccaacauuucuaccaagaaucagcaccuucccaaucugacguugcauuaauaagauauguaaacccagauacaggccguacacucuuugaagcuaaacuacauagaagcggauauauaaccguagcacacucuggagauuauccauuaguaguacccgcaaauggacacuucagauuugacgcaugguaa

SEQ ID NO: 34996 - RNA, 1563 nt, Artificial Sequence
  derived and/or modified sequence opt6 from VP1__Norovirus_and/or_Norovirus-like__KT864685
augaaaauggcuaguucagacgcagcaccaucaaaugacggagcagcaggucuaguaccugaaggcaacaaugaaacacuaccucuagaaccaguugcaggagcagcuauagcagcuccaguaacaggacaaaacaacauaaucgauccauggauaagaacaaauuuuguacaagccccaaacggagaauuuaccguuagcccucgaaacucaccaggagaaauccuauuaaaccuagaauuaggcccagauuuaaauccauaucuggcacaccuaucaagaauguauaauggauaugcuggcggagucgaaguucaaguuuuacucgcaggaaacgcuuuuacagcagguaaaauauuauuugcagcaguaccaccaaauuuuccagucgaauuuuuaucuccugcucaaauuacaauguuaccacaccucauaguagauguuagaacacuagaaccaauaaugauaccauuaccagauguucgcaauacauucuuucauuauuccaaucaaccaaacucaagaaugagacuugucgcaaugcuuuacaccccauuaagauccaacggaucaggugacgauguauuuacaguauccugucgcguacuaacuagaccaacaccugauuucgaguucacauauuuaguacccccauccguagaauccaaaacaaaaccauucucccuaccaauacuaacacuuagcgaauuaacaaauucaagauuuccaguuccaauagacucauuauucacagcucaaaauaacguacuccaaguccaaugucaaaacggucgauguacauuagauggagaauuacaaggaaccacucaacucuuaccaucugguauaugugcuuuccgaggcagaguaaccgcacaaauaaaucaaagagauagauggcauaugcaacuacaaaauuuaaacggaacaacauacgacccaaccgaugauguacccgcaccauugggaacaccagacuucaaagguguaguauuugguaugguaagccaaagaaacguaggaaacgaugcucccggaucaacaagagcacaacaagcauggguuucaacuuacucaccucaauucguaccgaaacuaggaccaguaaaucucagaauaucagacaacgacgauuuccaauuccaaccaacuaaauucacacccguuggaguuaaugaugacgacgauggacaccccuucagacaaugggaauuaccuaacuauaguggagaauuaacacuaaacaugaacuuagcaccaccaguagcaccaaacuuuccaggagaacaacuguuauucuuccgcucauuuguaccaugcucaggaggauauaaccaaggaauaauagauugccuaauaccacaagaauggauucaacauuucuaucaagaaucagcaccaucucaaagugacguugcacucauaagauauguaaacccagacaccgguagaacacuauuugaagcaaaacuacauagaucaggauacaucacugucgcucauucaggagauuauccacuuguaguuccagcaaacggacauuucagauucgauuccugguaa

SEQ ID NO: 34997 - RNA, 1563 nt, Artificial Sequence
  derived and/or modified sequence opt6 from VP1__Norovirus_and/or_Norovirus-like__KT864684
augaaaauggcaucaucugacgcagcaccaucaaacgacggugcagcaggucuaguaccagaaggaaauaaugaaaccuuaccuuuagaaccaguagccggagcugcuauagccgccccaguaacaggacaaaacaauauaauagaccccuggauacgcacaaacuucguccaagcaccaaauggugaauuuacaguuaguccaagaaauucuccaggugaaauccuauuaaauuuagaauuaggaccagaccuaaacccuuaccuagcacauuuaagccgaauguacaauggauaugccgguggcguagaaguacaaguucucuuagcagguaaugccuucacagcugguaaaauacuauuugcugcuguaccaccaaacuuucccguagaauuucucucacccgcacaaauuacaaugcuaccacacuuaauaguagacguacgaacucuagaaccaauaaugauuccacuuccagaugucagaaauaccuucuuucauuacagcaaucaacccaauuccagaaugcgauuaguagcaaugcuauauacaccacuaagaucuaaugguaguggcgacgaugucuuuacaguaucaugucgaguauuaacuagaccaacaccagauuuugaauuuaccuaccuaguaccuccaucuguagaaucuaaaacuaaaccauuuucuuuaccaauauuaacuuuauccgaauuaacuaauucaagauuuccagucccaauagacucauuauuuacagcacaaaacaauguacuacaaguccaaugucaaaauggacgcuguacacuagauggagaauuacaaggaacaacacaauuauuaccaucugguauaugugcauuuagaggcagagucaccgcacaaauaaaucaaagagaccgauggcacaugcaacuacaaaaccuaaauggcacaacauacgacccaacagacgacgucccugcaccacuaggaacaccugauuuuaaaggcguaguauuuggaaugguaucucaaagaaacguuggaaaugacgcacccggaucaacaagagcacaacaagcauggguaucuaccuauucaccacaauuuguaccaaaauuagguucugucaacuuacgaaucucugauaacgacgauuuucaauuucaaccaacaaaauuuaccccagucggugucaaugacgacgacgacggacauccauuucgacaaugggaauuaccuaauuauuccggagaacuuacccuaaacaugaacuuagcaccuccuguugcaccaaacuuuccaggagaacaacuuuuauucuuuagauccuuuguaccauguucaggaggcuauaaccaaggaauaauagauuguuuaaucccacaagaauggauucaacauuuuuaccaagaaucagcuccaucccaaucagauguagcacucauucgauauguaaacccugacaccgguagaacacucuuugaagccaaacuucaucgcuccggcuacauuacaguagcccacucaggagauuacccccuaguaguaccagcaaacggacauuucagauucgaaaguugguaa

SEQ ID NO: 34998 - RNA, 1563 nt, Artificial Sequence
  derived and/or modified sequence opt6 from VP1__Norovirus_and/or_Norovirus-like__KX764836
augaaaauggcuucuucagacgccgcuccuucuaaugauggagcagcaggccuaguaccagaaggaaacaaugaaacauuaccacuagaaccaguagcuggugcugcaauagcagcuccaguaacuggacaaaacaauauaauagaucccuggauucgaacaaacuucguccaagcucccaacggcgaauuuaccguuucaccaagaaauuccccuggagaaauccuauuaaaucuagaauuaggcccagaucucaauccuuaccuagcacaucucagcagaauguacaacgguuacgcaggaggagucgaaguucaaguacuauuagcaggcaaugcauucacagcaggaaaaauauuauucgcagcaguaccaccaaacuuuccaguagaauuucuaucacccgcacaaauaacaauguuaccacaccuaauuguagauguaagaacauuagaaccaauuaugauucccuuacccgauguaagaaacacauucuuucacuauucuaaucaaccuaauagucgaaugcgauuagucgcaaugcucuacacaccauuaagaucuaacggaucuggcgacgauguauuuacaguuucaugcagaguauuaacaagaccaacaccugauuucgaauuuacauauuuagucccaccaagcguagaaucuaaaacaaaaccauucucucuaccaauacucacacucucagaauuaacaaacucaagauuuccaguacccauagacucucuauuuacagcacaaaauaauguucuacaaguacagugccaaaauggaagauguacacuagacggugaacugcaagguacuacacaacuacuaccuuccggaauuugugcauuuagaggaagaguaacagcacaaauaaaccaacgagauagauggcacaugcaauuacaaaaucuaaauggcacaacauaugacccgacagacgauguuccagcaccucuuggaacuccugauuuuaaaggaguaguauucggaaugguaucucaaagaaauguaggaaaugaugcuccuggcucaacuagagcacaacaagcaugggucucuacauauuccccacaguuuguaccaaaacuaggcucaguaaauuuacgaauaucugauaaugacgauuuccaauuccaaccaacaaaauucacaccgguaggaguaaaugacgacgaugacggucaucccuuuagacaaugggaacuaccaaauuauucaggagaacuaacauuaaacaugaaucuagcaccuccuguugcaccaaacuuuccuggugaacaacuacuuuucuuucgaucuuuugucccauguucagguggauacaaucaaggaguuauagauugucuaauaccucaagaauggauucaacauuucuaucaagaaucagcaccaucacaaucugacguagcucuaauccgcuacguaaacccggacacaggaagaacacuauucgaagcaaaacuccauagaucaggauauauaacaguagcacauucaggagacuacccuuuaguaguacccgcuaauggucauuucagauuugaagcaugguaa

SEQ ID NO: 34999 - RNA, 1563 nt, Artificial Sequence
  derived and/or modified sequence opt6 from VP1__Norovirus_and/or_Norovirus-like__KX764845
augaaaauggcaucaucagacgcagcaccaucaaacgauggagcagcagguuuaguacccgaaggaaauaaugaaacauuaccacuagaaccaguugccggggcagcuauugcagcaccaguaacuggacaaaacaauauaauagauccauggauaagaacaaacuuuguacaagccccuaauggcgaauuuacaguauccccacguaacucuccuggcgaaauauuacuaaaucuugaacuaggaccagaucuuaaccccuaucucgcccaucuaucuagaauguauaauggauaugcaggaggaguagagguacaaguacuauuagccggaaaugcuuucacagcuggcaaaauacuauuugcagcaguaccacccaauuuuccaguagaauuuuuaucacccgcucaaauuacaauguuaccacaccuaauaguugacgucagaacauuagaaccaauaaugauaccacuaccugauguccgaaauacauucuuucacuauucaaaucaaccaaauagucgaaugcgauuaguagcaaugcuauauacaccauuaagaucaaacggaucaggagacgauguauuuacaguaucaugucgaguauuaacacgaccaacaccagauuuugaauuuacauauuuaguaccacccucaguugaaucaaaaaccaaaccauuuucacuaccaauuuuaacacuaucagaacuaacaaacucuagauuuccaguaccaauagacucauuguuuacugcacaaaacaauguacuacaaguccaaugucaaaacggaagauguaccuuagauggagaauuacaaggaacaacucaacuacuaccaucugguauaugcgccuuucgaggaagagucacagcucaaauuaaccaaagagauagauggcauaugcaacuacaaaauuuaaauggaacuacauacgacccaacagaugauguacccgcaccauuaggaacaccagacuuuaaagguguuguauuuggaaugguuucacaaagaaacguaggaaaugacgcuccuggaagcacaagagcucaacaggcuuggguuucaaccuauucucuacaauuuguaccaaaauuaggaucugucaacuuaagaauauccgauaaugaugacuuccaauuucaaccaacaaaauuuacaccaguagguguaaacgaugaugacgauggucauccauuucgccaaugggaacuuccaaauuauagcggcgaacuuacacuuaauaugaauuuagcaccuccaguagcaccaaauuuuccaggagaacaauuauuauucuuuaggucauuuguacccugcucagguggcuacaaucaaggaauuauagacugcuuaauaccucaagaauggauacaacauuucuaucaagaaagugcaccaucacaaucugacguagcacuaauaagauauguaaacccagacacaggaagaacauuauucgaagccaaauuacaucgaaguggauauauaaccguagcacacucuggagauuacccauuaguuguuccugccaacggccauuuucgauucgaagccugguaa

SEQ ID NO: 35000 - RNA, 1563 nt, Artificial Sequence
  derived and/or modified sequence opt6 from VP1__Norovirus_and/or_Norovirus-like__KX764837
augaaaauggcaucaaaugacgcugcaccaucaaaugacggagcugcuggccuaguaccagaaggaaauaaugaaacauuaccacuagaaccaguagcaggagcugcaaucgcugcaccaguaacaggacaaaauaauauaauagaccccuggauaagaacaaacuuuguacaagcaccuaauggagaauuuacugucucaccaagaaauucacccggagaaauacuacuaaaucuagaacucggacccgaucugaacccuuaccuugcacauuuaucacgaauguauaacggauacgccggaggagucgaaguucaaguauuauuagcaggaaaugcauucaccgcaggaaaaauacuauucgcagcuguaccuccuaacuuuccaguagaauuucuaucaccagcccaaauaacaauguuaccacauuuaaucguagauguaagaacacuugaaccaaucaugauaccgcucccagacguacgaaauacauucuuucacuauucaaaucaaccaaacucaagaaugagacuuguugcuaugcuuuacacaccacuaagauccaacggaucaggagacgauguauucacaguuucaugucgaguacuuacaagaccaacaccagacuuugaauuuacauaccuuguaccaccaaguguagaaagcaaaacaaaaccauucucacuaccaauacuuaccuuaucagaacucacuaauagcagauuccccguacccauagacucacuauucacagcacaaaauaauguucuccaaguucaaugccaaaauggaagaugcacauuagauggagaacuacaaggcgcaacacaacuauuaccaaguggaauaugcgcauuuagagguaggguaacagcccaaauuaaccaacgcgaucgauggcacaugcaacuccaaaaucuaaauggcacaacauaugacccaacugacgacguacccgcaccccuuggaacaccagauuuuaaaggagucguauuuggaaugguaucucagagaaauguaggaaaugauguuccuggaucuacaagagcucaacaagcauggguaucuacuuacucaccucaauuuguaccaaaacuaggcaguguaaauuuaagaauaucugacaaugaugauuuccaauuccaaccaacaaaauuuaccccagucggaguaaacgaugaugacgacggacauccauuuagacaaugggaauuaccaaauuauucaggcgaauuaacauugaacaugaaucuagcaccaccaguugcuccaaacuuuccaggugaacaauuacuauucuucagaucuuuugucccauguucaggaggcuauaaucaaggaguuauagauugcuuaauaccacaagaauggauacaacacuucuaccaagaaucagcaccaucacaaucugacguagcauuaauacgauacguaaauccugacacaggacgaacauuauuugaagcaaaauuacauagaucuggauauauaacaguagcacauucuggugacuauccccuaguaguaccagcuaauggacacuucagauucgacgccugguaa

SEQ ID NO: 35001 - RNA, 1563 nt, Artificial Sequence
  derived and/or modified sequence opt6 from VP1__Norovirus_and/or_Norovirus-like__KX764838
augaagauggcuucaaaugaugcagcaccuucaaaugauggcgcagcaggauuaguaccagaaggaaacaaugaaacacuaccacuagaaccaguagccggagccgccauagcagcaccaguuacaggacaaaauaauauaauugacccauggauaagaaccaauuuuguacaagcaccuaacggagaauuuacaguuuccccaagaaauucaccuggagaaaucuuacuaaacuuagaacucggaccagaucuaucaccuuaccuugcacaucuaucccgaauguauaacgguuaugcaggaggcguagaaguacaagucuuacuagcagguaaugcauucacagcaggaaaaauacuauucgcagcuguaccaccaaauuucccaguagaauuucuaucuccagcacaaauaacaaugcuuccacacuuaauaguugacgucagaacccuagaaccaauaaugauaccacuucccgacgucagaaacacauucuuccacuauucaaaucaaccuaacucaagaaugagauuaguagcaaugcuauauacacccuuaagaaguaacggaucaggagaugauguauucacaguguccugcagaguacuaaccagaccuacaccugauuucgaauuuacauaucucguucccccaucaguagaaucaaaaacaaaaccauucucacuaccuauauuaacccuaucagaauuaacaaauucaagauucccuguuccaauagacucuuuauucacagcucaaaauaauguucuacaaguucaaugccaaaacggaagauguacccuugauggagaacuacaaggaacaacacaaguagucccaucaggaaucugugcauuucgaggcagaguuacagcacaaauuaaccaaagagauagauggcauaugcaauuacaaaaccuaaacucaacaacauaugaucccaccgacgacguaccagcaccauuagguacuccugauuucaaaggagucguauuuggaaugguuucacaaagaaacguagguaacgacgcaccaggaagcacaagagcccaacaagcauggguuucaacauauucaccacaauuuguaccaaaauuagguucagucaauuuaagaauaucagacaaugacgauuuucaauuucaaccaacaaaauuuaccccugucgguguaaaugacgaugacgauggccaucccuuuagacaaugggaacuacccaauuacuccggcgaacuaacauuaaacaugaaccuagcaccaccaguagcaccaaacuuuccuggagaacaauuacuuuucuuuagaucauuugucccaugcucaggaggauauaaccaaggaauaauagauugucuaauaccucaagaauggauacaacauuuuuaucaagaaagugcuccaucccaaucagacgucgcuuuaauaagauacguaaauccagacacaggaagaacauuguucgaagcaaaacuccauagaucaggauauauagcagucgcccacucuggagauuacccccuaguagucccagcuaauggucacuucagauuugauagcugguaa

SEQ ID NO: 35002 - RNA, 1563 nt, Artificial Sequence
  derived and/or modified sequence opt6 from VP1__Norovirus_and/or_Norovirus-like__KU687016
augaaaauggccucuaaugacgccgcaccaagcaaugauggagcugcaggauuagucccagaaggaaauaaugaaacauuaccccuagaacccguagcaggagccgcuauagcugccccaguuaccggacaaaacaauauaaucgauccauggauuagaaccaacuuuguacaagcaccaaacggcgaauuuacaguuucaccaagaaacucaccuggugaaauacuauuaaaccuagaacuaggcccggaucuaaauccauaccuagcgcacuuaucaagaauguauaacggcuaugcaggaggaguagaaguacaaguauuauuagcaggcaacgccuuuacagcuggcaaaauauuauucgcagcaguuccaccaaauuuccccguugaauuuuuaucuccagcccaaauaacaaugcuaccucauuuaauaguagacguuagaacacuagaaccaauaaugauaccauuacccgauguaagaaacacauucuuucauuacuccaaucaaccaaauucacguaugagauuaguagcaaugcuauacacaccucuaagaucaaauggaucaggagaugaugucuucacuguauccuucagaguuuuaacacgaccaacaccagauuuugaauuuacauauuuaguaccaccauccguagaaucacgaaccaaaccauucucacucccaauacuaacuuuaagugaacuaacaaauucacgauuucccguaccaauagacagucuuuucacugcacaaaauaacguacuucaaguccaaugccaaaacggaagauguacacuagauggagaauuacaaggaacuacccaauuacuaccauccggaauaugugcauuucgaggacaaguaacugcccaaauaaaucaaagagauagauggcauaugcaauuacaaaaucuaaauggcacaaccuaugacccuacagaugauguaccagcaccccuaggcacaccagacuucaaaggaguugucuuuggaaugguaucacaaagaaacguaggaaaugacgcgccaggaucaacaagagcacaacaagcauggguaucaacauauuccccacaauuugucccaaaacuaggaaguaucaauuuacguaucucugacaaugacgauuuccaauuccaaccaacaaaauucacaccuguagguguaaaugacgaugacgauggacacccuuuccgccaaugggaacucccuaauuauucaggugaauuaaccuuaaauaugaaccuggcuccaccaguagcuccuaacuuuccaggagaacaacuacuauucuuuagaucauuuguaccaugcuccggaggauacaaucagggaaucauagauugcuuaaucccucaagaauggauacaacacuucuaucaagaaucagcuccaucacaaucagacguagcuuuaauaagauacguaaacccagauaccggaagaacauuauuugaagcaaaauuacaucgaucaggcuacaucaccgucgcacacucaggcgauuacccauuagucgucccagccaauggccauuucagauucgacgcaugguaa

SEQ ID NO: 35003 - RNA, 1563 nt, Artificial Sequence
  derived and/or modified sequence opt6 from VP1__Norovirus_and/or_Norovirus-like__KU687015
augaaaauggcauccucagacgcagcaccuucuaaugauggagcagccggauuagucccugaaggaaacaaugaaacauuaccacucgaaccagucgcaggagcagccauagcagcaccaguaaccggucaaaauaauauaauagaccccuggauaagaacuaauuucguccaagcaccaaacggagaauuuacaguuagcccacgaaauucaccaggagaaauacuacuaaaucuagaacuaggcccagaccuaaacccuuauuuagcacacuuaucccgaauguacaaugguuacgcaggaggaguagaaguacaaguccuucuagcaggaaacgccuucaccgcuggcaaaauacuuuucgcagcagucuuaccuaacuucccaguagaauuucuaucacccgcccaaauuacaauguuaccacaccuaauaguagauguaagaacacuagaaccuaucaugauaccauuaccagacguaagaaacacuuucuuucacuauucaaaucaaccaaacucaagaaugcgauuaguagcaaugcuauauacaccacuaagaucaaacggaucaggagacgacguauuuaccgucagcugucgcguacuaacaagaccaacaccagacuuugaauuuacauaccuagugccaccaucuguagaaucaaaaacaaaaccauuuagccucccaauucuaacccuaucagaauuaacuaauucacgauuuccaguaccaauagacccacuauuuacagcacaaaauaacguauuacaaguccaaugccaaaauggaagauguacacuagacggagaauuacaaggaacaacacaauuacucccaucugguauaugugcguuuagaggaagaguaacugcucaaauaaaccaaagagaucgauggcauauccagcuacaaaaucuaaauggaacaaccuaugauccuacagaugacguaccagcuccacuaggaacuccagauuuuaaaggaguagucuuuggcaugguuucacaaagaaauguaggaaacgacgcuccagguaguacucgagcacaacaagcauggguuuccacauacucaccacaauuuguaccaaaacuaggaucuauuaaucuaagaauuucugauaaugacgacuuucaauuucaaccaacaaaauucacaccaguaggaguaaaugacgaugacgauggacauccauuuagacaaugggaauuaccaaacuauagcggugaauuaacauuaaauaugaacuuagcuccaccaguagcaccaaacuuuccaggagaacaacuacuauucuuuagaucuuucguaccauguucuggaggauacaaucaaggaauuauugauugucuaauaccccaagaauggauccaacauuucuaucaagaaucagcaccaucacaaucugacguagcauuaauccgauacguaaacccagacaccgguagaacuuuauucgaagccaaauuacaucgaucagguuacauaacaguggcccauucaggagauuauccccuuguaguaccagcaaacggccauuucagauuugacgcaugguaa

SEQ ID NO: 35004 - RNA, 1563 nt, Artificial Sequence
  derived and/or modified sequence opt6 from VP1__Norovirus_and/or_Norovirus-like__KU687013
augaaaauggcaagcagugacgcagcaccuuccaaugacggugcugcaggauuagucccugaaggcaacaaugaaacauuaccauuagaaccaguagccggagcagcuaucgcagcaccagucacaggccaaaacaauauaauagacccauggauacgcacaaacuuuguacaagcaccaaacggagaauuuacaguaucaccaagaaauucaccuggagaaaucuuacucaaucuagaacucggacccgaucuaaacccauaucuagcacauuuaucccguauguacaauggauacgcaggaggaguagaaguacaagucuuauuggcuggaaaugcauucaccgcuggcaaaauauuauucgcugcaguaccaccaaacuuuccaguagaauuucuauccccagcucaaauuacaauguuaccccacuuaaucgucgacguaagaacacuagaaccaauaaugauaccauuaccagauguaagaaacacauucuuucacuauucaaaucaaccaaauucacgaaugcgucuugucgcaaugcuauacacaccauuaagauccaacggaagcgguggagacguauucacagucucauguagaguucuaacaagaccaacaccagauuuugaauuuacuuaucuuguaccacccucaguaaaauccaaaacaaaaccauucucacuaccaauacuaacccuaucagaacuaacaaacucuagauucccaguaccuauagacucucucuucaccgcacaaaauaacguauuacaaguucaaugucaaaacggaagauguacuuuagacggugaacuccaaggaaccacacaacuucuuccuucagguauaugugcauuucgagguagaguuacagcacaaauaaaucaacgagacagauggcacaugcaauuacaaaauuuaaaugguacaaccuaugacccaaccgacgacguaccugcuccacuaggaacaccagacuuuaaaggaguagucuuuggaaugguaucacaaagaaauguaggaaacgaugcaccaggcucaacaagagcccaacaagccuggguaucaacuuauaguccacaauuuguaccaaaauuagguucaauaaaucuacgaaucuccgauaaugacgacuuccaauuccaaccaacuaaauuuacuccaguugguguaaacgacgaugacgauggacauccuuuuagacaaugggaauuacccaacuacuccggagaauuaacauuaaacaugaaccuggcuccacccguggccccaaauuuuccaggagaacaauuauuauuuuucagaucauuuguaccauguucaggcggauauaaucaagguauaauagauugccuaauaccacaagaauggauacaacauuucuaccaagaaucugcucccucacaaucugacguagcauuaauaagauauguaaacccagacacaggaagaacuuuauucgaagcaaaacuacauagaagcggcuacauaaccguagcacacucaggugauuacccuuuaguagucccagcaaauggccauuuccgauucgaaucuugguaa

SEQ ID NO: 35005 - RNA, 1563 nt, Artificial Sequence
  derived and/or modified sequence opt6 from VP1__Norovirus_and/or_Norovirus-like__KX764839
augaaaauggcauccucugaugccgcaccuucaaacgacggugcagccggcuuaguaccagaaggaaacaaugaaacacuaccuuuagaaccaguagcaggcacagcuauagcagcaccaguaacuggucaaaauaauaucauagaccccuggauaagaacaaacuucguacaagcaccaaacggagaguucacagucucuccacgaaacucaccaggugaaauacuccuaaaucucgaauuaggacccgaucuaaacccauaucucgcacaucuaucucgaauguauaacggauacgcaggcggaguagaaguccaaguuuuacuagcaggaaaugcauucacagcaggaaaaauauuauucgccgcaguaccaccaaacuuuccaguagaguuccucucuccagcccaaauaaccaugcuuccccacuuaauaguagauguacgaacucuagguccaauaaugauaccuuuacccgauguacgaaacacauucuuucacuauuccaaucaaccuaauucaagaaugagauuaguagcaaugcuauauacaccauuacgauccaacggaucaggcgacgacguauuuacuguaucauguagaguacuaacaagaccaacaccugacuuugaauuuacauacuuagucccaccuucaguagaaucuaaaaccaaaccuuuuuccuuaccuauauuaacacuaucagaacuaaccaacucacgauuccccguaccuauagauucuuuauuuacugcacaaaauaacguucuacaaguacaaugccaaaauggccgauguacacuagacggcgaacuacaaggaacaacacaacuacuacccuccggaaucugugcauuuagaggacgaguaacagcacaaauuaaccaaagagaucguuggcacaugcaauuacaaaauuuaaacggaacaaccuaugauccaacagaugacguaccagcaccacuaggaacaccagacuuuaaaggugucguauucggaaugguaucacaaagaaacguaggcaaugaugcaccagguucaacacgcgcacaacaggcauggguaucaacauauucaccccaauuuguaccuaaacuuggauccguaaauuuacgaauaucagauaacgacgauuuccaauuucaacccacaaaauucacaccaguuggcguaaaugacgaugaugauggccauccauuucgacaaugggaacucccuaacuauucaggagaauuaacacuaaauaugaaccuagcacccccaguagcaccaaacuucccaggugaacaauuauuauucuuuagaaguuucguuccaugcucaggaggauauaaucaaggaauaaucgauugucuuauaccacaagaauggauacaacauuuuuaccaagaaucagcaccuucacaaucagacguagcauuaauacgcuauguaaacccagauacuggccgaacucuauucgaagccaaacuccaccgaucaggauauauaacaguagcucauucuggugauuaccccuuaguuguuccagcuaauggacauuucagauuugaagcaugguaa

SEQ ID NO: 35006 - RNA, 1563 nt, Artificial Sequence
  derived and/or modified sequence opt6 from VP1__Norovirus_and/or_Norovirus-like__KX764844
augaaaauggccuccaaugacgcagcaccauccaaugauggagcugcagguuuaguaccagaaggcaauaauggaacccuaccucuugaaccaguugcuggugcagcaauagcagcuccaguuacuggccaaaauaauaucauugacccuuggauaagaauaaacuuuguccaagcaccaaauggugaauuuaccguaucaccucguaauagcccuggagaaauacuauuaaaccucgaacucggacccgaucuaaaucccuaucuagcacaucuaucaagaauguacaauggcuacgcaggaggaguagaaguacaagucuuacuagcagguaaugcauuuacagcaggaaaaauacuauuugcagccgucccuccuaauuuuccuguagaauuucuaucacccgcacaaauaacuaugcuuccccauuuaauagucgacgucagaacacuagagccaauuaugauaccauuacccgauguaagaaacacuuucuuucauuacucaaaccaaccuaacucaagaaugggccuaguagcaauguuauauacacccuuaagaucaaauggaucaggagaugaugucuucacaguaucaugccgaguacuaacuagaccuacaccagauuucgaauuuacuuauuuaguacccccaucuguagaaucuaaaaccaaaccauucuccuuacccauuuuaacacuauccgaauuaaccaauuccagauucccaguuccuauagauucacuauuuacugcucaaaauaacguccuccaaguacaaugucaaaauggaagauguacauuagacggagaauuacaaggaacuacacaauuacuaccaucaggaauuugugcauucagaggucgaguaacugcacaaauaaaccaacgagacagauggcacaugcagcuucaaaaucucaauggcacaaccuaugauccaacugacgauguaccagcaccauuaggaacucccgauuucaaaggugucguauucggaaugguaagucaacgaaauguaggaaaugaugcaccagguucaacaagagcucaacaagcaugggucucaacauauucuccacaauuuguaccaaaauuaggcucagucaauuuacguaucucugauaacgaugauuuucaauuucaaccaacaaaauuuacuccaguagguguaaacgacgacgacgacggucauccuuuuagacaaugggaacucccaaauuauuccggagaauuaacauuaaauaugaaccuagcaccaccuguagcuccaaacuuuccuggcgaacaauuacuauuuuucagaucuuuuguaccauguucaggagguuauaaucaaggaauaauagacugucuaauaccacaagaauggauucaacauuuuuaccaagaaucagcacccucacaaucggacgucgcuuuaauaagauacgucaacccugauacaggucgaacacucuucgaagcuaaacuacauagaucuggauacauaacuguagcccauuccggugauuauccauuaguaguccccgcaaauggucauuuuagauucgaaucaugguaa

SEQ ID NO: 35007 - RNA, 1563 nt, Artificial Sequence
  derived and/or modified sequence opt6 from VP1__Norovirus_and/or_Norovirus-like__KT864686
augaaaauggcaucaucagacgcagcuccaucaaaugauggagcagcaggccuaguaccagaaggaaacaaugaaacucuaccacuugaaccaguaguuggugcagcaauagccgcaccagucaccggacaaaacaauauaauugaccccuggauaagaacaaacuuuguccaagcaccaaauggugaauuuaccguaucaccaagaaacucaccaggagaaauacucuuaaauuuagaguuaggaccagaucuaaauccauaccuagcacaccuaucaagaauguauaacggcuaugcuggaggaguagaaguacaaguauugcuagcaggcaacgccuuuacagcaggaaaaauacucuucgcugcaguaccaccuaauuuucccgucgaauuucuaucuccugcacaaauaacaaugcuaccacacuuaauaguagacguuagaacucuagaacccaucaugauuccccucccagaugucagaaacacauucuuccacuauuccaaucaacccaacucuagaaugcgacuuguagcuaugcuauauacuccccuaagaucugacggauccggagacgacgucuuuacaguaucauguagaguacuaacucgcccaaccccagacuuugaauuuacuuaucuaguuccaccuucuguagaaucuaaaacaaaaccuuucucucuaccaauuuuaacauuaucagaacucacuaacagcagauuuccaguaccaauagacucacuauuuacagcacaaaauaacguauuacaaguacaaugccaaaauggaagauguacauuagacggagaauuacaaggaacaacacaauuauuaccaucaggaaucugugcauuucguggaagaguaacugcccaaaucaaucaaagagacagauggcacaugcaacuucaaaaccuuaauggaacaacauaugauccaacagaugacguaccagcaccucucggaacaccagauuucaaaggcguaguuuuuggaaugguaucucaacgaaacguaggcaaugaugcuccaggaaguacucgagcacaacaggcauggguaucuaccuauucaccacaauuuguuccaaaacuuggaucaguaaauuuaagaauuucagacaaugacgauuuccaauuucaaccaacaaaauuuacaccaguaggaguaaacgacgacgaugacggccauccuuuuagacaaugggaauuaccgaauuauuccggagaauuaacauuaaauaugaauuuagcaccaccaguugcaccgaacuuuccaggaggacagcuacuauucuuucguucauuuguaccaugcaguggaggauauaaccaaggaauaaucgauugccuuauuccacaagaauggauucaacauuuuuaccaagaauccgcaccaucucaaucagacgucgcccuaauaagauacguaaacccggauacaggacgaacccuauucgaagccaaacuucacagaucaggauauauaacaguagcucacuccggagacuauccucuaguaguaccagccaauggacauuuuagauucgaaagcugguaa

SEQ ID NO: 35008 - RNA, 1563 nt, Artificial Sequence
  derived and/or modified sequence opt6 from VP1__Norovirus_and/or_Norovirus-like__KU687012
augaaaauggccucuucagacgcagcucccucuaaugacggugcagcuggccuaguaccagaaauaaacaccgaaacacuaccacucgaaccaguugcaggagcagcaauagcggcucccguaacaggacaaaauaauauaaucgaccccuggauaagaaauaacuucguccaagcaccaaauggagaauuuacaguaucaccacgaaacagcccaggagaaauacuaaugaauuuagaacucgguccugauuuaaaucccuaccucgcacaccuaucaagaauguacaacggauacgcuggaggcguagaaguacaaguacuacuagcuggaaacgcauuuacagccggaaaaauacuauucgcagcagucccacccaacuucccuguagacaugcuuucaccagcccaaauaaccauguuaccacaccucacaguagacguaagaacacucgaacccauuaugauaccccuuccagacguacgcaacgucuuuuaucacuuuaacaaucaaccagcacccagaaugcgauuaguagcaauguuauauacaccccuucgaucaaacggaagcggagaugauguauucacuguauccugcagaguauuaacaagaccaacuccagacuucgaauuuaccuaccuaguaccaccaagcgucgaaucuaaaaccaaacccuucacuuuaccaaucuuaacuaucggagaacuaaccaacucaagauucccagcaccaauagaccaacucuauacaucaccaaauacagauauucuaguacaaccacaaaauggcagauguacacuagacggcgaauuacaagguacaacacaacuauuaaccacagcaaucugcucauaucgaggaacaacaucaaacccaaccucagauuacugggacgaccaucuccuacaucuaguacauccaaacggagcaacauacgaucccacagaagacguaccagcaccuuuuggaacacaagacuuucgaggaauacuauacggaguauuaacucaaaauacucaauccccaagagacgaagucuccaacagcagaggaauauacaucucuucaaccucagauaaauucacaccaaaacucggaacaauaggacuacaccaaguccaaggagacacagcaucaaaccaacaaucaaaauucacccccguaggaauagcaguaaaccaaaacacacccuucaaacaaugggaauuaccuaauuauuccggugcacuaacauuaaauaccaaucuugcacccgcagucggcccaaacuuuccuggagaacaaauacuauuuuuccgaucuaacgucccauccguucaaggaacacauccaacacaagaaauagacugccuaauaccccaagaauggauaucacauuucuaucaagaaucagcaccaucacaaucugacguugcccuagucagauacguaaacccagacacaggcagaacaauauuugaagcaaaacuacaccgacaaggauucauaacaaucgcagcaacuggaucaaacccagucguagucccuccaaauggauacuucagauucgacuccugguaa

SEQ ID NO: 35009 - RNA, 1563 nt, Artificial Sequence
  derived and/or modified sequence opt6 from VP1__Norovirus_and/or_Norovirus-like__KU687018
augaaaauggcauccaaugacgcagcaccaucaaacgauggagcagccggccuagucccugaaauuaauaccgaaacuuuaccccucgaaccaguagcaggagcagccauagccgcuccaguaacuggacaaaacaacauaauagacccauggauucgcaacaauuuuguacaagcaccaaauggagaauuuacaguauccccuagaaacuccccaggagaaauacuaaugaaccuagaauuaggaccagaucucaaccccuaucucgcacaccuaucaagaauguauaacggcuacgcaagaggaguagaaguacaaguauuauuagcaggcaacgcauucacagcaggaaaaauacuauuugccgcaguaccaccaaacuucccaguagauaugcuauccccagcacaaauaaccaugcuuccacaccuaauuguagauguacguacucuagaaccaauaaugauaccacucccagacgucagaaacgucuucuaccacuuuaauaaccaacccgcaccccgaaugcgccuaguagccauguuauacacaccauuacgaucuaacggaucaggagacgacguauuuaccguuucaugcagaguccuaacccgaccaacacccgacuucgaauuuaccuaccuuguuccaccaucaguagaaucuaaaaccaaacccuucacuuuaccuauacuaacaauaggagaacuuaccaauagccguuucccagccccaauagaucaauuauacacaucacccaacgccgacgucguuguucaaccacaaaacggcagaugcacacuagacggagaacuucaaggaacaacgcaauuacucacaacugccaucugcucauaccgcggcacaacaucuaauccaacaucagacuacugggacgaucacuuacuacaccuuguacacccaaacggugcaacuuacgacccaacagaagacguaccagcaccuuuugguacacaagauuucagaggcaucuuauacggaguacucacccaaaacacccaaaaccccagagacgaaguaucaaauucaagaggcauauacauaucaucaacaucagauaaauuuacuccaaaauuaggaacaaucggucuacaucaaguacaaggagacacagcuucaaaccaacaaucuaaauuuacaccagucgguauugcaguuaaccaaaauaccccuuuuaaacaaugggaacuccccaauuacucaggagcacuaacacuaaauaccaaccucgcaccagcuguagguccaaacuucccaggagaacaaauccuauucuuuagaucaaacguaccaucaguacaaggaaaucacccaacacaagaaauagacugccucaucccacaagaauggguaucacacuuuuaucaagaaucagcaccaucccaaucagacguagcacucgucagauauguaaacccugauacaggaagaacaauauucgaagcaaaauuacaccgacaagguuucauaacaauagcagcaaccggaucuaacccuguuguaguacccccaaacggauacuuuagauucgaaucaugguaa

SEQ ID NO: 35010 - RNA, 1563 nt, Artificial Sequence
  derived and/or modified sequence opt6 from VP1__Norovirus_and/or_Norovirus-like__KU687021
augaaaauggcaagcaacgacgcaacaccaucaaaugacggagcagcuggauuagugcccgaaauuaacacagaaacucuaccucucgaaccaguagcuggagccgccauagcagcaccaguaacaggacaaaacaauauaauugacccauggauucgaaacaauuucguacaagcccccaauggagaguucacaguaucaccaagaaacucucccggagaaaucuuaaugaaucuagagcuaggacccgaccuaaacccauacuuagcacauuuaucaagaauguacaauggauaugccggaggcguagaaguacaaguccuccuagcaggaaaugcauucacagcuggaaaaauacuuuuugcugccguacccccaaacuuuccaguagacauguuaucaccagcacaaauaacaaugcuaccacacuuaauaguagauguuagaacacuagaaccaaucaugaucccacuuccagacguacgaaacguuuucuaucauuuuaauaaccaaccugcaccaagaaugagauuagucgcuauguuauauacaccacuaagauccaauggaucaggcgacgacguauuuacaguaaguugcagaguccuaacacgacccacaccugacuucgaauuuacauacuuagucccaccaucaguagaaucuaaaacaaaaccauucacauuaccaauucucacaauaggugaacuaaccaacucuagauucccagcaccaaucgaucaacucuauacauccccaaacgcagacguagucguucaaccacaaaacggaagauguacauuagauggcgaauuacaaggaacaacacaauuacuaacuacagcaauauguucuuacagaggaacaacaucaaauccaacauccgauuacugggacgaucaccuauuacaccuaguacacccaaauggugccacauacgaccccacugaagauguaccagcacccuucggaacacaagacuuuagagguauacuauacggcguuuuaacacaaaacacucaaaaucccagagauaagguaucaaauucaagagguauuuacauaucauccacaucagacaaauucaccccuaaauuaggaacaauaggacuacaccaaguacaaggagacacagccucaaaucaacaaucaaaauuuacuccagucggcauugcaguaaaucaaaauaccccauucaaacaaugggaauuacccaauuacucuggugcucucacacucaacacaaauuuagcaccagccguuggaccuaauuucccaggagaacaaauacucuucuucagauccaacguaccuucuguacaaggaaaccacccaacccaagaaauagauugccuaauaccucaagaauggguaucacacuucuaccaagaauccgcaccaucacaaucagacguagcacuuguacgauacguuaauccagauacuggucgcaccaucuuugaagcaaaauuacaccgacaaggauucauaauaauugccgccacaggaucuaacccaguagucguaccacccaauggcuauuuuagauucgaaucaugguaa

SEQ ID NO: 35011 - RNA, 1563 nt, Artificial Sequence
  derived and/or modified sequence opt6 from VP1__Norovirus_and/or_Norovirus-like__KU687020
augaaaauggcaucauccgacgcagccccaucuaaugacggagccgcaggacuuguaccagaaauaaacacagaaacacuaccauuagaaccaguagccggugcagcaauagcugcucccgugacaggacaaaacaauauaauagacccuuggauaagaaacaauuuuguucaagcaccaaacggagaauuuacaguuucaccaagaaacucccccggagaaauacuaaugaaucucgaauuagguccagaccuaaauccauacuuagcacauuuaucaagaauguauaacgguuaugcaggaggaguagaaguacaaguauuacuagcaggaaacgcauuuaccgcaggaaaaauacuauuugccgcaguaccaccaaacuucccaguagacaugcuaucucccgcccaaauaacuaugcuaccucaccuaauaguagacguacguacacuagaaccaauaaugauaccacucccugacguucgaaauguauucuaucacuuuaacaaccaaccagcaccaagaaugcgccuaguagcaauguuauacacaccacuaagaucaaacggaucaggagacgacguauuuaccguaucauguagaguguuaaccagaccaacacccgacuuugaauuuacauaccuaguaccacccucuguagaaucaaaaacaaaacccuucacuuuaccaauauuaacaauaggcgaauuaacaaauucaagauuuccagccccaauagaccaauuauaugcuucaccaaaugcagacguagucguacaaccccaaaacggccgaugcacccuagauggagaauuacagggaacaacacaacuccucacaacagcuauuugcucauauagaggaaccacuucaaacccaacuucagauuacugggaugaccaccuacuccacuuaguacauccaaauggagcaacauacgauccaacugaagauguaccagccccauuuggcacucaagacuuuagaggaauacuauacggaguuuuaacucaaaacacacaaaacccaagagaugaaguaucuaacucacgaggaauauauauauccuccacuucagauaaauucacaccuaaauuaggaacaaucggacuacaccaaguacaaggggacacagcuucuaaccaacaauccaaauuuaccccaguaggcauagcgguaaaccaaaauacuccauucaaacaaugggaacuaccuaacuacucaggagcauuaacauuaaauacaaaccuagcccccgcuguaggaccaaauuuccccggagaacaaauucuauuuuucagaucaaacguacccucaguacaaggaaaucacccaacacaagaaauagauugcuuaauaccucaagaauggguuucacacuuuuaucaagaaucagccccaucacaaucugacguagcucuaguuagauauguaaacccagacacuggaagaacaauauucgaggcaaaacuacauagacaaggcuucauaacuauagcggccacaggcuccaacccaguagucguaccaccaaauggauacuucagauuugacgcaugguaa

SEQ ID NO: 35012 - RNA, 1563 nt, Artificial Sequence
  derived and/or modified sequence opt6 from VP1__Norovirus_and/or_Norovirus-like__KU687014
augaaaauggcauccaacgacgcagcaccaucaaaugacggagcagcaggccuaguaccagaaauuaacacagaaacccuaccccuagaaccaguagcuggagcagccaucgcugcucccguaacaggacaaaacaacauaauagacccauggauacgaaacaacuucguacaagcaccaaauggagaauuuaccguaucaccuagaaauucaccuggcgaaauauuaaugaaucuagaacuaggaccagaucuaaauccuuauuuagcucaucuaucacgaauguauaauggauaugcaggcggaguagaaguccaaguacuccuagcuggaaacgccuucacagccggaaaaauauuauucgcagcagucccaccuaacuucccaguagacaugcuaauacccgcacaaauuacaaugcuaccacaccuuauaguugacgucaggacacuagaaccaauaaugauuccacuaccagacguaagaaacguauuuuaucacuucaauaaucaaccagcaccaagaaugagauuaguagcaauguuauacacacccuuaagaucuaacggauccggagacgauguauucacaguaucaugccgugucuuaacucgaccaacacccgacuucgaauuuacauaccuuguaccaccaaguguagaaucaaaaacaaaaccauucacuuuacccauacuaacuaucggagaacuaaccaacucuagauuuccagcaccaauagaucaacuauauacaagcccaaaugcagacguagucguucaaccacaaaauggaagauguacacuagauggagaauuacaaggaacaacccaacuauuaacaacagccauauguuccuacagagguacaacaucuaauccuaccuccgacuacugggaugaccacuuacuucauuuaguccacccaaauggcgccacuuacggaccaacugaagacguaccagcaccuuucggaacacaagacuuccguggaauacuuuacggaguacucacacaaaacacgcaaaauccaagagaugaaguaucuaacucacgaggcaucuacauauccucaaccucagauaaauuuacaccaaaacuaggaacuauugguuuacaccaaguacaaggugacacagcuucaaaccaacaauccaaauuuacacccguaggcauugcuguaaaccaaaauacaccauucaaacaaugggaacuaccaaacuacucaggagcacuaacuuuaaacacaaaucuagcaccagcaguaggaccaaauuucccuggcgaacaaauccuauucuuucgcuccaacguaccaucaguacaaggaacacacccaacacaagaaauagacugcuuaauaccacaagaauggauuucccauuuuuaccaagaaucagcacccucccaauccgauguugcacuugucagauauguaaacccggacacagguagaacaauauuugaagcaaaacuccaccgacaagguuuuauaacaaucgcagccacgggcuccaacccgguaguaguuccaccuaaugguuacuucagauucgacgcaugguaa

SEQ ID NO: 35013 - RNA, 1563 nt, Artificial Sequence
  derived and/or modified sequence opt6 from VP1__Norovirus_and/or_Norovirus-like__KU687019
augaaaauggccuccaacgaugcugcuccaucuaaugauggagcagcaggauuaguccccgaaauaaacacugaaacccucccucuugaaccagucgcaggagcagcaaucgcagcaccugucaccggacaaaacaauauaauagauccauggauaagaaacaauuucguacaagcuccaaacggcgaguucacaguuucuccaagaaauucaccaggagaaauacuaaugaaccuagaauuaggucccgaucucaaccccuaccuagcucaccucucuagaauguauaauggauaugcuggcggaguagaaguacaaguccuacuagccgguaaugcauucaccgcagguaaaauacuauucgccgccguuccaccaaacuucccagucgacaugcuaucacccgcacaaauuacuauguuaccccacuuaauuguagacguaagaacacuugaaccaauaaugauaccacuaccagacguccguaacguauucuaccauuuuaauaaccaaccagcaccacgaaugagauuaguagcaaugcuuuacaccccacuaagaucaaauggaucaggggacgauguauucacaguaucauguagaguauuaacacgaccaacuccagacuucgaauuuacauaccucguaccaccaagcguagaaucaaaaacaaaaccaucuacauuaccaauauuaaccaucggagaacuaacuaauucucgauucccagcaccaauugaccaacuauacaccucuccaaacgccgacguaguaguacaaccacaaaacggaagaugcacacucgauggagaauuacaaggaacaacacaacuacuaacaacagcaauuuguucuuauagaggaacuacaucaaacccaacaucagacuauugggacgaucaccuucuacaccugguacauccaaacggagcaacuuaugaccccacagaagaugucccugcaccauucggaacacaagauuuccgcggaauacuauauggcguacuaacacaaaacacacaaaacccaagagaugaaguaucaaacucacgaggaauauauauaucaucaacuuccgacaaauuuacaccaaaacuaggcacaauaggacuacaccaaguacaaggagauaccgccuccaaucaacaaucaaaauucacucccguaggcauagcuguuaaucaaaauacucccuuuaaacaaugggaacuaccuaacuauuccggagcauuaacauuaaacacagaccuugcuccugcaguaggaccaaacuuuccaggagaacaaauauuauucuuuagaucaaacguaccaucaguacaaggaaaucaccccacacaagaaauugacugccuaauaccacaagaauggguaucccacuuuuaccaggaaucagcaccaucacaaucagauguagcauuaguacguuacguuaacccagacaccggaagaacaauauuugaagcaaaauuacaccgccaaggauuuacaacaauagcagcuacaggaucaaacccagucgucguaccaccaaauggauacuucagauucgaaucaugguaa

SEQ ID NO: 35014 - RNA, 1563 nt, Artificial Sequence
  derived and/or modified sequence opt6 from VP1__Norovirus_and/or_Norovirus-like__KU687017
augaaaauggcaucauccgacgcagcaccaucuaacgauggagccgcaggccuagucccugaaauaaauacugaaacccuaccauuagaaccuguagcaggcgcagcaaucgccgcacccguaacaggacaaaauaauauuauagaucccuggauaagaaauaacuucguucaagcaccaaauggugaauuuaccguaucaccaagaaacucaccuggugaaauacuaaugaacuuagaacuaggaccugaucuaaauccauacuuagcucaccuuucaagaauguauaacggcuacgcuggcggaguagaaguucaaguacuacuagcaggaaaugcauucacagccgggaaaauacuuuucgcagccguaccuccuaacuuuccaguagacauguuaucaccagcacaaauuacaaugcucccccaccucauaguagacguacgcacuuuagaaccaauuaugauaccacuacccgauguacgaaacguauucuaucacuuuaauaaucaacccgcaccaagaaugcgauuaguagcuguccuuuacacuccacucagaagcaacgguagcggcgaugauguauuuacuguaucauguagaguauuaacaagaccuaccccagacuuugaauuuaccuaccuaguaccaccaagugucgaauccaaaacaaaaccauucacucucccaauccucacaauuggagaacuaacuaacucacgauucccagcaccaauagaucaauuauauacuucaccaaaugcagauguaguaguacaaccacaaaacggucgauguacauuagauggagaacuacaaggaacaacacaacuuuuaacaaccgccaucugcagcuaucguggaacaacaucaaauccaacuucagauuacugggacgaccauuuacuacacuuaguacaccccaauggagccacauaugacccaacagaagauguacccgcuccuuucggaacacaagauuuuagaggaauuuuauacgguguacugacacaagacacacaaaauccucgagacgaaguaucgaacucuagaggaauauauauaucaucuacaucugacaaauucacaccaaaauuagguaccauaggauuacaccaaguacaaggugacacagcaucuaaucaacaaucaaaauuuacccccguaggaauugcaguaaaccaaaacacaccuuuuaaacaaugggaauuaccaaauuauucaggugcacuaacguuaaauacaaauuuagcaccagcuguaggaccaaauuuccccggagaacaaauccuauuuuucagaucaaauguaccuucaguccaaggcaaccauccaacacaagaaaucgauugcuuaauaccacaagaaugggucucacauuucuaccaagaaucagccccaucacaaucagacguagcauuagucagauauguaaauccagaugcaggacgaacaauuuucgaagcaaaacuacauagacaaggauuuauaacuauugcagcaacagggucuaacccaguaguaguuccuccaaauggcuacuuucgauuugaagcaugguaa

SEQ ID NO: 35015 - RNA, 1563 nt, Artificial Sequence
  derived and/or modified sequence opt6 from VP1__Norovirus_and/or_Norovirus-like__KU687024
augaaaauggccucaucugacgcugcaccuucaaacgacggugcagcaggucuaguaccagaaauaaacacagaaacauuaccucuagaaccuguagccggcgcagccauagcagcaccaguaacaggacaaaauaauauaaucgauccuuggauacgaaacaacuucguacaagcuccaaacggagaaucaacaguuuccccacgcaacucuccaggagaaauuuuaaugaauuuagaacuaggcccagaccucaaucccuauuuagcacauuuaucccgcauguauaaugguuacgcaggaggaguagaaguacaaguauuacuugcaggaaaugcauucacugcuggaaaaauccuuuucgcagccgucccaccuaacuucccaguagacaugcuuucaccagcccaaauuaccauguuaccacaucuaauaguggacguuagaacacuagaaccuauaaugauaccauuacccgacguacgaaacguauuuuaccacuucaauaaccaaccagcaccaagaaugcgccuaguagcaauguuauauacaccauuacgaucaaacggagcaggagaugacguauuuacuguuucuugccgaguccuaacucgaccaacaccagauuuugaauuuaccuauuuaguuccaccaucaguagaaucaaaaaccaaacccuucacacuaccaauauuaacaauaggagaacuaacaaacucacgauuucccgcaccaauagaucaacuuuauacaucuccaaacacagauauauuaguccaaccacaaaacggacgaugcacauuagauggagaauuacaaggaaccacacaacuacuaacaacugcaauaugcucuuaucgaggcacaacaucaaacccaaccuccgacuacugggacgaccaccuucuacaccuuguccauccaaacggagcaacauacgacccaacagaagaugucccagcacccuucggaacucaagauuucagaggaauacuauauggcguauuaacacaaaacacccaaaacccacgagacgaagucucaaauucacgaggaauauacauaucaucaacaucagauaaauuuacaccaaaauuaggaacaaucggucuacaucaaguccaaggugauacugcaucaaaucaacaaucuaaauuuacaccagucggaauagcaguaaaucaaaacacaccauucaaacaaugggaauuaccaaacuauucgggugcauuaacuuuaaacaccaaucuagcccccgcagucggaccaaauuuccccggagaacaaauacuauuuuuccgcucaaauguaccaucuguacaagguacacauccuacacaagaaauugacugccuaauaccacaagaauggauaucacauuuuuaucaagaaucagcccccucacaaucagaugucgcccuaguacgcuacguaaauccagacaccggaagaacaaucuucgaagcaaaacuucacagacaaggauucauaaccauagcagccacagguucaaaccccgucguaguaccaccaaauggcuacuuccgauucgaagcaugguaa

SEQ ID NO: 35016 - RNA, 1563 nt, Artificial Sequence
  derived and/or modified sequence opt6 from VP1__Norovirus_and/or_Norovirus-like__KU687022
augaaaauggcaucuaaugaugcugcacccucaaacgacggugcagcaggccuaguaccugaaauaaacacagaaacccucccucuagaaccaguagccggagcugcaaucgcagcaccaguaacaggccaaaacaacauaauagacccauggauaagaaacaacuuuguacaagcacccaacggugaauuuacaguaagcccaagaaauuccccaggagaaauacuuaugaacuuagaacuaggaccugaucucaacccauaucuagcucaccccuccagaauguauaacggcuacgccggaggcguagaaguccaagucuuauuagccgguaaugcauucacagcaggaaaaauuuuauucgcagcaguaccaccuaacuuccccguagauauguuaucaccaacacaaauaacaauguuaccacacuuaacaguugacguccgaacacuagaaccaauaaugaucccccuuccagacguacguaacgucuuuuaccauuucaacaaccaaccagcuccaagaaugagauuaguagcuaugcuauacacaccacuacguuccaacggaucaggagacgauguccuuacaguauccugcagaguccuaacaagaccaacaccugacuuugaauuuaccuaccuaguacccccaucagucgaauccaaaacaaaaccauucacacuaccuauacuaaccauaggugaacuaacaaacucccgauuucccgcacccaucgaucaacuauauaccucacccaaugcagauguuguuguccaaccccaaaacggaagaugcaccuuagacggagaauuacaaggaacaacgcaacuacucaccacugcuauauguucauauagagguacuacaucuaacccaacauccgacuacugggaugaccaucuucuacaccuaguucacccaaacggagcaacuuacgacccaacagaagauguaccugccccauuugguacacaagacuuuagaggaauauuauacggaguccuaacacaaaauacucaaaacccaagagacgaaguaucaaauucccgagguauauacauuucaucaacaucagacaaauucacaccaaaauuaggaacuauaggccuacaucaaguacaaggcgauacagcauccaaccaacaaucaaaauuuaccccuguaggaauugccgucaaccaaaauacaccauuuaaacaaugggaacucccuaauuauucaggagccuuaacacuaaacaccaaucucgcuccagcaguuggaccuaacuucccaggagaacaaauauuauucuucagauccaacguaccuucaguacaaggcaaucacccaacccaagaaauagauugucuaauaccgcaagaauggguaucacacuucuaucaagaaucagcacccucccaaucagacgucgcauuaguaagauacguaaaccccgauacaggaagaacaauauuugaagcuaaacuacaccgacaaggguucauaacaauagccgccacaggaucaaaccccguagucguaccacccaacggcuacuucagauuugaaucaugguaa

SEQ ID NO: 35017 - RNA, 1563 nt, Artificial Sequence
  derived and/or modified sequence opt6 from VP1__Norovirus_and/or_Norovirus-like__KU687023
augaaaauggccucuucagacgcugccccuagcaaugacggugcagcaggacucguaccagaaauaaauacagaaacauuaccucuagaaccugucgcaggagcagcaauagcagcuccaguaaccggacaaaacaacauaauagacccauggauuagaaacaacuucguccaagcaccaaauggagaauuuacagucagcccuagaaacucaccaggagaaauacuaaugaaccuagaacucgguccagaccuaaaccccuacuuagcccacuuaucuaggauguauaacggcuaugccgguggcguagaaguccaaguacuacuagcuggaaaugccuucacagccggaaaaauacuauucgcagccguaccaccaaacuucccaguugacauguuaucaccagcacaaauaacuauguuaccacaucuaauaguagacguaagaacacuagaaccaaucaugauaccccuaccagacguuagaaacguauuuuaccauuuuaacaaccaacccgccccaagaaugagacucgucgcaaugcuauacaccccacuaagaucaaauggaucaggcgacgacguuuucacaguaucauguagaguacucacuagaccaacaccagacuuugaauuuacauacuuaguuccuccaagcguagaaucaaaaaccaaaccauuuacauuaccaauauuaacuaucggagaacuaacaaauucacgauuuccagcacccauagaccaauuauacacaucaccaaauacagauauacuuguacaaccucaaaacggacguugcacauuagacggagaacuacaaggcacaacacaacuauuaacaaccgcaauaugcucauauagaggcacaacauccaauccaaccucugacuacugggacggucauuuauuacacuuaguccauccaaacggugcaacuuaugauccaacagaggaugucccagccccauucggcacacaagacuuuagagguauauuauacggaguucuaacucaaaauacacaaaauccaagagacgaaguaucaaacuccagaggaauuuacauaaguucaacaagugacaaauuuacaccaaaauuaggaacaauaggacuacaccaaguacagggugacacugcaaguaaucaacaaucuaaauucacaccaguaggaauugcaguaaaccaaaacacaccauuuaaacaaugggaacuuccaaauuacagcggcgcacuaacacuaaacaccaacuuagccccagcuguaggacccaacuucccaggcgaacaaauacuauucuuuaggucaaacguacccagcguacaaggaacacauccaacacaagaaauagacuguuuaauaccacaagaauggauaucacacuucuaucaagaaucagcacccucccaaucugacgucgcacuuguacgauacguaaacccugauacaggaagaacaauauucgaagcaaaacuacacagacaagguuuuaucgcaauagcagcaacaggaucaaacccuguugucguaccuccaaacggauacuuccgauuugaagcaugguaa

SEQ ID NO: 35018 - RNA, 1563 nt, Artificial Sequence
  derived and/or modified sequence opt6 from VP1__Norovirus_and/or_Norovirus-like__KX764847
augaaaauggcaucuaacgaugccaacccaucugacggaucagcagcuaaccuaguuccagaaguaaauaacgaaguaauggcuuuagaaccaguggucggagcagccauugcggcuccuguagcaggacaacaaaauguaauagaucccuggauacguaauaauuuuguacaagcaccagguggagaauuuacaguaucccccagaaaugcaccuggcgaaauacuuuggucugcaccauuaggcccagaccuuaauccuuauuuaucacaccuagcacguauguacaauggauaugcaggaggauuugaaguacaaguaauucucgcaggaaacgcauuuacugcaggcaaaguuauuuuugccgcaguaccaccaaacuucccaacagaaggcuuaucacccucgcaaguaacuauguuuccacauauaguaguugacguacgacaacucgaaccaguauuaaucccuuuaccagauguuagaaauaauuuuuaccauuauaaccaaucaaacgacccaacaauaaaauuaaucgcaaugcuuuacacaccauuaagagcaaacaaugcuggugacgacguauuuacaguaucauguagaguuuuaaccagaccauccccugacuuugauuuuauuuuucucgucccuccaacaguagaaucaagaacaaaaccuuuuuccguaccaguacuaacuguugaagaaaugaccaacucaagauuuccaauaccccuugaaaaacuuuucacaggcccuucaucagcauuuguaguacaaccccaaaacggaagauguacaacagauggaguacuucuaggaacuacacaacuaucacccguuaauauaugcacauuucgaggagauguuacacauauaacaggaucaucaaauuacacaaugaauuuagcaucacaaaacuggucaaacuacgauccuacugaagaaauaccagcaccucucgguaccccagacuuuguagguaaaauacaaggcauguuaacacaaaccacaagaacugacggaucaacuagaggacauaaagcaacuguauacacagguucagcagacuuugcucccaaauuaggucgaguccaauucgaaacagauacagaucaugauuuugaagcaaaccaaaauacuaaauucacacccgucggaguaauucaagacggaucaacaacacauaggaaugaaccacaacaauggguucuaccauccuauucuggacgcaauacuccuaauguacacuuagccccugcaguagccccaacauucccaggagaacaacuacuauucuuuagaagcacuaugccuggaugcucagguuaccccaauauggaccuagacuguuuauuaccacaagaauggguacaauauuuuuaucaagaagcagcaccagcacaaucagacguagcauuacuacgauucguaaacccagauacaggacgaguauuauucgaauguaaacuacauaaaaguggauauguuacaguagcccacacaggucaacaugacuuaguaauaccaccaaacgguuacuucagauucgaagcaugguaa

SEQ ID NO: 35019 - RNA, 1563 nt, Artificial Sequence
  derived and/or modified sequence opt6 from VP1__Norovirus_and/or_Norovirus-like__KX764846
augaaaauggccucuaaugacgcaaacccaucggauggaagcgcagcaaaucuaguaccagaaguaaauaacgaaguuauggcacuagaaccaguaguaggagcagcaauagcagcaccaguagcaggacaacaaaauguaauugaccccuggaucagaaauaauuuuguucaagcaccaggaggugaauuuacaguuucaccaagaaaugcaccaggugaaauuuuauggucugccccucuuggacccgacuuaaauccauauuuaucccacuuagcaagaauguauaauggauacgcuggagguuuugaaguccaaguuauucuagcaggaaaugcuuucacagcugguaaaguaaucuuugcugcaguaccaccaaauuuuccaacagaaggauuaucaccaucacaaguaacaauguucccacauaucguaguugacguacgacaauuagaaccaguacuaauaccauuaccagacguacgaaauaacuuuuaucauuauaaccaaucaaacgacccacccauaaaauuaauagcaaugcuauauacuccacuaagagcuaacaaugccggugacgaugucuucacaguaucaugcagaguucuaaccagaccaucuccagacuucgauuuuauauuuuuagucccaccuacugucgaaucacguacuaaacccuucucaguaccuguauuaacaguagaagaaaugacaaauucucguuuuccaauuccauuagaaaaacuauucacgggaccaucaucagcauucguaguacaaccacaaaacggaagaugcacaacagacggaguauuacuaggaacaacacaacuaucaccugucaauaucugcacauuucgaggagauguaacucauauaaccggcucaagaaauuacacaaugaaucuagcaucacaaaauuggucaaauuacgacccaacagaagaaauacccgcaccauuaggaaccccagacuuuguuggaaaaauccaaggaauguuaacacaaacaacaagaacagacggauccacucgaggacauaaagcaacuguuuauaccggaucagcagacuuugcaccaaaauuagguagaguccaauucgaaacugacacagaccaugauuucgaagcaaaucaaaauacaaaauuuacacccgucggaguaauacaagauggaucaacuacacauagaaacgaaccucaacaauggguuuuaccaucauauucaggucgcaauacuccaaacguacaccuagccccagcaguagcaccuacauuuccaggagaacaacuauuauucuuucgaucuaccaugccaggaugcuccggauaucccaacauggaucuagauuguuuacuuccacaagaauggguucaauacuuuuaucaagaagcugcaccagcacaaagugacguagcacuccuaagauuuguaaauccagacacaggcagaguacuauuugaaugcaaacuacauaaaucaggauauguaacaguagcacacacgggccaacaugaucuaguuauaccuccaaacggauacuucagauuugaugccugguaa

SEQ ID NO: 35020 - RNA, 1563 nt, Artificial Sequence
  derived and/or modified sequence opt6 from VP1__Norovirus_and/or_Norovirus-like__KX764833
augaaaauggcaucuucagacgcaaauccauccgacggaucagcagcaaauuuaguacccgaaguaaauaacgaaguuauggcacuugaaccagucguaggagcagcuauagcagcaccaguagccggacaacaaaauguaaucgauccuuggaucagaaauaacuuuguacaagcaccaggaggagaauuuacuguuucaccaagaaacgcaccaggagagauauuauggucagcaccacuaggacccgaucuuaacccuuacuuaucacaccuugcacguauguacaacggauaugcaggcggauucgaaguacaaguaauacuagcaggcaaugcauuuacugccggaaaaauaauuuucgcagcaguaccaccuaauuuccccacagaaggucuaaguccaucccaagugaccauguucccacacaucauaguagacguucgacaacuagaaccaguauuaaucccacuuccugauguacgcaacaauuucuaccacuacaaccaaagcaaugauucaacaauaaaauuaauagcaaugcuauauacaccauuaagagcaaauaaugcaggcgacgauguauuuacaguaucaugccgcguacucaccagaccuucaccagauuucgacuuuauauuuuuaguaccaccuacaguagaaucaagaacuaaaccauucucagucccaguauuaacuguagaagaaaugacaaacuccagauuuccaauaccauuagaaaaacuauucaccggcccaagcucagcuuucguaguacaaccacaaaacggaagaugcacaacagacggaguacuacuaggaacaacucaauuaucaccaguaaauauaugcacauuuagaggagacguaacucacauaacuggaucccgaaauuacacuaugaacuuagcaucacaaaacuggaacaauuacgaucccacagaagaaauaccugcaccucuaggcaccccugauuucguaggaaaaauucaaggaauguuaacacaaacuacaagaacagacggcucaacacgcggucaccgugcuacaguauauacaggaucugcugacuucgcaccaaaauuaggacgaguacaauuugaaacagauacagaccacgacuucgaagcaaaccaaaauacaaaauuuacacccgucggaguaauacaagacggauccacaacucacagaaaugaaccacaacaaugggucuuaccaucauauaguggacgaaauacacauaacguacacuuagcaccagcaguagcaccaacauucccaggagaacaacuauuauucuucagaagcacaaugccaggauguucaggauauccaaauauggacuuagauugccuacucccacaagaauggguccaauauuucuaccaagaagcagcuccugcacaaucagacguugcauuauuaagauucguaaaccccgacacaggaagaguauuauucgaauguaaauuacauaaaaguggauauguaacaguugcacacacuggucaacacgaccuaguuauacccccaaauggcuauuucagauuugaugcaugguaa

SEQ ID NO: 35021 - RNA, 1563 nt, Artificial Sequence
  derived and/or modified sequence opt6 from VP1__Norovirus_and/or_Norovirus-like__KX764834
augaagauggcaagcucugacgcaaacccuuccgauggaucagcagcaaacuuaguuccagaaguaaacaaugaaguaauggcacuagaacccgucguaggagcagcaauagcagcaccuguagcuggacaacaaaacguaauagauccauggauuagaaauaacuuuguucaagcaccaggaggagaauuuaccguaaguccaagaaaugcaccaggugaaaucuuauggucugcuccauuaggaccagaucucaauccauaucuuucacaucucgcucgaauguacaacggauacgcaggaggcuuugaaguacaaguuauauuagccggaaaugcauuuacagcagguaaaauaauauuugcagcuguaccaccuaacuuuccaacugaaggacuaucaccaucacaaguaaccauguuuccucacauaauuguugacguuagacaauuagaaccaguacuaauaccauuaccagauguccguaacaacuucuaccacuauaaccaaucaaacgauucaacaauaaaacuuauagcaaugcuauacaccccacuaagagcaaauaaugcuggagaugauguauuuacaguuuccugccgaguccucacacguccauccccagacuucgacuuuauauuuuuaguacccccuaccgucgaaucuagaacaaaaccauucucagucccaguacuaaccguagaagaaaugacaaauucccgauuucccauuccauuagaaaaacucuuuacaggaccauccucagcauucguuguccaaccacaaaauggaagauguaccacagacggcguauuacuagauacaacacaacucuccccuguaaauaucuguacauuucgaggagacgucacacauauaacaggaucucgaaacuauacuaugaaucucgcaucucaaaacuggaacaacuaugauccaacagaagaaauaccagccccauuaggaacaccagauuucguaggaaaaauacaagguaugcuaacacaaaccacaagaaccgacggaucaacucgaggacauaaagccacaguuuauaccggaucagcugauuuugccccaaaauuaggaagaguucaauuugaaaccgacacagaccacgauuuugaagccaaucaaaacacaaaauucacaccaguuggcguaauacaagacgguuccacaacacaucguaacgaaccacaacaauggguuuuacccuccuauaguggcagaaacacacacaauguucaccuagccccagcuguagcaccaacauuucccggagaacaauuauuauucuuuagaucaacaaugccuggaugcucaggauacccaaacauggauuuagauugccuccucccacaagaauggguacaauacuucuaucaagaagcagcaccagcccaaagugacguagcauuauuacgauucguaaacccagauaccggucgaguacuauucgaaugcaaauuacauaaaucaggauacguaacagucgcucauacaggccaacaugauuuaguaauaccaccaaauggauauuucagauucgauucuugguaa

SEQ ID NO: 35022 - RNA, 1563 nt, Artificial Sequence
  derived and/or modified sequence opt6 from VP1__Norovirus_and/or_Norovirus-like__KU687027
augaaaauggcuucaaaugaugcuaaccccucagacggaucagcagcaaaccuaguacccgaaguaaacaaugaaguaauggcacuagaaccagucgucggagcagcaauagcugcauuaguagcaggacaacaaaauguaauagacccuuggauaagaaacaauuucguccaggcaccaggaggagaauuuacuguaucacccagaaaugcaccaggugaaauacuauggucagcaccuuuaggaccagaucucaauccauaucuaucacaucuagcaagaauguacaauggauacgcaggaggauuugaaguacaaguaauuuuagcaggaaaugcuuuuacagcgggaaaaguaaucuuugcugcugucccaccaaauuuuccaacugaaggacuaucaccaucacaaguaacaauguucccacauauaguaguagauguaagacaacuagaaccaguacuaauaccuuuaccagacguaagaaacaauuucuaccacuauaaccaaucaaacgacccaaccauaaaauuaauagcaauguuauauacuccauuacgagcaaauaaugcuggagaagauguauuuacaguauccuguagaguacuaacaaggcccucuccagauuuugauuuuauauuuuuaguaccuccaacuguagaaucaagaacuaaaccauuuucaguaccaguauuaacaguggaagaaaugacuaauucaagauuuccaauuccauuagaaaaacuauuuacaggacccucauccgccuucguuguccaaccgcaaaacggcagaugcacaacagauggaguucuacuaggcacaauucaacuuucaccuguaaacauuuguacauuuagaggagacgucacacauauaacaggaagcagaaacuauaccaugaaucuagcaucacaaaauuggaaugacuaugauccaacagaagaaauaccagcacccuuaggaacaccugauuuuguugguaaaauacaagguaugcuuacacaaacuacacgcacagauggaagcacccgaggccauaaagcaacugucuacacaggaucagcugacuuugcaccaaaauuaggacgcguccaauucgaaaccgacacugaucaugauuucgaagcaaaccaaaauaccaaauucacuccaguuggaguuauccaagauggaucaacaacacauagaaaugaaccccaacaauggguuuuaccaucauauucaggccgaaauacuccuaacguucauuuagcuccagcaguugcaccaaccuuuccuggcgaacaauuauuauucuuuagaucaacaacaccugguuguuccggauauccaaauauggaccuagacugccuccuuccucaagaauggguucaauauuuuuaccaagaagcagcaccagcacaaucagauguugcccuuuuaagauucguaaacccagauacugguagaguauuauucgaauguaaacuacauaaaucugguuacgucacuguagcacauacaggacaacacgacuuaguaaucccacccaauggauauuucagauucgaaucaugguaa

SEQ ID NO: 35023 - RNA, 1563 nt, Artificial Sequence
  derived and/or modified sequence opt6 from VP1__Norovirus_and/or_Norovirus-like__KX764835
augaaaauggcaucaaacgaugcuaauccaucagacggcucagcagcaaauuuaguuccugaaguaaacaaugaaguaauggcccuugaaccaguaguaggcgcugcaauagccgcacccguagcaggacaacaaaaugucauagacccauggauuagaaacaacuuuguacaagcaccaggcggcgaauuuaccguaucaccaagaaaugcaccaggugaaauauuauggucagcaccuuuaggaccagaucuaaacccauaucuaagucacuuagcaagaauguacaacggauaugcaggaggcuucgaaguucaagucauacucgccggaaaugcauucacugccggaaaaauaaucuuugcagcaguacccccaaauuuccccacugaaggccuaucuccaucacaagugacaauguucccacauauaauaguagacguaagacaauuagaaccaguacuaauaccauuaccagauguaagaaacaauuuuuaucauuauaaccaaucaaaugacucaacuauuaaauuaaucgcuaugcuauacacuccacccagagcaaauaaugcuggagacgauguauucacaguuuccuguagaguacuaacaagaccuucaccagacuuugacuuuauauuuuuaguaccaccaacuguagaauccagaacuaaaccuuucucaguuccaguacuaaccguagaagaaaugacuaacucuagauuuccaauuccacuagaaaaauuauucacuggaccaucaucagcuuucguuguucaaccacaaaacggccgauguaccacugacgguguauuauuaggaaccacucaauugucaccuguaaacauauguacauuucgaggugauguaacacauauaacuggcucacgaaacuacacaaugaaccucgcaucacaaaacuggaacaauuaugauccaaccgaagaaauaccugcacccuuaggaacaccagacuuugucggaaaaauacaaggaauguuaacacaaacaacccguacagacggaucuacuagaggacauaaagcaacaguauacacagguucagcagauuuugcacccaaauuaggucgcguacaauucgaaaccgauacagaucaugauuuugaagcaaaucaaaauacaaaauucacaccaguuggugucauacaagacgguucaacaacacacagaaacgaaccacaacaaugggucuuaccaagcuauucaggacgcaauacacacaauguacauuuagcaccagcaguagcaccaacauuucccggugaacaacuacuauucuuucguuccacaaugccaggcuguucuggcuacccaaauauggauuuagacuguuuacuaccucaagaauggguacaauauuuuuaucaagaagcagcaccagcacaaucagacguugcauuacuuagauuugucaacccugauacaggucgaguacuuuucgaaugcaaauuucacaaaucuggcuauguaacaguagcacacaccggacaacaugaucucgucauaccacccaauggcuauuuccgauuugaaucaugguaa

SEQ ID NO: 35024 - RNA, 1563 nt, Artificial Sequence
  derived and/or modified sequence opt6 from VP1__Norovirus_and/or_Norovirus-like__KX764832
augaaaauggcauccaacgauguaaacccauccgaugguucagcagcaaaucuuguaccagaaguuaacaaugaaguaauggcauuagaaccaguaguaggugcagcaauagcagcaccuguugcaggacaacaaaauguaauagacccauggaucagaaacaauuuuguacaagcaccugguggagaauuuacaguaucacccagaaaugcacccggcgaaauacuuuggucagcaccacuuggucccgaucuuaaucccuaucuaucacacuuagcacgaauguauaacggauacgccggaggauucgaaguacaaguaauuuuagcgggaaaugcuuuuacugcuggaaaaauaauauucgcagcaguaccaccuaauuuuccuacagaaggccucucaccaucucaaguaacaauguucccacacauaauaguagacguuagacaauuagaaccaguacuaauaccacugccagauguaagaaacaauuuuuaucauuauaaccaauccaacgacucaacuaucaaacuaauagcuauguuauacacaccacucagagcaaauaaugccggggaugauguauuuaccguauccugcagaguucuaacaagaccaucacccgauuuugauuuuauauuucuaguaccuccaacaguagaaucaagaacaaaaccauucucaguuccuguacuaacagucgaagaaaugacuaacucuagauuuccaauaccauuagaaaaacuauuuacaggaccaucaucagcuuuuguaguacaaccacaaaauggacgauguacaacugacggaguacuuuuaggaaccacucaguuaucaccagucaacauaugcacauuuagaggagaugucacacauaucacuggaucaagaaacuacacuaugaaucuagcaucacaaaauuggaacaacuacgauccaacagaagaaauaccugcuccauuagguacaccugauuuuguaggaaaaauccaagguaugcuaacacaaacaacaagaacagacggaagcacaagaggacauaaagcaaccguauauacgggaucagcagacuucgcaccaaaauuagguagaguacaauucgaaacagauacagaucacgacuuugaagccaaucaaaauacuaaauuuacaccaguaggaguuauacaagacggaagcacaacccauagaaaugaaccacaacaaugggcauugccuucauacucagguagaaacacacacaacguucauuuagccccugcaguugcaccuacauuucccggagaacaacuacuauucuuccgaucaaccaugcccggaugcucaggauauccaaauauggauuuagacugccuacuuccccaagaauggguucaauacuuuuaucaagaagcagcaccagcacaaucagauguagcauuacuacgcuuuguaaauccaaacacaggccgaguacuuuuugaauguaaacuacacaaaucaggacauguaaccguagcccacacaggacaacacgaucuaguaauaccaccuaauggcuauuuccgauuugauucaugguaa

SEQ ID NO: 35025 - RNA, 1563 nt, Artificial Sequence
  derived and/or modified sequence opt6 from VP1__Norovirus_and/or_Norovirus-like__KU687025
augaaaauggcaucaaacgacgccaauccuuccgaugguucagcugcaaaccuaguaccagaaguaaauaaugaaguaauggcccuagaaccuguuguaggagcagcaaucgcagcaccaguagcaggacaacaaaacguaauagacccauggauaagaaauaauuuuguacaagcuccaggaggugaauuuacgguaucaccuagaaaugcaccaggagaaauacuauggucagcaccauuaggccccgaucuaaauccauaccuuucacacuuagcacgaauguauaauggauacgcggguggauucgaaguucaagucguucuagcaggcaaugcauucacugcuggaaaaguaauuuuugcagcaguaccaccuaacuuucccaccgaagauuuaucuccaucacaaguuacuauguucccucauauuguaguagauguuagacaacuagaaccaguacuaauuccccuacccgauguacgcaacaauuucuaucacuauaaccaaucaaaugacccuacaauaaaacuuaucgcuauguuauacacaccauuaagagcaaacaaugcuggugaagauguauucaccguaucuugucgaguucucacaagaccaucgccagacuucgauuuuauauuucuaguaccaccaacagucgaaucaagaacaaaaccuuuuucaguaccaguauuaacaguugaagaaaugacaaauucaagauucccuauaccauuagaaaaacuauuuacaggaccaucaucagcauuuguaguucaaccccaaaacggaagauguacaacugaugguguacuucuaggaaccauucaacuaucaccaguaaauauauguacauuuagaggagacguaacacauauaacuggauccagaaauuauacaaugaauuuagcuucacaaaacuggaauaauuaugauccaacugaagaaauuccugccccacuggguacaccugauuucguaggaaaaauacaaggaaugcuaacccaaacaaccagaacagacggaucaacaagaggacauaaagccacuguauauacaggaucugcagacuucgccccuaaacucggacgagcacaauucgaaaccgacacugaucacgauuucgaagcaaaucaaaauacaaaauucacaccaguaggaguaauacaagacggaucaacuacacaucgaaaugaaccacaacaauggguauuaccuucauauucuggaagaaacacgccuaacguacauuuagcaccagcaguagcaccuacuuucccaggagaacaacuacuauucuuuagaaguacaacuccaggauguucuggauauccaaauauggauuuagacugcuuacuaccucaagaauggguccaauacuucuaucaagaagcagcacccgcacaaucagacguagcacuacucagauucguaaauccagacacaggucgaguacucuucgaaugcaaauuacauaaaucuggauauguaaccguugcucaugcaggacaacaugaccuaguuauaccucccaacggauauuucagauuugaagcaugguaa

SEQ ID NO: 35026 - RNA, 1563 nt, Artificial Sequence
  derived and/or modified sequence opt6 from VP1__Norovirus_and/or_Norovirus-like__KU687026
augaaaauggccaguucagaugcaaacccaucagauggaucagccgcaaacuuaguaccagaaguaaacaaugaaguaauggcauuagaaccaguaguaggagcugcuaucgccgcacccguagcaggacaacaaaauguaauagacccauggauaagaaauaacuuuguucaagcuccagguggagaauuuacaguaucuccaagaaacgcaccaggagaaauccuauggucagcaccacuagguccagaccuaaauccauaccugucacacuuagcaagaauguacaauggcuaugccggaggauuugaaguacaaguaauucuagcaggcaacgcauuuacagcaggaaaaguaauauucgccgcgguacccccaaauuuuccaacagaaggucuaucaccaucccaaguaacaauguucccacacaucguaguagauguuagacaauuagaacccguacuaauaccucuaccagauguacgaaauaauuuuuaucacuacaaccaaucaaacgaccccacaauuaaauuaaucgcaaugcuauauacuccacuccgagcaaacaaugcaggagaagauguauucacaguaucaugcaaaguacuaacuagaccuuccccagauuuugacuuuauuuucuuggucccaccuacuguagaauccagaacaaaaccauuuucagucccuguauuaacaguagaagaaaugacaaacucaagauuucccauccccuuagaaaaacuauucaccgguccuucaucugcauucguaguacaaccacaaaacggaagaugcaccacagaugguguuuuauuaggaacaauacaauuaucaccugucaauauauguacauucagaggagauguaacacauauaacugguucaagaaacuacacuaugaaccuagcuucacaaaacuggaacaacugugauccaacagaagaaauaccagcaccacuaggcacaccagauuuuguaggaaaaauacaaggaaugcuaacccaaacuacuagaacagauggaucaacaagaggacacaaagcaaccguauacacaggaucagcagauuucgcaccaaaacuaggaagaguucaauuugaaaccgauacugaucacgauuuugaagccaaucaaaauacaaaauucaccccuguaggagucauucaagauggaucuacaacucauagaaaugaaccacaacaauggguucuaccaucauauucaggacgaaauacaccaaauguacauuuagcuccagcaguagcuccuacauucccaggagaacaacucuuauucuucagaucaacaacgccaggauguucaggauacccaaacauggaucuugacuguuuacuaccucaagaauggguucaauacuuuuaccaagaagcagcaccagcacaaucagacguagcccuacuacgcuucguaaacccagauacaggcagaguacuauuugaaugcaaauuacauaaaucaggauacgucacagucgcacauacaggacaacacgaucuagucauaccaccuaacgguuauuuuagauucgaugcaugguaa

SEQ ID NO: 35027 - RNA, 1563 nt, Artificial Sequence
  derived and/or modified sequence opt6 from VP1__Norovirus_and/or_Norovirus-like__KU687028
augaaaauggcaucaaacgaugccaaucccucagaugguucagcagcaaaccucguaccagaaguaaacaaugaaguaauggcacuugaaccagcaguaggugccgcaauagcagcaccaguagcagggcaacaaaacguaauagauccauggauuagaaauaauuuuguacaagcaccaggaggugaauuuacaguaucaccaagaaacgcaccaggcgaaauauuauggucugccccuuuagguccagaccuaaauccauaucuaucacacuuagcacguauguauaaugguuaugcuggaggcuucgaaguacaaguaauucucgcagguaacgcauuugccgcagguaaaguaauauuugccgccgugcccccaaacuuuccaacagaaggccuuucaccaucacaaguuacaauguucccccacauaguaguagacguucgccaauuagaaccaguacuaauaccuuuacccgauguccgaaauaauuuuuaucauuacaaccaaucaaaugauccaacaauaaaauuaauagcaauguuauacacaccucuuagagccaacaaugccggcgaagauguauuuacaguaagcuguagaguacuaacacgaccaagcccagauuuugacuuuauauuuuuaguacccccuacaguugaaagcagaacaaaaccauuuucaguacccguccuaacaguagaagaaaugacaaacaguagauucccuauaccccuagaaaaacuauucacaggaccuucuucagcauuuguaguacaaccacaaaauggaagauguacaacagacggugucuuacuaggaacaauccaauuaucacccguuaauauaugcacauuuagaggagacguaacucauauaaccggaucuagaaacuauacaaugaaucuagcaucccaaaacuggaauaacuacgaucccacugaagaaaucccagcaccauuagguaccccagacuuuguaggaaaaauacaaggaaugcuaacucaaacaacaagaacugauggaucaacaaggggacacaaagcuaccguuuauacugguucugcagauuucgccccaaaacuaggaagaguucaauuugaaacagacacagaucacgauuucgaagccaaucaaaauacuaaauucaccccuguaggaguuauucaagauggauccacaacacacagaaaugaaccacaacaauggguccuaccuucauauucaggaagaaauacucccaacguacacuuagcuccagcagucccaccuacauucccuggagaacaacuauuauucuuuagaucaacaaccccagguugcucuggauauccaaauauggaucuugauuguuuacuaccccaagaauggguacaauauuuuuaucaagaagcugcuccugcacaaucagauguagcccuauuacgauuugucaaccccgacacuggacgaguacuauuugaaugcaaacuacauaaauccggauaugucacaguagcacauaccggacaacacgaucuugugauaccuccaaacggauacuuuagauuugaaucaugguaa

SEQ ID NO: 35028 - RNA, 1563 nt, Artificial Sequence
  derived and/or modified sequence opt6 from VP1__Norovirus_and/or_Norovirus-like__KX764831
augaaaauggccucuucugacguuaauccaucagauggaucagcagcaaaccugguaccagaaguaaacaaugaaguuauggcacuagagccaguaguaggagccgcaauagcugcaccagucgcaggacaacaaaauguaauagacccauggauacgaaauaacuucguucaagcaccaggaggagaauuuacaguuuccccaagaaaugcaccaggcgaaauauuauggucagcuccacuugguccagaccuaaauccauauuuaucacacuuagcacgcauguauaaugguuaugcaggcggauuugaaguccaaguaauauuagcuggaaacgcuuuuacagccgguaaaauaaucuuugcagcaguuccaccaaauuucccaaccggaggauuaucaccaucccaaguaacaauguucccucacauaaucguugauguuagacaacuagaacccguacucauaccacuuccagacgucagaaauaacuuuuaucauuauaaucaaucaaaugacucuacaauaaaauuaauagcaaugcuauauacaccucuaagagcaaacaaugcaggagacgauguauuuacaguaucaugccgaguacuaaccagaccaucaccagacuuugacuuuauauuucuaguaccaccaacaguugaaagcagaacaaaaccauuuuccguucccguacuuacugucgaagaaaugacaaauucacgauucccaauaccacuggaaaaacuauuuacaggaccaaguucagcauucguaguccaaccccaaaauggaagauguacuacagacggaguauuacucgguacaacucaacuaucaccaguaaacauauguacuuuucgaggugauguaacacauauaacaggaucaagaaauuacacaaugaauuuagccucacaaaacuggaacaauuacgauccaacagaagaaauuccagccccacuaggaacaccagacuucguaggaaaaauacaaggaauguuaacacaaaccacaagaacagacgguccaacacgaggacacaaagcuacaguauauacaggaagcgcugauuucgccccaaaacucggaagaguacaauuugaaacugauacagaucacgauuuugaagcaaaucaaaauacuaaauucacaccaguaggcguaauacaagauggaucaaccacacauagaaaugaaccacaacaaugggucuuaccauccuauaguggacgcaauacacacaacguucacuuagcuccagcaguugccccaaccuuuccaggagaacaacuccuuuucuuuagaucaacuaugccagguugcucaggauacccaaacauggauuuagauugccuacuaccucaagaauggguucaauacuuuuaucaagaagcagcaccagcacaaagugacguugcauuauuaagauuuguaaacccagacacaggacgcguauuauucgaauguaaacuacacaaaucagguuauguaacaguagcacacaccggccaacacgaucucguaaucccacccaacggauauuuuagauuugaagcaugguaa

SEQ ID NO: 35029 - RNA, 1560 nt, Artificial Sequence
  derived and/or modified sequence opt6 from VP1__Norovirus_and/or_Norovirus-like__JN222366
augaugauggcaaguaaagaugcaccaacaaguccagacggcgcaucaggagcuggucaauuaguaccagaagcaaauacagcugaacaaaucucuauggauccuguugccggagcaucaacugcaguugcaaccgcuggccaaguuaacaugauagacccauggauauuuaauaauuuuguucaagcuccacaaggugaauuuacaauaucaccuaacaauacuccuggcgauauacuauuugacuuacaauuaggaccacauuuaaaucccuuuuuagcucauuuaucacaaauguauaauggauggguugguaauaugagaguaagaauuuuacuugcaggaaacgccuuuacagcaggaaaaauaauuauuugcugcguaccaccuggauuugaugccaggauucuaacuauagcacaagcaacauuauuuccucauuuaauagcagauguaagaacacuagaacccguagaacuaccacuugaagacguaagaaauguccuauaccauaauucaucacaaccacaaccaaccaugagacucguagcaaugcuauauacuccucuaagaacaggugguggaucuggaggaacugaugcuuuuguaguugcaggacgaguacuuacuuguccagcaccagacuuuaguuucuuauuucuaguaccacccucaguagaacagaaaacaagagucuuuucaguacccaauaucccuuuaaaagaucuauccaacucaagaguuccaguuccaauacaaggaauguuuaugucaccagaugucaaccaaucaguacaauuucaaaauggaagaugucaaaucgacggacaacuccaaggaacuacaccaguaucauuaucucaacuauguaaaauacgaggaaaaacaagcagcaaugccagaguacuaaacuuaucugaaguagauggaacuccauuuauuccauuagaaucuccugcaccagucggauuuccugauuuaggaggaugugacuggcaugucaacuuuacguuucaagcacaaaaucaagauccaucccaaucaguaacauuugcaaccaacgaugcuaguuuuguaccauacuuagguucaauauccccucacaauggaggugauuuucaugcaggagauauaaucgguucacucggauggauaucagcaccaucagauaauucacaacuaaauguuuggacaauaccaaaauacggaucuuccuuacccgauguuacacacuuagcaccagcuguauucccaccaggcuucggagaagucauauuauauuuuuacucaacauuuccaggaucaggucaaccaagccaacuacaaguaccuuguuuacuaccacaagaauuuauaacucacuuuugcaaugaacaagcuccuauagcaggagaagcagcucuacuacacuauguugauccagauacaggacgcaauuuaggagaauuuaaauuauauccagacggauuuaugacuuguguacccaauucuguuucaucugguccacaaacacuuccaauaaacggcguauuuguauuuguauccuggguauccagauaa

SEQ ID NO: 35030 - RNA, 1557 nt, Artificial Sequence
  derived and/or modified sequence opt6 from VP1__Norovirus_and/or_Norovirus-like__KM386679
augaaaauggcuuccaacgacgcuacaccuuccaaugacggagcagcaggauuaguaccagaaaguaauaaugaagcuauggcacuagaaccaguaguaggagcaucauuagcggcaccaguaacaggccaaacuaauauaaucgacccauggauaagaacaaacuuuguucaagccccaaacggugaguucacaguaucaccaagaaacucaccaggagaaauucuaguaaaucucgaacuaggaccugaacucaauccauaucuugcacauuuagccagaauguacaacggcuaugccggaggaauggaaguacaaguaaugcuagcugguaaugcauuuacagcuggaaaaauaauauuugcagcuguuccaccuuauuuuccagucgaaaaccucucccccucacaaauaacaauguuuccacauguaauuauagacguacguaccuuagaacccguacuacuacccaugccugauguacgcucaacauuauuucauuuuaaccaaaaagaugaaccaaaaaugcgauuaguagcuaugcucuauacaccacucagaucaaacgguuccggagaugauguauucacagucagcuguagaauauuaacgcgaccaucuccagaguucgacuucacauauuuaguacccccaacaguugaaucaaaaaccaaacccuuuacauuaccaguauuaacauuaggagaacuaucaaacucacgauuuccauuaaguaucgacgaaaugguaacaaguccaaacgaaucaaucguaguacaaccacaaaaugguagaguaacuuuagauggagaauuauuaggaacaacacaauuacaagcauguaauauauguucaauaagaggaaaaguuacaggacaaguuccaaaugaacaacauauguggaaucuagaaauaacaaaucuaaauggcacccaauucgauccuacugacgauguacccgccccacuaggcgucccugacuucgcaggagaaguuuuugguguacuaucccaaagaaauagaggagaaucaaacccugcaaauagagcacacgacgcaguaguggcuacauacucagauaaauacacaccuaaacuaggucuaguacaaauuggaacauggaauacaaacgauguagaaaaucaaccuacuaaauuuacuccaauaggacucaacgaaguagcuaacggccaucgauuugaacaauggacucucccaagauauucaggagcuuuaacucuuaacaugaaucuagcucccgcagucgcaccuuuauuuccuggagaaagauuauuauucuucagauccuauguaccccuaaaaggaggauuuggcaacccagcuauagacuguuuaguaccccaagaauggguacaacauuucuaucaagaaucugcaccaucauuaggcgacguagcauuaguuagauauguaaacccagauacaggaaggguacuauucgaagcaaaacuacacaaaggaggauucuuaacaguaucuucuacaucaacaggaccuguuguaguaccagcaaauggauacuucagauucgauuaa

SEQ ID NO: 35031 - RNA, 1551 nt, Artificial Sequence
  derived and/or modified sequence opt6 from VP1__Norovirus_and/or_Norovirus-like__AY549156
augaaaaugacagacagagacacagucgacucagcaccagcacuaggacaaguucuacccccugaaguagaagcuagcgucccaguagagccaacugcuggagcaccaguagcagcaccaacagcaggacaaguaaauccaauugauccauggauauucgcaaauuucguacaagcuccacaaggagaauuuacaauuucaccaaauaauaauccaggcgaaauauuguuugaacuugaauuaggaccagacuuaaacccauaucuagcacauuuaagaagaauguauaaugguuggacaggaucgaugcguguuagaguucuccuagcuggcaacgcauuuuccgcaggaaaaguaguaguauucuguguacccccaggauuugauacaucauauuuaacaccuucucaagcaacacaauuuccacauguacuaauagacguaagagcacccgaaccaguagaaaugccacuugaagauguacgcaauauacuauuccaucaaggcccagauucaagaaugagacuaaugggcauguuauauacucccuuaagagcuaauucaggcgcagauccuuucguaguaacuggaagaguauuaacauguccauccccaaacuuuucuuucuucuuucuaguaccaccuacuguagaagaacgagaaccuccauuuacucucccaaauuuaccaguuaauaaucuaucacacucucgagucauggaaccaauugcacaaaugaugucaucaagaaacuuuccagcaucuguacaauuucaaaaugguagauguacacuuucaggagaccuacuaggaacaacaccuucaaguccagcagaccuaggagcauuuguaggacuaagagccgaacccgguuccagagucguagaauuaucacaaccaaaucaagaagacuuucaugcagguucagcaccagccccauuuggauuuccugauuuuagugauuguucuguaacauucguuguagcaucagcaacaacaguaggcgaaagaacaguaaauacaagaucuuuacaaaauuuuacuccugcguuaggccauaucacauucgaugaagaagcaccagcugaucuguuucgagcacauuuuagaaaucuaugggaaccaacagaacauucauuuuggagaauaccagauuauagagcagacguauuagguucagacuuugcaccuucaguauccgcaccaggcguaggagaaacccuacuauucuuuaugugcaaugucccacgguuaaauggagcaaacccaaauccaugcccauguuuauuaccccaagaauggauuacacauuuuguaucggaaagagcugcauuacaaucagauguagcacuuuuaaauuauguuaauccaaauacaggaagaguauuauuugaagcaaaauuauacgcaaacggauuuuuaacaguuaacuuaggugcaccagaucaagcuacuuuaccaguagaugguauuuuuaaauuuguuucauggguaucaucauauuaccaacuaagaccuguaggaaaugcaucagcuggacgaagauuauaa

SEQ ID NO: 35032 - RNA, 1551 nt, Artificial Sequence
  derived and/or modified sequence opt6 from VP1__Norovirus_and/or_Norovirus-like__AY549163
augaaaaugacugaucgagauacaauagacucagcaccagcauuaggccaaguauuaccaccggaaguugaagccucaguaccaguugaaccuacugcaggcgcaccaguagcagcaccaacagcaggccaaguuaauccaauagauccauggauuuuugcaaauuuuguacaagcuccacaaggagaauuuaccauaucucccaauaauaauccaggugaaauauuauuugaacuugaauuaggaccugauuuaaacccauacuuagcacaucuacgaagaauguacaauggauggacuggaucuaugcgaguacgaguacuccuagccggaaaugccuuuucagcaggaaaagucguagucuuuugcguuccaccaggauuugauacaucauauuuaacaccaucacaagcaacucaauuuccacauguacuaauugauguaagagcaccagaaccagucgaaaugccacuagaagacguaagaaacauauuauuucaucaaggaccugacuccagaaugcgacuaaugggaauguuauauacaccacuaagagcaaacuauggugcagauccauuugugguaacuggaagaguuuuaacauguccaucuccaaauuuuucuuucuucuuuuuaguaccuccuacaguagaagaaagagaaacaccauuuacuuuaccuaaucuaccaguuaauaauuugucccacucaagaguaauggaaccaauagcacaaaugaugucauccagaaacuuuccagcgucuguacaauuucaaaacggaagauguacacuauccggagaucuacuagguaccacaccuucuucgccugcugauuuaggugcauuuguaggucuacgugccgaaccuggaucccgaguagucgaauuaagucaaccaaaucaagaagacuuucaugcugguucugccccugcaccauuugguuuuccugauuuuucagacuguaguguaacauuuguugucgcauccgcaacaacaguaggagaacgaacuguaaauacacguucccuacaaaauuuuaccccagcacuaggucacauuacauuugaugaagaagcuccugcagaucuuuuuagagcacacuuucgcaaccuuugggaaccaacagaacacucauuuuggagaauaccugacuauagagcugauguuuuaggaucagauuucgcaccuucagucucagcacccggaguaggagaaaccuuauuauuuuucauguguaacguaccacgacuaaauggagcaaacccuaauccauguccaugucuacuuccacaagaauggauuacccacuucguaucagaacgagcugcacuucaaucagauguagcacuacuaaauuauguuaacccuaacaccggacgaguacuauucgaagcaaaacuuuacgccaauggauuuuuaaccguuaauuuaggugcaucugaucaagcaauacuccccguagauggaauauuuaaauuuguaucauggguaaguuuuuauuaccaauuaagaccuguuggaaacgcaucaguaggacgaagacuauaa

SEQ ID NO: 35033 - RNA, 1551 nt, Artificial Sequence
  derived and/or modified sequence opt6 from VP1__Norovirus_and/or_Norovirus-like__AY549159
augaaaaugacagauagagauacuguagacagcgcuccggcauuaggucagguucuaccaccagaaguagaagcaagcguaccaguagaacccacagcaggcgcaccaguagcagcacccacagcaggacaaguaaaucccauugauccauggauuuuugccaacuuuguacaagcaccacaaggagaauuuacaauaucccccaauaauaacccaggugaaauucuauuugaacucgaacuaggcccagaccucaacccauacuuagcacaucuaagacgaauguacaacggauggacuggaucuaugagagucagaguauuauuagcaggaaaugccuuuucagcaggaaaaguuguaguauuuuguguuccaccaggcuucgauacaucauaucucacuccaucacaagccacucaauucccucacgucuuaauugauguaagagcuccagaaccagucgaaaugccacuagaagauguaagaaacauacucuuccaccaaggaccagauagcagaaugagauuaaugggaauguuauacacaccuuuaagagcaaauucaggagcagauccauucguaguaaccggccguguauuaacauguccaucaccaaauuucucauuuuucuuucuaguuccaccaacagucgaagaaagagaaacaccuuuuacuuuaccaaauuuaccuguaaauaaucuaucacacucacguguuauggaaccaauagcccaaaugaugucuuccagaaauuuuccagcuucuguacaauuucaaaauggaagauguacuuuaucaggagacuuauuagguacuacacccuccuccccagcugacuuaggcgcauucgucggucuaagagcagaacccggcuccagaguuguagaauuaagccaaccuaaucaagaagacuuucaugcuggaucagcaccagcuccuuuugguuuuccugauuuuucagauuguucugucacauucguuguagcauccgcuacaacagucggagaacgcaccguuaaugcaagaucacuucaaaauuuuacuccagcacucggacauaucaccuucgacgaagaagcaccagcagacuuauuuagagcacauuuaagaaaucuuugggaaccaacagaacauucauuuuggagaaucccugauuauagagcagauguauuaggaucugauuucgcacccucaguuucugcaccaggaguuggugaaacacuauuauucuuuauguguaauguaccuagauuaaacggagcuaauccaaacccauguccuugucuacuuccucaagaauggauuacacauuuuguuucagaaagagcugcauuacaaucagauguagcauugcuaaacuaugucucaccaaauacaggacgaguacuuuuugaagcaaaacucuacgcaaaugguuuucuaacuguuaaucucggagcaucagaccaagcaacacuuccaguugaugguauauuuaaauucguaaguuggguaucauuuuauuaucaacuaagaccaguaggaaacgcaucaguaggacgucguuuauaa

SEQ ID NO: 35034 - RNA, 1551 nt, Artificial Sequence
  derived and/or modified sequence opt6 from VP1__Norovirus_and/or_Norovirus-like__AY549166
augaaaaugacagaucgagauacuguugauucagcaccagcauuaggacaaguuuuaccuccagaagucgaagcaucaguaccuguagaaccaacagcaggagccccuguagcugcaccuacagcaggucaaguuaacccuauugacccauggaucuucgcaaacuucguucaagcuccacaaggagaauuuacaauaucaccuaacaacaauccaggugaaauacuauuugaauuagaauuaggaccugaucuaaauccauauuuagcacaccuuagacgaauguacaauggauggacaggaucaaugagaguuagaguuuuacucgcaggaaacgcauuuucugccggaaaagucguaguauuuuguguuccucccggauucgauacaucuuaucuaacuccuucccaagcaacacaauuuccacacguuuuaauagacguacgcgccccagaaccaguagaaaugccauuagaagauguuagaaauauacucuuccaccaaggaccagauucccguaugagauuaaugggaaugcuauauacaccauuacgagcaaauucuggagcagauccauuuguaguuaccggacgaguauuaacuugucccucucccaacuuuucauuuuucuuucucgucccaccaaccgucgaagaaagagaaaccccauuuacauuaccuaauuuaccaguuaacaacuuaucucacucacgaguaauggaacccauagcacaaaugaugucaucaagaaacuuuccagcuucaguacaauuccaaaauggacgcuguaccuuauccggugauuuacuaggaacgacaccaucaucaccagcagacuuaggugcauucguaggauuaagagcagaaccuggaucacguguagucgagcuaucccaaccaaaucaagaagauuuucaugcaggauccgcaccggcaccauucggauucccggauuuuucagauuguucaguaacauuuguaguagcaucagcgacaacuguaggggaaagaacuguaaauacuagauccuuacaaaacuucacaccagcacuaggucauauaaccuucgacgaagaagccccagcugaucuauucagagcucacuuuagaaacuuaugggaacccacagaacauucauuuuggagaauaccagauuauagagcagauguacuaggaucugacuuugcaccaagcguaagugcaccaggaguuggagaaacacuauuauucuuuaugugcaacgucccaagacuaaauggagcaaacccaaaucccuguccauguuuacuaccacaagaauggaucacccauuuuguaucagaaagagcagcauuacaaucugacguagcauuacuaaauuauguaaauccgaauacuggacgagucuuacucgaagcuaaacucugugcaaauggauuucuaacuguaaaucucggagcauccgaucaagcaacuuuaccaguagacggaauauuuaaauucguuucauggguaucauuuuauuaucaauuaagaccaguaggaaaugcuucaguugguagaagacuauaa

SEQ ID NO: 35035 - RNA, 1551 nt, Artificial Sequence
  derived and/or modified sequence opt6 from VP1__Norovirus_and/or_Norovirus-like__AF320113
augaaaaugacagaucgugauauaauagauucugcaccagcauuaggacaaguauuaccuccagaaguugaagcaucaguuccaguugaaccuaccgcaggagcaccaguagcugcaccuacagcuggucaagucaauccaauugauccauggauauuugccaauuuuguucaagcaccucaaggugaauuuaccauuuccccuaauaacaauccuggcgaaauauuauuugaauuagaacuugguccagauuuaaauccauauuuagcacaccuaagaagaauguauaacggauggaccgguucaaugcgagucagaguacucuuagcaggaaaugcauuuucagcagguaaaguagucguauuuugcguuccaccaggauucgauacuucauaucuuacacccucucaagcuacacaauuuccacauguauuaauagacguaagagcaccagaaccaguugaaaugccccuugaagauguuagaaauauauuauuucaccaaggaccagacucacgaaugcgauuaauggggaugcuauauacaccacuaagagcaaacucaggagcugauccauucgucguaacuggaagaguucuaccauguccaucacccaauuuuucauucuucuuucuaguaccaccgaccguagaagaaagagaaccuccauuuacuuuacccaauuuaccaguaaauaaucuaucacauucuagaguaauggaacccauagcacaaaugaugucaucaagaacauuucccgcaucuguccaauuucaaaacggacgaugcacacuaucaggugaccuacuaggaacaacuccaucaucacccucagaucuuggugcauuuguaggacucauagcugaaccgggcucuagagucguugaauuauuucaacccaaucaagaagauuuucaugcagguucugcaccagcaccuuuagguuuuccagauuuuagcgauuguucauuaacauuuguuguagcaucugcuacaacaguaggcgaaagaacaguaaaugcuagaagucugcaaaauuucacaccagcauuaggacauauaacuuuugacgaagaagcaccagcagauuuauuuagagcacauuuacgaaauuuaugggacccaacagaacacuccuuuuggagaauaccugacuauagagcagauguacuaggaucagaauuagcaccaagcguaucugcaccaggcgucggagaaacauuauuauucuuuacauguaacgucccaagacucaauggagcuaauccaaacccgugcccuugucuacuuccacaagaauggauuacacauuuuguaagugaaagagcagcauuacaauccgauguagcacuucuaaauuauguaaauccaaauacagguagaguauuauuugaagcuaaauuauacguaaauggauuucuuacaguaaaucuaggagcaucagaucaagccacucuaccugucgauggaauauuuaaauuuguauccuggguaucauuuuacuaccaacuaagaccaguugguaacgcuucuguaggacgcagauuauaa

SEQ ID NO: 35036 - RNA, 1551 nt, Artificial Sequence
  derived and/or modified sequence opt6 from VP1__Norovirus_and/or_Norovirus-like__AY549153
augaaaaugacagauagagacacaguagauucagcaccagcguuaggucaaguucuuccaccagaaguagaagcaucaguaccaguagaaccaacagcuggugcacccguagcagcaccaaccgcaggacaaguaaacccuaucgacccauggauuuuugccaauuuuguacaagccccacaaggugaauuuacaauaucaccaaauaauaacccaggagaaauauuauuugaauuagaacuaggaccugaucuaaauccuuaccuagcccaucuaagaagaauguacaauggauggacuggaucaaugcgaguuagaguacuauuagcagguaaugcuuuuucagcagguaaaguuguuguauuuugcguaccaccaggauucgauacaucauacuuaaccccuucucaagcuacccaauuuccacaugucuuaauagauguacgugcaccugaaccgguagaaaugccacuugaagacguacgaaauauauuauuucaucaaggaccagauucaagaaugagacuaauggguaugcuauauacaccacucagggcuaacucaggcgcagauccuuuuguuguaacuggaagaguacucacaugcccauccccaaauuuuucguuuuucuuuuuaguucccccuacaguugaagaaagagaaccaccauuuacucucccaaauuuaccaguaaacaaccuaucacauucaagaguuauggaaccaauagcucaaaugaugaguucaagauccaguccagcaucuauucaauuccaaaauggacguugcacacuaucaggagacuuauuaggaacaacacccucuuccccagcagauuuaggagcauucguaggacuacgugcugaaccaggaucacauguugucgaacuuucucaaccuaaucaagaagacuuucaugcaggaucugcuccugcaccauuuggauuucccgauuuuuccgauuguucaguaacauuuguaguagcaucugcuacaauaguagaacaacgcacaguaaacgcuagaucacuacaaaauuuuacaccagcauuaggucacauaacauuugaugaagaagcuccagcagaucuauucagagcaagauuucguaauguuugggauccaacugaacauucuuuuuggcguauacccgauuaccgagcagacguccuaggaucagauuuugcuccuucuguuucugcucccgguguuggugaaacauuacuauucuuuauguguaauguaccccauucaaauggagcaaauccuaacccauguccuugcuuacucccacaagaauggaucacacauuuugucucagaacgagcugcacuacaaggugauguugcauuacuaaacuacauaaaccccaacacaggaagaguuucauuugaagcaaaacuauaugcaaauggauuucuaacaguaaauuuaggcgcuucugaucguacaacucuuccaguagauggcauauuuaaauucguaucauggguuucauuuuauuaccaacuaagaccaguaggaaaugcaucaguaggaagaagauuauaa

SEQ ID NO: 35037 - RNA, 1551 nt, Artificial Sequence
  derived and/or modified sequence opt6 from VP1__Norovirus_and/or_Norovirus-like__AY549157
augaaaaugacagauagagauacuguagauucagccccagcacuaggacaaguauuacccccagaaguagaagcuagcguaccaguagaaccaaccgcuggagcuccaguagcagccccaaccgcaggacaaguuaacccuauagaucccuggauauuugcuaauuuuguccaagcuccacaaggagaauuuacaaucucgccuaauaauaauccaggcgaaauauuauuugaacuagaauuaggaccagaccucaauccuuauuuagcucacuuacgaagaauguacaacggauggacaggaucuaugagaguaagaguacuauuagcuggaaacgcauuuagugcaggaaaaguaguaguauuuuguguuccaccaggauucgauacaucuuaucuaacaccaucacaagcaacacaauuuccacauguuuuaauagaugucagagcuccugaaccagucgaaaugccacuagaagauguuagaaauauauuauuucaucagggcccagauucccgaaugagauuaaugggcaugcuauauacaccuuuacgagcaaacucuggcgcagaucccuuuguaguuacaggacgcguccuaacuuguccauccccaaauuucucauuuuucuuucuaguaccaccaacaguagaagaacgugaaccaccauuuacauuaccuaaucuuccuguaaauaauuuaucacauucacgaguaauggaaccaauagcacaaaugaugucaucaagaaauuuuccagcuucaguacaauuucaaaauggaagacguaccuuauccggagaucuuuuaggcaccacuccaucaucaccagcagacuuaggugcauucguaggauuacgagcagaaccaggaucaagaguuguagaacuuucacaaccaaaccaagaagacuuucaugccggaucagcuccagccccuuuuggauucccagauuuuucagacuguucuguaaccuuuguuguagcaucagcaaccaccguaggagaaagaacaguaaacacccgaucauuacaaaauuucacuccugcccuuggacauaucacauuugaugaagaagcuccugccgacuuauuuagagcccauuuuagaaauuuaugggaaccuacagaacauucauuuuggagaauacccgacuauagagcagauguacuaggaucugauuuugccccaucaguaucagcuccaggaguuggagaaacacuucuuuucuuuauguguaauguuccaagauuaaauggagcaaaucccaaucccugcccaugucuuuugccacaagaauggauaacacauuucgucucugaaagagcagcuuugcaaucagauguagccuuauuaaauuauguaaauccaaauacaggaagaguucuuuuugaagcuaaauuauacgcaaacggauuuuuaacaguaaaucucggagcaucagaucaagcaacccuaccaguagauggaauauuuaaauucgucucuuggguaucauuuuauuaucaacuaagaccagucggaaacgcaucuguaggacgcagacuauaa

SEQ ID NO: 35038 - RNA, 1551 nt, Artificial Sequence
  derived and/or modified sequence opt6 from VP1__Norovirus_and/or_Norovirus-like__AY549158
augaaaaugacagacagagaugccguugacucagcuccagcucuuggacaaguacucccacccgaaguagaagcauccguaccaguagaaccuacugcuggagcuccaguugcagcaccuacagcaggucaaguaaacccaauugacccauggauauuugcaaauuucguacaagcaccacaaggagaauuuacaauaucuccaaauaauaauccuggugaaauauuauuugaacuugaauuaggaccagacuuaaacccauacuuagcccaucuaagaagaauguauaauggauggacaggaucuaugagaguacgaguuuugcuagccgguaaugcauuuucugcaggcaaaguaguuguauucuguguuccaccuggauucgauaccucauauuuaacuccuucacaagcuacacaauuuccacauguauuaauagauguacgagccccagaacccguagaaaugccacuagaagacguaagaaauauacucuuucaucaagguccagacucaagaaugcgucuaauggguaugcuauacacaccccuacgugccaauucuggagcugauccauuugucguaacaggaagaguacuaacauguccaucaccuaauuucuccuucuucuuucucguuccaccaacuguagaagaacgagaaccaccauuuacauuacccaaucuuccuguaaacaauccuucccauucucgaguuauggaaccaauagcccaaaugauguccucaagaaauuucccagcuucuguucaauuccaaaauggaagaugcacacuaucaggugacuuacuaggaacaaccccaucaucacccgcggaccuaggcgcuuuuguaggacuacgagcagaaccugguucaagaguaguagaauuaucacaaccaaaucaagaagacuuucaugcaggaucagcuccagcaccauucggauuuccagauuuuucagacugcucaguaacuuuugucguugcaagugcaacaacuguaggugaacgaacaguaaauacaagaucucuacaaaauuuuacaccagcucuuggacauauaacauuugaugaagaggccccugcugaucuauucagagcccauuuuagaaaccuaugggaaccaacagaacacaguuucuggagaauaccagacuaucgagcagauguacuaggaucagauuucgcaccaucaguaucugcacccggaguaggagaaacauuacuauucuuuauguguaauguuccuagauuaaacggagcuaacccaaacccauguccuugucuccuaccacaagaauggauaacacauuuuguaucagaaagagccgcacuacaaucugacguugcacuauuaaauuauguaaauccaaauaccggaagaguauuauuugaagcuaaauuguaugcuaacggaucauuaacaguuaauuuaggagcaucagaucaagcaacucuaccuguagauggaauauuuaaauuuguaaguuggguuucauuuuauuaccaacuacguccaguaggcaaugcaucagucggaagaagauuauaa

SEQ ID NO: 35039 - RNA, 1551 nt, Artificial Sequence
  derived and/or modified sequence opt6 from VP1__Norovirus_and/or_Norovirus-like__AY549165
augaaaaugaccgaucgagauacuguagauucagccccugcacuuggacaaguauuacccccugaaguugaagcaucagucccuguugaaccaacagcaggcgcacccguugcagccccuacagcuggacaaguaaaucccauagaucccuggauauuugcaaauuuuguacaagcuccacaaggcgaauuuacaauaucuccaaauaacaacccuggagaaauacuuuuugaauuagaauuaggaccagauuuaaauccauaucuagcacacuuaagaagaauguacaacggauggacaggaucaaugagaguacguguacuauuagcuggcaacgcuuuuagugcaggaaaaguuguaguauuuuguguaccaccuggauuugaugcaucauauuuaacaccaucucaagcaacgcaauucccacauguauuaauagauguaagagcuccagaaccuguagaaaugccucuagaagacguaagaaauauacuauuccaccaaggaccagauucaagaaugcgauuaaugggaauguuauacacaccauuaagagcaaacuccggagccgauccauuuguaguuacaggaagaguucuaacuuguccaucaccaaauuuuucauuuuucuuuuuagguccaccaacaguugaagaacgagaaccacuauuuacauuacccaaucucccaguuaauaaccugucacauucuaggguaauggaaccuauugcacaaaugauguccucacguucauuuccagcaucaguacaauuucaaaacggaagauguaccuuaucaggcgaucuccuagguaccacuccaucaaguccugcugauuuaggugcuuuuguaggauuacgugcagaaccaggaucacauguuguagaacuaucacaaccaaaccaagaagauuuucaugcaggaucagcgccagcaccauucggauucccagauuucucugguuguucaguaacauuuguaguagcuucugcaaccauaguagaacaaagaacaguaaauaccagaucauuacaaaauuucacaccagcauuaggacauauaacauuugacgaggaagcacccgcagaucuauuuagagcacgauuccguaacguaugggacccaaccgaacauagcuuuuggagaauaccugauuacagagcagacgucuuaggaucugacuuugcuccaagcguaucagcuccuggaggcggagaaacuuuauuauucuuuauguguaauguaccacacucaaacggugcuaauccaaacccauguccauguuuacuaccacaagaauggauaacacauuucguuuccgaacgcgcagcauuacaaggagacguugcccuauuaaacuacauaaaccccaauacaggucgaguccuauuugaagcaaaauuauaugcuaauggauuucucacuguaaauuuaggagcaucugaucaagcugcauuaccaguagauggaauuuuuaaauuuguaucauggguuucauucuauuaucaauuaagaccaguagguaaugcaucagugggaagaagacuuuaa

SEQ ID NO: 35040 - RNA, 1551 nt, Artificial Sequence
  derived and/or modified sequence opt6 from VP1__Norovirus_and/or_Norovirus-like__AY549167
augaagaugacagauagagauacuguugacucagcacccgcucucggacaagucuuaccaccagaaguagaagcaucaguaccaguagaaccuacugcaggagcuccaguagcagcuccaacagcaggacaaguaaauccaaucgacccauggaucuuugcaaauuuuguucaggcaccacaaggugaauuuacaauaucaccaaauaauaauccaggcgaaauauuauuugaacuugaacuaggcccagaccucaacccuuaucuugcgcacuuacgaagaauguauaacggauggacagguucaaugagaguucgagucuuacuagcaggcaaugcauucucagcaggaaaaguaguaguauuuuguguaccuccagguuuugacacaucauauuuaacuccaucacaagcaacucaauuuccacacguauuaauugauguuagagcacccgaaccaguagaaaugccacucgaagauguucgaaauauucuauuucaucaaggacccgacucaagaaugagacuaaugggaaugcucuauacaccacucagagcaaauucuggagcagauccuuuugucguaacaggaagaguucuaacaugcccuucaccaaauuuuucuuucuucuuuuuaguaccuccaacaguagaagaaagagaaccacuauuuacuuuaccaaaucuucccguaaauaauuuaucgcauucaagaguaauggaaccuauagcucaaaugaugucaucuagagguuuuccugcaucaguacaauuucaaaauggaagauguacuuuaucaggagauuuauuaggcacaacuccaucaucaccagcagauuuaggugccuuuguagguuuaagagccgaaccuggcucacauguagucgaacuaagucaaccaaaucaagaagauuuucaugccggaucagcuccugcacccuuuggcuuuccagauuuuucagauugcucuguaacuuuuguugucgcauccgcuacaauuguagaacaaagaacaguuaaugcacgaucuuuacaaaauuuuacaccagcauuaggacauauaacuuuugacgaagaagccccagcagauuuauuucgagcaagauuucguaacguaugggauccaacagaacauucauuuuggagaauaccagauuauagagcugacguauuaggaucagacuucgcaccaucuguaucagccccugguguaggagaaacacuacuuuucuuuauguguaacguaccucauucaucaggcgcaaacccaaauccuuguccuugccuccuaccacaagaauggauuacacauuuuguuucugaaagagccgcacuacaaggugauguagcccuucuuaauuacauuaauccaaacacagguagagucuuauuugaagcaaaauuauaugcaaauggauuccuaacuguaaaucuuggagcauccgaucaagcaacuuuaccugucgauggcauauuuaaauuuguuucauggguaaguuucuauuaccaauuaagaccuguuggaaaugcaucuguaggccgcagauuauga

SEQ ID NO: 35041 - RNA, 1551 nt, Artificial Sequence
  derived and/or modified sequence opt6 from VP1__Norovirus_and/or_Norovirus-like__AY549154
augaaaaugacagauagagauacaguagauccagcccccgcauuaggacaaguacuuccaccagaagucgaagcaucaguaccaguagaacccacagccggugcaccuguagccgccccaacugcuggccaaguuaauccaauugauccuuggauauuugcuaauuucguacaagcaccccaaggagaauuuacaauaucaccaaauaacaauccaggagaaauacuuuuugaacucgaauuagguccagaucuuaacccauauuuagcacaucuaagacauauguauaacgguuggacaggaucaaugagaguaagaguucuucuagcugguaaugcauucucagcaggaaaaguaguaguauuuuguguacccccagguuuugauacaaguuauuuaacaccaucacaagcuacacaauuuccccacgucuuaauagauguaagagcaccugaaccaguagaaaugccacucgaagacguaagaaauauuuuauuucaucaaggaccagauucaagaaugcgauuaaugggaaugcuuuauacuccacuaagagcaaauucuucugcugaucccuuuguaguaacaggcagaguauuaacuuguccuaacccaaauuucaguuucuucuuuuuagucccaccaacuguagaagaacgugaaccaccauuuacauuaccuaaccuuccaguaaacaauuuaucacacucaagaguuauggaacccauagcacaaaugauguccuccagaaauuuuccugcaucaguucaauuucaaaacggacguuguacacuaucaggcgauuuacuaggaacuacacccucauccccagcagauuuaggagcauuuguagguuuaagagcagaacccggaucucgaguuguugaauuaucccaaccaaaccaagaagauuuucacgcaggaucugcacccgcaccauuuggauuuccagauuuuuccgacugcaguguuacauuuguaguagcaucugcaacaacagucggagaaaggacuguaaauacaagaucauuacaaaauuuuacaccagccuuaggacauauaacauuugacgaagaagcaccagcugaucuauuucgagcccauuuuagaaauuuaugggaaccuacugaacauucauuuuggagaauaccagauuauagagcagauguacuagguucagauuuugcaccuucaguaucugcaccuggaguuggcgaaacccuuuuauucuuuauguguaauguacccagauuaaacggugcaaauccaaauccauguccauguuuauuaccacaagaauggauuacccauuuuguuucagaaagagcagcauuacaaucagauguagcauuacucaauuauguaaauccaaauacaggacgaguacuauuugaagcaaaauuauacgcuaacggauuuuuaacuguaaaccuaggagcgucagaucaagcuacgcuuccuguagauggcauauuuaaauucguuucauggguaucauuuuauuaccaacucagaccaguagggaacgcaucaguaggaagacgucuuuaa

SEQ ID NO: 35042 - RNA, 1551 nt, Artificial Sequence
  derived and/or modified sequence opt6 from VP1__Norovirus_and/or_Norovirus-like__AY549155
augaaaaugacagaucgagauacaguagacucagcacccgcacuuggacaaguuuuaccaccugaaguagaagccucaguaccaguagaaccaacugcuggugcaccuguagcagcuccaacugcaggucaaguuaauccuauugauccauggauauucgcuaacuuuguacaagcaccacaaggagaauuuacuauaucuccuaauaauaauccaggagaaaucuuauuugaacuagaacucggcccagacuuaaacccauauuuagcccauuuaagaagaguuuauaauggcuggacuggauccaugagaguaagaguauuacuugcaggaaacgccuucagcgcuggaaaaguagucguuuucuguguuccgcccgguuuugauaccuccuacuuaacuccaucacaagcaacacaauucccccacguuuuaauagacguucgagcaccagaaccugucgaaaugccauuagaagacgugagaaacauacuuuuucaucaagguccugacagucgaaugaaauuaauggguauguuauauacaccauuacgugcaaauuccucagcaaacccuuucgucguaacuggaagaguuuuaacauguccauccccuaacuuuuccuucuucuuucuaguaccaccaacaguagaagaaagagaaccaccauuuaccuuaccaaaccuuccuguaaacaaucuaucccauucacaaguaauggaaccaauagcacaaaugaugucaaguagaaauuuuccagcaucaguacaauuucaaaacggaagauguaccuuaucuggagaccuauuagguacaacaccuucaucaccagccgaccuaggugcauuuguaggauuaagagcagaaccaggaucacguguaguagaacucucacaaccaaaucaagaagauuuucaugcaggaucugcaccagcaccuuuugguuuuccagacuuuucagacugcucuguaacauuuguuguagcaucagccacaacugucggcgaaagaacaguaaacgcaagaacuuuacaaaauuuuacaccagcucuuggacauauaacauucgaugaagaagcaccagcagauuuauuuagagcacauuuucguaauuuaugggaacccacagaacauucauucuggagaauaccagacuaucgugcagacguacuuggaucagauuuugcaccuuccguaagcgcacccgguguaggcgaaacuuuguuauucuuuauguguaauguuccucgcuuaaauggugcaaauccuaauccaugucccugccuuuuaccacaagaauggaucacacauuuuguuucugaacgcgcugcauuacaaagcgauguagcucuacucaacuacguaaacccuaauacaggacguguauuauucgaagcaaaacuauaugcuaauggcuucuuaacaguuaaucuuggagcauccgaccaagcaacacucccaguagauggaaucuuuaaauuuguuucuuggguaucauuuuacuaucaauuaagaccagucgguaaugcaucagucggaagaagauuauaa

SEQ ID NO: 35043 - RNA, 1551 nt, Artificial Sequence
  derived and/or modified sequence opt6 from VP1__Norovirus_and/or_Norovirus-like__AF320625
augaaaaugaccgacagagauauaauugacucagcaccagcacuaggacaaguauuaccuccagaaguugaagccuccguuccagucgagccaaccgcaggcgcuccgguagcagccccaacagcaggacaaguaaaucccauugauccauggauuuuugcaaauuuuguucaagcaccacaaggaguauucacaauuucaccaaauaacaauccaggagaaauucuauuugaacuagaacuaggaccagauuuaaacccauaccuugcacaccuaagaagaauguauaauggauggacagguaguaugcgaguaagaguuuuacuagcaggaaacgcauuuucagcagguaaaguagucguauucuguguaccaccaggauuugauacauccuacuuaaccccaucacaagcgacacaauucccacauguauuaauagacguaagagcaccugaaccaguagaaaugccauuagaagauguaagaaacauacuauuucaccaaggaccagauucacgaaugcgacugaugggaauguuauacacaccacuaagagcaaacuccggugccgauccauucguaguaacaggaagaguacuaacuuguccaucaccuaauuucucauucuucuuuuuaguuccuccuacaguugaagaacgcgaaccaaguuuuacucuaccaaaucucccaguaaauaaucucucucacaguagagugauggaaccaauugcucaaaugaugucaucaagaacuuucccagcaucaguacaauuucaaaacgguagauguacucuaucaggugauuuauuagguacuacacccucaucacccagugaucucggagcuuuuguagguuuaauagcagaaccaggaaguagaauaguagaauuaucacaaccaaaucaagaagacuuucaugcaggaucugcaccagcaccauuugguuucccagacuuuucagacugcucacuaacauuuguaguagcaucagcaacaacugucggugaaagaacaguaaaugcaagaucacuacaaaauuuuaccccugccuuaggccauauaacauucgaugaagaagcacccgccgauuuauucagagcacauuuaagaaacuuaugggauccaacagaacauucuuuuuggagaauaccagacuauagagcagauguucuuggaagugaauuugcaccaucuguaagugcuccaggaguaggagaaacacuacuauucuuuauguguaauguaccaagacucaauggagcaaauccuaauccauguccuugccuccuuccacaagaauggauaacacauuuuguaucagaaagagcugcguuacaaucagacguagcacuacucaauuaugucaauccaaauacaggacgaguauuauuugaagcaaaacuauaugccaacggcuuucuaacaguaaaucuaggugcaucagaucaagccacuuuaccaguagauggaauauucaaauucguaucuuggguaucuuucuauuaccaauuaagaccaguaggaaaugcaucuguuggacguagacuauaa

SEQ ID NO: 35044 - RNA, 1551 nt, Artificial Sequence
  derived and/or modified sequence opt6 from VP1__Norovirus_and/or_Norovirus-like__AY274820
augaaaaugaccgauagagauacaguugauucagcuccugcuuuaggacaaguuuuaccacccgaaguugaagccucaguaccaguagaaccaacagcaggagcacccgucgcagcaccaacugcaggacaaguuaaucccauagaccccuggauauuugcuaauuucguacaagcuccacauggugaauuuacaauuucaccaaauaauaauccaggagaaguacuuuuugaacuuaaauuagguccagaucuaaaccccuaucuagcacaucuccguagaauguacaauggauggacaggaucaaugagaguaagaguauuacucgcaggaaacgcauuuucugcugguaaaguagugguauucuguguaccuccaggauuugauacaucauaccuuacaccaucacaagcuacucaauuuccacauguucuaauugauguacgagcuccaaaaccuguagaaaugccacuagaagacguacgaaauauacuauuucaccaaggaccggacucaagaaugagacuuaugggcaugcuauauacaccauuaagagcaaauucuggagcagauccauuugucguaaccgguagaguacuaacuuguccaucaccaaacuucucauuuuucuuuuuaguacccccaacaguagaagaacgagaaccacccuuuacauuaccgaacuuaccugucaauaauuuaucacauucaagaguaauggaaccaauagcucaaaugauguccucacguaauuuucccgcaucaguacaauuucaaaauggacgauguacuuuaucaggagaucuacuagguaccaccccaucuucacccgcagauuuaggagcauucguuggacuacgagcagaaccaggaucaagaguuguagaauuaucucaaccuaaccaagaagacuuucacgcuggaucugcaccagcaccauucggcuucccagauuucagcgaauguuccguaacauuuauggucgcaucagcaacaacagucggcgaacgaacuguaaauacacguucacuucaaaacuuuacccccgcacuaggacacaucacuuucgaugaagaagcaccagcagauuuauuuagagcaagauuucguaaucuaugggaaccaacagaacauucauuuuggcgaauaccugacuauagagccgauguacuagguuccgaauuugcucccucaguaucagcaccaggcguaggagaaacacucuuauucuuuauguguaauguaccucgacuuaauggagccaauccaaaucccuguccaugucuacuaccacaagaauggauaacacauuuuguaucagaaagagcagcuuuacaaucugacguagcacuucuaaacuacguuaauccaaacaccggacgaguacuauuugaagcaaaacuauaugcaaauggauuucuaacaguaaaucuaggagcuucagaucaagcauccuuaccaguagacggaauauuuaaauuugugucauggguaucauuuuauuaucaauuaagaccugucggaaacgcaucaguaggaagaagacuauaa

SEQ ID NO: 35045 - RNA, 1551 nt, Artificial Sequence
  derived and/or modified sequence opt6 from VP1__Norovirus_and/or_Norovirus-like__AF542083
augaaaaugacagaucgagauacaguugauucagcuccugcacuaggacaaguauuaccaccagaaguagaagcaucagucccaguagaaccaacagcaggagcaccuguugcagcaccaacagcaggacaaguaaauccuauagauccuuggauuuuugcaaauuuuguucaagcaccucaaggagaauuuaccauaucaccuaacaauaaucccggagaagucuuauucgaauuagaacuaggaccagaccuuaauccuuacuuagcacauuuacgacgaauguacaacggcuggacaggcucaaugagaguuagaguacuacuugcagguaaugcuuuuagcgcugguaaaguaguaguauuuuguguaccuccagguuucgauaccucauaccucacucccucucaagcuacacaauuuccacauguucuaauagacgucagagcaccagaaccuguagaaaugccauuagaagacguacgaaauauacuauuucaccaaggaccagauaguagaaugagauuaaugggaaugcuauauacuccacuucgagcuaauuccggagcagauccuuuuguuguaacuggaagaguacuuacauguccuucaccaaauuuuagcuucuucuuuuuaguaccaccaacuguagaagaaagagaaccaccuuucaccuuaccaaaucuaccugucaacaaucucucacacucaagagucauggaaccuaucgcccaaaugaugaguuccagaaacuuuccagcaaguguucaauuucaaaauggaagauguaccuuaagcggagaccuauuaggaaccacuccuucaucaccagcagaccuuggagcauuuguagguuuaagagcagaaccaggaucaagagucguagaauuaucacaaccaaaccaagaagauuuucacguaggauccgccccugcaccacuuggcuuuccagauuuuucagauuguuccguaacuuucguuguagcaucagcaacaacaguaggagaaagaaccguaaauacaagaucacuacaaaauuuuacaccagcauuaggacauauuacauuugaugaagaagccccugcagaucucuuuagagcacauuuccgaaaucucugggaaccaacagaacauucuuuuuggagaauaccagauuauagagcagauguucucggaucagauuuugcacccucaguaucagcaccaggcguaggcgaaacacuacuauucuucaugugcaauguaccccgacuaaauggagcaaauccaaaucccugcccuuguuuacuaccacaagaauggauaacacauuuuguaagcgaaagagccgcacuucaaucagaugucgcauuauuaaacuauguaaacccaaauacuggaagaguauuauuugaagcaaauuuauaugcaaauggauuuuuaacaguuaauuuaggagccucagaccaagcaacccuaccuguugauggaauuuuuaaauuuguaucauggguuucauucuauuaucaauuaagaccaguuggaaacgcauccguaggcagacgauuauaa

SEQ ID NO: 35046 - RNA, 1551 nt, Artificial Sequence
  derived and/or modified sequence opt6 from VP1__Norovirus_and/or_Norovirus-like__EU794907
augaaaaugacagauagagacguaacagauucagcaccagcuuuaggacaaguucucccaccugaagucgaggcuuccguaccaguagaaccaacagccggagcaccaguagcugcaccaacagcaggacaaguuaaccccauugauccauggauauucgcuaacuucguccaagcaccucaaggcgaauuuacaauaucacccaauaauaauccaggagaaauauuauuugaacuagaauuaggaccagacuuaaauccauaucuagcucacuuaagaagaauguauaacggauggacagguucaaugagagugagaguauuauuagcaggcaaugcuuuuucagcugguaaaguaguaguauuuuguguuccuccaggauuugacacaucuuauuuaacuccaucacaagcaacucaauuuccucauguauuaauagauguuagagccccugaaccaguagaaaugccauuagaagauguacgaaauauucuauuccaucaaggcccagauucucgaaugagacuaaugggaauguuauacacaccauuaagagcuaauucaggugcagauccuuuuguagucaccggaagaguauugacaugcccaucaccaaauuucucauuuuucuuuuuaguaccuccaacuguagaagaaagagaaccaccauuuacacucccaaauuuaccagucaauaauuuaucacauucuagagucauggaaccuauagcacaaaugaugucuucacgaaacuuuccugccagcguacaauuucaaaauggacgauguacacuuucaggagacuuacugggaaccacuccaucguccccaucugacuuaggagccuuugucggucuuauagcugaaccaggaucaagaguaguugaacuaucacaacccaaucaagaagacuuccaugcaggauccgcaccagccccauuuggauuuccagauuuuucagauuguagccuaacauuuguaguagcaucagcaacaacaguuggugaaagaacaguaaacgcacguaguccucaaaacuucaccccugcucuaggucauauaacauucgacgaagaagcaccagcggaucuauuuagagcucacuuaagaaaucucugggauccaacagaacacucuuuuuggagaauaccugacuauagagcugacguucuuggauccgaauuugcuccaucaguuuccgcaccuggaguaggagaaacuuuacuauucuuuauguguaacguacccagauuaaacggagcaaauccuaauccauguccauguuuacuaccucaagaauggaucacucauuuuguuuccgaaagagcugcauuacaaucagauguagcccuauuaaauuauguaaauccaaauacuggacgaguauuauucgaagcaaaauuauaugcaaacggcuuccuuacaguaaauuuaggagcaucagaccaagcaacacuaccaguagauggaauuuuuaaauuuguaucauggguuucauuuuauuaucaauuacgacccguaggaaacgcauccguaggacgaagacuuuaa

SEQ ID NO: 35047 - RNA, 1551 nt, Artificial Sequence
  derived and/or modified sequence opt6 from VP1__Norovirus_and/or_Norovirus-like__AY126474
augaaaaugacugaccgagacacaauagauucagcaccagcuuuaggacaaguauuaccuccagaaguagaagcaucaguaccaguagaaccaacagcaggagcacccguagcagcaccaacagcaggacaaguuaauccaauagacccuuggauauuugcaaauuucguacaagccccucaaggagaauuuaccauaucucccaauaauaauccuggagaaauauuauuugaauuagaauuaggaccagaucuuaauccauauuuagcccaccuaagacguauguauaauggcuggaccggaucuaugaggguacgaguauuacuagcaggaaacgcauuuucagcugguaaaguuguuguauucuguguaccaccaggauuugacacaucauaucuuacaccuucucaagcuacucaauuuccacauguauuaauugauguucgugcaccugaaccuguugaaaugccauuagaagauguuagaaacauauuauuucaucaaggaccagacucaagaaugcgauuaaugggaauguuauauacaccucuuagagccaauucaggcgcugacccauuugucguaacaggccgaguauuaacaugcccaucaccaaauuucucauuuuucuuucucguuccaccaacuguagaagaacgagaaccaccguuuacacuucccaauuuaccaguaaauaauuuaagucauucaagagucauggaacccauagcacaaaugaugucaucaagaaauuuuccagcaucaguacaauuucaaaacggaagauguacucuaucaggagaucuauuagguacuacaccaucuucucccgccgaccuaggagcuuuuguaggacucauugcugaacccggaucaagaguaguagaacuaucacaacccaaucaagaagauuuccacgcaggaucagcaccagcaccauuuggauuuccagauuuuucagaaugcucacuaacuuuuguaguagcaucagcaacaacaguaggagaacgaacuguaaacacaagauccuuacaaaacuuuacaccagcauuaggucauaucacuuuugacgaagaagcaccagcagacuuauuucgagcacauuuaagaaaucuaugggauccaacagaacauuccuuuuggcgaauaccagacuauagagcugacguauuaggauccgaauuugcaccaucaguuucagccccaggcguuggugagacacuacuauucuuuaugugcaacguaccucgauuaaauggugccaauccaggauuaugcccaugucuucuaccacaagaauggaucacacauuuuguaagcgaaagagcugcucuccaaagugaugucgcgcuucuuaauuacguuaacccaaacacaggaaggguccuuuuugaauguaaauuauaugccaauggauuuuuaacuguaaaucuaggugcaucagaucaagcaacacuaccaguagauggaauauuuaaauucguaucuugggucucuuuuuauuaucaacuaagaccuguuggaaaugcaucuguaggaagaagacuguaa

SEQ ID NO: 35048 - RNA, 1551 nt, Artificial Sequence
  derived and/or modified sequence opt6 from VP1__Norovirus_and/or_Norovirus-like__JX145650
augaaaaugacugaucgagauauaguagacucagcuccugcauuaggccaaguauuaccaccugaagucgaagcaucaguaccuguagaaccaaccgcaggagcaccuguagcagcaagcacugcaggucgcguaaauccuauagauccauggaucuuugcaaauuuuguccaagcaccacaaggagaguucacuaucucaccaaacaauaauccaggagaaauacuuuuugaacuggaauuaggaccagauuuaaacccauaucuagcccaucugagaagaauguauaacggauggacaggcagcaugagaguacgaguucuuuuagcaggaaacgccuuuucagcuggcaaaguagucguauucugcguuccaccaggauuugauacaucauauuuaacuccaucacaagcaacacaauuuccccauguuuuaauugauguuagagcaccagaaccaguagauaugccacucgaagacguaagaaauauccuauuucaucaaggaccagauucuagaaugcgauuaauggguauguuauauacuccauuaagagcaaacaguggagcagauccuuucgucguaacuggaagaguacuuacaugcccauccccaaauuuuucuuucuucuucuuaguaccaccaacaguagaagaaagagaaccuccauucacuuuaccuaaucuaccaguaaauucuuuaucacacucacgaguaauggaaccuauagcacaaaugaugucaucaagauccuuuccagcuuccguccaauuucaaaauggucgaugcacacuaucaggugaucuauuaggaacaacacccucaucacccgccgauuuaggugcauuuguuggccucaucgccgaaccaggaucuagagucgucgaacuuucacaacccaaucaagaagauuuucacgcaggaucagccccagcaccuuuugguuucccagauuuuucagaauguucaguuacuuuuguuguagcaucagcaacaacaguaggugaaagaaccguuaaugcaagaaacccacaaaauuuuaccccugccuuaggacauauuacuuucgaugaagaagcuccugcagaucuauuucgagcaagauuucguaaucuaugggaaccaacagaacauucauuuuggagaauaccagauuauagagcagauguccuaggauccgauuuugcaccaaguguaagcgcaccaggaguaggagaaacauuacucuuuuucauguguaaugucccuagauuaaacggcgcaaauccaaaucccugcccaugccuucuaccucaagaauggaucacacauuucguauccgagagagcagcauuacaaucagauguagccuuacuaaauuacguaaauccaaauacaggacguguacuuuucgaagcuaaacuuuacgcuaacggcuuucuuacaguaaauuuaggagcaucagaucaagcaauauuaccaguugacggaauauuuaaauuuguaucuuggguaucuuuuuauuaccaauuaagaccaguagguaacauaucaguaggccgaagauuauag

SEQ ID NO: 35049 - RNA, 1548 nt, Artificial Sequence
  derived and/or modified sequence opt6 from VP1__Norovirus_and/or_Norovirus-like__AY549161
augaaaaugacugaucgugacacuacugauagugcaccagcauuaggacaaguucuuccaccagaaguugaagcaucaguuccagucgaaccaacagccggagcaccaguagcagcugcaacagcaggacaaguaaauccaauagauccuuggauauuugcaaacuuuguacaagcaccacaaggagaauuuacuauaucaccaaacaacaauccaggagaaauucuauuugaauuagaacuuggacccgauuuaaauccauacuuagcccaccuuagacgaauguacaauggauggacagguucuaugcgcguuagaguccuccuagcaggaaaugcauuuagcgcaggaaaaguaguaguauuuugcguaccuccaggauuugaugcuucauaucuuacaccuucacaagccacucaauuuccacauguauuaauagauguaagagcaccagaaccaguagaaaugccacuagaagauguaagaaauauauuauuucaucaaggcccugauucacgcaugaaacuaaugggaauguuauauacaccucuaagagccaauucaggagcugauccauuuguaguaacaggacgaguccuaacauguccaucaccuaauuuuucuuucuucuuucuaguuccucccacaguagaagaaagagaagcacccuuuacauuacccaaucuuccuguuaacucauuaucucacucaagauauguaggaccaauaaugcaaaugaugucaucaagaacuuuuccagcauccguucaauuucaaaauggaagaugcacacuaucuggagacuuacuaggcacaacaccaucuucaucugcagaucugggagcauuuguagguuuaaucgcugaagcuggaucaaggguuguagaacuaucucaaccaaaccaagaagauuuccacgcaggaagugcaccagcaccacuaggcuuuccagauuuuucagauuguucucuuacuuucguuguagcauccuuaacuacaguaggagaacgaacagucaaugcaagaucacuacaaaauuuuaccccagcauuaggccacguuacuuuugacgaagaagcuccugcagaccucuuucgugcaagacuuagaaauuuaugggaucccacagaacauucaguauggagaauaccagauuauagagcagauguacuaggaucagaauuugccccuucaguaucagcaccaggaguaggagaaacauuacuauucuuuaugugcaauguaccacaccaaacaggagcaaacccuaauccaugucccugccuauuaccacaagaauggauaacccacuuuguuucagaaagagccgcuuuacaauccgaaguagcacuauuaaauuacguaaauccaaauacuggaagaguauuauuugaaugcaaauuauaugcaaauggauuucucacaguuaaucuaggcgcaucagaucaaguaucuuuacccguugacggaaucuuuaaauuuguaucauggguuucauuuuacuaucaguuaagaccagucggaaauacaggcguaggacgacgauaa

SEQ ID NO: 35050 - RNA, 1548 nt, Artificial Sequence
  derived and/or modified sequence opt6 from VP1__Norovirus_and/or_Norovirus-like__AY549164
augaaaaugacagauagagaugcaguagauucugcuccagcacuaggucaaguuuuaccacccgaaguagaggcaucaguaccugucgaaccaacagcaggagcuccagucgcagcaccuacugcuggucagguaaacccuauagaucccuggauauuugcaaauuuuguacaagcuccacaaggagaauuuacaauaucaccaaauaauaauccaggcgaaauauuauuugaauuagaacuaggaccagacuuaaauccuuacuuagcacauuuaagaagaauguacaauggauggacaggaucaaugagaguucguguacuuuuagccggaaaugcuuucuccgcagguaaaguaguaguauuuuguguuccaccaggauuugauaccuccuauuuaacuccaucacaagccacacaauucccacauguacuaauugacgucagagcaccagaaccuguugaaaugccacuagaagauguaagaaacauauuauuucaucaagguccagauucaagaaugagacuaauggguauguuauauacuccacuaagagcuaacuccggagccgauccauuuguuguaaccggaagaguauuaaccuguccaucccccaauuucucuuucuuuuuccuaggacccccuacaguagaagaaagagaaccacuuuuuacccuacccaaucuaccaguaaauaaccuaucacauucaagagucauggaaccaauagcccaaaugaugaguucaagaaguuuuccagcuucuguacaauuucaaaauggucguuguacauuaucuggagaucucuuaggaacaacaccaucaucaccagcugauuuaggagcauucguagguuuacgagcagaaccaggaucaagaguuguugaauuaucucaaccaaaucaagaagacuuucacgcaggaucagcuccagccccguuuggcuuuccugauuuuucagauugcucuguuacauuuguagucgcaaaugcaacaacaguucaagaauguacaguaaauacacgaaauccacaaaauuuuacaccagcuuuaggucacauuacauucgacgaagaagcacccgcagaccucuuccgcgcacgauucagaaauuuaugggauccaacagaacauucauuuuggagaaucccugacuauagagcagaagucuuagguucagauuuugcuccaucaguaucagccccuggaguaggagaaacacuucucuuuuucauguguaauguaccaagaucaaauggugccaauccaaaucccuguccuugcuuauuaccacaagaauggaucacacacuucguaucagaacgagcugcauuacaaucugaugucgcuuuauuaaauuauguaaauccaaacacaggaagaguacuauucgaagcaaaacuuuacgcaaauggauuccuaacagucaaucuaggagcaucagaucaagcaacacuaccaguugauggaauauuuaaauuuguaucauggguuucauucuauuaucaacuacgaccgguagguaauacuucaguuggaagaagauaa

SEQ ID NO: 35051 - RNA, 1548 nt, Artificial Sequence
  derived and/or modified sequence opt6 from VP1__Norovirus_and/or_Norovirus-like__AY126476
augaaaaugacagacagagauacaguugauucagcuccugcacuuggacaaguacuaccaccugaaguugaagccucuguuccaguagaaccaacagcaggagcaccuguugcagcuccaacagcaggucaaguaaacccaauugauccauggauauuugcaaacuucguccaagcaccucaaggcgaauuuacaauuaguccaaacaauaauccuggugaaauuuuauuugaauuagaacuagguccagaucuaaacccauaucuagcucaucuucgcagaauguauaauggauggacaggaucaaugagaguaagaguauuacucgcaggaaacgcuuuuucagcaggaaaaguaguuguauuuuguguaccuccaggauuugauacaucauaucuaacaccaucccaagcuacucaauucccacauguacuuauagacguacgcgcaccugaaccaguagaaaugccauuagaagauguuagaaacauacuauuucaucaaggacccgauucacgaaugcgcuuaaugggaaugcuauauacaccacuaagagcuaauucuggagccgacccauucguaguaaccggccgcgucuuaacauguccaucaccaaauuucucuuucuuuuucuuaguaccuccaacagucgaagaacgagaaccucccuuuacauuaccuaaucucccaguaaauaaucuuucacacucaagaguaauggaaccaauagcucaaaugaugucaagcagaucuuucccugcaucaguccaauuucaaaauggaagauguacauuaucaggagauuuauuaggaaccacuccuaguucaccagcagaucuaggcgcauuuguaggucuaagagcagaaccaggaucucgaguaguagaacuaucucaaccuaaccaagaagacuuucaugcuggauccgccccagccccauucggcuuuccagauuucucugacugcucaguuacauucguugucgccucagcuacaacaguacaagaauguaccgucaauacaagaaauuuacaaaauuuuacaccagcccucggucauaucacauucgaugaagaagcuccagcagacuuauuuagagcaagauucagaaauuuaugggauccaacagaacauuccuuauggagaauaccugauuauagagcagaaguacuaggauccgauuuugcaccaucagugucugcacccggaguuggagaaacauuauuauucuuuaugugcaauguaccaagaucaaauggagcuaauccaaacccuuguccaugcuuacuuccacaagaauggaucacacacuuuguaucagaaagagcugcucuacagucagauguugcgcuauuaaauuauguuaacccaaauacuggaagaguuuuauucgaagcaaaauuauaugcgucuggcuuuuuaacaguuaaucuuggugcuucagaccaagcaacauuaccaguagaugguaucuuuaaauuuguauccugggucucauuuuacuaucaacucagacccguaggaaauacaucaguaggaagaagauaa

SEQ ID NO: 35052 - RNA, 1548 nt, Artificial Sequence
  derived and/or modified sequence opt6 from VP1__Norovirus_and/or_Norovirus-like__EU794905
augaaaaugacagacagagauacuauagacucagcacccgcuuuaggacagguacuaccaccugaaguagaagcaucuguaccaguagaaccaacagcuggagcaccaguagcagcucccacagcuggacaaguaaacccaauugacccauggauauuugccaauuucguacaagcaccacaaggagaauuuacuauaucaccaaauaauaaucccggagaaauacuauucgaauuggaauuagguccagauuuaaacccuuauuuagcacaucuacgaagaauguauaauggcuggaccggcucaaugcguguacgaguauuguuagcaggaaacgcauuuucagcagguaaaguaguaguauuuugcguaccaccuggcuuugauacauccuacuuaacaccaucucaagccacacaauuuccacauguacuuauugaugucagagccccagaaccuguugaaaugccacucgaagacguaagaaauauacucuuucaucaaggaccagacucuagaaugagauuaaugggaauguuauauacaccacuuagagcaaacucaggagcagauccauuuguuguaacaggcagaguauuaacuuguccaagucccaauuucuccuuuuucuuccuagucccuccaacaguugaagaaagagaaacaccuuuuacauuaccaaaccuaccuguaaauucacucucacauuccagagcaauggaaccaaucgcacaaaugaugaguucaagaaauuuuccagccucaguacaauuucaaaauggaagaugcacauuaucuggagauuuguuagguacaacaccuucauccccagcugacgucggaacuuuugucggacuaauagcagaacccggaucacacgucguagaacuuagucaacccaaucaagaagacuuucaugcaggaucagcaccagcuccauucggauuucccgauuuuucugauuguucacuaacauuuguaguagcaucugcaucaacgguaggugaacgaacagucaauacucgcuccccacaaaacuuuacuccagcacuaggccauaucacauucgaugaagaagccccagcagauuuauuuagagcacacuuacgcaaccuuugggaucccacagaacauuccuuuuggagaauaccagauuauagagcagacguacuuggaggagaauuugcaccuagcgucagugcaccagguguaggagaaacacuacucuucuuuauguguaaugucccaagaucaaauggagcaaauccaaauccaugccccugcuuauuaccacaagaauggauaacccauuuuguauccgaaagagcagcauuacaaucagauguagcccuacuaaauuacauaaaccccaauaccggaagaguacuauuugaauguaaauuauaugccaauggauuuuuaacaguuaaccuaggagcaucagaucaagcuacauuacccguagacggaauauuuaaauuuguaagcuggguuucauucuauuaucaacuaagaccaguaggaaauaucggaguuggacguagauaa

SEQ ID NO: 35053 - RNA, 1548 nt, Artificial Sequence
  derived and/or modified sequence opt6 from VP1__Norovirus_and/or_Norovirus-like__EU794906
augaaaaugacagaucgagauacaauagauucugcuccagcauuaggacaaguauuaccacccgaaguugaagcaucaguaccaguagaaccuaccgcuggagcuccuguugccgcuccaacugcaggccaaguaaacccaauagauccauggauauuugcuaauuuuguucaagccccacaaggagaauuuaccauaucuccaaauaauaacccaggcgaaauuuuauuugaauuagaauuaggaccagaucuaaacccauauuuagcacaucuacgaagaauguauaauggauggacaggaucaaugagaguacguguauuauuagcugguaaugcuuucuccgcuggaaaaguaguuguauuuuguguaccucccggauuugauacaucuuaucuaacaccaucacaagcaacacaauuuccucauguacuuauagauguaagagcaccagaacccgucgaaaugccauuagaagauguaagaaauauauuauuucaucaaggaccagauucacguaugcgacuuaugggaaugcuauacacaccucuccgcgcuaauucaggagcugauccuuuugucguaacuggucgaguccuuacauguccaucuccaaacuucucauuuuucuuucucguacccccaacuguagaagaacgagaaacaccauuuacuuuaccaaacuuaccaguaaauucuuuaucacacucaaggguuauggaacccauugcacaaaugaugucaucaagaaauuuuccagcaucaguacaauuucaaaauggaagaugcacauuaucuggagauuuacuuggaacaacuccaucuucacccgcagauuuaggaacauucguaggacucauagcagaaccagguucacacguagcagaacuaucacaaccaaaucaagaagauuuucacgcuggcuccgcaccagcaccauucggauuuccugauuuuucugaauguucgcuaacuuuuguaguagcuucagcauccacaguaggagaacgaacaguuaacacgcgaucacuacaaaauuuuacccccgcacuaggacacaucacuuuugaugaagaagcuccagcagauuuauuucgugcucaucuaagaaauuuaugggauccaacagaacauucauuuuggcgcauuccagacuauagagccgauguauuaggaggugaauuugcuccaucaguaucugcacccggaguuggagaaaccuuauuauucuucaugugcaauguuccaagauuaaauggagcaaauccaaauccauguccaugucuucuaccacaagaauggauuacucauuucguaagugaacgagcagcacuucaaucagacguagcucuauuaaauuacauaaauccuaauaccggacguguacuuuuugaauguaaauuauauguuaacggauuuuuaacaguaaauuuaggagccucugaccaagcaacccuaccuguagacggaauuuuuaaauuuguuucuuggguaucauuuuauuaucaauuaagaccaguagguaacauaggcguuggaagacgauaa

SEQ ID NO: 35054 - RNA, 1548 nt, Artificial Sequence
  derived and/or modified sequence opt6 from VP1__Norovirus_and/or_Norovirus-like__AY126475
augaaaaugacagauagagauacagcagacccagcaccagcacuuggacaaguuuuaccacccgaaguagaagccucaguaccuguugaaccaacagcaggcgcaccaguagcagcaccaacagcaggacaaguaaacccaauagauccauggauauuugcaaauuuuguacaagcuccacaaggugaauuuaccauaucuccuaauaauaacccuggagaaauacuuuucgaauuagaauuaggcccugaucuuaauccauauuuagcacacuuaagaagaauguauaauggauggacuggaucuaugagaguacgaguauuacuagcaggcaacgcuuuuucagcaggaaaaguaguaguauuuuguguuccacccggcuuugauacaucauacuuaacaccuucacaagcaacccaauucccacauguauuaauagauguuagaguaccagaaccaguagaaaugccacuugaagauguaagaaacauacuuuuucaucaaggucccgauucacguaugcgacuaaugggaauguuauauacaccacuacgcgcuaauucaggugcagacccauucguaguaaccggaagaguccucacauguccaucaccaaauuuuucauuuuucuuuuuaguuccuccuacagucgaagaaagagaaccaccuuuuacacuaccuaaccucccagucaacaaucuaucccauucacgaguaauggaacccauagcucaaaugaugucaucaagaucauucccagccucaguucaauuccaaaacggaagauguacacuaucaggagaucuacuuggaacaacaccaucaaguccagcagacuuaggagcauuuguaggauuaauugcagaacccggaucaagaguugucgaauuauuccaaccaaaucaagaagauuuucacgccggauccgcuccugcaccuuuugguuucccagauuuuuccgaauguuccgucacauuuguaguuaguucagcaacaacagucggagaaagaacuguaaaugcaagaaaucaacaaaauuuuacaccagcacuuggacauauaacauuugaugaagaagcuccugcagaccuuuuuagagcaugcuucagaaauuuaugggaaccaacagaacauucuuuuuggcgaauaccagacuacagagcagacguacuaggaagugauuuugcaccuucagucagcgcaccuggaguaggugaaacauuauuauucuuuauguguaauguaccaagauuaaauggaguaaacccagguccuugcccuugucuacucccacaagaauggauaacacacuucguaagugaacgcgcagcacuacaaucagauguagcacuacucaauuauguaaaccccaauacuggaagagucuuauuugaagcaaaauuauacgcaaacggcuuuuuaaccgucaaccuuggugcaucugaucaagcuacacuaccuguagacgguauauuuaaauuuguaagcuggguauccuuuuauuaucaacuacgcccaguaggaaauacaucaguuggaagaagauaa

SEQ ID NO: 35055 - RNA, 1548 nt, Artificial Sequence
  derived and/or modified sequence opt6 from VP1__Norovirus_and/or_Norovirus-like__AF542084
augaaaaugacagauagagauaccgucgauagugcaccagcgcuaggucaagucuuaccaccugaaguagaagcaucaguucccguagaaccuacagcaggagcuccagucgcagcuccaacagccggacaaguaaauccaauugauccuuggauuuuugcaaauuucguacaggcaccacaaggcgaauuuacaauuucucccaauaacaaucccggagaaauacuguuugaacuugaauuaggaccagaccuaaauccauauuuagcacacuuacgaagaauguacaaugguuggacagguucaaugagaguacgaguguuacuagcuggaaacgcauuuucugcaggcaaagucguagucuuuuguguuccuccaggauucgauacaucauaccuuacaccuucacaagcaacacaauucccucauguacuaauagauguaagagcaccagaaccaguugaaaugccauuagaagacguucgaaauauauuauuccaucaaggaccagauuccagaaugcgacucaugggaaugcuauacacaccacuaagagccaacucaggagcagauccauucguagucacuggaagaguuuuaacaugcccaucacccaacuuuucauucuucuuucuuguaccaccuaccguugaagaaagagaaccauuauuuacacuaccaaauuuaccaguaaacaauuuaucacauucaagaguaauggaaccaauagcccaaaugaugucaagcagaaauuuucccgccucaguucaauuucaaaauggaagauguacauuaucuggagaucuauuagguacaacaccuucauccccagcagaucuuggagcauuuguaggucuaagagcugaaccagguucaagagucguagaacuaucacaaccuaaucaagaagauuuucaugcaggaucugcuccugcacccuuaggauuuccagauuucucagauuguucagucacauuuguaguugcaaacgcaaccacaguacaagaauguacaguaaacacacguaacccacaaaauuuuacaccagcauuaggacacauaaccuuugaugaagaagcaccagccgauuuauuuagagcacauuucagaaauuuaugggauccuacagaacauucauucuggcgaauaccugauuacagagcugaaguacuaggauccgauuuugcaccuucuguuucugcuccaggaguuggugaaacauuauuguucuuuauguguaaugucccaagaagcaauggagcaaauccaaauccuugcccauguuuauuaccacaagaauggauaacucacuucguuagugaaagagcagcacuucaaagcgauguagcacuuuuaaauuauguaaauccuaacacaggaagaguuuuauuugaagcuaaauuauaugcaaauggauuuuuaacaguaaaucuaggcgccuccgaucaagcaacauuaccuguagaugguauauuuaaauuuguuucauggguaucauucuauuaucaacuacguccaguaggaaacacauccguugguagacguuaa

SEQ ID NO: 35056 - RNA, 1536 nt, Artificial Sequence
  derived and/or modified sequence opt6 from VP1__Norovirus_and/or_Norovirus-like__KC695807
auggcacuagaaccaguaguuggagccgccauagcagcaccaguagccggucaacaaaauguaauugacccauggaucagaaauaacuuuguacaagcaccaggcggagaauuuaccguaucacccagaaaugcuccaggagaaauacuauggucggcaccucuaggaccagaccuaaaucccuaucuaucacauuuagcaagaauguauaacggcuaugcuggugguuucgaaguacaaguaauacuagcaggaaacgcauuuacagcgggcaaaguaauauucgcagcaguaccaccaaacuuuccaacugaagguuuaucaccaucccaaguaacuauguuuccacacauuguaguugauguacgacaacuagaaccaguacuaauaccacuuccagauguaagaaacaauuucuaucacuauaaucaaucaaacgacccaacaauaaaauuaauugcaauguuauacacacccuuacgagcaaacaaugcaggagaugaugucuucaccguuaguugucgaguucuaacaagaccaucaccagacuuugacuuuauauuuuuagucccaccuacaguagaaucuagaacaaaaccauucucuguacccguacucacagucgaagaaaugaccaacuccagauuuccaaucccacuagaaaaacuauuuacaggaccauccucugcauucguaguucaaccacaaaacggaagaugcacaacagauggagucuuauuagguacaacacaauuaucaccgguaaauauauguaccuucagaggagacguaacccauauuacuggaucucgaaacuacaccaugaacuuagcaucucaaaauuggaauaacuaugacccuacagaagaaauacccgcaccacuaggagcaccugacuuuguaggaaaaauucaaggaauguuaacucaaacaacaagagcagacggaucaacaagaggacauaaagcaacugucuacacuggaagugcugauuuugcaccaaaauuaggaagaguacaauucgaaacagauacagaucacgacuucgaagcuaaucaaaauacaaaguuuacaccaguaggagucauacaagacgguucuacaacccacagaaaugaaccccaacaauggguucuaccaucauauucaggaagaaacacacauaacguacaccucgcuccagcaguagcaccaacauuuccaggagaacaacuacuuuucuuuagaucuacaaugccagguugcucaggauaucccaacauggauuuagacugcuuacuaccucaagaauggguccaauacuuuuaccaagaagcagcaccagcacaaucagacguagcacuacuaagauuuguaaacccagauacaggaagaguauuauuugaaugcaaacuacacaaaucaggcuauguaaccguugcacauaccggacaacacgauuuaguaauaccaccuaaugguuauuuccgauucgauuccugggucaaucaauuuuacaccuuagcaccaaugggaaacggaacagguagaagauaa

SEQ ID NO: 35057 - RNA, 807 nt, Artificial Sequence
  derived and/or modified sequence opt6 from VP2_capsid_protein__Norovirus__AGL98415
auggcaggcgcauucuuugccggacuagcaucagauguauuaggaucaggacuaggaucgcuaauaaacgcaggagcaggagcaauaaaccaaaaaguagaauucgaaaauaauagaaaacuccaacaagcaaguuuucaauuuaguucaaaccuacaacaagcaucauuccaacacgauaaagaaauguuacaagcacaaauagacgcaacacauaaacuacaacaaggauuaaugcaaauaaaacaagcaguauuacucgaaggaggauucucagcagcagacgcagcaagaggagcaauaaaugccccaaugacaaaagcacuugauuggucaggaacacgauauugggcaccagaagcaagaguaacaaccuauaacgcaggacauuuuucccccucacaaccuagcagagcaccaagcggaagaaucaacucagguacaccaacaccagcaagaaauaguuuaaacucuccagcgacaaguucaguagcaacaagcguacacucaaaucaaacagcaagcacacgaauaggaucaagcgcaggaucgggaacaagcguaagcucacucccaaguacaagcagaacaagaaacuggguagaagaccaaaaccgaagcguaaguccauucaugagaggagcauuaaacacaaguuuuguaacaccaccaagcucaagaucgagcaaucaauccacaguaagcacaguaccaaaagaaauauuagacucauggacaggagccuucaacacaagaagacaaccauuauuugcacacauaagaagaagaggggaaucacgaguauaa

SEQ ID NO: 35058 - RNA, 792 nt, Artificial Sequence
  derived and/or modified sequence opt6 from VP2_capsid_protein__Norovirus__AGL98417
auggcaggagcuuuuuucgcaggacuagcaucagauguauuaggaacuggacuaggaucacuaauaggagcaggagcaggagcaauaaaucaaaaaguagaauaugaaaacaacagaaaauuacaacaagcaucauuccaauucucaagcgauuuacaacaagcaaguuuucaacacgauaaagacaugcuccaagcacaaauaaaagcaacacaaaaauuacaacaugaucuaaugagaguaaaacaagcaguacuauuagaaggaggauuuaguccaacagaugcagcacgaggagcaauaaaugcaccaaugacaaaaguacuugacuggucaggaacuagauacugggcaccaggcgcgagaguaacaacaucaaaugcaggacaauuuagcuuuucacaacccauaagagaaccaucaggaagaacagcaccagcucgaucaccagcaaacagagcaucaucaguuagugcaccaucaaguacacuaucaaaccaaacuaccucaacaagauuaggaacaucagcaggcucaggugcaucaguaucuggaucaucaucagcaucaagagucagaucauggguagaaggacaaaauagaaguuuaucaccauucauggacggagcucuacacacaaguuuuguaacuccaccaagcucaaaaucaucaagucaaggaacuguaucaacaguuccaaaagaaguauuagauucauggacaggagcauuuaacacacauagacaaccacuuuuugcucacguacgacgacaaggagaaaguagaguauaa

SEQ ID NO: 35059 - RNA, 648 nt, Artificial Sequence
  derived and/or modified sequence opt6 from capsid_protein_VP2__Norovirus__AFI08232
auggcacaagcaguauuaggagcaauagcagcaacagcagcaggaucagcaguaggagcaggaauccaagcaggaacagaagcagcacuacaacaccaaagauuccaacaagaccuaacauuacaaucaaauacauucaaacacgacaaagaaauguuagcaaugcaagucgaagcaucaaccucccuacuacaaaacucauuaaacaccagauacaaccuacuaacacaagcaggacuaacaucagccgacgcagcaagagcaguagcaggcgcacccguaacaagaguaguagacuggaacggaacaagaauagcagcaccacuaucaacagcuacaacacuaagaucaggagguuucaugucaauaccaguaauguacaggggagcaaaaacagaacaacaaaaauuaacaggauucucaaaccccaacuacgaaacaggaucaucagucucaagaacaucacaauggguaaguucucaaaacucaaugagaucaucaguagcuccauuccacccagacgcauuaagaacaacauggguaacaccaccaggaucaucaucaacaucaacaguaucaucagccucaucaauaccaagauuuuucaacacagaaagacuaccauuauuugcaaacaacaaaagauaa

SEQ ID NO: 35060 - RNA, 807 nt, Artificial Sequence
  derived and/or modified sequence opt6 from capsid_protein_VP2__Norovirus__AFI08235
auggcaggagcauucuucgcaggacuagcaagcgacguacucggaucaggauuaggcucacuaauaaacgcaggagcaggagcaauaaaucaaaaaauagacuucgaaaacaaccgaaaacuacaacaagcaaguuuccaauucucaucaaaccuacaacaagcauccuuccaacacgacaaagaaaugcuacaagcacaaauagaagcaacuaaaaaauuacaacaagaaaugaugaaaguaaaacaagcaaugcuacucgaaggcggauucucagaaaccgacgcagcaagaggugcaauaaacgcaccaaugacaaaagcauuagacuggucaggaacaagauacugggcaccagacgcaagaaccacaacauacaacgcugguagguucucaacaccacaaccaucaggagcccuaccuggaagaauaaacccaagaacaccaacacccgcaagaggaagcucaagcacaucaucaaacgcaucaacagccacaagcauacacucaaaccaaacaguaucaacaagauuaggaucuacagcaggcucaggaacaaacguauccucacuaccaucaacagcucgaacaagaaguuggguagaagaccaaaacagaaaccuaagcccauucaugagaggagcacacaacauaagcuuuguaacacccccaucaucacgaucuucaucacaaggaacaguaucaacaguaccuaaagaaguacuaaacucauggacaggagcauucaacaccagacgacaaccacuauucgcucauauaagaagacaaggagaaucaagaguauaa

SEQ ID NO: 35061 - RNA, 807 nt, Artificial Sequence
  derived and/or modified sequence opt6 from capsid_protein_VP2__Norovirus__AFI08238
auggcaggagcauucuucgcaggauuagcaagcgauguacuaggaucaggauuaggaucauuaauaaacgcaggagcaggcgcaauaaaucaaaaaauagacuucgaaaacaauagaaaauuacaacaagcaucauuucaauuuagcucaaauuuacaacaagcaucauuccaacaugauaaagaaauguuacaagcacaaauagaagcaacaaaaaaauuacaacaagaaaugaugaaaguaaaacaagcaaugcuauuagaaggaggauucucagaaacggacgcagccagaggagcaauaaaugcaccaaugacaaaaguauuagauuggucaggaacaagauauugggcaccugaugcaagaacaacaacauauaacgcaggcagauucucaacaccacaaccaagcgguacauuaccaggaagaauaaacccaagaacaccaacacccgcaagaggcagcucaucaacaagcucaaacgcaaguacagccacgagcauacacucaaaccaaacaguuagcacacgauuaggaucaacagcaggaucaggagcaaauguaucaucauuaccaagcacagcaagaacaagaagcuggguagaagaccaaaauagaaacuuaaguccauucaugagaggagcacacaauauaaguuuuguaacacccccaucaucaagaucaucaucucaagggaccguaagcacaguaccaaaagaagucuuagacucaugggcaggagcuuuuaauaccagaagacaaccauuauucgcacacauaagacgaagaggagaaucaagaguauaa

SEQ ID NO: 35062 - RNA, 807 nt, Artificial Sequence
  derived and/or modified sequence opt6 from capsid_protein_VP2__Norovirus__AFI08241
auggccggagcauucuuugcaggacuagcauccgauguauuaggaucaggauuaggaucauuaauaaacgcaggagcaggagcaauaaaucaaaaaauugauuucgaaaacaauagaaaacuacaacaagcaucuuuucaauuuucaucaaacuuacaacaagcaucauuccaacacgauaaagaaauguuacaagcacaaauagaagcaacaaaaaaauuacaacaagaaaugaugaaagucaaacaagcuaugcuacuagaaggcggauucucggaaacagacgcagcuagaggcgcaauaaaugcaccaaugacaaaaguacuagauuggucaggaacaagauauugggcaccugaugccagaaccacaaccuauaacgcaggaagauucucaacaccacaaccaagcggaacauuaccaggaagaacgaacccaagaacaccaacaccagcaagaggaucaucaucagcaagcucaaacgcaaguacagccacuaguauacuaucaaaucaaacagcaagcacaagauuaggcucgaccgcaggaucaggaacaaacguaagcucauuaccaucaacagcaagaacacgaaguuggguagaagaccaaaacagaaacuuaagcccauucaugagaggagcccauaauauaagcuucgucacaccaccaaguucacgcucaagcucacaaggaacaguaagcacaguaccgaaagaaguacuagacucauggacaggagcauucaauacaagaagacaaccacuauucgcacacauaagaagaagaggagaaucaagaguauaa

SEQ ID NO: 35063 - RNA, 807 nt, Artificial Sequence
  derived and/or modified sequence opt6 from capsid_protein_VP2__Norovirus__AFI08244
auggcaggugcauucuuugcaggguuagcaagugauguauuaggcucagguuuaggaucacuaauaaacgcaggagcaggugcaauaaaucaaaaaaucgacuucgaaaacaauagaaaacuccaacaagcuaguuuucaauuuagcucaaacuuacaacaagcaucauuccaacaugauaaagaaauguuacaagcacaaauagaagcaacaaaaaaacuacaacaagaaaugaugaaaguaaaacaagcaauguuacuagaaggaggauucucagaaacagacgcagcaagaggagcaauaaacgcaccaaugacaaaaguauuagauuggucaggaacacgauauugggcaccagaugcaagaacaacaacucauaacgcuggaagauucucaacaccacaaccaucaggaacacuaccuggaagaauaaacccaagaacaccaacaccagcaagaggaucaucaaacacgagcucaaacgcaaguacagccacaucaauacauucaaaccaaacaguaucaacaagacuaggaucaacugcaggaucaggaacaaaugugucaucguuaccaagcacagcaagaacaaggaguuggguagaagaccaaaacagaaacuuaaguccauucaugagaggggcacauaauauauccuuuguaacaccaccaucaucaagaucuagcucacaaggaacuguaagcacaguaccaaaagaaguauuagacucauggacaggagcauucaauacaagaagacaaccauuguucgcacacauuagaagaagaggagaaucaagaguauaa

SEQ ID NO: 35064 - RNA, 807 nt, Artificial Sequence
  derived and/or modified sequence opt6 from capsid_protein_VP2__Norovirus__AFJ38520
auggcaggaccauucuuugcaggacucgcaagcgauguauuaggaucagguuugggaucauuaauaaacgcuggcgcaggagcaauaaaucaaaaaguagaauucgaaaacaauagaaaacuacaacaagcaagcuuucaauuuucaucaaacuuacaacaagcaucauuucaacacgauaaagaaauguuacaagcacaaauagaagcaacacaaaaacuacaacaaggauuaaugaaagucaaacaagcaguccuacucgaaggagguuucucaacaacggaugcagcaagaggagcgaucaaugcaccaaugacaaaagcacuagauuggucaggaacaagauauugggcaccagaugcuagagcaacaacauauaacgcaggaagauucucaacaccacaaccguuaggagccuuacccggucgaauaaacccgcgaguaccagcaccagcaagaagcagcccaagcucacucucaaacgcaccaacggcuacaagcguauacucaaaucaaacaguaagcacaagauuaggaucaagcgcaggaucaggagcaggagugagcucauuaccaagcacagcaagaacaagaagcuggguagaagaccaaaacagaaacuuaaguccauucaugagaggugcauuaaacacaagcuuuguaacaccaccaaguucaagaucaagcaaucaaggaacaguaagcacaguaccaaaagaaauauuagauucauggacaggagcauucaauacuagacgacaaccauuauucgcacacauacgcaaaagaggagaaucaagaguauaa

SEQ ID NO: 35065 - RNA, 765 nt, Artificial Sequence
  derived and/or modified sequence opt6 from capsid_protein_VP2__Norovirus__AFX71657
auggcaggagcauucauagcaggacuagcaggagacauguuaacaucaacagucggaucacuaguaaacgcaggggcaucagccauaaaccaaaaaguagacuuugaaaacaacaaauacuuacaaaacgcaucauucaaccacgacaaagaaaugcuaaacgcccaaauagaagcaacaaaaagauuacaagcagacaugauagcaauaaaacaaggaguucucacagcagguggauucucaccaacagacgcagcaagaggagcaauaaacgcaccaauaacaagaguacuagacuggucagguacaagauacugggcaccaaacgcaacaucaacaacauccaugucaggaggauucacaucacaaacaguacacagaaccacaccaaacuucaaaacaaaccaagcacccaaaucaacuccaucaucaggaucauccguaagaucaaauucaacacaacucacaucauuaucaucacacagcucaggauccucaagauccucagguucaaccguaguaucaucacuaccaucaucaaacagaacuagagauuggguaaaccaacaaaacuucaacuuagaaccacacaugccaggauccuuaagaacagcauucguaaccccaccauccagcacagcaucaaauucagauacaguuucaacaguaccaaaaucaguauuagacucauggacaucagcauucaacacaagaagacaaccacuauucgcacaucuaagaagaagaggagaaucaaacguuuaa

SEQ ID NO: 35066 - RNA, 780 nt, Artificial Sequence
  derived and/or modified sequence opt6 from capsid_protein_VP2__Norovirus__AFX71660
auggcaggcgcauucguagcaggacuagcaggagacguacuuuccaacggauuaucaucacuaauaaacgcaggagcaaacgcaauaaaccaaagagcagaauucgacuuuaaccaaagacuacaacaaaacucauucaaccacgauaaagaaaugcuacaagcacaaauccaagcaacaaaacaacuacaagcagacaugauggcuauaaaacaaggaguccuaacagcaggaggauuuucacccacagacgccgcaagaggagcaguaaacgcaccaaugacacaagcacuagacuggaacggcacaagauacugggcaccaggaucaaugagaacaacaucauacucaggccgcuucacaucaacagcaccagcaagacaagcagauuuccaacauacacaaaacagaccaucaagcggaucaucaguaucauccuauacaacacaauccucaagaccaacacucacaacaacaacaggaucaagucacggaacaacaucaucaaacucaacaagaucaaccaaccuaucacaaucaaccgucucacgagccacaucaagaacaucagaauggguaagagaccaaaacagaaaccuagaaccauacaugcacggagcccuacaaacagcauucguaacaccaccaucaucaagagcaucagacggaacuguauccacaguaccaaaaggaguacucgacuccuggacaccagcauucaacacacgaagacaaccccuauucgcacaccuaagaaaaagaggagaaucaagaguauaa

SEQ ID NO: 35067 - RNA, 780 nt, Artificial Sequence
  derived and/or modified sequence opt6 from capsid_protein_VP2__Norovirus__AFX71666
auggcaggagcauucuucgcaggacuagcaggagacguagucucaaacggaauaggaucccuaauaaacgcaggagcaaaugcaguaaaucaaaaaguagaauacgacuucaauaaacaacuacaaauggcaucauucaaacaugacaaagaaaugcuccaaucacaaguucuagcaacaaaacaacuacaacaagaaaugaugaauauaagacaaggaguacuaacagcaggaggauucucccccgcagacgcagcaagaggagcaguaaacgcaccaaugacaaaaauccuagacuggaacggcacaagauacugggcaccaaacucaaugaaaacaacaucauacucaggacaauuuucaucaucaccuguacacagaccaccagcagcaccacaacauacagcaccacccaaaucaaaacuacaaggagacuccguaucaguauacucauccccaucaacaguaucaucacaaucaacacauaguacaguacuaucagcaggaacaggaucuucaagaucaacaucaacaucaacagcagcaucaacacuaucaagaacaagcgacuggguaagaggccaaaacgaaagauuaucaccauuuauggacggagcauuacaaacaacauucguaacaccaccaucaucaaaagcauccucaaacggaacaguaucaacaguaccaaaagcaguucuagacucauggacaccaacauucaacacucacagacaaccacucuuugcacacuuaagaagaagaggagaaucacaaauauaa

SEQ ID NO: 35068 - RNA, 807 nt, Artificial Sequence
  derived and/or modified sequence opt6 from capsid_protein_VP2__Norovirus__AFX71669
auggcaggagcauucuuugcaggacuagcaagcgacguauuaggaucaggauuaggaucauuaauaaaugcaggagcaggaguaauuaaucaaaaaguagauuuugaaaacaacagaaaguuacaacaagcgaguuuucaauuuaguucaaaucaacaacaagccucauuccaacacgauaaagaaauguuacaagcacaaauagaagcaacaaaaaaacuacaacaagaaaugaugagaguaaaacaagcaauguuauuagaaggaggauucucagaaacagaugcagcaagaggcgcaauaaaugcaccaaugacaaaagcacuagacuggucaggcacaagauauugggcaccagacgcuagaacaacaacauacaacgcaggaagauucucgacaccacaaccaaguggugcaucgccaggaagagcaaacuuaagagcaacaguaccagcaagaggaagcucaagcacaagcucaaacucaaguauagcaacaagcguauacucaaaccaaaccacaagcacgagauuaggcuccacagcaggaucaggaacaagcguaagcucacuaccaagcacagcaagaacaaugagcugggucgaagaccaaaacagaaacuuaagcccauucaugagaggagcacauaauauaagcuuuguaacaccaccaaguucaagaucaagcucgcaaggaaccguaagcacaguaccgaaagaaguauuagacucauggacaggagcauuuaauacaagaagacaaccauuauucgcacauauaagaaaaagaggagaaucaagaguauaa

SEQ ID NO: 35069 - RNA, 807 nt, Artificial Sequence
  derived and/or modified sequence opt6 from capsid_protein_VP2__Norovirus__AFX81122
auggcaggugcauucuuugccggacuagcgagugaugucuuaggaucaggauuaggaucauuaauaaaugcaggcgcaggagcaaucaaucaaaaaauagauuuugaaaauaauagaaaguuacaacaagcaagcuuucaauuuaguucaaaucuacaacaagcaucauuccaacacgauaaagaaaugcuacaagcacaaauagaagcuacaaaaaaacuacaacaagaaaugaugaaaguaaaacaagcaauguuauuagaaggaggauucucagaaacagaugcggcaagaggagcaauaaaugccccaaugacuaaaguauuagauuggucaggaacgagauauugggcaccagaugcccgaacaacaaccuauaacgcaggaagauucucaacaccacaaccaagcggaacacuaccaggaagaacaaauccaagaacaccaacaccagcaagaggaucaucgaguacaucuucaaacgcgaguacugcaacaaguauacuaucaaaccaaacagcaaguacaagauuaggaucaacagcaggaucaggaacaaacguaagcucauuaccaagcacagcaaggacaagaagcuggguagaagaccaaaacagaaauuuaagcccauucaugagaggagcacauaacauaagcuuuguaacuccaccaaguuccagaucaucaagccaaggaacuguaagcacaguaccgaaagaaguauuagacucauggacaggagcauuuaacacaagaagacaaccauuauucgcgcacauaagaagaagaggagaaucaagaguauaa

SEQ ID NO: 35070 - RNA, 807 nt, Artificial Sequence
  derived and/or modified sequence opt6 from capsid_protein_VP2__Norovirus__AFX81125
auggcaggcgcauucuuugcaggauuagcaagcgauguacuagguucaggacuaggaucacuaauuaacgcaggagcaggagcaauaaaucaaaaaauagauuuugaaaacaauagaaaauuacaacaagcaucauuccaauuuucaucgaaccuacaacaagcaucauuccaacaugauaaagaaauguugcaagcucaaauagaagcaacaaaaaaauugcaacaagaaauaaugaaagcaaaacaagcaauguuacuagaaggaggauucucugaaacagacgcagccagaggagcaauaaacgcaccaaugaccaaaguauuagauuggucuggaacaagauauugggcaccagaugcaagaacagcaacauauaacgcaggaagauuuucaacaccacaaccaucagggacuuuaccaggaagaauaaauccaagaacacccacaccugcaagaggaaguucaaguacaucaucaaacgcaagcacagcuacaagcauacacucuaaccaaacaguaagcacaagacuagguucaacagcaggaucaggaacaaacgugagcucacuaccaagcacagcaagaacaagaaguuggguagaagaccaaaaucgaaacuuaagcccauucaugagaggagcacauaacauaagcuuuguaacaccaccuaguucaagaucaaguucucaaggaacaguaaguacaguaccaaaagaaguacuagacucuuggacaggugcauuuaauacaagaagacaacccuuauucgcacauaucagaagaagaggagaaucacgagucuaa

SEQ ID NO: 35071 - RNA, 807 nt, Artificial Sequence
  derived and/or modified sequence opt6 from capsid_protein_VP2__Norovirus__AFX81131
auggcaggagcauucuuugcaggacuagcaagcgauguauuaggaucaggauuaggaucacuaauaaacgcaggagcaggagcaauaaaucaaaaaauagauuucgaaaacaauagaaaauuacaacaagcaucuuuucaauuuagcucaaaccuacaacaagcaucauuccaacacgauaaagaaaugcuacaagcacaaauagaagcaacaaaaaaacuacaacaagaaguaaugaaagucaaacaagcaaugcuacuagaaggcggauucucagaaacagacgcagcaagaggagcaauaaaugcaccaaugacaaaaguacuagacuggucgggaacaagauauugggcaccagaugcaagaacaacaacauauaacgcaggaagauucucaaccccacaaccaagugggacacuacccggaagaauaaaccccagaacaccuacaccagcaagagggucaucaagcacaagcucaaaugcaagcacagccacaagcauacacucuaaccaaacaguaagcacaagauuaggaucuacagcaggaucaggaacgaacguaagcucgcuaccaaguacagcaagaacaagaagcuggguagaagaccaaaacagaaaccuaagcccauucaugagaggagcacauaacauaaguuuuguaacaccaccaagcucuagaucaagcucacaaggaacagugucaacaguaccaaaagaaguacuagauucauggacgggagcguucaacacaagaagacaaccauuauucgcucacauaagaagacgaggagaaucaagaguauaa

SEQ ID NO: 35072 - RNA, 807 nt, Artificial Sequence
  derived and/or modified sequence opt6 from capsid_protein_VP2__Norovirus__AFX81134
auggcaggagcauucuuugcaggccuagcaagugacguacugggaucaggauuaggcucacuaauuaaugcaggagcaggagcaauaaaucaaaaaaucgacuucgaaaacaacagaaaacuacaacaagcgagcuuucaauucaguucaaaccuacaacaagcaucauuccaacacgauaaagaaauguuacaagcacaaauagaagcaacaaaaaaauuacaacaagaaaugaugaaaguaaaacaagcaauguuacuagaaggaggauucucagaaacagacgcagcaagaggagcaaucaaugcaccaaugacaaaaguacuagauuggucaggaacacgauauugggcaccagaugcaagaacaacaacauauaaugcaggaagauucaguacaccacaaccaagcggaaccuuaccagggcgaauaaacccaagaacaccaacaccagcaagaggaaguucaucaacaagcucaaaugcaucaacggcaacaaguauacacucaaaccaaacaguaagcacaagauuaggcucaacagcaggaucaggaacaaacguaaguucacuaccaucaacagcaagaacaagauccuggguagaagaccaaaacagaaacuuaagcccguucaugagaggagcacauaauauaagcuuuguaacaccaccaagcucaagaucaucaucacaaggaacaguaaguacagucccaaaagaaguauuagacucauggacgggagcauucaauacaagaagacaaccacuauucgcacacauaagaagaagaggagaaucaagaguauaa

SEQ ID NO: 35073 - RNA, 807 nt, Artificial Sequence
  derived and/or modified sequence opt6 from capsid_protein_VP2__Norovirus__AFX81137
auggcaggagcauucuucgcaggauuagcaucagacguacuaggaucaggauuaggcucauuaauaaacgcaggagcaggagcaauaaaccaaaaaauagacuucgaaaacaacagaaaacuccaacaagcaucauuccaauuuucauccaacuuacaacaagcaucauuccaacaugacaaagaaaugcuacaagcccaaauagaagcaacaaaaaaacuacaacaagaaaugaugaaaguaaaacaagcaaugcuacuagaaggaggauucuccgaaacagacgcagcuagaggagcaauaaacgcaccaaugacaaaaguauuagauuggucaggaaccagauacugggcaccagacgcaagaacaacaacauacaacgcaggaagauucucaacaccacaaccaagcggaacauuaccaggaagaauaaauccaagaacaccaacaccagcacgcggaucaucaagcacaucaucaaacgcaaguacagcaacaagcauacacucaaaccaaacaguaaguacaagacuagguucaacagcaggcucaggaacaaauguaucaucacuaccaucaacagccagaaccagaaguuggguagaagaucaaaauagaaaccuaagcccauucaugagaggagcacacaacauuucauucguaacacccccaagcuccagaucauccucacaaggaacaguaucaacaguaccaaaagaaguacuagacucauggacaggagcauucaauacaagaagacaaccauuauucgcacauauaagaagacgaggagaaucaagaguauaa

SEQ ID NO: 35074 - RNA, 807 nt, Artificial Sequence
  derived and/or modified sequence opt6 from capsid_protein_VP2__Norovirus__AFX81140
auggcaggagcauucuuugcaggacuugcaucagauguauuaggaucaggauuaggaucacuaauaaacgcuggagcaggagcaauaaaucaaaaaauagauuucgaaaacaauagaaaacuacaacaagcaagcuuucaauuuagcucaaacuuacaacaagcaucauuucaacacgauaaagaaauguuacaagcacaaauagaagcaacaaaaaaacuacaacaagaaaugaugaaaguaaaacaagcaauguuacuagaaggcggauuuucugaaacagacgcagcaagaggcgcaauaaaugcaccgaugacaaaaguacuagauuggucaggaacgagauacugggcaccagacgcaagaacaacaacauauaacgcaggaagauucucaacaccacaaccgaguggaacauuaccaggaagaauaaacccaagaacaccaacaccagcaagaggaagcucaagcacaagcucaagugcgaguacagcaacaucaauacacucaaaccaaacaguaagcacaagauuaggaucgacagcuggaucaggaacaaacguaagcucucuaccauccacagcaagaacaagaagcuggguugaagaccaaaacaggaacuuaagcccauucaugagaggagcacauaacauuaguuuuguaacaccaccuaguucaagaucgagcucacaaggaaccguaagcacagucccuaaagaaguauuagacucauggacaggagcuuucaauacaaggagacaaccauuauucgcacauauaagaagacgaggagaaucaagaguauaa

SEQ ID NO: 35075 - RNA, 807 nt, Artificial Sequence
  derived and/or modified sequence opt6 from capsid_protein_VP2__Norovirus__AFX81143
auggcaggagcauucuuugcaggacuagcaucagauguauuaggaagugguuuaggaucacuaauaaacgcaggagcaggagcaauaaaucaaaaaaucgacuuugaaaacaauagaaaauuacaacaagcaaguuuucaauuuaguucaaacuuacaacaagcaucauuccaacacgacaaagaaauguuacaagcacaaauagaagcuacaaaaaaauuacaacaagaaaugaugaaaguaaaacaagcaauguuacuagaaggcggauucucagaaacagacgcagcaagaggagcaauaaaugcaccuaugacaaaaguucuagacuggucaggaacaagauauugggcaccagacgcaagaaccacaacauauaaugcagguagauucucaaccccacaaccaucaggaacauuaccugguagaauaaacccaagaauaccaacaccagcaagaggaucaucgaguacgagcucaaaugcaagcacagcaacaagcauauacucaaaccaaacaguaagcacaagauuaggaagcacagcaggaucaggaacaaacguaucaucauuaccaagcacagccagaacaagaucauggguagaagaucaaaaccgaaaccuaucaccauucaugagaggagcacauaacauaucauuuguaacaccaccaucaucaagaucaaguucacaaggaacaguaagcacagucccuaaagaaguccuagacucauggacaggagcuuucaacacaagaagacagcccuuauucgcccacauuagaagaagaggagaaucaagaguauaa

SEQ ID NO: 35076 - RNA, 807 nt, Artificial Sequence
  derived and/or modified sequence opt6 from capsid_protein_VP2__Norovirus__AFX81149
auggcaggagcauucuuugcaggccucgcaucagauguauuaggaucaggacuaggcucguuaauaaacgcaggagccggagcaauaaaucaaaaaauagacuucgaaaacaauagaaaacuacaacaagcaucauuccaauuuucaucaaaccuacaacaagcaucauuccaacacgacaaagaaaugcuacaagcacaaauagaagcaaccaaaaaacuacaacaagaaaugaugaaaguaaaacaagcaauguuauuagaaggaggauucucggaaacagacgccgcaagaggagccauaaaugccccaaugacaaaagugcuugacuggucgggaacaagauauugggccccagacgcaagaacaacaacauauaacgcaggaagauucucaacaccacaaccaagcggaacauuaccaggaagaauaaacccaagaacaccaacaccagcaagaggaagcucaucaacaucaucaaaugcaagcacagccacaaguauacacucaaaccaaacaguaagcacacgucuaggcucaacagcaggaucaggcacaaauguaucaucacucccaaguacagcaagaacaagaucauggguagaagaccaaaacagaaacuuaagcccauucaugcgaggagcacauaacauaagcuuuguuacaccaccaaguucaagaucaaguucacaaggaacaguaaguacaguaccaaaagaaguauuagauucauggacaggagcauuuaauacaagaagacaaccacuauucgcacauauacgaagaagaggagaaucaagaguauaa

SEQ ID NO: 35077 - RNA, 807 nt, Artificial Sequence
  derived and/or modified sequence opt6 from capsid_protein_VP2__Norovirus__AFX81152
auggcaggagcguucuucgcaggacuagcaagcgauguccuaggcucaggauuaggaucacuaauaaacgcaggagcaggagcaauaaaucaaaaaaucgauuucgaaaacaaccgaaaacuacaacaagcaagcuuucaauuuagcucaaaccuacaacaagcaucauuucaacacgauaaagaaauguuacaagcacaaauagaagcuacaaaaaaacuacaacaaggaaugaugaaaguaaaacaagcaauguuauuagaaggaggauucucagaaacagacgcugcaagaggagcaauaaaugcaccaaugacaaaaguacuagauuggucaggaacacgauacugggcaccagaugcaagaacaacaaccuauaacgcaggcagauucucaacaccucaaccaucaggaacauuaccaggaagaauaaacccaagaacaccaacaccagcaagaggaaguucaagcacaaguucgaacgcaagcacugccacaagcauacauucgaaccaaacagugaguacaagacuaggcucgacagcaggaagcggaacaaacgugaguucacuaccaaguacagccagaacaaggagcuggguagaagaccaaaacagaaacuuaucaccauucaugcgaggugcacauaacauaaguuuugucacaccaccgagcucaagaucaucaucacaaggaacaguaucaacaguaccaaaagaaguacuagacucauggacaggagcauucaauacaagaagacaaccauuauuugcacacauaagaagaagaggagaaucgagaguauaa

SEQ ID NO: 35078 - RNA, 807 nt, Artificial Sequence
  derived and/or modified sequence opt6 from capsid_protein_VP2__Norovirus__AFX81155
auggcaggcgcauucuucgccggauuagcaagcgauguacuaggaucaggauuaggcucccuaauaaacgcaggagcaggagcaauaaaucaaaaaauagacuucgaaaacaaucgaaaacuucaacaagcaagcuuucaauuuagcucaaaccuacaacaagcaucauuccaacacgauaaagaaaugcuacaagcucaaauagaagcgacuaaaaaauuacaacaagaaaugaugaaaguaaaacaagcaauguuacuagaaggaggauucucagaaacagacgcagcaagaggcgcaauaaaugcaccaaugacaaaaguacuagacuggucaggaacaagauauugggcacccgaugcaagaacaacaacauauaacgcuggaagauucucuacaccacaaccaaguggaacacuaccaggaagaauaaacccaagaacaccaacaccagcaagaggaucaucaagcacaagcucaaacgcaucaacagcaacaucaauacacucaaaccaaacaguaagcacacgauuaggaucuacagcaggcuccggaaccaacgucccaucacuaccaagcacagcaagaaccagaagcuggguagaagaccaaaacagaaaccuaagcccguucaugagaggggcacaaaacauaagcuuuguaacaccaccaagcucaagaucaagcucacaaggaacaguaaguacaguaccaaaagaaguauuagacucauggacaggagcauucaauacaagacgacaaccauuauucgcacacauaagaagaagaggagaaucaagaguauaa

SEQ ID NO: 35079 - RNA, 807 nt, Artificial Sequence
  derived and/or modified sequence opt6 from capsid_protein_VP2__Norovirus__AFX81158
auggcaggagcauuuuuugcaggacuagcaagugauguacuaggcucaggauuagguucacuaauaaacgcaggcgcaggagcaauaaaucaaaaaauagauuucgaaaacaaucgaaaacuacaacaagcgucuuuucaauuuaguucaaacuuacaacaagcaucauuccaacacgauaaagaaauguuacaagcacaaauagaagcaacaaaaaaauuacaacaagaaaugaugaaaguaaaacaagcaaugcuauuagaaggaggguucucagaaacagacgcagcaagaggagcaauaaacgcuccaaugacaaaaguauuagacuggucaggaacaagauauugggcaccagaugcaaggacaacaaccuauaacgcaggacgauucucaacaccacaaccaagcggaacucuacccggaagaauaaacccacgaacgcuaacaccagcaagaggaaguucgaguacaagcucaaacgcuagcacugcaacaagcauacacucaaaccaaacaguaucaacaagauuaggcucaacagcaggaucaggaacaaacguaagcucacuaccaagcacagccagaacaagaaguuggguagaagaccaaaaccgaaaccuaagcccauucaugagaggagcacauaauauaagcuuuguaacaccaccaagcucaagaucuaguucacaaggaacaguaagcacagucccaaaagaaguauuagacucuuggacaggagcauuuaauaccagacgacaaccauuauucgcacacauuagacgaagaggagaaucaagaguauaa

SEQ ID NO: 35080 - RNA, 807 nt, Artificial Sequence
  derived and/or modified sequence opt6 from capsid_protein_VP2__Norovirus__AFX81164
auggcgggcgcauucuucgcaggacuagcaagugauguacuaggaucaggcuuaggaucauuaauaaacgcaggagcaggagcaauaaaccaaaaaauagauuucgaaaacaauagaaaacuacaacaagcaagcuuucaauuuucaucaaacuuacaacaagcaucauuccaacacgacaaagaaauguuacaagcacaaauagaagcgacaaaaaaauuacaacaagaaaugaugaaagucaaacaagcaaugcuauuagaaggcggauucucagaaacagaugcagcaaggggagcaauaaaugcaccaaugacaaaaguauuagacuggucaggaacaagauauugggcaccugaugcaagaacaacgacauauaaugcaggaagauucucaaccccacaaccaucaggaacauuaccagguagaauaaacccaagaacaccaacaccagcaagaggaagcucaucuacaagcucaaacgcuagcacagcaacaaguauauacucaaaccaaacaguaucaacgagauuagguucaacagcaggaucaggaacaaacguaagcucguuaccaucaacagcaagaacaagaagcuggguagaagaccaaaacagaaaccuaaguccauucaugagaggagcacauaacauaaguuuuguaacaccaccauccucacguucaaguucacaaggaacuguuagcacaguaccaaaagaaguacuagacucauggacaggcgcauuuaauacaagaagacaaccacuuuucgcacacauaagaagacguggagaaucaagaguguaa

SEQ ID NO: 35081 - RNA, 807 nt, Artificial Sequence
  derived and/or modified sequence opt6 from capsid_protein_VP2__Norovirus__AFX81173
auggcaggugcauucuuugcaggacuagcaagcgauguauuaggaucaggucuaggcucacuaauuaaugcaggagcaggagcaauaaaccaaaaaauagacuuugaaaacaauagaaaauuacaacaagcuagcuuccaauuuaguucaaaccuacaacaagcaucauuccaacacgauaaagaaauguuacaagcacaaauagaagcaacaaaaaaauuacaacaagaaaugaugaaaguaaaacaagcaaugcuacucgaaggaggauuuucagaaacagacgcagcaagaggagcaauaaaugcaccaaugacaaaaguauuagauuggucaggaacaagauauugggcaccagaugccagaacaacaacauauaacgcaggaagauucucaacaccacaaccaucaggcaccuuaccugggagaauaaacccaagaacaccaacaccagcaagaggaaguucaagcacaagcucaaacgcaaguacagcaacaaguauacacucaaaccaaacaguaagcacaagauuaggcucaacagcaggaucaggaacaaacguaagcucacuaccaagcacggcaagaacaagaagcuggguagaagaccaaaacagaaacuuaagcccauucaugagaggagcacauaauauaagcuuuguaacaccaccaagcucaagaucaagcucacaaggaacaguaagcacaguaccaaaagaaguacuagacucauggacaggagcauucaauacaagaagacaaccacuauuugcacacauaagaagacgaggagaaucgcgaguauaa

SEQ ID NO: 35082 - RNA, 807 nt, Artificial Sequence
  derived and/or modified sequence opt6 from capsid_protein_VP2__Norovirus__AFX81179
auggcaggcgcauucuuugcaggacuagcgagcgauguauuaggcucaggauuaggaucacucauaaacgcaggagcaggagcaauaaaccaaaaaauagacuucgaaaacaaucgaaaauuacaacaagcaagcuuucaauuuaguucaaacuugcaacaagcaucauuccaacacgacaaagaaauguuacaagcacaaauugaagcaaccaaaaaauuacaacaagaaaugaugaaaguaaaacaagcaauguuacuagaaggaggauucucagaaacagacgcagcacgaggagcaauaaaugccccaaugacaaaaguauuagauuggucaggaacaagauauugggcaccugaugcaagaaccacaacauauaacgcgggaagauucucaacaccacaaccaaguggaacauuaccaggacguauaaacccuagaacaccaacaccagcaagaggaagcucgaguacaagcucaaacgcaagcacagccacaucaauacacucaaaccaaacuguaagcacacgauuaggaucaacugcaggaucaggaacaaacguaagcucauuaccaagcacagcaagaacaagaagcuggguagaagaccaaaacagaaacuuaaguccauucaugagaggagcacauaacauaagcuuuguaacaccaccaucaucaagaucaaguucccaaggaacaguaagcacaguaccaaaagaaguauuagacucauggacaggagcauucaauacaagaagacaaccacuauuugcacacauaagaagaagaggagaaucaagaguauaa

SEQ ID NO: 35083 - RNA, 807 nt, Artificial Sequence
  derived and/or modified sequence opt6 from capsid_protein_VP2__Norovirus__AFX81182
auggcaggcgcauuuuuugcaggauuagcaagcgauguauuaggaucaggauugggaucacuaauaaacgcaggagcaggagcaauaaaucaaaaaauagauuucgaaaacaacagaaaacuacaacaagcaagcuuucaauuuaguucaaacuuacaacaagcaucauuucaacacgauaaagaaaugcuacaagcacaaauagaagcaacaaaaaaacuacaacaagaaaugaugaaaguaaaacaagcaaugcuauuagaaggcggauucucagaaacagaugcagcaaggggagcaauaaaugcaccaaugacaaaaguacuugauuggagcggaacacgauauugggcaccagaugcaaggacaacaacauauaaugcaggaagauucucaacaccgcaaccaaguggaacauuaccaggaagaauaaacccaagaacaccaacaccugcgagagguagcucaucaacaaguaguaacgcaagcacagcaacaagcauauacucaaaccaaacaguaagcacaagauuaggaucaacagcagguucaggaacaaacguaucaucacucccaucaacagcaagaacaagaagcuggguagaagaccaaaacagaaaccuaaguccauuuaugagaggagcacacaacauaaguuuuguaacacccccaucaucaagaucaagcucacaaggaaccguaaguacaguaccaaaagaaguauuagauuccuggacaggcgcauuuaauacaagacgacaaccccuauucgcacacauaagacgacgaggagaaucaagaguauaa

SEQ ID NO: 35084 - RNA, 807 nt, Artificial Sequence
  derived and/or modified sequence opt6 from capsid_protein_VP2__Norovirus__AFX81185
auggcaggagcguucuuugcaggacuagcaucagauguacuaggaucaggauuaggaucacuuauaaaugcaggagcaggagcaaucaaucaaaaagucgauuucgaaaacaaucgaaaacuacaacaagcaaguuuucaauuuaguucaaacuuacaacaagcuucauuccaacaugauaaagaaauguuacaagcacaaauagaagcaacaaaaaaauuacaacaagaaaugaugaaaguaaaacaagcaauguuauuagaaggaggauucucagaaacagacgcagccagaggagcaauaaaugcaccaaugacaaaaguacuugauuggucuggaacgagauauugggcgcccgaugcaagaacaacaacauauaaugcgggaagauucucaacaccacaaccaaguggaacauuaccaggaagaauaaauccgcgcacgcccacaccagcaagaggaaguucaaguacaagcucgaacgcaagcacagcaacaaguauacacucaaaccaaacaguauccacaagauuaggaucaacagcagguucaggcacaaacguaagcucacuaccaaguacagcaagaacaagaagcuggguagaagaccaaaauagaaaccuaagcccauucaugagaggagcacauaacauaaguuuuguaacgccaccaaguucucgaucaaguucacaaggaacaguaucaacagucccaaaagaaguauuagacucauggacgggagcauucaauacaagaagacaaccauuauucgcacacauacgaagaagaggggaaucuagaguauaa

SEQ ID NO: 35085 - RNA, 807 nt, Artificial Sequence
  derived and/or modified sequence opt6 from capsid_protein_VP2__Norovirus__AFX81188
auggcaggagcauucuuugcaggacuagcaagcgacguauuaggaucaggauuaggaucucuaauaaacgcaggagcaggagcaauaaaccaaaaaauagacuucgaaaacaacagaaaacuacaacaagcaagcuuccaauuuagcucaaacuuacaacaagcaucguuccaacaugauaaagaaaugcuacaagcacaaauagaagcaacaaaaaaacuacaacaagaaaugaugaaaguaaaacaagcgauguuacuugaaggaggauucucagaaacagacgcagcaagaggagcaauaaaugccccaaugacaaaaguacuagacuggucaggaacaagauauugggcacccgaugcaagaacaacgacauauaaugcaggcagauucucaacaccgcaaccaaguggaacacuaccaggaagaauaaacccaagaacaccaacaccagcaagaggaaguucuagcacaagcucaaacgcaaguacagcaacaaguauacacucaaaccaaaccguaagcacaagauuaggaucaacagcaggaucaggaacaaacguaaguucacuaccaaguacagccagaacaagaagcuggguagaagaccaaaacagaaacuuaaguccauucaugagaggagcacacaacauaagcuuuguaacacccccaaguucaagaucaaguucacaaggaacaguaagcacaguaccuaaagaaguacuagacucauggacaggagcauucaauacaagaagacaaccauuauucgcacacauacgaagacgaggagaaucaagaguauaa

SEQ ID NO: 35086 - RNA, 807 nt, Artificial Sequence
  derived and/or modified sequence opt6 from capsid_protein_VP2__Norovirus__AFX81191
auggcaggagcauuuuucgcaggacuagcaagugacguauuaggaucaggacuaggaucacuaauaaacgcaggagcaggagcaauaaaucaaaaaauagacuucgaaaacaacagaaaacuacaacaagcaaguuuccaauucagcucaaaucuacaacaagcaucauuccaacacgacaaagaaaugcuacaagcacaaauagaagcaacaaaaaaacuacaacaagaaaugaugaaagucaaacaagcaaugcuacuagaaggaggauucucagaaacagacgcagcacgaggagcuaucaacgcaccaaugacaaaaguacucgacuggucaggaacaagauauugggcaccugacgccagaacaacaacauacaacgcaggaagauucucaacaccacaaccaagcggaacccuaccaggaagaauaaacccaagaacaccaacacccgcacgcggaagcucaucaacaucaucaaacgcaaguacagcaacaucaauacacuccaaccaaacaguaaguacaagacuaggaucaacagcuggcucagguacaaauguaagcucauuaccaagcaccgcaagaacaagaagcuggguagaagaucaaaacagaaaccuaucaccauuuaugagaggagcucauaacauaaguuucguaacacccccaucuucaagaucaagcucacaaggaacaguuaguacuguuccaaaagaaguacuagacucauggacaggagcuuucaacaccagacgacaaccauuauucgcacacauaagaagaagaggagaaucacgaguauaa

SEQ ID NO: 35087 - RNA, 807 nt, Artificial Sequence
  derived and/or modified sequence opt6 from capsid_protein_VP2__Norovirus__AFX81194
auggcuggagcauucuuugcaggacuagcaagugauguacuaggcucaggacuaggcucauuaauaaacgcaggagcaggagcaauaaaucaaaaaauagacuucgaaaacaauagaaaacuacaacaagcaagcuuucaauuuucaucaaaucuacaacaagccucauuccaacacgauaaagaaauguuacaagcacaaauagaagcaacaaaaaaacuacaacaagaaaugaugaaaguaaaacaagcaaugcuauuagaaggaggauuuucggaaacagacgccgcaagaggugcaauaaaugccccaaugacaaaaguauuagacuggucaggcacaagauauugggcacccgaugcacgaacaacaacauacaacgcaggcagauucucaacaccacaaccaagcggaacacuaccaggaagaguaaacccacgaacaccuacaccagcaagaggaaguucaagcacaucaucaaacgcaagcaucgcaacauccauauacucaaaccaaacaguaagcacaagauuaggaucaacagcaggaucaggaacaaacguaagcucacuaccaagcacagccagaacaagaucauggguagaagaucaaaacagaaaucuaagcccuuucaugagaggagcccauaacauaucuuuuguaacaccaccaagcucaagaucaagcucacaaggaacaguaagcacaguaccaaaagaaguccuagacucguggacaggagcauuuaauaccagaagacaaccacuauucgcacacauacgaagaagaggagaaucaagaguauaa

SEQ ID NO: 35088 - RNA, 807 nt, Artificial Sequence
  derived and/or modified sequence opt6 from capsid_protein_VP2__Norovirus__AFX81197
auggcaggugcuuucuuugcagggcuagcaagugacguauuaggaucaggcuuaggaucacuaauaaaugcaggagcaggagcaaucaaucaaaaaauagauuucgaaaacaaccgaaaauuacaacaagcaaguuuucaauuuaguucaaauuuacaacaagccucauuucaacaugacaaagaaauguuacaagcgcaaauagaagcaacaaaaaaauuacaacaagaaaugaugaaaguaaaacaagcaauguuacuagaaggaggauuuucagaaacggacgcagcaaggggagcaaucaaugcaccaaugacaaaaguacucgauuggucaggaacacgcuacugggcaccagaugcaagaacaacaacauacaaugcaggaagauucucaacaccacaaccaagcggaacauuaccaggacgaauaaacccgagaacaccaacaccagcaagaggaucaucaagcacaagcucaaacgcaagcacggcaacaagcauacacucgaaccaaacaguaaguacgcgacuaggaucaaccgcgggaucaggaacuaacguaaguucacucccaucaacagcaagaacaagaagcuggguagaagaccaaaacagaaacuuaagcccauuuaugcgaggagcacauaacauaagcuuuguuacaccaccaaguucaagaucaagcucacaaggaacaguaagcacaguaccaaaagaaguauuagacucauggacaggagcauucaauacaagaagacaaccauuauucgcacacauacguagaagaggggaaucaagaguauaa

SEQ ID NO: 35089 - RNA, 807 nt, Artificial Sequence
  derived and/or modified sequence opt6 from capsid_protein_VP2__Norovirus__AFX81200
auggcaggagcauuuuuugcaggauuagcaagcgacguauuaggcucuggacuaggaucacuuauaaacgcaggagcaggcgcaauaaaucaaaaaauagauuucgaaaauaaucgaaaacuacaacaagcaagcuuucaauuuucaucaaaucuacaacaagcaucuuuccaacacgauaaagaaaugcuacaagcacaaauagaagcaacaaaaaaauuacaacaagaaaugaugaaaguaaaacaagcaauguuacuagaaggaggguucucagaaacagacgcggcuagaggagcaauaaaugcaccaaugacaaaaguacuugauuggucaggaacaagauauugggcacccgaugcaagaacaacaacauauaacgcaggcagauucucaaccccacaaccaagcgggacacuaccaggaagaauaaacccaagaacaccaacaccagcaagaggaagcucaaguacuaguucaaauguaucuacagccacuaguauauaucuaaaucaaacaguaagcacaagacuaggaucaacagcaggcucagguacaaauguaagcucauuaccuuccacagcaagaaccagaucauggguagaagaccaaaacagaaaucuaucaccauucaugagaggagcacauaacauaagcuuugucacacccccaagcucaagaucaagcucacaaggaacaguaaguacaguaccaaaagaaguacuagacucauggacaggagcauucaauacaagaagacaaccauuauuugcacacauaagaaggcgaggagaaucacgaguguaa

SEQ ID NO: 35090 - RNA, 807 nt, Artificial Sequence
  derived and/or modified sequence opt6 from capsid_protein_VP2__Norovirus__AFX81203
auggcaggagcauucuuugcaggauuagcaagugauguacuaggaucaggauuaggaucacucauuaacgcgggugcuggagcaauaaaucaaaaaauagauuuugagaacaauagaaaacuacaacaagcaucauuucaauuuagcucgaacuuacaacaagcaucauuucaacacgauaaagaaaugcuacaagcacaaauagaagcaacaaaaaaauuacaacaagaaaugaugaaaguaaagcaagcgaugcuacuagaaggaggauucucagaaacagaugcagcaagaggcgcgauaaaugcaccaaugacaaaaguuuuagauuggucaggaacaagauacugggcaccagaugccagaacaacaacauauaaugcaggcagauucucaacaccacaaccaagcggaacauuacccggaagaauaaacccaagaacaccaacaccagcacgaggaagcucaaguacaaguucaaacgcaagcacagcaacaaguauauacucgaaucaaacuguaagcacacgacuaggaucgacagcaggaucaggaacaaacguaagcucacuaccuagcacagcaagaaccagaaguuggguagaagaccaaaacagaaauuuaagcccuuucaugagaggggcacauaacauaagcuucguaacaccaccgagcucaagaucaagcucacaaggaacuguaagcacaguaccaaaagaagucuuagacucauggacaggagcauucaauacaagacgacaacccuuauucgcacacauacgaagaagaggagaaucaagaguauaa

SEQ ID NO: 35091 - RNA, 807 nt, Artificial Sequence
  derived and/or modified sequence opt6 from capsid_protein_VP2__Norovirus__AFX81206
auggcgggagcauucuuugcaggacuagcuagcgaugucuuaggaucgggauuaucaucacuaauaaacgcaggagcaggagcaaucaaccaaaagauagauuucgaaaacaauagaaaacuacaacaagcaagcuuucaauuuagcucaaaccuacaacaagcaucauuccaacacgacaaagaaauguuacaagcacaaauagaagcaaccaaaaaauuacaacaggaaaugaugaaaguuaaacaagcuauguuacuagaaggaggauucucggaaacagaugcagcaagaggagcaguaaaugccccaaugacaaaaguacuagauuggucaggaacaagauauugggcaccagacgcaagaacaacaacauacaacgcaggaagauucucaacaccucaaccaagcggaacauuaccaggaagaauaaacccaagaacaccaacaccagcaagaggaagcucaaguacaagcucaaaugcauccacagcaacaagcauauacucgaaccaaacagugaguacaagauuaggaucgacagcaggaucaggaacaaacguaaguucacuaccaaguacagcaagaacaagaagcuggguagaagaccaaaacaggaacuuaaguccauucaugagaggugcacauaacauaaguuuuguaacaccacccaguucgagaucaagcucgcaaggaacaguaucaacaguaccaaaagaaguauuagauucauggacgggagcauucaauacaagaagacaaccacuguucgcacacauaagaagaagaggagaaucaagaguguaa

SEQ ID NO: 35092 - RNA, 807 nt, Artificial Sequence
  derived and/or modified sequence opt6 from capsid_protein_VP2__Norovirus__AFX81209
auggcaggagcguucuuugcaggacuagcaagcgauguauuaggaucaggacuaggaucacuaauaaacgcaggagcaggcgcaauaaaucaaaaaauagauuucgaaaacaaucgaaaacuacaacaagcaaguuuccaauuuaguucgaacuuacaacaagcaucguuucagcacgauaaagagauguuacaagcucaaauagaagcaacaaaaaaacuacaacaagaaaugaugaaaguaaaacaagcaaugcuacuugaaggaggauucucagaaacagacgcagcaagaggagcaauaaaugcaccaaugacaaaaguauuagauuggucaggaacgagauauugggcgccagaugcaaggacaacaacauauaaugcagguagauuuucaacaccgcaaccaagcggaacauuaccaggaagaauaaacccaagaacaccaacaccagcaagaggaagcucaagcacaagcucaaacgcaagcacagcaacaagcauauacucaaaccaaacaguaagcacaagacuaggaucgacagcaggaucaggaacaaacguaagcucacuaccaaguacagcaagaacuagaagcuggguagaagaccaaaacagaaaccuaagcccauucaugagaggagcacauaacauaucauuuguaacaccaccaagcucacgaucaaguucacaaggaacaguaagcacaguaccaaaagaaguacuagacucauggacaggcgcauucaauaccagaagacaaccacuauucgcacacauaagaagaagaggagaaucgcgagucuaa

SEQ ID NO: 35093 - RNA, 807 nt, Artificial Sequence
  derived and/or modified sequence opt6 from capsid_protein_VP2__Norovirus__AFX81212
auggcaggagcauucuucgccggacuagccagcgaugucuuaggaucaggauuaggaucauuaauaaacgcaggcgcaggagcuauaaaucaaaaaauagauuucgaaaauaauagaaaacuccaacaagcaagcuuucaauucaguucaaacuuacaacaagcaucauuccaacacgauaaagaaauguuacaagcacaaauagaagcgacaaaaaaauuacaacaagaaaugaugaaaguaaaacaagcaaugcuauuagaaggaggauucucagaaacagacgcagccagaggagcuauaaaugcaccaaugacaaaaguacuagauuggucuggaacaagauauugggcaccagacgccagaacaacuacauauaacgcaggaagauucucuaccccacaaccaucaggaacauuaccaggaagaauaaacccuagaacaccaacaccagcaagaggaucaucaagcacaacaucaaacgcaagcacagccacaaguauacauucuaaccaaacaguaagcacaagacuaggauccacagcaggaucaggaacaaacguaagcucauuaccaagcacagcaagaacaagaaguuggguagaagaccaaaauagaaacuuaucaccauucaugagaggagcacacaacauaagcuuuguaacaccaccaagcucucgaucaaguucacaaggaacaguaagcacaguaccaaaagaagucuuagacucauggacaggagcuuucaauacucgaagacaaccucuguucgcucacauacgaagacgaggagaaucgagaguauaa

SEQ ID NO: 35094 - RNA, 807 nt, Artificial Sequence
  derived and/or modified sequence opt6 from capsid_protein_VP2__Norovirus__AFX81215
auggcaggagcauucuucgccggauuagcaucagacguauuaggauccggacuaggauccuuaauaaaugcaggcgcaggagcaauaaaccaaaaaauagacuucgaaaacaauagaaaacuccaacaagcaucauuccaauucagcucaaaccuacaacaagcaucauuccaacacgacaaagaaaugcuacaagcacaaauagaagcaacaaaaaaacuacaacaagaaaugaugaaaguaaaacaagcaaugcuauuagaaggaggauucucagaaacagacgcagcaagaggagcaguaaacgcacccaugacaaaaguacucgauuggucaggaacaagauacugggcaccagacgcaagaacaacaacauacaacgcaggcagauucucaacaccacaaccgucaggaacacuaccaggacgaauaaauccacgaacaccuacaccagcaagaggaagcucaagcacaucaucaaacgcaccaauagcaaccucaauauacucuaaccaaacaguuaguacacgacuaggaucaacagcaggaucaggcacaaacguaagcucauuaccaucaacagcaagaacaagauccuggguagaagaucaaaauagaaaucuaucaccauucaugagaggagcacauaacauaucauucguaacaccuccaagcucaagaucaucaucacaaggaacaguaucaacaguaccaaaagaaguauuagacucauggacaggagcauucaacacaagaagacaaccacuauucgcacacauaagaagaagaggagaaucaagaguauaa

SEQ ID NO: 35095 - RNA, 807 nt, Artificial Sequence
  derived and/or modified sequence opt6 from capsid_protein_VP2__Norovirus__AFX81218
auggcaggagcauucuuugcaggacuagcuagcgauguacuaggauccggcuuaggaucauuaauaaacgcaggagcuggugcaauaaaccaaaaaauagauuucgaaaauaauagaaaacuacaacaagccaguuuucaauucagcucaaacuuacaacaagcaucuuuccaacacgauaaagaaauguuacaagcucaaauagaagcaacaaaaaaauuacaacaagaaaugaugaaaguaaaacaagcaaugcuauuagaaggaggauuuucagaaacagacgcagcaagaggcgcaaucaaugcaccaaugacaaaaguacuagauuggucaggaacaagauacugggcuccagaugcaagaacaacaacauacaacgcaggaagauucucaacaccacaaccaucaggaacauuacccggaagaauaaacccacgcacacccacuccagcaagaggaucaucaagcacaagcuccaacgcaaguacagccacaagcauauacucaaaccaaacaguaaguacaagauuaggaucaacagcaggcucaggaacaaacguaagcucccuaccaucaacagcaagaacaagaagcuggguagaagaccaaaacagaaaccuuagcccguucaugagaggagcacauaacauaagcuuuguaacaccaccaagcucacgaucaagcucacaagggacaguaagcacaguaccaaaagaaguauuagacucuuggaccggagcauuuaauacaagaagacaacccuuguucgcacacauaagaagacgaggagaaucaagaguuuaa

SEQ ID NO: 35096 - RNA, 807 nt, Artificial Sequence
  derived and/or modified sequence opt6 from capsid_protein_VP2__Norovirus__AFX81221
auggcaggagcauucuuugccggacuagcaagcgauguacuaggaucaggauugggauccuuaauaaacgcaggcgcaggagcaauaaaccaaaaaauagauuucgaaaacaauagaaaacuccaacaagcuaguuuucaauuuaguucaaacuuacaacaagccucauuccaacacgauaaagaaauguuacaagcacaaauugaagcaacaaaaaaauuacaacaagaaaugaugaaaguaaaacaagcaauguugcuagaaggaggauucucagaaacagacgcagcaagaggagcaauaaacgcaccaaugacaaaaguacuagauuggucgggaacucgcuauugggcaccagaugcaagaacuacaacauauaacgcgggaagauucucaacaccacaaccauccggaacauuaccaggaagaauaaacccaagaacaccaacaccagcaagaggaagcccaucaacaagcucaaacgcaagcacagcaacaaguauauacucaaaucaaacaguaagcacaagacuaggaucaacagcaggaucagguacaaauguuagcucauuaccaagcacagcaagaacaaggagcugggucgaagaccaaaacagaaaccuaaguccauucaugcgaggagcacauaacauaucauuugucacacccccaucaucacgaucaagcucgcaaggaacaguuagcacaguaccaaaagaaguacuagacucauggacaggagcauucaauacaagaagacaaccauuauucgcacacauaagaagaagaggagaaucaagaguauaa

SEQ ID NO: 35097 - RNA, 807 nt, Artificial Sequence
  derived and/or modified sequence opt6 from capsid_protein_VP2__Norovirus__AFX81224
auggcaggagcauuuuuugcaggauuagcaagugauguauuaggaucaggauuaggcucacuaauaaacgcaggagcuggagcaauaaaucaaaaaauagauuuugaaaacaauagaaaauuacaacaagcaagcuuucaauuuagcucaaacuuacaacaagcaucuuuccaacacgauaaagaaaugcuacaagcgcaaauagaagcaacaaaaaaauuacaacaagaaaugaugaaaguaaaacaagcaauguuacuagaaggaggauucucugaaacagacgcagccagaggcgcaaucaaugcaccaaugacaaaaguauuagacuggucaggaacacgcuauugggcacccgacgcaagaacaacaacauacaaugcaggaagauucucaacaccacaaccaagcggaacacuaccaggaagaauaaacccaagaacacccacacccgcaagaggaaguucaucaacaagcucgaacgcuucaacagccacaaguauauacucaaaccaaacaguaagcacaagauuaggaucaacagcaggaucgggaacgaacguaagcucacuaccaucaacagcaagaacaagaagcuggguagaagaucaaaauagaaacuuaagcccauucaugagaggagcacauaauauaagcuuuguuacaccaccaaguucaagaucaucaucacaaggaacaguaaguacaguaccaaaagaaguauuagacucauggacaggagcguucaauacaagaagacaaccuuuauucgcacacauuagaagacgcggagaauccagaguauaa

SEQ ID NO: 35098 - RNA, 807 nt, Artificial Sequence
  derived and/or modified sequence opt6 from capsid_protein_VP2__Norovirus__AFX81227
auggcaggcgcauuuuuugcaggauuagcaagcgauguauuaggaucaggauuaggaucauuaauaaaugccggagcaggagcaauaaaccaaaaaauagacuucgaaaacaaccgaaaauuacaacaagcaagcuuccaauucucaucaaaccuacaacaagcaucauuccaacacgacaaagaaaugcuacaagcacaaauagaagcaacaaaaaaacuacaacaagaaaugaugaaaguaaaacaagcaauguuacuagaaggaggauuuucagaaacagacgcagcaagaggagcaauaaaugccccaaugacaaaaguauuagacuggucaggaacaagauacugggcaccagacgcaagaacaacaacauacaacgcaggaagauucucuacaccacaaccaagcggaaccuuaccaggaagaauaaauccaagaacaccaacaccagcaagaggaagcucaagcacaagcuccaacgcaucaacagcaacaaguauauacuccaaucaaacaguaucaacaagacuaggaucaacagcaggaucagguacaaacguaagcucucuaccaucaacagcaagaacaagaagcuggguagaagaccaaaacagaaaucuaucaccauucaugagaggagcacauaacauaagcuucguaacaccaccaaguucaagaucaucaucacaaggaacaguaagcacaguaccaaaagaagucuuagauucauggacaggagcauucaacacaagacgacaaccacuauucgcacacauacgaagaagaggagaaucaagaguauaa

SEQ ID NO: 35099 - RNA, 807 nt, Artificial Sequence
  derived and/or modified sequence opt6 from capsid_protein_VP2__Norovirus__AFX81230
auggcaggagcauucuuugcagggcuagcaagcgauguauuaggaucaggacuaggaucacuaauaaacgcaggagcaggagcaaucaaucaaaaaauagauuucgaaaacaauagaaaauuacaacaagcaaguuuucaauuuagcucggacuuacaacaagccucauuccaacacgauaaagaaauguuacaagcacaaauagaagcaacaaaaaaacuacaacaagaaaugaugaaagucaaacaagcaaugcuacuagaaggaggauucucagaaacagaugcagcaagaggagcaauaaacgcaccaaugacaaaaguacuagauuggucaggaacaagauacugggcaccagaugcaagaacaacaacauauaacgcaggaagauucucaacaccacaaccaaguggaacacuaccaggaagaauaaacccaagaacaccugcacccgcacguggaaguucaaguacgagcucaaacgcaaguacagcaacaagcauauauucuaaccaaacaguaaguacaagauuaggcucaaccgcagguucaggaacaaacguaucaucgcuaccaagcacugcaagaacaagaucaugggucgaagaucaaaacagaaaccuaaguccauuuaugagaggggcacacaacauaaguuuugucacaccaccaaguucacgaucaaguucacaaggaacaguuaguacaguaccaaaagaaguauuagacucauggacaggagcauucaauacaaggcgacaaccuuuauuugcacacauucgaagaagaggagaaucaagaguauaa

SEQ ID NO: 35100 - RNA, 807 nt, Artificial Sequence
  derived and/or modified sequence opt6 from capsid_protein_VP2__Norovirus__AFX81233
auggcaggcgcguuuuucgcaggacuagcgucagacguacuaggaucaggacuaggcucacuaauaaaugcaggagcaggagcaauaaaccaaaaaauagacuucgaaaacaacagaaaauuacaacaagcaucauuccaauucucaucuaaccuacaacaagcaucauuccaacacgacaaagaaaugcuacaagcacaaaucgaagcaacaaaaaaacuacaacaagaaaugaugagaguaaaacaagcaauguuauuagaaggaggcuucucagaaacagacgcugcaagaggagcaauaaacgcaccaaugacaaaaguacuagacuggucaggaacaagauacugggccccagacgcaagaacaacaacauacaacgcaggaagauucucaaccccacaaccuucaggaacacuaccagguagaauaaacccaagaacaccaacaccagcaagaggaucaagcucaacaucaucaaacguaagcacagcaacaagcauauacucaaaccaaacauucagcacuagacuaggaucaacugcaggaucaggaacaaacgucucaucacuaccaucaacagcaagaaccagaucauggguugaagaccaaaacagaaacuuaucaccauucaugagaggagcacacaacauaucuuucguaacaccaccaucaucaagaucaagcucucaaggaacaguaucaacaguaccaaaagaaguauuagacucauggacaggagcauucaauacaagaagacaaccacuauuugcacacauaagaagaagaggagaaucacgaguauaa

SEQ ID NO: 35101 - RNA, 807 nt, Artificial Sequence
  derived and/or modified sequence opt6 from capsid_protein_VP2__Norovirus__AFX81239
auggcaggcgcauucuuugcaggacuagcaagcgauguucuuggaucaggauuaggaucacuaauaaaugcaggagcaggagcaauaaaucaaaaaauagauuucgaaaacaacagaaaauuacaacaagcaaguuuucaauuuucaaguaauuuacaacaagcaucauuucaacacgauaaagaaaugcuacaagcacaaauagaggcaaccaaaaaauuacaacaagaaaugaugaaagucaaacaagcaauguuacuagaagguggauuuucagaaacagacgcagcuagaggagcaauaaaugcaccaaugacaaaaguacuagauuggucugguacgagauauugggcaccagacgccagaaccacuacauauaacgcaggaagauucucaacaccacaaccaagcggaacauuaccaggaagaauaaacccacgaacaccaacaccagcaagagguaguucuaguacaagcucgaacguaagcacagcaacaagcauauacucaaaccaaacagcaaguacaagauuaggaucaacagcaggaucaggaacaaacguaagcucacuaccaagcacagcaagaacaagaaguugggucgaagaucaaaacagaaacuugaguccauucaugagaggagcacacaacauaucauuugucacaccaccaucaucacgcucaaguagccaaggcacaguaagcacagucccaaaagaaguuuuagacucauggacuggagcauucaauacaagaagacaaccacuauucgcacacauaagaaggagaggggaaucaagaguauaa

SEQ ID NO: 35102 - RNA, 807 nt, Artificial Sequence
  derived and/or modified sequence opt6 from capsid_protein_VP2__Norovirus__AFX81242
auggcaggcgcauucuucgcaggacuagcaucagacguacuaggaucuggacuaggaucacuaauaaaugcaggcgcaggagcaauaaaccaaaaaguagaauucgaaaacaacagaaaauuacaacaagcaucauuccaauucucaucaaacuuacaacaagcaucuuuccaacacgacaaagaaaugcuccaagcacaaauagaagcaacaaaaaaauuacaacaagaaaugaugagaguaaaacaagcaaugcuacuagaaggcggauucucagaaacagacgcagcaagaggagcuauaaacgcaccaaugacaaaaacauuagacuggacagguacaagauauugggcacccgacgcaagaacaacaacauacaacgcaggaagauucucaacaccacaacccaguggagcacuucccggaagagcaaaucuaagagccacaguaccagcaagaggaagcucuucaacauucucaaacucaagcauagcaacaucaguauacuccaaccaaacaacuucaacaagacuaggaaguacagcaggaucaggaacaucaguaucaucauuaccaucaacagcaagaacaagaagcuggguagaagaccaaaacagaaaccuaucaccauucaugagaggcgcacauaacauaucauucguaacaccaccaagcucaagauccucaucacaaggaacuguaagcacagucccaaaagaaguacuagauucauggacaggagcauucaacacaagaagacaaccauuauucgcacacauacgaaaaagaggagaaucaagaguauaa

SEQ ID NO: 35103 - RNA, 807 nt, Artificial Sequence
  derived and/or modified sequence opt6 from capsid_protein_VP2__Norovirus__AFX81245
auggcaggagcauucuuugcaggacuagcaagugauguauuaggaucaggauuaggaucacuaauaaacgcaggagcaggagcaauaaaucaaaaaguagaauucgaaaauaauagaaaacuacaacaagcaagcuuucaauucagcucaagcuuacaacaagcaucauuucaacacgauaaagaaauguuacaagcucaaauagaagcaaccaaaaaauuacaacaagaaaugaugagaguaaaacaagcaauguugcuagaaggaggauucagcgaaacagacgcagcaagaggagcaauaaacgcaccaaugacaaaaacguuagauuggucgggaacaagauauugggcacccgaugccagaacaacaacauauaacgcaggaagauucucaacaccacaaccuaguggagcauuaccaggacgagcaaacuuaagagcaacaguaccagcaagaggaucaucuagcacaagcucaaacaguaguauagcaacuagcguauacucaaaccaaacaacgagcacgcgauugggaucaacagcaggaucaggaacaaguguaagcucacuaccaagcacagcaaggacaagaagcuggguagaagaccaaaacagaaacuuaaguccauucaugagaggagcacauaacauaaguuuuguuacucccccaaguucaagaucaucaucacaaggaacaguaagcacuguaccaaaagaaguauuagauucauggacaggagcauucaauacaagaagacaaccauuauucgcacacauaagaaaaagaggagaaucacgaguauaa

SEQ ID NO: 35104 - RNA, 807 nt, Artificial Sequence
  derived and/or modified sequence opt6 from capsid_protein_VP2__Norovirus__AFX81248
auggcaggagcauucuucgcagguuuagcuucagauguacuaggaucaggcuuaggaucacuaauaaacgccggagcaggagcaauaaaucaaaaaguagaauucgaaaacaauagaaaauuacaacaagcaaguuuucaauuuaguucaaacuuacaacaagcaucauuccaacacgauaaagaaaugcuacaagcacaaauagaagcaacaagaaaauuacaacaagaaaugaugaggguaaaacaagcaauguuacuugaagguggauuuucagaaacagaugcagcaagaggagcgauaaaugccccaaugacaaaaacucuagauuggucaggaacaagauauugggcgccagacgccagaaccacaacauauaacgcaggaagauucucaacaccacaaccaaguggagcauuacccggaagagcuaauuuaagagcaaccguaccagcaagaggcagcucaucaacauuuucaaacucaaguauagcaacaagcguauacucaaaccaaacaacaagcacaagauuaggaucaacagcagguucagguacgagcguaaguucccuaccaaguacagcaagaaccagaagcuggguagaagaucaaaacagaaaucuaucaccauucaugcgaggagcccauaacauaaguuucguaacacccccaagcucaagaucaagcucacaaggaacaguaagcacaguaccaaaagaagucuuagacucauggacaggagcauucaauacaagaagacaaccacuauucgcgcacauaagaaaaagaggagaaaguagaguauaa

SEQ ID NO: 35105 - RNA, 807 nt, Artificial Sequence
  derived and/or modified sequence opt6 from capsid_protein_VP2__Norovirus__AFX81251
auggcaggagcauucuuugcaggacucgcuucagauguccuaggaucaggacuaggaucauuaauaaacgcaggcgcaggagcaauaaaucaaaaaguagaauucgaaaacaaucgaaaauuacaacaagcaaguuuucaauuuagcucaaaccuacaacaagcaucuuuccaacacgauaaagaaauguuacaagcacaaauagaagcaacaaaaaaacuacaacaagaaaugaugagaguaaaacaagcgaugcuucuagaaggaggauucuccgaaacagacgcagcaagaggagcaaucaaugcuccaaugacuaaaacacuagacuggucuggaacacgcuauugggcaccagaugcacgaacaacaacauauaacgcaggaagauuuucaacaccacaaccaucaggagcauuaccaggacgagcaaacuuaagagcaaccguaccagcaagaggaagcucaucaacauucucaaacucaagcauagcaacaucaguauacucaaaccaaacaacaucaacacgacuaggaucaacagcaggaucaggagcaaguguaucaucauuaccaagcacagcaagaacaagaagcuggguagaagaucaaaacagaaauuuaaguccauucaugagaggagcacauaacauaucauucguaacuccaccaaguucaagaucaucaagucaaggaacaguaagcacaguaccaaaagaaguauuagacucauggacaggagcauucaauacaagacgacaaccacuauucgcacauauaagaaaaagaggagaaucaagaguauaa

SEQ ID NO: 35106 - RNA, 807 nt, Artificial Sequence
  derived and/or modified sequence opt6 from capsid_protein_VP2__Norovirus__AFX81254
auggcaggagcauucuuugcuggauuagcaagugauguauuaggaucaggcuuaggaucacucauuaacgcaggugcaggagcaauaaaucaaacaguagaauuugaaaacaauagaaaacuacaacaagcaagcuuucaauuuagcucaaacuuacaacaagcaucauuucaacacgauaaagaaauguuacaagcacaaauagaagcaacaaaaaaauuacaacaagaaaugaugagaguaaaacaagcaauguuacuagaaggaggauucucagaaacagaugcagcaagaggagcaaucaaugcaccaaugacaaaaacauuagauuggacaggaacaagauauugggcaccagaugccagaaccacaaccuauaaugcaggaagauucucaacaccacaaccaaguggagcauuaccaggacgagcgaauuuacgagcaacaguaccagcaagaggaaguucaagcacauucucaaacucgagcauagcaacaaguguauacucaaaccaaacaacaucaacaagacuaggaucaacagcgggaucgggaacaucaguaucaucauuaccaucuacagcaagaacaagaagcuggguagaagaccaaaacagaaacuuaucuccauucaugagaggagcucacaacauaucauuuguaacacccccgagcucaagaucaagcucacaaggaacaguaagcacaguaccaaaagaaguauuagacucauggacaggagcauucaacacaaggagacaacccuuauucgcacacauaagaaaacgaggagaaucaagaguauaa

SEQ ID NO: 35107 - RNA, 807 nt, Artificial Sequence
  derived and/or modified sequence opt6 from capsid_protein_VP2__Norovirus__AFX81257
auggcaggagcauuuuuugcaggucuagcaagugauguauuaggauccggauuaggaucacuaauaaacgcaggagcgggagcaauaaaucaaaaagucgaauucgaaaacaaucgaaaacuacaacaagcaucauuucaauuuucaucaagccuacaacaagccucauuccaacacgauaaagaaaugcuacaagcacaaauagaagcaacaaaaaaauuacaacaagaaaugaugagaguaaaacaagcaauguuacuagaaggaggauucucagaaacagacgcagcacgaggagcaauaaaugcaccaaugacaaaaacacucgacuggucuggaacacgauauugggcaccagaugcaagaacaacaacauauaacgcaggaagauucucgacaccacaaccaagcggugcucuaccaggaagagcaaaccuacgagcaacaguaccagcacgcggaagcucaagcacaaguucaaacucaagcauagcuacaucaguauacucaaaccaaacaacaucaacacgauuaggaucaacagcuggaucaggaacaagcguaagcucacacccaagcacagcaagaacaagaaguuggguagaagaccaaaacagaaacuuaagcccuuucaugagaggagcacauaacauaagcuucgucacaccaccaaguucgagaucaucaucacaaggaacaguaaguacaguaccaaaagaaguauuggacucguggacaggagcauucaauacaagaagacaaccauuauucgcacacauaagaaaaagaggagaaucaagaguauaa

SEQ ID NO: 35108 - RNA, 807 nt, Artificial Sequence
  derived and/or modified sequence opt6 from capsid_protein_VP2__Norovirus__AFX81260
auggcaggcgcauucuucgcaggacuagcauccgacguacuaggaucaggauuaggaucauuaauaaaugcaggagcaggagcaauaaaccaaaaaauagacuucgaaaacaacagaaaacuacaacaagcaucauuccaauucucaucaaaccuacaacaagcaucauuccaacacgacaaagaaauguuacaagcacaaauagaagcaacaaaaaaacuucaacaagaaaugaugaaaguaaaacaagcaaugcuauuagaaggaggauucucugaaacagacgcagcaagaggagcaaucaaugcccccaugacaaaaguauuagacuggucaggaacacguuacugggcaccagacgcaagaacaacaacuuacaaugcaggaagguucucuacuccacaaccuucaggaacuuuaccaggaagaauaaacccaagaacacccacaccagcaagaggaagcucaucaacaagcucaaacgcaucaacagcaacaaguauacacucaaaccaaacaguaagcacacgauuaggaucaacagcaggauccggaacaaacguaucaucauuaccaagcacagcaagaacaagaucauggguagaagaccaaaacagaaaccuaaguccauucaugagaggagcccacaauauaucauucguaacaccaccaucaucaagauccucuucacaaggaacuguaagcacaguaccaaaagaaguauuagacucauggaccggagcauucaacacaagaagacaaccacuauucgcacacacacgaagaagaggagaaucaagaguauaa

SEQ ID NO: 35109 - RNA, 807 nt, Artificial Sequence
  derived and/or modified sequence opt6 from capsid_protein_VP2__Norovirus__AFX81263
auggcaggagcauucuuugcaggauuagcaagcgauguacuaggcucaggauuaggaucacuaauaaacgcaggagcaggagcuaucaaucaaaaaauagacuucgaaaacaaucgaaaacuacaacaagcaagcuuucaauucagcucaaaccuacaacaagcaucguuccaacaugacaaagaaauguuacaagcacaaauagaagcaacaaaaaaauuacaacaagaaaugaugaaaguaaaacaagcaauguuacuagaaggaggauucucugaaacagacgcagcaagaggcgcaaucaaugcaccuaugacaaaaguacuagauugguccggaacuagauauugggcaccagacgcaagaacaacaacauauaacgcaggaagauucucaacuccacaaccaagcggaacacuacccggaagaauaaacccacgaacaccaacgccagcaagaggaagcucuaguaccaguucuaaugcgagcacagcaacaaguauauauucuaaccaaacaguaaguacaagacuaggaucaaccgcaggcucaggaacaaacguaagcucauuaccaucaacagccagaacaagaagcuggguagaagaccaaaauagaaacuuaagcccauucaugagaggagcacauaacauaagcuuuguaacacccccgaguucaagaucaaguucacaaggaacaguuagcacaguaccaaaagaaguuuuggacucauggacaggagcauucaauaccagaagacaacccuuauucgcacacauaagacgaagaggagaaucaagaguauaa

SEQ ID NO: 35110 - RNA, 807 nt, Artificial Sequence
  derived and/or modified sequence opt6 from capsid_protein_VP2__Norovirus__AFX81269
auggcaggagcauucuucgcaggacuagcaucagacguacuaggaucaggccuaggaucacucauaaacgcaggagcaggagcaauaaaccaaaaaaucgauuucgaaaacaaucgcaaauuacaacaagcaucauuucaauuuucaucaaaccuacaacaagcaucauuccaacacgacaaagaaaugcuacaagcccaaauagaagcaacaaaaaaacuacaacaagaaaugaugaaaguaaaacaagcaaugcuccuagaaggaggauucucugaaacagacgcagcaagaggagcaauaaacgcaccaaugacaaaaguauuagacugguccggaacaagauauugggcaccagacgcaagaacaaccacauacaacgcaggaagauucucaacaccacaaccaagcggaacacuaccaggaagaauaaaccccagaacacccacuccagcaagaggaucaucaucaacaucaucaaaugcaucaacagcaacauccauauacucaaaccaaaccguaucaacaagacuaggaucaaccgcagguucaggaacaaacguaaguucacuaccaucaacagcaagaacacgaucauggguagaagaccaaaacagaaacuuaucaccauucaugagaggagcacacaacauaucauucguaacaccaccaucaucaagaucaucaucacaaggaacaguaaguacagucccuaaagaaguccuagacuccuggacaggagcauucaauacaagaagacaaccacuauuugcacauauaagaagaagaggagaaucaagaguauaa

SEQ ID NO: 35111 - RNA, 807 nt, Artificial Sequence
  derived and/or modified sequence opt6 from capsid_protein_VP2__Norovirus__AFX81272
auggcaggagcauucuuugcaggacuagcaagcgauguauuagguucaggauuaggaucuuuaauaaacgcgggagcaggagcaauaaaucaaaaaauagacuucgaaaauaauagaaaacuacaacaagcaagcuuucaauuuagcucaaacuuacaacaagcaucauuccaacaugauaaagaaauguuacaagcacaaauagaagcaacaaaaaaauuacaacaagaaaugaugaaaguaaaacaagcaauguuacuagaaggcggauucucagaaacagaugcagcaagaggcgcaauaaaugcaccgaugacaaaaguacuagauuggucaggaacaagauauugggcgccagaugcaagaacaacaacauauaacgcaggacgauucucaacaccacaaccaagcggaaccuuaccaggacgaauaaacccaagaacaccaacaccagcaagaggaaguucaaguacaagcucgaaugcaagcacagcuacuagcauacacucaaaccaaacaguaaguacucgauuaggaucaacagcaggaucgggcacaaacguaagcucacuaccaagcacagcaagaacaagaaguuggguagaagaccaaaacagaaauuuaaguccauucaugagaggagcccauaacauaagcuuuguaacgccaccaagcucaagaucgagcucacaaggaacaguaagcacaguaccaaaagaaguauuagacucauggacaggcgcuuuuaauacaagaagacaaccauuauucgcucacauaagaagaagaggagaaucgcgaguauaa

SEQ ID NO: 35112 - RNA, 807 nt, Artificial Sequence
  derived and/or modified sequence opt6 from capsid_protein_VP2__Norovirus__AFX81275
auggcaggagcauucuucgcaggacuagcaagugacguacuaggaucaggauuaggaucacuaauaaaugcaggagcgggcgcgauaaaucaaaaaauagauuucgaaaacaauagaaaauuacaacaagcaagcuuucaauuuaguucaaaccuccaacaagcaucauuccaacacgacaaagaaauguuacaagcacaaauagaagcaacaaaaaaacuacaacaagaaaugaugaaaguaaaacaagcaaugcuacuagaaggaggauucucagaaacagaugcagcaagaggagcaauuaaugcaccaaugacaaaaguacuagauuggucaggaacaagauauugggcaccagaugcaagaacaacaacauauaaugcagguagauuuucaacaccacaaccaaguggaacauuaccuggaagaauaaacccaagaacaccaacaccagcaagaggaaguaguucaacgaguucgaacgcaucaacagcaacaucaauauacucaaaccaaacaguaagcacaagguuaggaucaacagcaggauccggaacaaacguaagcucguuaccaaguacugcaagaacaagaaguugggucgaagaccaaaauagaaacuuaagcccauucaugagaggagcacauaacauaagcuuuguaacaccaccaucaucaagaucaagcucacaaggaacaguaagcacaguaccaaaagaaguauuagauucauggacaggagcauucaauacaagaagacaaccauuauucgcgcacauaagaagaagaggagaaucaagaguauaa

SEQ ID NO: 35113 - RNA, 807 nt, Artificial Sequence
  derived and/or modified sequence opt6 from capsid_protein_VP2__Norovirus__AFX81278
auggcaggagcauucuuugcaggacuagcaagcgacguauuaggaucaggcuuaggaucacuaauaaacgcaggagcaggagcaauaaaucaaaaaauagauuucgagaacaaucgaaaacuccaacaagcuucauuucaauuuaguucgaacuuacaacaagccucauuccaacacgauaaagaaaugcuacaagcacaaauagaagcuacaaaaaaauuacaacaagaaaugaugaaaguaaaacaagcaauguuauuagaaggagguuuuucagaaacagacgcagcaagaggagcaauaaaugcaccaaugacaaaaguucuagauuggucaggaacaagauacugggcaccagaugccagaacaacgacauauaacgcaggcagauucucaaccccacaaccaucuggaacacuaccaggacgaauaaauccaagaacacccacaccagcaagagggagcucgagcacaucuucaaaugcgagcacagcaacaaguauauauucaaaccaaaccgugaguacacgacuaggaucaacagcuggaucaggaacaaacguaaguucacuaccaagcacagcuagaacaagaaguuggguagaagaccaaaacagaaacuuaagcccauucaugagaggagcacauaacauaucauuuguaacaccaccaaguucaagaucaagcucacaaggaaccguaagcacaguaccaaaagaaguauuagacucuuggaccggagcguucaauacaagaagacaaccacuauucgcacacauaagacgaagaggagaaucaagaguauaa

SEQ ID NO: 35114 - RNA, 807 nt, Artificial Sequence
  derived and/or modified sequence opt6 from capsid_protein_VP2__Norovirus__AFX81281
auggcaggagcuuuuuuugcaggacuagcaagugauguauuaggaucaggauuaggaucacuaauaaaugcaggcgcaggagcaauaaaucaaaaaauagauuucgaaaacaauagaaaacuacaacaagccucauuucaauuuaguucaaacuuacaacaagccucauuccaacacgauaaagaaaugcuacaagcacaaauagaagcaacaaaaaaacuacaacaagaaaugaugaaaguaaaacaagcaaugcuacuagaagguggauucucagaaacagacgcggcaagaggagcaaucaaugcaccaaugacaaaaguacuagauuggucaggaacaagauauugggcaccagaugcaagaacaacaacauauaacgcagguagauucucaacaccacaaccaucaggagcauuaccaggaagaauaaacccacgaacaccaacaccagcaagaggcaguucuagcacauccucuaacgcaucaacagcaacaagcauacacuccaaccaaacaguaaguacaagauuaggcucuacagcaggaucuggaacuaacguaucaucacuaccaucaacugccagaacaagaagcuggguagaagaucaaaacagaaauuuaagcccauucaugagaggugcacauaauauaagcuuugucacaccaccaagcucgagaucgagcucacaagggaccguaagcacaguaccaaaagaaguacuagauucauggacaggugcauucaauacaagacgacaaccauuauucgcacacauucgaagaagaggagaaucaagaguauaa

SEQ ID NO: 35115 - RNA, 807 nt, Artificial Sequence
  derived and/or modified sequence opt6 from capsid_protein_VP2__Norovirus__AFX81284
auggcaggagccuucuuugcaggacuagcaucagacguacuaggaucaggucuaggcucacuaauaaacgcaggugcaggcgcaauaaaucaaaaaauagacuucgaaaacaacagaaaauuacaacaagcgucauuccaauucucaucaaacuuacaacaagccucauuccaacacgauaaagaaaugcuacaagcacaaauagaagcaaccaaaaaacuacaacaagaaaugaugaaaguaaaacaagcaaugcuacuagaaggaggauucucagaaacagacgccgcaagaggagcaauaaacgcaccaaugacaaaaguauuagacuggucaggaacaagauacugggcaccugacgcucgaacaacaacauauaacgcaggaagauucucaaccccacaaccuucaggaacauuaccaggaagaauaaauccaagaacaccaacaccagcuagaggaucaucaucaacaucauccaacgcauccacagccacaaguauauauucaaaccaaacaguaucuacaagacuaggaucaacagcaggcucuggaacuaacguaucaucucuaccaucaacagcaagaacuagaucauggguagaagaccaaaacagaaaccuaucaccauucaugagaggugcacauaacauaucauucguaacaccaccaucaucucgaucaucaucccaagguacaguaaguacaguaccaaaagaaguccuagacucauggacaggagcauuuaauacaagaagacaaccauuauuugcacacauaagaagacgcggagaaucacgaguauaa

SEQ ID NO: 35116 - RNA, 807 nt, Artificial Sequence
  derived and/or modified sequence opt6 from capsid_protein_VP2__Norovirus__AFX81287
auggcaggagcauucuucgcaggauuagcaucagacguacuaggauccggacuaagcucacuaauaaacgccggagccggcgcaauaaaucaaaaaauagauuucgaaaauaauagaaaauuacaacaagcuaguuuucaauucaguucaaacuuacaacaagcaucauuccaacacgacaaagaaauguuacaagcacaaauagaagcaacuaaaaaacuacaacaagaaaugaugaaaguaaaacaagcaauguuacuagaaggaggauucucagaaacagacgcagcaagaggagcaauaaacgcaccaaugacaaaaguacuagauuggucaggaacaagauacugggcaccagacgcaagaacaacaacauauaacgcaggaagauucucaacaccacaaccaucaggaacauuaccagggcguauaaacccaagaacaccaacacccgcaagaggaucaucaaguacaagcucuaacgcgccaacagcaacaagcauucauucuaaccaaaccguaagcacaagacuaggaucaacagcaggcucaggaacaaauguaucuucacuaccaucaacagcaagaaccagaagcuggguagaagaccaaaacagaaauuuaaguccauucaugagaggagcacauaacauauccuucguaacaccaccaucaucaagaucaagcucacaaggaacaguaucaacuguaccaaaagaaguauuagacucauggacaggagcauucaauaccagaagacaaccacuauucgcacacauaagaagacguggagaaucuagaguuuaa

SEQ ID NO: 35117 - RNA, 807 nt, Artificial Sequence
  derived and/or modified sequence opt6 from capsid_protein_VP2__Norovirus__AFX81290
auggcaggagcguucuuugcaggauuagcaucagauguacuaggaucgggauuagguucuuuaauaaacgcaggagcaggagcaauaaaucaaaaaauagauuucgaaaacaacagaaaauuacaacaagcaucauuucaauucaguucaaacuuacaacaagcaucauuccaacacgauaaagaaauguuacaagcacaaauagaagcuacaaaaaaauuacaacaagaaaugaugaaaguaaaacaagcaaugcuacuagaaggaggauucucugaaacagacgcagcaagaggagcaauaaaugcaccaaugacaaaaguacucgauugguccggaacacgauauugggcaccagaugcaagaacaacaaccuauaaugcaggaagauucucuacaccacaaccaucaggaacauuaccaggaagaauaaacccaagaacaccaacaccagcaagaggaaguucaucaacaagcucuaacgcaagcacagcaacuagcauuuacucaaaccaaacaguauccacaagacuaggaaguacagcaggaucaggaacaaacguaagcucauuaccaagcacagcaaggacaagaagcuggguagaagaccaaaacagaaauuuaaguccauucaugagaggagcacauaauauaagcuuuguaacaccaccaagcucaagaucaagcucacaaggaacaguaagcacagucccaaaagaaguauuagacucauggacaggagcguucaauacaagaagacaaccauuauucgcgcacauaagaagaagaggagaaucaagaguauaa

SEQ ID NO: 35118 - RNA, 807 nt, Artificial Sequence
  derived and/or modified sequence opt6 from capsid_protein_VP2__Norovirus__AFX81293
auggcaggcgcauucuuugcaggacuagcaagcgauguauuaggaucaggauuaggaucauuaauaaacgcaggagcaggagcaauaaaucaaaaaauagauuucgaaaacaacagaaaacuacaacaagcgucauuucaauuuagcucaaacuuacaacaagcaucauuucaacacgauaaagaaauguuacaagcacaaauagaagcaacaaaaaaauuacaacaagaaaugaugaaaguaaaacaagcaaugcuauuagaaggaggauucucagaaacagacgcagcaagaggagcaauuaaugcaccaaugacaaaaguacuagacuggucaggaacaagauauugggcaccagaugcaagaacaacaacauauaacgcaggaagauucucaacaccacaaccaagcggaacauuaccaggaagaauaaaccccagaacuccaacaccagcacgaggaagcucaucaacaaguucuaacgcaagcacagccacaagcauacacucaaaccaaacaguaagcacaagauugggcucaacagcaggaucaggaacgaacguaaguucauuaccaagcacagcaagaacaagaucauggguagaagaccaaaacagaaaucuaucaccauucaugagaggagcucauaacauaucauucguaacaccaccaagcucaagaucgagcucacaaggaacaguaagcacagucccaaaagaaguauuagacucauggacaggcgcauucaauacuagacgccaaccauuguuugcacacauacgaagaagaggagaaucaagaguauaa

SEQ ID NO: 35119 - RNA, 807 nt, Artificial Sequence
  derived and/or modified sequence opt6 from capsid_protein_VP2__Norovirus__AFX81296
auggcaggagcauucuuugcaggacuagcaagugacguacuaggaucuggauuaggaucauuaauaaacgcaggagcaggagccauaaaccaaaaaauagauuuugaaaacaacagaaaacuacaacaagcaucuuuucaauuuagcucaaaccuacaacaagcaucauuccaacacgauaaagaaaugcuacaagcacaaauagaagcaacaaaaaaauuacaacaagaaaugaugaaaguaaaacaagcaauguuacuagaaggaggauucucggaaacagacgcagcaagaggagcaauaaaugcacccaugacaaaaguacuagauuggucaggcacaagauauugggcacccgaugcuagaacaacgacauacaaugcaggaagauucucaacaccacaaccaagcggaacacugcccggaagaguaaauccaagaacuccaacaccagcgagaggaagcucaagcacaagcucaaaugcaucaacagcaacaaguauacacucaaaccaaacaguaucaacaagacuaggcucaacagcuggaucaggaacaaacguaucaucacucccuaguacagcaagaacaagaaguuggguagaagaccaaaacagaaacuuaagcccauucaugagaggagcacauaacauaagcuucguaacaccaccuagcucaagaucaagcucacaaggaacaguaaguacaguuccaaaagaaguauuagacucauggacaggagcauucaauacaagaagacaaccauuauucgcacacauaagaagacgcggagaaucaagaguuuaa

SEQ ID NO: 35120 - RNA, 807 nt, Artificial Sequence
  derived and/or modified sequence opt6 from capsid_protein_VP2__Norovirus__AFX81299
auggcaggagcuuucuuugcaggacuagcaagugauguauuaggaucaggacuaggaucacuaauaaacgcaggagcaggcgcaauaaaccaaaaaauagacuucgaaaauaacagaaaacuccaacaagcaucauuccaauucagcucaaaccuacaacaagcaucauuucaacacgacaaagaaaugcuacaagcacaaauagaagcaacaaaaaaauuacaacaagaaaugaugaaaguaaaacaagcaaugcuacucgaaggaggauuuucagaaacagaugcagccagaggcgcaauaaacgcaccaaugacaaaaguacuagacuggucaggaacacgauacuggacaccagaugcaagaacaacaacauacaacgcaggaagauucucaacaccacaaccaucaggaacauuaccaggaagaauaaacccucgaaccccaacaccagcacgaggaaguucaucaacaaguagcaacgcaucaacagccacaagcauccacucaaaucaaacaguaucaacacgauuaggcucaacagcaggcuccgguacaaacguaucaucacuaccaucaacagcccgaacaagaucauggguagaagaccaaaacagaaaccuaucaccauucaugagaggagcacacaauauaucauucguaacaccaccaagcucaagaucaucaucacaaggaaccguaucaacaguaccaaaagaaguccuagacucuuggacaggcgcauucaauaccagaagacaaccacuauucgcacauauaagaagaagaggagaaucaagaguauaa

SEQ ID NO: 35121 - RNA, 807 nt, Artificial Sequence
  derived and/or modified sequence opt6 from capsid_protein_VP2__Norovirus__AFX81302
auggcaggagcauucuuugcaggacuagcaucagauguacuaaguucaggauuaggaucguuaauaaaugcaggcgcaggagcaaucaaucaaaaaauagauuucgaaaacaauagaaaacuacaacaagcauccuuucaauuuagcucaaacuugcaacaagcaucauuucaacacgauaaagaaaugcuacaagcacaaauagaagcaacuaaaaaauuacaacaagaaaugaugaaaguaaaacaagcuauguuacuagaaggcggauucucagaaacagacgcagcaagaggagcaauaaacgcaccaaugacaaaagcacuagauuggucaggaacaagauauugggcaccagaugccagaacaacaacauauagcgcaggcagauucucaacaccacaaccaucaggcgcauuaccaggaagaacaaacccacgagcaccaauaccagcacgaggaagcccaagcacaagcucaggagcaagcacagcaacaucuauauauucaaaccaaacaguaaguacuagauuaggcucuacagcaggcucaggaacaaacguuagcucacuaccaagcacagcaagaacaagaagcuggguagaagaccaaaacagaaacuuaaguccauucaugagaggagcacauaacauaucauucgucacaccaccaucaucaagaucaagcucacaaggaacaguaagcacagucccaaaagaaguauuagauucuuggacuggagcuuucaauacaagaagacaaccauuauuugcacacauaagaagaagaggagaaucuagaguuuaa

SEQ ID NO: 35122 - RNA, 807 nt, Artificial Sequence
  derived and/or modified sequence opt6 from capsid_protein_VP2__Norovirus__AFX81305
auggcaggagcauucuuugccgggcuagcaucagaugucuuaggcucaggauuaggaucauuaauaaacgcaggagcaggagcaauaaaucaaaaaauugauuucgaaaacaauagaaaacuacaacaagcaaguuuucaauuuaguucggacuuacaacaagcaucauuucaacacgauaaagaaaugcuacaagcacaaauagaagcaacaaaaaaauuacaacaagaaaugaugaagguaaaacaagcaauguuacuagaaggcggauucucugaaacagacgcagcaagaggugcaauaaaugcaccaaugacaaaaguacuagauuggucaggcacaagauauugggcacccgaugccagaacaacgacauauagcgcgggaagguucucgacaccacaaccaucaggaacuuugccaggacgaacaaacccaagaacacccacaccugcaagaggaagcucaagcaccagcucaaacgcaucuacagccacaagcauacacucaaaucaaacagugagcacaagauuaggaucgaccgcaggaucaggaacaaacguaaguucacuuccaucaacagcaagaacaagaagcuggguagaagaccaaaacagaaacuuaucaccauucaugagaggagcacacaacauaagcuuuguaacaccaccaagcucaagaucaaguucacaaggaacaguaucaacaguaccaaaagaaguauuagacucauggacaggagcauuuaauacuagaagacaaccauuauuugcacacauaagaagacgaggagaaucaagaguauaa

SEQ ID NO: 35123 - RNA, 807 nt, Artificial Sequence
  derived and/or modified sequence opt6 from capsid_protein_VP2__Norovirus__AFX81308
auggcaggagcauucuucgcaggacuagcauccgauguacuaggauccggauuaggaucgcuaauaaacgcaggagcaggugcaauaaaucaaaaaauagacuucgaaaauaacagaaaacuccaacaagcauccuuccaauucagcucaaacuuacaacaagccucauuccaacacgacaaagaaaugcuacaagcacaaauagaagcaacaaaaaaacuacaacaagaaaugaugaaaguaaaacaagcaaugcuacuagaaggcggauucucugaaacagacgcagccagaggagcaaucaaugcaccaaugacaaaaguacuagacuggucagguacaagauacugggcaccagacgcaagaacaacaaccuacaacgcaggaagauucucaacaccacaaccaagcggaacccuacccggaagaauaaacccaagaacaccaacaccagcaagaggaagcucaaguacaagcucuaaugcaaguacagccacaagcauacacucaaaucaaacaguaagcacaagacuaggcucaacagcaggcucuggaacaaacguaucaucauuaccaucaacagcaagaacaagaagcuggguagaagaccaaaacagaaauuuaaguccauucaugcgaggagcacauaauauaagcuucguaacaccaccaucaucaagaucaaguucacaaggaacaguaucaacaguaccaaaagaagucuuagacucauggacaggagcauucaacacacgaagacaaccacuauuugcacacauaagaagaagaggugaaucaagaguauaa

SEQ ID NO: 35124 - RNA, 807 nt, Artificial Sequence
  derived and/or modified sequence opt6 from capsid_protein_VP2__Norovirus__AFX81311
auggcaggcgcguuuuuugcaggacuagcaucagauguauuaggcucaggcuuaggaucacuaauaaacgcaggagcaggagcaauaaaucaaaaaauugauuucgaaaacaauagaaaauuacaacaagcaagcuuucaauuuucaucaaacuuacaacaagcaucuuuccaacacgauaaagaaaugcuacaagcacaaauagaagcaacaaaaaaauuacaacaagaaaugaugaaaguaaaacaagcaauguuacuagaaggaggauucucagaaacagacgcggccaggggagcaauaaaugcaccaaugacaaaaguacuagauuggucaggaacaagauauugggcgccagaugcacguaccacaacauauaacgcgggaagauucucaacaccacaacccucaggaacauuaccaggacgaauaaacccacgaacaccaacaccagcaagaggaagcucaagcacuagcucuaaugcaagcacagcaacaaguauauacucuaaccaaaccgucucaacaagauuaggaaguacagcaggaucuggaacaaauguaagcucacuaccaagcacagccagaaccagaaguugggucgaagaccaaaacagaaacuuaaguccauuuaugcgaggagcccauaacauaagcuuugucacaccaccaagcucaagaucgagcucacaaggaacaguaagcacaguaccaaaagaaguauuagacucauggacaggcgcauucaauacaagaagacaaccauuauuugcacacauaagaagaagaggagaaucaagaguauaa

SEQ ID NO: 35125 - RNA, 807 nt, Artificial Sequence
  derived and/or modified sequence opt6 from capsid_protein_VP2__Norovirus__AFX81314
auggcaggagcauucuuugcaggacuagcaagugauguauuaggaucaggacuaggaucacuaauaaacgcaggagcaggagcgauaaaccaaaaaaucgauuucgaaaacaauagaaaauuacaacaagcaaguuuucaauuuagcucaaacuuacaacaagcaucauuccaacacgauaaagaaaugcuacaagcacaaauagaagcaacaaaaaaauuacaacaagaaaugaugaaaguaaaacaagcaauguuauuagaaggaggauucucugaaacagaugcggcaaggggagcaauaaacgcaccaaugacaaaaguacuagacugguccggaacaagauacugggcaccugaugcaagaacaacaacauauaacgcaggaagauucucgacaccacaaccaucagguacauuaccaggcagaauaaacccacgaacaccaacuccagcgagaggaagcucaagcacaaguucgaacgcaagcacagcaacaagcauacacucaaaccaaacaguauccacaagauuaggaucgacagcaggaucaggaacaaacguuaguucacuaccuagcacagcaagaacccgaaguuggguagaagaucaaaacagaaacuuaagcccauucaugagaggagcacauaacauaucauuuguaacuccaccaagcucaagaucaaguucucaaggaacaguaaguacuguaccaaaagaaguauuagacucauggacuggcgcauucaauacaagaagacaaccauuauucgcacacauaagaagacgaggagaaucgagaguauaa

SEQ ID NO: 35126 - RNA, 807 nt, Artificial Sequence
  derived and/or modified sequence opt6 from capsid_protein_VP2__Norovirus__AFX81317
auggcaggagcauucuuugcaggauuagcauccgauguauuaggaucaggauuagguucacuuauaaacgccggagcaggagcaauaaaucaaaaaauagauuucgaaaacaauagaaaauuacaacaagcaagcuuucaauuuucauccaaccuacaacaagcaucauuccaacacgauaaagaaauguuacaagcacaaauagaagcaacaaaaaaacuacaacaagaaaugaugaaagucaaacaagcaauguuacuagaaggaggauuuuccgaaacugacgcagcaagaggagcaauaaaugcaccuaugacaaaaguauuagacugguccggaacaagauauugggcaccagacgcaaggacaacaacauauaaugcaggaagauucucaacaccacaaccaagcggaacauuaccaggaagaauaaacccaagaacuccaacaccagcaagagguagcucaagcacaagcucaaacgccagcacagccacuucaauacacucaaaccaaacaguaagcacaagauuaggaucaacagcaggaucaggaacaaacguaucaucacuuccaucaacagcaagaaccagaaguuggguagaagaccaaaauagaaaucuaagcccauucaugagaggggcacauaacauaagcuuuguaacuccaccaagcucaagaucaucaucacaaggaaccguaagcacuguaccaaaagaaguauuagauucauggacaggcgcauucaauacuagaagacaaccauuauucgcacacauaagaagaagaggagaaucaagaguauaa

SEQ ID NO: 35127 - RNA, 807 nt, Artificial Sequence
  derived and/or modified sequence opt6 from capsid_protein_VP2__Norovirus__AFX81320
auggcaggagcauucuuugcaggauuagcuagugacguacuaggaucaggacuaggaucacucauaaacgcaggagcaggagcaauaaaccaaaaaauagauuucgaaaauaaucgaaaacuacaacaagcaucauuccaauucagcucaaaccuacaacaagcaucauuccaacacgauaaagaaauguuacaagcacaaauagaagcaacaaaaaaauuacaacaagaaaugaugaaaguaaaacaagcaauguuauuagaaggcggauuuucagaaacagacgcagccagaggagcaauaaaugcaccaaugacaaaaguacuagacuggucaggaacaagauauugggcaccagacgccagaacaacaacauauaacgcagguagauuuucaacaccucaaccaaguggaacauuaccuggaagaaucaacccaagaacaccaacaccagcaagaggaaguucaagcacaagcucaaaugcaaguacagcaacaucuauacacucaaaucaaacuguaagcacaagacuaggauccacagcaggauccggaacaaacgugucaucauuaccaagcacagcccgaacaagaaguuggguagaagaccaaaacagaaaccuaucaccauucaugagaggugcacacaacauaagcuucguuacaccaccaagcucaagaucaagcucacaaggaacaguaagcacaguaccaaaagaaguauuagacucauggacaggagccuucaacacaagaagacaaccacuauucgcacacauaagaagaagaggagaaucaagaguauaa

SEQ ID NO: 35128 - RNA, 807 nt, Artificial Sequence
  derived and/or modified sequence opt6 from capsid_protein_VP2__Norovirus__AFX81323
auggcaggagcauucuuugcaggacuagccucagacguauuaggaucaggauuaggaucacuaauaaaugcaggagcaggagcaauaaaccaaaaaauagacuuugaaaacaacagaaaauuacaacaagccaguuuccaauucucaucaaacuuacaacaagcaucauuccaacacgacaaagaaaugcuacaagcacaaauagaagcaacuaaaaaauuacaacaagaaaugaugaaaguaaaacaagcuauguuacucgaaggaggauucucagaaacagacgcagcaagaggagcuauaaacgcacccaugacaaaaguacuagacuggucaggcacacguuacugggcacccgacgcaagaacaacaacauacagugcaggaagauucucaacaccacaaccaucaggaacccuaccuggaagaauaaacccaagaacaccaacaccagcacgaggaaguucaucaacaucaucaaacgcaagcacagcuacaagcauacauagcaaccaaacaguaucaacaagacuaggaucaacagcaggaucaggcacaaacguaucaucacuaccaucaacagcacgaacuagaucauggguagaagaccaaaacagaaaucuauccccauucaugagaggagcacacaacauaagcuucguaacaccaccaucaucaagaucaucaucacaagguaccguaucaacgguaccaaaagaaguacucgacucauggacaggagcuuucaauacaagaagacaaccacuauucgcacacauaagaagaagaggagaaucaagaguauaa

SEQ ID NO: 35129 - RNA, 807 nt, Artificial Sequence
  derived and/or modified sequence opt6 from capsid_protein_VP2__Norovirus__AFX81326
auggcaggagcauucuucgcaggauuagcaagcgacguauuaggaucaggacuaggcucccuaauaaaugcaggagcaggcgcaauaaaucaaaaaauagauuucgaaaacaacagaaaauuacaacaagcaagcuuccaauucucauccaaccuacaacaagcaucauuccaacaugacaaagaaaugcuacaagcacaaauagaagcaacaaaaaaauuacaacaagaaaugaugaaaguuaaacaagcaauguuauuagaaggaggauuuucagaaacagacgcagcaagaggagcaauaaacgcaccaaugacaaaaguauuagacuggucaggaacaagauacugggcaccagaugcaagaacaacaacauacaacgcaggaagauucucaacaccacaaccaaguggaacauuacccgguagaauaaacccaagaacaccaacaccagcaagaggaagcucuagcaccucaucaaacgcaucuacagcaaccucaauauacucaaaccaaacaguaagcacacgucuuggaucaacagcaggauccggaacaaacguaucaucacuaccaucaacagcacgaacuagaucauggguagaagaucaaaauagaaacuuaucaccauucaugcgaggagcacauaacauuucauuuguaacaccaccaucaucaagaucaaguucacaagguacagucagcacaguccccaaagaaguauuagacucauggacaggcgcauucaauacaagaagacaaccuuuauucgcacacauaagaagaagaggagaaucacgaguauaa

SEQ ID NO: 35130 - RNA, 807 nt, Artificial Sequence
  derived and/or modified sequence opt6 from capsid_protein_VP2__Norovirus__AGE89434
auggcaggcgcauucuuugcaggauuagcaagugacguacucggaucaggauuaggaucauuaauaaaugcaggagccggcgcaaucaaucaaaaaaucgauuucgaaaacaauagaaaauuacaacaagcaagcuuucaauuuagcucaaaccuacaacaagcaucauuccaacaugauaaagaaauguuacaagcacaaauagaagcaacaaaaaaauuacaacaagaaaugaugaaaguaaaacaagcaaugcuacuagaaggaggauucucagaaacagaugcugcaagaggagcaauaaaugccccgaugacaaaaguacuagacuggucaggaacaagauacugggcgccagaugcaagaaccacaacuuacaacgcaggaagauucucaacaccacaaccaagcggaacacuaccaggaagaauaaacccaagaacaccaacaccagcaagagggaguucaaguacaucaucaaacgcaucaacggcaacgagcauacacucaaaucaaacaguaagcacaagauuaggaucgaccgcaggcucaggaacaaacguaaguucacuaccaucaacagcaagaacaagaagcuggguagaagaccaaaacagaaacuuaagcccauucaugagaggagcacacaacauaagcuuugucacaccaccgucaucaagaucaagcucacaaggaacaguaagcacaguaccgaaagaaguacuagauucauggacaggagcauuuaauacaagaagacaaccauuauucgcacacauacgaagaagaggagaaucaagaguguaa

SEQ ID NO: 35131 - RNA, 807 nt, Artificial Sequence
  derived and/or modified sequence opt6 from capsid_protein_VP2__Norovirus__AGE89437
auggcaggagcauucuuugcaggacuagcgagcgaugucuuaggaucaggauuaggaucgcuaauaaaugcaggagcaggagcaauaaaucaaaaaauagacuucgaaaacaauagaaaacuacaacaagcaagcuuucaauuuagcucgaaccuacaacaagccucauuucaacacgauaaagaaauguuacaagcacaaauagaagcaacaaaaaaacuacaacaagaaaugaugaaaguaaaacaagcaauguuacuagaaggaggauucucagaaacagacgcagcaagaggagcaauaaaugccccaaugacaaaaguacuagauuggucaggaacgagauauugggcaccagaugcaagaacaacaacauauaacgcaggaagauucucuaccccacaaccaagcggaacauuaccagggagaauaaauccaagaacacccacaccagcgagaggaucaucaagcacaucaucaaacgcgagcacagcaacaaguauucacucuaaccaaacaguuaguacaagauuaggcucgacagcaggaucgggaacaaacguaaguucauuaccaucaacagcaagaacaagaaguuggguagaagaccaaaacagaaacuuaagcccauuuaugcgaggagcacacaacauaagcuuuguaacaccaccaagcucaagaucaagcucacaaggaacaguaaguacaguaccgaaagaaguacuagacucauggacaggagcauucaauacaagaagacaaccacuguucgcacacauaagaagaagaggagaaucaagaguuuaa

SEQ ID NO: 35132 - RNA, 807 nt, Artificial Sequence
  derived and/or modified sequence opt6 from capsid_protein_VP2__Norovirus__AGE89440
auggcaggcgcauuuuuugcaggacuagcaucagauguauuaggaucaggauuaggaucauuaauaucagcaggagccggugcaauaaaucaaaaaguagaauucgaaaacaacagaaaacuacaacaagcaucauuucaauucucaucaaacuuacaacaagcuucauuccaacacgauaaagaaauguuacaagcacaaauagaagcaaccaaaaaauuacaacaagaaaugaugagaguaaaacaagcaaugcuauuagaaggaggauuuucagaaacagacgcagcaagaggagccauaaaugcaccaaugacaaaaacauuagauuggucgggcacaagauauugggcaccagaugcacgaacaacaaccuauaacgcaggacgauuuucaacaccacaaccaucaggagcucuaccaggaagagcaaacuuaagagcaacuguaccagcuagaggaucaucaucaacauucucaaacucaagcauagcaacaucaguauacucaaaccaaacaacaucaacaagauuaggaucaacugcaggauccggaacuucaguaaguucacuaccaagcacagccagaacaagaagcuggguagaagaccaaaacagaaaccuuagcccauucaugagaggagcacauaacauaagcuuuguaacaccacccucaucccgcucaagcucacaaggaacaguaagcacaguaccaaaagaaguauuagauucauggacaggcgccuucaauacaagaagacaaccacuauuugcacacauaagaaaaagaggagaaucaagaguauaa

SEQ ID NO: 35133 - RNA, 807 nt, Artificial Sequence
  derived and/or modified sequence opt6 from capsid_protein_VP2__Norovirus__AGE89443
auggcaggagcauucuuugcaggauuagcaucagauguauuagguucaggauuaggaucacuaauaaacgcaggcgcuggagcaauaaaucaaaaaguagaauucgaaaacaaucgaaaauuacaacaagcaucauuucaauuuagcucaaacuuacaacaagcaucauuccaacacgauaaagaaauguuacaagcacaaauagaagcaacaaaaaaauuacaacaagaaaugaugagagucaaacaagcaaugcuacuagaaggaggguucucagaaacagacgcagcaagaggagcaauaaaugcacccaugacaaaaacauuagauuggucaggaacaagauauugggcaccagaugcaagaacaacaacauacaacgcaggaagauucucuacaccacaaccaucaggagcucuaccaggaagagcaaauuuaagagcaacaguaccagcaagaggaagcucaaguacaagcucaaacgcaaguauagcaacaagcguauacucaaaccaaacaacaagcacaagauuaggaucaacagcuggaucuggaacaucaguaagcucacuaccuagcacagcaagaaccagaagcuggguagaagaucaaaacagaaacuuaagcccauucaugagaggagcacauaacauaagcuuuguaacaccaccaagcucuagaucaagcucucaaggaacaguaagcacagucccaaaagaaguauuagacucauggacaggagcguucaauacaagaagacaaccauuauucgcccacauaagaaaaagaggagaaucaagaguauaa

SEQ ID NO: 35134 - RNA, 807 nt, Artificial Sequence
  derived and/or modified sequence opt6 from capsid_protein_VP2__Norovirus__AGE89449
auggcaggagcauucuuugccggacuagccucagauguacuaggaucaggauuaggaagucucauaaacgcaggagcgggagcuauaaaucaaaaaguagaauucgaaaacaaucgaaaacuacaacaagcaagcuuccaauuuagcucaaacuuacaacaagcaucauuccaacaugacaaagagaugcuacaagcacaaauugaagcaacaaaaaaauuacaacaagaaaugaugagaguaaaacaagcaauguuauuagaaggaggauuuucagaaacagacgcagcaaggggagcaauaaaugccccaaugacaaaaacauuagauuggucaggaacaagauauugggcgcccgaugcaagaacaacaacauauaacgcaggcagauucucaacaccacaaccaaguggagucuuaccagguagagcaaaccuaagagcaaccguaccagcaagaggaagcucaucaacauuuucaaacucaagcauagcaacaagcguauacucaaaccaaaccacaagcacaagauuaggaucaacagcaggaucaggaacaaguguaucaucucuaccaucaacagcaagaaccagaagcuggguagaagaccaaaacagaaacuuaagcccauucaugagaggggcacauaacauaagcuuuguaacaccaccaaguucaagaucuagcucacaaggaacaguaagcacaguaccaaaagaaguauuagauucauggacaggagcauucaauaccagaagacaaccccuauuugcacacauaagaaaaagaggagaaucaagaguauaa

SEQ ID NO: 35135 - RNA, 807 nt, Artificial Sequence
  derived and/or modified sequence opt6 from capsid_protein_VP2__Norovirus__AGE89455
auggcaggagcuuuuuucgcaggauuagcaagugauguauuaggaucaggauuaggaucacuaauaaacgcaggagcaggugcaauaaaccaaaaaauagauuuugaaaauaauagaaaacuacaacaagcaagcuuucaauuuagcucaaacuuacaacaagccucauuccaacacgauaaagaaauguuacaagcacaaauagaagcaacuaaaaaauuacaacaagaaaugaugaaaguaaaacaagcaaugcuacuagaaggaggauucucagaaacagaugcagcaagaggagcaauaaaugccccaaugacaaaaguauuagauuggucaggaacaagauacugggcaccagaugcaagaacaacaacauacaacgcuggaagauucucaacaccacaaccaagcggagccuuaccaggaagaauaaacccaagaacgccaacaccagcaagaggaucaucaaguacauccucaaacgcaagcacagccacaaguauacacucaaaccaaacaguaagcacaagauuaggaucaacagcaggaucaggaacaaacguuagcucacuaccaagcacagcaagaacuagaucauggguagaagaccaaaacagaaaucuaagcccauucaugcgaggagcacauaacauaagcuuuguaacaccaccaagcucaagaucaagcucucaaggaacaguaagcacagucccaaaagaaguauuagauucauggacgggagcauuuaauacaaggcgacaaccauuauucgcgcacauaagaagaagaggagaaucacgaguauaa

SEQ ID NO: 35136 - RNA, 807 nt, Artificial Sequence
  derived and/or modified sequence opt6 from capsid_protein_VP2__Norovirus__AGE89458
auggcaggagcauucuuugcaggccucgcaagcgauguauuaggcucaggauuaggaucauuaauuaacgcaggagcaggugcaaucaaucaaaaaauagauuucgaaaacaauagaaaacuacaacaagcaaguuuucaauuuagcucaaauuuacaacaagcauccuuccaacacgauaaagaaauguuacaagcacaaauagaagccacaaaaaaacuacaacaagaaaugaugaaaguaaaacaagcaaugcuacuagaaggaggauuuucagaaacagacgcagcaagaggagcaaucaacgccccaaugacaaaaguacuagauuggucaggaacaagauacugggcacccgaugcaagaacaacaacauauaacgcaggaagauucucaacaccacaaccaagugggacuuuacccggaagaauaaacccaagaacaccaacaccagcacgaggaagcucauccacaagcucaaacgcaagcacagcaacaagcauacacucaaaccaaacaguaagcacaagauugggauccacagcaggaucgggaacaaauguaaguucauuaccaagcacagcaagaacaagaagcugggucgaagaccaaaacagaaauuuaagcccauucaugagaggagcacauaacauaagcuuuguaacaccaccaagcucaagaucaagcucacaaggaacaguaagcacagucccaaaagaaguauuagacaguuggacaggagcauuuaauaccagaagacaaccauuauuugcacacauacgaagaagaggagaaucacgaguauaa

SEQ ID NO: 35137 - RNA, 807 nt, Artificial Sequence
  derived and/or modified sequence opt6 from capsid_protein_VP2__Norovirus__AGE89461
auggcaggagcauucuuugccggauuagcgagcgauguuuuaggaucaggauuaggcaguuuaauaaaugcaggcgcaggagcaaucaaucaaaaaaucgauuuugaaaacaacagaaaacuacaacaagcaagcuuucaauucaguucaaaccuacaacaagcaucauuccaacacgauaaagaaauguuacaagcacaaauagaagcgacaaaaaaauuacaacaagaaaugaugaaaguaaaacaagcuauguuacuagaaggaggauucucagaaacagacgcagcaagaggagcaauaaaugcaccaaugacaaaaguacuagauuggucaggaacaagauacugggcaccagacgccaggacaacaacauauaacgcaggaagauucucaacuccacaaccaagcggaacauuaccuggaagaauaaauccaagaacaccuacaccagcaagaggaagcucaagcacaucaucaaacgcaagcacagcaacaagcauauacucaaaccaaacaguaagcacaagacuaggaucaacagcaggaucaggaacaaacguaagcucacuaccaaguacagcaagaacaaggagcuggguagaagaucaaaacagaaauuugucaccauucaugagaggagcacauaacauaaguuuuguaacacccccaucaucgagaucaagcucacaaggaacaguaaguaccguaccaaaagaaguacuagacucauggacaggagcauucaacacaagaagacaaccauuauucgcacacauaagaagaagaggagaaucaagaguauaa

SEQ ID NO: 35138 - RNA, 807 nt, Artificial Sequence
  derived and/or modified sequence opt6 from capsid_protein_VP2__Norovirus__AGE89464
auggcaggagcauucuucgcagguuuagcaucagacguauuaggaucaggacuaggcucacuaauaaacgcaggcgccggagcaauaaaccaaaaaauagacuucgaaaacaacagaaaauuacaacaagcuucauuccaauuuucaucaaaccuacaacaagcaucuuuccaacacgauaaagaaauguuacaagcacaaauagaagcaacaaaaaaacuacaacaagaaaugaugaaaguaaaacaagcaaugcuacucgaagguggauucucagaaacagacgcugcaagaggagcaauaaacgcuccuaugacaaaaguacuagacuggucaggaaccagauacugggcaccagaugccagaacaacaaccuauaacgcaggcagauucucaacaccacaaccaucaggaacacuaccaggaagaaucaacccaagaacaccaacaccagcaagaggaaguagcaguacaccaucaaaugcaucuacagcaacaucaauacacucaaaucaaacaguaucaacaagacuaggaucaacagcaggaucaggaacaaacguaagcucacuaccuucaacagccagaacaagaucauggguagaagaccaaaacaggaaccuaucaccauucaugcgaggagcccacaacauaucauucgucacaccaccaucaucaagaucaaguucccaaggaacaguaucaacaguaccaaaagaaguauuagauucauggacaggagcauucaauacaagaagacaacccuuauucgcacacauucgaagaagaggagaaucaagaguauaa

SEQ ID NO: 35139 - RNA, 807 nt, Artificial Sequence
  derived and/or modified sequence opt6 from capsid_protein_VP2__Norovirus__AGE89467
auggcaggagcauucuuugccggacuagcaucugacguacuaggauccggacuaggaucccucauaaacgcaggagcaggagcaaucaaccaaaaaauagauuucgaaaacaacagaaaauuacaacaagcaucauuccaauuuucaucaaacuuacaacaagcaucauuccaacacgauaaagaaaugcuccaagcacaaauagaagcaacaaaaaaacuacaacaagaaaugaugaaagucaaacaagcaaugcuacuagaaggcggauucucagaaaccgacgcagcaagaggugcaauaaaugcaccaaugacaaaaguacucgacuggucaggaacaagauacugggcaccagacgcaagaacaacaacauacaacgcaggaagauuuucaacaccacaaccaucaggaacauuaccaggaagaauaaacccacguacaccaacaccagcaagaggaagcucaucaacaucaucaaacgcauccacagcuacaucaauacacucaaaucaaacaguaucaacaagauuaggaucgacagcgggaucaggaacaaacguauccucacuaccaaguacagcaagaacaagaucauggguagaagaccaaaaccgaaacuuaagcccauuuaugcgaggagcacacaauauauccuucguaacaccaccaagcucaagauccucaagccaaggaacaguaucaacaguaccaaaagaaguauuagauucauggacaggagcauucaacacaagaagacaaccacuauuugcacauauaagaagacgaggagaaucaagaguauaa

SEQ ID NO: 35140 - RNA, 807 nt, Artificial Sequence
  derived and/or modified sequence opt6 from capsid_protein_VP2__Norovirus__AGE89470
auggcaggagcauuuuuugcaggacuagcauccgauguauuaggaucaggauuaggaucauuaauaaacgcaggagcaggagcaaucaaucaaaaaauagauuucgaaaacaaucgcaaauuacaacaagcaagcuuucaauucucaucaaacuuacaacaagcaucauuucaacacgauaaagaaaugcuacaagcacaaauagaagcaacaaaaaaacuacaacaagaaaugaugaaaguaaaacaagcaauguuacuagaaggcggauuuucagaaacagacgcagcuagaggagcaauaaaugcaccaaugacaaaaguuuuagauugguccggaacacgauauugggcacccgaugcaagagcaacaacauauaacgcaggaagauucucaacaccacaaccaagcggaacacuaccuggaagaauaaacccaagaacaccaacgccagcaagaggaagcccaagcacaaguucaaaugcaaguacagcaacaagcauauacucaaaccaaacaguaucaacaagauugggcucuacagcaggaucaggaacaaacguaagcucacucccaagcacagcaagaaccagaagcugggucgaagaccaaaauaggaacuuaagcccauucaugagaggagcacauaacauaagcuuugucacgccaccaagcucaagaucaaguucccaaggaaccguaaguacaguaccaaaagaaguacuagacucauggacaggagcauucaauaccagaagacaaccauuauucgcacacauaagaagaagaggagaaucaagaguauaa

SEQ ID NO: 35141 - RNA, 807 nt, Artificial Sequence
  derived and/or modified sequence opt6 from capsid_protein_VP2__Norovirus__AGE89473
auggcaggcgcauucuuugccggacuagcaagugauguauuaggaucaggauuaggaucauuaauaaacgcaggagcaggcgcaauaaaucaaaaaauagauuucgaaaacaauagaaaacuacaacaagcaaguuuucaauuuucaucaaaccuacaacaagcaucauuccaacacgauaaagaaauguugcaagcucaaauagaagcaacaaaaaaauuacaacaagaaaugaugaaagucaaacaagcaauguuauuagaaggcggauucucagaaacagacgcggcuagaggagcaauaaacgcaccgaugacaaaaguacuagauuggucaggaacgcgauauugggcaccagacgccagaacuacaacauauaacgcaggcagauucucaacaccacaaccaagcggagccuuaccaggaagaauaaacccgagaacaccaacaccagcaagaggaucaucaaguacgagcucaaacgcaucaauagcaacaucaauacacucaaaccaaacaguaaguacaagacuaggaucaacagcaggaucaggaacaaaugugaguucucuaccuagcacagcaagaacaagaagcugggucgaagaccaaaacagaaacuuaaguccauucaugagaggggcacauaacauaagcuuuguaacaccaccaaguucacgaucaagcucacaaggaacaguaagcacagucccaaaagaaguauuagacucauggacaggagcauucaauacaaggagacaaccauuauucgcgcacauacgaagacgaggagaaucaagaguauga

SEQ ID NO: 35142 - RNA, 807 nt, Artificial Sequence
  derived and/or modified sequence opt6 from capsid_protein_VP2__Norovirus__AGE89476
auggcuggagcauucuuugcaggacuagccagcgacguauuaggaucaggauuaggaucacuaauaaacgcaggcgcaggcgcgauaaaucaaaaaauugauuuugaaaacaaccgaaaacuacaacaagcaagcuuucaauuuucaucgaacuuacaacaagcaucuuuccaacacgauaaagaaauguuacaagcucaaauagaagcaacaaaaaaauuacaacaagaaaugaugaaaguaaaacaagcgauguuauuagaaggcggauucucagaaacagacgcagcaagaggagcaauaaaugccccaaugacaaaaguacuagauuggucaggaacaagauauugggcaccagaugcaagaacaaccacauauaacgcaggaagauucucaacaccacaaccaagcggaacauuaccaggaagaauaaauccacgaacaccaacaccagcaagaggaucaucaagcacgagcuuuaacgcaagcacagcuacaaguauacauucaaaucaaaccguaagcacacguuuaggaucaaccgcaggaucaggaacaaacguaagcucgcuaccaagcacagcaagaacaagaagcugggucgaagaccaaaacagaaacuuaaguccauucaugagaggagcacauaacauaagcuuuguaacaccaccaucaucaagaucaagcucacaaggaacuguaaguacgguaccgaaagaagucuuagauucauggacaggagcauucaauacaagaagacaacccuuauucgcacauaucagacgcagaggagaaucgagaguauaa

SEQ ID NO: 35143 - RNA, 807 nt, Artificial Sequence
  derived and/or modified sequence opt6 from capsid_protein_VP2__Norovirus__AGE89479
auggcaggcgcauucuucgcaggacuagcaagcgaugucuuaggaucaggauuaggcucacuaauaaaugcaggagcgggcgcgauaaaucaaaaaauagauuucgaaaacaauagaaaacuacaacaagcaagcuuucaauucaguucaaacuuacaacaagccucauuccaacaugauaaagaaauguuacaagcgcaaauagaagcgacaaaaaaauuacaacaagaaaugaugaaaguaaaacaagcaaugcuacuagaaggaggauuuucagaaacagaugcagcaagaggcgcaauaaaugcaccaaugacaaaagugcucgauuggucaggaacacgauauugggcaccagaugcaagaacaacuacauauaaugcaggcagauucucaacaccacaaucgagcggaaccuuaccaggaagaauaaacccacgaacaccaacaccagcaagaggaaguucaagcacaagcucaaacgcaagcacagcaacaaguauacacucaaaccaaacaguaaguacacgauuaggaucaacagcaggaucaggaacaaacguaaguucacacccaagcacagcaagaaccagaagcuggguagaagaccaaaacagaaaccuaucaccauucaugagaggagcacauaacauaucuuucgucacacccccaucaucacgaucaagcucacaaggaacaguaagcacagucccaaaagaaguucuggacucauggacaggagcauucaauacuagaagacaaccuuuauucgcacacauaagaagaagaggagaaucaagaguauaa

SEQ ID NO: 35144 - RNA, 807 nt, Artificial Sequence
  derived and/or modified sequence opt6 from capsid_protein_VP2__Norovirus__AGE89482
auggcaggagcauucuuugcaggacuagcaagcgauguauuaggaucaggccuaggcucauuaauaaaugcaggagcaggagcaauaaaucaaaaaaucgauuucgaaaacaaucgaaaacuacaacaagcaagcuuucaauuuagcucaaauuuacaacaagcaucauuccagcacgauaaagaaauguuacaagcacaaauagaagcaacaaaaaaauuacaacaagaaaugaugaaaguaaaacaagcaauguuacuagaaggcggauuuucagaaacagacgcagccagaggagcaauaaaugcaccaaugacaaaaguauuagauuggucuggaacacgauacugggcaccagacgccagaacaacaacauauaacgcaggaagauucucaacaccacaaccaaguggaacccuaccaggaagaauaaacccaagaacgcccacaccagcaagaggauccucaagcacaagcucaaaugcaagcacagcaacaucaauauacucaaaccaaacaguaaguacaagauuaggcucaaccgcaggaucaggaacaaacguaagcucauuaccaaguacggcaaggacuagaagcuggguagaagaccaaaacagaaauuuaagcccauucaugagaggugcacauaacauaagcuuuguaacaccaccaagcucaagaucguccucacaaggaacaguaucaacaguaccaaaagaagucuuagacucauggacgggagcauuuaauacuagacgacaaccauuauucgcacauauaagaagaagaggagaaucaagaguguaa

SEQ ID NO: 35145 - RNA, 807 nt, Artificial Sequence
  derived and/or modified sequence opt6 from capsid_protein_VP2__Norovirus__AGE89485
auggcgggagcauucuuugcagggcuagcaagcgauguauuaggaucaggauuaggaucacuaauaaacgcaggagcaggagcaaucaaucaaaaaauagauuucgaaaacaaucgaaaacuacaacaagcaagcuuucaauuuaguucaaacuuacaacaagccucauuccaacaugauaaagaaauguuacaagcacaaauagaagcaacaaaaaaauuacaacaagaaaugaugaaaguaaaacaagcaaugcuacuagaaggaggauucucagaaacagacgcagcaagaggagcaauaaaugcaccaaugacaaaagucuuagauuggucagguacaagauacugggcaccagaugccagaacaacaacauauaacgcaggaagauucucaacaccacaaccaagcggaacacuaccaggaagaauaaacccacgaacaccaacaccagcaagaggaaguucaagcacaagcucaaacgcaagcacggccacaucaauacacucaaaccaaaccguaaguacaagauuaggcucaacagcaggcucaggaacaaacgugucaucacuaccaagcacagccagaacaaggagcuggguagaagaccaaaacagaaacuuaagcccauuuaugagaggagcaagaaacauaagcuuuguaacaccaccaagcucacgaucaagcucacaaggaacaguaagcacgguaccaaaagaaguccuagacucuuggacaggagcauuuaauacaaggagacaaccacuauucgcacacauaagaagaagaggagaaucaagaguguaa

SEQ ID NO: 35146 - RNA, 807 nt, Artificial Sequence
  derived and/or modified sequence opt6 from capsid_protein_VP2__Norovirus__AGE89488
auggcaggagcauucuuugcaggacuagcaucagauguauuaggaucaggauuaggcucacuaauaaacgcaggcgcaggagcaauaaaucaaaaaauagauuucgaaaacaauagaaaacuacaacaagcaaguuuucaauuuagcucaaacuuacaacaagcaucauuccaacaugauaaagaaauguuacaagcacaaauagaagcaacaaaaaaauuacaacaagaaaugaugaaaguaaaacaagcaauguuacuagaaggaggauuuucagaaacagacgcagcaagaggagcaauaaaugcaccaaugacaaaaguacucgauuggucaggaacaagauauugggcaccagacgcacgaaccacaaccuauaacgcaggaagauucucagcaccacaaccaaguggaagcuuaccaggaagaauaaacccaagagcgcccacaccagcaagaguaagcucaagcacaaguucaaacgccagcacagucacaucaauauauucaaaccaaaccguaagcacuagauuaggaucuacagcaggcucaggaacaaacguaagcucacuaccaagcacagccaggaccagaucauggguagaagaccaaaacagaaaccuaucaccauucaugcgaggagcacauaacauaucauucguaacaccaccaagcucaagaucaaguucacaaggaacuguaucaacaguaccaaaagaaguccuagacucauggacaggagcauucaacacaagaagacaaccacuauucgcacacauaagaagacgaggagaaucacgaguauaa

SEQ ID NO: 35147 - RNA, 807 nt, Artificial Sequence
  derived and/or modified sequence opt6 from capsid_protein_VP2__Norovirus__AGE89491
auggcaggagcauucuuugcaggacuagcaagugaugucuuaggaucaggauuaggaucacuaauaaacgcaggagcaggcgcaauaaaucaaaaaaucgauuucgaaaacaauagaaaacuacaacaagcgagcuuucaauuuagcucaaacuuacaacaagcaucauuucaacacgauaaagaaaugcuacaagcacaaauagaagcgacaaaaaaacuacaacaagaaaugaugaaagucaaacaagcaauguuacucgaaggaggauucucagaaacagacgcagccagaggagcaaucaaugcacccaugacaaaaguacucgauuggucaggaacaagauauugggcaccagaugcaagaacaacaacauauaacgcaggaagauucucgacaccacaaccaagcgggacauuaccaggaagaauaaauccaagaacaccaacaccagcaagaggguccucaagcacaaguucaaacgcaucaacugcaacuagcauacacucaaaccaaaccguaagcacaagauuaggcucaacagcagguucaggaacaaacguaagcucauuaccaucaacagcaagaacaagaagcugggucgaagaccaaaaucgaaacuuaucaccauucaugcgaggggcacacaacauaagcuuuguaacaccaccaagcucacgaucaucuucacaaggaaccgugagcacaguaccaaaagagguacuagauucauggacaggagcauucaauacaagaagacaaccacuauucgcacacauaagaaggagaggagaaucaagaguauaa

SEQ ID NO: 35148 - RNA, 807 nt, Artificial Sequence
  derived and/or modified sequence opt6 from capsid_protein_VP2__Norovirus__AGE89494
auggcaggagcauucuucgcaggacuagcaucagacguauuaggaucaggacuaggaucacuaauaaacgcaggagcaggagcaauaaaucaaaaaauagauuucgaaaacaacagaaaacuacaacaagcaaguuuucaauucucaucaaaccuacaacaagccucauuucaacacgacaaagaaauguuacaagcacaaauagaagcaacaaaaaaauuacaacaagaaaugaugaaaguaaaacaagcaaugcuacuagaaggaggauuuucagaaacugacgcagcaagaggagcaauaaacgcaccaaugacaaaaguauuagauuggucaggaacaagauacugggccccagaugccagaacaauaacauauaacgcaggaagauucucaacaccacaacccucaggaacccuacccggaagaauaaacccaagagcaccaacaccagcaagaggcucaucaagcacaagcucaaacgcaucaacagccacaagcauauacucaaaccaaaccguaagcacaagauuaggaucuacagcaggaucaggaacuaacguaagcucauuaccaucaacagcaagaacuagaagcuggguugaagaucaaaacagaaauuuaaguccauucaugagaggagcccacaacauaagcuucgucacaccaccaagcucacgaucaucaucacaaggaacaguaucaacaguaccaaaagaaguauuagacucauggacaggagcauucaacacaagaagacaaccacuauucgcacacauaagaagacgaggagaaucuagaguauaa

SEQ ID NO: 35149 - RNA, 807 nt, Artificial Sequence
  derived and/or modified sequence opt6 from capsid_protein_VP2__Norovirus__AGE89497
auggcaggagcauucuuugcaggauuagcaagugauguacuaggaucaggauuaggaucauuaauaagcgcaggcgcaggagcaauaaaucaaaaaauagauuucgaaaacaauagaaaacuacaacaagcgaguuuucaauuuagcucaaacuuacaacaagcaucauuccaacaugauaaagaaauguuacaagcacaaauagaagcgacaaaaaaauuacaacaagaaaugaugaaaguaaagcaagcaaugcuacuagaaggaggauucucagaaacagacgcggcaagaggagcaauaaaugcaccaaugacaaaaguauuagauuggucaggaacaagauacugggcaccagaugcaagaacaacaacauacaacgcgggaagauucucaacaccgcaaccauccgggacauuaccuggaagaauaaacccaagaacaccaacaccagcaagaggaagcucaaguacaagcucaaaugcaucaacagcaacaagcauauauucaaaccaaacagugagcacacgauuaggcucaacagcaggaagcggaacaaacguaagcaguuuaccaaguacagcaagaaccaggaguuggguagaagaccaaaacaggaaccuaagcccauucaugcgaggagcccauaacauaaguuuuguaacaccaccaaguuccagaucaagcucacaaggaacaguaaguacaguaccaaaagaaguauuagacuccuggacaggagcguucaauacaagaagacaaccacuauucgcacacauaagaagaagaggagaaucgagaguauaa

SEQ ID NO: 35150 - RNA, 807 nt, Artificial Sequence
  derived and/or modified sequence opt6 from capsid_protein_VP2__Norovirus__AGE89500
auggcaggcgcauucuuugccggacuagcaagugacguacuaggauccggauuaggaucauuaauaaaugcaggagcaggagcaauaaaucaaaaaauagacuucgaaaacaauagaaaauuacaacaagcaaguuuccaauucaguucaaacuuacaacaagcaucauuccaacaugauaaagaaauguuacaagcacaaauagaagcaacaaaaaaauuacaacaagaaaugaugaaaguaaaacaagcaaugcuacuugaaggaggauucuccgaaacggaugcagcaagaggagcaauaaaugcaccaaugacaaaaguacuagauuggucaggaacaagauacugggcuccagaugcaagaaccacaaccuauaacgcaggacgauucucaacaccacaaccaagcggaacauuaccaggaagaauaaacccaagaacaccaacaccagcaagaggauccucaagcacaagcucaaacgcaaguacagcaacaagcauacacucaaaccaaaccguaagcacaagauuaggaucaaccgcaggaucaggaacuaacguuagcucgcuaccaaguacagcaagaacaagaagcuggguagaagaucaaaacagaaacuuaagcccauucaugagaggagcacauaacauaaguuuuguaacacccccgagcucgagaucaagcucacaaggaacaguaagcacaguaccuaaagaaguccuagacucuuggacaggagcauucaauacaagaagacaacccuuauucgcacacauaagaaggagaggagaaucacgaguauaa

SEQ ID NO: 35151 - RNA, 807 nt, Artificial Sequence
  derived and/or modified sequence opt6 from capsid_protein_VP2__Norovirus__AGE89503
auggcaggagcauucuucgcaggacuagcaucagacguccuaggcucaggauuaggaucacuaauaaacgcaggagcaggagccauaaaccaaaaaauagacuucgaaaacaacagaaaacuacaacaagcaaguuuccaauucagcucaaaccuacaacaagcauccuuccaacaugacaaagaaauguuacaagcacaaauagaagcaacaaaaaaauuacaacaagaaaugaugaaaguaaaacaagcaaugcuacuagaaggaggauucucagaaacagacgcagcaagaggagcaauaaaugcaccaaugacaaaaguacuugacuggucaggcacaagauacugggccccagacgcaagaacaacaacauacaacgcaggaagauucucaacaccacaaccaucaggaacacuaccaggaagaauaaacccaagaacaccaacacccgcaagaggaucaucaucaacaucaucaaaugcaucaacagcaacaucaauacacucaaaccaaacaguaucaacaagacuaggaucaaccgcaggauccggaacaaacguaagcucacuaccaucaacagcacgaaccagaucauggguagaagaucaaaacagaaaccuaaguccauucaugagaggcgcacacaacauaagcuucguaacaccaccaagcucaagaucaucaucacaaggaacaguauccacagucccaaaagaaguacuagacucauggacaggagcauucaacacaagaagacaaccacuauucgcacauauuagaagaagaggagaaucacgaguauaa

SEQ ID NO: 35152 - RNA, 807 nt, Artificial Sequence
  derived and/or modified sequence opt6 from capsid_protein_VP2__Norovirus__AGE89506
auggcgggagcauucuuugcaggucuagcaagcgauguacuaggaucaggauuaggaucacuaauaaacgcaggagcaggagcaauaaaucaaaaaauagauuucgaaaacaaucgaaaacuacaacaagcauccuuucaauuuagcucaaacuuacaacaagcaucuuuccaacaugauaaagaaauguuacaagcacaaauagaagcaacaaaaaaauuacaacaagaaaugaugaaagucaaacaagcaaugcuacuagaaggaggauucucagaaacagacgcagcaagaggagcaauaaacgccccaaugacaaaaguacuagauuggucaggaacacgauauugggcaccagaugcaagaacaacaacauauaacgcaggaagauucucaacuccacaaccaaguggaacacuaccaggucgaauaaacccuagaacaccaacuccagcaagaggaagcucaagcacaaguucaaacgcuagcacagcaacaucaaugcacucaaaccaaaccguaucuacaagauuaggaucaacagcaggaucaggaacgaauguaaguucauuaccaaguacagccagaacaagaagcuggguagaagaccaaaacagaaacuuaagcccauucaugagaggagcacauaacauaaguuuuguaacaccaccaucaucacgaucaagcucucaaggaacaguaagcacagucccaaaagaaguacuagacucauggacaggcgcauucaauacaagaagacaaccauuauuugcacauauaagaagaagaggagaaucaagaguauaa

SEQ ID NO: 35153 - RNA, 807 nt, Artificial Sequence
  derived and/or modified sequence opt6 from capsid_protein_VP2__Norovirus__AGE89509
auggcaggagcauucuuugcuggguuagcaagugauguauuaggcucaggauuagguucauuaauaaacgcaggcgcaggagcaauaaaucaaaaaauagauuuugaaaacaauagaaaauuacaacaagcaagcuuucaauuuagcucaaaccuacaacaagcaucauuccaacaugauaaagaaauguuacaagcacaaauagaagcaaccaaaaaauugcaacaagaaaugaugaaaguaaaacaagcaauguuacuagaaggaggauuuucagaaacagacgcagcaagaggcgcaauaaaugcaccaaugacaaaaguacuagauuggucaggaacaagauauugggcaccagaugcuagaacaacaaccuauaacgcaggaagauucucaacaccacaaccaaguggaagcuuaccaggaagaauaaacccaagagcgccaacaccagcaagagcaagcucaagcauaagcucaaacgcaaguacaguaacaagcauauacucaaaccaaaccguaagcacaagauuaggcucaacagcaggaucgggaacgaauguuagcucauuaccaucaacagcaagaacaagaucauggguagaagaccaaaacagaaaucuaagcccauucaugagaggagcacauaacauaaguuuuguaacaccaccaaguucaagaucaagcucgcaaggaacaguaaguacagucccaaaagaagucuuagacucauggacaggagcauucaauacaagaagacaaccauuauucgcacauauaagaagacgaggagagucaagaguauaa

SEQ ID NO: 35154 - RNA, 807 nt, Artificial Sequence
  derived and/or modified sequence opt6 from capsid_protein_VP2__Norovirus__AGE89512
auggcaggagcauucuucgcaggacuagcaucagacguauuaggaucaggacuaggaagcuuaauaaacgcaggagcaggagcaauaaaccaaaaaauagacuucgaaaacaauagaaaauuacaacaagcgagcuuccaauucucaucaaacuuacaacaagcaucuuuucaacaugacaaagaaaugcuacaagcucaaauagaagcaacaaaaaaauuacaacaagaaaugaugaaaguuaaacaagcuauguuacuagaaggcggauucucagaaacagacgcagccagaggagcaaucaaugccccuaugacaaaaguauuagauuggucaggaacaagauacugggccccagacgcaagaaccacaacauacaacgcaggucgauucucaacaccacaacccucaggcacauuaccaggaagaauaaacccaagaacaccaacaccagcaagaggaagcucaucaacaagcucaaacgcaucaacagcaacaaguauacauucaaaccaaacaguaucaacaagauuaggaucuaccgcaggaucaggaacaaauguaagcucacucccaucaacagcaagaacacgaaguuggguagaagaccaaaacagaaacuuaucaccauucaugagaggcgcacacaacauaucauucguaacaccaccaucauccagaucaucaucacaaggaaccguaucaacaguaccaaaagaaguacuagacucauggacaggagcauucaacacaagaagacaaccauuauucgcacacauacgaagaagaggcgaaucuagaguauaa

SEQ ID NO: 35155 - RNA, 807 nt, Artificial Sequence
  derived and/or modified sequence opt6 from capsid_protein_VP2__Norovirus__AGE89515
auggcaggagcauucuuugcaggauuagcaagcgauguacuaggaucaggauuaggcucacuaauaaacgcgggagcaggagcaauaaaucaaaaaauagauuuugaaaacaauagaaaacuacaacaagcaagcuuccaauuuagcucaaacuuacaacaagcaucauuccaacaugauaaagaaauguuacaagcacaaauagaagcaacaaaaaaauuacaacaagaaaugaugaaagucaaacaagcaauguuauuagaaggaggauucucagaaacagacgcagcaagaggagcaauaaaugcaccaaugacaaaaguacuagacuggucaggcacgcgauauugggcaccugacgcaagaacaacaacauauaacgcaggaagauucucaacaccacaaccaagcggaacucuaccaggacgcauaaauccucgaacacccacaccagcacgaggaucaucaagcacaucaucaaacgcaaguacagcaacaagcauauacucaaaccaaacaguaagcacacgauuaggaucaacagcaggaucaggcacaaacguaagcucacuaccaucaacagcaagaacaagaucaugggucgaagaccaaaacagaaacuuaagcccauucaugagaggagcacauaacauaaguuuuguaacaccaccaaguucaagaucaucuucacaaggaacaguaagcacaguaccaaaagaaguauuagauucauggacaggagcauuuaauacaaggagacaaccauuauucgcacacauaagaagaagaggagaaucaagaguauaa

SEQ ID NO: 35156 - RNA, 807 nt, Artificial Sequence
  derived and/or modified sequence opt6 from capsid_protein_VP2__Norovirus__AGE89518
auggcuggagcauucuuugcaggacuagcaagcgauguacuaggaucaggauuagguucauuaauaaacgcaggcgcaggcgcaauaaaucaaaaaauagauuucgaaaacaauagaaaacuacaacaagcaaguuuucaauuuucaucaaacuuacaacaagcaucguuccaacacgauaaagaaauguuacaagcacaaauagaagcaacaaaaaaauuacaacaagaaaugaugaaaguaaaacaaacaaugcuccuagaaggcggauucucggaaacagacgcagcaagaggagcaauaaaugccccaaugacaaaaguauuagauuggucaggaacgagauacugggcgccagaugcaagaacaacaaccuauaacgcaggcagauucucuacaccacaaccaagcggaacacuaccaggaagaauaaacccaagaacaccaacuccagcaagaggaaguucaaguacaagcucuaacgcaagcacagcaacgagcauacacucuaaccaaacaguaagcacuagauuaggaucaaccgcaggcucaggaacaaacguaagcucacuaccgagcacagccagaacaagaucauggguagaagaccaaaacagaaacuuaagcccauucaugagaggagcacacaacauaaguuuuguaacaccaccaucaucaagaucaagcagucaaggaacaguaagcacagucccaaaagaagucuuagacucuuggacaggagcauucaauacaagaagacaaccacuauucgcacacauacgaagaagaggagaaucaagaguauaa

SEQ ID NO: 35157 - RNA, 807 nt, Artificial Sequence
  derived and/or modified sequence opt6 from capsid_protein_VP2__Norovirus__AGE89521
auggcaggagcauuuuuugcaggacuagcaagugauguacuagguucaggauuaggaucauuaauaaacgcaggugcaggagcaauuaaucaaaaaauagauuucgaaaacaauagaaaacuacaacaaguaaguuuucaauuuaguucaaaccuacaacaagcaucauuccaacacgauaaagaaaugcuacaagcacaaauagaagcaacaaagaaauuacaacaagaaaugaugaaaguaaaacaagcaauguuacuagaaggcggauucucagaaacggacgcagcucgaggcgcaauaaaugcaccuaugacaaaaguacuagauuggucaggcacaagauacugggcaccagaugcaagaacaacaacauacaacgcaggaagauucucaacaccacaaccaaguggaaccuuaccaggaagaauaaauccaagaacaccaacaccagcaagaggaaguucaucaacaagcucaaacgcaagcacagcaacaagcauacacucaaaucaaacagugucaacacguuuaggaucaacagcaggaucaggaacaaaugugagcucacucccauccacagcaagaacuagaagcuggguagaagaucaaaacagaaauuuaaguccauuuaugagaggagcacauaacauaagcuuuguaacaccaccaagcucaagaucaaguucacaaggaacaguaagcacagucccaaaagaaguauuagauucauggacaggagcguucaauaccagaagacaaccacuauucgcccacauaagaagaagaggagaaucaagaguauaa

SEQ ID NO: 35158 - RNA, 807 nt, Artificial Sequence
  derived and/or modified sequence opt6 from capsid_protein_VP2__Norovirus__AGE89524
auggcaggugcauucuuugcaggacuagcaagugauguauuaggcucaggauugggaucacuaauaaacgcaggagcaggagcaaucaaucaaaaaauagauuuugaaaacaauagaaaauuacaacaagcgaguuuucaauuuagcucaaaccuacaacaagcuucuuuccaacaugauaaagaaauguuacaagcacaaauagaagcgacaaaaaaacuacaacaagaaaugaugaaaguaaaacaagcaauguuacuagagggaggauuuucagaaacggaugcagcaagaggagcaaucaaugccccaaugacaaaaguacuagauuggucgggaacaagauauugggcaccagaugccagaacaacaaccuauaacgcaggcagauucucaacaccacaaccaagcggaacauuaccagguagaauaaacccaagaacaccaacaccagcaagaggaagcucaagcacaucaucaaacgcaagcacagcaacaaguauacacucaaaccaaacaguaagcacacgauuaggaucaacagcaggaucaggcacaaacguaagcucauuaccaagcacagccaggacaagaagcuggguagaagaccaaaaccgaaacuuaucaccguucaugagaggagcacauaacauaagcuuugucacaccaccaagcucaagaucaaguucacaagguacaguaaguacaguaccaaaagaagucuuagacucauggacgggagccuucaauaccagacgacagccacuauucgcacacauaagaagaagaggagaaucaagaguauaa

SEQ ID NO: 35159 - RNA, 807 nt, Artificial Sequence
  derived and/or modified sequence opt6 from capsid_protein_VP2__Norovirus__AGE89530
auggcaggagcuuucuucgcaggacucgcuagcgauguacugggaucaggauuaggaucacuaauaaacgcaggagcaggagcaauaaaccaaaaaauagauuucgaaaacaauagaaaacuccaacaagcaaguuuccaauucagcucaaaccuacaacaagcaucauuccaacaugauaaagaaauguugcaagcacaaauagaagcgaccaaaaaauuacaacaagaaaugaugaaaguaaaacaagcaaugcuauuagaaggaggauucucagaaacagaugcugcaagaggagcuauaaacgcuccaaugacaaaaguauuagacugguccggaacuagauauugggcaccagaugcaagaacaacaacauacaacgcaggaagguucucaacaccgcaaccaaguggaacacuaccaggaagaacaaacccaagaacaccaacaccagcacgaggaaguucaagcacaagcucaaacgcaaguacagcaacaaguauauauucaaaccaaacaguaaguacaagacuaggaucaacagcaggaucaggaacaaacguaucaucacuaccaaguacugcaagaaccagaagcuggguagaagaccaaaacagaaacuuaucaccauuuaugagaggagcacauaacauaagcuuuguaacaccaccaaguucaagaucaaguucacaaggaacaguaaguacaguaccaaaagaaguauuagacucauggacaggagcauucaauacaagaagacaaccauuauucgcacacauaagaagaagaggagaaucaagaguauaa

SEQ ID NO: 35160 - RNA, 807 nt, Artificial Sequence
  derived and/or modified sequence opt6 from capsid_protein_VP2__Norovirus__AGE89533
auggcaggagcauucuucgcaggauuagcaagcgauguauuaggaucaggauuaggaucacuaauaaacgcaggagcaggagcaauaaaccaaaaaauagacuuugaaaacaacagaaaacuacaacaagcaucauuccaauucuccuccaaccuacaacaagcaucauuccaacacgacaaagaaaugcuacaagcacaaauagaagcaacaaaaaaacuacaacaagaaauaaugaaaguaaaacaagcaaugcuauuagaagguggauucuccgaaacagacgcagcaagaggcgcaauaaaugccccaaugacaaaaguacuagacuggucaggaacaagauauugggcaccagaugcaagaacaacaacauacucagcaggucgauuuucaacaccacaaccaucaggaacacuaccaggaagaauaaacccaagaacgccaacaccagcaagaggcucauccucaacauuuucaaacgcaucaacagcaacaucaauacacucaaaccaaacaguaucaacaagauuaggcuccacagcaggaucaggaacgaacguaucaucauuaccaucuacagcaagaacaagaucauggguagaagaccaaaacagaaaccuaagcccauucaugagaggagcacacaauauaagcuucguaacaccaccaucaucuagaucaagcucacaaggaacaguaucaacaguaccaaaagaaguauuagacuccuggacaggagcauucaacacaagaagacaaccacuauucgcccacauaagaagaagaggagaaucacgaguauaa

SEQ ID NO: 35161 - RNA, 807 nt, Artificial Sequence
  derived and/or modified sequence opt6 from capsid_protein_VP2__Norovirus__AGE89536
auggcaggagcauucuucgcaggacuagcaagugacguauuaggaucggguuuaggaucgcuaauaaacgcaggagcaggcgcaauaaaucaaaaaauagauuucgaaaauaauagaaaauuacaacaagcauccuuucaauuuagcucaaauuuacaacaagcaucauuucaacacgauaaagaaauguuacaagcacaaauagaagcaacaaaaaaauuacaacaagaaaugaugaaagucaaacaagcaauguuacuagaaggaggauuuucagaaacagacgcagcaagaggagcgauaaacgcaccaaugacaaaaguacuagauuggucaggaacaagauauugggcacccgaugcaagaaccacaacauauaacgcaggccgauucucuacaccacaaccaagcggaacacuucccggaagaauaaacccaagaacaccaacaccagcgagagggagcucgaguacaucaucaaacgcaagcacagcaacaagcauauacucaaaccaaacaguaagcacaagauuaggaucaaccgcaggaucaggaacaaacguaagcucacuaccaucaacagcaaggacaagaucauggguagaagaccaaaacagaaacuuaaguccauuuaugagaggagcacacaauauaucauuuguaacacccccaagcucuagaucaucaucacaagggaccguaagcacagucccaaaagaagucuuagauucauggacaggagcauucaacaccaggagacaaccuuuauuugcacauauaagaagacgaggagaaucucgaguauaa

SEQ ID NO: 35162 - RNA, 807 nt, Artificial Sequence
  derived and/or modified sequence opt6 from capsid_protein_VP2__Norovirus__AGE89539
auggcgggagcauucuuugccggacuagcuagcgaugucuuaggaucaggccuaggaucacuaauaaaugcaggagcgggagcgauuaaucaaaaaauagauuucgaaaacaauagaaaacuacaacaagcaagcuuucaauuuagcucaaacuuacaacaagcaucauuccaacacgauaaagaaaugcuacaagcacaaauagaagcaacaaaaaaauuacaacaagaaaugaugaaaguaaaacaagcaauguuauuagaaggcggauucucagaaacagacgcagcaagaggagcaauaaaugcaccaaugacaaaaguauuagauuggucaggaacaagauacugggcaccagaugcaagaaccacaacauacaacgcaggaagauuuucaacaccacaaccuagcggaacacuaccaggaagaauaaacccacgaacaccaacaccagcaagaggaaguucaucaacaucaucaaacgcaagcacagcaacaucaauauacucaaaucaaacaguaucaacaagacuaggaucaacagcagguucaggaacaaacguaaguucguuaccaagcacggcaagaacaagaucauggguagaagaccaaaacagaaauuuaagcccauucaugagaggagcccauaacauaagcuuuguaacacccccaagcucaagaucuagcucucaaggaacaguaagcacaguuccaaaagaaguacuagauucauggacaggagcauucaauacaagaagacaaccacuauucgcacacauaagaagaagaggagaaucgagaguauaa

SEQ ID NO: 35163 - RNA, 807 nt, Artificial Sequence
  derived and/or modified sequence opt6 from capsid_protein_VP2__Norovirus__AGE89542
auggcaggagcauucuuugcaggacuugcaagugauguauuaggaucuggauuaggaucccucauaaacgcaggcgcaggugcaauaaaucaaaaaauagauuucgaaaacaauagaaaacuacaacaagcaucauuucaauuuaguucaaacuugcaacaagcaucauuccaacacgacaaagaaauguuacaagcacaaauagaagcaaccaaaaaauuacaacaagaaaugaugaaaguaaaacaagcaauguuacuagaaggaggauucucugaaacagacgcagcaagaggagcaauaaaugcaccgaugacaaaaguacuugauuggucaggaacaagauauugggcaccagaugcccgaacuacaacauauaacgccggaagauucucaacaccacaaccuucaggaacauuacccggaagaauaaauccaagaacaccaacaccagcaagaggaagcucaucaacaagcucuaacgcaagcacagcaacaaguauauacucuaaccaaacaguaagcacaagauuagguucaacagcaggcuccggaacaaacguaaguucacucccaagcacagcaagaacaagaagcuggguagaagaccaaaacagaaacuuaagcccauucaugcgaggagcacauaauauuagcuuuguaacaccaccaucaucaagaucaucaucucaaggaacaguuagcacaguaccaaaagaaguacuagauucauggacaggagccuucaacacaaggagacaaccauuauucgcacauauaagaagaagaggagaaucacgaguauaa

SEQ ID NO: 35164 - RNA, 807 nt, Artificial Sequence
  derived and/or modified sequence opt6 from capsid_protein_VP2__Norovirus__AGE89545
auggcuggagcauuuuuugcaggacuagcaagcgauguccuaggcucaggauuaggaucccuaauaaacgcaggagcaggagcaauaaaucaaaaaauagacuucgaaaacaauagaaaacuacaacaagcaagcuuucaauucucaucaaacuuacaacaagcaucguuccaacaugacaaagaaauguuacaagcacaaauagaagcaacaaaaaaacuacaacaagaaaugaugaaagucaaacaagcaaugcuacuagaaggaggauucucagaaacagacgcagcaagaggcgcaauaaaugcaccaaugacaaaaguucuagauuggucaggaacaagauauugggcaccagaugccagaacaacuacauauaacgcaggccgauucucaacuccacaaccaucaggaacccuaccaggaagaauuaacccaagaacacccacaccagcucgaggauccucaagcacguccucuaacgcaagcacagcaacaagcauauacucgaaccaaaccguuagcacaagacuaggaucaacagcaggaucugguacaaacguaagcucauuaccaagcaccgcaagaacaagaagcuggguagaagaccaaaacagaaacuuaaguccauucaugagaggagcacauaauauaagcuuugucacaccaccaucaucaagaucaaguucacaaggaacaguaaguacaguaccaaaagaaguacuagacucauggacaggagcauucaauacaaggcgacaaccauuauucgcacacauaagaagaagaggagaaucaagaguauaa

SEQ ID NO: 35165 - RNA, 807 nt, Artificial Sequence
  derived and/or modified sequence opt6 from capsid_protein_VP2__Norovirus__AGE89548
auggcaggagcauucuucgcaggauuagcaucagauguauuaggaucuggacuaggaucacuaauaaacgccggcgcaggagcaauaaaucaaaaaauagacuuugaaaacaauagaaaauuacaacaagcaagcuuccaauucagcucaaaccuacaacaagcauccuuccaacaugacaaagaaauguuacaagcacaaauagaagcaaccaaaaaauuacaacaagaaaugaugaaaguaaaacaagcaauguuauuagaaggaggauucucagaaacagacgcagcaagaggagcaauaaaugcaccaaugacaaaaguacuagauuggucaggaacaagauauugggcacccgacgccagaauaacaacauacaacgccggacgauucucuacaccacaaccuaguggaacacuaccagguagaauaaaccccagaacuccaacaccugcaagaggauccucaagcacaucaucaaacgcaagcacagccacaucaauacacucaaaccaaacaguaucaacaagacuaggaucgacagcaggcucaggcacaaacguaagcucacucccaucaacagcaagaacuagaaguuggguagaagaucaaaacagaaaccuaaguccauucaugagaggagcacauaacauaucauucguaacaccaccaagcucaagaucaagcucacaaggaacaguaucaacaguaccaaaagaaguacuagacucauggacaggagcauuuaauaccagaagacaaccacuauucgcacacauaagaagaagaggagaaucacgcguauaa

SEQ ID NO: 35166 - RNA, 807 nt, Artificial Sequence
  derived and/or modified sequence opt6 from capsid_protein_VP2__Norovirus__AGE89551
auggcaggcgcauuuuuugcaggacuagcaagcgauguauuaggaucaggauuaggaucgcuaauaaacgcaggagcuggagcaauaaaccaaaaaauagauuucgaaaacaaucgcaaauuacaacaagcaaguuuucaauuuagcucaaacuuacaacaagcaucauuccaacacgauaaagaaauguuacaagcacaaauagaagcaacaaaaaaacuacaacaagaaaugaugaaaguaaaacaagcuaugcuacucgaaggaggguucucagaaacagacgcggcacgaggagcaauaaaugccccaaugacaaaaguucuagacuggucaggaacaagauauugggcgccagaugcaagaaccacaaccuauaacgcaggaagauucucgacaccacaaccgucaggaacauuaccaggaagaauaaacccacgaacucccacaccagccagaggaaguucaucaacaagcucaaaugccagcacagcaacuaguauacauucaaaccaaacaguaagcacaagauuaggaucaacagcaggcucaggcacaaacguaaguucacuaccaaguacagcacgaacaaggucauggguagaagaccaaaacagaaauuuaaguccguucaugagaggagcacauaacauaagcuuuguaacaccaccaagcucacgaucaaguucacaaggaacaguaagcacaguaccaaaagaaguauuagacucauggacaggugcauuuaauacaagacgacaacccuuauucgcacauauacgaagaagaggugaaucacgcguauaa

SEQ ID NO: 35167 - RNA, 807 nt, Artificial Sequence
  derived and/or modified sequence opt6 from capsid_protein_VP2__Norovirus__AGE89554
auggcaggagcauucuuugcaggacuagcaagugaugucuuaggaucaggacuaggaucacuaauaaacgcaggcgcaggagcaauaaaucaaaaaauagacuucgaaaacaaucgcaaauuacaacaagcaagcuuucaauucaguucaaaccuacaacaagcaucauuccaacaugauaaagaaauguuacaagcacaaauagaagcaacaaaaaaauuacaacaagaaaugaugaaaguaaaacaagcaauguuacuagaaggcggauuuuccgaaacagacgcagcaagaggagcaauaaaugcaccaaugacaaaaguauuagauugguccggaacaagauauugggcaccagaugccagaacaacaacauauaacgcaggcagauucucagcaccacaaccgagcggaagcuuaccaggaagaauaaacccuagagcaccaacaccagcaagaguaagcucgagcacaaguucaaacgcaagcacaguaacaagcauauacucaaaccaaacaguaucaaccagauuaggaucaacugcaggaucaggcacaaauguaaguucacuaccaagcacugccagaacaagaagcuggguagaagaccaaaacagaaacuugaguccguucaugagaggagcccauaacauaagcuuuguaacaccaccuagcucaagaucaagcucgcaaggaacaguaaguacaguaccaaaagaaguuuuagacucauggacaggagcauucaauacaagaagacaacccuuauucgcacacguaagaaggagaggagaaucgcgaguauaa

SEQ ID NO: 35168 - RNA, 807 nt, Artificial Sequence
  derived and/or modified sequence opt6 from capsid_protein_VP2__Norovirus__AGE89557
auggcaggagcauucuuugcaggauuagcaagugauguacuaggcucgggauuaggaucauuaauaaacgcaggcgcaggagcaauaaaucaaaaaauagauuucgaaaauaauagaaaauuacaacaagcaagcuuucaauuuagcucaaauuugcaacaagcaucauuccaacacgauaaagaaaugcuacaagcacaaauagaagcaacaaaaaaauuacaacaagaaaugaugaaagucaaacaagcaauguuacuagaaggaggauucucagaaacagacgcagcaagaggcgcaauaaaugcaccaaugacaaaaguacuagauuggucaggaacaagauauugggcaccagaugcaagaacaacaacauauaacgcaggaagauucucgacaccacaaccaaguggaacacuaccaggaagaauaaauccacgaacaccaacaccagcacgugggagcucaagcacaagcucaaacgcaaguacagcaacaagcauauauucaaaccaaacagugagcacaagacuaggaucaacagcaggaucaggaacaaacguaagcucguuaccaagcacagcaaggaccagaaguuggguagaagaccaaaaccgaaacuuaagcccauucaugagaggagcacauaauauuagcuuuguaacaccaccaaguucaagaucaaguucacaaggaacaguaaguacaguaccgaaagaagucuuagacucauggacaggagcauucaauaccagacgacaaccauuauucgcacacauaagaagaagaggagaaucaagaguguaa

SEQ ID NO: 35169 - RNA, 807 nt, Artificial Sequence
  derived and/or modified sequence opt6 from capsid_protein_VP2__Norovirus__AGE89560
auggcaggagcauuuuuugcaggacuagcaagugauguauuaggauccggauuaggaucacucauaaaugcaggagcaggagcaauaaaucaaaaaauagauuuugaaaauaaucgaaaauuacaacaagcaaguuuucaauuuucaucaaauuuacaacaagcaucauuccagcacgauaaagaaaugcuacaagcacaaauagaagcaacaaaaaaauuacaacaagaaaugaugaaagucaaacaagcaauguuauuagaaggcggauuuucagaaacggacgcagcaagaggcgcaauaaaugcaccgaugacgaaaguacuagauuggucaggcacaagauauugggcaccagaugcaagaacaacaacauauaacgcgggaagauucucuacaccacaaccaagcggaacauuacccggaagaauaaacucaagaacaccaacaccagcgagaggaaguucaaguacaagcucaaacgcaagcacagcaacaagcauauacucaaaccaaacaguaagcacaagauugggauccacagcagguucgggaacaaacguaagcucacuaccaagcacugcaagaacaagaaguuggguagaagaccaaaauagaaaccuaaguccauucaugagaggggcacauaacauaucauuuguaacaccaccgagcucaagaucaaguucacaaggaacaguaucaacaguaccaaaagaaguauuagacucauggacaggagcguucaauacaagaagacaaccuuuauucgcacacauaagaagaagaggagaaucaagaguauaa

SEQ ID NO: 35170 - RNA, 807 nt, Artificial Sequence
  derived and/or modified sequence opt6 from capsid_protein_VP2__Norovirus__AGE89563
auggcaggagcauucuucgcaggacuagcaucagauguacuaggcucaggacuaggaucauuaauaaacgcaggagcaggagcaauaaaccaaaaaauagacuuugaaaacaauagaaaacuacaacaagcaucauuccaauucagcucaaacuuacaacaagcaucauuucaacacgacaaagaaaugcuacaagcacaaauagaagcaacaaaaaaacuacaacaagaaaugaugaaaguaaaacaagcaauguuacuugaaggaggauucucagaaacagacgcagcaagaggcgcaauaaaugcaccaaugacaaaaguacuagauugguccggaacaagauacugggcaccagaugcaagaacaacaacuuauaacgccggcagauucucaacaccacaaccuagcggaaugcuaccaggcagaauaaacccaagaacaccaaccccagcaagaggaucaucaaguacaucauccaacgcaaguacagcaaccagcauacacuccaaccaaacaguauccaccagauuaggaucaacagcaggaucaggaacaaacguauccucauuaccuuccacagcaagaaccagaucauggguagaagaccaaaacagaaaccuaaguccauuuaugagaggagcccauaauauaagcuucguaacaccaccaucaucacgcucaagcucacaaggaaccguaagcacagucccaaaagaaguauuagacucauggacaggagcuuuuaacacaagaagacaaccacuauucgcacacauaagaagaagaggagaaucaagaguauaa

SEQ ID NO: 35171 - RNA, 807 nt, Artificial Sequence
  derived and/or modified sequence opt6 from capsid_protein_VP2__Norovirus__AGE89566
auggcaggagcauucuuugcaggacuagcaagugauguauuaagcucaggauuaggcucauuaauaaaugcaggagcaggcgcaauaaaucaaaaaauagauuucgaaaacaauagaaaacuacaacaagcaagcuuccaauuuaguucaaaccuacaacaagccucauuccaacaugauaaagaaaugcuacaagcacaaauagaagcaacaaaaaaauuacaacaagaaaugaugaaaguaaaacaagcaaugcuacuagaaggaggauuuucagaaacagacgcagcaagaggagcaauaaaugcuccaaugacaaaaguacuagauuggucaggaacacgauauugggcaccagaugcaagaacaacaacauauaacgcaggcagauucucaacaccacaaccgagcggaacauuaccaggaagaauaaacccaagaauaccaacaccagcaagaggaucaucgagcacaagcucaaacgcaagcacagccacaucaauauacucaaaccaaacaguaaguacuagauuaggcucaaccgcaggaucaggcacaaacguaagcucucuaccaaguacggcuagaacaagaaguuggguagaagaccaaaaccgaaaccuaaguccguucaugagaggagcacauaacauaagcuuuguaacaccacccaguucaagaucaagcucacaaggaacaguaaguacagucccaaaagaaguacuagacucauggacaggagcauuuaauacaagacgucagccauuauucgcacacauaagaagaagaggagaaucgcgaguuuaa

SEQ ID NO: 35172 - RNA, 807 nt, Artificial Sequence
  derived and/or modified sequence opt6 from capsid_protein_VP2__Norovirus__AGE89569
auggcaggagcauucuuugcaggauuagcaagcgauguauuaggaucaggauuaggaucacuaauaaacgcaggagcaggagcaauaaaucaaaaaauagauuucgaaaacaauagaaaacuacaacaagcaagcuuucaauucagcucuaacuuacaacaagcaucauuccaacacgauaaagaaaugcuacaagcacaaauagaagcaacuaaaaaauuacaacaagaaaugaugaaaguaaaacaagcaaugcuacucgaaggaggauucucagaaacagacgcagccagaggcgcaauaaaugccccaaugacaaaaguacuagauuggucaggaacaagauauugggcaccagaugcaagaacaacaacuuauaacgcaggaagauucucaacaccccaaccaagcggaacauuaccaggacgcauaaacccgagaacaccaacaccagcgagaggaagcuccaguacaaguucaaacgcguccacagcaacaucaauauauucaaaccaaacagugucaacaagacuaggaucaaccgcaggaaguggaacaaacguaagcucguuaccgagcacagcaagaacaagauccuggguagaagaucaaaacagaaaccuaagcccauucaugagaggagcacauaacaucagcuuuguaacgccaccaagcucaagauccagcucacaaggaacaguaagcacgguaccaaaagaaguauuggacucauggacaggagcauuuaacacuagaagacaaccauuauucgcacauauaagaagaagaggugaaucaagaguguaa

SEQ ID NO: 35173 - RNA, 807 nt, Artificial Sequence
  derived and/or modified sequence opt6 from capsid_protein_VP2__Norovirus__AGE89572
auggcaggagcauuuuuugcaggacuagcaagugacguacuaggaucaggauuaggcucauuaauaaacgcaggagcaggagcaauaaaucaaaaaaucgacuuugaaaacaauagaaaauuacaacaagcaaguuuucaauuuagcucaaaccuacaacaagcaucauuccaacacgauaaagaaauguuacaagcucaaauagaagcaaccaaaaaacuacaacaagaaaugaugaaaguaaaacaagcaauguuacucgaaggaggauucucagaaacagaugcagcaagaggagcaauaaaugcaccaaugacuaaaguacuagauuggucaggaacaagauauugggcaccagaugcaagaacaacaacauauaacgcaggaagauucucaacaccacaaccaagcggaacauuaccaggaagaauaaauccaagaacaccaacacccgcaagagggucaucuaguacuucaucaaaugcaagcacagcaacaagcauauacucaaaccaaacaguaagcacaagauuaggaucaaccgcaggaucagguacgaacguaagcucucuuccaagcacagcaagaacaagaagcuggguagaagaucaaaacagaaacuuaaguccguucaugagaggagcacauaacauaagcuuuguaacaccaccaaguucaagaucgaguucccaaggaacaguaaguacagucccaaaagaaguauuagacucauggacaggugcguuuaauaccagaagacaaccauuauucgcacacauaagaagaagaggagaaucuagaguauaa

SEQ ID NO: 35174 - RNA, 807 nt, Artificial Sequence
  derived and/or modified sequence opt6 from capsid_protein_VP2__Norovirus__AGE89578
auggcaggagcauucuuugcaggacuagcgagcgauguauuaggaucagguuuaggcucacuaauaaacgcaggagcaggagcaauaaaccaaaaaauagauuucgaaaacaauagaaaacuacaacaagcaaguuuucaauuuagcucaaacuuacaacaagcaucauuccaacacgauaaagaaauguuacaagcacaaauagaagcaacaaaaaaauuacaacaagaaaugaugaaaguaaaacaagcaauguuauuagaaggaggauucucagaaacagacgcagcuagaggagcaauaaacgcaccuaugacaaaaguauuagacuggaguggaacgcgauauugggcaccagaugcaaggacaacaaccuauaacgcaggaagauucucaacaccacaaccaucaggaacacuacuagaaagaguaaauccaagaacaccaacaccagcaagaggaagcucaaguacaaguucaaacgcaagcacagccacaagcauacacucaaaccaaacaguaagcacacgacuaggaucgacagcaggaucaggaacaaacguaaguucacuaccaagcacagcaagaacaagaaguuggguagaagaccaaaacagaaacuuaaguccauucaugagaggagcucacaacauaaguuuuguaacgccaccaagcucaagaucauccucacaaggaacaguaaguacaguaccaaaagaaguauuagacucauggacaggagcauucaauacaagaagacaaccacuauucgcacacauaagaagaagaggugaaucacgaguauaa

SEQ ID NO: 35175 - RNA, 807 nt, Artificial Sequence
  derived and/or modified sequence opt6 from capsid_protein_VP2__Norovirus__AGE89581
auggcaggagcauucuucgcaggacuugcauccgacgucuuaggaucaggauuaggaucacuuauaaaugcaggagcaggcgcaauaaaccaaaaaauagacuucgaaaacaauagaaaacuacaacaagcaucauuccaauucagcuccaacuuacaacaagcaucuuuucaacacgacaaagaaauguuacaagcacaaauagaagcgacaaaaaaacuacaacaagaaguaaugaaaguaaaacaagcaauguuacuagaaggaggauucucagaaacagacgcagcaagaggagcaauaaacgcaccaaugacaaaaguacuagacuggucaggaacacgauacugggcccccgacgccagaacaacaacauauaaugcaggaagauucucaacaccacaaccauccggaacacuaccaggaagaauaaacccaagaacaccaacaccagcaagaggaucaucuucaacaagcuccaaugcaaguacagcaacaucaauauacuccaaucaaacuguaaguacaagacuaggcucaaccgcaggaucaggaacaaauguaucaucacuaccaucaacagccagaacacgaagcuggguagaagaccaaaacagaaaccuaucaccauucaugagaggcgcccacaacauaagcuuuguaacaccacccucaucaagaucaagcucacaaggaaccguaucaacaguaccaaaagaaguacuagauucauggacaggcgcauucaacacaagaagacaaccacuauucgcacacauacgaagaagaggagaaaguagaguauaa

SEQ ID NO: 35176 - RNA, 807 nt, Artificial Sequence
  derived and/or modified sequence opt6 from capsid_protein_VP2__Norovirus__AGE89587
auggcaggagcauucuucgcaggacuagcaucagacguacuaggaucaggauuaggaucuuuaauaaacgcaggagcaggagcaauaaaccaaaaaauagacuuugaaaacaaccgaaaacuacaacaagcaagcuuccaauucagcucaaacuuacaacaagcaucauuccaacaugacaaagaaauguuacaagcacaaauagaagcaaccaaaaaacuacaacaagaaaugaugaaaguaaaacaagcaaugcuauuagaaggaggauucucagaaacagacgcagcaagaggcgccaucaacgcaccaaugacaaaaguauuagauuggucaggaacaagauacugggcaccagacgcaagaacaacaaccuacaacgcaggaagauucucaacaccacaaccaagcggcaugcuaccaggaagaauaaacccaagaacaccaacuccagcaagaggaucaucaucaacauccucaaacgcaucaacagcaacaaguauacacucaaaccaaacaguaagcacaagacuaggaucaaccgcgggaucaggaacaaacgucucaucacucccaagcacagcaagaacaagaucauggguagaagaccaaaacagaaaccuaucaccauucaugagaggagcucacaacauaagcuucguaacaccaccaucaucaagaagcagcucacaaggaacaguaagcacaguaccaaaagaaguauuagacucauggacaggagcauucaacacaagaagacaaccacuauucgcacacauaagaagacgaggagaaucaagaguauaa

SEQ ID NO: 35177 - RNA, 807 nt, Artificial Sequence
  derived and/or modified sequence opt6 from capsid_protein_VP2__Norovirus__AGE89590
auggcgggagcauucuuugccggacucgcaagcgauguauuaggaucaggauuaggaucgcuaauaaacgcuggagcaggagcaauaaaucaaaaaauagauuuugaaaacaauagaaaacuacaacaagcaucauuucaauuuagcucaaacuuacaacaagcaucauuccaacaugauaaagaaauguuacaagcacaaauagaagcaacaaaaaaauuacaacaagaaaugaugaaagucaaacaagcaauguuacuagaaggaggauucucagaaacagacgcagcaagaggagcaauaaaugcaccgaugacgaaaguacucgauuggucaggcacgcgauacugggcaccagaugcacgaaccacaacauauaacgcagguagauucucgacaccacaaccaagcggaaccuuaccagaaagaguaaacccaagaacacccacaccagcaagaggaucaucaucaacaaguucaaacgcaagcacagcaacuagcauacauucaaaccaaacaguaucaacacgauuaggcucaacagcgggaucaggcacaaacguaagcucucuaccaagcacagcaagaacaagaaguuggguagaagaccaaaacagaaauuuaaguccauucaugagaggagcacacaauauaagcuucgucacaccaccaagcucaagaucaagcucacaaggaacaguaagcacaguaccaaaagaagucuuagacucguggacaggcgcauuuaauacaagaagacaacccuuauucgcacacauaagaagaagaggagaaucaagaguauaa

SEQ ID NO: 35178 - RNA, 807 nt, Artificial Sequence
  derived and/or modified sequence opt6 from capsid_protein_VP2__Norovirus__AGE89593
auggcaggcgcauuuuuugcaggauuagcaagcgauguauuaggaucaggauuaggcucacuaauaaaugcaggcgcaggagcaauaaaucaaaaaauagauuucgaaaacaauagaaaacuacaacaagcaucauuucaauuuaguucaaauuugcaacaagcaucauuccaacacgauaaagaaauguuacaagcacaaauagaagcaacaaaaaaauuacaacaagaaaugaugaaaguaaaacaagcaaugcuacuugaaggaggauucucagaaacagacgcagcaagaggagcaauaaaugcaccaaugacaaaaguauuagauuggucaggaacaagauauugggcaccagaugcaagaacaacaacauauaacgcaggaagguucucgacaccacaaccaaguggaacauuaccuggaagaauaaacccgcgaacaccaacaccagcaagagggagcucaagcacaaguucaaacgcgagcacagcaacaagcauacacucaaaccaaaccguaagcacaagauuagguucgacagcaggaucgggaacaaauguaagcucacuaccaaguacagcaagaacaagaaguuggguagaagaucaaaacagaaacuugucaccauucaugcgaggggcacacaacauaagcuuuguaacaccaccaaguucaagaucaagcagucaaggaacugugaguacaguaccaaaagaaguauuagacucguggacaggcgcauucaauacuagacgacaaccauuauucgcacacauaagaagaagaggggaaucuagaguauaa

SEQ ID NO: 35179 - RNA, 807 nt, Artificial Sequence
  derived and/or modified sequence opt6 from capsid_protein_VP2__Norovirus__AGE89596
auggcaggcgcauucuuugcaggacucgcaagcgauguauuaggcucaggccuaggaucacuaauaaaugcaggagcaggagcaauaaaucaaaaaguagaauucgaaaacaauagaaaauuacaacaagcaagcuuucaauuuagcucuaaccuacaacaagcaucauuccaacacgauaaagaaauguuacaagcucaaauagaagcaacaaaaaaauuacaacaagaaaugaugagaguaaaacaagcaauguuacuagaaggcggauucucugaaacagacgcugcaagaggagcaauaaaugccccaaugacaaaaacacuagauuggucuggaacaagauauugggcgccagacgcaagaacaacaacauauaacgcaggaagauucucaaccccacaaccaagcggagcauuaccaggaagagcgaacuuaagagcaacaguaccagcuagaggaagcucaagcacaagcucgaauucaaguauagcuacaucaguauacucaaaccaaacaacaaguacgagauuaggaucaacagcaggaucuggaacaaguguaaguucacuuccaagcacagcaagaaccagaagcuggguagaagaucaaaacagaaacuuaaguccauucaugagaggagcacauaacauaaguuucguuacaccaccaucaucaagaucaaguucacaaggaacaguaagcacagucccaaaagaaguauuagacucauggacaggcgcuuuuaauacaagaagacaaccacuauucgcacacauaagaaaaagaggagaaucaagaguauaa

SEQ ID NO: 35180 - RNA, 807 nt, Artificial Sequence
  derived and/or modified sequence opt6 from capsid_protein_VP2__Norovirus__AGE89599
auggcaggagcauucuuugccggacuagcaagugacguacuaggaucaggauuaggaucauuaauaaacgcaggagcaggcgcaauaaaucaaaaaaucgauuuugaaaacaauagaaaauuacaacaagcaagcuuccaauuuucuucaaaccuacaacaagcaucauuccaacacgauaaagaaaugcuacaagcacaaauagaagcaacaaaaaaauuacaacaagaaaugaugaaaguaaaacaagcaauguuauuagaaggaggauucuccgaaacagacgcagcaagaggagcaauaaacgcaccaaugacaaaaguauuagacuggucaggaacacgcuacugggcaccagacgcuagaacaacaacauacaacgcaggaagauucucaacaccacaaccaagcggaacauuaccaggaagaacaaacccaagaacaccaacaccagcacgaggaaguucaucaauaucaucuaacgcgaguacagcaacaagcauacacucuaaccaaacaguaagcacaagacuagguucaaccgcaggaucagguacaaacguaucaucacuaccaagcacagccagaacaagaagcuggguagaagaccaaaacagaaacuuaaguccuuucaugagaggagcacauaacauaagcuucguaacaccaccaaguucaagaucaagcucacaaggaacaguaagcacaguaccaaaagaaguuuuagacucuuggacaggagcauucaauacaaggagacaaccauuauucgcacauauaagaagaagaggagaaucaagaguauaa

SEQ ID NO: 35181 - RNA, 807 nt, Artificial Sequence
  derived and/or modified sequence opt6 from capsid_protein_VP2__Norovirus__AGE89602
auggcaggagcauucuuugccggacuagcaagcgacguauuaggaucaggacuaggcucacucauaaacgcgggagcaggagcaauaaaucaaaaaauagauuucgaaaacaauagaaaacuacaacaagcaagcuuucaauuuagcucaaacuuacaacaagcaucauuccaacacgauaaagaaauguuacaagcgcaaauagaagcaacaaaaaaacuacaacaagaaaugaugaaaguaaaacaagcaauguuguuagaaggaggauucucagaaacagacgcagcuagaggugcaauaaaugcaccaaugacaaaaguacuugacuggucaggcacaagauacugggcacccgaugcaagaacaacaacauacaacgcaggaagauucucaacaccacaaccaagcggaacacuaccaggaagaauaaacccaagaacacccacaccagcacgcggaagcucaagcacaaguucaaaugcaagcacagcaacaaguauacacucaaaccaaacagcuagcacaagauuaggaucaacagcaggaucaggaacgaauguaagcucacuaccaagcacagcaagaacaagaagcuggguagaagaccaaaacagaaacuuaagcccauucaugagaggagcacauaauauaaguuuuguaacgccaccgagcucacgaucaaguucacaaggaacaguaaguacaguaccaaaagagguauuagacucguggacgggagcauucaauacacgaagacaacccuuauucgcucacauacgaagaagaggagaaucaagaguauaa

SEQ ID NO: 35182 - RNA, 807 nt, Artificial Sequence
  derived and/or modified sequence opt6 from capsid_protein_VP2__Norovirus__AGE89605
auggcaggagcauucuuugccggacuagcaagcgauguccuaggaucaggauuaggaucacucauaaacgcaggagcaggagcaauaaaucaaaaaauagauuucgagaauaauagaaaauuacaacaagcaagcuuucaauuuaguucuaacuuacaacaagcaucauuccaacacgauaaagaaaugcuacaagcacaaauagaagcaaccaaaaaacugcaacaagaaaugaugaagguaaaacaagcuauguuacuagaaggaggauucucagaaacagacgcagcaagaggagcaauaaacgcaccaaugacgaaaguacuagauuggucaggaacacgauacugggcaccagaugcaagaacaacaacauauaacgcaggaagauucucaacaccacaaccaucaggaacauuacccggaagaauaaacccaagaacaccaacacccgcuagaggcagcucaagcacaagcucaaacgcaagcacagcaacaagcauacacucgaaccaaacaguaagcacaagacuaggcucaaccgcaggaucaggaacaaacguaaguucauuaccaagcacagcaagaaccagaaguuggguagaagaccaaaacagaagcuuaagcccauucaugagaggagcacauaacauaucauuuguuacaccaccgagcucaagaucaagcucacaaggaacagucagcacaguaccaaaagaaguacuugacuccuggacaggagcauucaauacaagaagacaaccauuauucgcgcacauaagaagaagaggagaaucaagaguauaa

SEQ ID NO: 35183 - RNA, 807 nt, Artificial Sequence
  derived and/or modified sequence opt6 from capsid_protein_VP2__Norovirus__AGE89608
auggcaggagcauucuucgccggauuagcaagcgauguauuaggaucaggauuaggaucacuaauaaaugcaggagcaggagcaauaaaucaaaaaauagacuucgaaaacaauagaaaacuucaacaagcaagcuuucaauuuaguucgaaucugcaacaagcaucauuucaacacgauaaagaaauguuacaagcacaaauagaagcaacaaaaaaacuacaacaagaaaugaugaaaguaaaacaagcaaugcuacuagaaggaggauucucagaaacagacgcagcccgaggagcaauaaaugcaccaaugacaaaaguacuugauuggucaggaacaagauauugggcacccgaugcaagaacaacaacauauaacgcgggaagauuuucaacaccacaaccaagcggaacauuaccaggaagaauaaauccaagaacacccacaccagcaagaggaaguucaaguacauccucaaacgcaaguacagcaacaagcauucacucaaaucaaacaguaaguacacgacuaggauacacagcagguucaggcacaaacguaagcuccuuaccaaguacagcaagaacacgaagcuggguagaagaucaaaauagaaguuuaagcccauucaugagaggagcacauaacauaaguuuuguaacaccaccaagcucaagaucaucaucacaaggaacaguaagcacagucccaaaagaaguauuagauucuuggacaggagcauucaauacaagaagacaaccacuauuugcacacauaagaagaagaggagaaucaagaguauaa

SEQ ID NO: 35184 - RNA, 807 nt, Artificial Sequence
  derived and/or modified sequence opt6 from capsid_protein_VP2__Norovirus__AGE89611
auggcaggagcauuuuucgccggacuagcaagugauguacuaggaucaggcuuaggaucauuaauaaacgcaggagcaggagcaaucaaucaaaaaauagacuucgaaaacaauagaaaauuacaacaagcaagcuuccaauucaguucaaaccuacaacaagcaucauuccaacacgacaaagaaaugcuacaagcacaaauagaagcaacaaaaaaauuacaacaagaaaugaugaaaguaaaacaagcaauguuacuagaaggaggauuuucagaaacagacgccgcaagaggagcaaucucagcaccaaugacaaaaguacuagauuggucaggaacaagauacugggccccagaugcacgaacaacaacauacaacgcaggaagauucucaacuccacaaccaagcggaaccuuaccaggaagaauaaacccacgaacuccaacaccagcaagaggaagcucaaguacaagcucaaacgcacccacagcaacaucaauauacuccaaccaaacaguaucaacaagacuaggauccacagcaggaucaggaacuaacguaagcucacuaccaagcacagcaagaacaagauccuggguagaagaccaaaauagaaaccuaagcccauucaugcguggagcacauaacauuucauucguaacuccaccaaguucacgaucaagcucucaaggaacaguaucaacuguaccaaaagaaguauuagacucauggacaggagcauucaauacaagacgacaaccauuauucgcacacauaagaagaagaggagaaucaagaguauaa

SEQ ID NO: 35185 - RNA, 807 nt, Artificial Sequence
  derived and/or modified sequence opt6 from capsid_protein_VP2__Norovirus__AGE89614
auggcgggcgcauucuucgcaggacuagcaagcgacguacuaggaucaggauuaggaucacuaauaaacgcaggagcaggagcaauuaaucaaaaaauagacuucgaaaacaauagaaaacuacaacaagcaaguuuucaauuuaguucaaacuuacaacaagcaucauuccaacacgauaaagaaauguuacaagcacaaauagaagcaacuaaaaaacuacaacaggaaaugaugaaaguaaaacaagcaauguuacuagaaggaggauucucagaaacagacgcagcaagaggagcaauaaaugcuccaaugacaaaaguacuugauuggucaggaacacgauauugggcacccgaugcaagaacaacaacauauaacgcaggcagauucucaacaccgcaaccaagcgaaacacuaccagggagaauaaacccgagaacaccaacuccagcaagaggaagcucaagcacaagcucaaacgcaaguacagccacaucaauacacucaaaccaaacaguaucaacaagauuaggaucaaccgcaggcucaggaacaaauguaucaucauuaccaagcacagcaagaacaagaaguuggguagaagaccaaaacagaagcuuaagcccauucaugagaggggcacauaacauaagcuuuguaacucccccaagcucaagaucaaguucacaaggaacaguaaguacaguaccaaaagaaguauuagacucguggacaggagcguucaauacuagaagacaaccccuauucgcacacauaagaagaagaggagaaucaagaguauaa

SEQ ID NO: 35186 - RNA, 807 nt, Artificial Sequence
  derived and/or modified sequence opt6 from capsid_protein_VP2__Norovirus__AGE89617
auggcaggcgcauucuucgcaggacuagcaucagauguauuaggaucaggcuuaggcucauuaauaaacgcaggagcaggcgcaauaaaucaaaaaguagaauucgaaaacaauagaaaauuacaacaagcaagcuuucaauuuagcucaaacuuacaacaagcaucguuccaacacgauaaagaaauguuacaagcgcaaauagaagcaacaaaaaaauuacaacaagaaaugaugagaguaaaacaagcaaugcuauuagaaggaggauucucagaaacagaugcggcaagaggagcaauuaaugcaccaaugacaaaaacacuagauuggucaggaacaagauauugggcaccagaugcaagaacaacaacauauaacgcaggaagauucagcacaccacaaccaagcggagcacugccaggaagagcgaacuuaagagcaacaguacccgcaagaggaagcucaagcacuucaucaaacucuaguauagccacaagcguauacucaaaucaaacaacaagcacaagauuaggaucaacagcaggaucaggaacgagcgugagcagucuaccaagcacagcaagaacaaggagcuggguagaagaccaaaacagaaaccuaaguccauucaugagaggagcccauaacauaagcuuuguaacgccaccaucaucgagaucgagcucacaaggaaccguaagcacaguaccaaaagaaguauuagacucguggacaggcgcauucaauacaagaagacaaccauuauucgcucacauaagaaaacgaggagaaucgagaguauaa

SEQ ID NO: 35187 - RNA, 807 nt, Artificial Sequence
  derived and/or modified sequence opt6 from capsid_protein_VP2__Norovirus__AGE89620
auggcaggagcauucuuugcaggauuagcaagugauguauuaggaucaggauuaggaucguuaauaaacgcaggagcaggugcaauuaaucaaaaaauagauuucgaaaacaauagaaaauuacaacaagcgaguuuucaauuuagcucaaaccuacaacaagcaucauuccaacacgauaaagaaauguuacaagcacaaauagaagcaaccaaaaaauuacaacaagaaaugaugaaagucaaacaagcuauguuacuagaaggaggauucucagaaacagacgcugcaagaggagcaauaaaugccccaaugacaaaaguacuagacuggucaggaaccagauauugggcaccagaugcaagaacaacaacauauaaugcaggccgauucucaacaccucaaccaagcggaacauuaccaggaagaguaaacccuagaacaccaacacccgcaagaggaucaucaucaacaaguucaaacgcaagcauagcaacaucaauauacucuaaccaaacaguaucaacaagacuaggaucaacagcaggcucaggaacgaacguaagcucacuaccaagcacagcaagaacaagaagcuggguagaagaccaaaacagaaauuuaucuccauucaugagaggagcacauaacauaagcuuuguaacacccccaagcucaagaucgagcucacaaggaacaguaagcacagucccaaaagaaguauuagacucuuggacaggcgcauucaauaccagaagacaaccacuauucgcacacauacgaagaagaggagaaucaagaguauaa

SEQ ID NO: 35188 - RNA, 807 nt, Artificial Sequence
  derived and/or modified sequence opt6 from capsid_protein_VP2__Norovirus__AGE89623
auggcaggagcauuuuuugcaggauuagcaucagacguuuuaggaucaggacuaggaucacuaauaaacgcaggcgcaggagcaaucaaucaaaagguugaauuugaaaacaacagaaaacuacaacaagcaucauuucaauuuaguucaaacuuacaacaagcaaguuuccaacacgauaaagaaauguuacaagcacaaauagaagcaacaaaaaaacuacaacaagaaaugaugagaguaaaacaagcaauguuacuagaaggaggauucucagaaacagacgcagcacgaggagcaauaaacgcaccaaugacaaaaacgcuagacuggucaggaacaagauauugggcaccagaugcaagaacaacaacauauaaugcaggaagguucucaacaccacaaccaagcggagcauuacccggaagagcaaauuuaagagcaacaguaccagcaagaggaagcuccagcacauucucuaacucaaguauugcaacuaguguauacucaaaucaaacaacaagcacgagauuaggaucaacagcaggaucaggaacaagcguaucaucacuaccaagcacagcaagaacaagaagcuggguagaagaucaaaacagaaacuuaagcccauucaugagaggagcccauaacauaagcuauguaacaccaccaaguucuagaucaagcucacaaggaacaguaucaacaguaccaaaagaaguauuagacucauggacaggagcauucaauacaagaagacaacccuuauuugcucacauaagaaaacgaggagaaucacgaguauaa

SEQ ID NO: 35189 - RNA, 807 nt, Artificial Sequence
  derived and/or modified sequence opt6 from capsid_protein_VP2__Norovirus__AGE89626
auggcaggagcauuuuucgcaggacuagcaagcgauguauugggaucaggcuuaggaucauuaauaaacgcaggagcaggagcaauuaaucaaaaaguagaauucgaaaacaauagaaaacuacaacaagcaagcuuccaauuuagcucaaacuuacaacaagccucauuccaacacgauaaagaaauguuacaagcacaaauagaagcaacaaaaaaauuacaacaagaaaugaugagaguuaaacaagcaauguugcuagaagguggauuuucagaaacagacgcagcaagaggagcaauaaaugcaccaaugacaaaaacacuugauuggucgggaacccgauacugggcacccgaugcaagaacaacgacauauaacgcaggaagguuuucaacuccccaaccaaguggagcacuaccuggaagagcaaaccuaagagcaacaguaccagcaagaggaagcucaagcacauuuucaaacucaagcauagcaacaaguguauacucaaaccagacaacaaguacaagauuaggcucaacugcaggaucaggaacuaguguaagcucgcuaccaaguacagcaagaacaagaagcuggguagaagaccaaaauagaaaccugagcccauucaugagaggagcacauaacauaaguuuuguaacaccaccaagcucaagaucaagcucgcaaggaacaguaagcacaguaccaaaagaaguauuagauucauggacaggagcauucaauaccagacgacaaccauuauucgcacacauaagaaaaagaggagaaucaagaguauaa

SEQ ID NO: 35190 - RNA, 807 nt, Artificial Sequence
  derived and/or modified sequence opt6 from capsid_protein_VP2__Norovirus__AGE89629
auggcaggagcauucuuugccggacuagcaagugauguauuaggcucaggauuaggaucgcuaauaaacgcaggagcaggagcaaucaaucaaaaaguagaauucgaaaacaauagaaaacuacaacaagcaagcuuucaauuuaguucgaacuuacaacaagcaucauuucaacacgauaaagaaaugcuacaagcacaaauagaagcaaccaaaaaauuacaacaagaaaugaugagaguaaaacaagcuauguuacuagaagguggauucucagaaacagacgcagcaagaggagcaauuaaugcaccaaugacaaaaacacucgauuggucaggaacaagauauugggcaccagaugcaagaacaacaacauauaacgcaggaagauucucuacaccacaaccaagcggagcacuacccggaggagcaaacuugcgagcaacaguaccagcaagaggaaguucaaguaccuucucaaacucaaguauagcaacaaguguauacucaaaucaaacaacaagcacaagauuagguucaacagcaggaucaggaacaucaguaaguucauuaccgaguacagcaagaacuagaagcuggguagaagaccaaaacaggaauuuauccccauuuaugaggggagcacauaacauaagcuuuguaacaccaccaagcucaagaaguaguucacaaggaacaguaucaacaguaccaaaagaaguacuagacucauggacaggcgcauucaauacaagaagacaaccauuauuugcacacauaagaaaaagaggagaaucaagaguauaa

SEQ ID NO: 35191 - RNA, 807 nt, Artificial Sequence
  derived and/or modified sequence opt6 from capsid_protein_VP2__Norovirus__AGE89635
auggcaggagcauucuucgcaggauuagcuucagauguauuaggaucagguuuaggaucccuaauaaaugccggagcaggagcaauaaaccaaaaaauagauuucgaaaacaauagaaagcuccaacaagcaaguuuucaauucaguucaaauuuacaacaagcuucauuccaacacgauaaagaaaugcuacaagcacaaauagaagcaaccaaaaaauuacaacaagaaaugaugaaagucaaacaagcaauguuacuagaaggaggauucucagaaacagacgcagcaagaggagcaauaaaugccccaaugacaaaaguccuagacuggucaggaacacguuacugggcaccagacgcaagaacaaccacauacaacgcaggaagauucucaacaccacaaccaucaggaacacuaccaggaagaauaaacccaagaacaccaacaccugcuagaggaagcucaaguacaucaucuaacgcauccacagccacaucaauacacucaaaccaaacaguaagcacaagauuaggaucuacagcaggaucaggaacuaacguaucaucauuaccaucaacagcaagaacaagaagcuggguagaagaccaaaacagaaacuuauccccauuuaugcgaggagcacacaacauaucauuuguaacgcccccaagcucaagaucaucaucacaaggaacaguaucaaccguuccaaaagaaguauuagacucauggacaggagccuucaacacaagaagacaaccauuauucgcacacauaagacgaagaggagaaucgagaguuuaa

SEQ ID NO: 35192 - RNA, 807 nt, Artificial Sequence
  derived and/or modified sequence opt6 from capsid_protein_VP2__Norovirus__AGE89638
auggcaggagcauucuucgcaggacuagcaucagacguauuagguucaggauuaggauccuuaauaaacgcaggagcaggcgcaauaaaccaaaaaauagauuucgaaaacaacagaaaacuacaacaagcaucauuucaauucagcucaaacuuacaacaagccucauuccaacacgacaaagaaaugcuacaagcacaaauagaagcaacaaaaaaauuacaacaagaaaugaugaaaguaaaacaagcaauguuauuagaaggaggauucucagaaacugacgccgcaagaggagcaauaaacgcaccaaugacaaaaguacuagacugguccggaacacgauacugggcaccagacgcaagaacaacaaccuacaacgcaggaagauucuccacaccacaaccauccggaacacuacccggaagaauaaacccaagaacaccaacaccagcccgcggaucaucaucaacaaguucaaacgccagcacagccacaucaauacaccuaaaucaaacaguaucaacaagacuaggcucaacagcaggaucaggaacaaacguaaguucacuaccaucaacagcuagaaccagaucauggguagaagaccaaaacagaaaccuaucaccauucaugagaggagcacauaacauaucauuugucacaccaccaucaucccgaucaucaucacaaggaacaguaagcacaguaccaaaagaaguccuagacucauggacaggagcauucaacacaagacgccaaccacuauucgcacacauaagaagacgaggagaaucaagaguauaa

SEQ ID NO: 35193 - RNA, 807 nt, Artificial Sequence
  derived and/or modified sequence opt6 from capsid_protein_VP2__Norovirus__AGE89641
auggcaggcgccuucuuugcaggacuagcaagugacguauuaggaucaggauuaggaucccuaauaaacgcaggagcaggagcaauaaaucaaaaaauagauuucgaaaauaauagaaaacuacaacaagcaagcuuucaauuuagcucgaacuuacaacaagcaucauuccaacacgauaaagaaaugcuacaagcacaaauagaagcaacaaaaaaauuacaacaagaaaugaugaaaguaaaacaagcaaugcuacuagaaggaggauucucggaaacagacgcagcaagaggagcgauaaaugcaccaaugacaaaaguauuagauuggucaggaacaagauauugggcaccagaugcaagaacaacaacauauaacgcaggaagauucucaacaccacaaccaaguggaacccuaccaggaagaauaaacccgagaacaccaacaccagcgagaggaucauccagcacaaguaguaacguaagcacagcaacaagcauauacucgaaucaaacuguaagcacaagauuaggaucaaccgcaggauccggaacaaacguaagcucacuaccaagcacugcaagaacaagaagcuggguagaagaucaaaauagaaaccuaagcccauuuaugcgaggagcacauaacauaaguuuuguaacaccaccgucaucaagaucaagcucacaaggaaccguaagcacaguaccaaaagaaguauuagacucuuggacaggagcauuuaauacaagaagacaaccauuauuugcacacauaagaagaagaggagaaucacgaguauaa

SEQ ID NO: 35194 - RNA, 807 nt, Artificial Sequence
  derived and/or modified sequence opt6 from capsid_protein_VP2__Norovirus__AGE89644
auggcaggagcauucuuugccggacuagcaagugauguauuaggaucuggauuaggaucauuaauaaaugcaggagcgggcgcaauaaaccaaaaaauagacuucgaaaauaauagaaaacuacaacaagcaaguuuucaauuuucaucaaauuuacaacaagcaucguuccaacacgacaaagaaauguuacaagcacaaauagaagcaacaaaaaaacuacaacaagaaaugaugaaaguaaaacaagcgauguuacuagaaggaggauucucagaaacagaugcagcuagaggagcaauaaaugccccaaugacaaaaguacuagauuggucaggaacaagauauugggcaccagaugcaagaacaacaacauauaacgcaggaagauucucaacaccacaaccaaguggagcauuaccaggaagaauaaacccgagaacaccaacaccagcaagaggaucaucgagcacaagcucaaacgcgagcacagcaacaagcauacacucaaaccaaaccguaaguacgagacuaggaucaacagcaggaucaggaacaaacguaaguggacuaccaucaacagcaagaacaagaagcuggguagaagaccaaaacagaaacuuaagcccauucaugagaggagcacauaauauaagcuuuguaacaccaccaaguucaagaucaaguucgcaaggaacaguaaguacaguaccaaaagaaguauuagacucauggacaggagcauucaauacaagacgacaaccacuauucgcacacauaagaagaagaggggaaucaagaguauaa

SEQ ID NO: 35195 - RNA, 807 nt, Artificial Sequence
  derived and/or modified sequence opt6 from capsid_protein_VP2__Norovirus__AGE89647
auggcaggagcauucuucgcaggacucgcaucagacguacuaggaucaggacuaggaucauuaauaaaugcaggagcaggcgcaauaaaccaaaaaauagacuucgaaaacaacagaaaacuacaacaagcaucauuccaauucucaucaaaccuacaacaagccucuuuucaacacgacaaagaaauguuacaagcacaaauagaagcuacaaaaaaacuacaacaagaaaugaugaaaguaaaacaagcaaugcuccuagaaggaggauucucagaaacagacgcagcaagaggagcaaucaacgcaccaaugacaaaaguauuagacuggucaggaacaagauacugggcaccagacgcuagaacaacaacauacaaugcaggaagauucucaacaccucaaccaagcggaacacuaccaggaagaauaaacccaagaacacccacaccagcaagaggaagcucaagcauaucauccaacgcaucaacagcuacaucaauacauucaaaccaaacaguaucaacacgacuaggaucaacagcuggcucaggaacaaacguaucaucauucccaaguacagcaagaacaagaucauggguagaagaccaaaacagaaaccuaucaccauucaugagaggagcccauaacauaucauucguaacccccccaucaucacgaucaaguucacaaggaacaguaucaacaguaccaaaagaaguucuagacucauggacaggagcauucaauacaagaagacaaccauuauucgcacacauaagaagaagaggagaaucaagaguauaa

SEQ ID NO: 35196 - RNA, 807 nt, Artificial Sequence
  derived and/or modified sequence opt6 from capsid_protein_VP2__Norovirus__AGE89650
auggcgggagcauuuuuugcaggacuagcaagugauguauugggaucaggauuaggcucacuaauaaaugcaggcgcaggagcaauaaaucaaaaaauagauuucgaaaacaauagaaaacuccaacaagcaaguuuucaauuuaguucaaacuuacaacaggcaucauuccaacacgacaaagaaauguugcaagcacaaauagaagcaacaaaaaaacuacaacaagaaaugaugaaaguaaaacaagcaauguuauuagaaggaggauucucagaaacagacgcagcaagaggagcaauaaaugcaccaaugacaaaagugcuagacuggucaggaacaagauauugggcaccagaugcaaggacaacaacauauaacgcgggaagauuuucaacaccacaaccaagcggaauguuacccggucgcauaaauccacgaacaccaacacccgcaagaggaaguucaagcacaaguucaaacgcaucaacagcaacaagcauacacucaaaccaaacaguaagcacaagauuaggaagcacagcaggaucggguacaaacguaaguucacuaccaucaacagcaagaacaagaagcuggguagaagaccaaaacagaaauuuaaguccauucaugagaggagcacauaacauaagcuucguaacaccaccaagcucacgaucaagcucacaaggaacagugucaacaguaccaaaagaaguauuagauucauggacaggagcauucaauacaagaagacaaccauuauucgcacacauaagaagacgaggagaaucaagaguauaa

SEQ ID NO: 35197 - RNA, 807 nt, Artificial Sequence
  derived and/or modified sequence opt6 from capsid_protein_VP2__Norovirus__AGE89653
auggcaggagcuuucuucgcaggacuagcaagcgauguacuaggaucaggauuaggaucacucauuaacgcuggagcaggcgcaauaaaucaaaaaguagaauucgaaaacaauagaaaacuacaacaagcaaguuuccaauuuucaucaaacuuacaacaagcaucauuccaacacgacaaagaaaugcuacaagcacaaauagaagcaaccaaaaaauuacaacaagaaaugaugagaguaaaacaagcaauguuacucgaaggaggauucuccgaaacugacgcagcaagaggugcaauaaaugcaccaaugacaaaagcucuagauuggucaggaacucgauauugggcaccagaugcaagaacaacaacauauaacgcgggccacuucucaacaccacaaucaagcggagcacuaccaggaagagcaaacuuaagagcugcaguaccagcaagaggaagcucaucaacaucaucaaauucuucaacagcaacuagcguauacucaaaccaaacaauaagcacaagauuaggaucaacagcaggaucaggcacaagcguuaguucacuaccaucaacagcaagaacaagaagcuggguagaagaccaaaacaggaaccuaucaccauucaugagaggugcacauaacaucaguuuuguaacaccaccuagcucaagaccaagcucacaaggaacaguaucaacaguaccaaaagaaguauuagacucauggacaggagcauucaauacaaggagacaaccauuauuugcacacauaagaaaaagaggagaaucaagagcauaa

SEQ ID NO: 35198 - RNA, 807 nt, Artificial Sequence
  derived and/or modified sequence opt6 from capsid_protein_VP2__Norovirus__AGE89656
auggcaggagcauucuuugcaggucuagcaagcgacgucuuaggaucaggacuaggaucauuaauaaacgcaggcgcaggagcuauaaaucaaaaaauagauuucgaaaacaauagaaaauuacaacaagcaagcuuucaauuuagcucaaacuuacaacaagccucauuccaacacgacaaagaaauguuacaagcacaaauagaagcaacaaaaaaacuacaacaagaaaugaugaaaguaaaacaagcaauguuacuagagggaggauucucagaaacagacgcagccagaggagcaaucaaugcacccaugacaaaaguacuagacuggucaggaacacgauauugggccccagaugcaagaacaacaacauauaacgccggaagauucucaacaccacaacccucaggaacucuuccaggacgaauaaacccacgaacaccaacaccagcaagagguucauccaguacaagcucaaacgcaagcacagcaacaagcauauacucaaaccaaacaguaagcacaagauuaggaucaacagcaggaaguggaacaaacguaagcucacuacccaguacagcacgaacacgaagcugggucgaagaccaaaauagaaacuuaucaccauucaugagaggagcacauaauauuagcuuuguaacaccaccaagcucaagaucaagcucacaagguacaguaagcacgguaccaaaagaaguacuagacucauggacaggcgcauucaauacaagaagacaaccauuauucgcacacauaagaagaagaggagaaucacgaguauaa

SEQ ID NO: 35199 - RNA, 807 nt, Artificial Sequence
  derived and/or modified sequence opt6 from capsid_protein_VP2__Norovirus__AGE89659
auggcgggagcauuuuuugcaggauuagcaagugacguauuaggaucaggccuaggaucacuaaucaacgcaggagcaggagcaauaaaucaaaaaaucgauuucgaaaacaauagaaaacuacaacaagcaucauuucaauuuagcucaaaccuacaacaagcaucauuccaacacgauaaagaaauguuacaagcacaaauagaagcaaccaaaaaauuacaacaagaaaugaugaaaguaaaacaagcaauguuacuagaaggaggauucucagaaacagacgcagcaagaggagcaauaaacgcaccaaugacaaaaguacuagauuggucaggaacgagauauugggcacccgacgcacgaacaacaacauauaacgcaggaagauucaguacaccacaacccagcggaacauuaccaggaagaauaaacccacgaauaccaacaccagcaagaggaagcucaaguacaagcucaaacgcaaguacagcaacaagcauauacucaaaccaaacaguaaguacaagauuaggaucagccgcaggcucaggaacaaacguauccucacucccaucaacagcuagaacaagaaguuggguagaagaccaaaacagaaaccuaagcccauucaugagaggagcacauaacauaagcuucguaacaccaccaaguucaagaucaagcucacaaggaacuguaagcacaguaccaaaagaaguuuuagacucauggacaggugcauucaauacaagaagacaaccauuauucgcacacauacgaaggagaggagaaucucgaguauga

SEQ ID NO: 35200 - RNA, 807 nt, Artificial Sequence
  derived and/or modified sequence opt6 from capsid_protein_VP2__Norovirus__AGE89662
auggcaggagcuuucuuugcaggacucgcaagcgauguacuuggaucaggacuaggaucauuaauaaacgcaggagcaggagcaauaaaucaaaaaauagacuuugaaaauaacagaaaacuccaacaagcaaguuuucaauuuagcucaaacuuacaacaagcaucguuccaacaugauaaagaaauguuacaagcacaaauagaagcaacaaaaaaacuacaacaagaaaugaugaaaguaaaacaagcaaugcuauuagaaggaggauucucagaaacagacgcagcaagaggagcaauaaaugcaccaaugacaaaaguacuagauuggucaggaacaagauauugggcaccagaugcaagaacaacaacauauaacgcaggaagauucucaacaccacaaccaucaggaacauuaccaggaagaauaaauccacgaacgccaacaccagcaagaggaagcucaaacacaagcucuaacgcaucaacagcaacaagcauacacucaaaccaaacaguaagcacaagacuaggaucaacagcgggcucaggaacaaacguaagcucacuaccaucaacagcaagaacaagaaguugggucgaagaccaaaacagaaaccuaagcccauucaugagaggagcacauaacauaagcuuugucacaccaccaagcucaagaucaaguucgcaaggaacaguaaguacaguaccaaaagaagucuuagacucguggacaggagcauucaauacaagacgacaaccauuauucgcacacauacgaaggagaggggaaucuagaguauaa

SEQ ID NO: 35201 - RNA, 807 nt, Artificial Sequence
  derived and/or modified sequence opt6 from capsid_protein_VP2__Norovirus__AGE89665
auggcaggagcauucuucgcaggacuagcaagcgauguauuaggaucaggauuaggcucauuaauaaacgcgggagcaggagcaauaaaucaaaaaauagauuucgaaaauaauagaaaauuacaacaagcaucauuucaauuuagcucaaaccuacaacaagcaucauuccaacacgauaaagaaauguuacaagcacaaauagaagcaaccaaaaaauuacaacaagaaaugaugaaaguaaaacaagcaauguuacuagaaggcggauucucagaaacagacgcagcaagaggagcaauaaacgcaccaaugacaaaaguacuagacuggucaggaacaagauacugggcaccugaugcaaggaccacgacauauaacgcaggaagauuuucaaccccacaaccaagcgggacuuuaccaggaagaguaaacccaagaacaccaacaccagcaagaggaagcucaaguacaaguucaaacgcaucaauagcaacaaguauauacucaaaccaaacaguaaguacaagauuaggaucaaccgcaggaucaggaacaaacguuagcucacuaccaaguacagcaagaacaaggaguuggguagaagaucagaauagaaacuuaagcccauucaugcgaggagcccauaacauaagcuuuguaacaccaccaagcucaagaucaaguucacaaggaacaguaaguacaguaccaaaagaaguauuagacucauggacaggagcauucaauacaagaagacaaccauuauuugcacacauaagaagacgaggagaaucuagaguauga

SEQ ID NO: 35202 - RNA, 807 nt, Artificial Sequence
  derived and/or modified sequence opt6 from capsid_protein_VP2__Norovirus__AGE89668
auggcaggagcauucuuugcaggucuagcaagugauguauuaggaucaggacugggcucauuaauaaacgcaggagcaggagcaauaaaucaaaaaaucgauuucgaaaacaauagaaaauuacagcaagcaagcuuucaauuuagcucaaacuuacaacaagcaucauuccaacaugauaaagaaauguuacaagcacaaauagaagcaaccaaaaaauuacaacaagaaaugaugaaaguaaaacaagcaauguuacuagaaggaggauucucugaaacagaugcggcaagaggagcaaucaacgcaccaaugacaaaagugcuagauuggucgggcacgcgauauugggcgccagaugcaagaacaacaacauauaacgcaggaagauucucgacaccucaaccauccgggacauuaccaggaagaauaaacccaagaacaccaacacccgcgagaggaagcucaaacacaaguucaaacgcaagcacagcaacaaguauacacucgaaccaaacaguaaguacaagacuaggaucaaccgcaggcaguggaacaaauguaagcucguuaccaucaacagcaagaacaagaagcuggguagaagaucaaaacagaaacuuaagcccauucaugcgcggagcacacaacauaaguuuuguaacaccaccaaguucaagaucaagcucacaaggaacaguaaguacaguaccaaaagagguccuagacucauggacaggagcauucaacacaagaagacaaccacuauucgcucauauaagaagaagaggagaaucaagaguauaa

SEQ ID NO: 35203 - RNA, 807 nt, Artificial Sequence
  derived and/or modified sequence opt6 from capsid_protein_VP2__Norovirus__AGE89671
auggcaggagcauuuuucgcaggacuagcgucagacguauuaggcuccggauuaggaucacuaauaaacgcaggagcaggugcaauaaaucaaaaaauagauuucgaaaacaacagaaaacuccaacaagcaucauuucaauuuagcucaaaccuacaacaagcaucauuucaacacgauaaagaaaugcuacaagcacaaauugaagcaacaaaaaaacuacaacaagaaaugaugaaagucaaacaagcaauguuguuagaaggaggauucucagaaacagacgcagcaagaggagcaauaucagcaccaaugacaaaaguauuagauuggucaggaacaagauauugggcaccagacgcaagaacaacaacauacaacucaggaagauucucaacuccgcaaccaagcgguacacuaccaggaagaauaaacccaagaacacccacaccagcaagaggaagcucaucaacaaguucaaacgcgagcacggcaacaagcauacacuuaaaucaaacaguaagcacaagauuaggaucaacagcaggaucaggcacaaacguaagcucauuaccaagcaccgcaagaacaagaagcuggguagaagaccaaaacagaaauuuaaguccauucaugcgaggagcacauaacauaagcuuugucacaccaccaagcucaagaucaaguucacaaggaacaguaaguacaguaccaaaagaaauauuagacucaugggcaggagcauucaauacaagaagacaaccauuauucgcacacauaagaagaagaggagaaucaagaguauaa

SEQ ID NO: 35204 - RNA, 807 nt, Artificial Sequence
  derived and/or modified sequence opt6 from capsid_protein_VP2__Norovirus__AGE89674
auggcaggagcauucuuugcaggauuagcaagcgauguacuaggaucaggauuaggcucauuaauaaacgcaggagcaggagcaauaaaucaaaaaauagauuucgaaaacaauagaaaauuacaacaagcaagcuuucaauuuucaucaaaccuacaacaagcaucauuccaacacgauaaagaaauguuacaagcacaaauagaagcaacaaaaaaacuacaacaagaaaugaugaaaguaaaacaagcaaugcuacuagaaggaggauucagugaaacagacgcagcacgaggagcaauaaaugcaccaaugacuaaaguauuagacuggucgggaacacgcuauugggcaccagacgcaagaacaacaacauauaacgcaggccgauucucaacaccacaaccaagcggaacauuaccaggaagaauaaacccaagaacaccaaccccagcaagaggaaguucaaacacaagcucuaacgcaucaacagcaaccucaauacacucaaaccaaacaguuagcacaagacugggaucaacugcagguucaggaaccaacguaaguucacucccaagcacagcacgaacaagaucauggguagaagaccaaaacagaaacuuaaguccauucaugagaggagcacauaacauaaguuuuguaacaccuccaagcucaagaucuagcucacaaggaacaguaagcacaguaccuaaagaaguauuagacucauggacaggagcauucaacacaagaagacaaccauuauucgcacacauaagaagaagaggagaaucccgaguauaa

SEQ ID NO: 35205 - RNA, 807 nt, Artificial Sequence
  derived and/or modified sequence opt6 from capsid_protein_VP2__Norovirus__AGE99604
auggcaggagcauuuuucgcaggacuagcaagugacguauuaucaucaggauuaggaucacuaauaaacgcaggagccggagcaauaaaucaaaaaauagacuucgaaaacaaucgaaaauuacaacaagcaucauuccaauucucaucaaaccuacaacaagcaucauuucaacacgacaaagaaaugcuacaagcacaaauagaagcaacaaaaaaacuacaacaagaauuaaugaaaguaaaacaaacaauacuauuagaaggaggauucucagaaacagaugcagcaagaggagcaauaaacgcaccaaugacaaaagcauuagacuggucaggaacaagauacugggcaccagacgcaagaacuacaacauacaacgcaggacgauucuccacaccccaaccaucaggagcccuaccaggacgaauaaacccccgcacuccaauuccagcaagaggaucaccaucaauaucaucaaacgcaucaacagcaacaaguauacacucaaaccaaacagcaucaacaagacuaggaucaaccgccggaucaggaacuaacguauccucacuaccaucaacagccaggacacgaagcuggguagaagaccaaaacagaaauuuaucaccauucaugagaggagcacacaacauaucauucguuacaccaccaucaucaagaucaucaucacaaggaacaguaucaacaguaccaaaagacguauuagauucauggacaggagcauucaauaccagaagacaaccauuauucgcacacauaagaagaagaggagaaucaagaguauaa

SEQ ID NO: 35206 - RNA, 807 nt, Artificial Sequence
  derived and/or modified sequence opt6 from capsid_protein_VP2__Norovirus__AGE99607
auggcaggaccauucuuugcaggauuagcaagcgauguauuaggcucaggacuaggaucauuaauaagcgcaggagcaggagcaauaaaccaaaaaguagaauucgaaaauaacagaaaauuacagcaagcaagcuuucaauuuaguucaaaccuacaacaagcaucauuccaacacgauaaagaaaugcuucaagcacaaauagaagcaacacaaaaacuacaacaagaacuaaugaaaguaaaacaagcaguauuacuagaaggcggauucucaacaacagacgcagcaagaggagcaauaaaugcaccaaugacaaaagcacuagacuggucaggcacaagauauugggcacccgaugccagaauaacaaccuauaacgcaggaagauucucaacaccacaaccauuaggagcauuaccaggacgaacaaacccaagaguaccagcaucagcacgaucaucaccuaguucauuaucaaacgcgccaacugcaacaagcguauacucaaaccaaaccgcaagcacuagacuaggaucaucagcaggaucuggagcaggaguaagcucacuaccauccacagcaagaacaagaagcuggguagaagaccaaaacaaaaacuuaagcccauucaugaaaggagcauuaaauacaagcuuugucacaccaccaucaucgagaucuucaaaucaaggaacaguaucaacaguaccaaaagaaauauuagacucguggacaggagcauucaauacuagaagacaaccacuauuugcacacauaagaaaaagaggagaaucaagaguauaa

SEQ ID NO: 35207 - RNA, 807 nt, Artificial Sequence
  derived and/or modified sequence opt6 from capsid_protein_VP2__Norovirus__AGK36312
auggcaggcgcauucuuugcaggauuagcaagcgacguauuaggaucaggauuaggcucacuaauaaacgcaggagcaggagcaauaaaucaaaaaauagauuucgaaaacaauagagaacuacaacaagcaucauuucaauuuagcucaaacuuacaacaagcauccuuccaacacgauaaagaaauguuacaagcacaaauagaagcaacaaaaaaauuacaacaagaaaugaugaaaguaaaacaagcgaugcuacuagaaggaggauucucagaaacagacgcggcaagaggagcaauaaacgcaccaaugacaaaaguucuagauuggucaggaacacgauauugggcgccagacgcaagaacaaccacauacaacgcaggaagguuuucaacuccacaaccaagcggaacauuacccggaagaauaaacccaagaacaccaacaccagcacgaggaagcucaagcgcaagcucaaacgcaagcacagcaacaaguauauauucaaaccaaacaguaagcacaagauuaggaucaacagcaggcuccgguacaaacguaagcucgcuuccaagcacagcaagaaccagaagcuggguagaagaccaaaacagaaacuuaagcccauuuaugagaggagcucauaauauaaguuuuguaacaccaccaaguucaagaucaaguucacaaggaacaguaagcacaguaccaaaagaaguacuagacucauggacaggagcauucaauaccagaagacaaccacuauuugcgcacauaagaagaagaggagaaucaagaguauaa

SEQ ID NO: 35208 - RNA, 807 nt, Artificial Sequence
  derived and/or modified sequence opt6 from capsid_protein_VP2__Norovirus__AGK36315
auggcaggagcauucuuugcaggacucgcaagcgauguauuaggaucaggauuaggaucacuaauaaacgcuggagcaggagcgauaaaucaaaaaguagaauuugaaaacaacagaaaacuacaacaagcaaguuuccaauucagcagcaacuuacaacaagcaucauuccaacacgauaaagaaauguuacaagcacaaauagaagcaacaaaaaaauuacaacaggaaaugaugagaguaaaacaagcaaugcugcuagaagguggauucucugaaacagacgcagcgagaggcgcaauaaaugcaccaaugacaaaaacauuagauuggucaggaacaagauauugggcaccagacgcaagaacaacaacauauaaugcaggaagauuuucgacaccacaaccaagcggagcauuaccaggacgagcaaacuuaagagcaacaguaccagcaagaggaaguucaaguacaagcucaaacucaaguauagccacaucaguauacucaaaucaaacaacaagcacaagauuaggaucaacagcaggaucgggaacaagcguaaguucacuaccaagcacggcaagaacaagaaguugggucgaagaccaaaacagaaacuuaaguccauucaugagaggggcucauaacauaagcuuuguaacaccaccgaguucaagaucaagcucacaaggaacagugagcacaguaccaaaagaaguauuagacucauggacaggagcuuucaauacaagaagacaacccuuauucgcgcacaucagaaaaagaggggaaucuagaguauaa

SEQ ID NO: 35209 - RNA, 639 nt, Artificial Sequence
  derived and/or modified sequence opt6 from capsid_protein_VP2__Norovirus__AGM33209
auggcacaagcaauaauaggagcaauagcagcaucaacagcaggaucagcauuaggagcaggaauacaaguaggaggagaagcagcacuacaaucccaaagauaccaacaaaaccuacaacuacaagaaaauucauucaaacacgacagagaaaugauaggauaccaaguagaagcauccaaucaauuacuagcaaaaaaccuagcaacaagauacucauuauuaagagcaggaggacuaacaucagcagacgcagcaagaucaguagcaggagcaccaguaacaagaauaguagacuggaacggaguaagaguaucagcacccgaaucaucagcaacaacacuaagaucaggaggauucaugucaguaccaauaccauuugcuucaaaacaaaaacaaguacaaagcucaggaauaaguaacccaaauuacagcccaagcucaauaucaagaacaacaagcuggguagaaucacaaaacucauccagauucggaaaucuaucaccauaccacgcugaagcacuaaacacaguaugguuaacaccaccaggaucaacagcaucaucaacauuaucaucaguaccacgaggauacuuuaacacagauagacuaccacuauucgccaacaacagaagauaa

SEQ ID NO: 35210 - RNA, 639 nt, Artificial Sequence
  derived and/or modified sequence opt6 from capsid_protein_VP2__Norovirus__AGM33215
auggcccaagcaauaauaggagcaauagcagcaagcacagcaggcucagcauuaggagcaggaauacaaguaggaggagaagcagcacuacaaucacaaagauaccaacaaaaccuacaacuacaagaaaacucauucaaacaugacagagaaaugauaggauaucaaguagaagcaagcaaccaacuacuagcaaaaaaccuagcaacaagauacucauuacuaagagcaggaggacuaacaucagcagacgcagcaagaucuguagcaggaguaccaguaacaagaauagucgauuggaacggaguaagaguaucagcaccagaaucaucagcaacaacacuaagaucaggaggauuuaugagcguaccaauaccauucgcaucaaaacaaaaacaaguacaaucaucaggaauaagcaacccaaacuacagcccaucaagcauaucaagaacaacaucauggguagaaucacaaaacucaagcagauucggaaaccuaucaccauaccacgcagaagcacuaaauacaguauggcuaacaccacccggaucaacagcaucaaguacauuaucaucaguaccaagaggauacuucaacacagacagacuacccuuauucgcaaacaauagaagauaa

SEQ ID NO: 35211 - RNA, 639 nt, Artificial Sequence
  derived and/or modified sequence opt6 from capsid_protein_VP2__Norovirus__AGM33218
auggcacaagcaauaauaggagcaauagcagcaucaacagcaggaucagcacuaggagcaggaauacaaguaggaggagaagcagcacuacaaucccaaagauaccaacaaaaccuacaacuacaagaaaacucauucaaacacgacagagaaaugauaggauaccaaguagaagcaucaaaccaauuacuagcaaaaaaccuagcaacaagauauucauuauuacgagcaggaggacuaacauccgcagacgcagccagaagcguagcaggagcacccguaacaagaauaguagacuggaacggaguuagaguaucagcaccugaaucaucagcaacaacacuaagaucaggaggauucaugucaguaccaauaccauucgcaucaaaacaaaaacaaguacaaucaucaggaauaucuaauccaaacuacaguccaucaucaauaucaagaacaacaucauggguagaaagucaaaauagcagcagauuuggaaauuuaucaccauaccacgcagaagcacuaaacacaguauggcuaaccccaccaggaucaacagcaucaucaacacuaucaucaguaccaagaggauacuucaacacagaccgacuaccauuauucgcaaacaacagaagauaa

SEQ ID NO: 35212 - RNA, 639 nt, Artificial Sequence
  derived and/or modified sequence opt6 from capsid_protein_VP2__Norovirus__AGM33221
auggcacaagcaauaauaggagcaauagcagcaucaacagcaggaucagcauuaggagccggaauacaaguaggaggagaagcagcacuacaaucacaaagauaccaacaaaaccuacaacuacaagaaaacucauucaaacacgacagagaaaugauaggauaccaaguagaagcaagcaaccaacuacuagcaaaaaaccuagcaacaagauacucacuauuaagagcagguggacuaacuucagcagacgcagcaagaagcguagcaggagcaccaguaacacgcauaguugacuggaacggaguaagaguaucagcaccagaaagcucagcaacaacauuacgaucaggaggcuucaugucaguacccauaccauucgcaucaaaacaaaaacaaguacaaucaucaggaauaaguaacccaaauuauucaccaucaucaauaucaagaaccacaucaugggucgaaagccaaaacucaucaagauucggaaaccuaucaccauaucacgcagaagcacuaaacaccguauggcuuacaccaccaggaucaaccgcaucaucaacacuaucaucaguaccccgaggauacuucaacacagacagacuaccacuauucgccaacaacagaagauaa

SEQ ID NO: 35213 - RNA, 639 nt, Artificial Sequence
  derived and/or modified sequence opt6 from capsid_protein_VP2__Norovirus__AGM33224
auggcacaagcaauaauaggagcaauagcagcaucaacagcaggauccgcacuaggagcaggaauacaaguaggaggagaagcagcauuacaaucacaaagauaccaacaaaaccuacaacuacaagaaaauucauucaaacacgacagagaaaugauaggcuaccaaguagaagcaucaaaccaacuauuagcaaaaaaccuagcaacacgauacucauuacuaagagcaggaggauuaacaucagccgacgcagccagaucaguagcaggaguaccaguaaccagaauaguagacuggaacggaguaagaguaucagcaccagaaucaucagcaacaacacuaagaucaggaggcuucaugucaguuccaauaccauucgcaucaaaacaaaaacaaguacaaucaucaggaauauccaaccccaacuacagcccaucaucaauaucaagaacaacaucauggguagaaucacaaaacucaucaagauucggaaaccuaucuccauaccacgccgaagcacuaaacacaguauggcuuacaccaccaggaucaacagcaucaucaacccuaucaucaguaccaagaggauacuucaacacagacagacuaccccuauucgcaaacaacagaagauaa

SEQ ID NO: 35214 - RNA, 639 nt, Artificial Sequence
  derived and/or modified sequence opt6 from capsid_protein_VP2__Norovirus__AGM33227
auggcccaagcaauaauaggcgcaauagcagcaagcacagcaggaucagcauuaggagcaggaauacaaguaggaggagaagcagcauuacaaagccaaagauaccaacaaaaucuacaacuacaagaaaacucauucaaacaugacagagaaaugauaggauaccaaguagaagcaaguaaccaauuauuagcaaaaaacuuagcaacaagauacucacuacuaagagcaggaggucuaacaucagcagacgcagcaagaagcguagcaggagcaccaguaacaagaauagucgacuggaacggaguaagaguaucagcaccagaaucaucagccacaacauuaagaucaggaggauucaugucaguaccaauaccauuugccucaaaacaaaaacaaguacaaucauccggaauaucuaacccaaacuacucaccaagcucaauaagcagaacaacaucauggguagaaucacaaaacucaucaagauucggaaacuuaucaccauaccacgcagaagcacuaaacacaguauggcuaacaccaccaggcagcacagcaucaucaacauuaaguucaguaccaagaggauacuucaacacagacagacuaccacuauucgcaaacaacagaagauaa

SEQ ID NO: 35215 - RNA, 639 nt, Artificial Sequence
  derived and/or modified sequence opt6 from capsid_protein_VP2__Norovirus__AGM33230
auggcacaagcaauaauaggagcaauagcagcaucaacagcaggaucagcacuaggagcaggaauacaaguaggaggagaagcagcauuacaaucacaaagauaccaacaaaaccuacaacuacaagaaaacucauucaaacacgacagagaaaugauaggauaccaaguagaagcaagcaaccaacuacuagccaaaaacuuagcaacaagauacucacuauuaagagcaggaggacuaacaucugccgacgcagcaagaaguguagcaggaguaccaguaacaagaauaguagacuggaacggcguaagaguaucagcaccagaaucaucagcaacaacauuaagaucaggaggauucaugucaguaccaauaccauucgcaucaaaacaaaaacaaguacaaagcucaggaauaagcaacccaaacuacucaccaucaucaauauccagaacaacaagcuggguagaaagccaaaacucaucaagauucggaaaccuaucaccauaccacgcugaagcacuaaacacaguauggcucacaccaccaggaucaacagcaucaucaacacuaagcucaguaccaagaggauacuucaauacagacagacuaccacuauucgcuaacaacagaagauaa

SEQ ID NO: 35216 - RNA, 639 nt, Artificial Sequence
  derived and/or modified sequence opt6 from capsid_protein_VP2__Norovirus__AGM33233
auggcacaagcaauaauaggagcaauagcagcaucaacagcaggaucagcauuaggagcaggaauacaaguaggaggagaagccgcauuacaaucacaaagauaccaacaaaaccuacaacuacaagaaaacucauucaaacacgacagagaaaugauaggauaccaaguagaagcaucaaaccaacuacuagcaaaaaacuuagcaacaagauacucacuauuaagagcaggcggacuaacaagcgcagacgccgcaagaucaguagcaggaguaccaguaacacgaauaguugacuggaauggaguaagaguaucagcaccagaaucaucagcaacaacacuaagaucaggaggauucaugucaguaccaaucccauucgcaucaaaacaaaaacaaauacaaucaucaggaauaagcaacccaaacuacucaccaucaucaauaucaagaacaacaagcuggguagaaucacaaaacucaucaagauucggaaaccuaucaccauaccacgcagaagcauuaaacacagucugguuaacaccaccaggaucaacugcaucaucaacauuaagcucaguaccaagaggauacuucaacacagacagacuaccacuauucgcaaacaaccgaagauaa

SEQ ID NO: 35217 - RNA, 639 nt, Artificial Sequence
  derived and/or modified sequence opt6 from capsid_protein_VP2__Norovirus__AGM33236
auggcacaagcaauaaucggugccauagcagcaucaacagcaggaucagcacuaggagcaggaauacaaguaggaggagaagcagcacuacaaucacaaagauaccaacaaaacuuacaacuacaagaaaacagcuucaaacacgacagagaaaugauaggauaccaaguagaagcaucaaaccaauuacucgcaaaaaaccucgcaacaagauacucauuacuaagagcaggaggacuaacaagugccgacgcagcaagaucaguagcaggagcaccagucacacgaauaguagacuggaacggaguaagaguaucagcaccugaaagcucagcaacaacacuaagaagcggaggauucaugucaguaccaauacccuucgcaucaaaacaaaaacaaguacaaucaucaggaauaaguaacccaaacuacuccccaucaucaauaucaagaaccaccucauggguagaaagucaaaacucaucaagauucggaaaccuaagcccauaccacgccgaagcccuaaacacaguaugguuaacaccaccaggaucaacagcaagcucaacucuaagcucaguaccaagaggauauuucaacacagacagauuaccacuauucgcaaacaauagaagauaa

SEQ ID NO: 35218 - RNA, 639 nt, Artificial Sequence
  derived and/or modified sequence opt6 from capsid_protein_VP2__Norovirus__AGM33239
auggcacaagcaauaauaggagcaauagcagcuucaacagcaggaucagcacuaggagcaggaauacaaguaggaggagaagcagcauuacaaucacaaagauaccaacaaaacuuacaacuacaagaaaacucauuuaaacacgacagagaaaugauaggauaccaaguagaagcaucaaaccaacuacuagcaaaaaaccuagcaacacgauacagccuacuaagagcaggaggccuaacaucagcagacgcagccagaucaguagcaggagcaccaguaacaagaauaguagacuggaacggaguaagaguaucagcaccagaaaguucagccacuacacuaagaucaggcggauucaugucaguaccaauaccauucgcaucaaaacaaaaacaaguacaaucaucaggaauaagcaacccaaacuacucaccaucaucaauaucaagaacaacaucauggguagaaucacaaaacagcucaagauucggaaaccuaucaccauaccacgcagaagcucuaaacacaguuuggcuaacaccaccuggaucaacagcuaguucaacauuaucaucaguaccaagaggauacuucaacacagacagacuaccacuauuugcaaauaacagaagauaa

SEQ ID NO: 35219 - RNA, 639 nt, Artificial Sequence
  derived and/or modified sequence opt6 from capsid_protein_VP2__Norovirus__AGM33242
auggcacaagcaauaauaggagcaauagcagcaucaacagcaggaucagcacuaggagcaggcauacaaguaggaggugaagcagcauuacaaucacaaagauaccaacaaaaccuacaauuacaagaaaacucauucaaacaugacagagaaaugauaggauaccaaguagaagccucaaaccaacuacuagcaaaaaauuuagcaaccagauacucauuacuacgagcaggaggauuaacaucagcagacgccgcaagaucaguagcaggagccccaguaacaagaauaguugacuggaacggaguaagaguaucagcaccagaaucaagugcaacaacacuaagaucaggaggauucaugucaguaccaauaccauucgcaagcaaacaaaaacaaguacaaagcucaggaauaagcaacccaaacuacucaccaucaucaauaucaagaacaacaucauggguagaaagccaaaacucaucaagauucggaaaccuaagcccauaccacgcagaagcacuaaacaccguaugguuaacaccaccaggaucaacagcauccuccacacuaucaaguguaccaagaggauacuucaacacagacagacuaccauuauucgcaaacaacagaagauaa

SEQ ID NO: 35220 - RNA, 639 nt, Artificial Sequence
  derived and/or modified sequence opt6 from capsid_protein_VP2__Norovirus__AGM33245
auggcacaagcaauaauaggcgcaauagcagcauccacagcaggaucagcauuaggagcaggaauacaaguaggaggagaagcagcacuacaaucacaaagauaccaacaaaaccuacaauuacaagaaaacucauucaaacacgacagagaaaugauaggcuaccaaguugaagcaagcaaccaauuacuagcaaaaaacuuagcaacaagauauucauuacuaagagcaggcggccuuacauccgcagaugcagcaagaucaguagcaggaguaccaguaacaagaauaguagacuggaacggagucagaguauccgcaccagaaucaagcgcaacaacacuaagaucaggaggauucaugucaguaccuauaccauucgcaucaaaacaaaaacaaguacaaucuucaggaauaucaaacccaaacuacucaccaucaucaauaucaagaaccacaucauggguagaaucacaaaacucaucaagauucggaaacuuaucaccauaccacgcagaagcacuaaacacaguauggcuaacaccaccaggaucaacagcaucaucaacacuaucaucaguaccaagaggauauuucaauacagacagacuaccacuauucgcaaacaacagaagauaa

SEQ ID NO: 35221 - RNA, 639 nt, Artificial Sequence
  derived and/or modified sequence opt6 from capsid_protein_VP2__Norovirus__AGT17786
auggcacaagccauaauaggagcaauagcagcaaguacagcaggaucagcacuaggagcaggaauacaaguaggaggagaagcagcacuacaaagccaaagauaccaacaaaaucuacaacuccaagaaaacucauucaaacacgacagagaaaugauaggauaccaaguagaagcaucaaaccaacuacuagcaaaaaaccuagcaacaagauacucacuacuaagagcaggaggauuaacaucagcagacgcagcaagaucaguagcaggagcaccaguaacaagaauaguagacuggaacggaguaagaguaucagcaccagaaucaucagccacaacacuaagaucaggaggauucaugucagucccaauaccauucgcaucaaagcaaaaacaaguacaaucaucaggaauaucaaacccaaauuacucaccaucaucaauaucaagaacaacaucauggguugaaucacaaaauucaucaagauucggaaaccuaucaccauaccacgcagaagcacuaaacacagucuggcuaacaccaccaggaucaacagcaucaucaacacuaucaucaguaccaagaggauacuucaacacagacagauuaccacuauucgccaacaacagaagauaa

SEQ ID NO: 35222 - RNA, 639 nt, Artificial Sequence
  derived and/or modified sequence opt6 from capsid_protein_VP2__Norovirus__AGT17793
auggcacaagcaauaauaggagcaauagcagcaaguacagcaggaucagcacuaggagcaggaauacaagucggaggagaagcagcacuacaaagccaaagauaccaacaaaaccuacaacuacaagaaaacucauucaaacacgaccgagaaaugaucggauaccaaguagaagcaagcaaccaacuacuagcaaaaaaccuagcaacaagauacucauuauuacgagcaggaggauuaacaucagcagacgcagcaagaucaguagcaggagcuccaguaaccagaauagucgacuggaauggagucagaguaucagcaccagaaucaucagccacaacacuacgaucaggaggauucaugucaguaccaauaccauuugcaucaaaacaaaaacaaguacaaucaagcggaauaucaaacccaaacuacucaccaucaucaauaucaagaacaacaagcuggguagaaagccaaaacaguucaagauucggaaacuuaagcccauaccacgcagaagcacuaaacacaguauggcuaacacccccaggaucaacagcaucaucaacauuaucaucaguuccaagaggauacuucaacacagacagacuaccacuauuugcaaacaauagaagauaa

SEQ ID NO: 35223 - RNA, 807 nt, Artificial Sequence
  derived and/or modified sequence opt6 from capsid_protein_VP2__Norovirus__AGT17796
auggcaggagcauucuucgcaggacuagcaucagauguauuagguucaggauuggguucacuaauaaaugcaggagcaggcgcaaucaaucaaaaaguagaauucgaaaauaauagaaaguuacaacaagcaaguuuucaauuuagcucaaaucuacaacaagcaaguuuccagcacgauaucgaaauguuacaagcacaaauagaagcaacaaaaaaauuacaacaagaaaugaugagagccaaacaagcaaugcuacuagaaggaggauucucagaaacagaugcagcaagaggcgcaauaaaugcaccgaugacuaaaacauuagauuggucgggaacaagauauugggcaccagaugcaagaacaacaacauauaacgcaggaagauucucaacaccacaaccaagcggagcccaaccaggaagagcaaauuuacgagcaacaguaccagcaagaggaagcucaagcacaagcucaaauucaagcauagcaacaaguguguacucaaaccagacaacgagcacgagacuaggaucgacagcgggaucaggaacaaguguuaguucacuaccaaguacagcaagaacaagaagcuggguugaagaccaaaacagaaacuuaaguccguucaugagaggagcacauaacauaucauuuguaacaccaccaagcucaagaucaucaucacaaggaacaguaaguacaguaccaaaagaaguauuagacucauggacgggagcauuuaauacaagaagacaaccauuauucgcacacauaagaaaaagaggagaaucaagaguauaa

SEQ ID NO: 35224 - RNA, 807 nt, Artificial Sequence
  derived and/or modified sequence opt6 from capsid_protein_VP2__Norovirus__AGT17799
auggcaggagcauuuuuugcaggacuagcauccgauguauugggcucaggauuaggaucacuaauaaacgcaggcgcgggagcaauaaaucaaaaaguagaauucgaaaacaauagaaaacuacaacaagauaguuuucaauuuaguucaaacuuacaacaagcuucauuccaacacgauaaagaaauguuacaagcacaaauugaagcaacuaaaaaauuacaacaagaaaugaugagaguaaaacaagcaauguuauuagaaggaggauucucagaaacagaugcugcaagaggagcaauaaaugcaccaaugacaaaaguauuagauuggucaggaacaagauauugggcaccaggagcaaggacaacaacauacaacgcaggauauuucucaacaccacaacauagcggagcucuaccaggacgagcaaacuuaagagcagucguacccgcaagaggaucaucacgagugucaucaaacucgagcacagcaacaaguguauacucuaaccaaacagcaagcacaagacuaggaaguacagcaggaucaggaacaaguguaagcucacuaccaucaacagcaagaacaagauccuggguagaagaucaaaacagaaaccuaagcccauucaugcgaggagcacauaacauaagcuuuguaacgcccccaaguucaagaucaucaucacaaggaacuguaucaacuguaccaaaagaaguauuaaacucacaagcaggaguauuuaauacaagaagacaaccauuauuugcacauauaagaagaagaggagaaucaagagcuuaa

SEQ ID NO: 35225 - RNA, 639 nt, Artificial Sequence
  derived and/or modified sequence opt6 from capsid_protein_VP2__Norovirus__AGT17804
auggcacaagcaauaauaggagcaauagcagcaucaacagcaggaucagcacuaggagccggaauacaaguaggaggagaagcagcauuacaaucacaaagauaccaacaaaacuuacaacuacaagaaaauucauucaaacacgacagagaaaugauaggauaucaaguagaagccagcaaucaauuauuagcaaaaaaccuagcaacaagauacucauuauuaagagcaggaggauuaacaucagcagacgcagcacguucaguagcaggagcaccaguaacaagaaucguagacuggaacggaguaagaguaucagcaccagaaagcucagcaacaacacuaagaucaggagguuucaugagcguaccaauaccauucgcaucaaaacaaaaacaaguccaaagcucaggaauaagcaacccaaacuacucaccaucaucaauaucaagaacaacaucauggguagaaagccaaaacucaucaagauuuggaaaccuaaguccauaucacgcagaagcacuaaacacaguaugguuaaccccaccaggaucaacagcaucaagcacauuaucaagcguaccaagaggauauuucaacacagacagacuaccauuauucgcaaacaacagaagauaa

SEQ ID NO: 35226 - RNA, 639 nt, Artificial Sequence
  derived and/or modified sequence opt6 from capsid_protein_VP2__Norovirus__AGT17807
auggcacaagcaauaauaggagcaauagcagcaucaacagcaggaucagcauuaggagcaggaauacaaguaggaggagaagcagcauuacaaucacaaagauaccaacaaaaccuacaacuacaagaaaacucauucaaacacgacagagaaaugauaggauaccaaguagaagcaucaaaccaacuacuagcaaaaaaccuagcaacacgauacucauuacuaagagcaggaggacuaacaucagcagacgcagcaagaucaguagcaggagcaccaguaacaagaauaguagacuggaacggagucagagucucagcaccagaaucaagcgcaacaaccuuaagaaguggcggauuuauguccguaccaauacccuucgcaucaaaacaaaaacaaguacaaucaucaggaauaucaaauccaaacuauucaccaucauccauaucaagaacaacaucauggguagaaucacaaaacucaucaagauuuggaaaucuaucaccauaccacgcagaagcacuaaacacaguaugguuaacaccaccaggaucaacagcaucaagcacucuaucaucagucccaagaggauauuucaacacagacagacuaccacuauucgcaaacaacagaagauaa

SEQ ID NO: 35227 - RNA, 639 nt, Artificial Sequence
  derived and/or modified sequence opt6 from capsid_protein_VP2__Norovirus__AGT17810
auggcacaagcaauaauaggagcaauagcagcaucaacagcaggaucagcacuaggagcaggaauacaaguaggaggcgaagcagcacuacaaucacaaagauaccaacaaaacuuacaacuacaagaaaacucauucaaacacgaccgagaaaugaucggauaccaaguagaagcaucaaaccaacuacuagcaaaaaaccuagcaacaagauacucauuacuacgagcaggaggccuaaccucagcagaugcagcaagaucagucgcaggagccccaguaacaagaauaguagacuggaacggcguaagaguaucagcacccgaaucaucagccacaacauuacgauccggaggauucaugucaguaccaauaccauucgcaucaaaacaaaaacaaguacaaucaucaggaauaucaaacccuaacuacucaccaucaucaauaucaagaacaacaucauggguagaaucucaaaauucaucaagauucggaaaccuaucaccauaccaugcagaagcauuaaacacaguauggcuaacaccaccaggaucaaccgcaucaucaacauuaucaucagucccacgaggauacuucaacacagacagauuaccacuauucgcaaacaacagacgauaa

SEQ ID NO: 35228 - RNA, 807 nt, Artificial Sequence
  derived and/or modified sequence opt6 from capsid_protein_VP2__Norovirus__AGT17814
auggcaggagcauucuuugcaggauuagcgagcgauguauuaggaucaggauuaggaucauuaauaaacgcaggagcaggagcaauaaaucaaaaaguagaauuugaaaacaauagaaaacuccaacaagcaagcuuccaauuuagcucaaaccuacaacaagcaucauuucaacacgauaaagaaaugcuacaaucgcaaauagacgcaacaaaaaaauuacaacaagaaaugaugagaguaaaacaagcaauguuacuagaaggaggauucucagaaacagacgcagcacgaggagcaaucaaugcaccaaugacaaaaguauuagauuggucaggaacaagauacugggcaccagacgcaagaacaacaacauauaaugcaggcagauucucgacaccacaaccaagcggagcaccgccaggaagagcaaacuuacgagcagcaguuccagcacgagggaguucaucaacaaguucuaauucaaguauagccacaaguauguauucaaaccaaacaacaagcacaagauuaggcucaacagcaggcucaggcacaagcguaaguucauuaccaaguucagcaagaacuagaagcuggguagaagaucaaaacaggaaccuaagcccauucaugagaggugcacauaacauaagcuuuguaacaccaccuagcuccagaucaagcucucaaggaacaguaagcacaguaccgaaagaaguacuagauucauggacaggagcauucaauacaagaagacaaccauuauucgcacacauaagaagaagaggagaaucaagaguauaa

SEQ ID NO: 35229 - RNA, 807 nt, Artificial Sequence
  derived and/or modified sequence opt6 from capsid_protein_VP2__Norovirus__AGT17820
auggcgggagcauucuuugccggauuagcaagcgauguacuaggcucaggcuuaggaucauuaauaaaugcaggagcaggcgcaauaaaucaaaaaguagaauucgaaaacaauagaaaacuacaacaagcaagcuuucaauuuagcucaaacuuacaacaagcauccuuccaacacgauaaagaaauguuacaagcacaaauagaagcaacaaaaaaauuacaacaagaaaugaugagagcuaaacaagcaaugcuacuagaaggaggauucucagaaacagacgcagcaagaggagcgauaaaugcaccaaugacaaaaacauuagauuggucaggaacaagauauugggcaccugaugcaagaacaacaacauauagcgcaggcagauuuucaacaccacaaccaucaggagcacuaccaggaagagcaaacuuaagagcaacaguaccagcaagaggcaguucaagcacaagcucaaauucguccauagcaacuaguguauauucaaaucaaacaacaaguaccagauuaggaucaacagcagguucaggcacaagcguaagcucacuaccaagcacagcaaggaccagaagcuggguagaagaccaaaacagaaauuuaagcccauuuaugagaggggcccauaacauaagcuuuguaacaccaccaaguucaagaucgagcucacaaggaacaguaaguacagucccaaaagagguauuagacucguggacaggagcauucaauacaagaagacaaccauuauucgcgcauauaagaaaaagaggagaaucaagaguauaa

SEQ ID NO: 35230 - RNA, 807 nt, Artificial Sequence
  derived and/or modified sequence opt6 from capsid_protein_VP2__Norovirus__AGT17824
auggcaggagcauucuuugcaggacuagcaagcgauguauuaggaucuggauugggaucacuaauaaacgcaggagcaggagcaaucaaucaaaaaguagaauucgaaaacaauagaaaacuacaacaagauagcuuucaauuuaguucaaauuuacaacaagcaucauuucaacaugauaaagaaaugcuacaagcacaaauagaagcaacaaaaaaauuacaacaagaaaugaugagaguaaaacaagcaauguuauuagaaggaggauuuucagaaacagacgcugcaagaggcgcaauaaaugcaccuaugacaaaaguauuagauuggucaggaacuagauauugggcaccagacgcaagaaccacuacauauaacgcaggacauuucucaaccccacaacauagcggagcauuaccuggaagagcgaacuugcgagcaacaguaccagcaagaggaucaucgagagcgagcuccaacucgagcacagcuacaagcguauacucaaaccaaacaacaaguacacguuuaggaucaacagcaggaucaggaacaucagugagcucauuaccaucaacagcaagaacaagaucauggguagaagaucaaaacaggaauuuaagcccauucaugagaggagcucauaacauaaguuuuguaacaccacccaguucgagaucaucaucacaaggaaccguaaguacagucccaaaagaaguuuuaaacucaagaacaggagcauucaauacaagaagacaaccauuauucgcacauauaagaagacaaggagaaucaagagcauaa

SEQ ID NO: 35231 - RNA, 639 nt, Artificial Sequence
  derived and/or modified sequence opt6 from capsid_protein_VP2__Norovirus__AGT17827
auggcacaagcaauaauaggugccauagcagcaucaacagcaggaucagcacuaggagcaggaauucaaguaggaggagaagcagcacuacaaagccaaagauaucaacaaaaccuacaacuacaagaaaacucauucaaacacgauagagaaaugauaggauaucaaguagaagcaucaaaccaacuauuagcaaaaaacuuagcaacaagauacucccuacuaagagcaggaggacucacaucagcagacgcagcaagaucaguagcaggagcaccaguaacaagaauaguugacuggaacggaguaagaguaucagcaccagaaucaucagcaacaacauuaagaucaggaggauucaugucaguaccaauaccauuugccuccaaacaaaaacaaguccaaucaucaggaauaucaaacccaaacuacucaccaucaucaauaucaagaacaacaucauggguagaaucacaaaacucaucaagauuuggaaaccuaaguccauaccacgcagaagcacuaaacacaguauggcuaacaccacccggaucaacagcaagcucaacacuaucaucaguaccaagaggauacuucaacacagacagacuaccauuauucgcaaacaacagaagauaa

SEQ ID NO: 35232 - RNA, 807 nt, Artificial Sequence
  derived and/or modified sequence opt6 from capsid_protein_VP2__Norovirus__AGT17831
auggcaggagcaauaauagcaggacuagcaagcgaugucuuaaguucaggauuaggaucacuaauaaacgcaggagcaggagugauaaaucaaaaaguagauuucgaaaacaauaaacaacuacaacaaaauagcuuucaauucagcucaaaccuacaacaagccucauuccaacacgauaaagagaugcuacaagcacaaauagaagcaacaaaaaaauuacaacaagaaaugaugggaauaaaacaagcaguauuacuaaaaggaggauucucagaaacagacgcggcaagaggagcagucaacgccccaaugacaaaaguacuagauuggucaggaacaagauauugggcaccaaaugcaucaacaacaacauauaacgcagguagauucucaacaccacaaccaagcggagcauuaccaggaagaacaaaccuaagaacagcagcaccagcaagaggaagcccaagcauaagcucaaacgcaaguacagcaacaucaguauauucaaaccaaacugugagcacaagauuaggaacaagcgcaggaucaggaacuaguguaucaucuuuaccaagcacagcaagaacaagaagcuggguagaggaucaaaacagaaauuuaagcccauucaugagaggagcacauaacauaaguuuuguaacaccaccaagcucaagaucaagcucccaaggaacaguaaguacagucccaaaagaaguacuagauucauggacaggcgcauuuaauacaagaagacaaccauuauucgcacacauacgaaaaagaggagaaucaagaguauaa

SEQ ID NO: 35233 - RNA, 639 nt, Artificial Sequence
  derived and/or modified sequence opt6 from capsid_protein_VP2__Norovirus__AGT17837
auggcacaagcaauaauaggagcaauagcagcaucaacagcaggaucagcauuaggagcaggaauacaaguaggaggagaagcagcacuacaaucacaaagauaccaacaaaaccuccaacuacaagaaaacucauuuaaacacgauagagaaaugauaggcuaccaaguagaagcaucaaaccaacuauuagccaaaaaccuagcaacaagauacucauuacuaagagcaggaggacuaacaucagcagaugcagcaagaucaguagcaggugcaccaguaacaagaauaguagacuggaacggaguaagaguaucagcaccagaaucaucagcaaccacacuaagaucaggaggcuucaugucaguaccaauaccauuugcaaguaaacaaaaacaaguacaaucaucaggaauaucaaacccaaacuacucaccaaguucaauaucaagaacaacaagcuggguagaaucacaaaauucaucaagauucggaaaccucucaccauaccacgcagaagcauuaaacacaguaugguuaacaccaccaggaagcacagcaucaagcacccuaucaucaguaccacgaggauacuucaacacagacagacuaccacuauucgcaaacaacagacgauaa

SEQ ID NO: 35234 - RNA, 807 nt, Artificial Sequence
  derived and/or modified sequence opt6 from capsid_protein_VP2__Norovirus__AGT17843
auggcaggcgcauucuuugcaggauuagcaagcgacguucuaggaucaggacuaggcucguuaauaaaugcaggcgcaggagcaauaaaucaaaaaguagaauuugaaaacaauagaaaacuccaacaagauagcuuucaauucagcucaaaccuacaacaagcaucauuucaacacgauaaagaaauguuacaagcacaaauagaagcaacaaaaaaauuacaacaagaaaugaugaggguaaaacaagcaauguuacuagaaggaggauucucagaaacagacgcagcaagaggagcaauaaaugccccaaugacaaaaguacuagauuggaauggaacaagauauugggcaccaggagcuagaacaacgacauauaacgcaggacauuucucgaccccacaacauucaggagcauuaccaggaagagcuaacuuaagagcagcaguaccagcgagaggaaguucaagagcaagcucaaacucgagcacagcaacaaguguauacucaaaccaaacaacaagcacaagacuaggaucaacagcaggaucaggaacgagcguaucaucauuaccaucaacagccagaaccagaucauggguagaagaccaaaacagaaacuuaaguccauucaugagaggagcacauaacauaagcuuuguaacuccaccaagcucgagaucaagcucgcaaggaacaguaaguacaguaccaaaagaaguauuaaacucacaaacaggagcauucaauacaaggagacaaccauuauucgcacauauaagaagaagaggagaaucaagagcauaa

SEQ ID NO: 35235 - RNA, 807 nt, Artificial Sequence
  derived and/or modified sequence opt6 from capsid_protein_VP2__Norovirus__AGX85887
auggcaggagcauucuuugcaggauuagcauccgauguauuaagcucaggauuaggcucacuaauaaacgcaggagcaggagcuauaaaucaaacaguagaauucgaaaacaacagaaaauuacaacaagcaaguuuccaauuuagcaguaaccuacaacaagcaucuuuucaacacgauaaagaaauguuacaaucacaaauugacgcaaccaaaaaacuacaacaagaaaugaugagaguaaaacaagcaauguuauuagaaggcggauuuucagaaacagacgcggcaaggggagcaauaaaugcaccaaugacaaaaguacuagauuggucaggaacacgcuauugggcaccagaugcaagaacaacaacauacaacgcaggaagauuuucaacaccacaaucgaguggagccccaccaggacgcgcaaaccuacgagcagcaguaccagcgcaagguucaucaucaacaagcucaaacucaagcauagcuacaagcauguacucaaaccaaacaacaaguacacguuuaggaucaacagcaggaucaggcacaagcguaagcucacuaccgaguucagccagaacaagaagcuggguagaagaccaaaacagaaauuugaguccauuuaugagaggagcucauaacauuagcuuuguaacaccuccaucaucaagaucaagcucacaaggaacaguaaguacaguaccaaaagaaguauuagauucauggacaggagcguuuaauacuagaagacaacccuuauucgcacacauuagaagaagaggagaaucaagaguauaa

SEQ ID NO: 35236 - RNA, 807 nt, Artificial Sequence
  derived and/or modified sequence opt6 from capsid_protein_VP2__Norovirus__AGX85893
auggcaggagcguuuuuugcuggacuagcuagcgauguauuaggaucaggcuuaggaucgcuuauuaacgcaggagcuggagcaauaaaucaaaaagucgaauucgaaaauaauagaaaauuacaacaagauucauuucaauuuaguucaaacuuacaacaagcaucauuccaacacgauaaagaaauguuacaagcacaaauagaagcaacaaaaaaauuacaacaagaaaugaugagaguaaaacaagcaauguuacuagaaggcggauucucagaaacagaugcagcaagaggagcaauaaaugcaccaaugacuaaagugcuagauuggucaggaacaagauauugggcacccggagccagaacaaccacauauaaugcaggauauuucucaacaccacaacauagcggagccuuaccaggaagagcaaauuuacgagcagccguacccgcaagaggaagcucaagaguaagcucaaacucaaguacagcaacuagcguauauucgaaccaaacagcaaguacacgacuaggaucaacagcaggaucuggaacaaguguaagcucacuaccaaguacagcaaggacaagaagcuggguagaagaucaaaacagaaauuuaagcccauucaugagaggggcacauaacauaagcuucgucacaccaccaagcucuagaucaaguucacaaggaacagugaguacaguaccaaaagaaguauuaaacucacaaacaggaguguucaauacaagaagacaaccacuauuugcacacauuagaagaagaggagaaucaagagcauaa

SEQ ID NO: 35237 - RNA, 807 nt, Artificial Sequence
  derived and/or modified sequence opt6 from capsid_protein_VP2__Norovirus__AGX85896
auggcaggagcauuuuuugcaggauuagcaagcgacguuuuaggaucuggucuaggaucacuaauaaacgcaggagcgggcgcaauaaaucaaaaaguagaauucgaaaacaauagaaaacuacaacaagauaguuuucaauuuagcucaaaccuacaacaagcaucauuucaacaugauaaagaaauguuacaagcacaaauagaagcaaccaaaaaacuacaacaagaaaugaugagagucaaacaagcaauguuacuagaaggaggauucucagaaacagacgcagcaagaggcgcaauaaaugcaccaaugacaaaaguauuagauuggucaggaacaagauauugggcacccggggcaagaacgacaacauauaacgcaggcuauuucucaacaccacaacauagcggagcauuaccagggagagcuaacuuaagagcugcaguaccagcaagaggaaguucaagaguauccuccaacucaaguacagcaacaaguguauacucaaaccaaacagcaagcacaagacuaggaucaacagcaggaucaggaacgucaguaagcucacuaccaagcacagccagaacaagaagcuggguagaagaccaaaacagaaacuuaaguccauucaugagaggagcacauaacauaagcuucguaacaccaccaagcucaagaucaaguucucaaggaacaguaucaacaguaccaaaagaaguauugaacucacaaacuggagcauucaauacaagaagacaaccauuauucgcacacauacgaagaagaggagaaucaagagcauaa

SEQ ID NO: 35238 - RNA, 807 nt, Artificial Sequence
  derived and/or modified sequence opt6 from capsid_protein_VP2__Norovirus__AGX85905
auggcuggcgcauucuuugcaggauuagcaagcgauguauuaagcucaggauuaggaucauuaauaaacgcaggugcuggcgcaauaaaucaacgaaucgauuucgaaaauaauagaaaauuacaacaagcaaguuuucaauuuagcucaaacuuacaacaagccucauuccaacaugauaaagaaaugcuacaagcacaaauagaagcaacaaaaaaauuacaacaagaauuaaugaagguaaaacaagcaaugcuacuagaaggaggauucucagaaacagacgcagcaaggggagcaauaaaugcaccaaugacaaaagcucuagauuggucaggaacaagauauugggcaccagaugcaagaacaacaacauacaacgcaggaagauuuucaaccccacaaccaaguggagcacugccaggaagaauaaacccacgcacaccaauaccagcaagaggaaguccuagcauaucaucaaacguaucaacagcaaauaguauacacucaaaccaaacagcaaguacaagauuaggaucaacagcuggaucaggcacagacguaaguucacuaccaucaacagcaagaacaagaagcuggguagaagaccaaaacagaaacuuaagcccguucaugcgaggagcacauaacauuucauuuguaacaccaccaaguucacgaucaagcucacaaggaacaguaagcacaguaccaaaagauguccuagacucuuggacaggagcauucaacacaagaagacaaccauuauucgcacacauaagaaggcgaggagaaucgcgaguauaa

SEQ ID NO: 35239 - RNA, 807 nt, Artificial Sequence
  derived and/or modified sequence opt6 from capsid_protein_VP2__Norovirus__AGX85914
auggcaggagcguuuuuugcaggacuagcaagcgauguauuaggaucaggauuaggaucacuaauaaacgcaggagcaggagcaauaaaucaaaaagucgaauuugaaaauaauagaaaacuacaacaagacagcuuccaauucaguucaaacuuacaacaagcaucauuccaacaugacaaagaaauguuacaagcacaaauagaagcaacaaaaaaauuacaacaagaaaugaugagaguaaaacaagcaaugcuacuagaaggaggauuuucagaaacagaugcagcaagaggggcaauaaaugcaccaaugacaaaaguauuagauuggucaggcacacgcuacugggcaccaggagccagaacaacaacauauaacgcaggauauuucucaacaccacaacauuccggggcauuaccagggagagcaaauuuaagagcagucgugccagcaagaggaaguucaagaguaagcucaaauucaagcacagcaacaaguguauacucaaaucaaacagcaagcacaagacuaggaucaacagcaggcucaggaacaagcguaaguucauuaccaagcacagcaagaacaagaagcuggguagaagaccaaaacagaaauuuaagucccuucaugagaggggcacauaacauaagcuuuguaacaccuccaucaucuagaucaaguucacaaggaaccguaagcacaguaccaaaagaaguauuaaacucacaaacaggcguauucaauacaagaagacaaccacuauucgcacacauaagaagaagaggagaaucaagagcauaa

SEQ ID NO: 35240 - RNA, 807 nt, Artificial Sequence
  derived and/or modified sequence opt6 from capsid_protein_VP2__Norovirus__AGX85917
auggcaggagcauucuuugccggacuagcaucagacguauuaucaucagguuuaggaucauuaauaaaugcaggagcaggagcaauuaaccaaacaguagaauuugaaaacaaccgcaaacuacaacaagccucauuccaauucucaucaaaccuacaacaagcaucauuccaacacgacaaagaaaugcuacaaucacaaauagacgcaacaaaaaaauuacaacaagaaaugaugagaguaaaacaagcaauguuacuagaaggaggauucucagaaacagacgcagcaagaggugcaaucaaugcaccaaugacaaaaguacuagacuggucaggaacaagauauugggcaccagacgcaagaaccacaaccuacaacgcaggaagauucuccacaccccaaucaucaggagccccaccaggaagagcuaaccuaagagcagcaguaccagcacaaggaucaucaagcaccuccucaaauucuaguauagcaacaaguauguacucaaaccaaacaacaucaacaagauuaggaucaacagcaggauccggaacaucaguaucaucacuaccaucaucagcaagaacaagaucauggguugaagaucaaaacagaaaucuaagcccauucaugcgaggagcccauaacauaagcuuuguaacaccaccaucaucaagaucaaguagucaaggaacagugucaacaguaccaaaagaaguacuagacucauggacaggagcauuuaacacaagaagacaaccauuauucgcacauauacgcagacgaggagaaucaagaguauaa

SEQ ID NO: 35241 - RNA, 807 nt, Artificial Sequence
  derived and/or modified sequence opt6 from capsid_protein_VP2__Norovirus__AGX85923
auggcaggcgcaauaauagcaggauuagcaucagauguuuuaagcucaggauuaggaucacucauaaacgcaggagcaggaguaauaaaucaaaaaguagauuucgaaaacaauaaacaauuacaacaaaauagcuuucaauuuagcucaaaccuacaacaagcaucauuucaacacgauaaagaaauguuacaagcacaaauagaagcaacaaaaaaauuacaacaagaaaugaugggaauaaaacaagcaguacuauuaaaaggaggauucucagaaacagacgcagcaagaggagcagucaaugcaccaaugacaaaaguacuagauuggucgggaacaagauauugggcaccaaaugcaucaaccacaacauauaacgcaggaagauucucaacaccacaaccgagcggagcauugcccggacgaacgaacuuaagaacagcagcaccagcaagaggaaguccaagcauuagcucaaacgcaagcacagcaacauccguauacucaaaccaaaccguaaguacaagauuaggaacaagcgcaggaucaggaacaagcguaaguucacuuccaaguacagcaagaacccgaagcuggguugaagaccaaaacagaaauuugucaccauuuaugagaggugcccauaauauuaguuuuguaacacccccaaguucgagaucaagcucgcaaggaacaguaaguacagucccaaaagaaguauuggacucguggacaggagcauucaauacaagaagacaaccauuauucgcacacauaagaaaaagaggagaaucaagaguauaa

SEQ ID NO: 35242 - RNA, 807 nt, Artificial Sequence
  derived and/or modified sequence opt6 from capsid_protein_VP2__Norovirus__AGX85926
auggcaggagcaauaauagcaggacucgcgagcgauguauuaagcucaggauuaggaucacuaauaaacgcaggagcaggagcaaucaaucaaacaauagauuucgaaaacaauagaaaauuacaacaagcaaguuuucaauuuaguucaaacuuacaacaagcaucauuccaacaugauaaagaaauguuacaagcacaaauagaagcaacaaaaaaauuacaacaagaaaugaugagaguaaagcaagcaauguuguuagaaggaggauucucggaaacggacgcugcacggggagcaauaaaugcaccaaugacaaaaacucuagauuggucuggaacacgauauugggcaccagaugcaagaaccacaacauauaacgcaggaagauucucaacuccacaaccaagcggagcaccaccaggaagagcaaacuuaagagcaaccacaccagcaagaggaagcucaaguacaaguucaaauucaagcauagcaacaagcguauacucaaaccaaacaacaagcacaagauuagguucaacagcaggaucuggaacaagcguaagcucacucccaagcacggcccgaacaagaaguuggguagaagaccaaaacagaaacuuaagcccauucaugagaggggcacauaacauaucauucguaacaccaccaaguucaaggucaaguucacaaggaacaguaagcacaguaccaaaagaaguauuagauucauggacaggagcauucaauacaagaagacaaccauuauucgcacacauacguacaagaggagaaucgagaguauga

SEQ ID NO: 35243 - RNA, 807 nt, Artificial Sequence
  derived and/or modified sequence opt6 from capsid_protein_VP2__Norovirus__AGX85932
auggcgggagcauucuuugcaggacuagcgagcgacguacuaggaucaggauuaggaucacuaauaaacgcaggagcgggagcaauaaaccaaaaaguagaauuugaaaacaaucgaaaacuacaacaagauagcuuucaauuuagcucaaauuuacaacaagcaucauuucaacacgauaaagaaaugcuacaagcacaaauagaagcaacaaaaaaauuacaacaagaaaugaugagaguaaaacaagcaaugcuacuugaaggaggcuucucagaaacagacgcagcaagaggagcaauaaaugcaccaaugacaaaaguacuagauuggucaggaacaagauauugggcaccaggagcacgaacaacaacauauaaugcaggauauuucucaacaccacaacauagcggagcauuaccaggaagagcaaacuuaagagcagucguuccagcaagaggaaguucacgagugagcucaaacucaucaacagcaacaaguguauacucaaaccaaaccgcaaguacuagauuaggaucaacagcaggaucaggcacaagcguaucaucauuaccaucaacagcaagaacaaggagcuggguagaagaccaaaacagaaacuuaaguccauucaugagaggagcacauaacauaaguuuuguaacaccuccaagcucgcgaucaaguucacaaggaacaguaagcacaguaccaaaagaaguacuaaacucacaaacuggaguguucaacacaagacgacaaccauuauucgcacacauaagaagaagaggagaaucaagagcauaa

SEQ ID NO: 35244 - RNA, 807 nt, Artificial Sequence
  derived and/or modified sequence opt6 from capsid_protein_VP2__Norovirus__AGX85935
auggcaggcgcauucuuugcaggauuagcaagugacguauuaggaucaggauuaggauccuuaauuaacgcaggcgcaggagcaauaaaucaaaaaguagaauucgaaaacaauagaaaacuacaacaagauucuuuucaauuuaguucaaacuuacaacaagcaucuuuccaacacgauaaagaaauguuacaagcucaaauugaagcaacaaaaaaauuacaacaagaaaugaugagagucaaacaagcaauguuacuagaaggaggauucucagaaacagaugcagcaagaggagcaaucaaugcaccaaugacaaaaguacuagacuggucaggaacaagauauugggcaccaggagcaagaaccacuacauauaacgcaggauauuucucuaccccacaacauaguggagcacuaccuggaagagcaaacuuaagagcagucguaccagcaagaggaagcucaagaguaagcucuaacucaagcacagcaacaagcguguacucaaaccaaacagcaaguacgagacuaggaucaacagcaggaucaggaacaucaguauccucauuaccuaguacagcaagaacaaggucauggguagaagaccaaaacagaaaccuaagcccauucaugagaggugcacauaacauaaguuuuguaacaccaccuagcucaagaucaagcucacaaggaacaguaucaacaguaccaaaagaagucuuaaacucucaaacaggaguauucaauacaagaagacaaccauuauucgcgcacauaagaagaagaggagaaucaagagcauaa

SEQ ID NO: 35245 - RNA, 780 nt, Artificial Sequence
  derived and/or modified sequence opt6 from capsid_protein_VP2__Norovirus__AHI59155
auggcaucagcauuccuagcaggccuagcaggagacguaauaacaaacggaguaggaucacuaauaaacgcaggagcuaacgcaguaaaucaaaaaguagaauacgacuucaacaaacaacuacaaauggcuucauucaaacaugacaaagaaauguuacaaucacaaguauuagcaacaaaacaacuacaacaagaaaugaugaacauaagacaaggaguacuaacugcaggcggauucuccccagcagaugcagcaagaggagccguaaacgcaccaaugaccaaaauauuagacuggaacgguaccagauacugggcaccaaacucaaugaaaacaaccucauacagcggacaauucucauccucucccguacacaaaucuccagcaccaucacaacacacagcauuaccaaaauccagacuacaaaacgacuuugcaucaguauacucauuuccaucaucaguaucaucacaaucaacccacucaaccgcauuaucagcaggaaccggaucaucaagaucaauaucaccaucaacagccacaccaacccuaucaagaacaucagacuggguaagaggacaaaacgaaagacuaucaccauucauggacggagcauuacaaacagccuucguaacaccaccaucaucaaaagcaucaucaaacggcacaguaucaacaguccccaaagcaguacuagauucauggacaccaauguucaacacacaccgacaaccacuauucgcacacccacgaagacgcggugaaucucaaguauaa

SEQ ID NO: 35246 - RNA, 807 nt, Artificial Sequence
  derived and/or modified sequence opt6 from capsid_protein_VP2__Norovirus__AHI59158
auggcaggcgcauucuuugcaggacuagcaagcgacguauuaggaucaggauuaggcucgcuaauaaacgcaggagcaggagcaauaaaccaaaaaguagaauucgaaaacaacagaaaacuacaacaagcaucauuucaauuuucaucgaacuuacaacaagcaucuuuccaacaugauaaagaaauguuacaagcacaaauagaagcaaccaaaaaauuacaacaagaaaugaugcgaguaaaacaagcgauguuacuagaaggaggauucucagaaacagacgcagcaagaggcgcaauaaaugcaccgaugacaaaaacucuagauuggucaggaacaagauauugggcacccgaugcaagaacaacaacauauaacgcaggacgauucucaacaccacaaccaagcggagccuuaccaggaagagcaaacuuaagagcaacaguuccagcaagaggaaguucaaacacgagcucgaguucaagcauagcaacuucaguguauucaaaccaaacaacaagcacaagacuuggaucaacagcuggcucaggaacaagcguuaguuccuuaccaaguacagcaagaacaagaucauggguagaagaccaaaacagaaacuuaagcccauuuaugagaggagcacauaacauaagcuuuguaacaccaccaagcucaagaucaagcucacaaggaacaguaagcacaguaccgaaagaaguauuagauucauggacaggcgcauucaacacaagaagacaaccauuauucgcacacauacgaaaaagaggagaaucuagaguauaa

SEQ ID NO: 35247 - RNA, 780 nt, Artificial Sequence
  derived and/or modified sequence opt6 from capsid_protein_VP2__Norovirus__AHI59160
auggccggagcauucguagcaggauuagccggagacguauuaucaaacggauuaucaucauuaaucaacgcaggcgcaaaugcaauaaaccaaagagcagaauucgacuucaaccaaaaauuacaacaaaacucauucaaccacgauaaagaaaugcuacaagcccaaauacaagcaacaaaacaacuacaagcagauaugauggcaauaaaacaaggaguauuaacagcaggaggauucucaccagcagacgccgcaagaggagcaguaaacgcaccgaugacacaagcacuagacuggaauggaaccagauacugggcaccaggaaguaugagaacaacaucuuacucaggaaaauucacauccacagccccaguaagacaagcagacuuccaacacacacaaucaagaccaucaucaggaucaucaguaucaucauucgcaacacaaucaucaagaccaacacuaacaacaacaaccggcucaucacacggaacagcaagcuccaacucaacaagaucaacaucacuaagccaaagcacaguaucacgagcaacaucaagaacaucagaauggguaagagaccaaaacagaaacuuagaaccauauaugcacggagcacuacaaacagcauucguaacaccaccaucaucaagagcaucagacggaacaguaucaacaguaccaaaaggaguacucgacucauggacacccgcauucaacacaagaagacaaccauuauucgcacacuuaagaaaaagaggagaaucacacgcauaa

SEQ ID NO: 35248 - RNA, 807 nt, Artificial Sequence
  derived and/or modified sequence opt6 from capsid_protein_VP2__Norovirus__AHI59163
auggcaggagcauucuucgcaggauuagcaagcgacguacuagguucaggacuaggaucauuaauaaacgcaggagcaggagcaauaaaccaaaaaguagaauucgaaaauaaccgaaaacuacaacaagcaucauuccaauucagcuccaacuuacaacaagccucauuucaacacgacaaagaaauguuacaagcacaaauagaagccacaaaaaaauuacaacaagaaaugaugcgugucaaacaagcaaugcuacuagaaggaggauucucagaaacagacgcagcaagaggcgcaaucaaugcaccaaugacaaaaacacuagacugguccggaacaagauacugggcacccgacgcaagaaucacaacauacaacgcaggaagauucccaacaccacaauuaucaggagcauuaccuggaagagcaaaccuaagagccacaguaccagcaagaggaaguccaucaacaucaucuaacucuucaauagccacaucaguauauucaaaccaaacaaccagcacaagacuaggaucaacugcaggaucaggaaccucaguaucaucauuaccaagcacagcaagaacaagaagcuggguagaagaucaaaacagaaacuuaucuccauuuuuaagaggagcacacaauauaucuuucguaacaccaccaagcucuagaucaucaucacaaggaacaguaucaacaguaccaaaagaaguauuagacucauggacaggagcauucaauacaagaagacaaccauuauucgcacacauaagaaaaagaggagaaucaagaguauaa

SEQ ID NO: 35249 - RNA, 807 nt, Artificial Sequence
  derived and/or modified sequence opt6 from capsid_protein_VP2__Norovirus__AHI59166
auggcaggagcauucuuugccggauuagcaucagauguauuaggaucaggauuaggaucauuaauaaacgcaggcgcaggagcaauaaaccaaaaaguagaauuugaaaacaaucgaaaacuacaacaagcaucauuucaauuuagcucaaacuuacaacaagcaucauuccaacacgacaaagaaauguugcaagcacaaauagaagcaacaaaaaaacuacaacaaggaaugaugaaggucaaacaagcaaugcuauuagaagguggauucucagaaacagacgcagcaagaggagcaauaaaugccccaaugacaaaagcauuagauuggucuggaacaagauauugggcaccugaugcaaggacaacuacauauaacgcaggcagauucucgacaccacaaccaagcggagcuuuaccuggaagaaauaacuuaagagcaacaguaccagcaagaggaagcucaaguacauuaucuagcauaccaacagcaacaagcguauacucaaaucaaaccguaagcacgagauuaggaucaucagcaggaucaggaacaaguguaaguucacucccaaguacagcaagaacaagaagcugggucgaagaccaaaacaaaaacuuaagcccauucaugagaggagcauuaaacacaagcuuuguaacgccaccaagcucacgaucaagcucgcaaggaaccguaagcacaguaccaaaagaaauauuagacucauggacgggcgcauucaauacaagaagacaaccauuguucgcacacguaagaaaaagaggagaaucaagaguauaa

SEQ ID NO: 35250 - RNA, 807 nt, Artificial Sequence
  derived and/or modified sequence opt6 from capsid_protein_VP2__Norovirus__AHX22026
auggcaggagcguucuuugcaggauuagcaagcgauguauuaggaucagguuuaggaucacuaauaaacgcuggagcgggagcaauaaaucaaaaaguagaauucgaaaauaauagaaaacuacaacaagcaagcuuucaauuuucaucaaacuuacaacaagcaucauuccaacacgauaaagaaauguuacaagcacaaauagaagcaacaaaaaaauugcaacaagaaaugaugagaguaaaacaaguaauguuauuagaaggaggauuuucagaaaccgacgcagcaagaggcgcaauaaaugccccaaugacaaaagcacuagauuggucaggaacaagauacugggcaccagaugcaagaacaacaacauacaacgcaggaagauucucaacaccacaaccaucaggagcauuacccggaagagcaaaccuaagaguaacagcaccagcuagaggaagcucaaguacaaguucgaacucaucaauagccacaucaguauacucaagucaaacaacgagcacaagauuaggaucaaccgcaggaucaggaacaucaguaaguucauuaccaaguacagcaagaacaagaagcuggguagaagaccaaaacagaaaccuaucaccauucaugagaggagcacauaacauaaguuuuguaacaccaccaagcucacgaucaaguucacaaggaaccguaagcacaguuccaaaagaaguauuagauucauggacuggugcauuuaauacaagacgacaaccauuauucgcacauauaagaaaaagaggagaaucaagaguuuaa

SEQ ID NO: 35251 - RNA, 807 nt, Artificial Sequence
  derived and/or modified sequence opt6 from capsid_protein_VP2__Norovirus__AHX22029
auggcaggagcauuuuucgcaggacuagcaagcgauguacuaggaucaggauuaggcucacuaauaaacgcaggcgcaggagcgauaaaccaaaaaguagaauucgaaaauaauagaaaauuacaacaagcaagcuuucaauuuaguucaaaccuacaacaagcaucauuccaacaugauaaagaaauguuacaagcacagauagaagcaaccaaaaaauuacaacaagaaaugaugaaaguaaaacaagugaugcuacuagaaggaggauucucggaaacagacgcagcuagaggcgcaauaaaugcaccaaugacaaaagcacuagauuggucaggaacaagauauugggcaccagaugcaagaacaacuacauacaacgcaggaagauucucaacaccacaaccaagcggaguauuaccaggaagagcaaacuugcgagaugcaguaccagcaagaggaagcucaucaaaaagcucaaacucauuuacagcaacaagcguauacucaaaccaaaccacaagcacgagauuaggaucgacugcaggaucaggaacaucaguaagcucauuaccaaguacagcuagaacaagaagcuggguagaagaccaaaguaggaacguaagcccauucaugagaggagcacauaacauaucauuuguaacaccaccaucauccagaucuagcucacaaggaacaguaagcacaguaccaaaagaaguauuagacucauggacaggagcauuuaauacaagacgacaaccauuauucgcgcacauaagaaaaagaggagaaucgagaguauaa

SEQ ID NO: 35252 - RNA, 807 nt, Artificial Sequence
  derived and/or modified sequence opt6 from capsid_protein_VP2__Norovirus__AHX22033
auggcaggagcauucuuugcaggacuagcaagugauguacuaggaucaggacuaggaucacuaauaaacgcaggagcaggagcaauaaaucaaaaaguagaauucgaaaauaauagaaaacuacaacaagcaucuuuucaauuuagcucgaacuuacaacaagcaucauuccaacaugauaaagaaauguuacaagcacaaauagaagcaacaaaaaaauuacaacaagaaaugaugagaguaaaacaaguaauguuacuagaaggcggauucucagaaacagacgcagcuagaggagcaauaaaugcaccaaugacaaaagcacuagacuggucaggaacaagauauugggcaccagaugcaagaacaacaacauauaacgcgggaagguucucaacaccacaaccuagcggagcucugagcggaagagcaaaucuaagagcaacagcaccugcacgaggaagcucaucaacaagcucgaauucaaguauagcaacaaguguguacucaaaccaaaccacaagcacaagauuaggcucaacagcaggaucaggcacaagcguaucaagcccaccgagcacagccagaacaagaagcuggguagaagaucaaaacagaaauuuaaguccauucaugcgaggggcacauaauauaucauucguaacaccaccaaguucuagaucaaguucacaaggaacaguaagcacaguaccaaaagaaguauuagauucauggacaggugcauucaauacaagaagacaaccccuauucgcacacauacgaaaaagaggagaaucaagaguauaa

SEQ ID NO: 35253 - RNA, 807 nt, Artificial Sequence
  derived and/or modified sequence opt6 from capsid_protein_VP2__Norovirus__AHX22036
auggcaggagcauucuuugcaggacuugcaagugauguauuagguucaggauuaggaucacuuauaaaugcaggagcaggagcaauaaaucaaaaagucgaauuugaaaauaauagaaaacuacaacaagcaagcuuucaauucucuucaaacuuacaacaagcaucauuucaacacgacaaagaaauguuacaagcacaaauagaagcaacaaaaaaauuacaacaagaaaugaugagaguaaaacaagcaauguuacucgaaggagguuuuucggaaacagaugcagccagaggagcaauaaaugccccaaugacaaaaacacuugauuggucaggaacaagauauugggcuccugaugcaagaacaacaacuuauaacgcuggaagauucucaacaccacaaccaucaggagccuuaccaggaagagcaaguuuaagagccacaguaccagcacgaggaaguucaagcaugucaucgaacucaagcauagcaacaagcguauacucaaaccaaacaacaagcacgagauuagguucaacagcaggaucaggaacaagcguaagcucauuaccaagcacagcaagaacaaggagcuggguagaagaccaaaacagaaacuuaagcccauuuaugagaggagcacacaauauaagcuucguaacaccaccaagcucgauaucuagcucacaaggaaccguaaguacaguaccaaaagaagucuuagacucauggacaggagcauucaacacaagacgacaaccacuauuugcacacauaagaaaaagaggcgaaucaagaguauaa

SEQ ID NO: 35254 - RNA, 807 nt, Artificial Sequence
  derived and/or modified sequence opt6 from capsid_protein_VP2__Norovirus__AHX22039
auggcaggagcauucuuugcaggauuagcaucagauguacuaggaucaggauuaggcucauuaauaaacgcaggagcuggagcaauaaaucaaaaaguagaauuugaaaacaauagaaaacuacaacaagcaagcuuucaauuuucaucaaacuuacaacaagcaucauuucaacacgauaaagaaauguuacaagcacaaauagaagcaacaaaaaaauuacaacaagaaaugaugaaagucaaacaagcaauguuacuagaaggcggguuuucagaaacagacgcagcaagaggagcaauaaaugcaccaaugacaaaagcacuagauuggucuggaacuagauacugggcacccgaugcaaggacaacaacauauaaugcuggaagauucucaacaccacaaccaagcggagcauuaccaggacgagccaacuuaagagacgcaguaccagcaagaggaagcucgucaaaaaguucaaacucaagcacagcuacauccguauacucaaaccaaacaacaagcacaagauuaggcucuaccgcaggaucuggaacaagcguaucaucccuaccaagcacagccagaaccagaucauggguagaagaccaaagcagaaacuuaagcccauucaugagaggagcacauaacauaagcuuuguaacgcccccaagcucaagauccucaucacaaggaacaguaucaacaguaccaaaagaaguauuagacucauggacaggagcauucaauacaaggagacaaccacuguucgcucacauaagaaaaagaggagaaucacgaguauaa

SEQ ID NO: 35255 - RNA, 807 nt, Artificial Sequence
  derived and/or modified sequence opt6 from capsid_protein_VP2__Norovirus__AHX22042
auggcaggagcauuuuucgcaggauuagcaagugauguccucggaucaggauuaggaucacuaauaaacgcaggagcaggcgcaauaaaucaaaaagucgaauucgaaaacaauagaaaacuacaacaagcaaguuuccaauucagcucaaauuuacaacaagcaucauuccaacaugauaaagaaaugcugcaagcacaaaucgaagcaacaaaaaaacuacaacaagaaaugaugaaaguaaaacaagcaauguuacuagagggaggauucucagaaacagaugcagcaagaggcgcaauaaaugcaccaaugacaaaagcacuagacuggucaggcacacgauauugggcaccagaugcaagaacaacaacauauaacgcaggaagguuuucaacaccacaaccaagcgguguauuaccaggaagagcaaacuuacgagaugcaguaccagcaagagggagcucaaguaaaucaucgaacucauucaccgcaacaaguguauacucaaaccaaacaacaaguacgcgacuaggcucaacagcaggaucaggaacaagcguaagcucacuaccaaguacagcaagaacaagaagcuggguagaagaucaaagcagaaacuuaagcccauucaugcgaggagcacauaacauaaguuuuguaacaccaccaaguucaagaucaagcucacaagggacaguaaguacgguaccaaaagaaguauuagacucauggacaggagcauucaauacaagaagacaacccuuauucgcacacauaagaaagagaggagaaucaagaguguaa

SEQ ID NO: 35256 - RNA, 807 nt, Artificial Sequence
  derived and/or modified sequence opt6 from capsid_protein_VP2__Norovirus__AHX22048
auggcaggagcauucuuugcaggacuagcaagcgauguauuaggaucaggauuaaguucacuaauaaaugcaggagcaggagcaauaaaucaaaaaguagaauucgaaaacaauagaaaacuacaacaagcaagcuuucaauuuagcucaaauuuacaacaagcaucauuucaacacgauaaagaaauguuacaagcacaaauagaagcaaccaaaaaacuacaacaagaaaugaugagaguaaaacaagcaauguuacuagaaggaggauucucagaaacagaugcagcaagaggagcaauaaaugcaccaaugacaaaagcguuagauuggucaggaacaagauauugggcaccagacgcuagaacaacuacauauaacgcaggaagauucucaacuccacaaccaaguggagcauuaccuggaagagcaaaucuaagagcagcaguaccagcaagaggaaguucgaguaugaguucaaacucaagcacagccacaucaguauacucaaaucaaacaacaaguacuagauuaggaucaacagcaggaucgggaacaagcguaagcucacuaccaagcacagcaagaauaagaagcugggucgaagaccaaaacagaaaccucagcccauucaugagaggagcacauaacauaagcuuuguaacuccuccaagcucaagaucaagcucacaaggaaccguaaguacgguuccaaaagaaguauuagacucuuggacaggagcauucaacacaagaagacaaccauuauucgcacacauaagaaaaagaggagaaucaagagcauaa

SEQ ID NO: 35257 - RNA, 807 nt, Artificial Sequence
  derived and/or modified sequence opt6 from capsid_protein_VP2__Norovirus__AHX22051
auggcaggagcauucuuugcaggacuagcaagugauguauuagguucaggcuuaggaucacuaauaaacgcaggagcaggagcaauaaaucaaaaaguagaauucgaaaacaauagaaaauuacaacaagcaaguuuucaauuuucaucaaaucuacagcaagcaucauuccaacacgauaaagaaauguuacaagcacaaauagaagcaacaaaaaaauuacaacaagaaaugaugagaguaaaacaagcaauguuacuagaaggaggauuuucagaaacggacgcagcaaggggagcaauaaaugcaccaaugacaaaaacacuagauuggucaggaacacgauacugggcaccugaugccagaacaacaacauauaacgcaggaagauucucaacaccacaaccaucaggagcauuaccaggacgagcgaguuuaagagcgacaguaccagcacgcggaaguucaagcaugagcucuaacucuagcauagcaacaagcguuuauucaaaccaaacaacaagcacaagauuaggaucgaccgcaggaucgggaacaagcguaagcucacuaccaagcacagccagaacaagaagcuggguagaggaccaaaacagaaauuuaagcccguuuaugagaggagcacacaacauaagcuuuguaacaccaccaagcucaauaaguucaucacaaggaacaguaaguacagucccaaaagaaguauuagacucauggacaggagcauuuaauacaagaagacaacccuuauucgcucacauaagaaaaagaggagaaucaagaguauaa

SEQ ID NO: 35258 - RNA, 807 nt, Artificial Sequence
  derived and/or modified sequence opt6 from capsid_protein_VP2__Norovirus__AHX22055
auggcaggagcauucuuugcaggauuagcuagugacguauuaggaucaggacuaucaucacuaauaaaugcaggagcaggagcaauaaaucaaaaaguagaauacgaaaacaauagaaaacuacaacaagcaaguuuucaauuuagcucaaacuuacaacaagcaucauuucaacacgauaaagaaaugcuacaagcacaaauugaagcaacaaaaaaauugcaacaagaaaugaugagaguaaaacaagcaauguuauuagaaggaggauucucagaaacagacgcagcaagaggagcaauaaaugcaccgaugacaaaaacacuagauuggucaggaacaagauacugggcaccagaugcaagaacaacaacauauaacgcaggaagauucucaacaccacaaccaagcggagcauuacccggaagagcaaaccuaagagcaacuguaccagcaagagguagcuccucaacaagcucaaacucaaguauagcaacaagcguauacucaaaccaaacaacacuaacaagauuaggaucgacagcaggaucaggaacaagcguaagcucacucccgucaacagccagaacaagaagcuggguagaagaccaaaacagaaaccuaucaccauucaugagaggagcacauaacauaagcuuuguuacaccaccaaguucaagaucaagcucacaaggaaccguaaguacaguaccaaaagaaguauuagacucauggacaggagcauucaauacaagaagacagccauuauucgcucacauuagaaaaagaggagaaucgagaguauga

SEQ ID NO: 35259 - RNA, 693 nt, Artificial Sequence
  derived and/or modified sequence opt6 from capsid_protein_VP2__Norovirus__AII02849
auggcaggagcauucauagcaggauuagcaggagacaugcuaacaaacacagucggaucacuagucaacgcaggagcaaacgcaaucaaccaaacaauagacuucgaaaacaacaaauacuuacaaaacgcaucauucaaccacgacaaagaaaugcuaaaugcacaaauagaagcaacaaaaagacuacaagcagacaugauagcaauaaaacaaggaguauuaacagcaggaggauucucaccaacagacgcagcacgaggagcaauaaaugccccaaugacaaaaguacuagacuggaacggcacaagauauugggcaccaggagcaacaucaacaacaucaaugucaggaggauucaucaaccaaacaguacacagaucaacaccaaacuucaaaacaaaccaagcaccaaaaccagcaccaucaucaggaucaucaguaagaucaaacucaacacaaauaacaucacuaucaucacacuccucaggcucaucaagaucaucaggaucuaccguaguaucaucaauaccaucaucaaacagaacacgagacuggguaaaccaacaaaacuucaaccuagaaccacacaugccaggaucacuacgaacagccuucgucacaccaccauccucaacagccucaucaagcggaacaguaucaaccguacccaaaaacguauuagacucauaa

SEQ ID NO: 35260 - RNA, 804 nt, Artificial Sequence
  derived and/or modified sequence opt6 from capsid_protein_VP2__Norovirus__AKE07101
auggcaggagcauucuuugcaggacuagcaucagauguauuaggaucaggccuaggaucauuaauaaaugcaggagcuggagcaauaaaccaaaaaguagaauucgaaaacaauagaaaacuacaacaagcaucauuccaauuuucaucaaaccuacaacaagccucauuccaacacgauaaagaaauguuacaagcacaaauagaagcaacaaaaaaacuacaacaagaaaugaugaaaguaaaacaagcagucuuauuagaaggcggauucucagaaacagacgcagcaagaggagcaauaaaugcccccaugacaaaagcucuagacuggucaggaacaagauacugggcuccagaugcaagaacaacaacauauaacgcaggccauuuuucaacaccacaaccaucaggagcaccacuaggaagagcuaacuuaagagcagcaguacccacaagagggucaucuucaacaagcaguaauucuucaauagcaacaucaguauacucuaaccaaacagcaaguacaagacuaggaucaacagcaggaucaggagcaagcguaagcucauuaccauccacugcaagaacaagaagcuggguagaagaccaaagaaacuuaucaccauucaugagaggagcacacaauauaucuuucguaacaccaccaucuucaagauccucaagccaaggaacaguaucaacaguaccaaaagaaguauuagacucauggacaggagcauuuaacacaagaagacaaccucuuuuugcucauaucagaaaaagaggagaaucaagaguauag

SEQ ID NO: 35261 - RNA, 807 nt, Artificial Sequence
  derived and/or modified sequence opt6 from capsid_protein_VP2__Norovirus__AKE07104
auggcaggagcauucuuugcaggacuagcaagcgauguacuaggaucaggcuuaggcucauuaauaaacgcaggagcaggagcaauaaaccaaaaaguagaauucgaaaacaauagaaaacuccaacaagcgagcuuccaauuuagcucaaacuuacaacaagccucauuucaacacgauaaagaaaugcuacaagcacaaauagaagcaacaaaaaaacuacaacaagaaaugaugaaaguaaaacaagcaguauuacuagaaggaggauucucugaaacagacgcagcaagaggugcaauaaaugcaccaaugacaaaagcacuagauuggucaggaacacgcuauugggcaccagaugcaagaacaacaacauauaaugcaggaagauucucaaccccacaaccaaguggaauauuacccggaagagcaaacuuacgagacacaguaccagcaagaggaagcucaucaacuagcucaaaaucuaguauagcaacaaguuuauacucaaaucaaacagcaacaacaagacuaggaucaacagcaggcucaggaacgaguguaagcucauuaccaagcacagcaagaacaagaaguuggguagaagaucaaaaccgaaauuuaagcccauucaugagaggagcccauaacauaucauucguaacacccccaaguucacgaucaucaucacaaggaacaguaagcacaguaccaaaagaaguauuagacucauggacaggagcauucaacacaaggagacaaccauuauuugcacauauaagaaaaagaggggaaucgcgaguauaa

SEQ ID NO: 35262 - RNA, 807 nt, Artificial Sequence
  derived and/or modified sequence opt6 from capsid_protein_VP2__Norovirus__AKE07107
auggcaggagcauucuuugcaggacucgcgagcgauguauuaggcucaggauuaggaucauuaauaaacgcaggagcaggagcaauaaaucaaaaagucgaauucgaaaacaauagaaaacuacaacaagcaaguuuucaauuuucaucaaacuuacaacaagccucauuccaacacgauaaagauauguuacaagcacaaauagaagcaacaaaaaaauuacaacaagaaaugaugagaguaaaacaagcaaugcuauuagaaggaggauucucagaaacagacgcagcuagaggagcaauaaaugcaccaaugacaaaagcacuagauuggucaggaacaagauauugggcaccagaugcaagaacaacaacauauaacgcaggccacuucucaacaccacaaccaagcggagcacuaccaggaagagcaaaccuaagagcagccguaccagcaagaggaccaucaagcacaagcucaaacucuucaacagccacaagcguauacucaaaucaaaccacaagcacgagauuaggaucaacagcaggaucaggagcaaguguaucaucguuaccaucaacagcaagaaccguaaacuggguaagagaccaaaacaggagcuuaaguccauucaugcgaggugcacauaacacaagcuuuguaacaccaccaucaucaagaucgagcucacaaggaacaguaaguacaguaccaaaagaaguauuagacucauggacaggcgcauuuaauacaagaagacaacccuuauucgcacacauaagaacaagaggagaaucgagaguuuaa

SEQ ID NO: 35263 - RNA, 765 nt, Artificial Sequence
  derived and/or modified sequence opt6 from capsid_protein_VP2__Norovirus__ALE30634
auggcaggugcauucauagcaggacuagcaggagacaugcuaacaaacacagucggaucccuaguaaaugcaggagcaggagcuauaaaccaaaaaguagacuucgaaaacaacaaauaccuacaaaacgcaucauucaaccacgacaaagaaauguuaaacgcacaaauagaagccacaaaacgccuacaagcagacaugaucgcaauaaaacaaggaguacuaacagccggaggauucucaccaacagacgcagcaagaggagcaauaaacgcaccaauaaccaaaguacuagacuggagcggaacaagauauugggccccaaacgccacaucaacaacaucaaugagcggaggauucacuggacaagcaguacaucgagcaacuccaaacuuuaaaacaaaccaagcaccaaaaucaaccccauccuccggaucaucaguaagaagcucuucaacacaacuaacaaaccucucaucacauuccucaggaaguucaagaucaucaggaucaacaaugguaucaucacuaccaucauccucaagaacaagagacuggguaaaucaacaaaacuucaacuuagaaccacacaugccaggaucacuaagaacagcuuucguaacacccccaucuucaacagcaucaucacuagacacaguaucaacagucccaaaauccguacuagacucauggacaccagcauuuaacacaagaagacaaccacuauucgcacaccuacgaagaagaggagaauccaacauauaa

SEQ ID NO: 35264 - RNA, 765 nt, Artificial Sequence
  derived and/or modified sequence opt6 from capsid_protein_VP2__Norovirus__ALE30636
auggcaggagcauucaucgcaggacuagccggagacaugcuaacaaacaccguaggaucacuaguaaaugcaggagcaggagccauaaaccaaaaaguagacuucgaaaacaauaaauaucuacaaaaugcauccuucaaccacgacaaagaaaugcuaaacgcucaaauugaagcaacaaaaagacuacaagcagacaugauagcaaucaaacaaggaguacuaacugcaggaggcuuuucaccaacagacgcagcaagaggcgcaaucaacgcaccaauaacaaaaguacuagacuggucuggaacacgauacugggcaccaaacgcuacaucaacaacaucaaugucaggaggauuuacaggacaagcaguacacagagcuacaccaaacuucaaaacaaaccaagcaccaaaaucaaccccaucaucaggaucuucaguaagaucaucuucaacacaauuaacaaaucuaucaucacacucaucaggaucaucaagaucaucaggauccacaaugguaucuucacuaccaucauccucaagaacaagagacuggguaaaccaacaaaacuucaacuuagaaccacacaugccaggaucauuaagaacagcauucguaacaccuccaucaucaacugcaucaucacuagacaccguauccacaguaccaaaaucaguauuagacuccuggacaucagcauucaacacacauagacaaccauuauucgcacaucuaagaaaacgaggcgaaucaaacguauaa

SEQ ID NO: 35265 - RNA, 780 nt, Artificial Sequence
  derived and/or modified sequence opt6 from capsid_protein_VP2__Norovirus__BAR42290
auggcaggagcauucauagcaggauuagcaggagauaugcuaacaucaucaguaggaucacuagucaaugcaggagccaaugcaauaaaucaaaaaauagauuucgaaaacaacaaacaacuacaaucugcauccuuccaacacgacaaagaaaugcuacaagcacaaguaagagcaacaaaacaacuacaaucagaaaugauagcauuaaaacaaggaguacuagcagcaggcggauucucuccaacagaugccgcacgaggaucaauaggagcaccaaugacuaaaguauuagauuggucuggaacaagauacugggcaccaaacuccacaaaaacaacagguuacuccggccaauuuacauccucaccaguccacauguccucaccaaacgcaccacaaucaaaaccagcaaaaccaagaucucuagccccaucaucaucaucaucaucaguauauucaauguacacacaaucaacacaccuaacauccggaucauccucaaacgccucauccgcaucaacaaaacuaacaucacuaucaucaggcucaucccaaaacagaacagcagaaugggucaaucaacaaagaucauuaucccccuucauguccggagcccucaacauaucacacguaacacccccaucaucaagagcauccucaucuggaacaguaucaacaguacccaaagaaguacuagacucauggacaucagcauucaauacacaccgacaaccuuuauucgcacauuuaagaguaagaggcgaaucaagaguauaa

SEQ ID NO: 35266 - RNA, 780 nt, Artificial Sequence
  derived and/or modified sequence opt6 from capsid_protein_VP2__Norovirus__BAR47617
auggccggcgcauucauagcaggacuagcaggagacauguuaacaucaucuguaggaucucuaguaaaugcaggagccaacgcaauaaaccaaaaaauagacuucgaaaauaacaaacaacuacaauccgcuuccuuucaacacgacaaagaaaugcuacaagcacaaguaaaagcaacaaaacaacuacaaucagaaaugaucgcccuaaaacaaggaguauuagcagcaggaggauucucaccaacagacgccgcaagaggagcaauaggagcuccaaugacaaaaguauuagacuggucaggaacacgauacugggcaccaaacucaacaaaaaccacaggcuauucaggacaauuuacaucaucacccguacacaugcccucaccuaacgcaccacaaucaaaaccagccaaaccaagaucacuagcaccaucauccucaucaucaucagucuacucaauguccacacaaucaacacaccuaacaucaggauccucaucaaacgcaucaucagcaucuacaaaacuaacaaaccucuccucuggauccucacaaaacagaaccgcagaauggguaaaccaacaaagauccuuauccccauucaugucaggagcacuaaacauaucacacguaacacccccaucaucaagagcaucaucaucaggcacaguaucaacaguaccaaaagaaguacuagacucauggacaucagcauucaacacacaccgacaaccauuauucgcacacuuaagaguaagaggagaaucaagaguuuaa

SEQ ID NO: 35267 - RNA, 780 nt, Artificial Sequence
  derived and/or modified sequence opt6 from capsid_protein_VP2__Norovirus__BAR63716
auggcaggcgccuucauagcaggacuagcaggagacaugcuaaccucaucaguaggcucauuaguaaacgcaggagcaaacgcaauaaaccaaaaaauagacuucgaaaauaacaaacaacuacaaucagccuccuuccaacacgacaaagaaaugcuacaagcacaaguaaaagcaacaaaacaacuacaaucagaaaugauagcacuaaaacaaggaguacuagcagcaggcggauucucaccaacagacgcagcaagaggagcuauaggagcaccaaugacaaaaguucuagacugguccggaacacgauauugggcaccaaacucaacaaaaacaacaggauacucaggucaauucacauccucaccagucagaaugccaucuccaaacgccccacaaucaaaaccagcaaaaccaagaucacuagcaccaucuucaucaagcucaucaguauacucuaugucaacacaaucaacacaccuuacaucaggauccucaucaaacgccagcuccgcaucaacaaaauuaacaaaucuaucaucuggcucaucacaaaacagaacagcagaauggguaaaccaacaaagaucacuaucaccauucaugucuggagcacuaaauauaucacacguaacacccccaucaucaagagcuuccucauccggaacaguaucaacaguaccaaaagaagucuuagacucauggacaucagccuucaauacacacagacaaccacuauuugcacaccuaagaguacgaggagaaaguagaguauaa

SEQ ID NO: 35268 - RNA, 780 nt, Artificial Sequence
  derived and/or modified sequence opt6 from capsid_protein_VP2__Norovirus__BAR63719
auggccggagcauucauagccggccuagcaggcgauauguuaacauccucaguaggaucauuaguaaacgcaggagcaaacgcaauaaaccaaaaaauagacuucgaaaauaacaaacaacuacaaucagcauccuuucaacacgacaaagaaaugcuacaagcccaaguaaaagcaacaaaacaauuacaaucagaaaugaucgcacucaaacaaggagucuuagcugcaggaggauuuucaccaacagacgcagcaagaggagcaaucggagcaccaaugacaaaaguacuagauuggucaggcacaagauacugggcaccaaacucaaccaaaacaaccggauacucaggacaauucacaucaucacccguacacaugcccucaccaaacgcaccacaaucaaaaccagccaaaccaagaucacuagcaccaucaucaucaucauccucaguauacuccaugucaacacaaucaacacaccuuaccucaggaucaucaucaaacgcuuccucagcauccacuaaacuaacaaaccuaucaucaggcucaucacaaaaccgaacagcagaauggguaaaccaacaaagaucacuaucacccuucaugucaggagcacuaaacauaucacacguuacaccuccauccucaagagcaagcucaucaggaaccguaucaacaguaccaaaagaaguacuagauucauggacaucagcuuuuaacacacauagacaaccacuauuugcacauuuaagaguaagaggugaauccagaguauaa

SEQ ID NO: 35269 - RNA, 780 nt, Artificial Sequence
  derived and/or modified sequence opt6 from capsid_protein_VP2__Norovirus__BAR63722
auggcaggagcauuuauagcaggacuagcaggagacaugcuaacaucaucaguaggaucauuaguaaacgcaggagcaaacgcaaucaaccaaaaaauagacuucgaaaauaacaaacaacuacaaucagccucauuccaacacgacaaagaaaugcuucaagcacaaguaaaagcaacaaaacaacuucaaucagaaaugauagcccuuaaacaaggaguauuagcagcaggaggauucucaccaacagacgcagcaagaggagcaauaggagcaccaaugacaaaaguauuagauuggucaggaaccagauacugggcaccaaauucaacaaaaacuaccggcuacucaggacaauucacauccucacccguacacaugccaucaccaaacgcaccacaauccaaaccagccaaaccaagaucacuagcaccaucaucaucauccucuucaguauacucaaugucaacacaaucaacacaccuuaccucaggauccucaucaaacgccucaucagcaucaacaaaacuaaccaaccuaucaucuggaucaucccaaaacagaacagcagaauggguaaaccaacaaagaucacuaucacccuucaugucaggagcccuaaacaucucccacguaacaccaccaucauccagagcaucaucaucuggaacaguaucaacaguaccaaaagaaguacuagacuccuggacaucagcauucaacacacacagacaaccacuauucgcacacuuaagaguaagaggagaaucacgaguauaa

SEQ ID NO: 35270 - RNA, 807 nt, Artificial Sequence
  derived and/or modified sequence opt6 from capsid_protein_VP2__Norovirus__BAS02084
auggcaggagcauucuuugcaggauuagcgagugauguauuaggaucaggcuuagguucacuuauaaacgcaggcgcaggagcaauaaaucaaaaaguagaguuugaaaauaaucgaaaacuccaacaagcaagcuuucaauuuaguucaaaccuacaacaagcaucauuucaacacgauaaagaaauguuacaagcacaaauagaagcaacuaaaagauugcaacaagaaaugaugaaagucaaacaagcaauguuacuagaaggcggauuuucagaaacagacgcagcaaggggagcaaucaaugcaccaaugacaaaagcauuagacuggaauggaacaagauauugggcacccgaugcaagaacuacaaccuauaacgcaggaagauucucaacaccacaaccaaguggagcauugccaggaagagcaaacuuaagagaugcaguaccagcacgaggaagcucauccaaaaguucaaacucaaguacagcaacaagcguauacuccaaccaaacaauaagcacacgauuaggcucaacugcaggaucaggaacaagcguaagcucauucccaagcacagccagaacaagaaguuggguagaagaccaauccagaaaccuaagcccauucaugagaggagcacauaacauaagcuuuguaacgccaccaagcucaagaucgagcucacaaggaacaguaaguacaguaccaagagaaauauuagacucauggacgggagcauucaauacaagacgucaaccauuauucgcacacauaagaaaaagaggagaaucaagaguauaa

SEQ ID NO: 35271 - RNA, 627 nt, Artificial Sequence
  derived and/or modified sequence opt6 from capsid_protein_VP2__Norovirus__CRL46953
auggcacaagcaauaauuggagcaauagcagcaucagcagcaggaucagcauuaggagcaggaauacaagcaggagcagaagcagcacuacaagcacaaagauaccaacaagaccuaacucuacaacaaaacucauucaaccacgacaaagaaaugcuaggauaccaaguagaaaugucaaacaaacuacuagcaaaaaauuuaaacacaagauacucacuacuacaagcaggaggacuaucaccaucagacgcagcaagagcaguagcaggcgcacccguaacaagacuaguagacuggggcggaguaagaguagccgcaccacaaucuucagcaacaaccuuacgaagcggaaacuucauggcaguaccauuaccagcacaaccaaaacaaaaaccacuagcaucagaaggauacucaaaccccgcauacgacccaaugcaacgaacagcaucauggguacaaucccaaaacucaucaagaaacuggucaccauaccacagacaagccuuacaaacaguauggguaacaccaccaggaucaacaucaucaucaucaguaucaacagcaccaagaggauacuucaacacagacagacuaccacuauucgcaaaccuaagacgauaa

SEQ ID NO: 35272 - RNA, 630 nt, Artificial Sequence
  derived and/or modified sequence opt6 from capsid_protein_VP2__Norovirus__CRL46956
auggcacaagcaguaauaggagcaauagcagcaucagcagcagguucaauacuaggagcaggaauacaagcuggagcagaagcaggauuacaagcacaaagauaccaacaagaccuacaacuacaacaaaauucauuuaaacacgacaaagaaaugcuaggauaccaaguccaagccucuaacgcacuauuagcaaaaaaccuaaacacaagauaugcauuacuacaagcaggaggacuuucaucagcagacgcagcaagagcaguagcaggagcaccaguaacaagaaucguagacuggaacggaacaagaauagcagccccagccucaucagcaacaacacuaagaucaggaggauuuauggcaguaccaauaccacucucaucaaaaacaaaacaaccaguaaugucaggacaagauaacccaaacuacgcagcaucaucaauaucaagaacagcaucauggguacaaucacaaaacucaaugagaucaguaucaccauuucacucagacgcacuaagaacaguauggguaacaccaccaggaucaucaucaacaagcucaguacaaucaucauucuacggaguauucaacacagauagauuacccuuauucgcaaauagaagauaa

SEQ ID NO: 35273 - RNA, 807 nt, Artificial Sequence
  derived and/or modified sequence opt6 from capsid_protein_VP2__Norovirus__CRL46959
auggcaggagcuuucuuugcaggacuagcaucagauguauuaggaucaggcuuaagcucauuaauaaacgcaggagcaggcgcaauuaaucaaaaaauagauuucgaaaacaacagaaaacuacaacaagcuuccuuucaauuuuccucaaauuuacaacaagcaucauuccaacacgauaaagaaauguuacaagcacaaguagaagcaaccaaaaaauuacaacaagaaaugaugaaaguaaaacaagcaauauuacuagaaggaggauucucagcaacagaugcagcaagaggagcaauaaaugcaccaaugaccaaaguacuagauuggaacggaacuagauauugggcuccagaugcaaggacaacaacauacaacacaggucauuucucaacaccacaaucaagcggagcacuacccggacgaacuaacccaagaauaccaacaccagcuagagcaucaucaaguacaucaucaaaugcaagcacagcaacaaguauaucaucaaaucaaacaguaagcacaagacuaggaucaacagcgggaaguggaacaaacguauccucauuaccaucaacugcaagaacaagaucauggguagaagaccaaaauagaaacuuaagcccauucaugagaggagcacauaacauaagcuuuguuacaccaccaucaucaagaucaagcucacaaggaacaguaagcacaguaccaaaaggaguauuagacucuuggacaggagcguucaauacccgaagacaaccacuauucgcauacacacacagaagaggagaaucaagaguauaa

SEQ ID NO: 35274 - RNA, 807 nt, Artificial Sequence
  derived and/or modified sequence opt6 from capsid_protein_VP2__Norovirus__CRL46962
auggcaggagcauuuuuugcaggacuagcaucagauguauuaggaucuggauuaggcucuuuaauaaacgcaggagcaggagcaauaaaucaaaaagucgaauucgaaaauaauagaaaacuacaacaagcaucauuucaauuuuccucuaacuuacaacaagcaucauuucaacaugauaaagaaauguuacaagcacaaauagaagcaacaaaaaaauuacaacaagaaaugaugaaaguaaaacaagcaauguuacuagaaggaggauucucagaaacagacgcagcaagaggagcaaucaaugcaccaaugacaaaagcacuagauuggucaggaacaagauauugggcaccugaugccagaaccacaacauauaacgcagguagauucucaaccccacaaccaucaggagcauuacccggaagagcuaaccuaagagaugcaguaccagcaagaggacccucaagcaaauucucaaacucaagcacagccacaagcguauacucuaaucaaacaauaaguacaagauuaggaucaacagcaggaucaggaacaucaguaucaucacucccgagcacagcaagaacaagaagcuggguagaagaccaaucaagaaaccuaaguccauucaugggaggagcacauaacauaucauuuguaacgccaccguccucaagaucaagcucacaaggaacaguaucaacuguaccaaaagaaauauuagacucauggacaggagcauucaauacaagaagacaaccauuauucgcacacauaagaaaaagaggagaaucuagaguauaa

SEQ ID NO: 35275 - RNA, 807 nt, Artificial Sequence
  derived and/or modified sequence opt6 from capsid_protein_VP2__Norovirus__CRL46965
auggcaggcgcauucuucgcaggucuagcaagcgacguccuaggaucaggauuaggaucacuaauaaacgcaggagcaggagcaauaaaucaaaaaguagaauucgaaaacaauagaaaacuacaacaagcaagcuuucaauucagcucaaauuuacaacaagcaucauuccaacacgauaaagaaauguuacaagcacaaauagaagcaaccaaaaaauuacaacaagaaaugaugaaagucaaacaagcaguauuacuagaaggaggauucucagaaacagaugcagccagaggagcaauaaaugccccaaugacaaaagcacuagauuggucaggaacaagauauugggcaccagacgcaagaacaacgaccuauaacgcaggaagauucucaaccccacaaccaaguggagcauugcccggaagagcaaacuuaagagaugcagcuccagcgagaggaagcucaaguaaaucaucaaauucauucacagcaacaucaguauacucaaaucaaacaacaagcacaagauuaggaucaacagcaggaucaggaacaucaguaagcucacuaccgucaacagccagaacaagaucauggguagaagaucagagcagaaaccuaucaccauucaugagaggagcacauaacauaagcuucguaacaccaccaaguucaagaucaucaucacaaggaacaguaagcacagucccaaaagaaguacuagacucauggacuggagcauucaauaccagaagacaaccauuauucgcacauauaagaagaagaggagaaucaagaguauaa

SEQ ID NO: 35276 - RNA, 777 nt, Artificial Sequence
  derived and/or modified sequence opt6 from capsid_protein_VP2__Norovirus__CRL46968
auggcaggagcauuccuagcaggauuaguuggagacgcuauaaccucaggaguaggaucauuaauaaacgcaggagcaaacgcaauaaaccaaaaaguagaauacgacuucaacaaacaacuacaacuagcaucuuuuaaacacgacaaagaaaugcuacaaucacaaguauuagccacaaaacaacuacaacaagaaaugaugaacauaagacaaggaguacuaucugccggaggcuucucaccaacagacgcagcacgaggagcaguaaacgcaccuaugacaaaaauacuagacuggaacggaacacgauacuucgcaccaaacucaaugaaaacaacaucauauucaggacaauucucaucaaauccaguacacagacaaccaacaucaccaagaucagacccaccaaaaauaaaaguaaacucagacucagcaucaguauacuccucagcuucaucagcaccaucucaaucuacacacucaaccgcacuaacagcaggaucaucaucaucccgcacaacaucaucaucagcagcagcaucaacacuaucacgaacaucagacugggucagaggacaaaacgaaagacuaucucccuucauggacggagcacuacaaacaacauuuguaacaccacccuccucaaaagcaucaucauauggauccguaucaacaguaccaaaagcaguacuagauucauggaccccaauguucaauacacacagacaaccacuauuugcacacguaagaagaagaggagaaucacaaauauaa

SEQ ID NO: 35277 - RNA, 765 nt, Artificial Sequence
  derived and/or modified sequence opt6 from capsid_protein_VP2__Norovirus__CRL46971
auggcaggcgcauucauagccggauuagccggcgacaugcuaacaaacacaguagguucacuaguaaacgcaggagcaaacgcaauaaaccaaaccauagacuuagaaaacaauaaauacuuacaaaacgcaucuuucaaccaugacaaagaaaugcuaaacgcacaaauagaagcaacaaaaaaauuacaagcagacaugauagcaauaaaacaaggaguacuaacagcaggaggauucagcccaacagacgcagcacgaggagcaaucaaugcaccaaugacaaaaguacuagacuggaauggaacaagacacugggcaccaggcgcaacaucaacaacaucaaugucaggaggauuuacacaccaaacaguacaucgaucaacaccaaauuucaaaacaaaucaagcaccaaaaucuaccccaucaucaggaucaucaguaagauccaacucaacacaaauaacaucacuaucaucacacucaucaggaucaucaagaucaucaggaucaacaguaauacgaucaauaccauccucagacagaacaagagacugggucaaccaacaaaacuucaaccuagaaccacacaugccaggaucacuaagaacagcauucguaacacccccaucaucaacagcaagcucauccggaacagucucaacagucccaaaaaacguauuagacagcuggacaucagcauucaacacaagaagacaacccuuauucgcacaccucagaagaagaggcgaaucaaacguauaa

SEQ ID NO: 35278 - RNA, 771 nt, Artificial Sequence
  derived and/or modified sequence opt6 from capsid_protein_VP2__Norovirus__CRL46974
auggcaggagcauucguugcaggacucgcaggagacauaguaaccaacuccauaggaucauuaguaaacgcaggagcaaacgcaauaaaccaaaaaguagacuuugaaaacaacaaacaauuacaacaagcaagcuucaaccacgaccaagaaaugcuacaagcacaaauacaagcaacaaaacaacuacaagcagacaugauagcacuaagacaaggaguauuaaccgcaggaggauucuccccaacagacgcagcuagaggagccguaaaugcaccaaugacacaaguucuagacugguccggaacaagauauugggcccccggugcaaccaaaaccacagcauucucaggaggauucacaucaucaccaaacacacgaacaaucguaccaaaaaaaacuucagccacaccagcaucaacaucaguaucaagaccaucaucacuagcaucaacagcauccacaagauccacauucguaucaggaacaagcuccuuaucaucaucaacacgaucauccuuuaacucacaaccaacaucaucauccucuagaacaucagaauggguaagaucacaaaacagaguacuagaaccauacaugagagguucacuacaaacagcauucguaacaccaccaucaucuagagcaucaucaaacggaacaguaucaacaguccccaaagaaguacuagacucauggacuuccguauucaacacacacagacaaccauuauucgcacaccuaagaagacgaggagaaucacaaguauaa

SEQ ID NO: 35279 - RNA, 807 nt, Artificial Sequence
  derived and/or modified sequence opt6 from capsid_protein_VP2__Norovirus__CRL46977
auggcaggagcguucuuugcaggacuagcauccgauguauuaggcucaggauuaggaucacuaauaaacgcaggcgcgggagcaauaaaucaaaaaguagaauucgaaaacaauagaaaacuacaacaagcaagcuuucaauuuagcucaagcuuacaacaagcaucauuccaacacgauaaagaaauguuacaagcacaaauagaagcaacaaaaaaacuacaacaagaaaugaugagagucaaacaagcaaugcuacuagaaggaggauucucagaaacagacgcagcaagaggagcaauaaaugcaccaaugacgaaaacauuagauuggucgggaacaagauauugggcaccagaugcaagaacaacaacauacaacgcaggaagauucucaacaccacaaccaaguggagcauuacccggacgagcaaacuuaagagcaacagcaccagcaagaggaagcucaagcaugagcucaaacucaagcauagcaacaaguguauauucaaaccagacaacaagcacaagacuaggaucaacagcaggcucaggcacaaguguaaguucauuaccaaguacggcacgaacaagaaguuggguagaagaucaaaacagaaaccuaaguccauucaugcgcggagcacauaacauaucauuuguaacaccaccaaguucuagaucaagcucacaaggaacuguaagcacaguaccaaaagaaguccuagacucuuggacaggagcauucaauacaaggagacaaccauuauucgcgcacauaagaaaaagaggagaaucuagagcauaa

SEQ ID NO: 35280 - RNA, 807 nt, Artificial Sequence
  derived and/or modified sequence opt6 from capsid_protein_VP2__Norovirus__CRL46980
auggcaggagcauucuuagcaggacuagcaagugauguacuaggaucaggauuaggaucacucauaaacgcaggagcaggagcaauaaaucaaaaaguagaauucgaaaauaauagaaaacuccaacaagcgaguuuucaauucagcucaagcuuacaacaagccucauuccaacacgauaaagaaauguuacaagcacaaauagaagcaacaaaaaaacuacaacaagaaaugaugagaguaaaacaagcaauguuacuagaagguggauucucagaaacagacgcagcaagaggagcaauaaaugcaccaaugacaaaaacauuagacuggucaggaacaagauauugggcaccagaugcaagaacaacaacauauaacgcaggaagauucucaaccccacaaccaagcggagcacugccaggacgcgcaaacuuaagagcaacagcaccagcgagaggaagcucaucaaugagcucaaacucaagcauagcuacaaguguauauucaaaccaaacaacaaguacuagauugggaucaaccgcaggcucaggaacaagcguaaguucacuaccaaguacagcaagaacaaggagcuggguagaagaccaaaacagaaaccugagcccauucaugcgaggagcacacaacauaagcuuuguaacaccaccaagcucacgaucaagcucacaaggaacaguaagcacaguaccgaaagaaguauuagacucguggacaggagcauucaacacaagacgccaaccacuauucgcacacauaagaaaaagaggagaaucuagagcauaa

SEQ ID NO: 35281 - RNA, 1623 nt, Artificial Sequence
  derived and/or modified sequence opt11 from capsid_protein_VP1__Norovirus__ABY65350
augaaaauggccagcaacgacgcaaaccccuccgacggcucagccgccaaccucguccccgaaguuaacaacgaagucauggcccucgaacccgucguaggagccgccaucgccgcccccgucgccggccaacaaaacgucaucgaccccuggauccgaaacaauuucguacaagcaccuggcggcgaguucaccgucucuccccgcaacgcccccggagaaauccucugguccgcaccccuaggccccgaccucaaccccuaucuaucucaccuugcccgcauguacaauggcuacgccggcggcuucgaaguccaagucauccucgccgguaacgccuucacugccggcaaaauaauauuugccgccguaccgcccaacuuuccaacagaaggccucucaccuucgcaagucaccauguucccacacauaaucguagacguccgacaacucgaaccaguucuaauaccucuccccgacguccgaaacaacuucuaccacuacaaccaauccaaugacuccaccauaaaacuaaucgccaugcuauacacaccccuacgagccaacaacgcgggagaagacgucuucaccgucuccugcagaguccuaacccgcccuuccccagacuuugacuucaucuuccuuguaccucccacugucgaaucucgaaccaaacccuucaccgucccaauccucacagucgaagaaaugacuaacagccguuucccuaucccccucgaaaaacuauuuaccggcccaucauccgccuuugucguccaaccacaaaacggacgcugcaccacagauggcguacuccuaggcaccacacaacucagccccgucaacaucugcacauuccgcggcgacguaacccacauagccggaucacgaaacuacacuaugaaccucgccagccuuaacuggaacaacuacgacccaaccgaagaaauccccgcaccccucggaacacccgacuucgucggaaaaauccaagguguccucacucaaaccaccaaaggcgauggauccacacgcggucacaaagccaccgucuacaccggcucugccccuuucaccccaaaacucggauccguccaauccucuaccgacaccgaaaacgacuucgaaacgcaccaaaacaccaaguucacccccguaggcguaauacaagacggcagcaccacccaccgaaacgaaccccaacaguggguacucccuuccuacuccggacgcaauguccacaacguacaccucgcccccgccgucgcccccacauuccccggcgagcaacuccuauucuuccguuccacaguccccgguugcucaggcuacccuaauauggaccuagacugccuccucccccaggaauggguccaacacuucuaccaagaagccgcucccgcccaaagcgaugucgcacuacuccgauucgucaacccagacaccggacgaguacuauucgaaugcaaacuccacaaauccggcuacgucacggucgcccacaccggccaacacgaccucgucauacccccuaacggcuacuuccgcuucgacuccugggugaaccaauucuacacccucgccccaauggguaauggcacaggccggcgacgugcacucuaa

SEQ ID NO: 35282 - RNA, 1623 nt, Artificial Sequence
  derived and/or modified sequence opt11 from capsid_protein_VP1__Norovirus__ACO55068
augaaaauggcauccaacgacgcuaacccuucagacggauccacagccaacuuaguacccgaagucaacaacgaagucauggcccucgaacccgucguaggcgccgccaucgccgcccccgucgccggacaacaaaacguaaucgaccccuggauccgcaacaacuuuguccaagccccaggaggcgaauuuaccgucucaccucgaaacgcccccggagaaauccuaugguccgcaccccucggacccgaccucaaccccuaccuaucgcauuuagcccgaauguacaacggcuaugcaggcgguuucgaaguccaagucauccucgcaggaaacgccuucaccgcaggcaaaaucaucuucgccgccgucccacccaacuucccuacggaaggccuaucccccucccaaguaacaauguucccccacauaauagucgacguucgacaacuagaacccguccuaaucccccuccccgacguccgcaauaacuucuaccacuacaaccaauccaacgacccaaccaucaaacuuaucgcaaugcucuacacuccccuccgcgccaacaacgccggagaagacguauucaccgucucgugucgcguacucacuagacccucacccgacuucgacuucaucuuccuaguaccacccaccguugaaucccgcaccaaacccuucaccguccccauccucaccguagaagagaugaccaacucccgauuccccauacccuuagaaaaauuauucaccggccccucuggugcauucgucguucaaccccaaaacggccguugcacaaccgacgguguucuccucggaaccacccaacuaucucccguaaacaucugcaccuuucgcggcgacgucacacacaucgccggcacccacaacuacaccaugaaccucgcuucccaaaacuggaacaauuacgaccccgccgaagaaauacccgcaccccucggaacccccgacuucguaggccgcauacaaggcguauuaacccagaccacacgcggagacggcuccacccgcggccacaaagcaacagucuccaccggcgacguacacuucacucccaagcucggaucaauccaguucaacacagacacaaacaacgacuucgaaaccggccaaaacaccaaauucacaccagucggcguaguccaagacggcaauggcacacaccaaaacgaaccccaacaauggguacuucccucauacagcggccgcaccggccacaacgugcaccuagccccagccguugcaccaacuuuccccggagaacaacuacucuuuuuccgcagcacuaugcccggcugcuccggcuaccccaacaugaaccuugauugccuacuaccccaagaauggguccaacacuucuaccaagaagccgccccugcccaauccgacguagcccuacugcgauucgucaaccccgauacaggccgcguacucuucgaaugcaaacugcacaaauccggauacguaacugucgcccauacaggucagcacgaccucgucaucccacccaacggcuacuuccgcuucgacucaugggucaaccaauucuacacccucgccccuaugggcaacgguacgggccgccgcagagcccucuaa

SEQ ID NO: 35283 - RNA, 1623 nt, Artificial Sequence
  derived and/or modified sequence opt11 from capsid_protein_VP1__Norovirus__ADI45808
augaaaauggccagcaacgacgccaaccccagcgacggauccaccgcaaaccuuguccccgaaguaaauaacgaaguaauggcccuugaacccgucguuggugccgcuaucgccgcccccgucgcaggccaacaaaacguuaucgaccccuggauccgcaacaacuucguacaagcaccaggcggagaauuuacagucucaccacgcaacgcccccggcgaaauccucuggucagcaccccuaggcccagaccuaaaccccuaccucagccaccucgcccgcauguacaacggcuacgccggcggauucgaaguacaagucauccuagccgguaacgccuucacagcaggcaaaaucaucuucgccgcaguaccucccaacuucccaaccgaaggccugucuccuagccaagucaccauguucccccgcaucaucgucgacguucgccaacuagaaccaguccucauccccuuaccagacguacggaauaacuucuaccacuacaaccaaucaaacgacccaaccauaaagcucaucgccaugcuauacacaccacucagagcgaacaacgccggagacgacguauucaccgucagcugccgaguacucacacgccccucccccgacuucgacuucaucuuccuaguaccacccaccgucgaaucacgcaccaaacccuucaccguacccauccucacagucgaagaaaugaccaacucucgcuucccaauaccucuugaacgccucuacaccggcccuagcagcgcauucgucguacaaccacaaaacggccgaugcaccaccgacggaguccuccucggaaccacccaacucuccgccguaaacaucugcaccuuccgaggagaugucacacacauagccggcucccgcaauuacacuaugaaccuagccucccaaaacuggaacaacuacgaccccaccgaggaaauacccgcgccucuaggcacacccgacuucgucggaaaaauucagggaauguuaacacaaaccacacgaagcgacggauccacccgcggccacaaagccacaguccuuacaggcuccgccgacuucgcccccaaauuaggccgaguacaauucgccaccgauacugacaacgacuucgagucuggacaaaacaccaaauucacucccguaggcgugauacaagacgguuccaccacucaccgaaacgaaccacagcaauggguccuaccaaacuauucaggcagaaccggacacaacguucaccuagccccagccguggcaccuaccuaccccggagaacaacuacuuuucuuccgcuccacuaugcccggcugcucaggauaccccaacauggaccuagacugccuaauaccacaagacuggguccaacacuucuaccaagaggcggcccccgcccaaagcgacguagcccuccucagauucgucaacccagacaccggcagaguccucuucgaaugcaaacuccauaaauccggauacgucaccgucgcccacacaggacaacacgaccucguaauacccccaaacggcuacuuccgauucgacuccuggguuaaccaauucuauacucuagcccccaugggcaacggaaccggacgccgcagagcacuuuaa

SEQ ID NO: 35284 - RNA, 1623 nt, Artificial Sequence
  derived and/or modified sequence opt11 from capsid_protein_VP1__Norovirus__ADI45811
augaaaauggcuucaucugacgcaaaccccucagacggaucaacagcaaaucucguccccgaaguaaacaacgaaguaauggcauuagaacccguugucggugccgccaucgcagcccccgucgcuggccaacaaaaugucaucgacccauggauccgcaacaacuucguucaagccccaggcggcgaauuuacagucucaccccgcaacgccccuggcgaaaucccaugguccgcaccccuuggaccagaccuaaacccauaccucucacaccucgcccgaauguacaacggcuacgccggaggguucgaaguccaaguaauacuugccgggaacgccuucacugccgguaaaauaauauucgccgccgucccacccaacuuccccacugaaggacuaucccccucacaagucaccauguucccccacaucauaguagacgugcgacaacucgaaccaguccucaucccccucccagacguccgcaacaacuucuaccacuacaaccaaagcaacgaccccacuauaaaacucaucgccaugcuauacacaccacugagagccaacaacgcaggagacgaugucuucaccgucuccugccgaguucucacacgccccucucccgacuucgacuucaucuuccuagucccucccacuguggaaucacgcaccaaacccuucuccguccccauccuaaccgucgaagaaaugacaaacucucgauuccccauaccacucgaaaaacuauucacaggccccucauccgccuucgucguucaaccccaaaacggccgcugcacgaccgacgguguccuccuaggcaccacccaacuauccccaguuaauaucugcaccuuccgaggcgacgucacacacauaaccggcucacgaaacuacaccaugaaucucgcuacccagaauuggaacuccuacgacccuacagaagaaauaccagcaccccucggaacaccugacuucgucggaaaaauccaaggcguccucacccaaaccacccgagccgacggauccacccgcggccacaaagccaccgucuacaccggcucagcagacuucgcacccaaacucggcagaguccaauucgcuacagacaccgacaacgacuucgaugccaaccaaaacacaaaauucacacccgucggcguaauccaagacggagacacagcccaccgaaacgaaccccaacaauggguccucccaagcuacuccggccgcaauucccauaauguccaucucgcacccgccgucgcaccaaccuuccccggcgaacaacuccucuucuuccgcuccaccaugccagguugcucaggauaccccaacauggaucucgacugccuccucccccaagaauggguccaauacuucuaccaagaagccgcaccagcccaauccgacgucgcacuccuucgcuuuguaaacccagacaccggacguguacucuucgaaugcaaacuacacaaaucaggcuacguuaccguugcacacacaggccaacacgaccuaguuauacccccaaacggcuauuuccgauucgacuccugggucaaccaauucuauacccuggcccccaugggcaacggcaccggccgccgacgcgcccucuag

SEQ ID NO: 35285 - RNA, 1623 nt, Artificial Sequence
  derived and/or modified sequence opt11 from capsid_protein_VP1__Norovirus__ADI45812
augaaaauggccuccuccgacgcaaacccuuccgacggcagcaccgcaaaccuggucccagaagucaacaacgaagucauggcccuugaaccaguagucggugccgcgauagcagcuccagucgccggucaacaaaaugucauagaccccuggauccgcaacaacuucgugcaagcccccggcggcgaguucacugucucgccccgcaacgcccccggcgaaauacucugguccgcaccacuugguccagacuuaaacccauaccucucacaccucgcccgaauguacaacggcuacgccggcggcuucgaaguccaagucauccucgccggcaaugccuucacagccggaaaaauaauauuugcugccguuccacccaacuuccccaccgaaggccucucgcccucccaagucaccauguucccacacauaauagucgacgugaggcaacucgaaccagucuuaaucccauuacccgacguacgcaacaauuuuuaccacuacaaccagucaaacgacccaaccauaaagcucauugccaugcucuacacaccccuccgagccaacaacgcaggcgaugacgucuucaccgucuccugccgcguccucacucgcccaucacccgacuucgacuucaucuuccucgugccacccaccguugaaucccgcaccaaacccuucucaguacccauccucacagucgaagagaugaccaacucccgauuccccauaccccucgaaaaacucuucacuggcccauccuccgccuuuguuguccaaccccaaaacggacgauguacaacagacgguguccuacucggcaccacacaacugucacccgucaacaucugcaccuuccgaggagacguaacucacaucacaggcucacgcaacuauaccaugaaucucgccacccaaaacuggaacuccuaugaccccacagaagaaaucccagccccacuaggaaccccagacuucguuggcaagauccaagguguacucacccaaaccacccgcgccgacggcuccacccgcggccacaaagcaaccgucuacaccggaagcgcugacuuuacacccaaauuaggccgcguccaauucgccaccgacaccgacaacgacuucgacgccaaccaaaacaccaaauucacccccgucgguguaauucaagacggcaacacugcacaccgcaacgaaccccaacaauggguccuacccucauacucaggccgaaacucccacaacguccaccucgcccccgccguugcacccacauuccccggugaacagcuacucuucuuccgcagcaccaugcccggcugcucuggauacccaaacauggaccuagacugccuucucccacaagaauggguccaauacuucuaccaggaagccgcacccgcacaaucugacguugcccuucuuagauucgucaacccagacacaggccgaguacucuuugaaugcaaacuacacaaaucaggauacguaaccgucgcccacaccggccaacacgaucuaguuauaccacccaacggcuacuucagauucgacucaugggucaaucaauucuacacacucgcccccaugggaaacggcaccggcagacgccgcgcccuauaa

SEQ ID NO: 35286 - RNA, 1623 nt, Artificial Sequence
  derived and/or modified sequence opt11 from capsid_protein_VP1__Norovirus__ADI45814
augaaaauggccuccuccgacgccaaccccucagacggcucgaccgccaaccucguccccgaaguaaacaacgaaguaauggcacuagaaccaguagucggcgccgccaucgccgccccagucgcaggucaacaaaacgucaucgaucccuggauacgcaacaacuucguacaagcccccggcggcgaguucacagucucccccagaaacgccccuggcgaaauccuaugguccgcgccacuuggccccgaccucaaccccuaccucucucaccucgcccgcauguauaacggcuacgcaggcggcuucgaaguacagguuauccuagcugguaacgcauucaccgccggcaagauaauauucgcagccguucccccaaacuucccaaccgaaggauuaucaccaucucaaguaaccauguucccccacaucaucguggacguccgccaacuagaaccaguccucauaccauuacccgacguccgcaacaacuucuaccacuacaaccaguccaacgacccgaccaucaaacucaucgcaaugcuauacacaccccuucgagcuaacaacgcaggagacgauguauucacaguaagcugccgcguccucacccgccccuccccggauuucgacuucaucuuccuaguaccacccaccguugaaucccgcacaaagcccuucuccguacccauucuaacagucgaagagaugaccaacucccgcuuccccaucccacuggaaaaacucuucacaggacccucaagcgccuucgucguccaaccccaaaacggccgcugcaccacugacggaguccuacuuggcaccacccaacuaagccccguaaacaucugcaccuuucgaggcgacgucacccacaucgccggaucccgaaacuacaccaugaaccucgccacccaaaacuggaacucauaugauccaaccgaagaaaucccagcaccccucggaacccccgacuucgucggaaaaauccagggcguccucacccaaaccacccgcgccgacggguccacucgcggccacaaagccaccgucuacacaggcuccgcagacuucgccccgaaacucggccgcguacaauucgcaaccgacacagacaaugacuucgacgcaaaucaaaacaccaaguucaccccagucggcguuauccaagauggcgacaccgcccaccgaaaugaaccccaacaauggguccuccccagcuacuccggccgaaacucccacaacguucaccucgcccccgcagucgccccaaccuuccccggcgaacaacuccuauucuuccgcuccaccaugcccggaugcuccggcuaccccaacauggaucuagacugccuacucccucaagaauggguccaauacuucuaccaagaagccgcacccgcacaaucagacguagcccuccuccgcuucgucaaccccgacaccggccgcguacucuuugaauguaaacuccacaaauccggcuacguuacaguagcccauacuggccaacacgacuuaguuaucccacccaacggguacuucagauucgacucaugggucaaccaguuuuacacacucgcacccaugggcaacggcacaggacggcgcagagcccucuaa

SEQ ID NO: 35287 - RNA, 1623 nt, Artificial Sequence
  derived and/or modified sequence opt11 from capsid_protein_VP1__Norovirus__ADI45815
augaaaauggccucauccgacgccaaccccuucgacggcuccaccgcaaaccucgucccagaagucaacaacgaagucauggcucucgaacccgucgucggagcagccauagccgcacccgucgcuggccaacaaaauguaauagauccuuggauccgcaauaacuucgugcaagcacccggaggcgaguucaccgucucccccaggaaugcccccggcgaaauccuuuggucagcuccucuaggccccgaccucaacccauaccuuucccaucucgcccgcauguacaacggcuacgccggcggguucgaaguccaaguaauucuugccggaaacgccuucaccgccggaaaaaucauauucgcagccgucccucccaauuuucccacugaaggacuaucccccagccaagugaccauguucccacacaucauaguagacguccgacaacuggaaccaguccucaucccucuuccagacguccgcaacaauuucuaccacuacaaccaaucaaacgacccaaccauaaaacucaucgccaugcuauacacuccccuacgagccaacaacgccggcgacgacgucuucaccgucuccugccgcguccuaacccgaccaucacccgacuucgauuuuauuuuucuggucccacccaccgucgaaucccgcaccaaaccauucucugucccuauccucaccgucgaagaaaugaccaacuccagauuccccaucccacucgaaaaacucuuuaccggucccuccucagcauucgucguucaaccucaaaacggccgcugcacaaccgacggcguccuacucggcaccacacaacuuucccccgucaacaucugcaccuuccguggcgacguaacacacaucaccggcucacgcaacuacaccaugaaccuugccacucaaaacuggaacucauacgacccaaccgaagaaaucccagcaccccuuggcaccccugacuucguuggaaagauccaaggcguacuaacacaaacaacacgcgccgacggcuccacucgaggacacaaagcaaccguuuacacaggaucugccgacuucgcccccaaacuaggccguguccaguucgccaccgacaccgacaacgauuuugacgcaaaccaaaacacaaaauucacuccagucggcgucauacaagacggaaacaccgcacaccgcaacgaaccacaacaguggguccuccccuccuacucaggucgcaacucacacaauguucacuuagcccccgccguagcccccaccuuccccggcgaacaguuacucuucuuucgaucgaccaugcccggaugcucaggcuaccccaacauggaccuagacugccuccuaccccaagaauggguccaauacuucuaccaagaagcagcacccgcccaauccgacguugcccuccuccguuucguaaacccagacaccggacgaguucucuucgaaugcaaacuacacaaauccggcuacgucacugucgcacacacgggacaacacgaucuagucaucccacccaacggcuacuuccgcuucgacuccugggucaaccaauucuacacccucgcccccaugggcaacgguaccggccgucgcagagcucuauaa

SEQ ID NO: 35288 - RNA, 1623 nt, Artificial Sequence
  derived and/or modified sequence opt11 from capsid_protein_VP1__Norovirus__ADI45816
augaaaauggccuccaaugacgccaaccccucagacggcuccgccgcaaaccucguccccgaaaucaacaacgaagucauggcucucgaacccgucguaggcgcugccaucgcugcacccgucgcaggccaacaaaacguaaucgaccccuggauccgcaacaacuucgugcaagcacccggaggagaguucacagucucaccccgcaaugccccaggcgaaauccuaugguccgcaccccuuggcccagaccucaacccauaucuuucacaccucgcccgcauguacaacggcuacgccggcggcuucgaaguccaaguuauuccagccggcaacgccuuuaccgccggcaagaucaucuuugcugcagugccaccaaacuuccccaccgaaggccucucacccucacaaguuaccauguucccacacauaaucgucgacguuagacaacuagaacccguacuaaucccccucccugauguccgcaauaacuucuaccacuacaaccaauccaaugacucgacaaucaaacucauagccaugcucuacacaccccuucgcgccaacaaugccggcgaugacgucuucacugucucuugccgcguccuaaccagacccucacccgacuucgacuuuaucuuccuuguacccccaacagucgaaucccgcacaaaaccauucacaguaccaauccuuaccgucgaagaaaugaccaacagucgcuucccaaucccacucgaaaaacucuucaccggacccuccucugccuuugucguccaaccccaaaacggccgcugcacaaccgacggugucuuacuagggacuacccaacucucccccgucaacaucugcacauuccgcggcgacguaacccacaucgcaggaucccgcaacuacacaaugaaccuagcaucccuaaacuggaacaacuacgaccccacugaagaaauccccgcaccccucggcacccccgacuucguaggcaaaauacaagguguccucacccaaacuaccaaagaagacggaucaacccgcggucacaaagccacagucuacaccggauccgccgacuucacacccaaacuaggcagcguacaauucggcaccgacaccgaaaacgacuucgaaacacaccaaaauaccaaguucacccccgucggcgucauacaggacggaucaacgacccaucgcaaugaaccacaacaauggguccuccccucauacagcggccgaaacguacacaacguccaucucgccccugccguggccccaaacuuccccggagaacaacuacuauucuuccgcucaacaaugcccggcugcucuggcuacccaaacauggaccuggacugccuacucccacaagaauggguccaacacuucuaccaagaagcggcacccgcacaauccgaugucgcccuacuccgauuuguaaaucccgacaccggccgcguccuauucgaaugcaaacuccacaaaagcggcuacgucaccgucgcccacacaggccaacacgaccucguaauaccaccuaacggcuacuucagauucgacuccugggucaaccaguucuacacacucgccccaaugggcaacggcacaggccgccgcagagcccucuaa

SEQ ID NO: 35289 - RNA, 1623 nt, Artificial Sequence
  derived and/or modified sequence opt11 from capsid_protein_VP1__Norovirus__ADI45817
augaaaauggcaucaaacgacgcuaaccccucagacggcucaaccgccaaucucguccccgaaguaaacaacgaagucauggcacuagaacccgucgucggcgcagcaaucgccgcccccgucgcaggccaacaaaacguaaucgaccccuggauccgcaacaacuucguacaagcacccggaggcgaguucaccguauccccacgcaaugcccccggagaaauccucuggagcgcaccccuuggcccagaccuaaaccccuaccucucacaccucgcccgcauguacaacggauacgccgguggcuucgaaguacaggucauccucgccggcaacgccuucaccgccggcaaaaucaucuucgccgcuguaccacccaacuuccccacagaaggccucucucccucccaagucaccauguucccccacauuaucguagacguccgccaauuagaacccguacucaucccacuacccgacgugcgcaacaacuucuaccacuacaaucaauccaacgauccaaccaucaaacugauugcaaugcuauacacaccccuccgagccaacaacgccggcgacgacgucuucaccguauccugccgcguacucacccgccccuccccagacuucgacuucaucuuucccguacccccgaccguugaaucccgcaccaaaccauucacagucccaauccuaaccguugaagaaaugacgaacucccgcuuccccaucccccucgaaagacucuacaccggccccuccuccgcuuucgucguacaaccacaaaacggacgcugcaccacagacggcguccuacucggcacuacccaacucuccgccgucaacaucuguaccuuucgcggcgacgucacacacaucgcaggcucucgcaacuacaccaugaaccucgcaucccaaaacuggaacaacuacgaccccaccgaagaaaucccagcaccacucggcacaccagauuucguaggcaaaauccaaggcaugcuaacccaaacaaccagaucagacggcuccacacgaggccacaaagcuacagugcucacaggauccgccgacuucgcacccaaacucggcagaguccaauucgccaccgacaccgacaacgacuucgaaucuggucagaauaccaaauucacccccgucggaguaauucaagacggcagcacuacccaccgaaaugaaccacagcaauggguccuccccaacuacagcggccgcaccggccacaauguccaccucgcucccgccguugccccuaccuaccccggcgaacaacugcuauucuuucgcucuaccaugcccgguugcuccggauaccccaacauggaucuugacugccuccuaccccaagaauggguccaacacuucuaucaagaagccgcccccgcacaaucagaugucgcccuccuccgguucguaaaccccgacaccggacgcguccucuuugaaugcaaacuccacaaauccggcuacguaaccgucgcacacaccggacaacacgaccucgucaucccaccaaacggcuacuuccgcuucgauuccuggguaaaccaauucuacacacucgccccaaugggcaacggaaccggcagacgacgcgccguauaa

SEQ ID NO: 35290 - RNA, 1623 nt, Artificial Sequence
  derived and/or modified sequence opt11 from capsid_protein_VP1__Norovirus__ADI45818
augaagauggcguccucagacgcacaccccagcgacggauccacugccaaccucgucccugaagucaacaacgaaguaauggcucucgaacccgucgucggcgccgccaucgccgcccccguagccggacagcaaaacguuaucgacccuuggauccgcaacaacuucguccaagccccaggaggagaguucaccgucucuccucgcaacgcccccggcgaaauucuauggucggcaccccucggccccgaccucaaccccuaccucucccaccucgcccgaauguacaacggauacgccggcggauucgaaguccaggucauacuugcuggcaacgccuucacagcaggcaaaauaaucuucgccgccgucccaccaaacuucccaaccgaaggacucucccccucccaagucacaauguucccacacaucaucguagacgugagacaacucgaaccaguccuaauaccccuaccagacguccgcaacaacuucuaccacuacaaccaauccaacgaccccacuaucaaacucaucgccaugcuauacacaccccuccgcgccaacaacgcaggagacgacgucuucaccgucucaugccgaguccuuacccgcccaucacccgacuucgacuucauauuccucgucccucccacagucgaaucccgcacuaaaccauuuuccgucccaguccucaccguugaagaaaugacaaacucacguuuucccaucccacucgaaaaacucuucacuggacccucguccgccuucguaguacaaccacaaaacggacgcugcaccacagacggcguacuacuaggcacaacccaacucuccccaguaaacaucugcaccuucagaggagacgucacccacauccccggaucucgcaauuacacaaugaacuuagccucccaaaacuggaacucuuacgaccccaccgaggaaauccccgcaccacuagguaccccagacuucgucggaaagauccaaggaguccuaacccagaccacccgaaccaacggcuccacacgaggacacaaagcaaccgucuacacugguuccgcugacuuuuccccaaaacucggccgaguacaauucgcaaccgacaccgacaacgacuucgaaaccaaccaaaacacaaaauucacccccgucggcguaauccaagacggaucuaccacaccccgaaacgaaccccaacaauggguccuaccaagcuacuccggacgcaacauccacaacguccaccuagccccugccguagcccccaccuuccccggcgaacaacuccuauucuuccgcucgaccaugccaggcugcuccggguaccccaacauggaccucgacugccuacucccacaagaauggguccaauauuucuaccaagaagcugcaccagcccaauccgacguagcccuccuccgcuucguuaacccggacacaggccgaguccuauucgaaugcaagcuacacaaaucaggcuacgucaccgucgccuacacuggccaacacgaccucgucaucccacccaacggauacuuccgcuucgauuccuggguaaaucaauucuacaccuuagcccccaugggaaacggcaccggccgccgccgagcacucuaa

SEQ ID NO: 35291 - RNA, 1626 nt, Artificial Sequence
  derived and/or modified sequence opt11 from capsid_protein_VP1__Norovirus__AET79296
augcgaauguccgacggcgccgccccaaaagcaaacggcucugaagccagcggccaagaccucguccccacagccguagaacaagccgucccaauacaacccgucgcaggagccucccuugcagccccagcugccggccaaaucaaccaaaucgaccccuggaucuuccaaaacuucguacaaugcccgcucggcgaauucuccauuuccccccgaaacacaccaggcgaaauccucuucgacuuagcacuaggccccggccugaacccauaccuagcccaccuuucagccauguacaccggcugggucggcaacauggaaguucaacuuguccucgccggcaacgcguucaccgccggcaaaguaguagucgcccucguaccccccuacuuccccaaaggcucccucaccacggcccaaaucacuugcuucccacacgucaugugcgacguccgcacuuuagaacccauccaauuaccccuccucgacgucagacgcguacuauggcacgccacccaggaccaagaagaaagcaugcgccucgucugcaugcuauacaccccccuccgcacaaacucccccggugaugaaucauucgucgucuccggcagacuccucagcaaacccgccgccgacuucaacuucguuuaccucacccccccaauagaaagaacuaucuacagaauggucgaccuucccguccuccaaccccgccucugcacacacgcccgcuggccagccccugucuacggccuucuugucgacccuucacucccuuccaacccccaauggcaaaacggcagaguccacguagacggcacacuccuaggaaccaccccagucucuggcucgugggucuccuguuucgcagcagaagcugccuacgaauuccagucuggcacuggugaaguagccaccuucacccuaaucgaacaggacggcuccgcauacguccccggcgaccgcgccgccccccucggauacccagacuucucaggccaacuugaaauagaaguccagaccgaaaccacuaaagcaggugacaaacucaaaguaaccaccuucgaaaugauccuagggccaacgaccaacgucgaccaagcccccuaccaaggacgcguccacgccucuacauccguaacagcaucccuaaaccucgucgacggccgcguaagagccgucccacgcucaaucuacucuuuccaagaugucgugcccgaauacaacgacggacuccucgucccccuagcaccccccauaggcccauuccuaccuggagaaguccuccuacgcuuccgcaccuauaugcgacaaauagacuccucagacgcagcugccgaagcgaucgacugcgcccucccacaagaauucauuucaugguucgcaucaaacgccuucacaguccaaucugaagcacuccuacuccgcuaccguaacacacucaccggacaacuccucuucgaaugcaaacucuacuccgaaggcuacaucgcccuauccuauuccggcucaggaccccucacauuccccacugacggcuucuucgaaguugucucuugggucccccgccucuaucaacucgcaucggugggaucccuagccaccggucggacccucaaacaauaa

SEQ ID NO: 35292 - RNA, 1626 nt, Artificial Sequence
  derived and/or modified sequence opt11 from capsid_protein_VP1__Norovirus__AFB18026
augcgcauguccgacggcgccacccccaaacccaacggcagcgaggcagcaggccaagaccuagucccauccucagucgaacaagccauaccaauacaaccaguugccggugccgccgucgcagcccccaccgccggccaaaucaaccaaauagaccccuggauauuccaaaacuucguucagugcccacucggcgaguucucaaucucaccccggaauaccccaggagaaauccuuuucgaccuugcucucggacccggccuaaaccccuaccuagcacaccuauccgccauguacacaggaugggucggcaacauggaaguccaacucguccuagccggaaaugcauucaccgcuggaaaaguaguagucgcacucgucccaccauacuucccacaaggcucucuaacaaccgcucaaauaacaugcuuuccucacgucaugugcgauguccgaacacucgaacccauccaauuaccccuccuagacguuagacgaguccucuggcacgcaacgcaaaaccaagaagaagcuaugcgccucgucugcaugcucuauacaccgcuucgcaccaauuccccaggcgacgaaucguucgucgucuccggccgccuacucucacgucccuccccagacuucaauuuugucuaccuaacacccccuauugaacgcacaaucuaccguaugguagaccuccccguuguccaaccacgacucugcacccacucccgcuggccagccccuguauaccaaauccuugucgaccccucccuccccuccaacccccaauggcaaaacggccgcguccucaucgacggcacacuacucggcaccaccccuaucuccucauccuggguagccucguucgcaggcaccgccgaauacuccuuucaaucuccacccucugccgaaauaggugaagucucacuauucgaaaucgacggcuccgccuacacacccggcgaccgagccgcaccccucggcuaccccgacuucucaggcacccucgaaguugaaauccaaacugaaaccaccaaagccggacaaaaacucgacguccacaccuucaaucuggaacucaaaucccaaaccguagaucaagccccauuccaaggcaaagucuacauggaccuugaagcaucagccagccuagaccucgucaacggccgcguucgcgcaucaccccguuccgucgcugccuucaaagaugaacuccccuccuauaacuccggccuccucgucccccucgccccuccccugggccccuuccuucccggcgaaguccuccuacgcuuccgcaccuucgcccgacaaguagauaccaccgacgcauccgcccaagcaguagacugcgcccucccccaagaacuggucuccugguucgcuucauccaacuucaccguccaauccgaggcccuacuccugcguuaccgcaacacccucacaggccaacuacucuucgaaugcaaacuguacucagaaggcuacaucgcccuuucauacaccggcucauccccacuuaccuuccccaccgacggauuccucgaagucgucuccuggguccccagacuccaccaacuagccuccgucggaucccucgcaaccggccgcucucucaaacaauag

SEQ ID NO: 35293 - RNA, 1626 nt, Artificial Sequence
  derived and/or modified sequence opt11 from capsid_protein_VP1__Norovirus__AFB18027
augcgaauguccgacggcgcgacccccaagcccaacggaucagaagccgccggacaagacuuaguccccuccucugucgaacaggcaaucccuauccaacccgucgcuggagccgcugucgccgcacccaccgccggccaaaucaaccaaaucgaccccuggauauuccaaaacuucguccaaugcccccuuggcgaauuuucaauaucaccccgcaacacccccggagagauccuauucgaccucgcccucggcccaggacucaaccccuaccucgcucaucuauccgccauguacaccggcugggucggcaauauggaaguucaacucguccucgcaggcaacgccuucaccgccggcaaagucgucgucgcacucgucccacccuacuuccccaaaggcucccucaccaccgcccaaauaaccugcuucccacacguaaugugugacguccgaacccucgaacccauccaacuaccccucuuagauguucgacgcguccucuggcacgcaacccaagaucaagaggaagccaugcgccuagucugcaugcucuacacaccccuacgcaccaacucucccggagacgaauccuucguagucuccggccgccuacucagccgccccgcauccgacuucaacuucgucuaccucacaccacccaucgaacgaacaaucuaccgcauggucgaucuaccagucguacaaccccgccucugcacccacucacgcuggcccgcacccgucuaccaaauacuugucgaucccucacuccccuccaacccgcaguggcaaaacggaagaguccaagucgauggaacacuccucggcaccaccccagucuccggauccuggguagcauccuucgccggcaccgcagaauacucauuccaaacaccaccuuccgcagaaauaggcaccauauccuuauucgaaaucgacggcucagccuaugucccuggcgaucgcgcugccccacucggcuaucccgacucugcaggcacacucgaaguagaaauucaaacugaaaccaccaaagccggccaaaaacucaacguacacacuuucucacuagaacucgucucucaaaccguagaccaagcccccuaccaaggccaaauauucgucgaccucgaaaccucuucauccauggaccucguaaacggacgcguacgcgccucaccccgcuccauauccggcuucaaagaugagcuccccuccuacaacaacggacuacuugucccccuagcaccuccccucggacccuuccuccccggcgaaguccuucuucgcuuccgcacuuucgccggccaagucgaccucaccgacgcugcagcccaacccgucgacugcgcccucccccaagaauuuguuuccugguucgcauccaauaacuucacuguacaauccgaagcccuccuccuccgauaccgcaauacccuaacaggccaauuacucuucgaaugcaaacucuacucagaaggcuauauagcccuuuccuacaccggcuccggcccccuuaccuuccccaccgacggcuucuucgaaguggucucgugggucccccgccuauaucaacucgccuccguaggcucccucgccacuggccgaucccuuaaacaauaa

SEQ ID NO: 35294 - RNA, 1635 nt, Artificial Sequence
  derived and/or modified sequence opt11 from capsid_protein_VP1__Norovirus__AFI08231
augaugauggccucaaaagacgcccccacgaacauggacgguaccucuggagcaggucaacucgucccagaagccaacacagccgaaccaaucucaauggaccccguagccggagcggcuaccgcagucgcaaccgcaggccagaucaacaugaucgaccccuggaucaugagcaacuucguccaagcaccccaaggcgaauuuacugucagccccaacaauacccccggcgacguauuauucgaccuacaacucggcccccaacucaaccccuuccuagcccaccucgcccaaauguauaacggcugggucggcaacaugcgaguaaaaguucuccucgccggcaacgccuucaccgcgggcaaaaucaucaucucuugcaucccgcccggcuucaccucccaaaacaucuccauugcccaaaugacaauguucccccacgucaucgcagacguuaggguccucgaacccaucgaaaucccacuagaagacguccgcaacgugcuuuuccacaccaacgacaaccgccccaccaugcgccuagucugcaugcuuuacacaccccucagagcuaauggcuccagcuccggcaccgacccauucgucaucgcaggucgaguucucaccuguccagacucaaacuucucauuccucuuccucgucccaccaaacgucgaacagaaaacacgccccuucuccguacccaauauuccucucaacacacuauccaacucucgcguccccucccuuaucaaauccaugaccaucucccgagaccaaaaccaaaucauccaauuccaaaacggccgggucacacucgacggacaacuccaaggcacuacccccaccuccgucucacaacugugcaaaauccguggaaccaccuaucacgcaaccggcggcaacgguaucaaccucaccgaacucaacggagaacccuaccacgccuucgaaucccccgcacccaucggauuccccgaccuaggcggaugugacuggcaccuaacugccacacccacccaagccuucaacgauggcgcaaaagucguccgccucuccguaacccaaggcgccgcuuuugcuccacaccucgguaccauacacuacacuaccaccgacaccgacuacaaccccaacaccuccaucaucugcacacuagacuggcucucacagacagccggacaaucaaacgucgaccccuggcaaaucccaaccuauggcucgacacucaccgaagcagcgcaacuugccccacccaucuucccacccggcuucggugaaacccucguauucuuucucuccgacuuccccauauccaacggcaaaaacggacuauccguuccaugcacacucccucaggaauuuguaacacacuucgucaacgaacaagccccaauucgcggcgaagccgcucuacuccacuacguggacccugacacgcaccguaaccugggugaguucaaacucuacccagaaggauucaugaccugcguaccaaacaccucuggcggaggcccacaaacccucccaaucaacggggucuucgucuucgucucgugggucucacgcuucuaccaacuaaaacccgucggcaccgcaggcgccgcccgacgccucgguauccgccgaucauaa

SEQ ID NO: 35295 - RNA, 1623 nt, Artificial Sequence
  derived and/or modified sequence opt11 from capsid_protein_VP1__Norovirus__AFI08240
augaaaauggccucaaaugacgccaaccccucugacggauccgcugcaaacuuaguaccugagguaucaaacgaaguaauggcccucgaacccgucguaggcgccgccaucgcugcacccguagcaggccaacaaaacguaaucgaccccuggauccgcaauaauuucguccaagcgcccggcggcgaguucaccguaucaccccgaaacgcccccggagaaauccucuggucugcgccccucggaccagaucucaaccccuaccuaucccaccucgccagaauguacaacggcuacgccggaggcuucgaaguucagguaauccuagccgguaacgccuucacagccggcaaaaucauuuucgcagccgucccacccaacuuccccaccgaaggccucucccccucacaagucacuauguuuccccacauaauagucgacguccgccaacucgaacccguacuuauaccccuacccgacguccgcaacaacuucuaccacuacaaccagacaaaugacucuaccauaaaacuuaucgcaaugcucuacaccccacuccgcgccaacaacgccggcgaagaugucuucaccguauccugucgcguacucacacgcccuucuccagacuucgacuuuaucuuucucgugcccccuacugucgaaucccgcaccaaacccuucaccgucccaauacucacagucgaagaaaugacaaacagccgauucccaauaccccucgaaaaacucuucaccggucccucaggcgccuucgucguccaaccacaaaacggccgcugcaccacagacggcguucuacuaggcacuacacagcucucacccgucaacaucugcaccuuccguggcgacgucacccacauagccggaucccgcaacuacacaaugaaccuagccucacucaacuggaacaacuacgaccccaccgaagaaauacccgcaccccucgguacaccagacuucgucggcaaaauccaggggguccucacccaaaccacaaaaggagacgguucaacucgaggacacaaggccaccguauacaccggcuccgcccccuucacacccaagcuaggcucaguccaauucuccaccgacacagaaaacgacuucgaaacccaccaaaacaccaaauucacccccguuggaguaauacaagacggaggcacaacccaccgcaacgaaccccaacaauggguacuucccucauacucgggccgcgacguccacaacguccaccucgcccccgcagucgcccccaccuuccccggagaacaacuccucuucuuccgcuccacaaugcccggcugcuccgguuaccccaacauggaccucgacugucuucuaccccaagaauggguccaacacuucuaucaagaagcagccccagcccaaagcgacgucgcauuacuacgcuucgucaacccugacaccggccgcguucuauucgaauguaaacuacauaaauccgguuacgucacagucgcccacaccggccaacacgaccucgucauaccgcccaacggcuauuuccgcuucgacucuugggucaaccaauucuacacacuagcccccaugggcaacggcacaggccgccgccgcgcacuguaa

SEQ ID NO: 35296 - RNA, 1620 nt, Artificial Sequence
  derived and/or modified sequence opt11 from capsid_protein_VP1__Norovirus__AFS33552
augaaaauggccuccucagacgccaaccccuccgacggcuccgcagcaaaccuaguccccgaaguaaacaaugaagucauggcccuagaacccguugucggcgccgccauagcagcaccagucgccggccaacaaaacaucaucgaucccuggauccgaaauaacuucguacaagcccccggcggcgaguucaccgucucaccccgcaacgccccaggcgaaauccucugguccgcaccccuuggccccgaccuaaaccccuaccuuucccaccuaucccgaauguacaacggcuacgccggcggauucgaaguccaaguaauccucgccggcaacgccuucaccgcuggaaaagucaucuucgccgcaguuccaccuaacuucccaaccgaaggccucucccccucccaaguaaccauguucccccacaucauaguugaugucagacaacucgaacccguccucauuccccucccugacguccgcaacaacuucuaccacuacaaccagucucacgacuccacauuaaaacuaaucgccaugcucuacacgccccuccgagccaacaacgcaggcgacgacguuuucaccgucucuugccgcguccugacccgcccauccccagacuucgacuucauauuccucguaccacccaccgucgaaucccgaaccaaaccauucaccguuccaauccuaaccgucgaagaaauguccaacucacgauuucccauuccccucgaaaaacucuacaccggcccauccucagccuucgucguacaaccacagaacggacgaugcaccaccgacggaguacuucucggcaccacccaacuaucagccgucaauaucugcaacuuucgcggugacguaacccacaucgucggaucccaugacuacaccaugaaccucgccucacaaaacuggucuaacuacgaucccacagaagaaauccccgcaccccucgguaccccagacuuugucggcaaaauacaaggccucuuaacccaaacaacacgcgccgacggcuccaccagagcacacaaagccaccgucucaaccggcuccguccacuuuacccccaaacuagguucaguccaauucacuacagacacuaacaacgacuuccaaaccggccaaaacacaaaauucacaccaguaggcgucauacaagacggugaucaucaccaaaacgaaccccaacaauggguccuccccaacuacucaggccgaaccggacacaacguucaccuugcacccgcugucgcccccacauuccccggagaacaacuacucuucuuccgaagcacaaugcccggcugcuccggauaccccaacaugaacuuagacugccuccuuccucaagaauggguacuacacuucuaccaagaagccgcccccgcacaaucugacgucgcccuacuccgauuugucaaucccgauaccggccgaguucuauucgaaugcaaacuccacaaaagcggcuacaucacagucgcccacaccggcccuuacgaccucgucauacccccgaacggcuacuuccgauucgauuccuggguaaaccaauucuacacacucgcuccgauggguaacggcaccggacgacgccgcgcccucuaa

SEQ ID NO: 35297 - RNA, 1608 nt, Artificial Sequence
  derived and/or modified sequence opt11 from capsid_protein_VP1__Norovirus__AFS33555
augaagauggcguccaacgacgccgcccccuccaacgauggcgccgccgguuuaguccccgagguaaacaacgaaaccauggcacucgaacccgucgccggagcauccauagccgcuccccuaacaggccaaaacaacgucaucgaccccuggauccgaaugaacuucguccaagcccccaacggagaguucacagucuccccucgaaacucccccggcgaaauccuccuuaaccucgaacucggccccgaacucaaccccuuccucgcccaccucucccguauguacaacggcuacgccggcggcguagaaguccaaguccuccucgcaggcaacgcauuuaccgccgguaaacucgucuucgcagccauacccccucacuucccccuugaaaaucucucccccggccaaaucaccauguucccccacguaaucaucgacguacgcacacuagaacccguccuccuaccucuacccgacguccguaacaacuucuuccauuacaaccagcaaccugaaccccgaaugcgccucguugccaugcucuacacaccacuacgcagcaaugguuccggcgacgauguuuucacagucaguugccgaguccucacucgaccaucaccagacuucgauuucaacuaccucgucccacccacugucgaaucaaaaacuaaaccuuucacacuccccauacucacaaucggcgaacuauccaacucccgcuucccuguucccaucgacgaacucuacaccuccccuaacgagggcguaauaguacaaccccaaaacggccgcagcacccucgacggcgaacuucuaggcacaacccaacucguccccagcaacaucugcgcccuucgcggccgcauaaacgcucaagugcccgaugaccaucaccaauggaaccuacaagucacaaacacaaacgguacacccuucgacccaacugaggacguccccgccccucuuggaacaccagacuuccuagccaauauauaugguguaaccucccaacgaaaccccaacaauaccugccgcgcccacgacggcguccucgccaccuggucccccaaauuuacccccaaacuaggaagcguuauccucggcaccugggaagaauccgaccuagaccuaaaccaacccacacgcuucacccccgucggacucuucaacaccgaccacuuugaccaaugggcccugccuuccuauuccggacgccucacacucaacaugaaccuagcaccauccgucuccccuuuauuccccggcgaacagcuccuauucuuccgcucucacauaccccucaaaggcggcacauccgacggagccaucgauugccuccucccccaggaauggauacagcacuucuaccaagaauccgccccuucccccaccgacguagcccuaauccgcuacaccaaccccgacacaggccgcguccucuucgaagccaaacuccaccggcaaggcuuuaucaccgucgccaacagcggcucacgccccauaguggucccacccaacggcuacuuccgcuucgacucaugggucaaccaauucuacucccucgcacccauggguacuggcaacggccgccgccgugugcaauaa

SEQ ID NO: 35298 - RNA, 1623 nt, Artificial Sequence
  derived and/or modified sequence opt11 from capsid_protein_VP1__Norovirus__AFW15938
augaaaauggcauccaacgacgccaaccccucagacggauccgccgccaaccucguaccagaaguaaacaaugaagucauggcccuagaacccgucgucggagcagcaaucgcugcccccgucgcuggccaacaaaacgucaucgaccccuggauccgcaacaacuucguccaagcuccuggcggcgaauuuaccgucucuccccgcaacgcucccggcgaaauccuaugguccgcaccacucggucccgaccucaaccccuaucuaagccaccucgcucgcauguacaacggauacgccggcgguuucgaaguccaagucauccuugccggcaacgcauucaccgcaggcaagauaauauuugcagcgguaccacccaacuuccccacagaaggccuaucacccucccaagucaccauguucccccacaucaucgucgacguacgccaacuagaacccgucuuaaucccccuccccgacguacgcaacaauuucuaucacuacaaccaaucaaacgacucuacaaucaaacuaauugccaugcucuacacuccccuccgcgccaacaacgccggggaagaugucuucacgguauccugccgaguacucacgcguccaagcccagacuucgacuucauauuccuagucccacccaccguagaaucccgcacaaaaccauuuacugucccaauccucacaguagaagaaaugaccaacucccgauucccaauaccacucgaaaaacuauucaccggcccauccuccgcauucgucguccaaccacaaaacggccgaugcaccacugacggcguacuucuaggcaccacacaacuguccccaguaaacauaugcaccuuuagaggcgacguaacacacaucgccggcucccgaaacuacaccaugaaccuagccucccucaacuggaacaacuacgacccuaccgaagaaauccccgcaccccuuggcacacccgauuucgucggcaaaauacaaggcguacucacccaaacaacaaaaggcgacggcuccacccgcggccacaaagccacugucuacaccggcuccgccccuuucacccccaaacuagguucuguccaauucuccacugauaccgaaaacgacuucgaaacccaccagaacacaaaauucacacccgucgguguaauccaagacggcuccaccacccaccgcaacgaaccccaacaauggguccuaccauccuacucgggacgaaacgcccaaaacguccaccuugcccccgcagucgcccccacauuucccggcgaacaacuccuuuucuuccgaucaaccaugccugguugcuccggauaucccaacauggaccucgacugccuccuaccccaggaauggguacaacacuuuuaucaagaagccgcaccggcccaauccgauguugcccuacuacgauuugucaaccccgacacaggccgcguccuauucgaaugcaaacuacacaaauccggauacgucaccguugcucacaccggccaacaugaccucgucaucccacccaacggcuauuuccgcuucgacagcuggguaaaccaauucuacacacucgcccccaugggcaacggcaccggccgacgacgagcccuuuaa

SEQ ID NO: 35299 - RNA, 1623 nt, Artificial Sequence
  derived and/or modified sequence opt11 from capsid_protein_VP1__Norovirus__AFW15940
augaaaauggccagcaacgacgccaaccccucagacggcuccgcugcuaaccugguacccgaaguaaacaacgaagucauggccuuagaaccuguaguuggcgcugcaaucgcagcucccgucgccggccaacaaaacgucaucgacccguggaucagaaacaacuucguccaagccccaggaggcgaguucaccgucucaccccgcaacgcaccuggcgaaauccucugguccgcaccccucggcccagaccuuaacccauaccucucccaccucgcccgcauguacaacggauacgccggcggcuucgaaguccaaguaauccuagccggcaacgcuuucacagccggcaaaauaauauucgcagccgucccacccaacuuccccaccgaaggacucuccccgucacaaguaaccauguucccacacaucaucgucgacguccgucaacuugaacccguccugaucccccuucccgauguccgcaacaacuucuaccauuacaaccaaagcaaugacuccacgauuaaacuuaucgccaugcucuacacaccacuacgcgcaaacaacgccggcgaagacgucuucaccgucuccugccguguccuuacgcgccccucaccagacuucgacuucauauuccuagucccacccaccgucgaauccaaaacaaaacccuucaccguacccauccucaccgucgaagaaaugaccaacucgcgcuuccccaucccucucgaaaaacuauucacaggacccucuuccgccuucgucguccaaccacagaacggucgcugcaccaccgacgggguccuccucggcaccacccaacucucgccagucaacaucuguacauuccgcggcgacguuacccacaucgccggcucccgcaacuacacaaugaaccuagcaucccucaacuggaacaacuacgaccccaccgaagaaauacccgccccacucggaacaccugacuucguaggaaaaauccaaggaguccuaacacaaaccaccaaaggugacggaucaacacgcgggcacaaagccacuguauauacuggauccgcccccuucacuccaaagcucggauccguacaauucuccaccgacaccgaaaacgacuucgaaacucaccaaaauaccaaauucacaccaguaggcguuauccaagacggaucaacaacacaccgcaacgaaccccaacaguggguccuucccagcuacuccggccgaaacgcacaaaacguccaccucgccccugcugucgcccccaccuuccccggcgaacaacuccucuucuucagaagcaccaugcccggcugcuccggcuaccccaacauggaccucgacugccuccucccacaagaauggguacaacacuucuaccaagaagcagcucccgcccaauccgacgucgcccuacucagauucguaaaucccgacaccggacgcguacucuuugaauguaaacuccacaaauccggcuacgucacaguagcccacaccggccaacaugaucuagucaucccacccaacggcuacuuucgcuucgacuccuggguaaaccaauucuauacucucgcacccaugggcaacgguaccggccgacgccgcgcccucuaa

SEQ ID NO: 35300 - RNA, 1623 nt, Artificial Sequence
  derived and/or modified sequence opt11 from capsid_protein_VP1__Norovirus__AFW15941
augaaaauggccucuaacgacgccaaccccucagacggaucagccgccaaccucguccccgaagucaacaacgaagucauggcacucgaacccguugucggcgcugcaauugcugcacccgucgccggccaacaaaaugucaucgacccauggauccgcaacaacuucguucaagcccccggcggcgaauuuacuguaucaccccgcaacgcucccggugaaauccucugguccgcgccccuaggacccgaccuaaaccccuaccuaucucaccucgcccgcauguacaacggcuacgcaggcggcuucgaaguacaagucauccucgccgggaacgcguucaccgccggaaaaaucauauucgccgcaguaccacccaacuuccccacagaaggccuaucccccucccaagucaccauguucccccacaucaucgucgacguccgccaacucgagccaguccucaucccccuacccgacguccgcaacaauuucuaccacuauaaccaauccaacgauuccacaauaaaacucaucgccaugcucuacacaccccuuagagcaaacaacgcuggcgaagacguuuucaccgucuccugccgcguccuuacccgaccaagccccgacuucgacuucaucuuccucgucccacccaccguagaaucccgcacaaaacccuucacuguacccauccuaaccgucgaagaaaugaccaauucucgcuuucccaucccacucgaaaaacucuucaccggcccguccucagcauuuguaguccaaccacaaaacggaaggugcaccaccgacggcguccuacucggcaccacccaacucucccccguuaauauaugcaccuuccgaggcgacgucacccacaucgccggcucccgcaacuacaccaugaaccucgcuucacucaacuggaacaacuacgacccuaccgaagaaaucccagcaccccucggcacucccgacuuuguaggcaaaauccaagguguccucacccaaacaacaaagggcgacggcuccacacgaggccacaaagccaccguauacacaggcucagcccccuucaccccuaaacuaggcuccguccaauucuccaccgacacugaaaacgacuucgaaacccaccaaaacaccaaauucacccccguaggcgucauccaagacggcucaaccacccaccgcaacgaaccacaacaguggguccucccuuccuauucuggcagaaacguccaaaacguccaccucgccccugcaguugcccccaccuuccccggcgagcaacuccucuucuuucgcuccaccaugcccgguugcuccgguuacccaaacauggaccuggacugccuucuaccccaagaauggguucaacacuuuuaccaggaagccgcacccgcccaauccgacguagcauuauuacguuucgucaacccagauaccggacgcguacuauucgaaugcaaacuccacaaauccggauaugucaccgucgcccauaccggacaacacgaccuugucauaccacccaacggcuacuuccgauucgauuccuggguaaaccaauucuacacccuagcacccaugggcaacggcacaggucgccgccgggcacucuaa

SEQ ID NO: 35301 - RNA, 1623 nt, Artificial Sequence
  derived and/or modified sequence opt11 from capsid_protein_VP1__Norovirus__AFW15944
augaaaauggccucuucggacgccaaccccuccgacggcagcaccgccaaccucguacccgaaguaaacaacgaagucauggcacucgaacccgucgucggcgccgcaaucgcagcacccguagcaggccaacaaaacgucaucgaccccuggauccgaaacaacuucguccaagccccuggcggcgaauuuaccgucucaccucguaacgccccaggcgaaauccucugguccgccccauuaggcccagaccuuaacccauaccuaucccaccuagccagaauguacaacggcuaugcaggcggauucgaaguccaagucauacuagccggcaacgccuucacagccgguaaaaucaucuucgcagccgucccacccaacuuccccacagaaggccucucccccucucagguuaccauguucccccacaucaucgucgacguccgacaacuagaaccuguacucauaccccuaccagacgucagaaacaacuucuaccauuacaaccaguccaacgauuccaccaucaaacucaucgcuaugcucuacacaccucuccgugcuaacaaugccggcgacgacguauuuacagucuccugucgaguccucacgcgccccucccccgacuucgacuucaucuuccucguaccaccgaccgucgaauccagaacgaaacccuucucaguccccguccuaacagucgaagaaaugaccaauucacgauuccccaucccacucgaaaaacuauucaccggccccuccuccgccuucgucguucaaccccaaaacggucgauguacaacagauggcguccuucuaggaaccacacaacuaucccccguaaacaucugcaccuucagaggcgacguaacccacauccccggcaguagaaacuacaccaugaaccuagcaucccaaaacugguccuccuacgaccccaccgaagaaauacccgccccgcucggcacacccgacuucguaggcaaaauccaaggcguccuuacccaaacaacucgcacuaacggauccacacgaggacacaaagccaccgucuacaccggcucagccgauuucagcccaaaacucggccgcguccaauucgccacagacacagacaacgacuucgaaacaaaccaaaacaccaaauucacucccgucggcguaauccaggacggcucuaccacccccagaaacgaaccccaacaauggguacucccuuccuacuccggccgcaauauccauaacguccaucucgcucccgcaguugcccccaccuuccccggcgaacaacuccuauucuuccgcuccaccaugcccgggugcucagguuaccccaacauggaccucgacugccuccucccacaagaauggguccaguacuucuaccaagaagcagcccccgcccaauccgacguagcccuccuacgauucgucaaucccgacaccggacgcguccuauuugaauguaaacuccacaaaucuggcuacguaaccgucgcacacacaggccaacacgaccuagucaucccuccaaacggcuacuuucgcuucgauuccugggucaaccaauucuauacucucgccccaaugggcaacggaaccggcagacgccgugcccucuaa

SEQ ID NO: 35302 - RNA, 1623 nt, Artificial Sequence
  derived and/or modified sequence opt11 from capsid_protein_VP1__Norovirus__AFW15947
augaaaauggcauccuccgaugcaaauccaucagauggauccaccgccaaccucgucccagaaguaaacaacgaaguaauggcccuugaacccguagucggcgccgccaucgccgcacccgucgccggccaacaaaacgucauagaccccuggaucagaaacaacuucguccaagcaccgggcggugaguucaccguauccccacgcaacgcccccggcgaaauacucuggucagcuccccuaggcccagaccucaaccccuaccucucccaccuugcccgcauguacaacggcuaugccggcggcuuugaaguccaagucauccuggcaggcaacgcauucacagcugguaaaaucauauucgccgccgucccacccaacuuccccacagaaggcuuaucaccaucccaagucaccauguucccucauaucaucgucgauguacgccaacucgaacccguccuaaucccccuacccgauguccguaacaacuuuuaccacuacaaccaguccaacgauuccacaauaaaauuaaucgcaauguuauacacaccccuucgugccaacaacgccggagacgacgucuucaccgucucuugccgcgucuuaacccgacccucacccgacuucgacuuuaucuuccuaguuccacccacuguugaaucucgcacaaaacccuucucagucccaguccucaccgucgaagaaaugaccaacuccagauuccccauaccccuugaaaaacucuucaccgguccgucguccgcauuuguaguccaaccccaaaacggccgaugcaccacagacggaguccuccucggcacaacccaacuaucuccagucaacaucugcaccuuccgaggagacguaacccacauuccagguucuagaaacuacacuaugaaccuugcaagccaaaacuggaacucauaugaccccaccgaagaaauccccgcaccccucggcaccccggacuucguagguaaaauccaaggcguccucacccaaacaacacguacaaacggcucuacccgcggacacaaagccaccguauacaccgggagcgccgacuucagcccaaaacuaggacgcguccaauucgccaccgacaccgacaacgacuucgaaaccaaccaaaacaccaaauucacaccugucggagucauucaagacggcuccaccaccccacgcaacgaaccccaacaauggguucucccauccuacucaggucgcaacauccacaacguccaccucgcccccgccgucgccccaaccuuccccggugaacaacuccuguucuucagauccacaaugcccggaugcucaggcuaccccaacauggaccucgacugccuccuaccccaggaauggguccaauacuucuaccaagaagccgcacccgcccaauccgacgucgcccuccuucgauucgucaacccagacacuggccguguccuauucgaaugcaaacuccacaaaucgggcuacgucacaguugcccacacaggacagcaugaccucgucaucccacccaacggcuacuuccguuucgacucaugggucaaccaauucuacacccucgcccccaugggcaacggaaccggacgacgccgagcuuuauaa

SEQ ID NO: 35303 - RNA, 1623 nt, Artificial Sequence
  derived and/or modified sequence opt11 from capsid_protein_VP1__Norovirus__AFW15948
augaaaauggcaucaucggacgcaaacccauccgacggcuccacagcaaaccucgucccagaagucaacaacgaagucauggcccucgaacccguagucggcgcugccaucgccgcccccguagccggccaacaaaacguaauagaccccuggauacgaaauaacuucguccaggccccaggaggcgaguucacuguuucuccccgcaacgcccccggcgaaauccuauggucagcuccccucggaccugaccuuaaccccuaccucucccaccucgccaggauguacaacggcuacgccggcggauucgaaguccaagucauacuagcaggcaacgccuuuaccgcuggaaaaaucaucuucgcagcaguuccacccaacuuccccacagaaggccucucccccucccaagucacaauguucccacacaucaucgucgacguccgacaacucgaacccguacucaucccacuaccugacguacgaaacaacuucuaccacuacaaccaauccaacgauucgaccaucaaacucaucgccaugcucuacacaccccuucgagccaauaaugccggcgacgacguauucacuguauccugccggguucucacucgcccaucccccgacuuugacuucaucuuccuaguaccacccaccgucgaaucccgcacuaaacccuuuucaguacccguccucacaguagaagaaaugaccaacucccgcuuccccaucccccucgaaaaacuguucaccggacccucaaacgccuucguuguccaaccccaaaacggccgcugcaccacagacgguguccuucugggcaccacccaacuauccccaguaaacaucugcaccuuccgcggcgacguaacccauauuccaggaucccgaaacuacaccaugaaccucgccucacaaaacuggaacagcuacgaccccaccgaagaaauccccgcgccccuaggcaccccagacuucguaggcaaaauccaaggcguccucacccaaaccacacguacaaacggcuccacccggggccacaaagccacagucuacacaggcucagccgacuucucaccaaaacuaggccgcguccaauucgcgaccgacaccgacaacgacuucgaaaccaaccagaacacaaaauucacccccgucggcgucauacaagacggaaguaccacaccccgcaacgaaccucaacaauggguccuacccucauacuccggacgcaacauacacaacguccaucucgcccccgcagucgcacccaccuucccaggcgaacaacuccucuucuuccgauccaccaugcccggcugcucaggcuaucccaacauggaccuagacugcuuacuaccccaagaauggguccaauacuucuaucaagaagccgccccagcccaauccgacguugcauuacuccgcuuuguaaacccugacacaggccgcguccucuucgaauguaagcuccacaaauccggcuacgucacugucgcccacaccggccaacacgaccucgucaucccucccaacggcuacuucagauucgacucuugggucaaucaauuuuacacacuagcccccaugggcaacggcaccggaagaagacgagcacuauaa

SEQ ID NO: 35304 - RNA, 1623 nt, Artificial Sequence
  derived and/or modified sequence opt11 from capsid_protein_VP1__Norovirus__AFW15949
augaaaauggccucauccgacgcaaaccccucagacggauccaccgccaaccugguacccgaagucaacaacgaggucauggcccucgaaccagucguaggagccgccauagccgccccagucgccggucaacaaaacguuaucgacccguggauacgaaacaacuucguccaagcccccggcggugaauuuaccgucucccccagaaacgccccaggcgaaauccucuggucugcaccacucggcccagaccuuaacccauaccucucacaccuagcccgcauguacaacggcuacgccggcggcuucgaaguccaaguaauccuugcaggaaacgccuuuaccgccggcaaaaucaucuucgcagccguacccccaaacuuuccaacagaaggacucucccccucccaagucaccauguucccacacaucaucgucgacguucgacaacuagagcccguacucauaccacuacccgacgucagaaacaacuucuaccacuacaaccaaucaaaugacuccaccaucaagcucauagccaugcucuacaccccgcuacgcgccaacaacgcaggagacgacgucuuuaccguauccugccgaguacucacccgccccucacccgacuucgacuuuauauuccuagugccacccaccguagaaucccgaaccaaacccuucuccguccccguccuaaccgucgaagagaugaccaacucccgcuuccccauucccuuagaaaaacucuucacaggccccagcuccgccuucgucguccaaccccaaaacggcagauguacaacugacggcguccuacuaggaacuacccaacucucaccuguaaacaucugcacauuccgaggagacgucacccacauccccggcucucgcaacuacacaaugaaccuagccucccaaaacuggaacuccuacgacccaaccgaagaaaucccagcaccacucggaacccccgacuuuguuggcaaaauacaaggaguccucacccaaacuacacgcaccaacggcuccacccgaggacacaaagccacggucuacaccgguucagccgauuucucucccaaacuaggccgcguccaauucgcaaccgacaccgauaaugacuucgaaacaaaccaaaacaccaaauucacccccgucggagucauccaggacggcuccaccaccccucgaaacgaaccccaacaauggguccuccccuccuacuccggacgcaacauacacaacguucaucuggccccugccgucgccccaacuuucccaggcgaacaacuucuauuuuuccgcagcaccaugcccggaugcagcggcuaccccaacauggaccuagauugccuccucccccaagaauggguccaauacuucuaccaggaggcagcccccgcacaaucagacguugcccuccucagauucgucaacccagacaccggaaggguacucuucgaaugcaaacuccauaaauccgguuacgucacuguagcccacacgggccaacacgaccuagucauaccacccaacggcuacuuccgcuuugauucgugggucaaccaauucuacacccucgcccccaugggcaacggcacuggacgccgacgagcccuguaa

SEQ ID NO: 35305 - RNA, 1623 nt, Artificial Sequence
  derived and/or modified sequence opt11 from capsid_protein_VP1__Norovirus__AFW15950
augaaaauggcaucauccgacgcaaacccaagcgacggaucuaccgccaaccuagucccugaagucaacaacgaagucauggcacucgaaccuguugucggcgccgccaucgccgcaccagucgcuggccaacaaaacgucaucgaucccuggauccgcaacaacuucguacaagcccccggcggcgaguucacugucuccccacguaacgcucccggugaaauacucugguccgccccacucgggcccgaccucaaucccuaccucucccaccuugcccgcauguauaacggcuacgccggcggcuucgaaguccaagucauccucgccggcaacgccuuuacugcaggcaaaaucauauucgccgccguaccacccaacuuccccaccgaaggccucucucccucucaagucaccauguucccacacauaaucgucgacguccgccaacuggaacccguacuuaucccccuccccgacguccguaacaacuucuaccacuacaaccaaucuaacgacuccacuaucaaacuaaucgcaaugcuuuacacccccuugcgagccaacaacgcaggagacgacguauucacagucuccugccguguccuaacacgucccucaccagacuuugacuucaucuuccucguuccucccaccgucgaaucccgaaccaaacccuucuccguccccauccuaaccguugaagaaaugacaaacucccgcuuccccaucccccucgaaaaacuauucacaggccccucuuccgcauucgucguccagccacaaaacggcagaugcacaaccgauggcguccuucuaggcaccacccaacucucacccguuaacgucugcaccuuuagaggcgacguaacacauaucuccggaucccgcaacuacaccaugaaccucgccucccaaaacuggaccuccuacgaccccaccgaagaaauccccgccccacuuggaacccccgauuucgucggcaaaauccaaggcguuuuaacccaaacaacucgaaccaacggcucgacccgcggccacaaagcaaccgucuacaccggcuccgccgacuucucccccaaacuaggccgaguacaauucgcuaccgacaccgauaacgacuucgaaacuaaucaaaacacaaaguucacccccguaggcgucauccaagacggauccaccacccccagaaacgaaccccaacaauggguacucccuuccuacucaggaagaaacauccacaacguucaucuagcacccgccgucgccccaacauuccccggugaacaacuucucuucuuccgauccaccaugccagguugcuccggcuaccccaacauggaccuagacugccuacucccacaagaauggguccaauauuucuaccaagaagcagcacccgcccagucagacgucgcccuccuccgcuucgucaaccccgacaccggccguguccucuucgaauguaaacuucacaaaucaggcuauguaaccgucgcccacaccggccaacacgaccuagucaucccacccaacggcuacuuccguuucgacuccugggucaaccaauucuacacucucgccccaaugggaaacgggaccggccgccggcgcgcacuauaa

SEQ ID NO: 35306 - RNA, 1623 nt, Artificial Sequence
  derived and/or modified sequence opt11 from capsid_protein_VP1__Norovirus__AFW15951
augaaaauggccuccuccgacgccaaccccuccgacggcucaaccgccaaccuuguaccagaagucaacaacgagguuauggcccuugaacccgucguaggggccgccauagccgcaccagucgccggccaacaaaacgucaucgaccccuggauccgaaacaacuucgugcaagcccccgguggcgaguucaccguuagcccccgcaacgccccaggcgaaauacuaugguccgcuccccucggaccagaucucaacccauaccucucucaccuagccagaauguauaacggcuacgccggcggcuucgaaguccaaguaauccuagcaggcaacgccuucaccgcuggcaaaauuaucuucgccgccgugcccccaaacuuccccacugaaggccuaucuccaucccagguaaccauguucccccacaucaucgucgacguccgccaacucgaacccgucuuaaucccccucccagacguccgaaacaauuucuaccauuacaaccaauccaacgacucaacaauuaaacuaauagccaugcucuacacuccccuuagagcaaacaacgccggcgaugacgucuucaccgucuccugccgcguacucacccgaccuuccccagacuucgacuucaucuuccuaguucccccaaccgucgaaucccgcaccaaacccuucagcgucccaauccucaccguugaagaaaugaccaacucccgcuuccccaucccucucgaaaaacucuucaccggacccucauccgccuucgucguacaaccccaaaacggccgcugcaccacagacggcguccuccucggaacaacccaacuauccccagucaacaucugcaccuuccgaggcgaugucacccacauauccggcucccgaaacuauacaaugaaccucgccucacaaaacuggaccuccuacgaccccacugaagaaaucccagcaccccuaggcacccccgacuucgucggcaaaauacaaggcguccucacccaaaccaccagaaccaacggauccacccguggccacaaagccacagucuacaccggauccgccgacuucuccccuaaacucggccggguacaauucgccacagacacugauaaugacuuugaaacaaaccaaaacacuaaauucacccccguaggaguaauccaagauggauccacuaccccucgaaacgaaccccaacaauggguacuacccuccuacuccggacgaaacauccacaacguccacuuagcccccgccgucgccccaacauuccccggcgaacaacuacucuucuucagauccaccaugcccggcugcuccggcuaccccaacauggaccucgauugccuccucccacaagaauggguacaauauuucuaccaagaagccgccccagcccaauccgacguagcacuccuccgcuucguaaacccagauaccggccgcguccucuucgaaugcaaacuacacaagucgggcuacgucaccguagcacauaccggacaacacgaccuugucaucccacccaacggauacuuccgcuucgauagcugggucaaccaauucuacaccuuagcccccaugggcaacggcaccggccgccgccgcgcccucuga

SEQ ID NO: 35307 - RNA, 1653 nt, Artificial Sequence
  derived and/or modified sequence opt11 from capsid_protein_VP1__Norovirus__AFX71665
augaagauggcauccaacgaugccgcccccucaaacgacggcgcugccaaccuaguucccgaagccaacaacgaaguaauggcccuugaaccagucguaggcgccuccaucgccgcaccagucgucggacaacaaaacaucauagaccccuggauacgagaaaacuucguacaggcaccccaaggcgaauuuacagucucaccccgcaacucccccggagaaauguuacugaaccucgaacuuggccccgaacucaacccauaccuaucccaccucuccagaauguacaacggcuacgccggcggcaugcaaguccaagucguacuagccggcaacgccuucaccgcaggcaaaaucauauucgcugcaguacccccacacuucccagucgaaaacauauccgccgcccaaauaaccauguguccccacgucaucguagacguccgccagcucgaacccguccuccucccccuucccgauauacggaaccgguucuuccacuacaaucaggagaacaccccacgcaugcgcuuagucgcaaugcuauacacgccccuacgagcaaacuccggagaagacguauucacagucuccugcagaguucucacacgccccgcccccgauuucgaguucaccuuccucguaccacccaccgucgaauccaaaacaaaacccuucacccuacccauccucacacuaggagaacuaucaaacucccgcuuuccagccgcaaucgacaugcucuacaccgacccaaacgaaagcaucgucguacaaccccaaaacggcagaugcacccucgacggaacacuccaaggcacaacccaacuggugcccacccaaauaugcgccuuccgaggcacccucauuagccaaaccgcacgcgcugccgacucuaccgacuccccacagcgagcacgcaaccacccccuccacguacaagucaaaaacuuagacggcacacaguacgaccccaccgacgacauuccagcaguccucggcgccaucgacuuccaaggcaccguauucggcguagcgucacagcgcgacgucuccggccagcaagaacagggccauuacgccaccagagcccacgaagcccacaucgacacuaccgacccgaaauaugcaccaaaacucggcaccauccucaucaaauccgacucagacgacuucaacaccaaccaacccaucagauucaccccagucggaaugggcgacaacaacuggcgacaaugggaacuaccagacuacucaggccgccucacccugaacaugaaccuagccccugccgucuccccuuccuuccccggcgaacgcauccucuuuuuccgcuccaucguacccuccgccggaggcuauggcuccggauacaucgacugccuuauaccacaagaaugggugcaacacuucuaccaagaagccgccccaucccaauccgcagucgcacucguccgauacgucaaccccgacacaggccguaacaucuuugaagccaaacugcaucgcgaaggauuccucacagucgccaauucaggcaacaaccccaucguugucccacccaacgguuacuuccgauucgaagccugggucaaccaauucuacacccucgcccccaugggcucaggacagggccgacgccgagcacaauga

SEQ ID NO: 35308 - RNA, 1623 nt, Artificial Sequence
  derived and/or modified sequence opt11 from capsid_protein_VP1__Norovirus__AFX71668
augaaaauggccuccuccgacgcaucccccucagacggcuccaccgccaaccuagucccugaagucaacaacgaagucauggcacuagaacccguagccggcgccgccauugcagcacccgucgccggccaacaaaacgucauugacccauggauccgaaacaacuucguacaagcgcccggaggcgaguucacugucuccccuagaaacgcacccggcgaaauauuauggagcgcaccccuuggccccgaccucaaccccuaccuaucccaccucgccagaauguauaauggcuacgccggcggauuugaaguccaaguaauccucgccggcaacgccuucaccgccggcaaaauuaucuucgccgcugucccacccaacuuccccaccgaaggccuaucacccucccaaguaacuauguuuccccauaucauuguagacguccgacaacucgaacccguucucaucccccuccccgacguacgcaacaacuucuaccacuacaaccaacucaacgaccccaccauaaaacucaucgcuaugcuauacacaccccuacgcgcaaacaacgcaggggaugacgucuucaccguauccugccguguccucacccgccccucccccgacuucgacuucauauuccucgucccacccacagucgaaucacgaaccaaacccuucagcguccccguacucacggucgaagaaaugaccaacucccgauuccccauaccccuagaaaaacucuucaccggucccucaagcgcauucgugguacagccccaaaacggacgcugcacuacagacggcguccuccucggcaccacccaacucucccccgucaacaucugcaccuuccgcggagacgucacacacaucagcggcucacgaaacuacaccaugaaccucgccucacaaaacuggaacuccuaugaccccacagaagaaauaccagcaccccuaggaaccccugacuucguaggcaaaauccaaggagugcucacacaaaccaccagaacaaauggaucuacccgaggccacaaagccacagucuacacaggaucagcagacuucucccccaaacucggccgaguucaauucgccaccgacaccgauaacgacuucgagacaaaccaaaacacaaaauucacccccgucggagucauacaagacggaaacacuacaccaagaaacgaaccccaacaauggguacuucccuccuacucaggccgcaacauacaaaacguccaccucgcuccagcaguagcccccaccuuuccuggagaacagcuccuauucuuccgauccacuaugcccggaugcuccggcuaccccaauauggaccucgacuguuuacucccccaagaauggguccaauacuucuaccaagaggcugccccugcacaaucagacgucgccuuacuccgauucgucaacccagacaccggccgcguucuauucgagugcaaacuccacaaauccggcuauguuacaguugcccacacaggucaacacgaccuugucauacccccuaauggcuacuuccgguucgacuccugggucaaccaauucuacacccucgcacccaugggaaacggcaccggacgcagacgcgcccucuaa

SEQ ID NO: 35309 - RNA, 1623 nt, Artificial Sequence
  derived and/or modified sequence opt11 from capsid_protein_VP1__Norovirus__AFX81121
augaaaauggccucuaacgacgccaaccccuccgacggcucugcagcaaaccuagucccagaaguauccaacgaagucauggcccucgaaccagucguuggcgccgccauagcagccccagucgcaggccaacaaaacgucauagaccccuggauucgcaacaacuucguccaagcacccggcggcgaauuuacaguaucaccccgcaacgcccccggcgaaauccuuugguccgcuccccuaggccccgaccucaaccccuaccuaucccaccuggcccgaauguacaacggcuacgccgguggcuucgaaguccaaguaauccucgccggaaacgccuucaccgccggcaaaaucauauucgccgccguacccccaaacuuccccacagaaggccucucgcccucccaagucaccauguucccccacaucauuguugacguccgccaacuugaacccguccucaucccccuaccggacguccgcaacaacuucuaucacuacaaccaaaccaacgacucaacaauaaaacucaucgcaaugcucuacaccccuuuaagagcaaacaacgccggagaagacgucuucaccguaucaugccgaguccucacacggcccuccccagacuucgacuuuaucuucuuagucccgcccaccgucgaaucacggaccaaacccuucaccguccccauccucacuguugaagaaaugacgaacucccgcuucccaauaccacucgaaaaauuauucaccgggcccucgggagccuuugucguacagccacaaaacggcagaugcacaaccgacggcguccugcucggcaccacccaauuaucucccguuaauaucugcacauuuagaggagaugucacccacauagcaggcuccagaaacuacacaaugaaccucgcgucccuaaacuggaacaacuacgauccaacugaagaaauucccgcaccccucggcaccccagacuucgucggcaaaauccaaggaguccuaacccaaaccacuaaaggagacggauccacucgcggacacaaagccaccgucuacaccgguuccgcacccuucacaccaaaacucggcuccguacaauuuucuaccgacaccgaaaacgacuucgaaacccaccaaaacaccaaauucaccccaguaggcgugauccaagacggaggcaccacccaccgaaacgaaccgcaacaguggguacuccccuccuacucuggccgcgacguccacaacguacaccuagcgccagcagucgccccuacauuccccggcgaacaacuccucuucuuccguuccaccaugcccggcugcucaggcuaccccaauauggaccuagacugccuacuaccccaagaauggguacaacacuucuaccaagaagccgcucccgcacaaucagacguagcccuccuccguuucgucaaccccgacacuggccguguccuauuugaaugcaaacuccacaaaucaggcuaugucaccguagcccacacaggacaacacgaccucgucauaccuccuaacgguuacuuucgauucgacuccugggucaaccaauucuacacucuagcccccaugggcaacggcaccggacgccgacgagcacuauaa

SEQ ID NO: 35310 - RNA, 1623 nt, Artificial Sequence
  derived and/or modified sequence opt11 from capsid_protein_VP1__Norovirus__AFX81127
augaaaauggccagcaaugacgccaaccccuccgacggcucagccgcaaaccuuguccccgaaguaucaaaugaagucauggcccuagagcccgucgucggagcagcaaucgcugcacccgucgcaggccaacaaaacgucaucgaccccuggauccgcaacaacuucguacaagcacccggaggcgaguucacaguaucaccccgcaacgcccccggcgaaauccugugguccgcaccuuuaggccccgaccucaacccuuaccuaucccaccuagcacgcauguauaacgguuacgccggcggcuuugaaguccaagucauucuagcaggaaacgccuuuaccgccggcaaaaucauauucgcagcugucccacccaauuuccccaccgaaggccucucacccucccaagucacaauguucccccacaucaucguagacguccgccaacucgaaccuguccucauaccccuaccagacguccgcaacaacuucuaccacuacaaccaaaccaacgauuccacaaucaaacucauagcaaugcuuuacaccccacuccgagcuaacaacgccggcgaagacguauucacuguaagcugccgcguccucacacguccuagccccgacuucgacuuuaucuuccucguuccacccacagucgaaucacgcacaaaacccuucaccguccccauccuaaccguagaagaaaugaccaacucccguuuccccauaccccucgagaaacucuucacaggcccaucaggcgccuucgucguccaaccccagaacggcagaugcacaaccgacggaguucuacuaggcacaacccaacuaagccccgucaacauaugcaccuuccgaggagacgucacccacaucgcaggguccagaaacuacacaaugaaccucgcaucacucaacuggaacaacuacgacccaaccgaagaaauucccgccccacucggaaccccagacuucgucggaaaaauccaaggcguccuuacccagacaaccaagggagacggcuccacccgcggucacaaagccacugucuauaccggcucagcgccuuucaccccuaaacucggauccguccaauucuccacagacaccgagaacgacuuugaaacccaccaaaacaccaaauucacuccugucggcgucauccaagaugguggcaccacacaccgcaacgagccccaacaauggguacuccccuccuacucgggaagagacguacacaacguacaccuagcccccgcugucgcaccaacguuucccggagaacaacuccuauucuuccgaucaacaaugcccggcugcucaggcuaccccaacauggaccuagacugccuacucccccaagaguggguucaacacuucuaccaagaagccgcacccgcacagucagacgucgcacuucuccgauucguaaacccagacaccggacgcguacucuucgagugcaaacuucacaagucaggcuauguaacagucgcccacaccggacagcacgaccuaguaaucccucccaacggauacuuccgguucgacucuugggucaaccaauucuacacccucgcccccaugggaaacgguaccggccgccgacgagcacuuuaa

SEQ ID NO: 35311 - RNA, 1623 nt, Artificial Sequence
  derived and/or modified sequence opt11 from capsid_protein_VP1__Norovirus__AFX81130
augaaaauggccucaaacgacgccaacccaucugacggauccgcugccaaccuugucccggaaguauccaacgaagucauggcccucgaacccgucgucggagccgcuauugccgcccccgucgcaggccaacaaaacgucaucgaccccuggauccguaacaacuucguccaggccccaggcggugaguucaccgugagcccccgaaacgccccaggcgaaauccuaugguccgcaccacucggccccgaccucaaccccuaccuaucccaccuagcccgcauguacaacggauacgccgguggauucgaaguccaagucauccucgcuggaaacgccuucaccgccggcaagaucaucuucgccgccguacccccaaauuucccaacagaaggccucucccccucccaagucaccauguucccccacauaaucgucgacguccgccaacuagaacccguccucauuccccuucccgauguaagaaacaauuucuaccacuacaaccaaacuaacgacuccaccaucaaacuaaucgcaaugcucuacacaccccuccgugccaacaacgcgggcgaagacgucuuuaccguaucgugcagaguccucacccgccccucccccgauuucgacuucaucuuccucgucccacccaccguugaaucccguaccaaacccuucacaguccccauccuuacagucgaagaaaugacaaacucacgcuucccaauaccccucgaaaaacucuucacaggacccucaggagccuuuguaguccaaccacaaaacggccgcuguacaaccgacggcguucucuuaggaaccacccaacucagccccgucaauaucuguacauucagaggcgacgucacacacauagcaggcucccgaaacuauaccaugaaccuagccucccucaacuggaacaacuacgaccccacagaagaaauaccagcaccccucggcacccccgacuucgucggcaaaauccaaggcguccucacccaaacaaccaaaggugacggauccacccgcggucacaaagccaccguauacaccggcagcgcucccuucaccccuaaacuuggaucaguccaauucuccacagauaccgaaaacgacuucgaaacccaccaaaacaccaaauucacccccgucggaguaauccaggacggaggcaccacccaccgcaacgaaccacaacaauggguccuccccuccuacucggggagagacguacacaacguucaccucgccccagcagucgcacccaccuucccaggcgaacaacuccuauuuuuccgcucaacuaugcccggaugcuccggcuaucccaacauggaccucgacugccuccucccccaagaauggguucaacauuucuaccaagaggccgcccccgcccaaucagacguagcacuacuacgcuucgucaaccccgacacaggacguguacucuucgaaugcaaacuacacaaauccggauacgucaccguagcccauacaggacaacacgaucucgucauaccgcccaauggcuacuucagauuugacucuugggucaaccaauucuacaccuuagcaccuaugggcaacggcaccggccgccgccgagcccuguaa

SEQ ID NO: 35312 - RNA, 1623 nt, Artificial Sequence
  derived and/or modified sequence opt11 from capsid_protein_VP1__Norovirus__AFX81136
augaaaauggcauccaacgacgcaaaccccuccgacggcuccgccgccaaccucgugcccgaagucucaaacgaagucauggcccuagaacccgucguaggagccgcaauugcugccccaguagcaggccaacaaaacguaaucgaccccuggaucagaaacaacuucguacaagcccccggcggagaguucaccguaucaccccgaaacgcccccggcgaaauacucugguccgcuccccucggccccgaccuaaaccccuaccucagucaccuugcccgcauguacaacgguuacgccggcggauuugaaguacaaguaauccuagccggcaacgcuuucaccgccggcaaaaucaucuucgccgccgucccaccaaacuuccccaccgaaggcuuaucccccucacaagucaccauguuuccccacaucauugucgacguacgccaauuagaacccguacuaaucccacucccagauguccgcaacaacuucuaccacuacaaccaaaccaacgacucaacaaucaaacucauagcaaugcucuacaccccacuccgagccaacaaugccggagaagacgucuucaccgucucuugccgaguccuaacacgcccaucccccgacuucgacuucaucuuccucguuccacccaccgucgaaaguagaaccaagcccuucaccguccccauacucacuguagaagaaaugaccaacucccgcuucccaauaccccuagaaaaacuuuucacaggacccucgggcgcauucgucguacaaccccaaaacgggcgcugcaccaccgacgguguccuacucggcaccacccaacucuccccagucaacauaugcaccuucagaggagacgucacccacauagcgggcucccgaaacuacaccaugaaccuagcaucucuaaacuggaacaauuacgacccaaccgaagaaauacccgcuccccuaggaacccccgacuucgucggcaaaauccaaggcguccuaacccagaccaccaaaggcgauggauccacaagaggccacaaggccacagucuacaccggcuccgcccccuucacccccaaacuaggcucuguacaauucucaacagacaccgaaaacgacuucgaaacccaccaaaacaccaaauucaccccaguaggggucauucaagacggaggaacaacccaccgcaacgaaccccaacaauggguucuucccuccuacucaggccgcgacguacacaauguccaccucgcuccagccguagcccccaccuuccccggcgaacaacuccuauucuuccgauccaccaugccaggcugcuccgguuacccaaauauggaccuagacugccuccucccccaagaauggguccaacacuucuaccaagaagccgccccagcccaaucagacgucgcccugcuccgcuucgucaaccccgauaccggcagaguccucuucgaaugcaaacuucacaaauccggcuacgucaccgucgcacacaccggccaacacgaccucgucauacccccaaauggcuacuuccgcuucgacucauggguaaaucaauucuacacccuagcccccaugggcaauggaacaggccgucggcgcgcccucuaa

SEQ ID NO: 35313 - RNA, 1623 nt, Artificial Sequence
  derived and/or modified sequence opt11 from capsid_protein_VP1__Norovirus__AFX81139
augaaaauggcauccaacgacgcaaaccccuccgacggcuccgccgcaaaccucguccccgaagucuccaaugaagugauggcccuagaacccguagucggcgccgcaaucgcagcacccgucgccggccaacaaaacgucaucgaccccuggauccgcaacaacuuuguccaagccccuggcggagaguucacagucuccccacgcaacgcccccggagaaauucucuggagugcuccacucggccccgaccucaaccccuaccucucacaucuugcaagaauguacaacggcuacgccggcgguuucgaaguacaagugauacucgcuggcaacgccuuuaccgccggcaaaaucaucuucgcugccguacccccaaacuucccaacagaaggccuuuccccaucacaggucacuauguucccccauaucaucgucgacguccggcaacucgaacccguccucaucccccuucccgacguccgcaauaacuucuaccacuacaaccaaaccaacgacuccaccaucaaacuaaucgccaugcucuacacgccccuacgcgccaacaacgcuggcgaagacgucuucacaguaucaugccgcguccuaacccgccccucacccgauuucgacuucauauuccucgucccgcccacagucgaaucucgcaccaaaccauucaccguuccuauccuaaccguagaagaaaugaccaacucccgcuuccccauuccccuagaaaaacucuucacaggcccguccggcgccuucgucguccagccacaaaauggcagaugcaccaccgacggcgucuuacuaggcaccacucaacucucccccguuaacaucugcaccuuccgaggcgauguaacccauauugcggguucuagaaauuacacaaugaaccucgccagccucaauuggaacaacuacgaccccacagaagaaaucccagccccacuagguacccccgacuucguaggcaaaauccaaggaguccuaacccaaacaaccaaaggcgacggcucaacacgaggccacaaagcaaccgucuacacuggauccgcccccuucacccccaaacucggguccguccaauucuccaccgacacagaaaacgacuucgaaacccaccaaaacacaaaauucacacccguaggcgucauacaagacggcggcaccacccaccgcaacgaaccacaacaaugggucuuacccucauacuccgggcgcgacguacauaauguccaccucgcccccgccgucgccccaacauucccaggagaacaacuccucuuuuuccgcuccaccaugcccggcugcuccggcuaccccaacauggaccuagacugccuacuaccacaagaauggguacaacacuucuaccaagaagccgccccagcucaauccgacgucgcccugcuucgauucgucaaccccgacacgggacgaguccucuucgaaugcaaacuucacaaaucaggcuacguaaccguugcacauacaggccaacacgaccucguaauaccaccgaacggcuacuuccgcuucgacucauggguaaaccaauucuacacucuagcccccaugggaaacggcaccggacgacgccgcgcacucuaa

SEQ ID NO: 35314 - RNA, 1623 nt, Artificial Sequence
  derived and/or modified sequence opt11 from capsid_protein_VP1__Norovirus__AFX81142
augaaaauggccuccaacgacgccaaccccuccgacggcuccgccgcgaaccuagucccugaaguuuccaacgaagucauggcccucgaacccgucgucggcgccgccaucgccgccccugucgccggccaacaaaacgucaucgacccauggauccgaaauaacuucguccaagccccaggcggagaauuuacuguauccccacgaaacgcccccggcgaaauauuauggucugcaccccuaggccccgaccuaaacccauaccucucacacuuagcccgcauguacaacggauacgccggaggauucgaaguacaagucauacuagcuggcaacgcauucacagccggaaaaaucauauucgccgccguucccccgaacuuuccaacagaagggcuaucucccucccaaguuaccauguuuccacacauaaucgucgacguccgacaacucgaaccuguccuaaucccccuaccagacguacggaacaauuucuaccacuacaaccagacaaacgacucaacaaucaaacuuaucgccaugcuguacaccccacuacgagcaaacaacgccggcgaggacgucuucacagucucaugccgcguccucacccgccccucucccgacuucgacuucaucuuccuggucccacccaccguagaaucacgaaccaagcccuucaccguacccauucucacagucgaagaaaugaccaacucucgauuccccaucccccucgaaaaacucuucaccggcccauccggcgccuucgucguacaaccucaaaacgggagaugcacaaccgacggcguacuccuaggcaccacccaacuaucccccgugaacaucugcaccuuccgcggcgacgucacccacaucgccggcuccagaaacuacacaaugaaccuugcuagccuaaacuggaacaacuaugacccaaccgaggaaauccccgcaccccucgguacccccgacuucgucggaaaaauccaaggcgucuuaacccaaaccacuaaaggugacgguagcacacgagggcauaaagccacagucuacaccggcuccgccccauucacaccaaaacucggcucaguacaauucucaaccgacacugaaaacgauuucgaaacccaccaaaacacgaaauucacacccgucggcgucauacaagacgguggcaccacccaucgcaacgaaccccaacaauggguccuucccuccuacagcggccgcgauguccauaacguccaccuagcccccgccgucgcacccaccuuccccggcgaacaacuuuuauucuuccgguccaccaugcccggcugcuccggauacccaaacauggaccucgacugccuccuuccucaagaauggguccaacacuucuaccaagaagcagcccccgcacaaucugacgucgcucuccuccguuuuguaaaccccgacaccggccgcguccuauucgaaugcaaacuacacaaauccggcuaugucacagucgcccacaccggccaacacgaucuaguaaucccuccaaacgguuauuuccgcuucgacuccugggucaaccaauucuacacccuugcccccaugggcaacggaaccggaagacgccgcgcucuauaa

SEQ ID NO: 35315 - RNA, 1623 nt, Artificial Sequence
  derived and/or modified sequence opt11 from capsid_protein_VP1__Norovirus__AFX81145
augaaaauggccuccaacgacgcaaacccaagcgacggaucagccgcaaaccugguccccgaagugucaaacgaagucauggcgcucgaacccgucguaggagcagcgaucgccgccccuguugccggacagcaaaacguuaucgaccccuggauacguaacaacuucguccaagcaccaggcggugaguucaccguuucaccccgcaacgccccaggcgaaauccuaugguccgccccacuuggccccgaccucaacccauaucucucccaccuugcccgaauguacaacggcuacgcaggcggauucgaaguccaagucauccucgccggcaacgcguucaccgccggcaaaaucauauucgccgccgucccacccaacuuccccaccgaaggccuaucacccucacaaguuaccauguucccacacaucauugucgacguccgccaacuggaaccaguccucaucccccuccccgaugucagaaacaacuucuaccacuacaaccaaacaaacgacucaaccauaaaacucaucgccaugcuauacacaccccuucgagccaacaacgccggcgaagacgucuucaccguauccugccgcguucucacccgcccaagucccgacuucgauuuuaucuuccuaguacccccuacagucgaaucacgcaccaaacccuucacuguccccauacuaaccguugaagaaaugaccaacucuagauuccccaucccccucgaaaaacucuuuaccggacccucaggcgccuucgucguccaaccacaaaacggccguugcaccacggacggaguacuccuaggaaccacccaacuuucccccgucaauaucugcacauuccgcggagacguaacccacauagccggcucccgcaacuacaccaugaaccucgccucccuaaacuggaacaacuacgacccaaccgaagaaauacccgcaccccucggaacccccgacuucgucgguaaaauccaaggaguacucacacaaacaacuaaaggcgacggcuccacccgaggccacaaagccaccgucuauaccggcagcgcccccuucacacccaaacuuggauccguacaauucucaaccgacacagaaaaugacuucgaaacccaccagaacacgaaguucaccccugugggcgucauccaagacggcggaacaacacaccgcaacgaaccccagcaguggguccucccaagcuacuccggccgagacguccacaacguccaccucgcccccgccgucgcccccaccuuccccggcgaacaguuacuuuucuuucgaucgaccaugcccggcuguuccggcuaccccaacauggaccucgacugccuccuuccccaagaauggguacaacacuucuaccaagaagccgccccagcacaaucagacguugcccuacucagauucguaaacccugacacaggaagaguccucuucgaaugcaaacuccacaaauccggcuacgucaccgucgcucacacuggccagcaugaccuagucaucccacccaacgguuacuuccgauucgacuccugggucaaccaauucuacacccuugcccccaugggcaacggcacuggacgacgccgagcacuuuaa

SEQ ID NO: 35316 - RNA, 1623 nt, Artificial Sequence
  derived and/or modified sequence opt11 from capsid_protein_VP1__Norovirus__AFX81148
augaaaauggcuucaaacgacgccaacccuagcgacgguucggcagcaaaccucguccccgaaguauccaacgaagucauggcccucgaacccguagugggcgccgccaucgcagcaccagucgccggacaacaaaacguuauagaccccuggauccgcaacaacuucguacaagcccccggcggcgaguucaccguauccccacgcaacgccccaggcgaaauccucuggucagccccucucggaccagacuuaaaccccuaccucucccaccuugcucgaauguacaacggcuacgccggcggcuucgaaguccaagucauccucgcaggcaacgccuucaccgccggcaaaaucaucuucgcagcuguuccaccaaacuuccccaccgaaggccuguccccuucccaaguaaccauguucccccacauaaucguagacgucagacaacucgaacccgugcucauaccccucccagacguccgaaacaacuucuaccacuacaaccagacaaacgacuccaccauaaaacuaauugccaugcucuacacaccccuacgcgccaacaacgcaggcgaagacgucuucaccguauccugccgcguacuaacccgaccaucaccagacuucgacuucauauuccucguucccccaaccguugaaucccgcaccaaacccuucacgguccccauccucacagucgaagaaaugacuaacucucgcuucccaauuccacucgaaaaauuauucacaggcccauccggcgccuucguaguacagccacaaaacggacgcugcaccaccgacggaguacuccucgguaccacucaacucucccccguaaacauauguaccuuccgaggcgacgucacccacauugcaggaucacgaaacuacaccaugaaccuagccucucucaacuggaacaacuacgaccccacggaagaaauccccgccccacuggguacccccgacuucguuggcaaaauacagggcguccuuacccaaaccacaaaaggagauggcucaacccgaggccacaaagccaccguauacaccggauccgcccccuucacccccaaacucggauccguacaauucuccaccgauaccgaaaacgacuucgaaacacaccaaaacaccaaauucacucccgucggcgucauucaggacggaggaaccacacaccgaaaugaaccacaacaauggguccuaccuagcuacuccggacgcgacguccacaauguacaccucgcacccgccguugcacccacauucccaggagaacaacuucuuuucuuccgaagcaccaugcccggauguucaggauaccccaacauggaccuagauugucuccucccccaagaauggguccaacacuucuaccaagaagccgcccccgcacaauccgaugucgccuuacuccgcuucguuaaucccgauaccggacgaguccuuuuugaaugcaaacugcacaaaucuggauauguaacuguagcccacaccggccaacacgaccucguaaucccucccaacggcuacuuccgauucgauuccugggucaaucaauucuacacacucgccccaaugggcaacggcacaggccgccgccgcgcccucuaa

SEQ ID NO: 35317 - RNA, 1623 nt, Artificial Sequence
  derived and/or modified sequence opt11 from capsid_protein_VP1__Norovirus__AFX81154
augaaaauggcaucaaacgacgcuaaccccagcgauggcagcgccgccaaccucguccccgaagucucaaacgaagucauggcccuagaacccgucguaggggccgccaucgcugcccccgucgccggccaacagaacguuauugaccccuggauaagaaacaacuucguacaagcccccggaggcgaauucacagucucaccccgaaacgcccccggcgaaauacucuggagcgccccacuagguccagacuuaaacccuuaccucucccaucucgcccgaauguauaacggauacgccggcggauucgaagugcaaguaauccucgcaggcaacgccuucaccgccggaaaaaucaucuucgccgccguaccucccaacuuccccacugaaggacucucccccucacaagucaccauguucccccacaucauagucgauguucgccaacucgaacccguccuaaucccccuccccgacgucaggaauaacuucuaccacuacaaccaaaccaacgacuccacaaucaaacucauugcuaugcucuacacaccccuccgcgcaaacaacgccggagaagacgucuucacagucuccugccgcguacucacccgccccucccccgacuucgauuucaucuucuuagucccacccaccgucgaaucacgcacaaagcccuucaccguacccauccuaacagucgaagaaaugacaaacucccgcuuccccauaccccucgaaaaacucuucaccggaccauccggcgccuucgucguucaaccacaaaauggccgaugcaccaccgauggaguccuccucggcacaacacaacucucaccaguaaacauaugcaccuuccgcggcgacgucacccacauugcaggcucccgcaacuacaccaugaaccucgcaucacucaacuggaacaacuacgaccccacagaagaaauccccgcuccccuaggaacaccagacuucgucggcaaaauccaaggcguccucacccaaaccaccaaaggcgacggcuccacccgaggccacaaagcaaccguauacaccggcucagcaccuuucacaccaaaacucggcuccguacaauucuccaccgacaccgaaaacgacuucgaaacccaccaaaacaccaaauucaccccagucggcgucauacaagacgguggcaccacccacagaaacgaaccccaacaauggguccuccccucuuacuccggacgcgacguacacaacguucaccuagccccggccgucgccccuaccuuccccggagaacaacuucuuuucuuccgaucuacaaugcccgguugcuccggcuaccccaacauggaucucgacugucuccucccccaagaauggguacaacacuucuaccaagaagcagccccagcccaaucagacgucgcccuccuucgguucgucaacccugacaccggccgcgugcucuucgaaugcaaacuccacaaauccggcuacgucaccgucgcccacaccggccaacacgaccucgucauaccccccaacgguuacuuccgcuucgacagcugggucaaccaauucuacacucucgccccuaugggaaacggcacaggccgacgccgugcccucuaa

SEQ ID NO: 35318 - RNA, 1623 nt, Artificial Sequence
  derived and/or modified sequence opt11 from capsid_protein_VP1__Norovirus__AFX81157
augaaaauggccucaaacgacgccaacccauccgacggaucugccgccaaccucguaccagaagucuccaacgaaguuauggcccuagaacccgucgucggcgcugcaaucgcagcacccgucgcaggccaacaaaacgucaucgaccccuggauccgaaauaacuuuguccaagccccaggcggcgaguucacugucuccccacgcaacgcacccggugaaauccuuugguccgcuccccucggaccagaccucaacccauaucucucacaccuugcccgaauguacaacggcuacgccggcggauuugagguccaagucauacucgccggaaacgccuucaccgccggcaaaaucaucuucgcugccguacccccaaacuucccaacugaaggccucucacccucucaagucaccauguucccccacauuaucgucgacguccggcaacuagaacccguccuaauaccccuccccgacguccguaacaacuucuaccacuacaaccaaaccaacgacuccacaaucaaacuaaucgccaugcucuauacaccccuccgagcgaacaacgccggagaagacgucuuuacagucuccugccgcguccuuacccgacccucccccgacuucgauuucaucuuccucguuccucccacggucgaaucccguacaaaacccuucaccguccccauccugaccgucgaggaaaugacuaacucccgauuccccauccccuuagaaaaacuuuucacuggacccucuggagccuucguaguacaaccccaaaacggcagaugcaccacagacggcguccuucuuggcaccacccaacuuagccccgucaacaucugcaccuuucgcggcgacgucacacauauugccggaucucgcaacuacaccaugaaccucgccucccuaaacuggaacaacuacgaccccaccgaagaaauccccgcaccgcucggaacgccagacuucgucggcaaaauacaaggaguacuaacucaaaccacuaaaggcgacggcuccacacgaggccacaaagccaccgucuacacaggauccgcccccuucacaccuaagcuaggcuccguccaauucucuacagacaccgaaaacgacuucgaaacccaccaaaacaccaaauucacccccgucggcgucauccaagacggcggcacaacccaccgcaacgaaccccaacaauggguccuccccagcuauuccggacgcgacguccacaacguccaucuagcgccagccgucgcacccaccuuccccggagaacaacuacucuucuuccgauccaccaugcccggcugcuccgguuaucccaacauggaccuugacugccuccucccucaagaguggguacaacacuucuaccaagaagcagcacccgcccaguccgacgucgccuuacuccgcuuugucaaccccgacaccggacgaguccucuucgaaugcaaauuacauaaaucaggguacguaaccguagcgcacaccggccaacacgaccucgucauacccccaaacggcuacuuccgcuucgacucaugggugaaccaauucuacacacucgccccaaugggaaacggaacaggccgacgacgagcacucuaa

SEQ ID NO: 35319 - RNA, 1623 nt, Artificial Sequence
  derived and/or modified sequence opt11 from capsid_protein_VP1__Norovirus__AFX81163
augaaaauggcaucuaacgacgccaaccccuccgacggcuccgccgccaaccucgucccagaaguguccaacgaagucauggcccucgaacccguggucggcgccgccaucgccgcccccgucgcuggccaacaaaacguaaucgaccccuggauccgcaacaauuucguacaggcacccggcggcgaguucacagucucaccccgcaacgcaccuggcgaaauccuaugguccgccccacucggacccgaccucaacccguaccuaucccaccucgcccgcauguacaacggcuacgcuggcggcuucgaaguccaggucauccucgccggcaacgccuucaccgcuggaaaaauaauauuugccgcaguucccccaaacuuccccacagaaggccucucaccaucccaagucaccauguucccccacaucaucgucgacguccgucaacuagaaccuguccucauacccuuaccagacguccguaacaacuucuaccauuacaaccaaaccaacgacucaaccaucaaacucaucgccaugcuauacacaccccuacgagccaacaacgccggggaagacgucuucaccgucuccugccgaguccucacccgcccuucccccgacuucgacuucaucuuccucguacccccaaccguugaaucccgcaccaagccauucaccguacccauccuaaccgucgaagaaaugacaaacucacgauuccccauaccccuugaaaagcuguucacaggcccauccggcgcauucguaguccaaccccaaaacgguagaugcaccacagacggaguccuucucggaaccacccaacucuccccagucaacaucuguaccuuccgaggcgacgucacccacaucgcaggaucucgcaacuauacaaugaaccuagccucacuaaacuggaacaacuaugaccccaccgaggaaaucccagcaccuuuaggcacccccgacuucgucggcaaaauucaagguguacuaacccaaacaaccaaaggcgacggcagcacgcgaggccacaaagcuaccgucuacacaggcuccgcucccuucacaccaaaacuaggauccgugcaauuuuccacagacaccgaaaacgacuuugaaacccaccaaaacaccaaauucacccccgucggcgucauccaagacggaggcaccacccaccgcaacgaaccccaacaauggguccucccauccuacuccggccgcgacguacacaacguucacuuggcccccgcugucgcaccaaccuuccccggugaacagcuccucuucuuccgcuccaccaugccugguugcuccggguaccccaacauggaucucgauugccuccuuccccaagaauggguacaacacuucuaccaagaagcugcacccgcccaaucagacguagcccuacuacgcuucgucaacccagacaccggccguguacucuuugaaugcaaacuacacaaauccggcuacgucaccgucgcacacaccggacaacacgaccuaguuaucccacccaacggcuacuuccgcuucgauuccuggguaaaccaauucuacacacuagcucccaugggaaacggcaccggccgacgccgcgcccucuaa

SEQ ID NO: 35320 - RNA, 1623 nt, Artificial Sequence
  derived and/or modified sequence opt11 from capsid_protein_VP1__Norovirus__AFX81166
augaaaauggccucauccgacgccaaccccuccgacggaucagccgccaaccucgucccagaaguaaacaacgaaguaauggcacuagaaccagucguaggcgccgcuaucgccgcacccguagccggccaacaaaacguuaucgaccccuggauacgcaacaacuucguccaagcccccggcggcgaguucacuguaucaccacgcaacgcacccggcgaaauccuaugguccgcaccccuagguccagaccuaaacccauaccuuucacaccucgcccgcauguauaacggauacgccggaggcuucgaaguccaagucaucuuagccggaaacgccuucaccgccggcaaaauaaucuucgcagccgucccgccgaacuuccccaccgaaggccucuccccaucccaagucaccauguuuccacacauaaucguagacguacgccagcuugaacccguacucaucccacuccccgacguccgcaacaacuuuuaccacuauaaccaauccaacgacucgacaaucaaacucaucgcgaugcucuacacaccacuccgcgcaaacaacgccggagaagacgucuucaccguaucaugccgaguccucacccgcccauccccugacuucgacuucaucuuccucguaccacccaccgucgaaucccgcaccaaacccuucaccguccccauucucaccgucgaagagaugaccaacucacgcuucccuauaccacuagaaaaacucuucaccggacccuccucagccuucgucguccaaccccaaaacggccgcugcacuacugacggcgucuuacucggcacaacucaacucagcccagucaacauaugcacauuccgaggcgacgucacacacauagcaggaucccgaaacuacacgaugaaccucgccucccugaacuggaacaacuacgaucccacagaagaaauccccgcaccccucggcacuccagacuucguaggcaaaauccaaggcguacucacccaaacaacaaaaggcgacggcucaacacguggccacaaagccacagucuauacaggcuccgcccccuuuacacccaaacuuggcuccguccaguuuucaaccgacaccgaaaacgacuucgaaacccaucaaaacacaaaauucacccccgucggagucauccaagacgguggcacaacccaccgaaacgaaccccagcaguggguacuccccuccuacuccggccgcaauguacccaacguacaccuagccccagccguugcucccaccuuucccggggaacaacuacuauucuuccgcucaaccaugccaggcugcuccggauaccccaacauggaccucgacugccuccucccccaggaauggguacaacacuucuaccaagaagccgcacccgcucaaucagacgucgcccuucuccgcuucguuaauccagacaccggcagaguacucuucgaaugcaagcuccacaaaucuggcuacguaaccgucgcacacacaggacaacacgaccucguaaucccaccaaacggcuacuuccgauucgacuccugggucaaccaauucuacacacucgcaccaaugggcaacggcaccggccgccgccgcgcccucuaa

SEQ ID NO: 35321 - RNA, 1623 nt, Artificial Sequence
  derived and/or modified sequence opt11 from capsid_protein_VP1__Norovirus__AFX81169
augaaaauggccucaaacgacgcuaaccccuccgacggaucagccgccaaccuaguccccgaaguauccaaugaagucauggcacuggaacccgucgucggcgccgccaucgccgccccaguugcuggccaacaaaacgucaucgaccccuggauacgcaacaacuucguacaagcccccggcggcgaguucacugucucaccccgaaacgcuccuggcgaaauccuuugguccgccccacucggaccagaccucaaccccuaccucucccaccucgcccgcauguacaacggcuacgccggcggauucgaaguccaagucauccucgccggaaacgccuucacugccggcaagaucauauucgcugcagucccucccaacuucccuaccgaaggacuuucucccucccaaguuacaauguucccccacaucaucguagacguucgucaacucgaacccguucucaucccccuuccagacguccguaacaacuuuuaccacuauaaccaaaccaacgacuccacaauuaaacucaucgcaaugcucuacaccccacuccgcgcaaacaacgcuggagaagacgucuucacugucucaugccgcguccuaacacgccccucccccgacuucgacuuuauauuccuagucccuccaacaguugaaucccgaacaaaacccuucaccguccccauacuaaccgucgaagaaaugacaaacucuagauuccccaucccccuggaaaaacuuuuuacaggacccuccggugccuucgucguccaaccccaaaacggccgauguacaaccgacggaguccucuugggcaccacucaacucuccccagucaacaucugcacuuuccgcggcgacguuacacacauagccggcucucgaaacuacacuaugaaccucgccucccuaaacuggaacaacuacgaccccacugaagaaauacccgcgccacuaggcacccccgacuucguaggcaaaauccaaggcguccuaacccaaaccacaaaaggcgacgguuccaccagaggccacaaagccaccgucuacacaggcucagcaccuuucaccccaaaacucgguuccguccaauucuccaccgauacagaaaacgacuucgaaacacaucaaaauaccaaauucacccccgucggcgucauccaagacggaggcacaacacacagaaacgaaccccaacaauggguacuacccuccuacuccggacgcgacguccacaacguucaccucgcccccgccgucgccccaacuuuccccggcgaacaacuccuuuucuuccgcuccacaaugcccggaugcucaggauaccccaacauggaucucgacugccuccucccacaagaguggguccaacacuucuaccaagaagcagcacccgcucaaagcgacguagcacuacuccgauucgucaaccccgacacaggccgcguccucuucgaaugcaaacuacacaaguccggauacgucaccguagcccacaccggccaacacgaccuagucauaccacccaacggcuacuuccgauucgacucuugggucaaccaguucuacacucucgcccccaugggcaacgguaccggccgccgacgcgcccuauaa

SEQ ID NO: 35322 - RNA, 1623 nt, Artificial Sequence
  derived and/or modified sequence opt11 from capsid_protein_VP1__Norovirus__AFX81172
augaaaauggccuccaacgacgcuaacccuagcgacggcucagccgcuaaccucgucccagaagucuccaacgaagucauggcccucgagccggucgucggagccgcaaucgcagcccccgucgcgggacaacaaaacguaaucgaccccuggauccgcaacaacuucguccaagccccaggaggcgaguucaccgucucaccccgcaacgcccccggcgaaauccucugguccgcaccccuuggacccgaccucaaccccuaucuaucucaccucgcccgaauguacaacggcuacgccggcggauucgaaguccaagucauacuugccggcaacgccuucacugccggaaaaauaaucuucgcagcaguaccacccaauuuccccacagaaggccucuccccaucucaaguaacaauguucccgcacaucauugucgacguccgccaacucgaacccgucuugauaccccuccccgacguaagaaacaauuuuuaccacuacaaccaaaccaacgacucuaccaucaaacucaucgcgaugcucuacaccccacugcgcgccaacaacgccggcgaagacguauucaccgucuccugccgcguccuaacccgccccuccccagauuucgacuucaucuuccucgucccacccacaguagaaucccgaaccaaacccuucaccguccccauacuaaccgucgaagaaaugaccaacucacgcuuccccauaccccucgaaaaacuauucaccggccccuccggagccuucgucguccaaccacaaaacggccgcugcaccacagacggaguacuacuaggcaccacccaacucucaccuguaaacauaugcacauuccgcggcgacgucacccauauugcaggcucacgcaacuacaccaugaaccuagccucccucaacuggaacaacuacgaccccacagaagaaauccccgcaccccucggcacgccagacuucgucggcaaaauccaaggcguacuaacccaaaccaccaaaggagauggaucaacacgcggacacaaagccacagucuacaccggcucagccccauuuacccccaaacugggcuccguacaauucuccacagacaccgaaaacgacuucgaaacccaccagaacaccaaauucacccccguaggagucauccaagacggaggcacuacucaccgcaacgaaccacaacaauggguacuuccaucauacuccggcagagacguacacaacguccaccuagccccagccguagcuccaacauucccuggcgaacaacuccuuuucuuucgcuccaccaugcccggcugcucuggguauccaaacauggaccucgacugccuccucccccaagaauggguccaacauuucuaucaagaagccgcacccgcacaaagugacgucgccuuacuaagauucgugaaccccgauaccggccgcguccucuucgaaugcaaacuccacaaauccgguuacguaaccgucgcgcacacuggacaacacgaccucgucauucccccaaacggcuacuuccgcuucgacuccugggucaaccaauucuacacccuugccccaaugggcaacggcaccggacgccgacgagcccucuaa

SEQ ID NO: 35323 - RNA, 1623 nt, Artificial Sequence
  derived and/or modified sequence opt11 from capsid_protein_VP1__Norovirus__AFX81178
augaaaauggccuccaacgacgccaaccccuccgacggcucagccgccaaccucguacccgaaguauccaaugagguaauggcccuugaacccgucgucggcgcagcaaucgcagcacccgucgcaggccaacaaaacguaaucgaccccuggauccgcaacaacuucguccaagcccccggaggcgaguucacaguuucaccccgcaacgcacccggcgaaauccucugguccgcaccccucggaccugaccucaacccauaccucucccaccucgcccgcauguauaacgguuacgcuggcggauuugaaguccaaguuauccuagcaggcaacgcuuucaccgccggcaagaucaucuucgcagcagucccacccaacuuccccacagaaggccuaucccccucccaagucacuauguucccccacauuaucgucgauguucgccaacucgaacccguccucauaccccuccccgacguccggaacaacuucuaccacuacaaccagacaaacgacuccacaaucaagcuaaucgccaugcuuuacacaccccuccgcgcaaacaacgcuggugaagacgucuucaccguauccugccgaguccucacccgaccgucacccgacuuugacuucaucuuucucgucccacccaccguagaaucacgcacuaagcccuucacaguccccauccucacggucgaagaaaugaccaacucuagauuccccauaccgcucgaaaaacuauucacuggccccuccggcgcauuuguaguccaaccucaaaacggccgcugcaccacagacggcguccuucucgggaccacacaacucucaccagugaacauuugcacauuccgcggcgacguuacccacaucgcaggauccagaaacuacaccaugaaucuagccucacucaacuggaacaacuacgaccccaccgaagaaauccccgcacccuuaggaacaccugacuucguaggaaaaauccaaggcguacucacacaaacgaccaaaggcgauggaagcaccagaggacacaaagcaaccgucuauacaggcucagcccccuucacccccaaacucggcuccguccaauucucaaccgauaccgaaaacgacuucgaaacccaccaaaacacaaaauucacacccguuggcguaauccaagacggcggaacaacccaccgcaacgaaccacaacaauggguccuacccuccuacucaggccgcgacguccacaacguccaucucgccccugccguagcaccaaccuuccccggagaacaacuacuauucuuccgauccacaaugccaggcugcuccggcuaccccaacauggaccucgacugccuccucccccaagaauggguacaacacuucuaccaagaagcagccccagcacaaucggacguggcccuccuccgcuucgucaaccccgacaccggccguguucuuuucgaaugcaaacuccacaaauccggauacguaacagucgcccacaccggacaacacgaccuaguaauucccccuaacggguacuuccgcuucgauucaugggucaaucaauucuacacccucgccccaaugggcaacggcacaggccgccgccgcgcccucuaa

SEQ ID NO: 35324 - RNA, 1623 nt, Artificial Sequence
  derived and/or modified sequence opt11 from capsid_protein_VP1__Norovirus__AFX81181
augaaaauggccuccaacgacgccaacccaucagacggcuccgcugccaaccucguacccgaagucuccaacgaagucauggcccucgaacccgucgucggcgccgcaaucgccgccccugucgccggacagcaaaaugucaucgaccccuggauacgaaacaacuucguccaggcccccggaggagaguucaccguuuccccacgcaacgcacccggcgaaauccuuugguccgcaccacucggacccgaccucaacccuuaccucucccaucuagcccgaauguacaacgguuacgccggaggauucgaaguccaaguaauccuugccgguaacgcauucaccgccggcaaaauaaucuuugccgccguaccucccaacuuucccaccgaagggcucucucccucacaaguaaccauguucccacacauaaucguagacguacgccaacucgaacccguacuuauaccacucccagacgugcgcaacaauuucuaccacuacaaccaaacuaacgacucgaccaucaaacuaauagccaugcuauacacaccccuccgcgccaacaacgccggcgaagacgucuucaccgucuccugccgcguccucacucgcccaucacccgacuucgacuuuauauuccuuguaccuccuacagucgaaucucgcaccaaacccuucacuguccccauccugaccgucgaagaaaugacaaacucacgcuuccccauccccuuagaaaaacuguucacaggucccuccggagccuucgucguccaaccccaaaacggccgcugcacaaccgacggaguccuacuuggcaccacccaacucucaccggucaacaucugcacauuccgaggcgacgucacccacaucgccggcucaagaaacuacacuaugaaccuagccucccuaaacuggaacaacuaugaccccacagaagaaauccccgcaccccuaggcacccccgacuucgucggcaaaauacaaggaguacucacccaaaccaccaaaggggauggauccacccgcggccacaaagccacaguauauaccggcuccgcucccuucaccccuaaacuuggcucgguacaauucuccacagauacagaaaacgacuucgaaacccaccaaaacaccaaguucacccccgucggcgucauccaagacggaggcacaacccaccgaaaugaaccacaacaauggguacucccaucauacucaggccgagacguucacaacguacaccuagcacccgcaguagcccccacauucccuggagaacaacuccucuucuuucggucaacaaugccaggcugcuccggcuacccgaacauggaccucgacugcuuacucccccaagaauggguccaacacuucuaccaagaagcagcccccgcacaaucagacgucgcccuacucagauucgucaacccugacacaggcagaguacucuucgaaugcaaacuacacaaaucaggcuaugugacagucgcccacacaggccaacacgaccuugucauaccacccaauggcuacuuccgcuucgacucuugggucaaccaauucuacacacucgcccccaugggaaauggcaccggucgccgccgugcacucuag

SEQ ID NO: 35325 - RNA, 1623 nt, Artificial Sequence
  derived and/or modified sequence opt11 from capsid_protein_VP1__Norovirus__AFX81190
augaaaauggcauccaacgacgccaacccuuccgacggcagcgccgccaaccuaguccccgaaguauccaacgaagucauggcccuagaacccguggucggagccgccauagcagcaccaguagccggucaacaaaacgucaucgaccccuggauucgcaacaacuucguccaagccccaggcggcgaguucaccguuucacccagaaacgccccuggcgaaauacuaugguccgcaccucucggccccgaccuaaacccuuaccucucccaccucgcccgaauguacaacggcuacgcuggcggcuucgaaguacaaguaauccuagccggcaacgcuuucaccgccggaaaaaucaucuuugccgcagucccacccaacuuccccaccgaaggccucucccccucacaagucaccauguucccccacaucauagucgacguccgccaacuagaacccguacuaaucccccuacccgauguacguaacaacuucuaccauuacaaccaaaccaaugacuccaccauaaaacucaucgcaaugcucuacacuccccuuagagccaacaacgccggagaagacgucuucaccguuucaugccgcguccucacccgaccauccccagacuucgacuuuauauuccucgugcccccaaccgucgaaucuagaaccaaacccuucaccguccccauccucacugucgaagaaaugaccaauucuagauucccaaucccccucgaaaaacuauucaccggaccgucuggcgcauucguaguccaaccccaaaacggccguugcaccaccgacggcguacuccuuggaaccacacagcucucccccgucaacauauguacauuccgcggugacgucacacauaucgcuggcucacgcaacuacaccaugaaccuagccucccucaacuggaacaacuacgaccccaccgaagaaauccccgcaccccucggcacuccggacuuugucggcaaaauacaaggcguccuaacccagaccaccaaaggcgacggcucaacucgaggacacaaggccacagucuacacaggcuccgcccccuucacucccaaacucggauccguccaauucuccaccgacaccgaaaacgacuuugaaacccaccaaaacaccaaauucacccccguagguguaauccaagacggcggcacaacccaccgcaacgaaccucagcaauggguucucccgucauacuccggccgagacguccacaacguccaccuagcccccgcugucgccccuaccuuucccggcgaacagcuccuauucuuucgaucaaccaugccaggcugcuccggcuaccccaacauggaccuagacugccuccucccccaagaauggguacaacauuucuaucaagaagcugccccugcccaauccgacgucgcccuccuacguuucgucaacccugauaccggccgcguccucuucgaaugcaaacuucacaaguccgguuacgucacaguugcucacaccggccagcacgaccucgucaucccacccaauggauacuuucgauucgacuccugggucaaccaauucuacacacuugcccccaugggaaacgggacuggccgucgccgagcccucuaa

SEQ ID NO: 35326 - RNA, 1623 nt, Artificial Sequence
  derived and/or modified sequence opt11 from capsid_protein_VP1__Norovirus__AFX81193
augaaaauggccagcaacgacgccaaccccucagacggauccgccgcaaaccucguccccgaaguauccaacgaaguuauggcccuagaacccguagucggcgccgcuaucgcugcccccguagcaggacaacagaacgucaucgacccauggauccgaaacaacuucguucaagcacccgguggcgaguucacaguauccccacguaacgcacccggcgaaauccuaugguccgcaccccucggccccgaccucaaccccuaccucucccaccuugccagaauguacaacggcuacgcaggcggauucgaaguccaaguaauccuagcagguaacgccuucaccgcuggaaaaauaaucuucgcagccgucccucccaacuuccccaccgaaggacuaucccccucccaagugacuauguucccccacaucaucguagauguccgccaacucgaacccguacucauaccccuacccgacguacgaaacaacuucuaccacuauaaucaaacuaacgacuccaccauaaaacuaauagcaauguuauacacaccccuccgcgccaacaacgccggcgaagacgucuucaccgugucaugucguguccugacccgacccagcccagacuuugacuucaucuuccuugucccacccaccgucgaaucacgcacuaaacccuucaccguacccauccucacaguagaagaaaugaccaacucccgcuuccccaucccccucgaaaaacucuucaccggacccucaggcgccuucgucguccaaccccaaaacggucgcugcaccaccgacggcguccuccucggaaccacacaacucuccccaguaaacauaugcacauuucgaggcgacguaacacacaucgcaggcucccgcaacuacaccaugaaccuagcaucacugaacuggaacaacuaugauccaacugaagaaaucccagcaccccucggaacccccgacuuugucggaaaaauacaaggaguccuuacccaaaccacaaaaggcgauggcucaacacgaggacacaaagcaaccgucuauacaggcagcgcccccuucacacccaaacucggauccguccaauucucaacugacaccgaaaacgacuucgaaacccaccaaaauaccaaauucacccccgucggagucauccaagacggcggcacaacacaccgcaaugaaccacaacaauggguccucccaucauauagcggacgggacguucacaauguccaccucgccccagcugucgcccccacauuuccaggcgaacaacuacucuucuuccgaucaaccaugcccggcugcuccggcuacccaaacauggaccuagacugucuacucccccaagaauggguucaacacuuuuaccaagaagcagccccagcccaauccgacgucgcccuacuacgauucgucaaccccgauacuggccgcguccucuucgaauguaaacuacacaaaucuggcuacguaaccguagcccacaccggacaacacgaccucgucauaccacccaacggauacuuccgcuucgacucauggguuaaccaauucuacacccucgcccccaugggcaacggcacaggacgaagacgagcccucuaa

SEQ ID NO: 35327 - RNA, 1623 nt, Artificial Sequence
  derived and/or modified sequence opt11 from capsid_protein_VP1__Norovirus__AFX81196
augaagauggcuucaaaugacgccaaccccucagauggaucagccgccaacuuaguccccgaagucuccaacgagguaauggcccuagaaccagucgucggcgcagccaucgcagccccagucgcuggccaacaaaacguaaucgacccauggauccgcaacaacuucguccaagccccaggcggagaguucaccgucucuccccgcaacgcccccggcgaaauccucuggucagccccauuaggaccagaccuaaaccccuaccuaagccaccucgcccgcauguacaacggcuacgccggaggcuucgaaguucaagucauccucgccggcaacgccuucaccgccggcaaaauaauauucgcugccgucccacccaacuuccccacagaaggccuaagccccucccaagucaccauguucccccacaucaucgucgauguccgccaacuagaacccguccuuauuccccuccccgacguccgcaacaacuucuaccacuacaaccaaacaaacgacuccaccaucaaacugaucgcaaugcuauacacaccacuccgcgcaaacaacgccggcgaagaugucuuuaccgucuccugccgcguucuaacccgccccucacccgacuuugacuucaucuuccucguaccuccaaccgucgaaucccgaaccaaaccauucacuguccccauacucaccguagaagaaaugaccaacagccgcuuccccaucccccucgaaaagcuguucaccggacccuccggcgccuucgucguccaaccccaaaacggccgaugcaccacugacggcguccuucucggcaccacacaacucucucccguaaacaucugcaccuuccgaggcgacgucacccacauagccggcucccgaaacuacaccaugaacuuagcaucacuaaauuggaauaauuacgaucccacugaagaaaucccagcaccccuagggaccccagacuucgucggcaaaauccaaggaguauuaacccaaaccacaaaaggugacggaucaacccgcggacacaaggcaacugucuacacuggcuccgccccauuuacacccaaacucggcagcguccaauucucaacagacacagaaaacgacuucgaaacccaccaaaauaccaaauucacacccguaggcgucauccaagacggcgguaccacccacagaaacgaaccccaacaauggguacuccccuccuacagcggacgcgacguccacaacguccaccucgcaccagccguagcacccaccuuucccggagaacaacuccucuuuuuccgcuccacaaugcccgggugcucaggcuaccccaacauggaccucgacugccuccucccucaggaauggguccaacauuuuuaucaagaggccgcccccgcccaauccgacguagcacuccuccgcuuuguaaacccugacaccggacgcguccuauucgaaugcaaacuccacaaaucuggcuacguuacaguggcccacaccggccaacacgacuuggucaucccacccaacggcuacuuccgcuucgacuccugggucaaccaguucuacaccuuagcccccaugggcaacgggacaggccgccgacgcgcacuuuaa

SEQ ID NO: 35328 - RNA, 1623 nt, Artificial Sequence
  derived and/or modified sequence opt11 from capsid_protein_VP1__Norovirus__AFX81199
augaaaauggccagcaacgacgcuaacccauccgacggcuccgcggccaaccucguacccgaagucucaaacgaaguaauggcacucgaaccugucguuggcgccgcaaucgccgcccccguggccggucaacaaaacgucaucgacccauggauccggaacaacuucguucaagcccccggcggcgaguucaccgucuccccacgcaacgccccaggcgaaauccugugguccgcuccccuuggccccgaucucaacccauaccucucgcaccucgcccgcauguacaacggauacgcaggcggcuucgaaguccaaguuauccucgcuggcaacgcauucacagccgguaaaaucauauuugccgcagucccuccaaacuuccccaccgaaggacuuuccccaucccaagucaccauguucccacacaucaucguagacguccgacaacucgaacccguccuaauaccccuccccgacguacgcaacaauuucuaccacuacaaccaaaccaacgauuccaccaucaaacuaauugccaugcucuauacccccuuaagagccaacaacgcaggcgaagacgucuucacugucucaugccgcguccuaacacggcccagcccagacuucgacuucauauuccucgucccuccaaccguagaaucacgaaccaaaccauucaccgucccaauccucaccguagaagaaaugaccaacucacgcuucccuaucccacucgaaaagcuauucaccggcccaucaggcgcauucgugguccaaccccaaaacggccgcugcacaaccgacggaguccuacucggcacuacccaacuaucaccugucaacaucuguaccuuucgaggagacguaacccacauagccggcucccgagacuacacaaugaaucuugccucacugaacuggaacaacuacgaccccaccgaggaaauccccgcuccccucggcacaccagacuucgucggcaaaauacaaggcguccuaacccaaacgaccaaaggugauggauccacacgcggccacaaagccacagucuauaccggaagcgccccuuucacaccuaaacucggaucaguccaauuuuccaccgacacagaaaacgacuucgaaacccaccaaaacaccaaauucacacccgucggagucauacaagauggcggaaccacccaccgcaacgaaccacaacaauggguccuccccuccuacucaggacgagacguccacaacguccaccucgccccggcagucgcacccaccuuccccggagaacagcuacuauucuuccgcucaacaaugccaggcugcuccggcuacccaaacauggaccucgacugccuccuuccacaggaauggguccaacacuucuaccaagaagcagccccugcccaauccgacgucgcccuccuacgauucgucaaccccgacaccggucgaguccucuucgaaugcaaacuucacaaaucaggcuacgucaccgucgcacacacaggccaacacgaccuaguaaucccacccaacggcuacuuccgauucgacucauggguaaaccaauucuacacccuugccccuauggguaacggcaccggacgcagacgcgcccuauaa

SEQ ID NO: 35329 - RNA, 1623 nt, Artificial Sequence
  derived and/or modified sequence opt11 from capsid_protein_VP1__Norovirus__AFX81202
augaaaauggcuagcaaugacgccaauccaagcgacggcuccgccgcaaaccuaguacccgaagucuccaaugaagucauggcccucgaacccgucguaggagccgccaucgcagcccccguagcaggacaacaaaacgucaucgacccauggauccgaaacaacuuuguccaagccccaggcggcgaauuuaccguaucuccccgcaacgccccaggcgaaauccuaugguccgcaccccugggacccgaccucaacccauaccuaagccaccucgcccgcauguacaacggcuaugcuggcggcuucgaaguccaaguaauacucgccggaaacgcuuucacagcagguaaaaucaucuucgcagcagucccacccaacuuccccacagaaggacucucacccucccaagucaccauguucccccacaucaucguagacguccgccaacucgaaccuguauuaaucccccuccccgacguucgcaacaacuucuaccacuacaaccaaacaaacgacucaacgauaaagcucaucgcuaugcucuacacuccccuucgcgccaacaacgccggcgaagacgucuucaccgucuccugccgcguccucacccgcccuucacccgacuucgacuucaucuuccuugucccacccaccguagaaucacguaccaaaccauucaccguacccauacucaccgucgaagaaaugacaaacucccgauucccaaucccccucgaaaaacuauucaccgguccuuccggcgccuucgucgugcaaccccagaacggccgaugcaccaccgacggaguacuacuaggcaccacucaacucucccccguuaacauuugcaccuuccgcggcgacgucacacacaucgccggcucccgcaacuauaccaugaaccuagccucccucaacuggaauaacuacgaccccaccgaagaaauccccgcaccccuaggaacccccgacuucguaggcaaaauccaagguguacuaacccaaaccacgaaaggugacggcagcacacgaggacacaaagccaccguauauaccggauccgcacccuucaccccuaaacuaggcuccguccaauucagcacagacacagaaaacgacuucgaaacccaccaaaacaccaaauucacacccgucggcguaauacaagacggcggaaccacacaccgcaacgaaccccagcaaugggugcuccccucauacucaggacgcgacguccacaacguucaccuagcccccgccgucgcuccaacauuccccggcgaacaacuacucuucuuccgaucaaccaugccagguuguuccgguuaccccaacauggaccucgacugccuauuaccacaagaauggguccaacacuuuuaccaagaagcagccccugcccaauccgacgucgcccuccuucgcuucguaaacccagacacuggccgagucuuauucgaaugcaaacuccacaaauccgguuacgucacagucgcccacaccggccagcacgaccucguuauucccccaaacggcuacuucagauucgacuccuggguaaaccaauucuacacacuagcccccaugggcaacggcaccggccgccgccgcgcccuguaa

SEQ ID NO: 35330 - RNA, 1623 nt, Artificial Sequence
  derived and/or modified sequence opt11 from capsid_protein_VP1__Norovirus__AFX81205
augaagauggccucaaacgacgcaaaccccucagacggcucagccgcaaaccucguaccagaagucucaaacgaagucauggcccuagaacccgucgucggcgccgccauagccgccccaguggccggacaacaaaacguaaucgacccauggauccgaaacaacuuuguacaagcccccggcggcgaguucaccguauccccacgcaacgcacccggcgaaauacucuggucagccccacucggcccagaccuaaacccauaucuaucccaccucgcccgcauguauaacggcuacgccggcggcuucgaaguccaagugauccuagcuggcaacgccuucacagcaggcaaaaucaucuucgccgccgucccacccaacuuccccacagaaggacucucacccucacaggucacaauguuuccccauauaaucgucgacguccgucagcuagaaccaguccuaaucccgcuccccgacguacgcaacaacuucuaucacuacaaccaaaccaacgacuccacuaucaaguuaaucgcuaugcucuacacaccccuacgagccaacaacgccggcgaagacgucuucaccguauccugcagaguucucaccagacccucccccgacuucgauuucauauuccucguaccaccaaccgucgaaucacgaaccaagccauucacaguccccauccuaaccgucgaagaaaugacaaacucacgcuucccaauuccacucgaaaaacuauuuaccggaccaucaggcgccuucgucguucaaccacaaaacggccgcugcaccaccgacggcguacuacucggcaccacacaacucaguccggucaacauaugcaccuuccgcggcgacgucacccacauagcaggaucccgcaacuacacaaugaacuuagcaucauuaaauuggaacaacuacgacccaaccgaagaaauccccgccccgcuggguacccccgacuuugucggcaaaauccaaggaguccuuacacaaacaacaaaaggcgacggcuccacaagaggucacaaagccaccgucuacacuggcuccgccccauucaccccuaaacuaggcucaguccaauucucaaccgacaccgaaaacgacuucgaaacucaccaaaacaccaaauucaccccaguaggagucauacaagacggcggcaccacccaccgcaacgaaccccagcaaugggcccuccccucauacucgggacgagacguacacaacguccaccucgcccccgcagucgcccccacauuccccggcgaacaacuacuuuucuuccguuccacaaugcccggcugcuccggcuaccccaacauggaccuagacugccuccucccccaagaauggguucaacacuucuaccaagaggccgcacccgcccaaucagacgucgcccuccuccgcuucgucaacccagacaccggacgcguacucuucgaaugcaaacuccacaaauccggcuacgucacuguagcccacacaggccaacaugaccuagugaucccacccaacgguuacuuccgauucgacagcugggucaaucaguucuacacucucgcacccaugggcaacggcaccggcagaagacgagcucuauaa

SEQ ID NO: 35331 - RNA, 1623 nt, Artificial Sequence
  derived and/or modified sequence opt11 from capsid_protein_VP1__Norovirus__AFX81208
augaaaauggccuccaacgacgcaaaccccucggacgguuccgcagccaaccuaguacccgaagucucaaacgaaguaauggcucucgaacccgucgucggugcugccauugccgcccccgucgccggccaacaaaacgucauagaccccuggauccgaaacaacuucguacaagccccugguggcgaauuuaccguauccccacgcaacgcucccggagagauccucugguccgcaccccucggccccgaccucaaccccuaucuaucccaccuugcccgcauguacaacggcuacgcgggcggcuucgaaguccaaguaauccucgcgggcaacgccuuuaccgccggcaaaauaaucuucgcagcggucccacccaacuuccccaccgagggccucagccccucccaagucacuauguucccacacaucaucguagacguccgacaacucgaaccuguccuaauaccccuccccgacguucgcaacaacuucuaccauuacaaccaaaccaacgauuccaccauaaaacucaucgccaugcucuacacaccccucagagccaauaacgcaggagaagacguauuuaccgucuccugucguguccuaacccgccccucccccgacuucgacuucaucuuccuaguaccacccaccguagaaucgcgaaccaaacccuucaccguacccauccucaccgucgaagaaaugaccaacucccgauuccccaucccucucgaaaaacucuucaccggacccagcggcgccuucgucguccaaccccaaaacggccgcugcaccacugacggagugcuccuuggaaccacacaacucuccccaguaaacaucugcacauuccgcggcgacgucacacauaucgccggcucacgcaacuacaccaugaaccucgcaucccucaacuggaacaauuacgaccccaccgaagaaauccccgcuccccucggcacccccgacuucgucgguaaaauacagggcguccucacacaaaccacuaaaggcgacggaucaacucgcggccacaaagccaccgucuacaccggauccgccccuuucacccccaaauuaggcagcguccaauucuccaccgacaccgaaaacgacuucgaaacccaccaaaacacaaaauucacaccagucggcguaauacaagacggaggcaccacacaccggaacgaaccccaacaauggguacuucccucauacuccggacgggacguccauaacguccaccucgcucccgccgucgcccccacauucccaggugaacaacuucuuuucuuccgcucaaccaugccagguugcuccggcuaccccaacauggaucuugacugccuccuaccucaagaauggguccaacauuucuaccaagaagcagccccugcccaaagcgaugucgcccuucuccgauucgucaaccccgacacuggccgcguccuuuucgaaugcaaauuacacaaaucaggcuaugucaccgucgcacauaccggacaacaugacuuaguaauuccacccaacggcuacuuccgcuucgauucauggguaaaccaauucuacacucucgcccccaugggcaacggcacaggcagaagacgcgcccucuaa

SEQ ID NO: 35332 - RNA, 1623 nt, Artificial Sequence
  derived and/or modified sequence opt11 from capsid_protein_VP1__Norovirus__AFX81211
augaaaauggccagcaacgacgcuaaccccucugacggauccgccgccaaccuaguacccgaagucuccaacgaaguaauggcgcucgaacccgugguaggggccgcaaucgccgcucccguagccggccaacaaaacgucaucgaccccuggauccgcaacaacuucguccaagccccaggcggcgaguucaccgucagcccccgcaaugcccccggcgaaauacucugguccgccccgcucggcccagaccucaaucccuaccuaagccaccucgcccgaauguacaacggcuacgcaggcggcuucgaaguacaagucauccucgccggaaaugcauuuaccgccggcaaaaucaucuucgccgcagucccuccaaauuuccccacagaaggccucucaccuucgcaagucaccauguucccccacauaaucgucgacguccgacaauuagaaccuguacuuaucccccucccagacguacgaaauaacuucuaccacuauaaccaaaccaacgauuccaccaucaaacuaaucgcaaugcuauacacaccccuccgcgccaacaacgccggagaagacgucuucaccgucuccugccggguccucacccgccccuccccagauuucgacuucaucuuccugguacccccaaccgucgaaucccgcacaaaacccuucaccguacccauccucaccgucgaagaaaugacuaacucacgcuuccccaucccgcucgaaaaacuuuucaccggacccucuggcgccuucguaguacagccccagaacggcagaugcaccacagacggcgucuuacuaggcaccacccaacucucccccgucaacauaugcaccuuucgcggcgacgucacccacaucgccggcucucgaaacuacacaaugaaccuugccucccucaacuggaacaacuacgacccaaccgaagaaauccccgccccacuuggaaccccugacuucguuggaaaaauacaaggaguccuaacccagacaaccaaaggcgacggcuccacccgaggacacaaagccaccgucuauaccggcuccgcaccauucaccccaaaacuagguuccguccaauucucaaccgacacagaaaacgacuucgaaacacaccaaaacaccaaauucacacccgucggcguuauccaagacggcggcaccacacaccgcaacgaaccacaacaaugggucuuaccaagcuacuccggccgcgacguccacaacguccaccucgcaccagccguugccccaaccuuccccggcgaacaacuccuauucuuccguuccaccaugccuggaugcuccggcuauccaaauauggaccuagacugccuccucccccaggaaugggugcaacacuucuaccaagaagccgcacccgcccaaucugacgucgcacuccuccguuucgucaaccccgacaccggccgaguucucuucgaaugcaaacuccacaaauccggcuacgucaccgucgcgcacaccggccaacacgaucuaguaaucccucccaacgguuacuuccgauucgacuccuggguaaaccaauucuacacucucgcccccaugggcaacgguacuggucgccgccgcgcccucuaa

SEQ ID NO: 35333 - RNA, 1623 nt, Artificial Sequence
  derived and/or modified sequence opt11 from capsid_protein_VP1__Norovirus__AFX81214
augaagauggccuccaacgacgcaaacccaucagauggcuccgccgcuaaccucgucccagaagucucuaacgaagucauggcccuagaacccguagucggcgccgcaaucgcggcucccgucgccggccaacaaaacgucaucgaucccuggauccgaaacaacuucguccaagcacccgguggagaguucaccguaucuccccgaaaugccccuggagaaauccuaugguccgcaccccucggccccgaccuaaaucccuaccuaagucaccuagcacgcauguacaacggcuaugcaggagguuucgaaguccaaguuauccuagccggaaacgccuuuaccgccggcaaaauaaucuucgccgccguaccacccaacuuucccacagaaggucuaucccccucccaagucaccauguucccacacaucaucgucgacguccgccaacucgaacccguacuuaucccccuucccgacguccgcaacaacuucuaccacuacaaccaaaccaaugacucgacaaucaaacucaucgcaaugcuuuacacaccccuccgagccaacaacgccggugaagacgucuucaccgucucuugucgaguccuaacccgaccuucccccgacuucgacuucauauuccuagucccucccaccgucgaaucccgaacuaaacccuucaccguacccauccucaccguagaagaaaugacuaacagccgcuucccaauaccauuagaaaaacucuucacagggcccuccggcgccuucgucguccagccacaaaacggacgaugcaccaccgacggcguccuacucggcaccacccagcuaucgccugucaacaucugcacauuccgcggcgacgugacccacauagcaggcuccagaaacuacaccaugaaccuugccucacugaauuggaacaacuacgaccccacagaagaaauccccgcuccccucggcaccccagacuucguaggcaaaauccaaggcguccucacacaaaccaccaaaggcgacgggucaacccguggccacaaagccaccgucuacacaggauccgcaccauucaccccaaaacuaggcuccguccaauucuccaccgacacugagaacgacuucgaaacccaccaaaacaccaaauucacacccgucggcgucauccaagacggcggcacaacccaccgcaaugaaccccaacaauggguccuccccucauacuccggacgcgacguccacaacguccaccuagcucccgcuguggcccccacauuuccaggcgaacagcuccuauucuuccgcucuaccaugccaggaugcucaggcuaccccaacauggaucuugacugucuucucccccaagaauggguccaacacuucuaccaagaggcagcccccgcccaaucagacgucgcccuacuacgcuucgucaaccccgacacaggccguguacucuucgaaugcaaacuccacaaaucaggcuacgucaccgucgcccacacaggacaacacgaccucguuaucccacccaacggauacuucagauuugacucaugggucaaccaauucuacacccucgcgcccaugggaaacggcacuggccgccgccgcgcccucuaa

SEQ ID NO: 35334 - RNA, 1623 nt, Artificial Sequence
  derived and/or modified sequence opt11 from capsid_protein_VP1__Norovirus__AFX81226
augaaaauggccuccaacgacgcuaaccccuccgacggcuccgccgccaaccuaguccccgaggucuccaacgaaguaauggcccuggagcccgucgucggcgccgccaucgcugcucccgucgccggccaacaaaaugucauagacccuuggauacgaaacaauuucguccaagcccccggcggcgaguucaccguaagcccccgaaacgcaccaggagaaauacucuggucugccccucucggacccgacuuaaaucccuaccucucacaccucgcacgaauguacaacggcuacgccggcgguuuugaaguccaagucauccucgcaggcaacgccuucaccgccggcaaaauaaucuucgcagcuguaccacccaacuuccccaccgaaggccucagccccucacaggucaccauguucccccacauaaucgucgauguuagacaacucgaaccaguacucauaccccuacccgacguccgcaacaacuucuaccacuacaaccaaaccaacgacuccacaaucaagcugauugccaugcucuacaccccucuccgcgccaacaacgcaggcgaagacgucuucacaguuuccugccgaguucucacucgccccucacccgacuucgacuucaucuuccuugugccucccaccguugaaucccgaacuaaacccuucaccguacccauacucacaguagaagaaaugaccaacucccgguucccaaucccccuugaaaaacucuucacaggccccagcggcgcauucguaguacaaccacaaaacggccguuguaccaccgacgguguacucuuaggaaccacacaacucucaccagucaauauaugcaccuuccgaggcgacgucacucacauagcuggcucccgcaacuacaccaugaaccucgccucccuaaacuggaacaacuacgaccccacagaagaaauacccgccccucuuggcacccccgacuucgucggaaaaauccaaggcguccuuacucaaaccacaaaaggcgacggcuccaccaggggccacaaagcgaccgucuauaccggaucagcacccuucacucccaaacuuggcucaguccaauucucaaccgacacagaaaacgacuuugaaacccaccaaaacacaaaauucacccccgucggcguaauccaagacgguggaacaacccaccgcaacgaaccacaacaguggguccuccccuccuacucaggccgcgacguccauaacguucaccuagcccccgcuguagcgccaaccuuccccggcgaacaacuacuuuucuuccgcuccaccaugcccggcugcuccggauacccaaauauggaccucgacugccuccucccacaagaauggguccaacacuucuaccaagaagccgcccccgcccaauccgacgucgcccuccuucgcuucguaaaccccgacacaggacgcguccucuucgaauguaaacuccacaaaucuggauacgucacaguagcccacacgggccaacaugacuuaguaaucccuccaaacggcuacuuccgauucgacucaugggucaaccaauuuuacacccuggcacccauggguaacggaacaggccgccgccgagcacucuaa

SEQ ID NO: 35335 - RNA, 1623 nt, Artificial Sequence
  derived and/or modified sequence opt11 from capsid_protein_VP1__Norovirus__AFX81229
augaaaauggccuccaacgacgcaaaccccucagacggcuccgccgccaaccuaguacccgaagucuccaacgaagucauggcccuagaaccagucgucggagcugcaaucgccgcacccguagccggccaacaaaacgucaucgacccauggauccgaaauaacuucguacaagcccccggcggcgaguucaccgucucaccccgcaaugcccccggcgaaauccuaugguccgcaccacucggcccagaccucaaccccuaccuaucccaccucgcacguauguacaacggcuacgccggcggcuucgaaguacaaguaauacucgcuggaaacgccuucaccgccggaaaaaucaucuucgccgcaguacccccaaacuucccaaccgaaggccucucccccucacaagucacaauguucccacacauaaucgucgacguccgccaacucgaaccagugcuuaucccccuccccgacguccgcaacaacuuuuaccacuacaaccaaaccaacgacuccaccauaaagcucaucgccaugcucuacacuccccuccgcgcaaacaacgcaggcgaagacguguucaccgucagcugccgcguacucacccgccccagcccagacuucgacuucauauuccucguaccaccuaccguagaaucucguaccaaaccauucaccguuccaauccucaccgucgaagaaaugacaaacucccgcuuucccaucccgcuagaaaaacucuucaccgggcccucuggagcauucgucguacaaccccaaaacggccgaugcacaaccgacggcgugcuacuaggaaccacacaacuaucaccaguaaacaucugcacauuccgcggugacgucacccauaucgcaggcucccgcaacuacaccaugucacucgccucccucaacuggaacaacuacgacccuaccgaagaaauacccgccccacucggcacgcccgacuucgucggaaaaauccaaggaguccucacacaaacuaccaaaggcgacggcucaacccgcggccacaaagccaccgucuacaccggcuccgccccauucacacccaaacucggcuccguccaauucagcaccgacaccgaaaacgacuucgaaacccaccaaaauaccaaauucaccccagucggcgucauccaagacggcggcacaacccacagaaaugaaccccaacaauggguccugcccuccuacucuggccgcgacguucacaauguccaccuagcaccagccgucgcuccuaccuuucccggcgaacaacuacuauucuuccgcuccaccaugcccggaugcucuggauaccccaacauggaccuugacugccuccucccccaagaauggguccaacacuucuaccaagaagcagcccccgcccaaagcgacgucgcucuccuaagauucgucaacccggacaccggacgcguacucuucgaaugcaaacuccacaaauccggcuacguaacugucgcccauaccggacaacacgaccuaguaaucccacccaacggauacuuccgcuucgacucauggguaaaccaguucuacacacuugcccccaugggcaacggcacaggccgucgacgcgcccuauaa

SEQ ID NO: 35336 - RNA, 1623 nt, Artificial Sequence
  derived and/or modified sequence opt11 from capsid_protein_VP1__Norovirus__AFX81232
augaaaauggccucaaacgacgccaacccaucagacggauccgcagcaaaccuuguccccgaaguuuccaacgaaguaauggcacuagaacccguagucggcgcagccaucgccgcccccgucgccggacagcaaaacguaaucgaccccuggauccgcaauaacuucguacaagccccagguggggaauuuaccguaucuccccgcaacgccccaggcgaaauccuauggucagcaccccuaggacccgaccucaaccccuaccucucacaccucgcccgaauguacaacggauacgccggcggcuucgagguacagguuauacucgccggaaacgccuucaccgcuggaaaaauaaucuucgcugccgucccaccaaacuuccccaccgagggccucucccccucccaagucacuauguucccccacauaauaguagauguacgccaacuagagcccguucucaucccccuacccgacguccgcaacaacuucuaccacuacaaccaaaccaacgacucaaccaucaaacuaaucgcaaugcuguacacaccccuacgagccaacaacgccggagaagacguauucaccgucucaugccgcguccuaacccgcccuuccccugacuucgacuucaucuuccucgucccaccaaccguagaaucccgcaccaaacccuucaccguccccauacucaccgucgaagaaaugaccaacucccgcuuccccaucccacuggaaaaacucuucaccggccccuccggugccuucgucguacaaccacaaaacggucgcugcaccacagacggcguacuccuugguaccacccaacucagccccgucaacauaugcacauucagaggugacgucacccacaucgcagggucucgaaacuacacuaugaaccuggcaucccucaacuggaacaacuaugaccccaccgaagaaauccccgccccucuaggcacacccgacuucguaggcaaaauacaaggcguacucacccaaaccaccaaaggcgacggauccacccgcggccacaaagccaccgucuacaccggcagcgcccccuucaccccaaaacuaggcucaguccaauucucaaccgacacagagaacgauuucgaaacccaccaaaacacaaaauucaccccaguaggcgucauccaagacggaggcacuacccaccgcaacgaaccccaacaauggguccuaccauccuacaguggccgcgacguacacaacguacaccuugccccagcagucgcccccaccuuccccggcgaacaacuacuauucuuccgcagcacaaugcccggaugcucaggcuaccccaacauggaccuggacugccuacuaccacaagaauggguccaacauuucuaccaagaagccgccccagcucaauccgaugucgcccuccuccgcuucgucaaccccgacaccggucggguccucuuugaaugcaaacuacacaaauccggcuacguaaccgucgcccacaccggccaacacgaccucguaaucccacccaacggcuauuuccgauucgacuccugggucaaccaauucuauacacuagcccccaugggcaacggaaccggccguagacgcgcacuuuaa

SEQ ID NO: 35337 - RNA, 1623 nt, Artificial Sequence
  derived and/or modified sequence opt11 from capsid_protein_VP1__Norovirus__AFX81238
augaaaauggcauccaacgacgccaacccaucagacggauccgccgccaaccuuguacccgaagucucaaaugaaguaauggcacucgaaccagucgucggcgccgcaaucgcagcccccgucgcgggccaacaaaaugucaucgaccccuggauacgcaacaacuucguccaagcccccggcggcgaguucacaguauccccacgcaaugccccaggcgaaauccuauggucagccccacuaggccccgaccucaacccuuaccucucacaucucgccagaauguauaacggcuacgccggcggauucgaaguccaagucauccucgcgggcaacgcuuucaccgccggcaaaauaaucuucgcagccguuccaccaaacuucccaaccgaaggucuaagccccucccaaguaaccauguucccacacaucauaguagacguucgccaacucgaaccaguacucauuccccuaccagacguccgaaacaacuucuaccacuacaaccagaccaacgacuccacaaucaaacuaaucgcuaugcucuauacaccacuccgcgccaacaacgccggggaagaugucuucaccguuuccugucgaguacuuacacgccccucaccagacuucgacuucauauuccucguaccgcccacagucgaaagccgcaccaagcccuucacaguucccauucuuaccgucgaagaaaugaccaacucccguuuuccaaucccacuugaaaaacucuucacaggccccuccggugcauucguaguacagccccaaaacggccgcugcaccacagacggcguccucuuaggcaccacccaacuauccccggucaacauaugcacauuccgcggggacguaacacacauugcaggcucgcgcaacuauacaaugaaccucgcaucccuaaauuggaacaacuacgaccccaccgaagaaauccccgcaccccucggcacaccagacuucgucggcaaaauccaaggaguacugacccaaaccaccaaaggcgacggaagcacccgcggccacaaagccaccguuuauaccggaucagcccccuucacaccaaaacuaggcucuguccaauucuccaccgacaccgaaaacgacuucgaaacacaccaaaacaccaaauucaccccagucggagucauacaagacggcggaaccacccaccgcaaugaaccacaacaauggguccucccaucguacucaggacgagacguccacaacguccaccuagcccccgccguagccccaacauucccaggagaacaacuacucuucuuccgcuccaccaugcccggcugcucaggcuaccccaauauggaccucgauugccuccucccccaagaguggguccaacauuucuaccaggaagccgcacccgcccaauccgacgucgccuuacuccgcuucgucaacccagacacaggccgcguacuauucgaaugcaaacuacacaaauccggcuacguaaccgucgcccacacaggccaacacgaccuugucauacccccaaacggcuacuucagauucgacucuuggguaaaccaauucuacacacucgcccccaugggcaacggcacuggacgccgccgcgcccuuuaa

SEQ ID NO: 35338 - RNA, 1623 nt, Artificial Sequence
  derived and/or modified sequence opt11 from capsid_protein_VP1__Norovirus__AFX81241
augaagauggccaguuccgacgcaaaccccagcgacggcucuacugcgaaccucguccccgaaguuaacaacgaaguuauggcccucgaacccguugucggagccgccaucgcagcccccgucgccggccaacaaaacguuauagaccccuggauccgaaacaacuucguccaagcccccggaggcgaguucaccgucucccccagaaacgcacccggcgaaauccuauggucagcaccccucggacccgaccucaaccccuaucuaucccaccucgcccgaauguacaacggauacgccggcggauuugaaguccagguuauccuagccggaaacgccuucaccgcaggcaaaauaaucuucgcggcugucccacccaacuuccccaccgaaggccucucccccucccaagucaccauguucccccacaucaucguagacguccgccaacucgaacccguccuaaucccucuccccgacguucgaaacaacuucuaccacuacaaccaaucaaacgaccccaccauaaaacugaucgccaugcuauacacuccgcugcgggccaacaacgccggcgacgacguuuuuaccgucuccugccgaguacucacccgucccucccccgacuucgacuucaucuuccucguaccaccaaccguagaaucccgcaccaaacccuucagcguaccuguacuaaccguugaggaaaugacuaacucccgauuccccaucccccuugaaaaacucuucaccggucccucuucagccuucgucguccagccacagaacggcagaugcaccaccgacggcguucuacucggcacgacucaacuuucacccguaaacaucuguacauuccgaggagacgucacucacaucuccgguucccgaaacuacaccaugaaccucgccucccaaaacuggaacagcuacgauccaacagaagaaauccccgcaccacucggcacccccgacuucgucggcaaaauccaaggcguccucacacaaaccacccgcaccaacggcuccacccgcggucacaaagcaacagucuacacaggaucagccgacuucucaccaaaacuaggccgcgugcaauucgcaacggacaccgacaacgacuucgaaaccaaccaaaauaccaaauucaccccugucggcguaauccaagacggcucaaccacccccagaaacgaaccccaacaauggguccuuccuagcuacucuggucgcaauauacacaacguccaccucgcacccgccguggcccccacauuuccaggagaacaacuacucuucuuccgcuccaccaugccaggcugcuccgguuauccaaacauggaucuugauugccuacucccacaagaauggguccaauacuucuaccaagaagccgcaccagcccaauccgauguagcccuucuaagauucgucaacccagacaccggccgaguucucuucgaaugcaaacuucacaaauccggauacgugacagucgcccacacaggccaacacgaccuagucaucccucccaacggcuacuuccgcuucgacuccugggucaaccaguucuacacacucgcccccaugggcaacggcacuggccgcagacgagcccuauaa

SEQ ID NO: 35339 - RNA, 1623 nt, Artificial Sequence
  derived and/or modified sequence opt11 from capsid_protein_VP1__Norovirus__AFX81247
augaaaauggccuccuccgacgccaaccccuccgacggcuccaccgccaaccuaguacccgaaguuaacaaugaagucauggcacucgaacccgucgucggcgccgcaauagcagcucccgucgccgggcaacaaaaugucaucgacccuuggauccgcaacaauuucguccaggccccaggcggcgaguucaccguauccccacgcaacgcccccggugaaauccuauggagcgccccacuaggccccgaucuaaacccuuaccucucccaccucgccagaauguacaauggcuacgccggcggcuucgaaguccaagucauccucgcaggaaacgccuucaccgccggcaaaaucaucuucgccgcaguacccccuaacuucccaaccgaaggacuaucaccuucacaagucacaauguucccccacaucaucgucgaugucagacaacucgaaccaguccucaucccucucccagacguacgaaauaacuucuaccacuacaaccaaucaaacgacccaacaauaaaacucauagccaugcuuuacaccccucuccgugccaacaacgccggggacgacgucuucaccgucuccugccgcguccucacccgacccucaccagacuucgacuucaucuuccuggucccuccaaccguagaaucccgcaccaaacccuucucaguucccguccucacuguugaagaaaugaccaacucccgauuccccauaccccucgaaaaacucuuuacaggcccaagcuccgccuucguaguccaaccacaaaacggucgcugcacuacugacggcguccuacuaggcacgacccaacuaucccccgucaacaucugcaccuuccgcggugacguaacccacauaccaggaucccgcaacuacaccaugaaccucgccucccagaacugggauucauacgaccccacagaagaaaccccagcaccacuagguacacccgacuucgucggcaaaauccaaggcguccucacacaaacuacccgaaccaacggcagcacacgcgggcacaaagccaccgucuacacaggaucagcagacuucucacccaaacuaggccgcguacaauucgccaccgacaccgacaacgacuucgaaacuaaccaaaacaccaaauucacacccgucggagucauccaagacggcuccacuacaccccgcaacgaaccccaacaauggguccuuccuucauacucaggccguaacauccacaacgugcaccuagccccagcagucgcacccacuuuucccggugaacaacuccuauuuuucagauccaccaugcccggaugcuccggcuaccccaacauggaccucgacugccuucucccccaagaauggguccaauacuucuaccaggaggcagcccccgcccaauccgacguagcccuacuccgauucgucaacccagacacaggacgcguccuauucgaaugcaaacugcacaaaucaggauacguaaccguagcacacacaggccaacacgaccucgucauaccacccaacggcuacuuccguuucgacuccugggucaaccaauucuacacucuagcucccaugggcaacggaaccggacgacgccgagcccucuag

SEQ ID NO: 35340 - RNA, 1623 nt, Artificial Sequence
  derived and/or modified sequence opt11 from capsid_protein_VP1__Norovirus__AFX81250
augaagauggccagcucagaugccaaucccuccaacggcuccaccgccaaccuuguccccgaagucaacaacgaaguuauggcccuagagccaguagucggcgcagcaaucgccgcacccguagccggccaacaaaauguuaucgacccuuggaucagaaacaacuucguucaagcccccggcggagaguucacuguaucaccccgcaaugcccccggagaaauccucugguccgcaccacucggaccagacuuaaaccccuaucuuucccaccucgcccgcauguacaacggcuacgccggaggauucgaaguccaagucauccucgccggcaacgccuucacagccggcaaaaucaucuucgcagccguuccucccaacuuccccaccgaaggccucagccccagccaaguuaccauguucccccacaucauagucgacguccgccaacuagaaccaguacucaucccccuccccgacgucagaaacaacuucuaccacuacaaccaauccaaugaccccaccauaaaacucaucgcaaugcuauacacaccacuccgcgcuaacaacgcaggcgacgacgucuuuacagucuccugccgcguccucacccgaccuuccccagacuucgacuucaucuuccucgucccacccaccgucgaaucacguaccaaaccauucuccguccccgugcuaacagucgaagaaaugaccaacucccguuucccaauuccucucgaaaagcuauucacuggacccucauccgccuucguaguacaaccacaaaauggccgcugcaccacagacggcguccuccuaggcacaacccaacucucccccguaaacauauguaccuuucggggugacgucacucacauuccaucuucccacaauuauaccaugaaccucgccucacaaaacuggaacucauacgacccaaccgaagaaauccccgccccucucgguacaccugacuucgucggcaaaauacaaggcguacucacacaaaccacccgaaccgacggcagcacacguggccacaaagcaaccguuuacaccggcucggccgacuucucgccuaaacuaggccguguccaauucgccaccgacacugacaacgacuuccaaacaaaccaaaacacaaaauucacccccguuggugucauacaagacggcuccaccacaccccgaaacgaaccacaacaauggguccuccccucauacucugggcgcaacauccauaacguacaccuugcccccgccgucgccccaaccuuccccggcgaacaauuacucuucuuccgcucaaccaugcccggcugcuccggcuacccaaacauggaccuagacugucugcucccccaagaauggguccaauacuucuaccaagaagccgcuccagcccaaagcgacguugcucuccucagauucguuaaccccgacaccggacgcguacucuucgaaugcaaacuccacaaauccggauacgucaccgucgcacacaccggccaacacgaucucgucauaccucccaacggauacuuccgauucgacuccugggucaaccaguucuacacccuugcccccaugggcaacggcaccggacgacgacgcgcccucuaa

SEQ ID NO: 35341 - RNA, 1623 nt, Artificial Sequence
  derived and/or modified sequence opt11 from capsid_protein_VP1__Norovirus__AFX81253
augaaaauggcauccuccgacgccaaucccuccgacggcuccaccgccaaccucguccccgaaguaaacaacgaagucauggccuuagaacccgucgucggcgccgcaauagccgcuccaguagccggacaacagaacgucaucgaccccuggauccgaaacaacuucguacaggcccccggcggagaguucaccgucagcccccgcaacgccccaggcgaaauccuuugguccgccccacucggccccgaccucaacccauaccucucccaucucgcccgaauguacaacggauacgccggcggcuucgaaguccaagucauacucgcaggaaaugccuuuaccgccggcaaaaucaucuucgccgccguacccccaaacuucccuacagaaggacucucuccaucacaagucaccauguucccccacauaaucgucgacguccgccaacuagaaccaguccucaucccccuacccgacguccgaaacaacuucuaccacuauaaccaaagcaacgaccccaccaucaaacucaucgccauguuguauacaccucuacgggcaaacaacgccggcgacgacgucuucacugucuccugcagaguccuaacccgacccucccccgacuuugacuucaucuuucuaguacccccaacagucgaaucccgcacuaaacccuucucagucccuguccucacagucgaagaaaugaccaacucccgauuccccaucccccucgaaaaacucuucacuggccccucaucagccuucgucguacaaccccaaaacggccgcugcaccaccgacggcguccuccuaggcacaacacaacuaagucccgucaacaucugcaccuucagaggagacguuacccacaucucuggcucccgaaacuacacaaugaaucucgcaucucaaaacuggaacuccuacgaccccaccgaagaaauuccagcaccacucggcacccccgacuucgucggcaaaauccaaggcguccugacccaaaccacccgcacuaacggaucgaccagaggucacaaagcaaccguauacaccgguuccgccgacuucuccccuaaacucggccgcguccaauucgccaccgacacagacaacgacuucgaaacaaaucaaaacacgaaauucacaccagucggcguuauccaagacggauccacaacaccacgaaacgaaccccaacaauggguccuccccucauacuccggacgcaacauacacaacguccaccucgcccccgccgucgcacccaccuuccccggagaacagcuacucuucuuccgcuccacaaugcccggaugcagcggguaccccaacauggaucuagauugccuccuaccccaagaauggguacaauacuucuaccaagaagcagcccccgcccaauccgacgucgcacuacucagauucguaaaucccgacaccggacgcguccuguucgaaugcaaacuccacaaguccggcuacgucacaguugcacacacuggacaacacgaucuaguaaucccucccaacggauauuuccgcuucgacucuugggucaaucaauucuacacacucgcucccaugggcaacggcaccggacgccgccgagcccucuaa

SEQ ID NO: 35342 - RNA, 1623 nt, Artificial Sequence
  derived and/or modified sequence opt11 from capsid_protein_VP1__Norovirus__AFX81256
augaaaauggcuucauccgacgccaaccccucagacgguuccacagcaaaccuaguccccgaggucaacaacgagguuauggcccucgaacccgucguaggugcagccaucgccgcccccgucgcaggccaacaaaacguuaucgaccccuggaucagaaacaacuucguacaggcaccuggcggcgaguucacugucucaccccguaacgccccaggcgaaauccucugguccgcaccccucggccccgaccucaaccccuaccucagccaccucgcccgaauguacaacgguuacgccggcggauucgagguccaagucauucucgccgguaacgccuuuacggccggcaaaaucaucuucgcagccguaccacccaacuuccccacugaaggccuaucaccaucccaagucacgauguucccacacaucauaguagacguacgccaacuugaacccguccuaaucccccuccccgacguacgcaacaacuucuaccacuacaaccaaagcaacgacccuaccauuaaacucauagccauguuauacacaccacuccgcgcuaacaacgcaggcgacgacguauucacaguaagcugccgcguccucacccgcccuucccccgacuucgacuucaucuuccuaguuccucccaccgucgaaucccgcaccaaaccauucucugucccuguucucaccgucgaagaaaugacaaacucccgauuccccauaccacuagaaaagcuauucaccggucccuccucagccuucgucguccagccacaaaacgguagaugcaccaccgacggaguccuccuaggcaccacacaacucuccccagucaacauaugcaccuuccgcggagacguuacccacauccccggcucacgcaauuacacuaugaaccuagccucccaaaacuggaacucauaugacccaacugaagaaauccccgcaccccuaggcacccccgacuucguaggcaagauucaagguguccucacccaaaccacccgcaccaacggcagcacccgcggccauaaagccaccgucuacaccggcuccgccgacuucucacccaaacucggccgcguccaauucgccaccgacacagacaacgacuucgaaaccaaccaaaacaccaaauucaccccaguaggcgucauccaagacggcucaacaacaccacgaaacgaaccacaacaauggguccuuccauccuacucaggacgcaacauccacaacguccaccucgccccagccgucgccccaaccuuccccggagaacaacuacuauucuuccgaucuaccaugccaggcugcuccggauaccccaacauggaccuagacugccucuuaccacaagaauggguccaauauuucuaccaagaagcagccccagcccaauccgacgucgcccuucuccguuucgucaacccagacaccggucgaguccuauucgaaugcaaacuccacaaaucaggauacguaacagucgcacacacuggacaacacgaucucgucauaccacccaauggauacuuccgcuucgacuccuggguaaaccaauucuacacacucgccccaaugggaaacggaacaggaagacgccgcgcccuauaa

SEQ ID NO: 35343 - RNA, 1623 nt, Artificial Sequence
  derived and/or modified sequence opt11 from capsid_protein_VP1__Norovirus__AFX81262
augaaaauggcgucaaacgacgccaaccccuccgacggcuccgcagccaacuuaguccccgaaguaucaaacgaggugauggcccucgaaccagucgucggagccgccaucgcagcccccgucgccggccaacaaaacgucaucgaccccuggaucagaaacaacuucguacaagccccgggcggcgaguuuaccguaucaccccgaaacgccccaggcgaaauccucugguccgccccacuagguccugaccucaaccccuaccucucacaccuagcucgaauguauaaugguuacgccgguggcuucgaaguccaagucauccuagccggcaacgccuucaccgccggcaaaauaauauucgcagccguaccgccaaacuuccccaccgaaggacucucacccucacaggucaccauguucccacacaucaucgucgacguccgccaacucgaacccguccugaucccccucccagacguccgcaacaacuucuaccacuacaaccaaaccaacgacucuacaauaaaacucauagccaugcuauacaccccgcuccgcgccaacaaugccggcgaggacguauucaccgucagcugccgaguacuuacccgccccagcccagacuuugacuucaucuuccuugucccuccuaccgucgaaagccgaaccaagcccuucaccguacccauacuuaccgucgaagaaaugaccaacucacgcuuucccaucccacuugaaaaacucuucaccggacccucaggcgcauucgucguccaaccccaaaacggccgcugcacaaccgacggcguccuccuuggcaccacacaacucuccccaguaaacauaugcaccuuccgaggagacgucacccacaucgccggcucccgaaacuacacuaugaaccucgcuucacucaauuggaacaacuacgaccccacggaagaaauacccgcaccacuaggcacccccgacuucgucggcaaaauccaaggcguccucacccagaccacaaaaggcgacggaucaacacgcggccacaaagccacugucuacacaggcuccgccccauucacccccaaacucggauccguccaauucucaacggacaccgaaaacgacuucgaaacccaccaaaauacaaaauucacucccgucggcguaauacaagacggcggcaccacccaccgcaacgaaccacaacaauggguccuucccuccuacuccggccgcgacguucacaauguccaccucgccccagccgucgccccaaccuuccccggcgaacaacuacuauucuuccgaucaaccaugcccggcugcuccggauaccccaacauggaccuagacugcuuacuaccacaggaauggguccaacacuucuaccaagaagcagccccugcacaauccgacguagcacuacuccgauucgucaacccagacacuggacggguacucuucgaaugcaaacuacacaaauccggcuacgucaccgucgcccacacaggacaacaugaucucgugaucccacccaacggauacuuccgauucgacucaugggucaaucaauucuacacccucgcucccaugggaaacggcaccggccgccgacgcgcacucuga

SEQ ID NO: 35344 - RNA, 1623 nt, Artificial Sequence
  derived and/or modified sequence opt11 from capsid_protein_VP1__Norovirus__AFX81265
augaaaauggcauccaaugacgccaaccccucagacggcucugccgcuaaccuaguucccgaagucucaaacgaagugauggcccucgaacccgucgucggagccgccaucgccgcccccgucgccggccaacaaaaugucaucgacccauggauacgcaacaacuucguccaagcaccaggcggagaguucaccgucucaccccgcaacgccccaggagaaauccucuggucggcaccccucggccccgaucucaaccccuaccucucacaccucgcccgcauguauaacggcuacgccgguggauucgaaguccaagucauucuugccgguaacgccuucacagccggcaaaauaaucuucgcagccguuccacccaacuuccccaccgaagggcuaucccccucacaagugacuauguucccccacaucaucguagacguccgccaacuagaacccguacucauaccacucccagacgucagaaauaacuucuaucacuacaaccaaacaaacgacuccaccaucaaacucaucgcaaugcucuacacaccccuucgcgccaacaacgcaggagaagacguauucaccgucuccugccgcguacuaacgcgccccagcccggacuucgacuucaucuuccucgucccucccaccgucgaaucucgcacuaaacccuucaccguccccauacucaccgucgaagaaaugaccaacucccguuuuccaaucccccucgaaaaacucuucaccggcccaucaggcgcauucgucguacaaccacaaaacggucgaugcaccacagacggcguacuccucggaaccacccaacuauccccaguuaacaucugcaccuucagaggcgacgucacccauauugcaggcuccagaaacuacaccaugaaccucgcaucucucaacuggaacaauuacgaccccaccgaagaaauccccgcaccccucggaacccccgauuucguugggaaaauccaaggcguccucacccaaaccaccaaaggagacggcucaacucguggacauaaagccaccguauacaccggcagcgcccccuucacaccaaaacucggcuccguccaauucucuacugacaccgaaaacgacuucgaaacccaucaaaacaccaaauucacccccgucggcguaauucaagacggcgggaccacccaccgcaacgaaccacaacaauggguccuccccuccuacuccggacgagacguccacaauguacaccucgccccagccgucgcccccacauuccccggugaacaacuccuauucuucagaucuacaaugcccggcugcucgggcuaccccaacauggaccucgacugccuccuaccacaagaauggguacaacacuuuuaccaagaagccgcccccgcccaauccgacguagcccuccucagauucgucaaccccgacaccggccguguauuauucgagugcaaacuccacaaauccggcuacguaacagucgcccacacaggccaacacgaccucgucauaccacccaacggauacuuccgguucgacuccugggucaaccaauucuacacccuagcccccaugggcaacggcacaggacgucgccgcgcccucuaa

SEQ ID NO: 35345 - RNA, 1623 nt, Artificial Sequence
  derived and/or modified sequence opt11 from capsid_protein_VP1__Norovirus__AFX81268
augaaaauggccuccaacgacgcaaacccaucggacggcuccgcagccaaccucguacccgaaguaagcaacgaagucauggcacucgaacccguagucggagccgcaaucgcagcccccgucgcaggccaacaaaauguaaucgaccccuggauacgaaauaacuucguccaagcccccggaggugaguucaccgucagcccccgcaacgccccgggcgaaauacuaugguccgccccacucggaccagaucucaacccauaccuaucccaccuugcccgcauguacaacggcuaugccggggguuuugaaguccgagucauacuagccggcaacgccuucaccgcaggcaaaauaauuuucgcagccguacccccaaacuuccccaccgaaggccucucacccucccaagucaccauguucccccauaucauagucgacguccgccaacuugaaccaguccucaucccucuuccagacguaagaaacaauuucuaccacuacaaccaaacaaacgacucaaccaucaagcuaaucgccaugcuauacacaccccuccgagccaauaacgcuggagaagacgucuucaccgucuccugccgcguccucacccguccuagcccagacuucgacuucaucuuccucguacccccaaccgucgaaucccgcaccaaacccuucaccguaccaauacucacaguagaagaaaugaccaacuccagauuccccauaccccucgaaaaacuuuucaccggcccaucuggcgcauucguuguacagccacaaaauggucgcugcacaaccgacggcguccuccucggaaccacccaacucucaccaguaaacaucugcaccuuucguggagacgucacccacauagcaggcucucgaaauuacaccaugaaucucgccucccuaaacuggaacaacuacgaccccacggaagagauacccgcgccccucggaacaccugacuucgucggcaaaauccaagggguccucacucaaaccacuaaaggagacggaucaacccgcggccacaaagccaccguauauaccggcucagcacccuucacccccaaacuaggcucuguccaauucuccaccgacacagaaaacgauuucgaaacccaccaaaacaccaaauucacccccguaggcgucauccaagacggcggcaccacacaccgaaacgaaccacaacaauggguccuaccauccuacuccggacgagacguccacaacguucaccuagccccugccguagcccccaccuuccccggcgaacagcuccucuuuuuccgcuccaccaugccaggaugcuccggcuacccaaauauggaccuagauugccuccuaccccaagaauggguacaacacuucuaccaagaggccgcaccagcccaaucagacguagcccuccuacgcuucguaaaccccgacaccggccgcguccucuucgaguguaaacuccacaaguccggguacgucaccgucgcccacacuggccaacacgaucuagucaucccacccaacggcuacuuccgcuucgacuccugggucaaccaauucuacacccuagccccaaugggcaauggcacuggccgccgacgcgcacuauaa

SEQ ID NO: 35346 - RNA, 1623 nt, Artificial Sequence
  derived and/or modified sequence opt11 from capsid_protein_VP1__Norovirus__AFX81271
augaagauggcuagcaacgacgcaaacccgucagacggaagcgccgcaaaccucguccccgaggucuccaacgaagucauggcccucgaacccgucgucggugccgcaaucgccgcaccaguugccggccaacaaaacgucaucgaccccuggauacgaaacaacuucguccaagccccgggcggcgaguuuaccgucucaccccgcaacgcccccggcgaaauccuuugguccgcaccccucggaccagaccuaaaccccuaucucagccaccuugcccgaauguacaacggcuacgccggcggauucgaaguccaggucauccuugccggcaacgcauucaccgcaggcaaaaucaucuucgccgccgucccucccaacuuccccaccgagggccuaucucccucccaaguaacuauguucccccacaucaucgucgacguccgucaacucgaacccguacucauuccacuccccgacguccgcaacaacuucuaccacuacaaccaaaccaacgacuccaccaucaaacucauagccaugcucuacaccccacucagagccaacaacgccggcgaagacguauuuaccgucucaugccgcguacucacuagacccucacccgacuucgacuucauauuccucguacccccuacagucgaaucucgaaccaaacccuucaccguccccauacuaacagucgaagaaaugaccaacucccgcuuccccaucccccuugagaaacuauucaccggcccauccggcgcauucgucguacaaccccaaaauggccgcuguaccacugacggaguccugcuagguacaacacaacucuccccagucaacaucugcaccuuccgaggcgacguuacccauaucgccggcucccguaacuacaccaugaaucucgcaagccucaacuggaacaacuacgaccccacagaagaaauaccugcaccccucggcacccccgacuucgucggcaaaauacaaggcguccucacccaaacaaccaaaggcgacggaucaacccguggacacaaagccaccguuuacaccggaucugcccccuucacccccaaacucggcucaguucaauucucaaccgacacagaaaacgauuucgaaacccaccagaacaccaaauuuacaccagucggugucauccaagacggaggcacaacccaccgaaacgaaccccaacaauggguacucccaagcuacucaggccgcgacguccauaacguacaccuagccccagcaguugccccuaccuuccccggugaacaacuacucuucuuccgaucaacuaugcccggcugcucuggcuaccccaauauggaccucgacugccuccucccccaagaauggguccaacacuucuaccaagaagccgcccccgcccaauccgacgucgcccuucuacgcuucgucaacccagacaccggccgaguucuauucgaaugcaaacuccacaaaucaggcuacgucacaguagcccacaccggccaacacgaccucguuauacccccuaacggauacuuucgcuucgacuccugggucaaccaauucuacacacuagccccgaugggaaacggcacuggccgucgccgagcccucuaa

SEQ ID NO: 35347 - RNA, 1623 nt, Artificial Sequence
  derived and/or modified sequence opt11 from capsid_protein_VP1__Norovirus__AFX81274
augaaaauggcuuccaacgacgccaaccccucagauggcagcgccgccaaccuugucccugaaguaucuaacgaagucauggcccucgaacccgucguaggcgccgccaucgcagcccccgucgcaggccagcaaaacgucaucgacccuuggauccgcaacaacuucguccaagcccccgguggcgaguucacagucucaccccgcaaugcaccaggggaaauccucugguccgcuccacuagggcccgaccucaacccauaccuaagccaccucgcacgcauguacaacggcuacgcuggaggcuucgaaguccgaguaauccucgccggcaaugcauucaccgccgguaaaauaaucuucgccgcuguaccacccaacuuuccaacagaaggccucuccccuucccaagucaccauguucccccacauaaucgucgacguccgacaacuagaaccaguucuaaucccacuccccgacguccgcaacaauuucuaccacuacaaccagacaaacgacucaaccaucaaacucauagccaugcucuacaccccacuacgugccaacaacgccggcgaagacguuuucacugucucuugccguguccuaacccggcccuccccugacuucgacuucauauuccucguacccccaacagucgaaucccgcaccaaacccuuuacagucccaauccuaaccgucgaagaaaugacaaacucacgcuucccaauaccacuagaaaaacucuucaccggccccucaggcgcauucgucguccagccccaaaacggccgcugcaccacagacgguguccuccucggaacuacccaacuaucucccgucucaauuugcaccuuccgcggcgacgucacacacaucgccggcucaagaaacuacacaaugaaucuagccucccucaauuggaacaacuacgaccccaccgaagagauccccgccccauuagguaccccagacuuugucggaaaaauccaagguguucucacacaaacaaccaaaggcgacggaucaacacgcggucacaaagccaccgucuacaccggcuccgcaccuuucacccccaaguuaggcuccguucaauucuccacagacaccgaaaacgacuuugaaacacaccaaaacaccaaauucacccccguaggugucauccaagauggagggaccacccauagaaacgaaccccaacaguggguccuccccucauacucaggccgcgacguccacaacguacaccucgcaccagccgucgcacccacauuucccggcgaacaacuucucuucuuccgcucaaccaugcccggcugcuccggcuaccccaacauggaccucgacugccuacuaccccaagaauggguacaacacuucuaccaagaagccgcacccgcccaaucagacgucgcucuccuccgcuucguuaaccccgacacaggccgcgucuuauucgaaugcaagcuccacaaauccggcuacgucacuguagcccacaccggacaacacgaucucgucaucccucccaacggauacuucagauucgacuccugggucaaccaauuuuacacccuugcccccaugggcaacggcaccggacgccgacgcgcccucuaa

SEQ ID NO: 35348 - RNA, 1623 nt, Artificial Sequence
  derived and/or modified sequence opt11 from capsid_protein_VP1__Norovirus__AFX81277
augaaaauggccuccaacgacgcuaacccaucggacggcuccgcagccaacuuggugcccgaagucuccaaugaaguaauggcauuagaacccgucgucggcgccgccauugccgccccugucgccggacaacaaaacguaaucgacccauggauccgcaacaacuuuguccaagcccccggcggcgaguucaccguaagcccccgcaacgcccccggagaaauacucugguccgccccucuagggcccgaccucaacccauaccucucccaccucgcccgcauguacaacggauacgcaggcggcuucgaagugcgcgucauccuagcaggaaacgccuucacugccggcaaaauuaucuucgccgcgguacccccaaacuucccaacugaaggccucucccccucccaagucaccauguucccgcauaucauagucgacgugagacaauuagaacccguccuuaucccacuaccagacguccgcaacaacuucuaccacuauaaccaaaccaacgacuccaccaucaaacucaucgccaugcuguacaccccacuccgcgccaacaacgccggagaagacguguucaccgucucaugucgcguacucacucgccccucccccgacuucgacuucaucuuccuaguaccacccacaguagaaucacgcaccaaacccuucacaguucccauccucaccgucgaagaaaugaccaacucacgauuccccauaccccucgaaaaacucuucaccggccccuccggcgccuucguuguacaaccgcagaacggacgaugcaccaccgacggcguccuacuagguacuacacaacuaucaccaguuaacaucuguacauucagaggugacgucacccacaucgccgguucucgcaacuacaccaugaaucuagcuucccugaacuggaacaacuacgaccccaccgaagaaauacccgcaccccucggcacccccgacuucguaggaaagauacaaggcguccucacccaaacaacaaaaggcgacggauccacacgcggacacaaggccaccgucuacacuggcuccgcccccuucacacccaaacucggcucaguccaauucuccaccgacacagaaaaugacuucgaaacccaccaaaacaccaaauucacccccgucggcguaauccaagauggcggcaccacccaccguaacgaaccacaacaauggguccucccaucuuacagcggccgcgacguccacaacguacaccucgcccccgcagucgcccccaccuucccaggcgaacaacuucuuuucuuucgaucaaccaugccaggaugcucaggcuacccaaacauggaccucgacugccuccuaccccaagaauggguccaacacuucuaucaagaggccgccccagcccaaucagacgucgcucuccuaagauucguaaacccggacaccggacguguccuauucgaaugcaaacuacauaaaagcggcuacgucacagucgcccacacuggacaacacgaccucguaaucccacccaacggcuacuucagauuugacuccugggucaaccaauucuacacacucgcccccaugggcaacggcaccggccgacgccgcgcccuguaa

SEQ ID NO: 35349 - RNA, 1623 nt, Artificial Sequence
  derived and/or modified sequence opt11 from capsid_protein_VP1__Norovirus__AFX81283
augaaaauggcauccaacgacgcgaaccccucugacggauccgcagcaaaccuaguacccgaaguauccaaugaggucauggcccucgaacccgucguaggcgccgccauagccgcccccgucgccggacaacaaaacgucauagacccauggauacgaaacaacuucguccaagcaccuggaggugaguucaccgucucaccccgcaacgcacccggagaaauccucugguccgcaccacuuggccccgaccucaaccccuaccuaucucaccucgcccgcauguauaacggauacgccggaggcuucgaaguccaagucauacucgccgguaacgccuucaccgcaggaaaaaucaucuucgcugcagucccacccaacuuccccaccgaaggccucucacccucacaaguuaccauguucccccauaucaucgucgacguacgucaacucgaacccguccugaucccgcuccccgauguccgaaacaacuucuaccacuacaaccaaacaaacgacuccacaaucaaacucaucgccaugcucuacacuccccuccgcgcaaacaacgccggcgaagacgucuucaccguaucaugccgcguucuaacccgcccauccccagacuucgacuucaucuuccucgucccacccaccguagaaucccgaaccaaaccauucaccguaccaauacucacugucgaagaaaugaccaacucccgcuuccccauaccccucgaaaaacuuuucaccggaccaucuggcgcauucguaguccaaccccaaaacggacgcugcaccacugacgguguccuccucggaacaacgcaacucucccccgucaacaucugcaccuuccgaggagacgucacccacaucgcaggcucccggaauuacaccaugaaucucgccuccuuaaacuggaacaacuacgaucccacagaagaaauccccgcaccccucgggacccccgacuucgucggaaagauccaaggcguccucacacaaaccaccaaaggcgacggcucaacucgcggccacaaagcaaccgucuacaccggcuccgcuccauucaccccaaaacuuggcucgguccaguucuccacagacaccgaaaacgacuucgaaacccaccaaaacacaaaauucaccccagucggcgucauccaagacggcuccacaacccaccgaaacgaaccccagcaauggguccuucccuccuacucgggccgcgacguccacaacguccaccuugccccagccgucgcucccaccuuccccggagaacagcuacuuuucuuccgcuccacaaugcccgguugcuccggauacccaaacauggaccucgacugccuacucccccaagaauggguccaacacuucuaccaagaggcagcuccagcacaaagcgacguagcccuucuccgcuucguaaacccagacaccggccgcguccuauucgaaugcaaacuacacaaaucuggauacgucacugucgcccacaccggccaacacgaccuagucaucccacccaacggcuacuuccgcuucgacuccuggguuaaccaauucuauacacucgccccaaugggaaacggaacaggucguagacgcgcccucuaa

SEQ ID NO: 35350 - RNA, 1623 nt, Artificial Sequence
  derived and/or modified sequence opt11 from capsid_protein_VP1__Norovirus__AFX81289
augaaaauggcuuccaacgacgccaaccccuccgacggcucugcagcuaaccucguacccgaaguuagcaacgaagucauggcccucgaaccagucguaggagcugcaauagcagccccagucgcuggacaacaaaacgucaucgacccuuggauacgaaacaacuucguacaagccccuggcggagaguucacaguauccccacgaaacgcccccggcgaaauccucugguccgccccacuuggcccggaccucaacccauaccucucacaccucgcccgaauguacaacggcuacgccggcggcuucgaaguacaagucauccuagccggaaacgccuuuaccgcuggcaaaaucauauucgccgccgucccacccaacuuuccgaccgaaggccucucucccucccaagucaccauguucccccacaucaucguagacguccgucagcucgaacccguccuaaucccacucccugacguacgaaacaacuucuaccacuacaaccaaaccaacgacuccacaauaaaacucaucgcuaugcuauacacaccccuccgcgccaacaacgccggcgaagacgucuucaccgucuccugccgcguccucacccgaccguccccagacuucgacuucaucuuccucgucccacccaccgucgaaucgcguaccaaacccuucaccgucccuauccuuaccguagaagaaaugaccaacucacgauucccaaucccccucgaaaaacucuuuacuggccccuccggagcauucgucguucaaccccagaacggacgcugcacuacagacgguguucuacuaggaaccacccaacucagccccguaaacauuugcacauuccgcggcgacgucacccacauagcgggcucucguaacuacacaaugaaccucgcgucccucaacuggaauaacuacgaccccaccgaagaaauacccgccccacuuggaacacccgacuuugucggcaaaauccaaggcguccuaacccaaaccacuaaaggugacggcagcacacgcggacauaaggcaaccguauacacuggcuccgcuccauucacccccaaacuuggcuccguccaauucucaacugauaccgaaaaugacuuugaaacccaccaaaacaccaaauuuacacccgucggcgucauccaggacggcggcaccacacaccgcaacgaaccccaacaauggguccuccccuccuacagcggacgagacguccacaacguccaccuagcccccgcaguagccccaaccuuccccggcgaacagcuccuauucuucagaucaacgaugccaggcugcuccggauaccccaauauggaccuagacugccuacuaccccaagaauggguccaacacuuuuaccaagaagccgcaccagcccaaagcgauguagcccuccuccgcuucgucaacccagacacuggcagaguccuauucgagugcaaacuccauaaaucgggcuacguaaccguugcccacaccggccaacacgaccuagucaucccacccaauggcuacuuccgcuucgacuccugggucaaccaauucuacacccuagcccccaugggcaauggcacaggcagacggcgcgccuuauaa

SEQ ID NO: 35351 - RNA, 1623 nt, Artificial Sequence
  derived and/or modified sequence opt11 from capsid_protein_VP1__Norovirus__AFX81292
augaaaauggcauccaacgacgcaaaccccucggacggcuccgccgcuaaccucguuccagaaguaucaaacgaaguaauggcacuugaaccagucgucggcgcugcuauagccgcacccgucgccggccaacaaaacgucaucgaccccuggauccgcaacaacuucguccaagcccccggaggugaauuuacaguauccccacgcaaugcccccggugaaauccuauggucugcaccccucggccccgaccuaaaccccuaccuaucccaccucgcccgcauguauaacggcuacgccggcggauucgaagugcaaguaauccucgccggcaacgccuucacggccggcaagauaaucuucgcugcagucccacccaacuuccccacagaaggccuuucacccucccaaguaaccauguucccacauaucaucgucgacguccgacaacucgaaccaguacucauaccccuacccgauguccgaaacaacuucuaccacuacaaucaaaccaacgacuccaccaucaaacucaucgccaugcucuacaccccacuccgagccaacaacgccggcgaagacgucuucacaguaucaugccgaguccucacacgcccauccccagacuucgacuucaucuucuuagucccacccaccgucgaaucccgcaccaaacccuucaccguccccauacuaacagucgaagaaaugaccaacagccgcuuccccauaccccuagaaaaacuauucaccggcccaucaggcgcauucgucguccaaccacagaacggaagaugcacaacagacggcguacuccuaggcaccacccaacucucgccagucaacaucugcaccuuccgaggcgacgucacacacaucgccggaucccgcaacuacaccaugaaccucgccucccucaacuggaacaacuacgacccaacugaagaaauucccgcuccccucggaaccccagacuucguaggcaaaauccaaggcguccuaacccaaaccacuaaaggcgacggcuccacccguggccacaaagcaaccguauauacaggcuccgcacccuucacccccaagcucggaucaguccaauucucaaccgacaccgaaaaugacuucgaaacccaccaaaacaccaaauucaccccaguuggcgucauccaagacggcggcaccacccaccgcaacgaaccacaacaauggguacucccauccuacagcggccgugacguacacaauguccaccucgccccggccgucgcccccaccuuccccggagaacaacuucuuuucuuccgauccacaaugccugguugcucaggauaccccaacauggauuuagacugcuuacugccccaggaauggguucaacacuucuaccaagaagcugcccccgcccaaucugacgucgcccuccuucgcuucgucaaccccgacacgggacgcgucuuauucgaaugcaagcuccacaaauccggcuacgucaccgucgcccacaccggacaacacgaucuagucauaccgcccaacggcuacuuccgcuucgacucguggguuaaucaguucuacacccucgcccccaugggcaacggcaccggccgacgccgagcccucuaa

SEQ ID NO: 35352 - RNA, 1623 nt, Artificial Sequence
  derived and/or modified sequence opt11 from capsid_protein_VP1__Norovirus__AFX81295
augaaaauggccucuaacgacgcaaauccauccgacggcuccgccgccaaccuuguacccgaagucuccaacgaagucauggcacucgaaccagucgucggcgcagccaucgcugcacccgucgcaggacaacaaaacguuauagauccauggauacgaaacaacuucguccaagcccccggcggcgaguucaccguaucuccccgcaacgcacccggcgaaauacucugguccgcuccacuaggccccgaccucaaccccuaccucucccaucuagcgcgcauguacaacggauacgccggcggcuucgaaguccaaguaaucuuagccggaaacgccuucaccgccggcaagaucaucuucgccgcagucccacccaauuuccccaccgaaggucucucccccucccaaguaaccauguucccccacaucaucgucgacguccgacagcucgaacccguccuaaucccccuacccgacguccgcaacaacuucuaucacuacaaccaaaccaacgacuccacaaucaagcucauagcuaugcucuacacaccacuccgagcaaacaacgccggcgaagacgucuucaccgucucaugccguguacugacacgcccauccccugacuucgacuucaucuuccucguuccucccaccgucgaaucucgaacaaaacccuucaccguccccauacucaccguagaagaaaugacuaacucccgcuucccgaucccccucgaaaaacuauucaccggccccucaggagccuuuguaguccagccccaaaaugggcgcugcaccaccgacggcguccuccucggcaccacccaacucucccccgugaauaucugcaccuuccgcggagacguaacgcacaucgccggaagccgcaacuacaccaugaaccuagccucccucaacuggaacaacuacgacccaaccgaagaaauccccgcaccacucggcaccccagacuucgucggcaaaauucaaggcguauuaacccaaacuaccaaaggagacggaucaaccagaggccauaaggccaccguauacacaggcagcgcccccuucacccccaaacuaggaucaguacaauucucaaccgacaccgaaaacgacuucgaaacccaccaaaacacaaaauucacucccgugggcguaauccaagauggcggcaccacacaccgcaacgaaccacaacaaugggucuuacccucauacucaggaagagacguccacaacguccaccuagcccccgcagucgcacccaccuuccccggcgaacaacuccucuucuuccgaucaacaaugccuggaugcuccggcuacccaaacauggaccuugacugccuccuaccccaagaauggguacaacacuucuaccaagaagccgcuccugcccaaucagacguagcccuccuccgcuuugucaaccccgacacaggccgcguccucuucgaaugcaaacugcacaaaucuggcuacgucacagucgcacacacaggccagcacgaccuaguaauuccuccaaacggcuacuucagauucgacuccuggguaaaccaauucuacacccucgcucccauggguaacggaaccggccgaagacgagcacucuaa

SEQ ID NO: 35353 - RNA, 1623 nt, Artificial Sequence
  derived and/or modified sequence opt11 from capsid_protein_VP1__Norovirus__AFX81298
augaaaauggccagcaacgacgccaaccccuccgacgguuccgccgcaaaccuaguccccgaagucucaaacgaaguaauggcauuagaacccguaguaggcgccgcaauagcagccccugucgccggccaacagaacgucauugaccccuggauccgcaacaacuuuguccaagcccccggcggggaauuuacaguauccccucgcaacgcaccaggcgaaauccucuggucagccccacucggccccgaccucaaccccuaccucucucaccucgcccgaauguacaacggguacgccgguggauucgagguccaagucauccuagccggaaacgccuuuacagccggcaaaaucaucuucgccgccgugccucccaacuuccccaccgaaggacucuccccaucccaaguuaccauguucccccacaucaucguagacgucagacagcucgaacccguccucauaccccucccagacguccgaaauaacuucuaccacuacaaccagacaaacgacuccacaaucaaacuaauugccaugcuauacacgccccuucgagcuaacaacgccggagaagacgucuuuacaguauccugccgcguacucacccgccccucaccugacuucgacuucauauuccucguaccuccaacagucgaaucacgaacaaaaccauucaccguacccauccucaccguggaagaaaugacaaacucccgcuuccccauaccccucgaaaaacucuucaccggucccucaggcgcuuucgucguccagccacagaacggucgcugcaccaccgacggcguccuccucgguacuacccaacucucaccuguuaauaucugcacauuucgcggcgacguaacccacaucgccggcucccgcaacuacaccaugaaccucgcuagccuaaacuggaacaacuacgauccaaccgaagaaauccccgcaccccuaggcacgccagauuucgucggaaaaauccaaggaguccugacacaaacaacaaaaggcgauggauccacacgcggacacaaagcaacagucuacacagguuccgcucccuucacaccuaagcucggcucuguacaauucucuaccgauaccgaaaacgacuucgaaacccaccaaaacaccaaauucaccccagucggagucauccaagacggcggcaccacccacagaaaugaaccccaacaguggguccuacccagcuacuccggacgcgacguacacaacguccacuuagcccccgccguagccccaacauuucccggugaacagcuucucuucuuccgauccacaaugccaggaugcucaggauacccuaacauggaccuugacugccugcuuccccaagaauggguucaacacuucuaccaagaggccgcccccgcccaaucagacgucgcacucuuacgcuucgucaaucccgacacaggccguguacuauucgaaugcaagcuccacaaauccggcuacgucacagucgcccacacaggccagcacgaccuagucauaccacccaauggcuauuucagguucgacagcuggguaaaccaauucuacacacuagcacccaugggaaacggcaccggccgucgccgcgcccucuaa

SEQ ID NO: 35354 - RNA, 1623 nt, Artificial Sequence
  derived and/or modified sequence opt11 from capsid_protein_VP1__Norovirus__AFX81301
augaaaauggccuccagugacgccaacccguccgacggcuccgccgccaaccucgucccagaaguaaacaacgaagucauggcucuagagcccgucguaggagcagcaaucgccgcacccguggccggccaacaaaacgucauagacccauggauucgcaacaacuucguacaagcaccaggaggcgaguucacugucucaccccgcaacgcccccggcgaaaucuuaugguccgcgccccucggacccgacuuaaaccccuaccucucacacuuagcccgcauguacaacggguacgccggcggcuuugaaguccaagucauccuagccggcaacgccuucaccgccggaaaaaucauauucgccgccguacccccaaacuuccccaccgaaggccuaagcccaucacaaguaacuauguucccccacaucaucgucgacguccgacaacucgaaccuguacucaucccccuccccgauguccggaacaacuucuaucacuacaaccaaucuaacgacuccaccaucaaacucauagcaaugcuuuacacuccccuacgagcuaacaacgccggagaagacgucuucaccguauccugcagaguccuaacccgaccuucucccgauuucgacuucaucuuccucgucccacccaccguggaaucacgaaccaaacccuucaccgugcccauccucacaguagaagaaaugaccaacucccgcuucccaaucccucuagaaaaacucuucaccggcccaagcuccgccuucguaguccaaccccaaaacggaagaugcaccacagacggcguccuccuaggcaccacccaacuuucccccguaaauaucugcacauuccgaggagacguaacccacauagcaggcucccgcaacuacacuaugaaccuagccagccuuaacuggaacaacuacgaccccaccgaagaaauacccgcuccccucgggaccccagacuucgucggcaaaauccaaggaguccucacccaaacuaccaaaggagauggcuccacccgcggccacaaagccaccguauacaccggcuccgccccauuuacccccaaacuaggaucuguccaguucuccaccgacaccgaaaacgacuucgaaacacaccaaaacacaaaauucacaccagucggcgucauccaagacggaucaaccacccaccgcaacgaaccacaacaauggguacuaccuucauacuccggccgaaauguucccaacguccacuuagccccagccgucgcccccaccuucccaggcgaacaauuacucuuuuuccgcucaaccaugccaggaugcagcggcuacccuaacauggaccucgacugccugcucccgcaagaauggguccaacacuucuaccaagaagcagcaccagcccaaucagacgucgcccuccuacgcuucguaaaccccgacaccggacgcguccuauucgaaugcaaacuccacaaauccggcuacguaacagucgcacacaccggccaacacgaccucguaaucccacccaauggauauuuccgcuucgacucaugggucaaccaauucuacacgcucgccccgaugggcaacgguacaggcagacgacgcgccuuauag

SEQ ID NO: 35355 - RNA, 1623 nt, Artificial Sequence
  derived and/or modified sequence opt11 from capsid_protein_VP1__Norovirus__AFX81304
augaaaauggcauccaacgaugccaaccccuccgacggcuccgccgccaaccugguccccgaagucuccaacgaagucauggcacuggaacccgucgucggcgccgccauugcagccccgguagccggccaacaaaacguaaucgaccccuggauccgcaacaacuucguccaagccccaggcggcgaauuuacagucucaccccgcaaugcccccggcgaaauccucugguccgcgccccugggccccgaucucaacccauaccugucccaccucgcccgaauguacaauggcuacgcaggcggauucgaaguccaagucauccuagcgggaaacgccuuuaccgccggcaaaauaauauucgcagccguuccacccaacuuccccacagaaggacuauccccaucccaagucacaauguuuccccacauaauugucgacguccgccagcuagaaccaguccucaucccccugcccgacguccgcaacaacuucuaccacuacaaccaaaccaacgacucuaccauaaaacucaucgcaaugcuauacacaccacuccgcgccaacaaugccggcgaagacgucuucaccguauccugccgaguccucacucgucccucaccagacuucgacuucaucuuccucguaccucccaccguagaaucccgaaccaaacccuucaccgucccaauccucacaguagaggaaaugacaaacucccgcuuccccauaccccuagaaaaacuauucaccggcccauccggagcuuucgucguccaaccacaaaacggccguugcaccacggacggaguccuacucggcaccacacaacuuucccccgucaauaucugcacauuccgaggcgaugucacccacauagccggcucacgaaacuacacaaugaaccuagccucccuaaacuggaacaacuacgaccccaccgaagaaauacccgccccacuugguacucccgacuucgucggaaaaauccaaggcguacucacccaaaccaccaaaggagacgguuccacccgcggccacaaagcaaccguauacaccggaucagcgcccuucaccccaaaacucggaucaguacaauuuucaaccgacaccgaaaacgacuucgaaacccaccaaaacaccaaauucaccccagucggcgucauacaagauggcggaaccacucaccgaaacgaaccccagcaauggguacugcccagcuacuccggccgcgauguacacaacguucaccuugcacccgccguagcccccacauuccccggagaacaacuucuuuucuuccgauccaccaugcccggaugcuccggauacccaaacauggaccucgacugccuacucccccaagaauggguccaacacuucuaccaagaagcagcaccagcccaauccgacguagcccuccuacgcuucgucaaccccgacacuggccgaguccucuucgaaugcaaacuccauaaauccggauacgucaccguugcacacaccggccaacacgaccucguuaucccaccaaauggauacuuccgcuuugacuccuggguuaaucaauucuacacccucgcacccaugggcaacggcacugggcgacggcgcgcccuuuag

SEQ ID NO: 35356 - RNA, 1623 nt, Artificial Sequence
  derived and/or modified sequence opt11 from capsid_protein_VP1__Norovirus__AFX81307
augaaaauggccucgaacgacgccaacccuagcgacggcuccgccgcaaaccuaguaccagaaguauccaacgaagucauggcacuagaaccaguagucggggccgccauagcagcccccguagccggccaacaaaacgucaucgacccuuggauccgcaauaauuucguccaagccccagguggcgaguucaccguaucccccagaaaugcaccaggcgaaauccucugguccgcaccccucggccccgaccugaaccccuaccucucacaccucgcccggauguacaacggauacgccggcggauuugaaguacaagucauccucgccggcaacgccuucacagccggaaaaauuauauucgcagccgucccaccaaacuuccccacagaaggccuauccccuucccagguaacaauguucccccacauaauaguagacguccgccaacucgaacccguucucauaccacuacccgauguuagaaauaacuucuaccacuauaaccaaacuaacgacucaacaauaaaacuaaucgccaugcucuauaccccacuuagagccaacaacgcuggugaagacguauucacaguauccugccguguccuaacaagacccucacccgacuuugacuuuaucuucuuagucccgccaaccgucgaaucacgaaccaaacccuucacaguccccauccuuaccgucgaagaaaugaccaacucccgcuuccccaucccacucgaaaaacucuucaccggaccauccggcgccuucgucgugcaaccgcaaaacggaagaugcacuacagacggcguacuucuagguacaacacaacuauccccaguaaacauaugcaccuuccgaggcgauguaacccacaucgccggaucacgcaacuacaccaugaaccuagcaucacucaacuggaacaacuacgaccccacugaggaaauccccgcuccccucggcacacccgacuucgucggaaaaauacaaggcguucuaacccaaaccacaaagggagacggcuccacccggggccacaaagccacagucuacacaggcuccgcacccuucaccccuaagcuaggcagcguccaauucuccaccgacaccgaaaacgacuucgaaacacaccaaaacaccaaauucacuccagucggcgucauacaagacggcggcacaacccaccgaaacgaaccccaacaauggguccuaccaucauacuccggccgcgacguccacaacguacaccuagcuccagccguggcacccaccuuccccggcgaacaacuccuuuucuuccgcagcaccaugccaggcugcuccggcuacccaaacauggaccucgacugccucuuaccacaggaauggguacaacacuucuaucaagaagcagccccagcccaauccgacgucgcccuccuccgcuucgucaaccccgacaccggccgaguacucuucgaaugcaaacuccacaaauccggcuacgucaccguugcccacacgggacaacacgaccuagucaucccacccaacggauacuuccgauucgacuccugggucaaccaauucuacaccuuagcuccaaugggcaacggcacaggccgccggagagcucuauag

SEQ ID NO: 35357 - RNA, 1623 nt, Artificial Sequence
  derived and/or modified sequence opt11 from capsid_protein_VP1__Norovirus__AFX81313
augaaaauggccucaaacgacgccaacccaucugacggaucggcagccaaccucguacccgaagucucaaacgaagucauggcccucgaacccgucguaggcgcagcaaucgccgcacccguagccggccaacagaaugucaucgacccauggauccgcaauaacuucguacaagccccuggaggcgaguucaccgucuccccaagaaaugcccccggcgaaauccucugguccgcaccccuaggccccgaccucaaccccuaccuaagucaccuagcacgcauguauaacggcuacgcaggcgguuucgaaguccaagucauccucgcuggcaacgcuuucacagcagggaaaauaaucuucgccgccgucccacccaacuuucccacugaaggacucucccccucccaggucacaauguuuccacacaucaucgucgacguccgucaacucgaaccuguccuaauuccccucccagacguccgcaacaacuucuaccauuauaaccaaacaaacgacuccaccaucaaauuaaucgccaugcucuacacaccccucagggcuaacaacgccggcgaagacgucuucaccguuucgugccgcguccucacccgccccucacccgacuucgacuucaucuuccucguacccccaaccguagaaucaagaaccaaaccuuucacuguccccauacuaaccgucgaagaaaugaccaacucccgauucccaauaccacucgagaaauuauucaccggccccuccggagcauucgucguccaaccacaaaacggccgcugcacaacugauggcguacuccugggcaccacccaacuaucaccugucaacaucugcaccuuccgcggugacgucacccacauagcaggcucccgaaacuacaccaugaaccuagcuucccuaaacuggaacaacuacgaccccaccgaagaaauaccagcaccucuaggcacuccugacuucguuggcaagauccaaggaguccucacgcaaaccacaaaaggcgauggcuccacucgcggccauaaagccaccgucuacaccggcagcgcuccauuuacacccaaacuuggcuccguacaauucuccacagauaccgaaaacgacuucgaaacccaccaaaacaccaaauucacacccgucggcgucauccaagacggaggaacaacccaccguaaugaaccacaacaauggguccucccauccuacuccggccgcgacguucacaacguacaccucgcacccgccgucgcccccaccuuccccggcgaacaacuccuauucuuccgguccacaaugcccggcugcucuggcuacccaaacauggaccuagacugccuacucccacaagaauggguccaacacuucuaccaagaagccgccccugcccaauccgacgucgcccuccuccgcuucgucaaccccgacaccggccgcguacucuucgaaugcaaacuucacaaauccggcuacgucaccgucgcccacaccggucaacacgaccuagucaucccucccaacggcuauuuccgauucgacuccugggucaaccaguuuuauacccuggccccaaugggcaauggcaccggccgucgccgcgcccucuga

SEQ ID NO: 35358 - RNA, 1623 nt, Artificial Sequence
  derived and/or modified sequence opt11 from capsid_protein_VP1__Norovirus__AFX81316
augaaaauggccuccaacgacgcaaacccaucagacggcagcgccgcaaaccuagucccagaagucuccaacgaaguuauggcacucgaacccgugguaggcgcagccaucgcagcacccguagcuggccaacaaaacgucaucgaccccuggaucagaaacaacuucguccaagccccaggaggcgaguucacaguuucaccccgcaacgcucccggcgaaauucugugguccgccccacucggaccagaccuaaaucccuaccucucccaccucgcccgcauguauaacggcuacgccggaggguucgaaguccaagucauccucgccggaaacgccuucacagccggcaaaaucaucuucgcggcaguacccccaaacuucccaaccgagggacuaucccccucccaagucaccauguucccccauaucauaguagacguccgccaacuagaaccaguacuaaucccccucccagacguccgcaacaacuucuaccacuacaaccagaccaacgacuccacgauaaaacuaaucgcaaugcucuacacaccccuccgagccaauaaugcuggagaagacguauucaccgucucaugccgaguucuaacccgccccuccccagacuuugacuucaucuuccucgucccgccaaccguagaaucacgaaccaaacccuucaccgugcccauacucacagucgaagaaaugacaaauucucgcuuccccaucccacucgaaaaauuauucaccggacccucaggagcuuucgucguacaaccacaaaacggccgcugcacaacugacggaguccuccuuggaaccacacaacucucgcccguaaauauuugcaccuuccgaggggauguuacacacaucgccggaucccgaaacuacacuaugaaccuugcuucccuaaacuggaacaacuacgaccccaccgaagaaauccccgcaccccuaggcacgcccgacuuugucggcaaaauccaaggaguccucacccaaaccacaaaaggcgacggcuccacccgcggccacaaagccacagucuacaccggauccgccccauuuacgcccaaauuaggcuccguacaauucucuaccgacaccgaaaacgacuucgagacacaccaaaauaccaaauucaccccaguaggaguaauacaagacggcggcaccacacaccgaaacgaaccacaacaauggguccuuccauccuacucaggacgcgauguucacaacguacauuuagccccggccgucgccccaaccuuccccggcgaacaacuccuguucuuccgcuccaccaugcccggcugcucagguuaccccaacauggaccuagacugccuccucccccaagaauggguucagcacuucuaccaagaagcagcccccgcacaaagcgacguagcacuccuucguuucgucaacccagacaccggccgcguccuauucgagugcaaauuacacaaaucaggcuacgucacaguagcccacacuggccagcacgaccucgucaucccgcccaacggcuacuucagguucgacucaugggucaaccaauucuacacccucgcucccaugggaaacggaaccggccgccgacgcgcacucuaa

SEQ ID NO: 35359 - RNA, 1623 nt, Artificial Sequence
  derived and/or modified sequence opt11 from capsid_protein_VP1__Norovirus__AFX81319
augaaaauggccuccaacgacgccaaccccuccgacggcuccgccgccaaccucguccccgaagucucaaacgaagucauggcacuagaaccagucgucggagccgccaucgcagcccccgucgcaggucagcaaaacgucauugacccuuggauucgcaauaacuucguccaagccccuggcggagaguucaccgucagcccacgcaacgcacccggagaaaucuuauggucggcaccccucgguccugacuuaaaccccuaccuaucgcaccucgcccgcauguacaacggcuacgccggcggcuuugaaguacaaguaauccuagccgguaaugccuucaccgcaggcaaaaucaucuucgccgcuguaccacccaacuucccuacagaaggccucucucccucacaagucacaauguucccccauaucaucgucgacguccgucagcucgaacccguccuaaucccccuacccgacguacgcaacaacuuuuaccauuacaaccaaacaaacgacucaaccaucaagcuaauagcuaugcucuacaccccacuccgcgcaaacaacgccggcgaagaugucuucacuguaucaugucgcguccucacccgacccuccccugacuucgacuucaucuuccuagucccacccaccguagaaucacgcaccaagcccuuuacaguccccauccuaaccgucgaagaaaugaccaacucacgauucccuaucccccuugaaaaacucuucacaggccccuccggagccuucguaguacaaccccaaaacggucguugcacaaccgacggcguccugcuaggcacaacccaacucucccccguuaacaucugcacauuccgcggugacgucacacacaucgccgguucccgaaacuacacaaugaaccucgcuucucucaacuggaacaacuacgaccccaccgaagaaauccccgcuccccucggcaccccagauuucgucgguaaaauccaaggcgucuuaacacaaaccaccaaaggcgacggcuccacccgcggccacaaggccaccgucuacacuggcucagccccuuucacuccaaaacuuggcucuguccaguucuccacugauaccgaaaacgacuucgaaacccaccaaaacaccaaauucaccccagucggaguaauccaagacggaggaaccacccaucgcaacgaaccccagcaauggguacucccuuccuacuccggccgcgacguacacaacguacaccucgcccccgccgucgcccccacauucccaggcgaacaacuccuauucuuucgaucaaccaugccaggcugcuccggcuacccaaacauggacuuagacugccuccuaccccaagaauggguccaacacuucuaccaagaagccgccccagcccaauccgacguagcccuccuacgauucgucaacccagacacaggccgcguacuauuugaaugcaaacuacacaaaagcggcuaugucacagucgcccauaccggccaacaugaccuugucaucccaccaaacggauacuuucgauucgacuccugggucaaccaauucuauacacucgccccgaugggcaacggcaccggccgccgccgcgcccuauaa

SEQ ID NO: 35360 - RNA, 1623 nt, Artificial Sequence
  derived and/or modified sequence opt11 from capsid_protein_VP1__Norovirus__AFX81322
augaaaauggcauccaaugacgcaaaccccagcgacggcucugccgccaaccucguccccgagguaucuaacgaagucauggcccuagaaccagucguaggagccgcaauagcagcacccgucgccggccaacaaaacgucaucgaccccuggauucgcaacaacuucguccaagcccccggcggcgaguucacaguuagcccacgaaacgccccaggugaaauccucuggucagccccucuuggcccagaccucaaccccuaccuuucccaccucgcacguauguacaauggcuacgccggcggcuuugaaguucaaguaauccuagccggaaacgcuuucacagcaggcaaaaucaucuucgccgccgucccuccaaacuuccccaccgaaggccuauccccaucccaaguaaccauguucccccacaucaucguagacguccgacaacucgaacccguccucaucccacuacccgacgucagaaacaacuucuaccacuacaaccaaaccaaugacagcaccaucaaacucauagccaugcucuacacaccccuuagagcaaacaacgcuggagaagacgucuuuaccguaucaugucguguccucacccgcccuucccccgacuucgacuucaucuuucucgucccacccaccguugaaucccgcaccaaacccuucacaguccccauccucacugucgaagaaaugaccaacucacguuuccccaucccccucgaaaaacucuuuaccggccccucaggggcauucgucguacaaccacaaaacggacgcugcacaacagacggcguucuccuaggcaccacacaacuaucccccgucaacauaugcaccuuucgaggcgacguaacgcacaucgcaggcucccgaaacuacacuaugaaccucgccucacuaaacuggaacaacuacgaccccaccgaagaaauccccgcgccccucggaacccccgacuucgucggcaaaauacaaggaguccuaacacaaaccaccaaaggcgacggcucuacucgaggccacaaagccaccgucuacacaggauccgcccccuucacccccaagcuaggcuccguucaauucuccaccgacacagaaaacgacuucgaaacccaccagaauaccaaauucacccccguaggcgucauccaagacggcggaaccacacaccgcaacgaaccucaacaguggguccuaccauccuacucaggccgcgauguacacaacguacaccucgcccccgccguggcccccaccuuccccggcgaacaacuccucuucuuccgauccacaaugcccggaugcucuggauacccaaauauggaccucgacugccuccuaccccaagaauggguccaacacuucuaccaagaggccgccccggcccaguccgacguagcacuacuucgcuucgucaaucccgacacuggccgcguccucuucgaaugcaaacuccacaaaucuggcuacguaacaguagcacacacgggccaacacgaccucgucaucccaccaaacggcuacuuccgcuucgacucaugggucaaccaauucuacacccucgcccccaugggcaacggcaccggacgccgccgagcccucuaa

SEQ ID NO: 35361 - RNA, 1623 nt, Artificial Sequence
  derived and/or modified sequence opt11 from capsid_protein_VP1__Norovirus__AFX81325
augaaaauggccagcaacgacgcaaacccauccgacggcuccgcagccaaccucguacccgaagucucaaacgaagucauggcccucgaacccgucgucggcgccgccauagccgccccagucgccggacaacaaaacgucaucgacccauggauccgaaacaacuucguccaagcccccggcggcgaguucacuguauccccacgcaacgcaccaggcgaaauccuaugguccgccccacuaggccccgaccucaaccccuaccuaucacaccuagcccgcauguacaacggauaugcuggaggcuuugagguccaagucauacucgccggcaaugccuucaccgccggaaaaauaaucuucgccgccguucccccaaacuuucccaccgaaggccucucacccucacaagucaccauguucccacacaucauagucgacguucgccagcuagaacccguccucaucccgcuacccgacguccgcaacaacuucuaucacuacaaccaaaccaacgacuccacaaucaaacuaaucgccaugcuuuacacaccccuacgcgcaaacaacgccggagaagacguauucacagucuccugccgcguccuaacacgccccucccccgacuucgacuucaucuuccuggucccacccaccgucgaaucccguacgaaacccuucacuguuccaaucuuaacagucgaagaaaugaccaacucccgcuucccaauuccacucgaaaaacucuucaccggucccuccggcgcauucguaguccaaccccaaaacggccgcugcacaacagacggcguacuccucggcaccacccaauuaagcccagucaauaucugcaccuuccgaggcgacgucacucacaucgccggaagccgcaacuacaccaugaaucuggcgucacucaacuggaacaauuacgaccccacugaagaaauccccgcaccccucggcacccccgacuucgucggcaaaauccaagguguacucacucaaaccaccaaaggagacggcuccacacggggccacaaggccaccgucuacaccggaagcgcccccuucaccccaaaacucggaucuguacaauucuccacugacaccgaaaacgacuucgaaacacaucagaacacaaaauucacuccaguaggcguuauccaagacggaggcacuacccaccgcaacgaaccccaacaguggguccucccgucauacuccggccgcgacguccauaacguacaccuagccccugccguagcuccuacauuccccggagaacaacuccucuucuuccgcucuaccaugccaggaugcuccggcuacccaaacauggaccucgacugucuccucccccaagaauggguccaacacuucuaccaagaagccgcccccgcccaauccgacgucgcccuccuccguuucgucaaccccgacaccggcagaguccucuucgaaugcaagcugcacaaaucgggauacguaaccgucgcccacaccggucaacacgaccucguaaucccacccaacggauacuuccgauucgacuccuggguaaaucaauucuacacccucgcuccaaugggcaaugggacaggccgccgccgcgcccuauaa

SEQ ID NO: 35362 - RNA, 1623 nt, Artificial Sequence
  derived and/or modified sequence opt11 from capsid_protein_VP1__Norovirus__AGE89433
augaaaauggccuccaacgacgcaaacccaucugacggauccgcagcaaaccuagugcccgaaguauccaacgaagucauggcccucgaacccgucgucggcgccgccaucgccgcccccgucgcuggccaacaaaacguuauugaccccuggauccguaacaacuucguucaagcacccggcggcgaguucacuguuucucccagaaacgcaccuggagaaauccuaugguccgcuccucuaggaccagaccucaacccauaccucucucaccucgcccgaauguacaacggcuacgccggcggcuucgaaguccaaguaauccuagccggaaacgccuucaccgcaggcaaaaucauauucgccgcagucccucccaacuuccccaccgaaggacuuucccccucacaagucaccauguucccccacaucauagucgauguccggcaacuugaacccguccuaaucccccuaccugacguacgcaacaacuucuaccauuacaaccaaaccaacgacuccacaauaaagcucaucgcaaugcuauacacaccccuccgcgccaacaaugccggcgaagacgucuucaccguaagcugccgcguccuaacccgcccauccccagacuucgacuuuauauuccucgucccaccaaccgucgaaucucgaaccaaaccauucacagucccaauccuaaccgucgaagaaaugaccaacucccgcuuccccauuccccuagaaaaacucuucacaggacccucuggugccuucgucguacaaccccaaaacggucgcugcaccacugacggcguccuacucggcacaacacaacucucccccgucaacaucugcacauuccgcggcgacgucacccacaucgccggcucacgaaacuauaccaugaaccuagccucacuaaacuggaauaacuaugaccccaccgaagaaauucccgcaccccucggcaccccagacuucgucggcaagauccaaggaguccucacacaaaccaccaaaggcgacggcuccacccguggucacaaagccacuguauacaccggaagcgccccauucacccccaaauuaggcucaguacaauucuccacagacacagaaaacgauuucgaaacacaccaaaacaccaaguuuaccccagucggcgucauccaagacggagguaccacccaccgaaacgaaccccaacaauggguccucccaucuuauucaggcagagacguccacaauguccaccucgccccagccguagccccaaccuuccccggcgaacaacuccucuucuuccguuccacaaugcccggcugcucaggcuaucccaacauggaccuagacugccuacugccccaggaauggguccaacacuucuaccaagaagccgcacccgcccagucagacgucgcacuccucagauucgucaaccccgacacuggccgaguguuauucgaauguaaacuacacaaauccggauacgucaccgucgcccacacaggccaacacgaccucguaaucccucccaacggcuauuuccgcuucgacuccugggucaaccaauucuacacccucgcccccaugggaaacgguaccggccgccgccgcgcacuauaa

SEQ ID NO: 35363 - RNA, 1623 nt, Artificial Sequence
  derived and/or modified sequence opt11 from capsid_protein_VP1__Norovirus__AGE89436
augaaaauggcauccaacgacgccaacccuucugacggcuccgccgccaaccucguacccgaaguuuccaacgaagucauggcccucgaaccggucgucggcgccgcuauagccgccccagucgccggccaacaaaauguuaucgacccuuggauacgaaacaacuucguacaagcucccggcggugaguucacaguuucaccacgcaacgcccccggcgaaauacucugguccgccccacucggcccagaccucaaccccuaucuaucccaccuagcacgcauguacaacggcuacgcaggcggcuucgaaguucaagucauccucgccggcaacgccuuuaccgcagggaaaaucauuuucgccgcagucccaccuaacuucccaacagaaggccuuucacccucacaaguaacaauguucccacacaucauagucgacguacgacaacuagaacccguccucaucccucuaccugacguccgcaacaacuucuaccacuacaaucaaacaaacgacucuacaaucaaacucaucgccaugcuauacacaccccuccgcgcgaacaacgccggcgaagacgucuucacaguuucaugccgaguccuaacccgccccucccccgacuucgacuucaucuuucucgugcccccaaccgucgaaucccggacaaaaccauucaccgucccaauacucaccgucgaagaaaugacaaacucccgcuucccaauaccacuagaaaaacuauuuaccggucccucgggggccuucgucguccaaccccagaacggucgcugcaccaccgacggcgucuuacuaggaaccacccaacucucacccgucaacaucugcaccuuccgaggagacguaacccacaucgcuggcucacgcaacuauaccaugaaucucgccucacucaacuggaacaauuacgacccaaccgaagaaauccccgcaccccucggcacccccgauuuuguuggcaaaauccaaggaguacucacacaaacaacuaaaggcgacggaucuacacgcggccacaaggccacggucuacaccggaucagccccauucacucccaaacuuggcuccguacaauucagcaccgacaccgaaaacgacuucgaaacucaccaaaauacuaaguucaccccagucggcgucauccaagacggcggcaccacacaccgcaacgaaccacaacaauggguccuccccuccuauucaggucgcgacguccacaacguccaccucgcccccgccguugcgccgacauuccccggugaacaacuccuauucuuccgcuccaccaugccaggcugcuccggcuacccaaacauggaccucgacugccuccucccccaagaauggguccagcacuucuaccaggaagcagcccccgcacaauccgacgucgcccuccuccgauucgucaaccccgauaccggccgcguacuauucgaaugcaaacuacacaaaucuggcuacguaaccgucgcccacacaggccaacacgacuuagucaucccaccaaauggcuacuuccgcuucgauuccugggucaaccaauucuacacccucgccccaaugggcaacgguaccggccgacgccgugcccuuuaa

SEQ ID NO: 35364 - RNA, 1623 nt, Artificial Sequence
  derived and/or modified sequence opt11 from capsid_protein_VP1__Norovirus__AGE89439
augaaaauggccagcuccgacgccaaucccuccgacggcuccacagccaaccuaguccccgaaguaaacaacgaaguaauggcccuagaacccgucgucggggccgccauagccgccccagucgccggacagcaaaacguuauagaucccuggauccgcaacaauuucguccaagcaccugguggcgaauuuaccgucucaccccgaaacgcccccggagaaauacuauggucagccccacucggacccgaccucaacccuuaccucucacaccucgcccgaauguacaacggauacgccggaggcuucgaaguccaagucauccucgccggcaacgccuucaccgccggcaaaaucaucuucgccgccgucccacccaacuucccaaccgaaggccucucacccucacaagucaccauguucccccauaucaucgucgacguccgccaacucgaaccaguccucauuccccucccugacguucggaacaacuucuaccacuacaaucaauccaacgacccaaccauaaaacugaucgccaugcucuacacaccccuucgcgcuaacaacgccggcgacgacguauucacagucagcugucgaguccuuacccgccccuccccugacuucgacuucaucuuccuagucccacccacaguagaaucccgcaccaaacccuucuccguacccguacuuaccgucgaagaaaugacaaacucccgauuccccauuccccucgaaaaacuauucaccggacccucauccgcuuucgucguacaaccacagaacggcagaugcacaacugaugggguccuccuaggcaccacacaacuaagccccgucaacaucugcaccuuccgaggggacguaacccacauaccuggcucccgcaacuacacuaugaaccuugccagccaaaauuggaacucauacgacccgacugaagaaauccccgccccacucggcacccccgacuucguaggcaaaauccaaggcguccucacucaaaccacucgcaccaacggcucaacccgaggccacaaggccacuguuuacacuggauccgccgacuucuccccuaaacuaggcagaguccaauucgccaccgacaccgacaacgacuucgaaacaaaccaaaacaccaaauucacccccgucggcgucauccaagacggcuccaccaccccacgcaacgaaccccaacaauggguacuacccuccuacagcggucgcaacauucacaacguccaccucgcccccgccgucgcacccaccuucccuggcgaacaacuccuauucuucagauccacaaugcccgguugcucaggcuaccccaacauggaccucgacugccugcuaccccaagaauggguccaauacuucuaccaagaagcagcccccgcucaaucagacguagcauuacuccgguucgucaacccugacaccggccgcguacuguucgaaugcaagcuccauaaauccggcuacgucaccgucgcucacaccggacaacaugaccuugucauaccacccaacggcuacuucagauucgacuccuggguaaaccaauuuuacacacucgccccuaugggcaacggaacaggccgucgccgcgcccucuaa

SEQ ID NO: 35365 - RNA, 1623 nt, Artificial Sequence
  derived and/or modified sequence opt11 from capsid_protein_VP1__Norovirus__AGE89442
augaaaauggccucaucagacgccaaccccucagacggcagcaccgccaaccucguccccgaagucaacaacgaagucauggcacuagagcccgucgucggcgcugcaauagcagccccagucgcaggacaacaaaacgucaucgacccuuggauacgauccaacuucguucaagccccaggaggcgaguucacaguaucaccccgcaacgcaccuggcgaaauccucuggucugcuccccucggccccgaccucaaccccuaccucucgcaucuagcccgaauguauaacggcuacgccggcggcuucgaaguccaaguaauccucgccggcaacgccuucacagccgguaaaaucauuuucgccgccguacccccaaacuucccuaccgaaggccuaucaccaucucagguaacuauguucccccacauaaucguagacguacgccaacucgaacccguacuaaucccccuacccgacguccgcaacaacuucuaccacuacaaccagagcaaugacccuaccaucaaacucaucgcgaugcuauacacaccccuacgagcaaacaacgcaggggacgaugucuucaccgucuccugccgcguacucacccgcccaucaccagacuucgacuucauuuuucuagucccacccaccgucgaaucacgaaccaaaccuuucucagucccaguacucacagucgaagaaaugaccaacucccgcuuucccauaccccucgaaaaacucuucaccggacccucauccgcauucgucguccaaccccaaaacggaagaugcacaacagacgguguccuacucggcaccacccaacucucccccgucaacauaugcacuuuccguggugacgucacccacaucccuggcucacgcaacuacaccaugaaccucgccucacaaaacuggaacucauacgaccccaccgaagaaaucccugcaccccuaggcacccccgauuucguaggaaaaauccaaggcguccuuacccaaaccacccgcaccgacggcuccacccgcggucacaaagccacagucuacacaggaagcgcagacuucuccccgaaacucggccgaguccaauuugcaacagacacagacaacgacuucgaaaccaaccaaaacaccaaguucacuccagucggcguuauacaggacggcagcaccacccaccgcaacgaaccucaacaauggguacuccccucauacagcgggcgugacguccacaacguacaccucgcccccgccgucgcaccuaccuuccccggugaacaacuccuauucuuucgcucuaccaugcccggcuguuccggauaccccaacauggacuuagacugccuccuaccccaggaauggguacaauauuucuaccaagaagccgcccccgcccaaucagacgucgcucuccuacgauucguaaacccggacacaggccgcguacucuucgaaugcaaacuccacaaaucaggauacgucacaguugcccacaccggccaacacgaccucgucaucccacccaacggcuacuuccgcuucgacucauggguaaaccaauucuacacccuugcccccaugggcaacggaaccggccgacgccgcgcucuauaa

SEQ ID NO: 35366 - RNA, 1623 nt, Artificial Sequence
  derived and/or modified sequence opt11 from capsid_protein_VP1__Norovirus__AGE89445
augaaaauggcaaguuccgacgcaaaccccagugauggcuccaccgcaaaccucgugcccgaagucaauaacgaagucauggcacucgaacccguagucggcgcagcgaucgcugccccaguagcaggccaacaaaacguaauagacccauggauccgauccaacuucguccaagcaccaggcggcgaauuuacaguaucaccacgcaacgccccuggugaaauccucugguccgcuccccucggcccagaucucaacccguaccuaucccaccucgcccgcauguacaacggauaugccggcggcuucgaaguccaagucauacuggccggcaacgccuucacagccggcaagaucaucuucgccgccguaccacccaacuuccccacagaaggacuaucccccagccaaguaacgauguucccccacauaaucgucgacguucgccaacuggaacccguccuuauaccacuccccgacgucagaaauaacuucuaccacuacaaccaauccaacgaccccaccaucaaacucaucgccaugcuauacacaccccuccgcgcuaacaacgccggugacgacgucuucaccguauccugccgaguacuaacccgccccucccccgacuuugauuucaucuuccucguaccacccaccgucgaaucacgaaccaaacccuucuccgucccaguccucaccgucgaagaaaugaccaacucccgcuuccccauaccccucgaaaaacuauucacuggucccuccagcgccuucgucguacaaccacaaaauggccgaugcacaaccgacggcguccuccucggcaccacccaacuaucccccgucaacauaugcaccuuucgaggcgacguuacacacaucccaggaucucgaaacuacacaaugaaccucgccucacaaaauuggaacuccuacgaccccaccgaagaaaucccugccccacucggaacaccugacuucguaggcaaaauccaaggaguccucacccaaacaacccgaaccaauggcucaacccgaggucacaaggcaaccguuuauacaggcuccgccgacuucagcccaaaacuaggcagaguacaauucgcuacagacacagacaaugacuucgaaaccaaccaaaacaccaaauucacacccgugggcgucauccaagauggauccaccacgccccgaaacgaaccccaacaauggguucuacccucauacuccggucgcaauauccauaacguccacuuagccccagccguagcuccaaccuucccaggcgaacaacuccucuucuuccgcuccaccaugcccggaugcuccggauaccccaacauggaucucgauugcuuacucccacaagaauggguccaauacuucuaucaagaagccgcccccgcacaaucagacgucgcccuccuacgcuucgucaaccccgacaccggccgcguccuauucgaauguaaacuccacaaaucaggauacgucacggucgcccauacaggacaacacgaucugguuauaccacccaacggauacuuccgcuucgacuccugggucaaccaauucuacacccucgcccccaugggcaacggcaccggccgacggcgcgcccucuaa

SEQ ID NO: 35367 - RNA, 1623 nt, Artificial Sequence
  derived and/or modified sequence opt11 from capsid_protein_VP1__Norovirus__AGE89448
augaaaauggccucaucagacgccaaucccuccgacggcucaacagccaaucuagucccagaaguuaacaacgaagucauggcacuagaacccgucguaggcgccgccaucgcggcccccgucgcuggccaacaaaacgucauugaccccuggauccgcaacaacuucguccaagcgccaggaggggaguucacagucucaccccgcaaugccccaggcgaaauccucugguccgccccucucggccccgaccuaaaccccuaccucucccaccucgcccgcauguacaacggcuacgccggcggcuucgaaguucaagucauccucgcaggcaaugccuucacagccggaaaaauuaucuucgcagcuguaccaccaaacuucccuacugaaggccucucacccucacaagucacaauguucccccacaucaucgucgacguacgccaacucgaaccaguccucaucccccugcccgacguacgcaacaacuucuaccacuauaaccaaucaaacgacccaaccaucaaacuaaucgccaugcuauacacaccccuccgcgcuaacaacgccggagacgacguauucaccguaagcugccgcguccucacccgccccuccccugauuucgacuucauauuccuagucccucccaccgucgaaucaagaaccaaacccuucuccguccccguacuaacagucgaagaaaugaccaacucucgcuuccccaucccacuugaaaaacuuuucaccggccccuccuccgcuuucgucguccaaccucaaaacggacgaugcaccacagacggcguccuacucggcaccacccaacuaagcccagucaacauaugcaccuuccgcggagacgucacucacauccccggaucccgcaacuacacuaugaaccuagccucccagaacuggaacucauacgaccccacagaagaaauccccgcaccccucggcacacccgacuucgucggaaagauccaaggcguauuaacccaaaccacacgaaccaacggauccacacgaggccacaaagccacugucuacacaggcucagccgacuucucccccaaacuuggccgcguccaauucgcaaccgacaccgacaacgacuuugaaacaaaccaaaacacaaaauucacaccaguaggugucauccaagacggcucaaccacgccaagaaacgaaccccaacaaugggucuuacccagcuacuccggaagaaacauacacaacguccaccucgcccccgccguugcacccaccuucccaggcgaacaacuccuauucuuucgcagcacaaugcccggcugcucaggauaccccaacauggaccucgacugccuccucccccaggaauggguccaauacuucuaccaagaagcggcccccgcccaaucagaugucgcauuacuacguuucgucaaccccgauaccggccgcguccuuuucgaaugcaaacuucacaaguccggauacgucaccgucgcccacacaggucaacacgaccuggucaucccuccuaacggauauuuccgcuucgacuccugggucaaccaauucuacacccucgcccccaugggcaauggcaccggccgacgacgcgcccuuuaa

SEQ ID NO: 35368 - RNA, 1623 nt, Artificial Sequence
  derived and/or modified sequence opt11 from capsid_protein_VP1__Norovirus__AGE89451
augaaaauggccuccaacgacgccaacccguccgacggauccgccgcaaaccucgucccugaagucucaaacgaagucauggcccucgaaccaguaguuggcgccgccaucgcugcucccgucgcuggacaacaaaaugucaucgacccauggauccgcaacaauuucguucaagcccccggaggcgaguucaccgucagcccaagaaacgccccaggcgaaauccucuggucagcaccccucggccccgaccuaaaucccuaccucucccacuuagcccgcauguacaacggcuacgccggcggcuucgaaguccaagucauccuagccggcaacgccuucacagccggcaaaaucaucuucgccgccgucccuccuaacuuccccaccgaaggacuaucccccucucagguuaccauguucccccacaucaucgucgacguacgccaacuagaacccguacucaucccacuaccugauguaagaaacaacuucuaccauuacaaccaaaccaaugacucaacaauuaaacuuaucgccaugcucuacacuccccuacgcgccaacaaugccggcgaagacgucuucaccgucuccugccguguccuuacucgccccucaccagacuucgacuucaucuuccucgucccacccaccguagaaucccgcacaaagcccuucacuguaccaauccucacagucgaagaaaugacaaacucaagguuucccauaccccucgaaaaacucuucacuggccccucuggcgccuucgucguucagccccaaaacggacgaugcaccaccgacggcguccuccucggaaccacccaacuuucacccgucaacaucugcacauuccgcggcgacguuacacauaucgccggcucccgcaacuacacuaugaaccuagccucucucaacuggaacaacuacgaucccacagaagaaauucccgcaccccucggcacacccgacuucguaggcaaaauccagggcguacuuacccaaacaacuaaaggcgacggcuccacucgcggucacaaggccacagucuacaccggaagcgcccccuucacaccaaaacuaggcuccguccaauucuccaccgauaccgaaaacgacuucgaaacccaccaaaacaccaaauucacccccgucggcguaauucaagacggagggacaacccaucgcaaugaaccccaacaauggguacuccccuccuacuccggacgagacguccacaacguccaccuugccccagccgucgcacccaccuuuccaggcgaacaacuccucuucuuccgauccacaaugcccggaugcucaggcuaccccaacauggaccucgacugccuccuaccccaagaauggguacaacauuucuaucaagaagcagcccccgcccaauccgacgucgcccuccuccgcuucguaaacccagauacaggccgaguccucuucgaaugcaaacuccacaaaucaggauaugugaccgucgcccauaccggacaacacgaccucgucauacccccaaauggauacuucagauucgacuccugggucaaucaauucuacacccucgcacccaugggaaacggaaccggccggcgccgcgcccucuaa

SEQ ID NO: 35369 - RNA, 1623 nt, Artificial Sequence
  derived and/or modified sequence opt11 from capsid_protein_VP1__Norovirus__AGE89454
augaaaauggcauccaacgacgccaacccauccgacggaagugcagccaaccucgucccagaaguauccaacgaaguaauggcucucgaacccguagucggcgcagcaaucgcagcacccgucgccggccaacaaaaugucaucgacccguggauccgcaacaacuucguccaagcaccaggcggagaguucacugucucaccccgcaacgcucccggcgaaauacucuggggcgcaccccucggccccgaccucaaccccuaccucucccaccuagcccgcauguacaacggcuaugccgggggcuucgaaguccaaguuauacucgccggcaacgccuucaccgccgguaaaauaaucuuugccgccgucccacccaacuuccccacagaaggccucucccccucgcaagucaccauguucccacacaucauagucgacguccgccaacuugaaccaguccucauaccccucccagacguccguaacaacuucuaccacuacaaccaaaccaacgauuccacgauuaaacucaucgccaugcucuauacuccccuccgagcaaacaacgccggcgaggacgucuucaccguaucaugccgcguccucacccgacccucuccagacuucgacuucaucuuccucguaccacccacaguagaaucacgcaccaaacccuucacuguacccauccuuaccguagaagaaaugaccaacucucguuuccccauaccccuagaaaaacucuucaccggaccauccggugcauuugucguccaaccccaaaacggccgaugcaccaccgacggcguccuccucggcacaacccaacuaucacccgucaacaucugcacauuucgaggcgacgucacccacaucgccggcagccguaacuauaccaugaaccucgcuucacucaacuggaauaacuacgaccccaccgaagaaauucccgcaccccucggaacacccgacuucgucggcaagauccaaggcguccucacacaaaccaccaaaggcgacggaagcacccgcggacacaaagccacagucuacacaggcucugcccccuucacacccaaacucggcucaguacaauucagcaccgacaccgaaaacgacuuugaaacccaccaaaacaccaaauucacaccagucggagucauccaagacggcggcacgacacaccguaacgagccccaacaauggguucuacccuccuacuccggccgcgacguccauaacguccaucucgcuccagcuguagcuccaaccuuccccggcgaacaacuccuauucuuccgaucuacuaugccgggcugcuccggauacccuaacauggaccuagacugccuacucccccaagaauggguacaacacuucuaucaagaagccgcccccgcacaaucagacgucgcacuccuccgcuucguuaacccugacacaggccgaguccucuucgaaugcaaacuccacaaauccggcuacguaacaguggcccacaacggccaacacgaccucgucauaccgcccaacggcuauuucagauucgacucauggguuaaucaauucuacacacuagccccaaugggcaauggaaccggacgacgacgcgcccuauaa

SEQ ID NO: 35370 - RNA, 1623 nt, Artificial Sequence
  derived and/or modified sequence opt11 from capsid_protein_VP1__Norovirus__AGE89457
augaaaauggccuccaacgacgcgaaucccagcgacggcagcgcagcaaaucucguccccgaagucucaaacgaagucauggcccucgaacccgucguaggagccgccaucgcagcccccgucgccggccaacaaaacgucaucgaccccuggauucgaaacaacuucguacaagcacccggcggcgaguucaccgucagcccccgcaacgccccuggcgaaauccucugguccgcaccccuaggcccagaccucaaccccuaccucucgcaucucgcacgcauguacaacggcuacgccggagguuucgaaguccaaguaauacuagccggaaacgcauucaccgcuggcaaaauaauauucgccgcagucccucccaacuuccccacugaaggacucucacccagccaaguuaccauguucccccacaucauaguagacguccgacaacuagaacccguccucauaccacuacccgacguccgaaauaacuucuaccacuauaaccaaaccaacgacuccacaaucaagcucauagcuaugcucuacacuccccuccgagccaacaacgccggugaagacguauucaccgucuccugccgcguucuaacacgcccuuccccugauuuugacuuuauauuucuaguacccccaaccgucgaaucccgaaccaaacccuucaccgucccaauacucaccguugaggaaaugaccaacucccgauuccccauaccacuagaaaaacucuucacaggacccuccggcgccuucgucguccaaccccaaaacggccgcugcacuacugacggcguacuucugggaacaacacagcucucaccagucaacaucuguacauuccgcggcgacgucacccacaucgccggcucucgcaacuacacaaugaaccucgcaucccucaacuggaacaacuacgaccccaccgaagaaauaccugccccacuuggaacacccgacuucguaggaaaaauccaagguguccuaacucaaaccaccaaaggcgacggcuccacccgcggacacaaagcaaccguauacacaggcuccgcccccuucacaccuaaacucggcaguguacaguucagcaccgacacagaaaacgacuucgaaacacaccaaaacacaaaauucacccccgucggcguuauccaagacggaggcaccacccaccgcaacgaaccccaacaauggguacuccccucauacucaggccgcgacguccacaacguccaccucgccccugccguagcgcccaccuuccccggcgaacaacuucucuucuuccgcucaaccaugccaggcugcucaggauacccaaacauggaccucgacugccuacucccccaggaauggguccaacacuucuaccaagaagccgcgcccgcucaaucugacguagcccuacuacgauucgucaaccccgacacuggcagaguacuuuucgaaugcaaacuccacaaauccggcuacgucaccguagcccacaccgggcaacacgacuuagucauaccgcccaacggcuacuuccgauucgacuccuggguaaaccaauuuuacacccuagcccccaugggaaacggcaccggccgccgcagggcccucuaa

SEQ ID NO: 35371 - RNA, 1623 nt, Artificial Sequence
  derived and/or modified sequence opt11 from capsid_protein_VP1__Norovirus__AGE89460
augaaaauggcaucaaacgacgcaaaccccuccgacgguucugccgccaaccuugucccagaaguauccaaugaaguaauggcacucgaacccgucgucggcgccgcaaucgccgcccccgucgccggccaacaaaacguaauagaccccuggauacgcaacaacuucguacaagcgccugguggcgaauuuacagucucaccccguaaugcacccggcgaaauucucuggucagccccacucggcccugaccuuaaccccuaucucucacaccuagcccgcauguacaacggcuacgccggcggcuucgaaguucaagucauccucgcuggcaaugccuucaccgcuggcaagaucaucuucgccgccguuccucccaacuucccaaccgaaggccuaucucccucccaagucaccauguucccccacaucaucgucgacguccgacaacuggaacccguccucauccccuuacccgacguccgaaacaacuucuaccacuacaaucaaacaaacgacuccaccaucaaacuaaucgccaugcuauacacaccccucagagccaacaacgccggugaagacguauuuaccguauccugccgcguccucacccgcccuucacccgacuucgacuucauauuccucguaccacccaccgucgaaucccgcaccaaacccuuuaccgucccaauccuaacagucgaagaaaugacaaauucccgcuuccccauaccccuagaaaaacucuucacagggccauccggugccuuuguaguccaaccccaaaacggccguugcaccaccgacggcguacuccuuggcaccacccagcucuccccugucaauaucugcaccuuccgcggggacgucacccacauagccgguucccgaaacuacacuaugaacuuagccucacucaacuggaacaacuaugaccccaccgaagaaauccccgcaccacucggcacccccgacuucgucgguaaaauccaaggcgugcuuacccaaaccaccaaaggggacgguuccacucgcggccacaaagccaccguauacacaggauccgcccccuuuaccccaaaacucggcuccguccaauucucaaccgauaccgaaaacgacuuugaaacucaccaaaacaccaaauucacaccaguaggaguaauacaggacggcggcaccacucaucgaaacgaaccccaacaauggguccuacccuccuacucgggucgcgacguccacaacguccaccuggcaccagccgucgcacccaccuucccaggagaacagcuccucuucuuccgaucaaccaugccaggaugcucaggcuaccccaacauggaccuagacugccuccuaccacaagaauggguccaacacuucuaccaagaagccgcccccgcccaaucagacguugcccuccuccgcuucgucaaccccgacacuggcagaguccuuuucgaaugcaaacuccauaaauccggauacguuaccgucgcccacaccggacaacacgaccucgucaucccucccaauggcuacuuucgauuugauucauggguaaaccaauucuacacccucgcacccaugggaaacggcacaggacgacggcgcgcacucuga

SEQ ID NO: 35372 - RNA, 1623 nt, Artificial Sequence
  derived and/or modified sequence opt11 from capsid_protein_VP1__Norovirus__AGE89463
augaaaauggcuuccaacgacgccaaccccucagacggcucagcagccaaccuaguacccgaagucucgaacgaagucauggcccucgaacccguaguuggugcagcaaucgcagcccccgucgcaggccaacaaaacgucaucgaccccuggaucagaaacaacuucguccaagccccaggcggcgaauuuacagucucuccccgcaacgcacccggagaaauacucugguccgcaccccucggccccgaccucaaccccuaccuaucacaccucgccagaauguacaacggcuacgccggcggcuucgaaguccaaguaauucucgccggcaaugcuuucacagcuggcaaaauaauuuuugccgccguacccccaaacuuucccacugagggccucucccccucccaaguuaccauguucccccacauaaucgucgacguacgccaacuagagccaguccuaaucccccuccccgacguacgcaacaacuucuaucacuacaaccaaacaaacgacuccaccauaaagcucauagccaugcucuacacaccccuccgcgcaaacaacgcaggcgaagacguauuuaccgucucuugccgcguccucacccgacccuccccugacuucgacuucaucuuccucguacccccaaccgucgaaucccgcaccaaaccauucacaguccccauccucacaguugaagaaaugacaaacucccgauuucccaucccacucgaaaaacuauucaccggcccauccggcgccuucgucguacaaccccaaaacggccgcugcacuaccgacggaguacuccucggcaccacacaacucucacccgucaacaucugcaccuuucgaggagacgucacccacaucgccggaagccgcaacuacacaaugaaucucgcgucccucaacuggaacaacuacgacccuacagaagaaauccccgcgccccucggaaccccagacuucguuggcaaaauccaaggcguccucacccaaaccacaaaaggcgacggcuccacccgaggccacaaagccacaguauauaccggcuccgcuccauucacacccaaauuaggcuccguacaauucucuacagacaccgagaaugacuucgaaacacaccaaaauacgaaauucacccccgucggagucauccaagacggcggaaccacacaccgcaacgaaccccaacaauggguccucccaucguacaguggacgcgacguccacaacguacaccuugcaccagcaguagcgcccaccuuccccggcgaacaauuacucuucuuucgaagcaccaugccaggcugcucuggauacccaaacauggaccucgacugccuacucccccaagaauggguucaacacuucuaccaagaagccgcacccgcccaaucagacgucgcacuccuacguuucgucaaccccgacaccggacgcguacucuucgaaugcaagcuccacaaauccggauacgucaccgucgcccacacaggccaacacgaccuagucaucccacccaacggcuauuuccgcuucgauuccuggguuaaccaauucuacacccucgcucccaugggaaacggcaccggccgccgacgagcacucuaa

SEQ ID NO: 35373 - RNA, 1623 nt, Artificial Sequence
  derived and/or modified sequence opt11 from capsid_protein_VP1__Norovirus__AGE89466
augaaaauggcauccaacgaugcaaacccaucagacggcucagccgccaaccucguccccgaaguaucaaacgaaguuauggcccuagagccagucgucggcgccgccaucgcagccccagucgcaggccaacaaaacgucauagacccauggauccguaacaacuucguccaagcccccggaggugaguucacaguaucaccccgcaaugccccaggcgaaauccuuugguccgccccacucggccccgacuuaaaucccuaccucucccaccucgcccguauguacaacggcuacgcaggcggcuucgaaguacaagucauccuugcaggcaaugcauucaccgcaggcaaaaucauuuucgccgccgugccgcccaacuuuccaaccgaaggccucucccccucccaagucaccauguucccccacauaauugucgacguccgccaacuagaaccaguucuuaucccacucccugacgucagaaacaacuucuaccacuacaaccaaacaaacgacucaaccaucaaacuaauagccaugcuuuacaccccacugagagcuaacaacgccggcgaagacgucuucacagucucaugccgaguccucacccgccccuccccagacuucgacuucauauuccucgucccacccacugucgaaagccguaccaaacccuucacaguacccauacucacaguagaagaaaugaccaacuccagauuccccauaccccucgaaaaacuauucaccggucccucaggcgccuucgucgugcaaccccaaaacggacgcuguaccaccgacggcguccuucucgguaccacccaacucucccccgucaacaucugcaccuucagaggcgacgucacucacaucgccggaucacgcaauuacacaaugaaccucgccucccucaacuggaacaacuacgaccccaccgaagaaaucccagcaccccuaggcacuccugacuucgucggcaaaauccaaggaguccuaacacaaacaaccaaaggugacggcagcacaagaggccacaaggccacaguauacacaggcuccgcccccuucaccccaaaauuaggaucaguacaguucucaacagacacagaaaacgacuuugaaacccaccaaaauacaaaauucaccccaguuggcgucauccaagacggaggaacaacacaucgcaacgaaccccaacaauggguacuccccucuuacagcggccgcgauguccauaacguucaccuugccccagccgucgccccaacauucccaggcgagcaacuccuauuuuuccgcuccaccaugcccggaugcucaggcuaccccaacauggaccucgacugccuccuaccccaagaauggguccaacacuuuuaccaagaagccgcccccgcacaauccgacguugcccuccuccguuucgucaacccugauaccggcaggguccucuuugagugcaaacuucacaaauccggcuacguaaccgucgcccacacaggccaacacgaccuagucaucccucccaacggcuacuuccgauucgacucaugggucaaccaauucuacacucucgccccaaugggcaacggaaccggccgacgccgagcccucuaa

SEQ ID NO: 35374 - RNA, 1623 nt, Artificial Sequence
  derived and/or modified sequence opt11 from capsid_protein_VP1__Norovirus__AGE89472
augaaaauggccagcaacgacgcaaaccccuccgacggcucagcagccaaccucguaccggaaguauccaacgaagucauggcauuagaaccuguagucggcgcagcuaucgcagcacccguugccggacaacaaaacgucaucgaccccuggauaagaaacaacuucguacaagcccccggaggcgaguucacagucagcccccgcaacgcuccaggagaaauccucuggggcgccccacucggccccgaccucaaucccuaccucagccaccucgcccgaauguauaacggauacgccgggggcuuugaaguccaaguaauccuagcagguaacgcauuuaccgcaggcaaaaucaucuucgcggccguaccaccaaacuucccaaccgaaggccucucccccucccaagucacgauguuuccccacaucaucgucgacguaagacaacucgaaccaguccuaaucccacuucccgacguccgaaacaacuucuaccacuacaaccagaccaaugacucaaccauuaaacucauagcaauguuauacacaccccuccgcgccaacaacgcuggcgaagacguauucaccgugucuugcagaguucuaacccgcccaucccccgacuucgacuucaucuuccucguaccgcccacggucgaaagccgcaccaaacccuuuacagucccaauccucacaguagaagaaaugaccaacagccgcuuccccaucccacuagaaaaacucuucaccggcccuuccggagccuucgucguccaaccacaaaacggucgcugcaccaccgacgguguccuccuaggaaccacacaacuaucaccuguaaacaucugcacauuccgcggugacgucacccacauagccggcucccgcaacuacacaaugaaccuggccucccuaaacuggaacaacuacgaccccacagaagaaauucccgcaccccucggcacucccgauuucguagguaaaauacaaggcguacuuacccaaacuaccaagggagacgguaguacccgcggccacaaagccaccguauacaccggcucagccccauucacuccuaaacuaggauccguacaauucagcaccgauaccgaaaacgacuucgaaacccaccagaacaccaaauucacccccgucggcguaauccaagacggaggcaccacacaccgcaacgagccccaacaauggguucucccaucuuacuccggccgcgacguccacaacguccaccucgccccugccguagccccaacauuucccggcgaacaacuccucuuuuuccguuccaccaugccaggcugcagcggcuaccccaacauggaccuugacugccuacucccccaagaauggguacaacacuucuaucaagaagccgcccccgcccaaucagacguagcucuacuacgauucgucaaccccgacacaggaagaguccucuuugaaugcaaacuacacaaaagugguuacgucaccgucgcccacaacggacaacacgaccucguuauacccccaaacggauauuuccgcuucgacagcuggguaaaccaauucuacacacucgcaccaaugggcaacgguaccggacggcgcagagcacuauaa

SEQ ID NO: 35375 - RNA, 1623 nt, Artificial Sequence
  derived and/or modified sequence opt11 from capsid_protein_VP1__Norovirus__AGE89475
augaaaauggccuccaacgacgcaaaccccagcgacggauccgccgccaaccuaguccccgaagucuccaacgaagucauggccuuagaaccaguugucggcgccgcaaucgccgcacccgucgccggccaacaaaauguuauagaccccuggauacgcaacaauuucgugcaagccccuggaggagaguucaccgucuccccucgcaacgcccccggcgaaauccuuugguccgcaccccuaggaccagaucuaaacccuuaccucucccaccuagcccgaauguacaacggauaugccggcggcuucgaaguccgcguaauccuugccggaaacgccuucaccgccggcaaaaucaucuucgccgccgucccaccaaacuucccaacagaaggacuaucccccucccaagucaccauguucccucacaucaucgucgacguccgccaacucgaaccuguccuuaucccccuccccgaugucagaaacaacuucuaucacuacaaccagaccaacgacuccacuauaaaacucauagccaugcuauacacccccuuacgagccaauaacgccggcgaagaugucuucaccguuagcugccgcguacucacccgcccauccccagacuucgacuucaucuuucuaguaccucccaccgucgaaucucgcaccaaacccuucaccguccccauacuaaccguggaagaaaugacaaacucacgauucccaauacccuuagaaaaacuauuuaccggacccucaggagccuucguuguccaaccccaaaauggucgcuguacaacagacggcguacuccucggcaccacccaacugucaccuguaaacaucugcacauuccgcggcgacgucacccacaucgccggcucgcgaaacuacacaaugaaccucgcaucccucaacuggaacaauuacgacccaacagaagaaauccccgcaccccucgggaccccagacuucgucggaaaaauccaaggcguucucacacagaccacaaaaggcgacggaucaacacgaggucacaaagccacagucuacaccggcuccgccccauucacaccaaaacuaggaucuguccaauucagcaccgacaccgaaaacgacuucgaaacccaccaaaacaccaaguucacccccgucggcgucauccaggacggcggcaccacccaccgcaacgaaccccaacaauggguccucccuuccuacagcggacgcgauguccacaacguccaccucgcccccgccgucgcccccaccuuucccggagaacaacuccuauuuuuccgcuccaccaugccaggcugcuccgguuacccaaacauggaccucgacugccuacucccacaagaaugggugcaacacuucuaccaggaggccgcaccagcacaaucagacguagccuuacuccgcuucgucaaccccgacacaggccgaguccucuucgaaugcaaacuccacaaauccggcuacgucaccgucgcacacacaggccaacacgaccuggucaucccacccaacggcuacuucagauucgacuccuggguuaaccaauucuacacucuagcacccaugggcaauggaacuggacgacgccgcgcccucuaa

SEQ ID NO: 35376 - RNA, 1623 nt, Artificial Sequence
  derived and/or modified sequence opt11 from capsid_protein_VP1__Norovirus__AGE89478
augaaaauggccuccaacgacgcaaaccccagcgacggcucagccgcuaacuugguccccgaggucuccaacgaagucauggcccuugaaccagucguaggugcugccauagcagcacccgucgccggccagcaaaacguuauagacccuuggauacgcaacaacuucguccaagcucccggaggcgaguucaccguaucaccccgcaacgcccccggcgaaauccucugguccgccccucucggccccgaccucaaccccuaccuaucccaccucgcacgaauguacaaugguuacgccggcggcuucgaaguacaagucauccuagccggcaacgccuuuacagccggcaaaauaauuuucgcagcaguaccacccaacuuccccaccgaaggccucucucccucacaaguaaccauguucccccacaucaucgucgauguccgccaacucgaacccguccucaucccccuccccgacguccgcaacaacuucuaccacuacaaccaaacaaacgacuccacaauuaaacucaucgccaugcucuacaccccacuccgugccaacaaugcaggcgaagacgucuucaccgucuccugccggguccugacccguccaucacccgacuucgacuucauuuuccuagugcccccuaccgucgaaucccgcaccaaaccauucacggucccaauacuaaccgucgaagaaaugaccaacuccagauuccccaucccucuugaaaaacucuuuaccggucccucaggcgccuucgucguacaaccccaaaacggccgcugcaccaccgacggcguacuucuaggcacaacccaacucucccccguuaauaucugcaccuuccgcggcgacgucacacauauagccggaucccgaaacuacacuaugaaccuagccucacucaacuggaacaacuacgacccaaccgaagaaaucccagcaccccucgguacaccagacuucguaggcaaaauacaaggaguccucacccaaaccaccaaaggcgacggcuccacucguggacacaaagccacaguauacaccggauccgccccguucacccccaaacucggauccguccaauucucaacagacacagaaaacgacuucgaaacucaccaaaauaccaaauucacccccguaggcguuauccaagacggcggcaccacccacagaaacgaaccccaacaauggguccuacccucauacuccggacgcgauguccacaacguucaccuagccccugccguagccccuaccuuucccggcgaacaacuccuuuucuuccgcucaaccaugcccggcugcuccggcuaccccaacauggaccucgacugccuacucccccaagaaugggugcaacacuucuaccaagaagccgcccccgcccaaucagacguagcccuacuccgcuucguaaacccagauaccggcagaguacucuuugaaugcaaacuccacaaaucuggauacgucacagucgcccacaccggacaacaugaccucgucaucccuccaaacggauacuuccguuucgacuccugggucaaccaauucuacacccucgcaccaaugggaaacggcaccggacgucgacgugccuuauaa

SEQ ID NO: 35377 - RNA, 1623 nt, Artificial Sequence
  derived and/or modified sequence opt11 from capsid_protein_VP1__Norovirus__AGE89481
augaaaauggcuucaaacgacgccaauccauccgacggauccgccgccaaccucgucccagaagucagcaacgaaguaauggcgcucgaaccaguagucggcgccgcaaucgcugccccagucgccggccaacaaaacgucauagaccccuggaucagaaacaacuucguccaagcaccaggcggagaguucacagucucaccccgcaacgcccccggagaaauacucugguccgcaccccuaggccccgaccucaacccguaccuaucccaccucgcccgcauguauaacggcuacgccggcggauucgaaguacaagucauacuagccggaaacgccuucacagcaggcaaaauaauauucgccgccgucccacccaacuucccuacugaaggacucucccccucccaagucaccauguucccacacaucaucgucgacguucgacaacucgaacccguccuaaucccccuaccagacguccguaacaacuucuaccacuacaaccaaaccaacgacucaaccaucaaacuaauagcaaugcucuacacaccccuucgagcaaacaacgccggugaagacgucuucaccgucuccugccgaguccucacccgcccaagucccgacuucgacuucaucuuccuaguacccccgacagucgaaucccgaaccaaacccuucaccguccccauccucaccgucgaagaaaugacaaacucucgcuucccgaucccccucgagaaacucuucaccggcccuuccggcgcauucgucguccaaccacaaaacggccgcuguaccaccgacggagucuuacucggcaccacccaacucuccccgguaaacaucugcaccuuccggggcgacgucacccauaucgcuggcucucgaaacuacaccaugaaccucgcaucccuaaacuggaacaacuaugaccccaccgaggaaaucccugcaccccucggcacacccgacuucgucggcaaaauacaagggguacucacccaaaccaccaaagaagacggcuccacccgaggacacaaggccaccgucuacaccggcuccgcacccuuuacuccaaaacuaggcuccguacaauucuccacggacaccgagaacgauuucgaaacacaucaaaacaccaaauucacaccaguaggcgucauccaagacggcggcaccacccaccguaaugagccccaacaauggguacucccauccuacucaggacgcgacguacacaacguacaccuugcccccgccgucgcccccacauuccccggagaacaacuccucuucuuccgcuccacgaugccaggcugcucuggcuaccccaacauggaccuagauugccuccucccacaagaauggguacaacacuucuaccaagaggcagccccagcccaaucugacguagcccuccuccgguucguaaaccccgacacaggccgcguccucuucgaaugcaaacuccacaaaagcggcuacgucacugucgcucauaccggacaacacgaccuagucaucccaccaaacggauacuuccgcuucgacucaugggucaaccaauucuacacccuagcacccaugggaaauggcaccggccgucgcagagcccuuuaa

SEQ ID NO: 35378 - RNA, 1623 nt, Artificial Sequence
  derived and/or modified sequence opt11 from capsid_protein_VP1__Norovirus__AGE89490
augaaaauggcauccaaugacgcaaaccccucugacggcuccgccgccaaucugguacccgaaguauccaacgaaguaauggcccucgaacccgucguaggcgcugcaaucgcagccccugucgccggccaacaaaacgucaucgacccauggauccgcaacaacuucguacaagcccccggcggcgaguucaccgucuccccacgaaacgcaccaggagaaauccucugguccgcaccccuaggccccgaucucaaucccuaucuuucccaccucgcaagaauguacaaugguuacgcaggcggcuucgaaguccaagucauccuagcaggcaacgccuuuaccgcaggcaaaaucaucuucgccgccgugcccccaaacuuccccaccgaaggccuuucccccucacaagucaccauguucccccacauaaucgucgacguccgacaacucgaaccuguccucauaccccuccccgacguccgcaacaacuucuaccacuacaaccaaaccaacgacucaacaaucaaacugaucgccaugcuauacacccccuuacgcgccaacaacgcaggcgaagacgucuucaccgucucaugccgaguccucacccgaccaucaccagacuucgacuucaucuuccucguuccacccaccguagaauccagaacuaaacccuucaccguacccauacucacagucgaagaaaugaccaacucccgauuccccaucccccucgaaaaacucuucaccggccccucaggcgccuucgucguccaaccucaaaacggcagauguacaacagacggaguucuccucgguacaacacaacuauccccagucaacauaugcacauuccgcggcgacguaacucacauagcgggcucccgcaacuacacaaugaaucucgcgucccucaacuggaauaacuacgacccaaccgaagaaauccccgccccacuaggcacacccgacuucgucggaaaaauccaaggcguucuuacccaaacuacuaaaggcgacggcuccacccgcggucacaaagccacgguauacaccggcucggccccauucacaccgaaacucggcuccguucaauucuccaccgauaccgaaaacgauuucgaaacacaccaaaacaccaaauucaccccgguaggcguaauacaggacggcggaaccacccaccgcaacgaaccccaacaauggguccuccccucauacuccggaagagacguccacaacguccaccucgcacccgccgucgccccaacauuccccggugaacaacuucuauucuuccguagcacaaugccaggcugcuccggcuaucccaacauggaccuagauugccuccuaccccaagaauggguccaacacuucuaccaggaagcagcccccgcacaaucugacguagcccuccuccgguucguaaaucccgacaccggacgcguucucuucgaaugcaaacuucacaaauccggauacgucacuguugcccacacgggacaacacgaccucgugauaccacccaacgguuacuuccgauucgacuccuggguuaaccaauucuauacacucgcacccaugggcaacggaacuggccgucgcagagcacucuaa

SEQ ID NO: 35379 - RNA, 1623 nt, Artificial Sequence
  derived and/or modified sequence opt11 from capsid_protein_VP1__Norovirus__AGE89493
augaaaauggccagcaaugaugccaaccccuccgacggaucagccgcuaaccucguccccgaagucuccaacgaagucauggcccucgaacccgucguaggcgcagccaucgccgcccccguagccggccaacaaaacgucauagaucccuggauccgcaacaacuucguccaagccccuggcggagaguucaccgucucaccaagaaacgccccaggcgaaauccucugguccgccccucucggcccagaccucaaccccuaccucucacaccuagcccguauguacaacggcuaugccggcggcuucgaaguacaagucauccuagcaggcaacgccuuuacagccggaaaaaucauuuucgcggccgucccacccaacuuccccaccgaaggccucucccccucccaaguaacaauguucccccacaucaucguagacguccgccaacucgaaccaguccucaucccccuccccgacguccgcaacaacuucuaccacuacaaucaaaccaacgacucuaccauaaaacuuaucgccaugcuauacaccccacuacgcgccaacaacgcaggagaagacgucuucacggucagcugccgcguccuaacccgaccaucccccgacuucgacuucaucuuccucgucccucccaccguagaaucacgcacaaaacccuucaccguacccauacucacugucgaagaaaugacaaacucccgauucccaaucccccucgagaaacuauucaccggcccuuccggcgcauucguaguccagccacaaaacggccgaugcacaacugacggcguccuccucggcaccacccaacugucccccgucaacauuugcaccuuccgaggcgacguuacacacaucgcaggaucccgcaacuacacuaugaaccuagccucccucaacuggaacaacuacgaccccaccgaggaaauccccgcaccccuaggcacccccgacuucgucggcaaaauccaaggcguacucacccaaacaaccaaaggagacggcuccacccgcggccauaaagccacagucuacacaggguccgcacccuucacccccaaacucggcucaguccaauuuuccacagauaccgaaaacgacuucgaaacacaccagaacaccaaauucaccccaguaggagucauccaagauggcggcaccacucaccguaacgaaccccaacaauggguccuccccuccuacuccggccgcgacguccacaacguccaccuugcccccgccguagcccccacauuucccggcgaacaacuccucuucuucagauccacuaugcccggcugcucugguuacccaaacauggaccuagauugccuccucccacaagaauggguacaacacuucuaccaagaagccgcaccagcucaaucagacguugcccucuuaagauucgucaaccccgacacaggccgaguacucuucgaaugcaaacuacacaaaucuggcuacgucacaguugcccacaccggccaacacgacuuagugauuccacccaacggcuacuucagauucgauuccugggucaaccaauuuuauacccucgcccccaugggcaacggaaccggccgccgccgcgcccucuaa

SEQ ID NO: 35380 - RNA, 1623 nt, Artificial Sequence
  derived and/or modified sequence opt11 from capsid_protein_VP1__Norovirus__AGE89496
augaaaauggccucaaacgacgccaacccguccgacggcucagccgccaaccucguaccugaagucagcaacgaggucauggcucuagaacccgucgucggcgcagcaauagcagcccccguagccggucaacaaaacgucaucgacccuuggauacgcaacaacuucguccaagccccaggaggcgaguucacagucucaccccgaaacgcccccggcgaaauccucugguccgccccucucgguccagaucucaaccccuaucuaucacaccuagcccgaauguacaacggcuacgccgguggauucgaaguacaagucauccucgcagggaaugcguucaccgcaggcaaaaucaucuucgccgcugucccucccaacuuucccacggaaggccucucccccucacaagucaccauguucccccacauaaucgucgacguacgacaacuagaaccaguacuaaucccccucccagauguccgcaacaacuucuaccacuacaaccaaaccaacgacucuaccaucaaacucauagcaaugcuauacacaccccuccgcgccaacaacgcaggagaagacgucuucaccgucagcugccgcguccucacccgcccuucccccgacuucgacuucaucuuccuagucccacccaccgucgaaagccgcaccaaacccuucacuguccccauacucacaguagaagaaaugaccaacucacgcuuccccaucccauuagaaaagcucuuuacaggacccucaggcgccuucguaguccaaccacaaaacggucgcugcaccacagacggaguucuccuaggaacaacccaacucucacccgucaacauaugcaccuuccgcggcgacguaacccacaucgccggcucccgcaacuacacuaugaaccuugcaucccuaaacuggaacaacuacgaccccaccgaagaaaucccagccccacucggcacccccgacuuugucggcaaaauccaaggaguccucacacaaaccaccaaaggcgacggauccacgcgcgggcacaaggccacagucuacaccggcuccgcacccuucacccccaagcucggcuccguacaauucuccaccgacacagaaaacgacuucgaaacccaccaaaauaccaaauucaccccagucggagucauucaagacggcggcaccacccaucgcaacgaaccccaacaauggguucuacccuccuauuccggccgagacguccacaacguacaccucgcgcccgcaguagcacccaccuuccccggugaacaacuucuauucuuccgcuccacaaugcccggaugcagcggcuauccaaacauggaccucgacugccuccucccccaagaauggguccaacacuucuaccaagaggcagccccagcccaaucagacguagcacuacucagauuugucaacccugacaccggacgaguccucuucgaaugcaaacuccacaaacccggcuacguuaccguagcccacacaggacaacacgaccuaguuaucccaccaaacggcuacuuccgcuucgacucaugggucaaucaauucuauacacuagcacccaugggcaacggcacaggccgccgcagagcccuauaa

SEQ ID NO: 35381 - RNA, 1623 nt, Artificial Sequence
  derived and/or modified sequence opt11 from capsid_protein_VP1__Norovirus__AGE89499
augaaaauggccucaaacgacgcuaaccccucagacgguuccgccgccaaucuuguccccgaagucucaaacgaagucauggcacuagaacccguagucggcgcugcuaucgcagcccccgucgcuggccaacaaaacgucaucgaccccuggauccgcaauaacuucguccaagcccccggcggggaguucaccgucagcccacgcaacgcccccggugaaauccucuggucggcaccccucggcccugaccuaaacccauaucucucccaccucgcccgaauguacaacggcuacgccggcggcuucgaaguacaagucauccucgccggcaacgccuucacagccggcaaaauuaucuucgccgccgucccacccaauuuccccaccgaaggucucucucccucucaagucaccauguucccccacaucaucgucgacguccgacaacuagaacccguccucaucccccucccagauguacgcaacaacuuuuaccacuacaaccaaaccaacgacuccaccauaaaacucauagcaaugcucuacacuccccuccgugcaaacaaugccggcgaagacgucuuuaccgucuccugccgcguucucaccagaccaucaccugacuucgacuuuaucuuccucguaccacccacaguagaaucccgcaccaaacccuucacaguccccauccucaccgucgaagaaaugacaaacucucgauuccccaucccacucgaaaaacucuucacuggacccuccggcgccuuuguuguccagccucaaaacggccgaugcaccaccgacggcguccuccucggaacaacccaacucucacccgucaauaucugcacuuuccggggcgacgucacccacaucgccggcucccgcaacuacacaaugaaccuagccucacuaaacuggaacaacuacgaccccacagaagaaauacccgcgccacucggcaccccagacuucgucggcaaaauccaaggcguacucacccaaacaaccaaaggcgauggaagcacgcgcggccacaaagccacagucuauaccggcuccgcccccuucacgcccaaacucggcucaguccaauucuccaccgacacggaaaacgacuucgaaacccaccaaaauaccaaauucacucccgucggcguaauccaagacggaggcaccacccaccguaacgaaccacaacaauggguacuccccuccuacuccggcagagacguacauaacguacaucuagcaccagccguagcccccaccuuccccggcgaacaacuccucuucuuccgcuccacuaugcccggcuguuccggcuaccccaacauggaccuugacugcuuacucccacaggaauggguccaacacuucuaccaagaagccgcacccgcccaauccgacguugcccuccuccgcuuugucaaccccgacaccggacgcguccucuucgaaugcaagcuccacaagagcgguuacguaaccgucgcccacaccggacaacacgaccuagucauaccacccaacggauacuuccgauucgacagcuggguaaaccaauucuacacacuggcccccaugggcaauggcaccggacgccgccgcgcucucuaa

SEQ ID NO: 35382 - RNA, 1623 nt, Artificial Sequence
  derived and/or modified sequence opt11 from capsid_protein_VP1__Norovirus__AGE89502
augaaaauggcaucaaaugacgccaacccuagcgacggcuccgccgccaaccucguaccagaaguuuccaacgaagucauggcccucgaacccgucgucggcgcagcaaucgccgcccccgucgccggacaacaaaacgucaucgaccccuggauccggaacaacuucguccaagccccaggcggcgaguucacaguaucaccccgcaacgcccccggcgaaauccuauggucugcaccccuaggccccgaccucaaccccuaccucucacaccucgcccgcauguacaacggcuacgcuggaggcuucgaaguccaagucaucuuagccggcaaugccuuuaccgccggaaaaaucauauuugccgcagucccaccuaacuucccaacagaaggacucucccccucccaagucacaauguucccccacauaaucgucgauguacgccagcucgaaccuguacucaucccccucccagacguacgcaacaacuucuaccacuauaaccaaaccaaugacuccaccaucaaacucaucgccaugcucuacacaccccuccgcgccaacaacgccggagaagauguauuuaccguguccugccgcguccucaccagaccaucaccagauuucgacuucaucuuccuagucccgcccaccgucgaaucccgcaccaagcccuucaccguacccauccuaacaguagaagaaaugacaaacucccgauuucccaucccacuugaaaaacuuuucacaggcccaucaggcgcguucguuguccaaccacaaaacggccgaugcaccacagacggcguccuacucggaacaacccaacuauccccagucaacaucugcgccuuccgcggcgacguaacccacaucgccggcucccgaaacuacacaaugaaccucgcaucccucaacuggaacaacuacgaccccaccgaagaaauacccgcgccccuaggcacccccgacuucguaggcaaaauacaagguguucucacccaaacaaccaaaggagacgguucaacacgcggacacaaggccaccgucuacacaggcucagcccccuucacacccaaacucggcuccguucaauuuucaaccgauacagaaaacgacuuugaaacccaccaaaacacaaaauucacaccagucggagucauccaggacggcggaacaacacaccgaaacgaaccucagcaauggguccuacccuccuacucagggcgcgacguccacaacguccaccucgcccccgcaguugcccccacauuccccggcgaacaacuccucuucuucagauccaccaugccagguugcuccggauaccccaacauggaccucgacugccuccucccccaagaauggguccagcacuucuaccaagaagccgcccccgcacaaucugacguagcccuccuccgcuucguaaaccccgacacaggacgcguccuauuugaaugcaagcuccacaaauccggcuacgucacaguagcacacaccggacagcacgaccucguuauaccaccaaauggcuacuuccgauucgacucaugggucaaccaauucuacacccuagcgcccaugggaaacggaacaggccgccgccgcgcccucuga

SEQ ID NO: 35383 - RNA, 1623 nt, Artificial Sequence
  derived and/or modified sequence opt11 from capsid_protein_VP1__Norovirus__AGE89505
augaaaauggccagcaaugacgcaaaccccucagacggauccgccgcaaaccucguccccgaaguaucaaacgaaguaauggcgcucgaacccguagucggcgccgcgaucgccgcccccgucgccggucaacaaaacgucaucgaccccuggauccgcaacaacuuuguccaggccccaggcggagaauuuaccgucucuccccgaaacgccccaggugaaauccucugguccgcaccccucggaccagaccucaaccccuaccucucccaccuugcgcgcauguacaacggcuacgccgguggauucgaaguccaaguaauccucgcaggcaacgcauucaccgccggcaaaaucauauucgcagccguaccacccaauuuccccacagaaggccucucaccaucgcaagucacaauguucccccacaucaucguagacguacgacaacuagaacccguacucaucccccuccccgauguacgcaacaacuucuaccacuacaaccaaaccaacgacuccaccauaaaacucaucgcgaugcucuauacuccccuacgagcgaacaacgcuggagaggacgucuucaccgucagcugcagagugcuaacccgcccaucaccugacuuugacuucaucuuccucgucccucccaccgucgaaucccgaaccaaaccauucacagucccaauccuaaccgucgaagaaaugaccaacucacgcuuccccauuccccucgaaaaacucuucaccggaccauccggugcauuugucguccaaccacaaaacggccgcugcaccaccgacggcguacuccucgguaccacccaacuaucccccgucaacaucugcacauuccguggcgacgucacccacauagcaggcucaaggaacuacaccaugaaccucgccucccuaaacuggaacaacuacgaccccaccgaagaaauacccgccccacucgguaccccagacuuugucggaaagauacaaggagucuuaacccaaaccacaaagggagacggcuccacacgaggacacaaagccaccguauacaccggcuccgcccccuuuaccccaaaacuaggauccguccaauucucaacagacacagaaaacgacuucgaaacacaccaaaacaccaaauucaccccagucggagucauccaagacggcgguaccacccaccgcaacgaaccccaacaguggguccuccccucauacuccggccgcgauguccacaacguacaccuugcuccagccguggcaccaaccuucccaggagaacaacuccuguucuuucgcuccaccaugccuggcugcagcggauaucccaacauggaccucgacugccuacucccacaagaauggguacaacacuucuaccaagaagcagccccagcccaaucagacguagcccuccuaagauucguaaaccccgacacaggccgaguacucuucgaaugcaaacuccacaaaucgggcuacgucacugucgcucacacgggccaacaugaccucguaaucccgcccaacggcuacuuccgcuucgacucaugggugaaccaauucuacacccucgcucccaugggcaacggaaccggcagacgccgcgcccucuaa

SEQ ID NO: 35384 - RNA, 1623 nt, Artificial Sequence
  derived and/or modified sequence opt11 from capsid_protein_VP1__Norovirus__AGE89508
augaaaauggcauccaacgacgccaacccaucagauggauccgcagccaaucugguccccgaagucaacaacgaagucauggcccuagaacccgucgucggagcagcaauagccgcccccgucgccggccagcaaaacguaaucgaccccuggauccgcaacaacuucguccaagcaccagggggagaauuuaccgucucuccccgcaacgcccccggagaaauccuaugguccgccccacuaggcccagaucuaaacccauaccuaucccaccucgcccgaauguacaacggauacgcuggcgguuucgaaguccaagucauacuggcaggaaacgcuuucaccgcuggcaagaucauauucgccgccguaccacccaacuuccccacagaaggucucucccccucccaagucacaauguucccccacauuauaguagacguccgccaacucgaacccgugcuaauaccacucccagacguccgaaacaacuucuaucauuauaaucaauccaacgacuccaccauaaaacuaaucgccaugcuauacacuccacugcgcgccaauaacgccggagaagacgucuucaccguauccugccgcguccucacccgccccagcccugacuucgacuucaucuuccucguaccacccaccgucgaaucaagaaccaaaccauucaccgucccgauccuaaccguagaagaaaugaccaauucccgcuuccccauaccacucgaaaaacucuuuacgggccccucaggcgccuucgucguccaaccccaaaacggacgauguacaacagacggaguccuccucggcaccacucagcucuccccugucaacauaugcaccuuccgaggggacguaacacacauagccgguucacgcgacuacacaaugaaccucgccagccucaacuggaacaacuacgaccccaccgaagaaaucccagccccucucgguacaccagacuucgugggaaaaauccaaggcguccucacccaaacaaccaaaggcgacggaagcacccguggccauaaagcaacuguauacaccggcucagccccauucaccccaaaacucggcucaguccaauucucaaccgauacagaaaacgacuucgaagcccaccaaaacaccaaauuuacacccgucggcgugauacaggauggaggaaccacccacagaaaugaaccacaacaauggguccuacccuccuacuccggccgagacguacacaacguccaccucgccccagcaguagccccgaccuuccccggagaacaacuacuauucuuucgcuccacaaugcccggaugcucaggauaccccaacauggaccuagacugccuucuaccacaagaauggguacaacacuuuuaccaagaagccgcaccagcccaauccgacguagcccuacuacguuucgucaacccagauacuggccgcguccucuucgaaugcaaacuacacaaauccggauacguuaccguagcccacaccggccaacacgaccucguaauacccccuaacggauacuuccgguucgacuccugggucaaccaauucuacacacuagcccccaugggaaacggaaccggcaggcgccgagcccuuuaa

SEQ ID NO: 35385 - RNA, 1623 nt, Artificial Sequence
  derived and/or modified sequence opt11 from capsid_protein_VP1__Norovirus__AGE89511
augaaaauggcaucaaacgacgccaacccuuccgacggcucagcugcaaacuuaguccccgaaguaucaaaugaagugauggcccucgaaccagucgucggagcugccaucgcagcccccgucgcaggccaacaaaacgucaucgacccauggauccgcaauaacuuuguccaagcaccaggcggggaguucaccgucagcccgcgcaacgcccccggcgaaauacugugguccgcaccccuaggucccgaccucaaccccuaccucucccaccuagcacgcauguacaacggauacgcaggcggcuucgaaguacaagucauccucgcuggaaacgcauucaccgccgguaaaaucauauuugccgcagucccacccaauuuccccaccgaaggauuaucccccucccaaguaaccauguucccccacaucauaguagacguacgccagcucgaacccguccuaaucccccuacccgacguacgaaacaacuucuaccacuacaaccaaaccaacgacuccaccauaaaacucauagcaaugcuuuacacaccccuccgcgccaacaacgccggcgaagacgucuucaccguaucaugccgcguccucacccgccccuccccugacuucgacuucauauuccucguacccccaacagucgaaucacgcacuaaacccuucaccguccccauccuaacagucgaagaaaugacuaacucacgcuuccccaucccccuagaaaaauuauucaccggccccucuggcgccuucguaguccaaccccaaaacggccguugcaccaccgacggcguacuucucggcaccacccagcuaucccccgucaacaucugcacauuccgaggcgacgucacgcacaucgccggcucccgcaacuacaccaugaaccucgccucacuuaacuggaacaauuacgacccaacagaagaaauaccagccccacucggaacccccgacuucgucggcaaaauucaaggaguccucacccaaacaacuaaaggugacggcucaacccggggccacaaagccacugucuacacuggcucagcacccuucacucccaaacucggcucgguccaauucucaacagacacagaaaacgauuucgaaacccaccaaaacaccaaauucaccccaguaggcgucauccaagacggaggcaccacacaccgcaacgagccccaacaauggguccuccccucauacuccggccgagacguccacaacguccaccucgccccugcaguagcacccaccuuuccaggagaacaacuccuuuucuuccgcucaacaaugcccggcuguucaggcuaccccaauauggaccucgacugccuucuaccacaagaauggguccaacacuucuaccaagaagccgcccccgcccaaucggacgucgcccuccuacgcuucguaaaccccgacacaggacgcguccucuucgaaugcaaacuacacaaauccggcuacgucacagucgcccacaccggccaacacgaccuuguuaucccacccaacggcuacuucagauucgauuccugggucaaccaauucuacacccuagcacccaugggcaacggcaccggccgcagacgagcccuuuaa

SEQ ID NO: 35386 - RNA, 1623 nt, Artificial Sequence
  derived and/or modified sequence opt11 from capsid_protein_VP1__Norovirus__AGE89514
augaaaauggcauccaacgacgcaaacccauccgacggcuccgccgccaaccuaguacccgaaguaucaaacgaagucauggcacuagagcccguagucggcgcagccaucgccgcacccgucgcaggccaacaaaacguuaucgacccauggauccgaaacaacuucguccaagcacccggcggugaguucaccgucucaccccgcaacgcacccggagaaauacucugguccgcaccccugggcccugaccucaacccuuaccucucccauuuagccaggauguauaacggcuacgccggaggcuucgaaguccaaguuauccucgccggaaaugccuucaccgccggcaaaaucaucuucgcugccguaccacccaacuuccccacagaaggccucucccccucccaagucacaauguucccccacaucaucguagacguccgccaacucgaacccguauuaauuccccuccccgacguccggaacaacuucuaccacuacaaccaaacaaacgauuccacgaucaaacuaaucgccaugcucuauacaccccuacgagcaaacaacgcaggagaagacguauucaccguauccugucgcguccuaacccgccccuccccagacuucgacuucaucuuucuaguuccucccacaguagaaucccgaacaaaacccuucacaguacccauccuaacgguagaagaaaugacaaacucacguuuucccaucccacucgaaaaacuauuuaccggccccuccggcgcauucgucguccaaccccaaaacggccgcugcacuacagacggcguccuccucggcaccacacaacuaucacccgucaacaucugcaccuuccgcggagacguaacccacauugcaggcucccggaacuacaccaugaaucucgccucccuaaacuggaacaacuacgacccaaccgaagaaauacccgcaccacucggaacacccgacuucgucggcaaaauccaaggcguacuaacacaaacaaccaaaggagacggcucuacaagaggacacaaagcaaccgucuacacagguuccgcccccuucacccccaaacuaggcagcguacaguucuccaccgauaccgaaaacgacuucgaaacacaccaaaacacaaaauucacuccaguaggagucauccaagacggcgguacaacccaccgcaacgaaccacaacaauggguccucccuuccuacucaggccgcgacguccacaacguacacuuagccccggcagucgcucccacauucccaggcgagcaacuccucuucuuccgaucuacaaugcccggauguuccggauaccccaacauggaccuugacugccuccucccacaagaauggguccagcacuucuaucaagaagccgcacccgcucagucugacgucgcccuccuacgcuucgucaaccccgacaccggacgcguccucuucgaaugcaaacuccacaaaucuggcuacgucaccguagcacacaccggccaacacgaccuaguuauacccccaaacggcuacuuccgcuucgacucuuggguaaaccaauucuacacccucgcucccaugggcaacggcaccggacgucgccgcgcacucuag

SEQ ID NO: 35387 - RNA, 1623 nt, Artificial Sequence
  derived and/or modified sequence opt11 from capsid_protein_VP1__Norovirus__AGE89517
augaaaauggccucaaacgacgcgaacccgucagacggcuccgccgccaaccuuguacccgaagucuccaacgaaguaauggcccucgaaccagucgucggcgccgccauagcagcaccugucgcaggccagcaaaacgucaucgacccauggauccgcaacaacuucguacaagcaccaggaggcgaauuuaccgucuccccgcgcaacgcccccggugaaauccucugguccgcaccccucggccccgaccuaaauccauaccucagccaccuugcccgaauguacaacggcuaugccggcggcuucgaaguacaagucauacuagccggcaaugccuuuacggccggcaaaaucaucuucgccgcaguaccucccaauuuccccaccgaaggccucucacccucccaagucaccauguucccccacaucaucguagauguucgccaacucgaacccguccucaucccccucccggacguccgcaauaacuucuaccacuacaaccaaaccaacgacagcaccauaaaacuaauagccaugcuauacaccccacuccgcgcuaacaaugccggugaagacgucuucacaguauccugcagaguacucacacgacccucccccgacuucgacuucaucuuccucguaccucccaccguagaaucccgcacaaaacccuucacaguaccaauccuaacaguagaagaaaugacaaacucccgauuccccaucccacuagaaaaacucuucaccggccccuccggcgccuucgucguucaaccccaaaacggccgcugcacaaccgacggaguccuccucggcaccacacaacucucgcccgucaacauaugcacauuccgaggcgacguaacccacaucgccggcuccagaaauuacaccaugaaccuagccucacucaauuggaacaacuacgaccccaccgaagaaauaccugcaccccucggcacccccgauuucgucggcaagauucaaggcguacuaacgcaaaccaccaaaggcgacggcucaacccgcggacauaaagccacagucuacacaggauccgcccccuucaccccaaaacuaggcucaguccaauuuuccacagacaccgaaaacgacuucgaaacccaccaaaacacaaaauucacccccgucggcguaauacaagacgguggcaccacccaccgcaacgaaccucaacaaugggugcucccauccuacagcggacgcgacguucacaacguccaccucgcccccgcagucgcacccacauuucccggggaacagcuacuguucuuccgaucuaccaugccaggauguaguggcuacccaaacauggaccucgacugccuccuaccucaagaauggguucaacacuucuaccaagaagcagcccccgcccaauccgacgucgcacuccuccgcuuugucaaccccgacacaggccgaguccucuucgaaugcaaacuccacaaauccggcuacguaacugucgcacacaccggccaacacgaccucgucaucccaccaaacggauacuucagauucgacuccuggguaaaccaauucuacacccuagcucccaugggaaauggcacuggccgcagacgagcccuuuaa

SEQ ID NO: 35388 - RNA, 1623 nt, Artificial Sequence
  derived and/or modified sequence opt11 from capsid_protein_VP1__Norovirus__AGE89520
augaaaauggcaucuaacgacgcuaacccaagcgacggcucagccgccaaccuaguacccgaaguauccaacgaagugauggcccuagaacccgucgucggcgcagccaucgcggcaccagucgccggacaacaaaacgucauugaccccuggauacggaauaacuucguacaagcccccggcggcgaguucaccgucucgccccgaaaugcccccggagaaauccuaugguccgcaccccucgggccagaucuaaaccccuaccuaucccaccuagcccgcauguacaacggcuacgccggcggauucgaaguacaaguaauucucgcuggcaacgccuucaccgcaggcaaaauaauuuucgcagccguacccccaaacuuccccaccgaaggacuuucccccucccaagucaccauguucccccauaucauagucgacguccgccaacucgaacccguacuaauuccucucccugacguccgcaacaacuuuuaccacuacaaccaaacaaacgacuccaccaucaaacuuauugccaugcuauacacuccucuccgagcuaacaacgcaggcgaagacgucuucacuguuuccugccgaguucucacacggcccagcccagacuucgacuucaucuuccuaguaccucccaccgucgaaucccgcaccaaacccuucaccguucccauccucaccguagaagaaaugacuaauucucgcuuccccauaccccucgaaaaacucuucaccggccccagcggcgcauucguuguccaaccacaaaacgguagaugcacaacagacggaguccuacuuggcacaacacaacucucccccguaaacauaugcgccuuucgcggcgauguaacccacauagcaggcucccgcaacuacaccaugaaccuagccucccucaauuggaacaacuacgacccuacugaagaaauccccgcaccccucggcacaccggacuucgucggcaaaauccaagguguacuaacccaaaccaccaaaggcgacggauccacccgcggacacaaagccaccgucuacacuggauccgcccccuucacccccaaacuuggcuccguccaauucuccaccgacaccgaaaacgacuucgaaacccaccaaaacaccaaauucacccccgugggcgucauacaagacggcggaaccacacaccgaaacgaaccccaacaguggguccuccccagcuacucuggccgagacguccacaacguccaccuagccccagccgucgccccaacauucccgggcgaacaacugcuguucuuucgcuccaccaugcccggcuguagcggauaccccaauauggaccuagacugccuccucccacaagaauggguccaacacuucuaccaagaagccgccccugcccaaucagacguagcacuccuccgcuucguaaacccagacacaggacgcguccucuucgagugcaaacuccacaaauccggcuacguaaccgucgcccacacuggccaacacgaucuagucaucccuccuaacggauacuuccgcuucgacuccugggucaaccaauucuacacacucgcccccaugggcaacggaaccggacgacgccgcgcacuauag

SEQ ID NO: 35389 - RNA, 1623 nt, Artificial Sequence
  derived and/or modified sequence opt11 from capsid_protein_VP1__Norovirus__AGE89523
augaaaauggcaucaaaugacgccaaccccuccgacgguuccgccgcaaaccucguccccgaggucuccaacgaaguuauggcccuagaacccguagucggcgccgccaucgcagcccccgucgcaggccaacaaaacgucaucgaccccuggauccggaacaacuucguccaagcccccgguggugaguucaccguuuccccacgcaaugcgcccggugaaauacuaugguccgcaccccugggccccgaucuuaaccccuaccuaucacaucucgcccgcauguacaacggcuacgccggcggcuuugaaguccaagucauccucgcaggaaacgccuucaccgcuggcaaaaucaucuucgccgccgucccacccaauuuccccaccgaaggccucucccccucucaagucaccauguucccccacauaauagucgacguccgucaacucgaacccguucuuauaccccucccagacguacgaaacaacuucuaccacuacaaccaaacuaacgacuccaccauuaaacuaauagccaugcucuacaccccacuccgagcgaauaacgccggugaagacguauucaccgucuccugccguguacucacccgccccucacccgacuuugauuuuaucuucuuaguuccgcccaccgucgaaucccgaaccaaacccuucaccguccccauacucaccgucgaagaaaugaccaacucccgauuccccauaccucuagaaaaacuauucaccggcccuuccggugccuucgucguccaaccccaaaauggccgcugcacaaccgacggcguacuccucggcaccacccaacuauccccagucaacaucuguacauuccgcggcgacguuacccacaucgccggaucacgcaacuacaccaugaaccuagccucccuuaauuggaacaacuacgaucccacagaagaaauacccgcccccuuaggaaccccagacuuugucggcaaaauccaaggcguccucacccaaacaacuaaaggcgacggauccacacggggacacaaagcuacaguauauaccgguuccgcccccuuuacaccuaaacucggcucaguccaauucucaacugacacagaaaacgacuucgaaacucaccaaaacacaaaauucacccccguaggagucauccaagacggcggcaccacccacagaaacgaaccccaacaauggguccuccccuccuacuccggacgcgacguccacaacguacaccuugccccagccguagccccaaccuucccuggcgaacaacuccuguucuuccgaucaaccaugcccggaugcucaggcuaccccaacauggaccuagacugccuacucccacaagaaugggugcaacacuuuuaccaagaagccgcccccgcacaauccgacgucgcccuucucagauucgucaaccccgacaccggccgaguccuauucgaaugcaaacuacacaaauccggcuacgucaccgucgcucauacagggcaacacgaccucgucaucccucccaacggcuacuuccguuucgacucaugggucaaccaauuuuacacacuugcccccaugggcaaugggaccggccgccgacgcgcacucuaa

SEQ ID NO: 35390 - RNA, 1623 nt, Artificial Sequence
  derived and/or modified sequence opt11 from capsid_protein_VP1__Norovirus__AGE89526
augaaaauggccucuaaugacgcaaaccccuccgacggaucagcagccaaccuuguccccgaagucucaaacgaagucauggcacucgaacccguuguaggcgccgccaucgcagcccccgucgcaggucaacaaaacgucauagacccuuggauccgaaacaauuuuguacaagccccaggcggcgaguucacaguaucaccccgaaacgcacccggcgaaauccuuugguccgccccacucggccccgaccuuaaccccuaucucucgcaccuagcccgcauguacaacggauacgcaggaggcuucgaaguccaagucauccucgccggcaacgccuucaccgcaggcaaaauaauuuucgcagccgucccaccaaacuuccccaccgaaggucucucucccucccaagucaccauguuuccccacaucauagucgacguccgccaacuagaacccguccucaucccccuccccgacgucagaaacaacuucuaccauuacaaccaaaccaacgacuccaccaucaaacuaaucgccaugcuguacacgccacugcgcgccaacaacgccggcgaagacgucuucacagucucaugccgcguccucacgcgccccucccccgacuuugacuucaucuuucucgucccucccaccgucgaaucacgcaccaaacccuucaccgucccaauccuaacagucgaagaaaugaccaacucccgcuuccccaucccccucgaaaaacucuucaccggccccucaggcgccuucgucguccaaccccaaaacggacgcugcacaaccgacggcguccuguuaggcacaacccaacucucccccgucaacauaugcaccuuccguggcgacgugacucacaucgcagguucacgcaacuacaccaugaaccucgcaucccucaauuggaacaacuacgacccaacagaagaaauucccgcaccucucggcacccccgacuucguuggcaaaauacaaggcguccucacacaaaccacgaaaggggauggcucgacuagagggcacaaagcaaccguauacacaggcuccgcccccuuuacaccaaagcuaggcucaguccaauucuccaccgacaccgagaacgacuucgaaacccaccagaacaccaaguucacccccgucggcgucauacaagacggcggcacuacccaucgcaacgaaccucaacaguggguacucccaucauacagcggacgugacguccacaacguacaccucgcacccgccgucgcacccaccuucccaggagaacaguuacucuucuuccgcucgaccaugccaggcugcucagguuaucccaacauggaccuagacugccuacuaccucaagaauggguacaacacuucuaucaagaagccgcccccgcucaaucagaugucgcccuccuccgcuucgucaaccccgacacagguagaguacucuucgaaugcaaacuccacaaaucaggcuacgugacagucgcccacacaggacaacacgaccucgucauaccacccaacggcuacuuccgcuucgacucaugggucaaccaauucuacacacucgcccccaugggaaacggaacuggccgaagacgagcccuuuaa

SEQ ID NO: 35391 - RNA, 1623 nt, Artificial Sequence
  derived and/or modified sequence opt11 from capsid_protein_VP1__Norovirus__AGE89529
augaaaauggcuucaaacgacgccaaccccuccgauggcucagcagccaaucucguacccgaagucucaaacgaagucauggcccuagaaccugucgucggugccgccauagcagcacccgucgccggacaacaaaacgugaucgaccccuggauccggaacaauuuuguccaagcccccggcggcgaguucaccguuucacccagaaacgcacccggcgaaauccuguggagcgcaccccucgguccggaccucaacccauaccucucccaccucgcacgcauguauaacggauacgccggcggauucgaaguccaagucauccucgccggcaacgccuuuaccgcaggcaaaauaauauucgccgccgucccgcccaacuuccccacagaaggccuaucucccucccaagucaccauguucccccacauaauaguagacguccgacaacuagaacccguccuuauaccccuccccgacguccgcaacaacuucuaucacuacaaccaaacuaacgacucaacaauaaaacucauagcuaugcucuacacuccccuucgcgcaaacaacgcaggcgaagacguauucaccgucucgugccgcguccuuacccgcccuucacccgacuucgacuucaucuuccucgucccacccaccgucgaaucgcgaacuaaacccuucacaguccccauccucaccgucgaagaaaugaccaacucccgguucccaauaccccuagaaaaacuuuucacaggaccaucaggcgcuuucgucguccaaccccaaaacggucgcugcacaacagacggcgugcuacucggcaccacccaacucucacccgucaacaucugcaccuuccgcggcgacgucacccacauagccggcuccagaaacuacaccaugaaccucgcaucacucaacuggaacaacuacgacccaacagaagaaauaccagcuccccucggcaccccagacuucgucggcaagauccaaggcguacuaacccaaaccacuaaggaggacggauccaccagaggccacaaagccacaguauacaccggaagcgccccauucacccccaaacucggauccguacaauucucuacagauaccgaaaacgacuucgagacccaccaaaacacuaaauucacacccgucggcgucauacaagacggcggcaccacacaccgcaacgaaccccaacaauggguccuaccaucuuacuccggccgcgacguacacaacguccaccuagcccccgccguugccccaaccuuccccggcgaacaacuccucuucuuccguucaacaaugccaggcugcuccgguuaccccaacauggaccucgacugccuucucccccaagaauggguacaacacuucuaccaagaagcagcaccagcccaauccgacgucgcccuccuccgcuucgucaacccagacaccggucguguccucuucgaauguaaacuccacaagucgggcuacgucaccgucgcccauacuggacaacacgaccuugucaucccacccaacggauacuuccgcuucgacagcugggucaaccaauucuacacccucgcccccaugggcaacgguaccggacgccgacgcgcacucuga

SEQ ID NO: 35392 - RNA, 1623 nt, Artificial Sequence
  derived and/or modified sequence opt11 from capsid_protein_VP1__Norovirus__AGE89532
augaaaauggccucgaacgacgccaaccccagcgacggaucagcagccaaccuuguccccgaagucuccaacgaagucauggcucucgaacccguagucggcgccgcaauagccgcacccgucgccggccaacaaaacgucauugauccauggauacgaaacaacuucguccaagcacccggcggcgaauuuacggucuccccacgcaacgccccaggcgaaauacucuggagugcuccccucggccccgaccuaaaccccuaccugucucaucuugcgcgaauguacaacggauaugcaggcggcuucgaaguccaaguaauccuagcaggcaacgcauucacagccggcaaaauuaucuucgcagccgucccacccaacuuccccaccgaaggucucucccccucgcaagucacuauguucccgcacaucauagucgacguucgccaacuagaaccuguccuaaucccccucccagacguccgcaacaacuucuaccacuacaaucaaacaaacgacuccaccaucaaacucaucgcaaugcuuuacacuccccuuagagcaaacaacgcaggcgaagacguauucacugucucaugccgcguccucacccgccccuccccugacuucgacuuuaucuuccuaguacccccaaccgucgaaucccgaaccaagcccuucaccguacccauccuuaccguagaagaaaugaccaacucccgcuuccccaucccucuagaaaaacuauucacaggccccuccggcgcauucgucguccaaccacaaaacggccgcugcaccaccgacggcguccuacucggcacaacccaauuaucccccgucaacauaugcacauuucgaggcgacgucacccacauagccggcucuagaaacuacaccaugaaccuagccucccuuaauuggaacaacuacgacccaacagaagaaauacccgcuccacuaggcacacccgacuucgucgguaaaauacaaggcguccuuacucaaaccaccaaaggcgacggcagcacccgaggccacaaagccaccgucuacaccgguucagcgcccuucaccccuaaacucggcucaguccaauucucuaccgacacagaaaacgauuucgaaacccaccaaaauacaaaauucaccccagucggcgucauucaagacggaggaaccacccaccgcaacgaaccccaacaauggguacugcccuccuacuccggccgagacguacacaauguccaccuagcccccgcugucgcccccacuuuccccggcgaacaacuucuguucuuccguucaaccaugcccggaugcuccggauaccccaacauggaccuagacugccuauuaccacaagaauggguccaacacuucuaccaagaagcagcccccgcgcaauccgacguugcccuucuacguuucguaaauccagacaccggccgaguacucuucgaaugcaaacuccauaaauccggauacguaaccgucgcccacaccggccaacacgaccucgucauaccacccaacggcuacuuccgcuucgacucaugggucaaccaauucuacacacucgcccccaugggcaacgguacggggcgccgccgcgcacucuaa

SEQ ID NO: 35393 - RNA, 1623 nt, Artificial Sequence
  derived and/or modified sequence opt11 from capsid_protein_VP1__Norovirus__AGE89535
augaaaauggccuccaacgacgcuaaccccucugacggcuccgccgccaaccucguccccgaagugucaaacgaaguaauggcacucgaacccguaguaggcgccgccauagcagcccccguagccggccaacaaaacguuaucgaccccuggauccgcaacaacuuuguccaagcaccaggcggcgaguucaccguuagcccucgcaacgcacccggagaaauccugugguccgcuccccucggccccgaccucaauccauaccuuucccaccucgcccgaauguauaacggauacgccggcggcuucgaaguccgcgucauccucgccggcaaugccuucaccgccggcaaaaucaucuucgccgcaguaccucccaacuuccccaccgaaggacucucccccucacaaguaaccauguucccccacaucauagucgaugugcgccaacuagaacccguccuaaucccauuaccagacguccggaacaacuucuaucacuacaaccaaaccaacgacuccaccaucaaacucauagcuaugcuuuacacaccacuacgcgcuaacaacgccggggaagauguuuucacagucucuugccguguacuuacccgacccuccccagacuucgacuucaucuuccuuguaccacccaccgucgaaucccgcaccaaacccuucaccguccccauccucaccguagaagaaaugacaaacucccgcuuuccuaucccacuagaaaaacuauucaccggccccucaggcgccuucguuguucaaccccaaaacggccgcugcaccaccgacggcguccuccucgguaccacccaacuaagccccgucaacauaugcacauuccgcggugacguaacucacauagccggaucacgcaacuacaccaugaaccuagcaucccuaaacuggaacaacuacgacccuaccgaagaaauucccgccccucuaggcacccccgacuucgucggcaaaauacaaggaguccucacccaaacaacaaaaggggacggcuccacucgcggccacaaagccaccguauacaccgguuccgcaccuuucacccccaagcucggcuccguacaauucuccacugacaccgaaaacgacuucgaaacucaccaaaauacaaaguucacacccgucggagucauccaagacggaggcaccacucacagaaacgaaccccaacaauggguccuaccauccuacuccggccgcgacguccacaacguccaccucgcccccgcuguagcccccaccuucccaggcgaacaacuccucuucuuucgcuccaccaugcccggcugcuccggcuaccccaauauggaccuagacugccuucucccacaagaauggguccaacacuucuaccaagaagccgcccccgcccaauccgacgucgcccuccuccgcuucguuaaccccgacacaggccgaguacucuucgaaugcaaacuccacaaaucuggcuacguaaccguugcccauacuggccagcacgaucucgucauaccacccaacggauacuuccgcuucgacuccugggucaaccaauucuacacucuagcgcccaugggaaacggaacuggccgccgccgagcccucuaa

SEQ ID NO: 35394 - RNA, 1623 nt, Artificial Sequence
  derived and/or modified sequence opt11 from capsid_protein_VP1__Norovirus__AGE89538
augaagauggccuccaaugacgccaacccuuccgacggcuccgcugcuucccuagucccugaaguaucaaaugaagucauggcccucgaaccuguaguuggcgccgcaaucgccgcccccgucgcgggccaacaaaauguaaucgaccccuggauccgcaacaacuucguacaagccccagguggugaguucacuguaucccccagaaaugcaccuggcgaaauccucuggucugcuccacuaggcccagaccuaaacccauaccucucccaccucgcaagaauguacaacggcuacgccggcggcuucgaaguccaagucauccuugccggcaacgccuuuaccgccggaaaaaucaucuucgcagcaguaccacccaacuuccccacagaaggccucucacccucccaagucaccauguucccccacaucauagucgacguacgccagcucgaaccaguccuuauuccccuccccgacguaagaaacaacuuuuaccacuacaaccaaaccaaugacuccacaauuaaacucaucgcaaugcucuacacuccucuacgcgcuaacaacgcuggcgaagacguauucaccguaagcugccgcguucuaacccgcccauccccagacuucgacuucaucuuccuaguaccacccaccgucgaaucacgaacuaaacccuucaccguccccauccucaccgucgaagaaaugaccaacucccgcuuccccaucccccucgaaaaacucuucacaggcccuuccggcgccuucgucguccaaccacaaaacggccgcugcacaaccgacgguguccuacuaggcaccacacaacuaucccccgucaauaucuguaccuuccgcggagacguaacccauaucgcuggcucacgcaacuacaccaugaaccucgccucacucaacuggaacaacuaugacccaacggaagaaaucccagccccgcucggcacccccgacuucgucggcaaaauacagggcguccucacccaaacaaccaaaggcgacggcuccacucgaggccacaaagccaccguauacaccggcucggcccccuucaccccaaaacucggcuccguacaauucuccacagacacugaaaacgacuucgaaacccaccaaaacaccaaauucacaccagucggcguaauccaagacggaggaacaacccaccgcaacgaaccccaacaguggguccuccccuccuauuccggccgcgacguccauaacguccaccuagcccccgccguagcacccacuuuccccggcgaacaacuccucuucuuccguuccacaaugcccggcugcucuggcuaccccaauauggaccucgacugucuccucccccaggaauggguccaacacuucuaccaagaagccgcccccgcacaaucugacgccgcccuccuccgcuucgucaacccggauaccggccgcguccucuucgaaugcaaacuucacaaaucaggauacgucaccgucgcccacaccggccaacaugaccuuguaauuccacccaacggcuacuuucgcuucgacuccugggucaaccaguucuacacacuagcaccaaugggcaacggaaccggacgaagacgagcacucuaa

SEQ ID NO: 35395 - RNA, 1623 nt, Artificial Sequence
  derived and/or modified sequence opt11 from capsid_protein_VP1__Norovirus__AGE89541
augaaaauggccuccaaugacgcgaaccccuccgauggcuccgcagccaaccuaguccccgaagucagcaacgaagucauggcacuggaacccgucguuggagccgcgaucgccgcaccagucgccggccaacagaacgucauagacccauggauccguaacaacuucgugcaagcacccggcggugaguucacugucuccccacgcaacgccccaggagaaauccuaugguccgcaccccucggacccgaccucaacccauaccucucacaucuagcccgaauguacaacggauacgccggcggcuucgaaguccaagucauccucgccgguaaugccuucacagccggcaaaaucaucuucgccgccgucccacccaacuuccccacagaaggccuuucacccucccaaguuaccauguucccccacaucauagucgacguucgacaacuugaacccguacucauaccacucccagacguccgaaacaacuucuaucacuacaaccagacaaacgacuccaccaucaaacuaaucgccaugcuauacacaccacuccgcgccaacaacgccggcgaagacguauucacagucucuugccgcguccucacccgccccucacccgacuucgacuucaucuuccucgugccacccaccgucgaaucccgcacaaaacccuucacuguccccauacucaccgucgaagaaaugaccaacucacgcuuccccaucccccuugaaaaacucuucacuggacccuccggcgccuucgucguccaaccacagaacggccgcugcaccaccgacggcguccucuuagguaccacucaacugucccccguaaauauaugcaccuuccguggagacguaacccacauagcaggcucccgcaacuacaccaugaaccuugccucgcucaacuggaacaacuacgacccaacagaagaaaucccagcgccccucggcaccccagauuucgucggaaagauccaaggaguccucacccaaacuacaaaaggagacggcuccacccgcggccacaaagcuacugucuacacaggcuccgcacccuuuacucccaaacucggauccguacaauucucaaccgauaccgaaaacgauuucgaaacccaccaaaacacaaaauucacgcccguuggcgucauccaagacggcggcacgacccaccgcaacgaaccccaacaguggguacuacccucauacuccgguagagacguccacaacguccaucucgcccccgccguagcacccacauuccccggcgaacaacuucuauuuuuccgaucuaccaugcccggcugcuccggcuacccuaacauggaccuagacugucuucuuccccaagaauggguucaacacuucuaccaggaggccgccccagcccaauccgacguagcccuccuacgauuuguuaacccagacacaggucgaguacuauuugaaugcaaacuacacaaaucgggauaugucacgguagcccacaccggccaacacgaccucgucauaccacccaacggcuacuuccgcuuugacuccuggguaaaccaauucuacacccuagccccaaugggcaauggcacuggacgacgccgugcccuauaa

SEQ ID NO: 35396 - RNA, 1623 nt, Artificial Sequence
  derived and/or modified sequence opt11 from capsid_protein_VP1__Norovirus__AGE89544
augaaaauggccucaaacgacgcaaaccccucagacggcuccgccgccaaccuaguaccugaaguguccaacgaggucauggcacucgaacccgucguuggcgcagcaauagccgccccugucgccggccagcaaaacgucauagaccccuggauccgcaacaacuucguccaagcaccaggaggcgaguucaccgucagcccacgaaacgcccccggagaaauccucugguccgcaccccuaggacccgaccuaaaccccuaccucucacaucuugcccgaauguacaacggcuacgccggcggcuucgaaguacaagucauacucgccggcaacgccuucacagccggcaaaaucauauucgccgcaguaccacccaacuuccccaccgaaggccucucgcccucucaaguuaccauguucccacacauuauagucgacguccgacaacucgaaccaguccucauuccacuaccagacguccgcaauaacuucuaccacuacaaccagaccaacgacuccaccaucaaauuaaucgcaauguuauacacaccccuccgagcaaacaacgccggcgaagacgucuucacagucuccugccgcguucucacucgccccucccccgacuuugacuucaucuuccuagucccacccacaguagaaucaagaacuaaaccauuuacagucccgauucucacugucgaagaaaugacuaacucacgcuucccaaucccacucgaaaaacuauucacaggccccucaggcgcauucgucguccaaccacaaaacggccgauguaccaccgacggcguacuacuagggacaacacagcucucccccgucaacaucugcaccuuccgaggugacguaacccacaucgccggcucccgcaauuacacuaugaaccuugccucccucaacuggaacaacuacgacccaaccgaagaaauccccgcaccccucggcacacccgauuucgucggaaaaauacaaggaguucuaacccaaaccacaaaaggcgacggcagcacacgaggccacaaagccaccgucuacaccggcuccgcccccuucacacccaaacuuggaucaguacaauucuccacugacaccgagaacgacuucgaaacccaucaaaacaccaaauucacaccagucggcgucauccaagauggaggcaccacccaccgaaacgaaccccaacaauggguucuccccuccuacucaggccgugacgugcauaacguucaccuagcccccgccguggccccuacauuccccggcgaacaacuccucuucuuccgauccaccaugccuggaugcaguggauaccccaacauggaccucgacugccugcucccccaagaauggguacaacacuucuaccaagaagccgccccagcccagucagacgucgcccuccuccgcuucgucaaccccgacaccggccgcgucuuauucgaaugcaaacuccacaaaucaggcuacguaacagucgcucacaccggccaacacgaccuuguaaucccacccaacggcuacuuccgcuucgacagcugggucaaccaauucuacacacucgcgccaaugggcaacggcaccggccgacgcagagcccuauaa

SEQ ID NO: 35397 - RNA, 1623 nt, Artificial Sequence
  derived and/or modified sequence opt11 from capsid_protein_VP1__Norovirus__AGE89547
augaaaauggccuccaaugacgcaaaccccagcgauggcuccgcugccaaccuaguuccagaagucaguaaugaaguaauggcgcucgaaccaguaguaggcgcagcaaucgccgcccccguagcaggccaacagaacgucaucgaccccuggauccgcaacaacuucguccaagccccuggcggcgaguucaccgucuccccacgcaacgccccaggcgaaauccucugguccgcaccacuuggcccugaccuuaacccauaccucagccaccuagcacgcauguacaacggcuacgccggaggcuucgaaguucaagucauccuagccggcaacgcuuucacagccggcaaaauaauauucgccgccgugcccccaaauuuucccacagaaggucuauccccaucacaaguaacaauguucccacacaucaucguagacguccgacaacuugaaccaguacuaaucccccuccccgacguccgcaacaacuuuuaccacuauaaccaaaccaacgacuccaccaucaaacucauagccaugcucuacaccccauuacgagccaacaaugccggagaagacgucuucaccgucucaugccguguucucacccgccccucacccgacuuugacuucauauuccucguaccgcccaccgucgaaucccgcacaaaaccauucacaguaccuauccuaaccguagaagaaaugaccaacuccagauuccccaucccccucgaaaagcuauuuaccggccccucaggcgccuucgucguccaaccucaaaacggccgcugcaccacugacggaguccuacucggaaccacccaacucucaccugucaacaucuguaccuuucgcggcgacguaacccauauagccggcucccgcaacuacaccaugaaccucgccagcuuaaacuggaacaacuacgacccaacugaagaaaucccugcaccccugggaacccccgauuucguaggcaaaauucaaggcguccucacccaaaccaccaaaggcgacggcuccacccgcggccacaaagccaccguuuacacuggaucugcccccuucacacccaaacucggaucaguccaauucuccacagacaccgaaaacgacuucgaaacacaccaaaacacaaaauucacacccgucggcgucauccaagacggcucaaccacacaccgcaacgaaccacaacaauggguccuaccgucauacuccggacgcgacguccacaacguccaccuggcccccgccguugccccaacauuccccggcgaacagcuccuauucuuucgcucaacaaugcccggcugcuccggauaucccaacauggaucuagacugcuuacucccucaagaauggguccaacacuucuaucaagaagcugcccccgcacaaucagacgucgcacuacuccgcuucguaaaccccgacacaggccgaguacuauucgaaugcaagcuccacaaaagugguuacgucacagucgcacacaccggccaacacgacuuagucauaccaccaaacggcuacuuccgcuucgacucaugggucaaccaauucuacacccucgcccccaugggaaacggcacaggccgccgccgcgcccucuaa

SEQ ID NO: 35398 - RNA, 1623 nt, Artificial Sequence
  derived and/or modified sequence opt11 from capsid_protein_VP1__Norovirus__AGE89550
augaaaauggccucaaacgacgccaaccccuccgauggcuccgccgccaaccucgucccagaagucucaaacgaagucauggcacucgaacccgucgucggcgccgccauagcagccccaguagcaggacaacaaaacgucauagaccccuggauacgcaacaacuucgugcaagcccccggcggugaguucaccgucucaccacgcaaugcccccggcgaaauacuaugguccgcaccccuaggacccgaccucaacccauaccucucacaccucgcucguauguacaacgguuacgccggcggcuucgaaguccaaguaauccuagccggcaacgcauucaccgccggcaaaaucaucuucgccgcaguaccacccaacuuucccaccgaaggccucagcccaucucaagucacaauguuuccccacaucaucgucgacguccgacaacuagaacccguuuuaaucccacucccagacguccgcaacaauuucuaccacuacaaccaaaccaacgacucaacaaucaagcuaaucgccaugcucuacacaccccuacgcgccaacaacgccggcgaagacgucuuuaccgucuccugccgagugcucacccgaccaucacccgacuuugauuucaucuuccucgucccacccaccguagaaagccgaaccaaacccuucacaguccccaucuuaacagucgaagaaaugaccaacucccgcuucccaaucccccucgaaaaacuauucacaggccccagcggcgcauucgucguacagccacaaaacggacgcugcaccaccgacgguguccuacucggcacaacccaacuaucucccguuaacaucuguaccuuccgaggugacgucacacacaucgccggcucccgggacuacaccaugaaccucgccagccuaaacuggaacaacuacgaccccacugaagaaauccccgcaccccucgguaccccagacuuuguagguaaaauucaaggcguacucacccaaaccacuaaaggagacggcucuacucgcggacacaaagccacaguuuacacuggcucagccccauucacaccaaaacucggaucuguacaauucagcaccgacaccgaaaacgacuucgaaacccaucaaaacacaaaauucacccccgucggcguuauccaagacggcggcaccacccaccgcaaugaaccccaacaauggguccuacccagcuacucgggacgcgacguccacaacguccacuuagcccccgccguagcucccaccuuccccggcgaacaacuucucuucuucagauccacaaugcccggaugcuccggcuaccccaacauggaccucgacugccuccucccccaagaauggguccaacacuucuaccaagaagccgcccccgcccaaucagacgucgcccuacuacgcuucgucaacccagacacuggccgcguccuauucgaaugcaaauuacauaaaucaggguacgucaccgucgcccacaccggccaacacgaccuagucauacccccaaacggcuacuucagauucgacucaugggucaaccaauuuuacacccuagcccccaugggaaacgguaccggccgccgccgcgcacuauaa

SEQ ID NO: 35399 - RNA, 1623 nt, Artificial Sequence
  derived and/or modified sequence opt11 from capsid_protein_VP1__Norovirus__AGE89553
augaaaauggccuccaacgacgcaaaccccucugacggcuccgccgcgaaccucguucccgaaguuaacaaugaagucauggcacucgaaccagucgucggagcugcaaucgcagccccgguagcaggccagcaaaacgucauagaccccuggauccgcaacaacuucguccaagcacccggcggcgaguucacagucucaccacgaaacgcacccggcgaaauccucugguccgcaccccuaggaccggaccucaaccccuaccucucacaccuagcccgaauguacaacggcuacgccgggggcuuugaaguccaaguaauccuagccggcaacgcauucacagcaggcaaaaucaucuuugccgcagucccucccaacuuccccacagaaggucuaucacccagccaagucacaauguucccucacauaaucgucgacguacgccaacucgaacccguacuuauaccccuccccgauguacgcaacaacuucuaccacuacaaccaauccaacgacuccacaaucaaacuuaucgccaugcuauacaccccacuucgcgccaacaaugcuggcgaagacgucuucacaguaucaugucgcguccuaacccgccccucacccgauuucgauuucaucuuccucguaccacccacuguagagucccgcacaaaacccuucaccguaccaauccucaccgucgaagagaugaccaauagccgcuucccaaucccccucgagaaacuauucaccggaccaagcggcgcuuucguaguccaaccucaaaacggccgcugcaccacggacggcguccuccuagggaccacccaacuaucccccguaaacaucuguaccuuccguggcgacgucacucacaucgccggcucucggaacuacaccaugaaccucgccagccuaaacuggaacaacuacgaccccaccgaagaaaucccagcaccccucgggacccccgacuucgucggaaaaauccaaggcguacucacccaaaccacaaaaggcgacggauccacccgcggccacaaagccacagucuacaccggcuccgcccccuucacccccaaacuaggcucuguccaauucucaaccgacaccgagaacgacuucgaagcccaccagaacacaaaauucaccccagucggcgucauacaggacggcggcaccacacaccgaaacgaaccacagcaauggguccuccccucuuacuccggccgagacguccacaacguccaccuggccccagccgucgccccaaccuuccccggcgaacaacuacucuucuuccgcucaaccaugcccggaugcucaggauaccccaacauggaccucgacugcuuacucccccaagaauggguccaacauuucuaccaagaagcagccccagcacaaagcgacgucgcacuacuacgauucgucaacccagacaccggccgaguccuauucgaaugcaagcuacacaaaucuggcuacgucaccgucgcacacaccggacaacacgaccucgucauaccaccaaacggcuacuuccgauucgacagcuggguaaaccaauucuacacccucgcccccaugggaaacggaaccggccgacgccgggcccuauaa

SEQ ID NO: 35400 - RNA, 1623 nt, Artificial Sequence
  derived and/or modified sequence opt11 from capsid_protein_VP1__Norovirus__AGE89556
augaaaauggccuccaacgacgccaaccccagcgacggcuccgcagccaaccuaguucccgaagucucaaacgaagucauggcacucgaacccgucgucggcgccgccaucgccgcaccagucgccggccaacaaaacgucaucgauccauggauaagaaacaacuucguacaagcccccggcggcgaguucaccgucucuccccgcaacgcccccggagaaauccucugguccgcaccucucggccccgaccucaaccccuaccucucccaccuugcacgcauguacaacggauacgccggcggcuucgaaguccaagucauccucgccggcaacgccuucaccgccggaaaaaucaucuucgccgccgucccaccaaacuuccccacagaaggccuaucccccucccaagucaccauguucccucacauaaucguggacguacgccaacuagaacccguccucaucccccuccccgacguucgcaacaacuucuaccacuacaaccaaacaaacgacuccaccaucaaacuuaucgccaugcucuacacaccccuacgagccaacaacgccggugaagacgucuucaccgucucaugucgcguccuaacccgcccauccccagacuucgacuuuaucuuucucguaccacccaccgucgaaucccguacaaaaccauucaccguccccauccuuacaguagaagaaaugaccaacucgcgcuucccaaucccccuugaaaaacucuucaccggcccaucaggagccuucgucguccagccacaaaauggccgcugcaccaccgacgggguacucuuaggcacaacccaacucagccccguaaacaucugcacauuucgcggagacguuacacacauagccggcucucgcaacuacaccaugaaccucgccucccuaaacuggaacaacuacgacccuaccgaagaaauacccgcaccacucggcacccccgacuucgucggcaaaauccaaggcguccuuacacaaacuaccaaggaagacggcucuacacgcggccacaaggccaccgucuacacagguucugcacccuucacccccaaacucggauccguccaauucuccaccgacaccgaaaacgacuuugaaacacaccagaacaccaaauucacaccagucgguguaauccaagacggcggaaccacccacagaaacgaaccacaacaauggguacuccccuccuacagcggccgcgacguccacaacguccaccucgcaccagcuguagcacccacauucccaggcgagcaacuccuauucuuccgcuccacaaugccaggauguucuggcuaccccaauauggaccucgacugccugcucccccaagaauggguucaacauuucuaccaagaagcagccccugcccaguccgacguagcccuucuccgauuuguuaacccugacaccggccgcguccuauucgaaugcaaauuacacaaauccggauaugucaccgucgcccacaccggccaacaugaucuagucaucccacccaacggguacuuccgauucgacuccuggguaaaccaauucuacacacucgcccccaugggcaacgguaccggaagaagacgcgcccucuag

SEQ ID NO: 35401 - RNA, 1623 nt, Artificial Sequence
  derived and/or modified sequence opt11 from capsid_protein_VP1__Norovirus__AGE89559
augaaaauggccuccaacgacgcaaaccccucugacggcucugccgccaaccucguaccagaagucucaaacgaagucauggcccuagaaccagucgucggugccgccaucgccgcccccguagccggccaacagaacgucaucgaccccuggauccgcaacaacuucguccaggcccccggcggcgaauuuaccgucucaccccgcaacgccccaggugaaauccuaugguccgcaccccucggcccagaccucaaucccuaccucucgcaccuagcacggauguauaacggauacgccggcggcuucgaaguccaaguaauccucgccggcaacgccuucacugccggaaaaaucaucuucgccgccguaccaccaaacuucccaaccgaaggccucuccccuucacaagucaccauguucccacacaucaucgucgacguccgccaacucgaacccguacuaaucccuuuaccugacguccgcaacaacuucuaccacuacaaucagacgaaugacuccacaauaaaacucaucgccaugcuauacacaccccuucgugcaaacaacgcaggagaagacgucuucaccgucucaugcagaguccuaacucgucccucccccgacuuugacuuuaucuuccuuguacccccaaccgucgaaucuagaaccaaacccuucaccguccccauccucacagucgaagaaaugacgaacucucgcuuccccaucccccuggaaaaacucuucaccggccccuccggcgccuucgucguacaaccccaaaauggccgcugcaccacagacgguguccuccuaggcaccacccaacucagccccgucaacaucugcaccuuccgcggagacgucacacauauagcaggaucccgcaacuacaccaugaaccuagccucacuaaacuggaacaacuacgaccccacagaagaaauccccgccccacucggaacucccgacuucgucggcaaaauacaagguguccucacccaaacaacaaaagaagacgguucgacccgcggacauaaagcuaccgucuacaccggcagcgcaccauucaccccaaagcugggcucaguccaauuuucuacagacaccgaaaacgacuuugaaacacaccaaaacaccaaauucacaccagucggcgucauacaagacggcggaacaacccaccgcaacgaaccccaacaauggguccuaccaagcuacucaggacgcgacguacacaacguccaccucgccccagcugucgcaccaacauuucccggggaacaaauccucuucuuccgcuccaccaugcccggcuguuccggcuacccaaacauggaccucgacugccuacuaccccaggaguggguccaacauuucuaccaagaagccgcuccugcccaauccgaugucgcccuacuccgguucguaaaccccgacaccggccguguacucuucgaaugcaaacuacacaaauccggcuacgucaccgucgcccacacgggccaacacgaccucgucauucccccaaacggcuacuuccgcuucgauuccugggucaaccaauuuuacacacuugcccccauggguaacggcaccggccgacgccgagcccuuuaa

SEQ ID NO: 35402 - RNA, 1623 nt, Artificial Sequence
  derived and/or modified sequence opt11 from capsid_protein_VP1__Norovirus__AGE89562
augaaaauggccucaaacgacgcaaaucccucagacggcucagcagccucccucguuccugaagucuccaacgaagucauggccuuagaaccagucgucggcgcagccaucgccgcacccgucgccggacaacaaaacgucaucgacccauggauccgaaacaacuucguccaagccccuggaggcgaguucaccguauccccacguaacgcaccaggugaaauccuuugguccgcaccccucggcccagaccucaacccauaccucucacaccuagcucgcauguacaacggcuacgcaggcggauucgaaguccaaguaauacucgccgguaacgccuucacagccggaaaaaucaucuucgccgccguaccgcccaacuuccccaccgaaggcuuaucucccucccaagucacaauguucccccacauaauagucgauguccgccaacucgagccaguacucaucccccucccagacguccgcaacaacuucuaccacuacaaccaaaccaacgaccccaccauaaaacuaaucgcaaugcucuacacuccauuacgcgccaacaaugccggcgaagacgucuucaccgucuccugccgaguccucacacgccccagucccgacuucgacuucaucuuucucgucccucccacagucgaaucccgcaccaagcccuucaccguccccauccucacaguagaggaaaugaccaacucccgauuccccauuccccucgaaaaacuauucacaggcccauccggcgcauucguaguccaaccacaaaauggacgaugcaccaccgacgguguccuacucggaacaacacaacuaagccccguaaauaucugcaccuuccgaggagacguaacacacaucgcuggcucucguaacuauaccaugaaccucgcgucccucaacuggaacaauuaugaccccaccgaagaaaucccugcuccccuaggcacccccgacuucgucggcaaaauacaaggcguccucacccagaccacaaaaggugacgggagcacccgaggccacaaagcaaccgucuacaccggcucagccccauucacacccaaacucggaaguguacaauucuccaccgacacagaaaacgacuucgaaacacaccaaaacaccaaguucacacccguaggcgucauccaagacggaggcaccacacaccguaacgaaccccagcaauggguacuccccuccuacuccggacgcgacguacacaacguucaccucgccccugccgucgccccaaccuuccccggcgaacagcuccucuucuuucgcuccaccaugcccggaugcuccggcuaccccaacauggaccuugacugccuccucccccaagaauggguccagcacuuuuaccaagaagcagcccccgcucaaucagacgucgcacuccuccgauucgucaauccagacacaggcagaguacucuucgaaugcaaacuacacaaaucaggcuacgucaccgucgcccacaccgggcaacacgaccuagucaucccucccaacggcuacuuccgauucgacuccugggucaaccaguucuacacccuagccccuaugggcaauggcacaggacgccgcagagcacucuag

SEQ ID NO: 35403 - RNA, 1623 nt, Artificial Sequence
  derived and/or modified sequence opt11 from capsid_protein_VP1__Norovirus__AGE89565
augaaaauggccucaaacgacgccaaccccucagacggcucggccgcaaaccucguacccgaaguaucaaacgaagucauggcacuugaaccaguggucggcgccgcgaucgcagcacccgucgcuggccaacaaaacgucaucgaccccuggauccguaacaacuuuguacaagcucccgguggcgaguucacuguaucaccccgcaacgcccccggagaaauacuauggucagcaccccucggcccagaccuaaaccccuaccuaagucaccuagcccgcauguacaacggcuacgccggcgguuucgaaguccaagucauccuagccggaaacgccuucaccgccggcaaaaucaucuucgcugcaguacccccaaauuucccaaccgaaggccuaucaccaucccaagucaccauguuuccccacauaaucgucgacguccgccaacucgaacccguccucauccccuuacccgacgucagaaacaacuucuaccacuacaaccaaaccaacgacucaaccaucaaacucaucgcaaugcucuacacaccccuacgugccaacaaugccggugaagacguauucaccgucucaugcagaguccucacccgcccuucacccgacuucgacuucaucuuccuaguacccccuaccguugaaagccgaaccaagcccuucacagucccuauccuaaccgucgaagaaaugaccaacucuagauuccccauaccucucgaaaaacucuucacaggacccucaggcgccuuugucguccaaccccaaaacggccggugcacaacagauggaguacuacuaggcacaacacaacuuuccccagucaacaucugcaccuuucgaggcgacgucacccacaucgcaggcucccgcaacuacacaaugaaccucgccucacucaacuggaacaacuacgacccuacugaagaaacgcccgcuccccucggaaccccagacuucgucggaaagauccaaggcguccucacacaaaccaccaaaggagacggcuccacccgcggccacaaagccacagucuacaccggaucagcgccauucacccccaaacucggaucuguccaauucucaaccgacaccgaaaacgacuucgaaacucaccaaaacaccaaauucacccccguaggcguaauccaagacggaggcacgacacaccgcaacgaaccccaacaauggguccucccaucguacuccggacgagacguacacaacguccacuuagcacccgcagucgcuccaaccuucccaggcgaacaacuccuauucuuucgcuccaccaugcccggcugcucaggauacccaaacauggaccucgacugccuacucccacaagaauggguucaacauuucuaccaagaagccgcucccgcccaguccgacguagcacuccuccgcuucgucaaccccgacaccggccgaguacucuucgaaugcaaacuacacaaauccgguuacgucaccguggcucacaccggacaacacgaccucguaaucccacccaauggcuauuuccgauucgacuccuggguaaaucaauucuacacccuagcccccaugggcaacggcaccggaagacgacgcgcccucuaa

SEQ ID NO: 35404 - RNA, 1623 nt, Artificial Sequence
  derived and/or modified sequence opt11 from capsid_protein_VP1__Norovirus__AGE89568
augaaaauggccucaaacgacgcgaaucccagcgacggcuccgccgccaaccuaguucccgaagucucaaacgaagucauggcgcucgaacccgucguaggcgccgccaucgccgccccaguagcaggccaacaaaacguaaucgacccauggauccgcaacaacuucguccaagcucccggaggcgaguucaccgucucgccccgaaacgcgccaggcgaaauccuuugguccgcaccccuuggcccagaccucaacccauaccucucccaccucgcacgaauguacaacggauacgccggcggcuucgaaguacaaguuauucucgccggaaacgccuucaccgccggcaaaaucaucuucgccgccguacccccaaacuucccaaccgaaggucucucccccucccaagucaccauguuuccccacaucaucgucgacguccgacaacuagaacccguccucaucccccucccagacguccgcaacaacuucuaccacuacaaccaaacaaacgacuccaccauaaagcucaucgccaugcuuuacacaccacuccgcgccaacaacgccggugaagacgucuucaccgucucaugccgcguccucacacgaccaucccccgacuucgacuucaucuuccucguaccacccacgguagaaucccgcacaaaaccauucaccguccccauacuaaccguugaagaaaugaccaacucacgcuuccccauuccacucgaaaagcucuuuacagguccaucuggcgcauucguaguccaaccucaaaacggucgcugcaccacagacggcguccuacucggcacaacccaacucagccccgugaauaucugcaccuucagaggcgacgucacacacaucgccggcucacgaaacuacaccaugaaccucgccucauuaaacuggaacaacuacgacccuaccgaagaaauaccagccccgcucgguacacccgacuucgucggaaaaauacaaggaguacucacacaaaccacaaaaggugaugguuccacccguggccauaaagccaccgucuacaccggauccgcccccuucaccccgaaacucggaucuguccaauucucaaccgauaccgaaaacgacuucgaaacccaccaaaacaccaaauucacacccguaggcgucauccaagacggcggcacaacacacagaaacgaaccccagcaauggguucuccccucauacuccggucgcgacguacacaacguccaccuugcaccagccgucgcccccaccuuucccggcgaacagcuacuauucuuccgguccaccaugccaggaugcuccggcuaccccaacauggaccucgacugcuuacucccucaagaauggguccaacacuucuaccaagaagccgccccagcacaaagugacgucgcucuccuccgauucgucaaccccgacaccggacguguacucuucgaaugcaaacuacacaaaagcggcuacgucaccgucgcccacacaggccaacacgaccuagucaucccacccaacggauacuuccgauucgacucauggguuaaccaauucuacacucucgcacccaugggaaauggcaccggucgccgcagagcccucuaa

SEQ ID NO: 35405 - RNA, 1623 nt, Artificial Sequence
  derived and/or modified sequence opt11 from capsid_protein_VP1__Norovirus__AGE89571
augaaaauggccuccaaugacgccaaccccuccgacggcuccgcagccaaccuaguccccgaagucuccaacgaagucauggcgcuagaacccgucgucggagccgccaucgccgcccccgucgccggacagcaaaacgucaucgaccccuggauccgaaacaacuucgugcaagcccccggaggagaguucacugucagcccacgaaacgcccccggcgagauccucugguccgcaccacucggaccugaccuaaaucccuaccuaucccaccuagcccgaauguacaacggauacgcaggcggcuucgaaguccaagucauacuagcuggcaacgcuuucacagccggcaaaaucaucuucgccgcagugcccccuaacuucccgaccgaaggccucucacccucacaagucaccauguucccacacaucaucguugauguccgccagcucgaacccguccuaaucccgcuccccgauguucgcaacaacuuuuaccacuacaaccaaaccaacgacucaacuauaaaacucaucgcuaugcucuacacuccccuacgcgccaacaacgccggagaagacguauucaccgucuccugccgcguccuaacccggccuucaccugacuucgacuucauauuccugguaccacccacuguagaaucccgaacaaaacccuucacaguacccauccucaccguagaagaaaugaccaacucccgcuuccccauaccccucgaaaaacuuuucaccggccccucaggagccuucgucguccaaccccagaacggccgaugcacaaccgacggaguacuacucgguacaacgcaacuauccccaguaaacauaugcaccuuccgaggcgacguaacccauaucgcaggcucccgaaacuacacaaugaacuuagccucacucaacuggaacaacuacgaccccaccgaggaaauccccgcuccccugggcacccccgauuucgucggcaaaauccaaggcguacucacucaaaccaccaaaggugacggcuccacaagaggacacaaagccacaguauacaccgggagcgccccauucacaccaaaacucggcuccguacaauucucaaccgacacggaaaacgacuucgaaacccaccaaaauacaaaauucaccccagucggcgucauccaggacggcggcacaacccaccgcaacgaaccccaacaauggguucuacccagcuacucuggccgcgacguacacaauguucaccucgcuccagccgucgcccccacauuucccggagaacaacuccucuucuuccgauccacaaugcccggaugcuccggauaccccaacauggaucuagacugccuccuaccccaggaauggguacaacauuucuaccaagaagccgcccccgcccaaucugacguagcccuccuccgauucgucaaccccgacaccggacgcguccucuucgagugcaaacuccauaaaaguggauacgucacgguagcccacaccggccaacacgaccuagucaucccacccaacggcuauuuccgcuucgacuccugggucaaccaauucuacacccucgcccccaugggcaacggcacaggacgccgccgagcacucuaa

SEQ ID NO: 35406 - RNA, 1623 nt, Artificial Sequence
  derived and/or modified sequence opt11 from capsid_protein_VP1__Norovirus__AGE89574
augaagauggcauccaacgacgccaacccaagcgacggcuccgcggccaaccucguccccgaagucuccaacgaagucauggcccuagaaccaguagucggcgccgcuaucgccgcacccgucgccggccaacaaaacguaauagacccauggauucgcaacaacuucguacaagcccccggcggagaguucaccgucagcccccgcaacgcucccggcgaaauccuaugguccgccccacuaggacccgaccuaaacccauaccucucccaccucgcccgcauguacaacggauacgccggcgguuucgaaguccaagucauccuggccggcaacgcauucaccgccggcaagaucaucuucgccgccguuccacccaacuuccccaccgaaggucucucaccaucucaaguuacaauguucccacacauaaucguugacguccgccaacuagaacccguccuaaucccccuaccagauguacgcaauaacuucuaccacuacaaccaaaccaacgacucaacaaucaagcucauagccaugcuauacacaccccuccgcgcaaacaacgccggcgaagacgucuucaccgucucaugccgaguccucacccgacccucccccgacuucgacuuuaucuuccucguuccacccaccguagaaucaagaaccaaacccuucaccguccccauacucaccgucgaagaaaugacaaacucccguuuccccaucccccuugaaaaacucuucaccggccccuccggugccuucguaguccaaccacaaaacggccgcugcacaaccgacggaguccuccuuggcacaacccaacucuccccaguaaacaucugcaccuuccguggagacguuacccacaucgccggaucacgcaacuacacaaugaaccucgccagccuaaacuggaacaacuacgaccccaccgaagaaauccccgccccacucggcaccccugacuucgucggaaagauacaaggcguccuaacccaaacaaccaaaggcgacgguuccacucgcggacacaaagccacaguauacaccggaucugcccccuucacccccaaacuuggcucaguacaauucuccacugacaccgaaaacgacuucgaaacccaccaaaacacaaaauucacuccagucggaguaauccaagauggcgguacuacgcacagaaacgaaccccaacaauggguucuacccuccuacucuggccgugauguccacaacguccaccucgcucccgccgucgcccccaccuucccaggagaacaacuccucuucuuccgcucuacuaugccaggaugcagcggauaccccaacauggaccucgacugccuacucccccaagaguggguccaacacuucuaucaagaagcagcccccgcccaauccgauguugcacuccuccgcuucguuaacccagacacaggcagaguucucuucgaaugcaaacuacacaaaucuggcuacgucacagucgcccacacaggccagcacgaccucguuaucccacccaacggauacuuccgcuucgacucaugggucaaccaauucuacacacucgcaccaaugggcaacggcaccggacgccgucgcgcgcuauaa

SEQ ID NO: 35407 - RNA, 1623 nt, Artificial Sequence
  derived and/or modified sequence opt11 from capsid_protein_VP1__Norovirus__AGE89577
augaaaauggcaagcaacgacgccaaucccucagacggguccgccgccaaccuaguacccgaagucucaaacgaagucauggcacucgaacccgucguaggagccgccaucgccgccccgguagcaggacaacaaaacguaaucgaccccuggauacgaaacaacuucguccaggccccagguggcgaguucaccgucucuccacgaaacgcacccggagaaauccuaugguccgcaccucucggaccagaccuaaaccccuaccucucccacuuagcaagaauguacaacggcuacgcgggcggguucgaaguccaaguaauacucgccggaaacgccuucaccgcaggcaaaaucauauucgcggccgucccucccaacuuccccacugaaggccucucccccucacaagucacaauguuuccacacaucauagucgacgugcgccaacuagaacccguccucaucccccuucccgacguccguaacaacuucuaucacuacaaccaaaccaacgacucaaccauuaaacuaauagccaugcuauacaccccacuucgagcaaacaacgccggcgaagacguauuuaccgucuccugccgcguucuuacccgucccucacccgacuucgacuucauauuccuaguacccccaaccgucgaaucccgcaccaaacccuucacaguacccauacuaaccguagaagaaaugaccaacucacgauuccccauaccacuugaaaaacucuucaccggucccuccggcgccuucgucguccaaccccaaaacggucgaugcaccacagacggcguccuccuaggcacaacacaacucucacccgucaacaucugcacauuccgcggcgacguaacccacaucgcuggcucacguaacuacaccaugaaccucgccucccuuaacuggaauaacuacgacccaacugaagaaaucccagcaccccucggcacccccgacuucguaggcaaaauccaaggcguuuuaacccaaacuaccaaaggcgacggcucaacacgaggucacaaagccacagucuacacggguuccgcccccuucacccccaaacucgguucaguacaauucagcaccgacaccgaaaacgacuucgaaacccaucaaaacacaaaauucacccccguaggcguaauccaagacggcggcacuacacacagaaacgaaccccagcaauggguccucccaucauacucaggccgugacguccacaacguccaccuagcacccgcagucgcccccacauuccccggugaacaacuccucuucuuccgcucaacaaugcccggcugcuccggcuacccuaacauggaccuagacugcuuacucccccaagaauggguacaacacuucuaucaagaagccgcucccgcccaauccgauguagcucuacuccgauucgucaaccccgacaccggccgaguucuguucgaaugcaaacuccacaaauccggauacguaacaguagcccacaccggccaacacgaccucguaaucccucccaacggcuacuuccgauucgacagcugggucaaccaauucuacacccucgcccccaugggaaacggcacaggccgccgcagagcccuuuga

SEQ ID NO: 35408 - RNA, 1623 nt, Artificial Sequence
  derived and/or modified sequence opt11 from capsid_protein_VP1__Norovirus__AGE89580
augaaaauggccuccaaugacgccaacccaucugacggcuccgccgcaaaccuaguaccagaaguauccaacgaagucauggcccucgaacccgucgucggcgcggccauugccgcccccgucgccggacaacaaaacgucauagaccccuggauccgcaacaacuucguccaagcaccaggcggagaauuuaccgugucaccccgaaacgcccccggcgaaauucucuggucagcaccccucgguccagaccucaacccauaccuuucccaccucgcccgcauguacaacggcuacgccggcggcuucgaaguccaagucauccucgccggcaaugccuucaccgcagggaaaaucaucuucgccgcagucccucccaacuuucccaccgaaggccucucccccagucaaguaacaauguucccccacaucauagucgacguacgacaacucgaacccguccuaaucccccuacccgacgucaggaacaacuucuaucacuacaaccaaaccaacgacucaaccaucaaacucaucgccaugcucuacacgccccuccgagccaauaacgccggcgaagacguuuucaccguaucuugccguguccucacccgccccuccccagacuucgauuucauauuccucgugccacccaccgucgaaucccgcaccaaacccuucacaguucccauccucaccgucgaagaaaugacaaacagccgcuuucccauaccccuggaaaaacuuuucaccggccccagcggagccuuuguuguccaaccccaaaacggccggugcacaaccgacgguguccuccucggcaccacccagcuaucaccagucaacaucuguaccuucagaggcgacguaacccacaucgccggcucacgugacuacaccaugaaccucgccucucucaacuggaacaacuacgaccccacagaagaaaucccugcuccccugggcacaccagacuuuguaggcaagauucaaggcguccucacccaaaccaccaaaggagacggcuccacucgaggacacaaagccaccguuuacacaggcucugcacccuucacccccaaacuuggcucuguccaauucucaaccgacaccgaaaacgacuucgaaacccaucaaaacaccaaauuuaccccaguaggaguaauacaagacggcggcaccacccaccgcaacgaaccacaacaauggguccuucccuccuacuccggccgcgacguccacaauguacaucuagcccccgccgucgcucccacuuucccaggugaacagcuccuauucuuucguuccaccaugcccggcugcuccggcuaucccaauauggaccucgacugccuacuaccacaagaauggguacaacauuucuaccaagaagcugcccccgcccaauccgacguugcacuccuacgcuucguuaacccagacacaggccgcguacucuucgaaugcaaacuccacaaauccggauacgucacugucgcccacacuggccaacacgaccucgucaucccacccaauggcuacuuccgcuucgacucaugggucaaccaauucuauacccucgcccccaugggcaacgggacaggacgacgccgcgcccuauga

SEQ ID NO: 35409 - RNA, 1623 nt, Artificial Sequence
  derived and/or modified sequence opt11 from capsid_protein_VP1__Norovirus__AGE89583
augaaaauggcauccaacgacgccaaccccuccgacggcuccgccgcaaacuuaguccccgaagucuccaacgagguuauggcccuagagccaguagucggcgccgccaucgccgcacccgucgccggacaacaaaacguaaucgacccuuggauccgcaacaacuucguacaggccccggguggagaguucaccguaucaccaagaaacgcccccggcgaaauccuuugguccgccccacucggaccggaccuuaacccuuaccucucucaccuagcccgcauguacaacggauacgccgguggcuuugaaguacaaguaauacucgcaggcaacgccuucaccgcuggcaaaaucauauucgcagcaguaccucccaacuuccccaccgaaggccuuagccccucacaagucacaauguucccacacaucauugucgacguucgacaacucgaacccguccucaucccacuaccagauguccgcaacaacuucuaccacuauaaccagacuaacgacuccaccaucaaacucaucgcaaugcuuuacacaccacuccgagccaacaacgccggcgaagacgucuucaccgucuccugccgcguacucacccgccccucucccgacuucgacuuuaucuuccucguaccaccaacagucgaaucucgaaccaaacccuucaccgugcccauccucaccgucgaagaaaugaccaacucccgauuccccaucccccuugaaaaacuuuucaccggccccuccggggccuucgucguacagccccaaaacggccgcugcaccacugacggcguccugcucggcaccacacaacuaucccccgucaacaucugcaccuuccgaggagacguaacacacauugcaggaucucgcaacuauaccaugaaccuagcaucccucaacuggaacaacuacgaccccacagaagaaauccccgccccgcucggcacccccgacuucgucggcaaaauucaaggcguccucacccaaaccacaaaaggagacggcagcaccagaggccauaaagccacuguguacacaggcucagcccccuucacaccuaaacucggcucgguccaguucucuacugacacagaaaacgacuucgaaacccaucaaaacacaaaauucacccccgucggugucauccaagacggcggcaccacacaccgcaaugaaccccaacaauggguucuccccuccuacuccggacgagacguccacaacguacaccucgcccccgccguagcccccaccuuccccggcgaacaacuccuauucuuccgauccaccaugccaggaugcuccggauaccccaacauggaccucgacugccuccuaccccaagaauggguccaacacuuuuaccaagaagccgcuccagcacaaagcgauguggcucugcuucgcuucguaaaccccgacacuggccgcguacuauucgaaugcaagcuccacaaguccggauacguaaccgucgcccacaccggccagcacgaccucgucauacccccaaacggcuacuuccgauucgacuccuggguaaaccaauucuacacccucgcucccaugggaaacggaaccggccgccgccgagcccuauaa

SEQ ID NO: 35410 - RNA, 1623 nt, Artificial Sequence
  derived and/or modified sequence opt11 from capsid_protein_VP1__Norovirus__AGE89586
augaaaauggcauccaacgacgccaaccccuccgacggaucggccgccaaccuagucccagaagucuccaacgaaguaauggcacucgagccugucgucggugcagcaauagcagcacccgucgccggucaacaaaaugucaucgacccauggauccgcaacaacuucguacaagcacccggaggcgaguucacugucuccccacgaaacgccccaggcgaaauccucuggucagcuccccuaggccccgaccuaaauccauaccucucccaccucgcccgcauguacaacggcuacgccggaggauucgaaguccagguaauacucgccggaaacgccuuuaccgccggcaaaaucaucuucgccgccguaccacccaacuuccccacagaaggacuaucccccucccaaguaaccauguucccacacaucauaguagacguacgacaacuugaacccguacucaucccccucccagacgucagaaacaauuucuaucacuauaaccaaacaaacgaccccaccaucaaacucauagccaugcucuauaccccacuacgggccaacaacgcaggcgaagacgucuucaccguauccugccgcguccucacccgcccaucccccgacuucgacuucauauuccucguacccccaacugucgaaucccgaacaaaaccauuuacagucccaauucuuaccguagaagaaaugaccaacuccagauucccaaucccccucgaaaaacuauucaccggucccucuggcgcauucgucguccaaccccaaaacggcagaugcaccacagacggcguccuacuggguacaacccaauuaucccccgucaacauaugcaccuuccgcggcgacgucacccacaucgccggcucacgaaacuacaccaugaaccucgcgucacucaacuggaacaacuacgaccccaccgaagaaguaccagcuccccucggcacacccgacuucguaggaaaaauacagggcguccuaacccaaaccaccaaaggcgacggcucaacacguggacacaaagccaccguauacaccggcagcgcucccuucaccccaaaacuaggcucgguccaauucucaacagacaccgaaaacgauuuugaaacccaucaaaauacaaaauucacaccagucggcgucauucaagacggaggcaccacccaccgcaacgaaccacaacaauggguacucccuuccuacuccggacgagacguccacaacgugcaccucgccccugcagucgcccccaccuuccccggagaacaacuacuauucuuucgcucaacaaugcccggaugcagcggcuacccuaacauggaccucgacugucugcuaccccaagaauggguccaacacuucuaccaagaagcugcccccgcacaaucggacgucgcccuccucagauucgucaacccagacaccggacgcguccucuucgaaugcaaacuccacaagucaggauacgucacuguagcccacaccggucaacacgaccucgucaucccucccaacggauacuuccgcuucgacuccuggguaaaccaauucuacacccuagcccccaugggcaacggcacgggccgccgacgcgcccucuaa

SEQ ID NO: 35411 - RNA, 1623 nt, Artificial Sequence
  derived and/or modified sequence opt11 from capsid_protein_VP1__Norovirus__AGE89589
augaaaauggccucaaacgacgccaacccauccgacggcucugccgccaaccuaguacccgaagucuccaacgaagucauggcgcucgaaccagucgucggcgccgcuauagcagcaccugucgcaggccaacaaaacguaauagaccccuggauacgcaauaacuucguucaagcccccggcggugaguucaccgucuccccacgcaacgcacccggcgaaauccucugguccgcaccccuaggucccgaccuaaacccguaccucucccaccuggcccgcauguacaacgguuaugccggcggauucgaaguccaaguaauucucgccggcaacgcauucaccgcagguaaaaucaucuucgccgcuguuccucccaacuuuccaacugaaggccucucccccucccaagucacuauguucccccacaucauagucgacguccgacaacucgaacccguccugaucccccucccagacguccguaacaacuuuuaucacuauaaccaaaccaacgacuccaccauaaaacucaucgcaaugcuuuacacgccccuccgcgcaaacaacgcaggagaagacgucuucaccgucuccugccgaguccucacccgccccucgccagacuucgacuucaucuuccucguaccacccacagucgaaucacgcaccaaacccuucacaguucccauccuaaccgucgaagaaaugacuaacucccgcuuccccaucccccuagaaaaacucuucaccggacccucaggcgccuucguaguccaaccucaaaacggccgcugcaccacugacggcguucucuuaggcaccacccaacuuucacccguuaacauaugcaccuuccgcggagacgucacccacaucgccggaucacgcaauuacacaaugaaccucgccucccuaaacuggaacaacuacgaucccacagaagaaaucccugcaccccucggcacccccgacuucguaggcaaaauacaagguguucucacacaaacaaccaaaggcgacggcucuacccgcggacacaaagccaccgucuacacaggaucagcaccguucacccccaaacucggcuccguccaguucuccaccgacacagaaaacgacuucgaaacgcaccaaaacaccaaauucacccccguaggcgucauacaagacggcggaaccacacaccguaacgaaccccaacaauggguccuccccuccuacuccggccgagacguccacaauguccaccuggcccccgccguagcccccaccuuuccuggcgaacaacuacucuucuuccgcucaacaaugcccggcugcuccggauaucccaacauggaccucgacugccuucuaccccaagaauggguccaacacuuuuaucaagaagccgcacccgcccaauccgacguugcccuccuacgcuucgucaaccccgacaccggacgcguccucuucgaaugcaaacuucacaaguccggcuacgucaccguagcccacaccggccaacacgaccucguaaucccaccgaacggcuacuuccgcuuugacuccuggguaaaccaauucuacacacucgccccaauggguaacggcacuggccgccgucgugcccucuga

SEQ ID NO: 35412 - RNA, 1623 nt, Artificial Sequence
  derived and/or modified sequence opt11 from capsid_protein_VP1__Norovirus__AGE89592
augaaaauggcauccaacgacgccaaccccucagacggcuccgccgccaaccuagugcccgaagucuccaacgaagucauggcacucgaacccguugucggggcagccauagcagcacccgucgcgggccaacaaaacgucaucgaccccuggauacgcaauaacuucguccaagcaccaggcggugaguucaccgucucaccacgcaaugcccccggcgaaauccuaugguccgcaccccuuggucccgaccuaaauccauaucucucccaccuggcccgcauguacaacggcuacgccggcggcuucgaaguccaagugauccucgccggcaacgcauucacagccgguaaaauuaucuucgccgccgucccucccaacuuccccacugagggccuuucacccucccaaguuacaauguucccccacaucauagucgauguccgccaacucgaacccguccuaauaccucuacccgauguccgcaacaauuucuaucacuacaaccaaaccaacgacucaacaaucaaacuaaucgccaugcuguacacaccccugcgagccaacaacgccggugaagacgucuuuacaguauccugccgcguucucacacggccaucucccgauuuugacuucaucuuccucgucccacccaccguagaaucucgaaccaaacccuucaccguaccuauacucaccguugaagaaaugaccaauucucgauuccccaucccucucgaaaaacuauucacgggccccuccggcgccuucgucguccaaccccaaaacggacgcuguaccacagacggaguccuucuuggaacaacccaacucuccccuguaaauaucugcaccuuccgcggagacgucacccacauagccggaucccgcaacuacacaaugaaucuugccucacugaacuggaacaacuacgauccuaccgaagaaauacccgccccacucggaacccccgacuucguaggcaaaauccagggaguccuaacccaaaccaccaaaggcgacggcagcacccgcggccacaaagccaccgucuacaccggcucugcacccuucaccccuaaacuaggcuccguacaauucuccaccgacaccgaaaacgacuucgaaacacaccaaaacaccaaguucacccccgucggcguuauacaagacggcggcaccacccaccgaaacgaaccccaacaguggguccucccaucguacuccggccgcgacguucacaacguccaccucgccccugccguagccccuacauuccccggcgaacaacuccucuucuuccgaucuaccaugcccggcugcuccggauacccaaacauggaccuagacugccuccuaccacaagaguggguccagcacuuuuaccaagaagcagccccagcccaaagcgacguggcacuccuucgcuucguaaacccggacacuggacgaguccuauucgaaugcaaacuccacaaaucaggcuacgucacagucgcucacacuggccaacaugaccucguaauaccaccgaacggcuacuuccgauucgacuccuggguaaaccaauuuuacacccucgcacccaugggcaacggcacaggccgccgccgcgcccucuaa

SEQ ID NO: 35413 - RNA, 1623 nt, Artificial Sequence
  derived and/or modified sequence opt11 from capsid_protein_VP1__Norovirus__AGE89595
augaaaauggccagcuccgaugccaacccguccgacggcuccacagcaaaccucgucccagagguaaacaacgaaguaauggcccuugaacccguagucggcgcagcaaucgcagcccccgucgcaggccaacaaaacgucaucgaccccuggauacgcaacaacuuuguacaagccccaggaggagaguucacugucagcccacgcaacgcccccggagaaauccuuugguccgcuccccuaggccccgaccuaaaucccuacuuaucccaccuagcccgaauguauaacggcuacgccggcggcuucgaaguccaaguaauauuagcaggcaacgccuucaccgcaggcaaaauuaucuuugcagccguaccucccaacuucccaacugaaggccucucaccaucccaaguaaccauguucccacacaucaucgucgacguccgccaacucgagcccguccucauaccccucccagauguucgcaacaacuucuaccauuauaaccaauccaacgaccccaccaucaaacuaaucgcaaugcucuacacaccccuccgcgcaaacaacgccggugacgacguauucacugucuccugccgcgugcucacacgcccgucaccugacuucgacuuuaucuuccuagucccacccacuguagaaagccguacuaaacccuucuccguccccguucuaaccgucgaagaaaugacuaacucccgcuucccaauaccccuagaaaaacucuucaccggcccaagcuccgccuucguaguccaaccucagaacggccgcugcaccacagacggcguacuccucggaaccacccaacuaucucccgucaacaucugcaccuuccgcggggacgucacccacauccccggaagccgcaacuacaccaugaaccuugcaucccaaaacuggaacuccuacgaccccaccgaagaaauacccgcaccccucggcacacccgacuucgucgguaaaauccaagguguacuaacccaaaccacacgaacaaacggauccacacgcggccacaaggccaccgucuacacaggcucagccgacuucagccccaaacucggccgcguccaauucgccacggacacagacaacgauuucgagacaaaccaaaacacaaaauucacccccgucggcgucauccaagacggcucaaccaccccucgcaacgaaccacaacaauggguacuccccucauacucaggccgaaacauacauaacguccauuuagcccccgccgucgccccuaccuuccccggcgaacaacuccuauucuuccgaucuacaaugccaggaugcuccggcuaccccaacauggaccucgacugucuccuuccccaagaauggguacaauacuucuaccaagaggccgccccagcccaaagcgauguugcccuccuacgcuuugucaacccugacaccggcagaguccuauucgaauguaaacuccacaaguccggcuacgucacaguagcccacaccggccaacaugaccucgucaucccucccaauggcuacuuccgcuucgacuccugggucaaccaguucuacacccuagccccuaugggcaacggcacgggccgaagacgagcccucuga

SEQ ID NO: 35414 - RNA, 1623 nt, Artificial Sequence
  derived and/or modified sequence opt11 from capsid_protein_VP1__Norovirus__AGE89598
augaaaauggccuccaacgacgccaaccccuccgacggcuccgccgccaaccucguccccgaaguauccaacgaagucauggcacucgaaccaguagucggagccgcgauagcagcacccgucgccggacaacaaaacgucaucgaccccuggauccguaauaacuucguacaagccccagguggagaguucacaguaucaccacgcaacgcaccaggcgaaauccucugguccgcaccccucggcccagaccucaauccuuaccucucccaccucgccagaauguacaacggcuacgccggcggcuucgaaguccaggucauacucgccggaaacgccuucaccgccggcaaaauaaucuucgcagccguacccccaaacuuccccaccgaaggccucucuccaucccaagucaccauguucccccauaucaucgucgacgucagacagcucgaaccaguacucaucccacugccagacguacgcaacaacuucuaccacuacaaccaaaccaacgacuccacaaucaaacugaucgcaaugcuauacacuccccuccgagccaacaacgccggcgaagacgucuucaccgucuccugccguguccucacccgcccaucccccgauuucgacuucaucuuucucguacccccaacagucgaaucacgcacaaaaccauucaccguccccauccucaccgucgaagaaaugaccaauucccgauuccccauaccacucgaaaaacucuucacaggacccuccggcgccuucgucguacaaccacaaaacggccguugcaccacagacggaguacucuuaggaaccacccaacucucucccgucaacaucugcacguuccgcggcgacgucacccacaucgcaggaucccgcaauuacaccaugaaccuugccucacucaacuggaacaacuacgaccccaccgaagaaauuccagcaccccucggcacucccgacuuuguuggcaagauacaaggcguccuaacccaaaccaccaaaggagacggcucaacacgcggacacaaagccacaguauacacaggauccgccccauucacccccaaacucggcuccguccaauuuuccacagacacagaaaacgacuucgaaacacaccaaaacaccaaauucacccccguaggagucauccaagacggcggaacaacccaccgcaacgaaccccagcaauggguccucccauccuacagcggacgcgacguccaaaauguccaccucgccccagccgucgcccccaccuuccccggagaacaacuccuauucuuccgaucaaccaugcccggcugcuccggcuaccccaauauggaccucgacugcuuacucccccaagaauggguccaacacuucuaccaagaagccgccccagcccaauccgacguagcccuccuacguuucgucaaccccgacacgggccgcguccucuuugaaugcaaacuucacaaaucuggcuacgucacagucgcccacacaggccaacacgacuuagucauaccacccaauggcuacuuccgauucgacucaugggucaaccaauucuacaccuuagcaccaaugggcaacggcaccggacgcaggcgagcccuauag

SEQ ID NO: 35415 - RNA, 1623 nt, Artificial Sequence
  derived and/or modified sequence opt11 from capsid_protein_VP1__Norovirus__AGE89601
augaaaauggcauccaacgacgccaaccccagcgauggcucugccgcaaaccuaguaccagaagucagcaaugaagucauggcacucgagccagucguaggcgccgccauagccgccccaguagcaggacaacaaaacguaaucgaccccuggauccgcaacaacuucguucaagcaccuggcggcgaguucaccguuuccccacgcaacgccccgggcgaaauccuaugguccgcaccacucggccccgaucucaaccccuaccuuucccaccucgcccgcauguacaacggcuacgcuggcggcuucgaaguccagguaauccucgcuggcaacgccuucacagccggcaaaaucauauucgcagccgucccucccaacuucccaaccgaaggccuuucccccagccaagucacaauguucccacacaucaucgucgacguccgccaacuugaacccguacucauaccccuccccgacguucgcaacaacuucuaccacuacaaccaaaccaacgacuccaccaucaagcucauugccaugcucuacaccccucuccgagccaacaacgcaggcgaagacgucuucaccgucuccugcagaguccuuacccgccccagcccagauuucgacuucauauuccuagugccacccacaguagaaucucgcacaaaacccuucacaguuccaauccucaccgucgaagaaaugacaaacucccguuucccuaucccucucgaaaaacuguucaccggccccuccggcgcauucgucguccaaccccaaaacggccgcugcaccaccgacggcguucuccuugguacuacccagcucucccccgucaauaucugcaccuuccgcggcgacgucacacacaucgcaggcucccgaaacuacaccaugaaccuagccucacuaaacuggaacaacuacgacccgaccgaagaaauccccgcaccccuagguacaccagacuucgucgguaaaauccaaggaguacucacacaaaccaccaaaggcgacggcagcacacgaggccacaaggccacagucuacaccggcucagcccccuucacccccaaacucgguuccguacaauucucaaccgacacugaaaacgacuuugaaacacaccaaaacaccaaauuuacacccgucggcguuauccaagauggcggcacaacccaccgaaacgaaccacagcaauggguccuacccuccuacuccggacgcgacguacacaacguacaccucgcccccgccgucgccccaaccuuccccggagaacaacuccucuucuuccgcucaaccaugccaggcugcuccggcuaccccaacauggaccucgacugccuccucccccaagaauggguccagcauuucuaccaagaagccgcucccgcccaaucugacgucgcccuacuucgcuucgucaacccagacacaggccgcguccucuucgaaugcaaacuacacaaaucaggcuauguaaccguagcacacacgggacaacacgaccucgucauaccacccaacggcuacuuccgcuucgacuccuggguuaaccaauucuacaccuuagcccccaugggcaacggcaccggccgcagacgagcccuauga

SEQ ID NO: 35416 - RNA, 1623 nt, Artificial Sequence
  derived and/or modified sequence opt11 from capsid_protein_VP1__Norovirus__AGE89604
augaaaauggccucgaacgacgccaacccaucagacggcagcgccgccaaccuaguccccgaagucuccaacgaagucauggcccucgaaccaguuguaggagcagccauagcagcccccgucgccggacaacaaaacgucaucgaccccuggauucgcaauaacuucguccaagcucccggcggcgaguucacagucuccccacgcaacgcccccggcgaaauccucugguccgcaccacucggacccgaccuuaacccauaccucucacaccuugcccguauguacaacggcuacgccggaggcuucgaaguucaagucauacucgccggcaacgcauuuacagcgggaaaaaucaucuucgccgcagucccacccaacuuucccacagaaggccucucacccucucaaguaacgauguucccccauauaaucguagacguccgacaacuagaacccguacuuaucccacuccccgacguccgaaacaacuuuuaccacuacaaccaaacaaacgacucuaccaucaaacucaucgcuaugcuauacacaccccuccgcgcaaacaacgccggcgaagacgucuucaccguuucaugccguguacucacacgcccaucacccgacuucgacuucaucuuccucgugcccccaacagucgaaucccguaccaagcccuuuaccguacccauccuaacggucgaagaaaugaccaacagucgcuucccuaucccacucgaaaaacucuucacaggaccguccggcgccuucgucguacaaccccaaaacggacgaugcacaaccgacggcgugcuucucggcaccacccaacucagcccuguaaacaucugcacauuccgaggcgaugucacccacauagccggcucccgaaacuacaccaugaaccucgccagccucaacuggaacaacuacgaccccaccgaagaaauucccgcuccccuaggaacacccgacuuugucggcaaaauucaaggcguacucacccaaacaaccaaaggagacggcucaacccgcggccacaaagccacuguuuauaccggcucugcccccuucacacccaaacucggcuccguucaauucagcacagacaccgaaaacgacuucgaaacccaccaaaacacaaaauucaccccagucggcgugauacaagacggcgggaccacccaccgaaacgaaccccaacaauggguccuccccucauacuccggccgcgacguccacaacguacaccuagccccugccgucgccccaacauucccaggagaacaacuccucuucuuccgauccaccaugcccggcugcuccggcuacccaaacauggaccuagauugcuuacucccacaagaauggguccagcacuucuaccaagaagccgcccccgcccaauccgaugucgcgcuccugcgcuucgucaaccccgacacaggccgaguccucuucgaaugcaaacuacacaagucaggauacgucacugucgcccacaccggccaacacgaccucguaauucccccuaacgguuacuuccgcuucgacuccuggguuaaccaauucuacacauuagcccccaugggcaacggaacaggccgucgccgugcccucuaa

SEQ ID NO: 35417 - RNA, 1623 nt, Artificial Sequence
  derived and/or modified sequence opt11 from capsid_protein_VP1__Norovirus__AGE89607
augaaaauggcuuccaaugacgcaaacccuucagacgguucagcagcaaaccuuguacccgaaguaucaaacgaggucauggcacuugaacccgucgucggcgcagccaucgccgccccagucgcaggccaacaaaacguaauagaccccuggauccgcaacaacuucguccaagcacccggcggcgaguucaccgucucccccagaaaugcaccaggcgaaauccuaugguccgcaccccuaggccccgaccuaaaccccuaccuuucccaccucgcccgaauguacaacggauacgccggcggauucgaaguacaagucauccucgccggcaacgccuucaccgccggaaaaaucaucuucgcugcaguucccccaaacuucccaacagaaggacuauccccaucacaagucaccauguucccacacauaaucgucgacgucagacaacucgaacccguccucaucccccucccggacguccgaaacaauuuuuaccacuacaaccaaaccaacgacucuaccaucaaacucaucgcuaugcucuauacaccccuccgcgccaacaaugccggugaagaugucuucaccgucucaugccgcguccucacccgccccucuccagacuucgacuucaucuuccuagucccucccacuguugaaucccgcaccaaacccuucacaguacccauccuaacagucgaagaaaugacgaacuccagauuucccaucccccuagaaaaacuauucaccggccccucaggcgcuuucgucguccaaccccaaaacggccgcugcacuacagacggaguacuccucggcaccacgcagcuuucccccgucaacaucugcaccuuccgcggcgacgucacccacaucgccggcucccgcaacuacaccaugaaccucgccagccucaacuggaacaacuacgacccaacagaagaaauacccgcuccccucggcacacccgacuucgucggaaaaauccaaggcguacuaacacaaacaaccaaaggcgauggaucaacccgcggacacaaagccacggucuauaccggcagcgcacccuucacacccaaacucggauccguccaauucuccaccgacacagaaaacgauuuugaaacccaccaaaacacaaaauucacccccguuggcguaauccaagacggcggaacaacccaccgaaacgaaccucaacaauggguacuacccuccuacucuggucgcgacguccacaacguacaccuugccccggccgucgccccuacauuucccggcgaacaacuccucuucuuccgcagcaccaugcccggaugcuccggcuacccuaauauggaccucgacugccucuuaccccaagaauggguccaacauuucuaucaagaagccgcacccgcacaaucagacguagcacuccucagauucguuaaccccgacaccggcagaguacuauucgaguguaaacuucacaaauccggcuaugucaccgucgcccacacaggccagcacgaccuagucaucccuccuaacggcuacuuccgcuucgacucaugggucaaccaauucuacacauuagcccccaugggcaacggcaccggacgccgccgagcccucuag

SEQ ID NO: 35418 - RNA, 1623 nt, Artificial Sequence
  derived and/or modified sequence opt11 from capsid_protein_VP1__Norovirus__AGE89610
augaaaauggcauccaacgacgcaaaccccuccgacggcucagccgcaaaccuaguaccagaaguauccaacgaagucauggcccuagaacccguuguaggcgccgccaucgcugcccccgucgccggccaacagaaugucaucgaccccuggaucagaaauaacuucguccaagcgccaggaggcgaauuuaccguaucaccccgcaacgcccccggcgaaauccucugguccgcaccccucggcccagaccucaaccccuaccuaucccaccuagcccgcauguacaacggcuaugccggcggcuucgagguccaaguaauacucgccgguaacgccuucaccgccggcaagauaaucuucgcagccguaccaccaaacuucccgaccgaaggacucucaccuucccaagucacaauguuuccacacaucauagucgacguccgacaacuagaacccguacucaucccccuccccgacguccgcaacaacuuuuaccacuacaaccaaaccaaugacuccacuaucaaacuuaucgccaugcucuacacaccgcuucgagccaacaaugccggcgaagaugucuucaccgucuccugucgaguccucacucgcccuucccccgacuucgacuucauauuccuaguucccccaaccgucgaaagucgcaccaaacccuucacagucccaauucuaacggucgaagaaaugaccaacucacgauuccccaucccccucgaaaaacuuuucacaggccccuccggagcauucgucguccaaccccaaaacggccgcugcaccaccgacgggguccuccucggcacaacacaacuaucuccggucaacaucuguaccuuccgcggcgacgucacccacauagccggaagucgcaauuacaccaugaaccucgccucccucaacuggaacaacuacgaccccacagaagaaauaccggcaccccucggcaccccagacuucgucggcaagauucaaggaguccucacacaaaccacaaaaggcgacggaucaacccgaggccacaaagccaccgucuacaccgguagcgccccauucacccccaaacuaggcagcguccaauucuccaccgacaccgagaacgauuucgaaacacaccaaaacaccaaauucacccccguaggagucauccaagacggcggcaccacccaccgcaacgaaccccagcaauggguacuaccaucuuacuccggccgagacguccacaacguccaccuugccccugcaguagcccccaccuuccccggcgaacaacuccucuucuuucgcuccaccaugccaggaugcucgggcuacccaaacauggaccucgacugccuucucccccaagaguggguucaacacuucuaccaagaagccgcacccgcccaauccgacguagcacuccuccgcuucguuaacccagacacuggaagaguacuauucgagugcaaacuccacaaaucuggauacgucaccgucgcccacacuggacaacacgaucugguaauaccacccaauggcuacuuccgauuugacucuuggguuaaucaauuuuacacacuugcccccaugggcaacggcaccggccggcgucgcgcccuauga

SEQ ID NO: 35419 - RNA, 1623 nt, Artificial Sequence
  derived and/or modified sequence opt11 from capsid_protein_VP1__Norovirus__AGE89613
augaaaauggccuccaacgacgcaaaccccagcgacggauccgccgccaaccucguacccgaagucucaaacgaagucauggcccuagaacccgucgucggcgcggccaucgccgcaccaguagcaggucaacaaaacgucauugaccccuggauucgcaacaacuucguucaagcucccggcggcgaguucacagucucaccacgcaacgcccccggagaaauccuaugguccgcuccucuaggcccagacuuaaaccccuaccucucccaccucgcacgcauguacaacggauaugcaggcggauucgaaguacaagucaucuuagccggaaacgccuucaccgccggcaaaaucaucuucgccgcaguaccucccaacuuccccacagaaggacucucgccaucacaaguuaccauguucccacacaucaucguagacguccgccaacucgaacccguucucauaccccuucccgaugucagaaacaacuucuaccacuacaaccaaacaaacgacucuaccauaaaacucauugccaugcuauacaccccacuucgcgccaacaacgccggugaagacguauuuaccgucuccugccgcguccuaacacgccccucacccgacuuugacuucauauuccucgucccacccacaguagaaucccgcaccaaacccuucacagucccaauccucacagucgaagaaaugacuaauucccgcuuccccaucccccuggaaaaacucuucaccggacccuccggugcauucgucguccaaccccaaaacggccgcugcaccaccgacgguguccuacucggcaccacacaacuuucccccguuaacaucuguacuuuccgaggugaugugacccacauagccgguucccgagacuacacaaugaaccuagccucacuaaacuggaacaacuacgaccccaccgaagaaauacccgccccucugggaaccccagacuucgucggaaaaauacaaggaguccucacccaaacaaccaaaggcgacggauccacacgcggccacaaggcuacagucuacacgggaagcgcccccuucacaccaaaacucggauccguacaauucucaacugauaccgaaaacgacuucgaaacacaccaaaacaccaaauucaccccagucggcguaauccaagacggcggcaccacacacagaaacgaaccucaacaguggguacuccccuccuacuccggccgcgacgugcacaacguccaccuagcacccgccguagccccaaccuucccgggagaacaacuccucuucuuccgauccaccaugcccggaugcucagguuaccccaacauggaccucgacugccuccuaccacaagaauggguacaacacuucuaucaagaggccgcacccgcccaaucugacgucgcacuacuccgauucguuaaucccgacacaggcagaguacucuucgaauguaagcuccacaaauccggauacgucaccguagcccacacaggccaacacgaccucgucaucccucccaauggcuacuuccgauucgacuccugggucaaccaauuuuacacacucgccccuaugggcaacggaacuggcagaagacgagcacucuaa

SEQ ID NO: 35420 - RNA, 1623 nt, Artificial Sequence
  derived and/or modified sequence opt11 from capsid_protein_VP1__Norovirus__AGE89616
augaaaauggccuccuccgacgcaaaccccuccgacggcucaaccgcaaaccuaguccccgaagucaacaacgaagucauggcccucgagccaguagugggcgcagccaucgcagcccccgucgccggacaacaaaacgucauugacccguggauacguaauaauuucguccaagcgcccggaggcgaguucacagucucacccagaaaugcucccggcgaaauccucugguccgccccacucggcccugaccucaacccauaccuaagccaccuagcccgaauguacaacgguuacgccggcggcuucgaaguccaagucauccucgcgggcaacgcauucaccgcaggcaaaaucaucuucgcagcugucccacccaacuuccccaccgaaggacucucccccucacaagucaccauguucccccauaucauagucgacguccgacaacucgaaccaguacuaaucccacuucccgacguacgcaacaacuucuaccacuacaaccaauccaacgacccaaccaucaaacuaaucgccaugcuauauacaccccugagagccaauaacgccggcgacgacguauucaccgucucaugccgcguccucacccgccccagccccgacuucgacuuuaucuuccucguacccccaaccgucgaaucacgaaccaaaccauucuccgucccaguccucaccgucgaagaaaugacaaacucccgcuucccuaucccccuagaaaaguuauuuaccgguccauccaacgccuuugucguacaaccccaaaacgggcguugcaccacagacggcguccuccuaggaacaacccaacuaucccccguaaacaucugcaccuuccgcggcgacgucacacacauacccggcucccgcaauuacacaaugaaccucgcaucacagaacuggaacucauacgacccuaccgaagaaaucccugcaccccuaggaacacccgacuucguuggaaaaauccaaggcguacucacccaaacaacccgaaccaacggcagcacacgcggacacaaagccacagucuacaccggcucagccgacuucucccccaaacuuggccgcguccaguucgccaccgacacagacaacgacuucgaaaccaaccaaaacaccaaauucacaccaguaggcgucauccaagacggaucuacaacaccccgcaacgaaccucagcaauggguccuccccuccuacuccggucgagacguccacaacguccaccucgccccugcagucgcccccaccuuccccggcgagcagcuauuauucuuccgcucaacuaugccagguugcucaggcuacccaaacauggaccuagacugccuccugccacaagaauggguccaauacuucuaccaagaagcagcacccgcccaauccgacgucgcccuacuccgauucgucaaccccgacaccggccgaguccuauucgaaugcaaacuacacaaauccggauacguaaccgucgcacacacaggccaacacgaucucgucaucccaccuaacggcuauuuccgcuuugacuccugggucaaccaauucuacacacuagcacccaugggaaauggaacaggccgccgccgugcccuauag

SEQ ID NO: 35421 - RNA, 1623 nt, Artificial Sequence
  derived and/or modified sequence opt11 from capsid_protein_VP1__Norovirus__AGE89622
augaaaauggccucaagcgacgcuaauccaucagacggcucaaccgccaaucucgucccugagguaaacaaugaagucauggcccuggaaccugucgucggcgccgccaucgcagccccugucgccggccaacaaaacgucaucgacccauggauccggaacaacuucguacaggccccaggaggcgaguucaccgucucaccacguaacgcccccggagaaauccuaugguccgccccacucggaccagaccucaaccccuaccucucucacuuagcccgaauguacaacggcuacgcugguggcuucgaaguccaagucauacuagccggaaacgcauucaccgccgguaaaaucauauucgcagccguacccccaaacuuccccaccgaaggccucuccccuucucaggucacaauguucccacauaucaucgucgauguacgccaacuagagccuguccucaucccccucccagacguccgcaacaacuucuaccacuauaaccagagcaacgaccccaccaucaaacucaucgcaaugcuauacacuccccuccgcgccaacaacgccggcgacgacgucuucaccgucuccugccgcguccugacacgacccucccccgacuucgacuucauauuccucguuccucccacagucgaaucacgaacaaaacccuucuccguccccguacucaccgucgaagaaaugacuaacucucgcuuccccaucccacuugaaaaacucuuuacaggccccucuuccgccuucgucguccaaccacaaaacggccgaugcaccacagacggaguacuacuaggaaccacccaacucucacccguaaacauuugcaccuuccgcggagacgucacccacauccccggaucccguaacuauacuaugaaccucgccucucaaaacuggaacuccuacgaccccacagaagaaauccccgcccccuuaggaaccccagacuucgucgguaagauucaaggaguccucacccaaacaaccagaacaaacggcagcacccgcggccacaaagccacaguauacacaggcuccgccgacuucucccccaaacucggacgcguccaguucgccaccgacaccgacaacgacuucgaaaccaaccaaaacaccaaauucacacccgucggcguaauccaagacggcuccacaacuccccgcaacgaaccacaacaauggguccuaccaucuuacagcggccgcaacauccauaacguccaucuugcccccgcuguagcccccaccuuucccggcgagcaacuccuauucuuccguuccaccaugcccggcugcuccggcuacccaaacauggaccuagauugccucuuaccccaggaauggguacaguacuucuaccaagaagcagccccagcccaauccgacguggcccuccuacgcuucgucaaccccgauaccggcagaguucuauucgaauguaaacuccacaaauccggcuaugucaccguagcacacaccggccaacacgaccuagucauaccucccaacggauacuucagauucgacuccugggucaaccaauucuacacacucgccccaaugggaaacggcaccggaagacgccgcgcccuauaa

SEQ ID NO: 35422 - RNA, 1623 nt, Artificial Sequence
  derived and/or modified sequence opt11 from capsid_protein_VP1__Norovirus__AGE89625
augaaaauggccuccagcgacgccaaccccucagacgguuccaccgcaaaccucguccccgaaguaaacaacgaaguaauggcacucgaaccugucgucggugccgcaauagccgcccccgucgccggccaacaaaaugucaucgaccccuggauccguaacaacuucguccaagcccccggcggagaauuuaccguaucaccccguaacgcacccggcgaaauccuaugguccgcccccuuagguccugaccuaaaccccuaccuuucccaccuugcacgaauguacaauggcuacgccggcggcuucgaaguccaagucauacuagccggaaacgcuuucaccgcaggaaagaucauauucgcagccgucccgcccaacuuccccaccgaaggucucuccccaucccaagucaccauguucccacacaucaucgucgacguccgucaacucgaacccguccucauaccccuuccagacguaagaaacaacuucuaccacuacaaucaauccaacgaccccaccaucaaacucaucgccaugcucuacacaccccucagagccaacaacgcaggcgacgacgucuucaccgucucaugccgcguacuaacuagacccucucccgauuucgacuucaucuuucucguaccacccacagucgaaucccgaaccaaacccuucuccguaccaguccucaccgucgaagaaaugaccaacucccgauucccuauaccccucgaaaaacucuucaccggcccauccuccgccuuuguaguccaaccccaaaacggccgcugcacaaccgacggaguacuccuaggcaccacccaacucuccccugucaacaucugcacuuuccgaggcgacguaacccacauccccggaucccgcaacuacaccaugaaccucgccucacaaaacuggaacuccuacgauccuacugaagaaauccccgcgccccuaggaacccccgauuucguuggaaaaauccagggcguccucacccaaaccacacgcaccaacggcaguacccgaggccacaaagcaaccgucuacacaggcucagcggacuucucccccaaacucggccggguccaauucgccacugacacugacaacgacuucgaaaucaaucaaaacaccaaauucacccccguaggugucauccaagacggcuccacaacuccccgcaacgaaccccaacaauggguccucccuucguacuccggccgcaacauccacaacguccaccuagccccagccgucgcccccacuuuccccggagaacaacuccucuucuuccgcuccaccaugcccggcugcucaggauacccaaacauggaccuugacugccuccucccucaagaauggguacaauacuucuaccaagaagccgccccagcccaauccgauguugcccuccuccgcuuugucaaucccgacaccggccgcguccucuucgaauguaaacuccacaaauccggcuacgucacagucgcacauaccggccaacaugaccucguaauaccacccaacggauacuuccgauuugacucuuggguaaaccaauucuacacucucgcccccaugggaaacggaacaggccgaaggcgugcccucuag

SEQ ID NO: 35423 - RNA, 1623 nt, Artificial Sequence
  derived and/or modified sequence opt11 from capsid_protein_VP1__Norovirus__AGE89628
augaaaauggcaucauccgacgccaaccccuccgacggcucaacagccaaccucguacccgaagucaacaacgaagucauggcccuagaacccguaguaggcgccgccaucgccgcccccgucgccggacaacagaacgucaucgaccccuggauccgaaacaacuucguccaggcccccggcggcgaguucacaguuucaccccgcaacgccccaggcgaaauacucugguccgcaccccuaggacccgaccucaacccauaccucucccaucucgcccgcauguacaacggauacgccgguggcuucgaaguccaagucauucuagccggaaacgccuuuacagccggcaaaaucaucuucgccgccguuccacccaauuuccccaccgaagggcucucccccucacaagucacaauguucccccacauaauagucgacguccgccaacucgaaccaguacucauaccccuuccagacguacgaaacaauuuuuaccacuacaaccaauccaacgaccccaccauaaaacuuaucgccaugcuguacacccccuuacgagccaacaacgccggcgacgacguauucaccguaucgugccgcguccucacacgcccauccccagacuucgacuuuauauuucucguaccacccaccgucgaaucccguacaaaacccuucucaguccccguccucaccguugaagaaaugacgaacucccgcuuccccaucccacuagaaaaacuuuucaccggaccaucauccgccuucguaguccaaccccaaaacggucgcugcaccacagacgguguacuccucgguaccacacaacucuccccagucaacaucugcaccuuccgcggcgacgucacccacaucucagggucgcgaaauuacacuaugaaccucgccucccaaaacuggaacuccuacgaccccacugaagaaauccccgcuccccuaggcacacccgacuucgucggaaagauccaaggugucuuaacucaaaccacacgcacagacggauccacccguggccacaaggccacaguuuacaccggcuccgccgacuucucacccaaacuaggcagaguccaauucgcaaccgauacugacaacgacuuugaaaccaaucaaaacaccaaauucacacccguaggcgucauccaagacggcggcaccacccaccgcaacgaaccccaacaaugggugcuuccauccuacagcggccgcaacauccacaacguccaccuagcccccgccgucgcccccacauucccaggcgaacaacuccuauucuuccgcuccaccaugccaggcugcuccggauaccccaacauggaccucgacugccugcucccacaggaauggguccaauacuucuaccaagaagccgccccagcacaauccgacguugcccuacuacgcuucgucaacccagacacaggccgcguccuguucgaaugcaaacuacacaaaucuggcuacgucacagucgcccacaccggccaacacgaccuagucauaccucccaacggcuacuuccgcuucgacucuuggguaaaccaauucuauaccuuagcucccaugggaaacggcacaggccgacgccgagcacucuag

SEQ ID NO: 35424 - RNA, 1623 nt, Artificial Sequence
  derived and/or modified sequence opt11 from capsid_protein_VP1__Norovirus__AGE89631
augaaaauggcauccaacgacgccaacccuuccgacggcucagcagcgaaccucgucccugaaguuuccaacgaagucauggcccucgaacccgucguuggagccgccaucgcugcccccgucgccggacaacaaaacguaaucgaccccuggaucagaaacaacuuuguacaagccccagguggcgaguucaccgucucaccccgaaacgcccccggagaaauccuuugguccgcaccccucggccccgaccucaaccccuaccuaucccaccuugcccguauguacaacggcuacgccggcggcuucgaaguccaaguaauacucgccggcaacgcauucacagccggaaaaaucauauucgccgccgucccuccaaacuuccccacagaaggccucucccccucccaagucaccauguucccacacaucaucguagacguuagacaacucgaaccaguccucauaccacucccagacguccgaaacaacuucuaccacuacaaccaaacuaaugacucaacaaucaaacucaucgccaugcucuacacaccccuucgcgcaaacaacgccggcgaagacguauucaccgucuccugccgaguccucacccgacccucccccgacuucgacuucaucuuccuaguaccucccaccgucgaaagccguaccaaacccuucaccguccccauccucaccgucgaagaaaugaccaauucucgcuuucccaucccccucgaaaaacuauucacaggccccuccggcgcauucgucguacaaccccaaaacggccggugcaccaccgacgguguccuccucggcaccacacaacuauccccagucaacauuuguaccuucagaggagacgucacacacauagccggcucacgcaacuauaccaugaaccuugccagccuaaacuggaacaacuacgacccaacagaagaaauacccgcaccccuaggaaccccagacuucguaggcaaaauacaaggcguacucacccaaaccacaaaaggagacggcuccacucgaggccacaaagccaccgucuacaccggcuccgccccauucacgccgaaacucggcucaguccaauucuccaccgacacagaaaacgacuucgaaacccaccaaaacaccaaauucaccccagucggcgucauccaagacggaggaacuacccaccgaaaugaaccacaacaauggguucuaccauccuacuccggccgcgacguacacaacguccacuuagcacccgccgucgcacccacauuccccggagaacaacuccucuucuuccgauccacaaugcccggaugcucaggauacccaaacauggaccuagacugccuccucccccaagaauggguccaacacuucuaccaagaagccgcccccgcccaauccgacgucgcccuccuccgauucgucaaccccgacacuggacguguacucuucgaaugcaaacuccacaaauccggauauguaaccguagcccauaccggccaacacgaccuaguaauucccccuaacggcuacuuccgcuucgacucauggguaaaccaauucuacacccuugcucccaugggcaacgguaccggccgacgucgcgcccucuaa

SEQ ID NO: 35425 - RNA, 1623 nt, Artificial Sequence
  derived and/or modified sequence opt11 from capsid_protein_VP1__Norovirus__AGE89634
augaaaauggccuccaacgacgcuaaccccuccgacggcuccgcagccaaccuaguccccgaagugucuaacgaagucauggcccucgaacccguugucggagccgccauagccgcccccgucgccggacaacaaaacguaauagaccccuggauccgcaauaacuucguccaggcccccggcggugaguucacagucucuccccgcaacgcacccggcgaaauccucugguccgccccacucggcccagaccucaaccccuaccucucacacuuggcccgcauguacaacggcuacgccggcggcuucgaaguacaagucauucuagcaggaaaugccuucacagcuggcaagaucaucuucgccgcugucccaccaaacuuccccaccgaaggacuaucucccucacaggucacaauguucccccacaucaucguagacguccgacaacucgaacccguccucaucccccuccccgacgucagaaacaauuucuaccacuauaaccaaaccaacgacuccaccauaaaacucaucgccaugcucuacacaccccuccgcgccaacaacgccggcgaagacgucuucacaguaucaugccgcguccucacccgacccuccccugauuucgacuucauuuuccucgugccucccaccgucgaaucacgcacaaaacccuucacaguccccauacucacagucgaagaaaugaccaacuccagauuccccaucccccucgaaaaacuauucacaggcccauccggugccuucgucguccaaccccaaaacggacgcugcaccacagacggcguacuacuaggaacaacacaacuaagccccgucaacaucugcacauuccgaggcgacgucacgcacauagcagggucccgcaacuacacaaugaaccucgcgucccucaacuggaacaacuacgacccaacugaagaaaucccagcaccccucgguacacccgacuucgucggcaagauccaaggcguacuaacccaaacuacaaaaggggacggcuccacacgaggccacaaagccaccgucuacaccgguucugcccccuucaccccgaagcucggcuccguccaauucuccacugacacagaaaacgacuucgaaacgcaccaaaacacaaaauucacacccgucggcgucauacaagauggcucaacaacccacagaaacgaaccccaacaauggguacucccuucuuacucaggccgcgacguccacaacguucaccuagcacccgcaguagcaccuacauuccccggcgaacagcuucucuucuuccgaucuacuaugcccggcugcucaggcuacccuaacauggaucucgacugccuccuaccacaagaauggguccaacacuucuaccaagaagccgccccagcccaaucagacgucgcccuauuacgauucgucaaccccgacaccggacgcgucuuauucgaaugcaaacuccacaaauccggcuacguaaccguugcccacacuggacagcacgaccuuguuauaccacccaacggcuacuucagauucgauuccugggucaaccaauucuacacacuagcccccaugggcaacggcacaggacgccgccgagcacucuaa

SEQ ID NO: 35426 - RNA, 1623 nt, Artificial Sequence
  derived and/or modified sequence opt11 from capsid_protein_VP1__Norovirus__AGE89637
augaaaauggcuagcaacgacgcaaaccccuccgacgguagcgccgcaaaccucguccccgaagucuccaacgaagucauggcccucgaacccgucgucggcgccgcaauagcagccccugucgccggacaacaaaacgucaucgaccccuggauacgcaacaauuucguucaagccccaggcggagaauuuaccgucuccccacgcaaugcccccggcgaaauccuauggucagcaccccuaggccccgaccucaacccuuaucugucccaccuagcacgaauguacaacgguuacgcaggaggcuucgaaguccaagucauacucgcuggaaacgcauucaccgccggcaagauaauauucgcagcagucccacccaacuuccccaccgaaggccucucacccucccaaguaaccauguucccucacauaauagucgacgucagacaacucgaaccaguccuaaucccccuacccgacgucagaaacaacuucuaccacuacaaccaaaccaaugacuccaccauuaaacuuaucgccaugcucuacacaccccuccgcgcaaacaacgccggcgaagacgucuucaccguuuccugccgcguccucacuagacccucccccgacuucgacuucaucuuccucguacccccaacagucgaaucccgcacuaaacccuucaccgucccgauacucaccgucgaagaaaugaccaacucccgcuucccaauaccccucgaaaaacucuuuaccggccccuccggcgcauucguaguccaaccccaaaacggacgaugcaccacggauggaguccuucucgguaccacacaacucucaccaguaaacaucugcaccuuccgaggcgacgucacgcacaucgccggcuccagaaacuacacaaugaaccucgcuucacucaacuggaacaacuacgaccccaccgaagaaauccccgcaccccucggaacccccgacuuuguaggaaaaauacaagguguccucacacaaacaaccaagggcgacggcuccacccggggccacaaagcaacagucuacaccggcucugcaccauucacacccaaacucggcucaguccaauucuccaccgacaccgaaaacgacuucgaaacucaccagaacaccaaauucacaccagucgguguaauacaagacggcggaaccacccaccguaacgaaccccaacaauggguccuaccauccuacuccggccgagacguacauaacguccaucucgcaccagcaguagcacccaccuucccaggagaacaacuccuauucuuccgcuccaccaugccaggauguuccggcuacccaaacauggaccucgacugucuucuuccacaagaauggguacaacacuucuaccaagaagcagccccagcccaaucagacgucgcccuacuccgauucguaaacccugacaccggacgcguccucuucgaaugcaaacuccauaaauccggcuauguaacugucgcccacacaggccaacacgaccucgucauaccucccaacggcuacuuccgcuucgacuccuggguuaaccaauucuacacacuagcccccauggguaacggaacaggccgccgccgugcauuauaa

SEQ ID NO: 35427 - RNA, 1623 nt, Artificial Sequence
  derived and/or modified sequence opt11 from capsid_protein_VP1__Norovirus__AGE89640
augaaaauggccuccaacgacgccaacccgucugacggaucagcugcuaaccucguccccgaagucagcaacgaaguuauggcccucgaacccgucgucggagccgcaaucgcagccccgguagcaggccaacaaaacguaaucgaccccuggauacgcaacaacuucguccaagcccccggcggcgaguucaccguaagcccacgcaacgcccccggcgaaauccucuggucugcaccacucggccccgaucucaacccauaccucucccaccucgcccgaauguauaacggcuacgcaggaggcuucgaaguccaagucauccucgcaggcaacgcauucacagccggaaaaaucaucuucgccgcugucccucccaacuuccccacagaaggacucagccccucccaaguaaccauguucccccacaucauaguggacguacgccagcuugaaccaguacucauaccccuacccgacguacguaacaacuucuaccacuacaaccaaaccaacgacucuaccauaaaacuaaucgccaugcuauacacaccacuucgugcaaacaacgccggcgaagacgucuucacagucucaugccgaguccucacacgaccaucaccagacuucgauuucauauuucucguacccccgacugucgaaucacgcacaaaaccuuucaccguccccauccucacugucgaagagaugaccaacucccgauuccccaucccccucgaaaaacuuuucaccggccccucaggcgcauucguaguccaaccccaaaacgggagaugcaccacagacgguguccuccucggaaccacccaacucuccccaguuaacaucugcaccuuccgcggagacguuacucacaucgccggcucacgaaacuacacuaugaaccucgcaagccucaacuggaacaacuacgaccccaccgaagaaauacccgccccacucggcacacccgacuucguuggcaagauucaaggcguccuuacccaaaccaccaaaggagacgguagcacucgcggccacaaagccacugucuacacaggcuccgcccccuucaccccgaaacucggcucgguacaauucucaaccgauaccgaaaacgacuucgaaacacaccaaaacaccaaauucacccccgucggcgugauccaggacggagguaccacucaccgcaacgaaccccaacaaugggucuuacccuccuacuccggucgugacguccauaacguacaccucgcacccgccguggcacccaccuuucccggcgaacaacuccucuucuuccgcucuaccaugcccggcugcuccggcuacccuaacauggaucuagacugccuccucccgcaagaguggguccaacacuucuaccaagaagcugcccccgcccaauccgacgucgcacuccuacgauucgucaacccagacacaggccgaguccucuucgaaugcaaacuccacaagucuggguacguaaccgucgcccauaccggccaacacgaccuagucaucccaccaaacggcuauuucagauucgacuccuggguaaaccaauucuacacccuagcuccaaugggcaacggcaccggacgccgccgugcccucuaa

SEQ ID NO: 35428 - RNA, 1623 nt, Artificial Sequence
  derived and/or modified sequence opt11 from capsid_protein_VP1__Norovirus__AGE89643
augaaaauggccuccaacgacgcaaaccccuccgacggcucagccgccaaccucguaccugaagucucuaacgaagucauggcccuagaaccuguaguaggcgccgcaaucgccgccccuguagccggccaacaaaacgucaucgauccauggauacgcaacaacuucguacaagcaccaggcggagaguucaccguuucuccgcgaaaugcccccggagaaauucucugguccgcaccccucggccccgaccuaaaccccuaccucucacaccuagcacgcauguacaacggauacgccggcggauucgaaguccaagucauccuggcagggaacgccuucacagccgggaaaauaaucuucgccgccgugcccccaaacuucccaaccgaaggucuaucaccgucccaagucacgauguucccccacaucauagucgacgucagacaacuagaaccaguccucaucccccuccccgacguccgcaacaacuucuaccacuacaaccaaaccaaugacuccaccaucaaacucauagccauguuauacacaccccuccgagccaacaacgccggcgaagacguuuucacaguauccugccgaguccucacacgucccucccccgacuuugacuucaucuuccuagucccacccacagucgaaucccggaccaaacccuucaccguacccauccuaacagucgaagaaaugacaaacucacgcuucccaaucccucucgaaaaacucuucacgggccccuccggugcauuugucguccagccccaaaacggccgguguaccacagacggcguccuccucggcacaacacaacuaucgccagucaacaucuguaccuuccgcggcgacguaacacacaucgccggaucccgaaacuacaccaugaaccucgcaucccucaacuggaacaacuacgacccaaccgaagaaauuccugccccacucggcaccccagacuucgucggaaaaauccaaggcguccuaacccaaacaaccaagggcgacgggagcacccguggccacaaagccaccgucuacacuggauccgccccauucacccccaaacucggcucuguacaauucuccacagacaccgaaaacgacuucgaaacacaccaaaacacaaaauucacacccgucggaguaauacaagacggcggaacaacccaccgcaacgaaccucagcaauggaugcuccccuccuauagcggccgcgacguucauaacguccaccuagccccugccgucgcccccaccuuccccggcgagcaacuccuuuucuuccgauccacaaugcccggaugcagcggcuaccccaacauggaccuugacugccuccuuccacaagaauggguacaacacuucuaccaagaagccgcaccagcccaguccgacguagcacuccuacguuucgucaaccccgacaccggacgaguccuauucgaaugcaaacuacacaaauccggcuauguaaccgucgcccauaccggccaacacgaccuagucauacccccaaacggcuacuuccgauucgacuccugggucaaccaauucuacacccuagcccccaugggcaacggcaccggacgccgacgagcacucuaa

SEQ ID NO: 35429 - RNA, 1623 nt, Artificial Sequence
  derived and/or modified sequence opt11 from capsid_protein_VP1__Norovirus__AGE89646
augaaaauggccagcaacgaugcuaacccauccgacggcuccgccgcuaaccuuguuccagaagucagcaacgaagucauggcccucgaaccagucguaggcgccgccauagcagcucccgucgccggucaacaaaacgucaucgaccccuggauacgaaacaauuucguccaagccccaggcggcgaguucaccgucuccccaagaaacgcacccggcgaaauacuauggucugccccucucggcccagaccucaaccccuaucuaucccaccucgcccgaauguauaacggcuacgccggaggauucgaaguacaggucauccucgccggaaacgcauuuaccgccggcaaaaucauauucgcagccguuccacccaacuuccccaccgaaggccuaucccccucacaaguaacaauguucccccacaucauagucgacguacgacaacucgaacccgugcugauuccccuacccgacguuaggaacaacuucuaccacuacaaccaaaccaacgacucaacaauuaaacuaaucgccaugcucuacacaccccuacgcgccaacaacgccggagaagacgucuuuaccgucuccugcagaguccucacccgccccuccccagacuucgacuucaucuuccucgucccacccaccgucgagucucgcaccaaacccuuuaccguccccauacucaccgucgaagaaaugacaaacucgcgauuccccauaccccucgaaaagcuauucacaggucccagcggcgcuuucguaguccagccccaaaacggccgcugcacaacggacggcguacuucucggcaccacccaacucuccccagucaacaucugcaccuuccgcggcgacgucacccacaucgcaggcucacgcaacuacaccaugaaccucgccucccuaaacuggaacaacuacgacccaacugaagaaauccccgccccacucggcacaccagacuucguaggcaaaauccaaggcguacucacacaaaccacaaaaggagacgguucaaccagaggccacaaggcuacagucuauacaggaucagcccccuuuacaccaaaacucggcuccguacaguucagcacggacaccgaaaacgacuucgaaacccaccaaaacaccaaauucacccccguaggaguaauacaagacggcggaaccacacaccgcaacgaaccucaacaauggguacuccccagcuacuccggccgcgacguccacaacgugcaccuggcccccgccgucgcucccacauuuccaggcgaacaacuacuuuucuuccgaagcacaaugccaggaugcuccggcuaccccaacauggaccucgacugucuacuaccucaagaguggguccaacacuucuaccaagaagccgcaccagcccaaucagacgucgcccugcuucgcuucgucaacccagacacuggacgcguccucuucgaaugcaaacuccauaaaagcggcuacguuacggucgcccacacugggcaacacgaccuaguaaucccaccaaacggcuauuucagauucgacuccugggucaaucaauucuacacacuggcacccaugggaaacggaaccggacgccgccgcgcccuauag

SEQ ID NO: 35430 - RNA, 1623 nt, Artificial Sequence
  derived and/or modified sequence opt11 from capsid_protein_VP1__Norovirus__AGE89649
augaaaauggccucuaaugacgcaaacccaucagacggauccgcagccaaccucgucccagaagucucaaacgaagucauggcccucgagcccgucgucggcgcagccauugccgcccccguagcaggccaacaaaacgucauagaccccuggauccgcaacaacuucguccaagcccccggaggagaguucaccguuucaccccgaaaugccccaggcgaaauccuaugguccgcuccccuaggccccgaucucaaccccuaccuaucccaccuggcccgcauguauaacggcuacgcaggcggguucgaaguccaagucauccucgcaggcaacgccuucaccgccggaaaaaucaucuucgccgcaguaccacccaacuucccaaccgaaggccuauccccaagccaagucacaauguucccacauauaaucguagacguccgccaguuagaacccguccucauaccccuccccgacguacgcaauaacuucuaccacuacaaccaaaccaacgaccccaccaucaaacuaauugcuaugcuauacaccccacuccgcgccaauaaugcaggcgaagacgucuuuaccguaucaugccgcguacucacccgcccaucccccgacuucgacuucauauuccuagucccgccgacaguugaaucccgcaccaaacccuucacaguacccauccuaacagucgaagaaaugaccaacagccgcuuucccauaccccuagaaaaacucuucacaggccccucaggcgcauucgucguccaaccccaaaacggccguugcacaacagacggaguacuccuagguacaacccaacucucccccguaaauaucuguaccuuccguggcgacgucacccauaucgcaggaucccguaacuacaccaugaaccuugccucccucaacuggaacaacuacgacccuaccgaggaaaucccagcaccccucggcacacccgacuucguaggaaaaauucaaggaguccuuacucaaaccaccaaaggugacggcagcacccgaggccacaaagccaccguauacacaggauccgcccccuuuacccccaagcucggcuccguacaauucucuaccgacacagaaaacgacuuugaaacccaccaaaacaccaaauucacacccgucggcgucauccaagacggcggaacaacgcacagaaacgaaccacaacaauggguccuccccuccuacuccggcagagauguccacaauguccaccuagcccccgccguagcccccaccuuccccggcgaacaacuccuguucuucagauccaccaugcccggcugcucaggcuaccccaacauggaccucgacugccuccuaccacaggaauggguucaacacuucuaccaagaagccgcccccgcccaaucugacgucgcccuccuacgauucgucaaccccgacaccggccgaguccucuucgaaugcaaacuacauaaaucuggcuacgucaccgucgcccacacuggacaacaugaccucgucaucccacccaauggcuacuuuagauucgacucaugggucaaccaauucuacacccuagcucccaugggcaacggcacaggccgccgccgagcgcucuaa

SEQ ID NO: 35431 - RNA, 1623 nt, Artificial Sequence
  derived and/or modified sequence opt11 from capsid_protein_VP1__Norovirus__AGE89652
augaaaauggccucauccgacgccaaccccuccgacggaucaacugcaaaccuugucccagaagucaacaacgaaguaauggcccuagaacccguaguuggugccgcuaucgccgcacccgucgcaggccaacaaaacgucaucgaccccuggauucgcaauaacuucguccaagcccccgguggagaguucaccguauccccacgaaacgccccuggcgaaauccuaugguccgcaccccucggcccagaccucaaucccuaucucucccaccucgcacguauguauaacggauacgcaggcggauucgaaguccaaguuguccuagccgguaacgccuucaccgccggcaaaauaaucuucgccgccgucccacccaacuuccccacagagggacucucacccucccaaguaacaauguucccacacaugaucgucgacguucgccaacuagagcccguacuaaucccgcucccugacguccgcaauaacuucuaccacuauaaccaauccaacgaccccacaaucaaacuaaucgccaugcuauacaccccacuacgcgcuaacaacgccggcgacgacguuuucacaguauccugccgcguacucaccagacccucacccgacuucgacuuuaucuucuuagucccacccaccgucgaaucaagaacgaaacccuucuccguacccauccucacagucgaagaaaugacuaacagccgcuuccccaucccacuagaaaaacucuucaccggucccagcuccgcuuucgucguacaaccccaaaacggccgcugcaccaccgacggcguacuccuaggcaccacccaacucuccccgguaaacauaugcacauuccgcggcgacguaacucacaucaccggcucucacaacuacaccaugaaccucgcuacacaaaacuggaacucuuacgaucccacugaagagauccccgcaccucucgguacccccgacuucgucggcaaaauccaaggaguccucacccaaaccacccgagccgauggcuccacccgcggccacaaagccaccgucuacacaggaucugccgacuucgcccccaaacuuggccguguccaauucgcaacugacaccaacaacgaccuuggcgcaaaccaaaacaccaaguuuaccccuguaggcgucauccaagacggcggcacagcccaccgcaacgaaccccaacaauggguucucccuucguacagcggacgaaacucacacaacguccaccuugccccagccgucgcccccacauuccccggcgaacaacuacucuucuucagaucuaccaugccuggcugcucuggcuacccaaacauggaccucgauugccuccuuccucaagaauggguucaauacuucuaccaagaagccgcacccgcccaauccgacgucgcccuacuccgauucguaaaccccgacacgggaagaguacucuucgaaugcaaacuucacaaauccggcuacgucacaguugcccacacaggccaacacgaccuugucaucccacccaacggauacuuccgauucgacaguugggucaaccaauucuacacacucgcacccaugggaaacggcaccggacgccgccgcgcccuauaa

SEQ ID NO: 35432 - RNA, 1623 nt, Artificial Sequence
  derived and/or modified sequence opt11 from capsid_protein_VP1__Norovirus__AGE89655
augaaaauggcauccaacgacgcgaaccccucagacgguuccgccgccaaccucgucccagaaguuuccaaugaaguuauggcccuagaacccguuguaggagccgcgauagccgcacccgucgcaggccaacaaaauguaaucgaccccuggauccgcaacaacuucguccaggcccccggcggcgaguucaccgucuccccacgcaacgccccuggcgaaauccuaugguccgcaccccucggucccgaccuuaaccccuaccuaucucaccuagcacgcauguacaacggcuacgcaggcggcuucgaaguccaaguaauccuagccggcaacgccuucaccgccgguaaaauaaucuucgcagccguacccccgaacuuccccacggaaggacucagccccucccaagucaccauguucccccacaucaucguagacguccgacaacucgaacccguccucaucccccuuccggacguacgcaacaacuucuaccacuauaaccaaacaaacgacuccaccaucaaacucaucgccaugcuauacaccccauuaagagccaacaacgcaggcgaggacgucuucaccguguccugcagaguccucacccgacccuccccugacuuugacuuuauauuccucgucccacccacagucgaaucccgaaccaaacccuucaccguacccauccuaacagucgaagaaaugaccaacucacgcuucccgauaccccucgagaaacuauucaccggccccucaggcgcauuugucguccaaccccaaaacggccgcugcaccacagacgguguacuccuaggcacaacccaacuaucccccgucaacaucugcaccuuuagaggcgacguaacccacauagccggcuccaggaacuacaccaugaaccuagccucccucaacuggaacaacuacgauccaaccgaagaaaucccagcaccacucggcaccccagacuucgucgguaaaauccaaggcguccucacacaaacaacaaaaggagacggcuccaccagaggccacaaagccaccgucuacaccggcuccgcucccuucaccccuaaacucggcucaguacaauucuccaccgacaccgaaaacgacuucgaaacccaccaaaacaccaaauucaccccagucggcgucauccaagacggaggcacgacccaccgcaacgaaccccaacaauggguacucccauccuacagcgggcgugacguacacaacguacaccucgcccccgccgucgcgcccaccuuccccggcgaacaacuacuauucuuccgauccaccaugcccggcugcucugguuaccccaauauggaucuagacugccuucucccccaagaauggguacaacacuuuuaccaagaagccgcccccgcacaaucagacguagcccuucuccgcuucguuaacccagacaccggaagaguccucuucgaaugcaaacuccacaaauccggauacguaaccgucgcccacacaggacaacacgaccuugucaucccacccaacggcuauuucagauucgauuccuggguaaaccaauuuuacacccucgcacccaugggaaacggcaccggccgcagacgcgcccucuga

SEQ ID NO: 35433 - RNA, 1623 nt, Artificial Sequence
  derived and/or modified sequence opt11 from capsid_protein_VP1__Norovirus__AGE89658
augaaaauggccucgaacgacgccaacccaagcgacggauccgccgccaaccuagucccagaagucagcaacgaaguaauggcccucgaaccaguggucggcgcagccaucgccgcccccgucgcgggccaacaaaacguaaucgaccccuggauucgcaacaacuucguccaggccccaggcggcgaguucacagucucgccccgaaacgcccccggcgaaauacucuggucugcaccccucggccccgaccugaaccccuaccucucccaccucgcccguauguacaacggcuacgcgggcggcuucgaaguacaaguuauucuagccggcaacgcauuuaccgcgggcaaaaucaucuucgccgcagucccacccaacuuccccaccgaaggacuaucaccaucccaagucacaauguuuccacacauaaucguagacguccgccagcuagaaccaguccuaaucccccucccagacguccgaaacaacuucuaccacuacaaccaaaccaacgacuccaccauaaaacuaaucgcaaugcucuacaccccacuccgcgccaacaacgcaggagaagacguuuucaccgucucaugucgaguacuaacccgaccaucccccgacuucgacuucaucuuucuagucccgcccaccgucgaaucgcgcacaaaaccuuucaccguacccauccucaccguagaagaaaugacaaauucgcgcuuccccaucccccuagagaaacuauucaccggccccuccggcgcguucguuguccaaccccaaaauggcagaugcaccacggauggcguccugcucggcaccacccaacuuucacccguaaacaucugcacauuccgaggagacgucacccacaucgcugguucccgcaacuacaccaugaaccuagcuucucucaacuggaacaacuacgaccccacagaggaaauccccgcaccccuaggcacccccgacuucguuggcaaaauccaaggcguacucacacaaacaacaaaaggagacggauccacacgcggacacaaagccacuguauacaccggcagugcccccuucacacccaaacucggcucaguccaguucucuaccgacacagaaaacgacuucgagacccaccaaaacacaaaauucacgcccgucggcgucauacaagacggcggcaccacacaccgaaacgaaccacaacaauggguccuacccucauacuccggccgagacguccacaacguacaucucgcccccgccgucgccccaacuuucccaggugaacaacuccucuucuuccgcuccaccaugccuggcugcucaggcuacccaaacauggaccucgacugccuccucccccaggaauggguccaacacuuuuaccaagaagccgcccccgcccaauccgacgucgcccugcuccgauuuguaaaccccgauaccggccgaguccuauucgaaugcaaacuccacaaaagcggcuacgucaccgucgcacacaccggacaacacgaccucguaaucccgcccaauggcuauuuccgauucgacuccuggguaaaccaguucuacacccuagcucccaugggcaauggcaccggacgacgucgcgcccucuaa

SEQ ID NO: 35434 - RNA, 1623 nt, Artificial Sequence
  derived and/or modified sequence opt11 from capsid_protein_VP1__Norovirus__AGE89661
augaaaauggccucuaacgacgcaaaccccucugacggcucagccgcgaaccuagucccagaagucucaaaugaaguuauggcacuagaaccugucgugggcgcggccauagcagcacccguggcaggccaacaaaaugucaucgaccccuggauccgcaacaacuucguccaggccccaggcggagaguucaccgucucaccacgaaacgcaccaggcgaaauucuauggucagccccucuaggccccgaccucaacccauaccuaucccaccuagcacgcauguacaacggcuacgccggcggauucgaaguccaaguaauccuagccggcaacgccuucaccgccggcaaaauaaucuucgcagcaguacccccaaacuuccccacagaaggucucuccccaucccaagucaccauguucccccacaucaucgucgacguccgacaacucgaacccguucucaucccccuccccgacguccgaaacaacuucuaccacuacaaccaaaccaacgacuccaccauaaaacucaucgccaugcucuacacaccccuaagggcuaacaacgcaggcgaagacgucuucaccguuagcugccgcguccucacccgacccucccccgacuucgacuucaucuuccucgucccacccaccguagaaagccgcacuaaacccuucaccguacccauacucaccguagaagaaaugaccaacucccgcuuucccaucccccucgaaaaacuauucaccggcccauccggcgccuuuguaguacaaccccaaaacggacgcugcacuacagacggcguccuccuaggaaccacacaacucagccccgucaacaucuguaccuuccgcggcgacguuacccauaucgccggaucccgcaacuacaccaugaaccuagcaagccucaacuggaacaacuacgacccaaccgaagaaaucccugcuccccucggcacccccgacuucgucggcaaaauacaaggcguccuuacccaaaccacaaaaggagacggcuccacccguggccacaaggccaccguuuacaccggaucagcccccuucacccccaaacuaggaucaguccaauucucuaccgacacggaaaacgauuucgaaacucaccaaaauaccaaauuuacacccgucggcgucauacaagacggcggcaccacucaccgaaacgaaccucaacaauggguacucccguccuacucgggccgagauguccacaacguccaccuagccccagccgucgcucccacuuuccccggcgaacagcuccucuucuuccgcuccaccaugcccgguugcucaggauaccccaacauggaucucgacugccucuuaccacaagaauggguccaacacuucuaccaggaagccgcacccgcacaauccgacgucgcccuccuccgcuucgucaaccccgacaccggacgcguacuauucgaaugcaaacuacacaaaucaggguacgucacagucgcccacacgggccaacaugaccuagucaucccacccaacggcuacuuccgauucgacuccugggucaaccaauucuacacccuagcccccaugggcaacggcacaggccgccgucgggcccucuaa

SEQ ID NO: 35435 - RNA, 1623 nt, Artificial Sequence
  derived and/or modified sequence opt11 from capsid_protein_VP1__Norovirus__AGE89664
augaagauggcauccaacgacgccaacccauccgacggauccgcagccaaccuagucccggaaguauccaaugaagucauggcccuagaacccgucgucggagcugccauagcagcccccgucgccggucaacaaaacgucauagacccauggaucagaaacaacuucguccaagcaccaggcggagaguucacagucuccccacgcaacgccccaggcgaaauccuaugguccgcaccccuaggucccgaccucaacccauaccugucacaccucgcccgaauguacaacggauacgccggcggcuucgagguacagguaauccuagccgggaacgcauucaccgccggaaaaaucaucuucgccgcaguaccucccaacuuccccaccgaaggacucucacccucccaagucacaauguucccccacaucaucguagauguccgccaacucgaaccaguccucaucccccucccugacguccgcaacaacuucuaccacuacaaccaaacaaacgacucaacaauaaaacucaucgcaaugcucuacaccccucuucgcgccaauaaugccggagaagacguauucacugucucaugccgcguccuaacucgccccucccccgacuucgacuuuaucuuccuaguaccacccaccgucgaaucccgcacaaaaccuuuuacaguccccauccucaccguugaagaaaugacaaauucacgauucccaauaccucucgaaaaacuauucacuggcccuagcggagccuucguuguccaaccccaaaacggccguugcaccacagacggaguccuccucggcaccacccaacuguccccaguuaacauuugcacauuucguggcgacgucacccacauagcaggcucacguaacuacacaaugaaccuggccucgcucaacuggaacaacuacgacccaaccgaagaaauacccgcuccccuaggcaccccugacuucgucggcaaaauccaggguguacucacccagacaaccaaaggugacgguuccacccgcggccacaaagccaccgucuauaccgguucagccccauucacccccaagcucggauccguccaauucucaaccgacacagaagacgacuucgaaacucaccaaaacaccaaguucaccccugucggcgucauucaagacggaggcacaacacacagaaacgagccacaacaauggguacuccccuccuacuccggccgcgacguucacaacguccaccuugccccagcagucgcacccaccuuccccggcgaacaacuucucuucuucagauccacaaugcccggcugcuccggcuaccccaacauggaccuagacugucuccucccccaagaauggguccaacauuucuaccaagaagcagccccagcccaaucugacguugcccuucuaagauucgucaaccccgacacaggccguguacucuucgaaugcaaacuacacaaauccggauacgucacaguagcacacaccggccaacacgaccuagucaucccacccaacggauacuucagauucgauagcugggucaaucaauucuacacucucgcccccaugggaaacggaaccggccgacgacgcgcccucuaa

SEQ ID NO: 35436 - RNA, 1623 nt, Artificial Sequence
  derived and/or modified sequence opt11 from capsid_protein_VP1__Norovirus__AGE89667
augaaaauggccuccaacgacgccaaccccucagacggaucugccgcuaaccucguccccgaaguuagcaacgaagucauggcccuagaacccgucgucggagcagcaaucgccgcacccgucgcaggacaacaaaacgucauagaccccuggauccgaaacaacuucguccaagcuccugguggcgaguucaccgucucaccccgcaacgccccaggcgaaauucuaugguccgcaccccucgguccggaccucaaccccuaccucucccaccucgccagaauguacaacggcuacgccggcggauucgaaguccaagucauccucgcuggcaacgccuucaccgcaggaaaaaucaucuucgcugccgucccacccaacuuccccaccgaaggccucucacccucccaagucacaauguucccacacauaauagucgacguccgacaacucgaaccaguccugaucccccuaccagacgucagaaacaacuucuaccacuauaaccaaacaaacgacuccaccaucaagcuaaucgccaugcucuacaccccacuacgcgcaaacaacgcaggcgaagacgucuucaccguauccugccgaguucucacacgcccaagccccgacuucgacuucauauuccucguuccgcccaccgucgaaagcagaaccaaacccuucaccgucccaauacucacagucgaagaaaugaccaacuccagauuccccaucccccucgaaaaacucuucaccggccccuccggagccuucgucguccaaccucaaaacggacgcugcaccaccgacggcgucuuacucggcacaacccaacucucccccgucaacauaugcaccuuccgcggagacgucacccacaucgccggcucacgaaacuacaccaugaaccucgccucccuaaacuggaacaacuacgaccccacugaagagauccccgcaccucuaggaacacccgacuucgucggaaaaauucaaggcguccuaacccaaaccacaaaaggagacggcagcacacgcggacacaaagccacagucuacaccggcuccgcccccuucacaccuaagcucggaucaguccaauucuccacagacaccgaaaacgacuucgaaacccaccaaaacacaaaauucacccccgucggagucauccaagacggaggcacaacccaccgcaaugaaccccagcaguggguccuaccaucuuacuccggccgugacguccacaacguacaccuagcacccgcaguagcccccaccuuccccggcgaacaacuacuuuucuuccgcuccaccaugccaggaugcagcggcuaccccaacauggaccuagacugucuccuaccgcaagaauggguccaacacuuuuaccaagaagcugcccccgcacaauccgacgucgcccuccuccgcuucgucaacccagacacuggaagaguccuauucgaaugcaaacuccacaaauccggcuacguaaccguagcacacaccggccaacacgaccucgucauacccccaaauggauacuuccgcuuugacucaugggucaaccaauucuacacucucgccccaauggguaacggcaccggacgacgccgcgcccuauaa

SEQ ID NO: 35437 - RNA, 1623 nt, Artificial Sequence
  derived and/or modified sequence opt11 from capsid_protein_VP1__Norovirus__AGE89673
augaaaauggccuccaacgacgccaacccaucugacggaagcgccgccaacuuaguccccgaagucucaaacgaaguaauggcacucgaacccgucgucggugccgcaaucgccgccccaguagccggccaacaaaacguaauugacccauggauccgcaacaacuucguccaagcaccaggcggugaauuuaccgucuccccuagaaacgcccccggcgaaauccuaugguccgcuccacucggacccgaccuaaaccccuaccucucccaccucgcccgcauguacaacggcuacgccggcggcuuugaaguccaagucauccucgcaggcaacgcauucaccgccggaaaaauaauauucgccgccgucccaccaaacuuccccaccgaaggacucuccccaucacaaguaaccauguucccccacaucaucgucgacguccgccaacucgaaccagugcucaucccccuccccgacguccgaaacaacuucuaccacuacaaccaaacuaacgacuccacaaucaaacuaauagccaugcuauacacccccuuaagagcgaacaacgccggcgaagacguuuucaccguauccugcagaguccuaacccgcccaagccccgacuucgacuucaucuuccucgucccacccacuguagaauccagaacaaagcccuucaccguccccauacuaacagucgaagaaaugaccaacucacgcuuccccaucccacuggaaaaacuauuuacaggccccucaggcgccuucguaguacaaccacaaaacggacgcugcaccaccgacggcguucuacucggcaccacccaacucucucccguuaacaucuguaccuucagaggcgacguaacucacauugccggcucccgcaacuacaccaugaaccucgccucacuuaacuggaacaacuacgaccccacagaagaaauccccgcaccccucgggacuccagacuucguaggcaaaauacaaggcguccucacccaaaccacaaaaggcgacggcagcacccgaggacacaaagcaacagucuacacaggcuccgcgccauucaccccaaaacuaggcucaguccaguucucuaccgacacagaaaacgacuucgaaacccaccaaaacaccaaauucacccccgucggcguaauccaagacgggggaaccacacaccgcaaugaaccccaacaaugggucuuacccuccuacucaggacgcgacguccacaacgugcaccucgcaccagccgucgcccccacauuccccggcgaacaacuacuuuucuuccgcucaaccaugcccggcugcuccgguuacccaaacauggaccucgacugcuuacucccacaagaauggguccaacacuucuaucaagaagcagcucccgcucaaucagacgucgcccuccuucguuucguaaaccccgacaccggccgaguccucuucgaaugcaaacuccacaaaucaggcuauguuacggucgcacacaccggccaacacgaccucgucaucccaccaaacgguuauuucagauucgacucaugggucaaccaauucuacacccucgcucccaugggcaacgguacgggacgacgccgagcucucuaa

SEQ ID NO: 35438 - RNA, 1623 nt, Artificial Sequence
  derived and/or modified sequence opt11 from capsid_protein_VP1__Norovirus__AGE99603
augaaaauggcaagcaacgacgccaaccccucagacggcucagccgcaaaccucgucccagaaguaaacaacgaagucauggcccucgaaccugucgucggcgcagcaauugcagcaccugucgccggacaacaaaacguaaucgacccauggauaagaucaaacuucguacaggcaccaggcggcgaauuuacaguaucaccacgcaacgcccccggcgagauccuuugguccgcuccccucggccccgaccuaaaccccuaccuaucccaccuagcccgcauguacaacggauacgccggaggcuucgaaguacaaaugauccuagccggaaacgccuucacugccggaaaaauuauauucgccgccgucccgccgaacuuccccaccgaaggacuauccccuucacaagucaccauguucccccacaucaucguagacguacgacaacucgaaccuguccuuaucccucuccccgacguccgcaacaacuucuaccacuacaaccaauccaacgaccccaccauaaaauuaaucgccaugcuuuacaccccacuccgcgccaacaacgcaggcgacgacguauucaccgucuccugccgcguacucacucgccccucacccgacuucgauuucaucuuucucguaccacccacagucgaaucucgcacuaaacccuucaccgucccaguccucacagucgaagaaaugaccaacucacgcuuccccaucccccucgaaaaauuauucaccggcccuucgagugcuuucguuguacaaccccaaaauggucgaugcaccaccgacggcguccuccucggcacaacacaacucucuccaguuaacauauguaccuucagaggagacgucacccacauagcuggcucucguaauuacacaaugaaccuagccucccuaaacuggaacaacuacgaucccacugaagaaaucccagcgccccucggcacaccagacuucguaggcaagauccaaggcguccucacacaaacaaccaaaggcgacggcuccacacgcggccacaaggccacaguauacacagguucugccgacuucacacccaaacucgguuccguccaauuuggcacugacacagacaacgacuucgaaacccaccaaaacacacgauucacacccgucggcgucauucaagauggcgccacaacacaccgcaacgaaccccaacaauggguacuucccucauacucaggacgcaacguccacaacguacacuuggcacccgccgucgccccaaacuuccccggcgaacaacuccucuucuuccgauccaccaugcccgggugcucaggcuauccaaacauggaccuagacugccuccucccacaagaauggguccaacacuucuaccaagaagccgccccugcccaaucggauguagcccuucuccgcuuuguaaaccccgacaccggacgcguucucuucgaaugcaaacuccacaaauccggcuacgucacagucgcucacacuggccaacacgaccucguaauaccacccaacggauacuuccgauucgacuccugggucaaccaauucuacacccucgcacccaugggaaacggcaccggcagacgcagagcccucuaa

SEQ ID NO: 35439 - RNA, 1623 nt, Artificial Sequence
  derived and/or modified sequence opt11 from capsid_protein_VP1__Norovirus__AGI17592
augaugauggccuccaacgacgccgcgcccucuaacgacggugccacaggccuuguucccgaaaucaaucacgaaacacucccccuagaaccagucgccggcgccgccauugccgcccccgucacuggccaaaacaacauaaucgaccccuggauccgcaccaacuucguccaagccccaaacggcgaguuuaccgucagcccccgcaauucccccggcgaaauccuccucaaccuugaacucggcccagaccuuaaucccuaccucgcacaccucucccgcauguacaacggcuacgcuggcggcgucgaaguccaaguacuccuagcaggcaacgccuucaccgccggcaaaauccucuucgccgccguucccccuaacuuuccuguugaguuccucucccccgcacaaaucacgaugcucccccacuuaaucgucgacguccgcacccucgaaccaauaaugauaccucuaccugaugugcgcaacacauucuuccacuacaacaaccaaccagccaaccgcaugcgccucguggcaaugcuauacacuccccuacgcucaaacgguuccggcgacgacgucuucaccguguccugccgcguacuaacccgcccgacccccgacuucgaguucaccuaccuuguaccuccaucaguagaaaguaaaaccaaacccuucucacuucccauccuaaccauuuccgaacucacaaacucacgcuucccagcacccaucgacagccuauacacagcccaaaauaacaaccucaacguccaaugccaaaacggccgaugcacccuagacggcgaacuccaaggcaccacccaacuccuccccuccggcauaugcgccuuccgaggaaaacucaccgccgacguccaccaaucucacgacgaccgcuggcacaugcaacuaacaaaccuuaacggaaccccauuugacccuaccgaagacguccccgcgccccucggcacccccgauuucaccggccuccuuuucggugucgccucacaacgaaacgucgucucaaauccaaauacaacucgcgcacacgaagcagucauauccacuacuuccucccaauucgucccuaagcucggauccauuaacuucggauccacaucagacgacuuccaacuacaacaacccaccaaauucacccccgucggcauaaaaguagaauccggacaugauuucgaccaaugggcacucccccgauacuccggacaccuuacccucaacaugaaccucgccccacccgucgccccuaacuuucccggcgaacaacuacuuuucuuccguucuaacgugccuugcgcaggaggcgucuccgacggcgucaucgacugccuacucccccaagaauggauucaauacuucuaccaagaaucagcccccucacaaucagauguugcccucauccguuacgucaaccccgacaccggacgaacccuauucgaagccaaacuacaccguaccggcuacauuaccgucgcccacuccggcgacuacccccucgucgugccaucaaauggauacuuccgcuucgacagcugggucaaccaauucuacucacucgcacccaugggcaccggaaacggacgccgccgaguacaauaa

SEQ ID NO: 35440 - RNA, 1650 nt, Artificial Sequence
  derived and/or modified sequence opt11 from capsid_protein_VP1__Norovirus__AGI17594
augaaaauggccucaaacgacgcagccccuuccaacgauggagccgcaggacucguaccagaaaucaacuccgaagccauggcccucgaaccagucgccggcgccgcaauugcagccccacucaccggucaacagaacaucauagacccuuggauaaugaacaacuucguccaagcaccgggcggagaguucaccauuucaccccgaaacggcccaggagaaguucuccucaaccuugaacucggaccugagaucaacccauaccuagcccaucuagcccgcauguacaacggcuacgcaggcggcuucgaaguccaagucgugcucgcuggaaaugccuucaccgcaggcaaaaucauauucgccgccauuccacccaacuuccccaucgacaaccucuccgccgcccaagucacaauguguccccacguaaucgucgauguccgacagcuagagccugucaaccuccccaugccagacgugcgaaacuccuucuuccacuacaaccaaggcaccgacucacgccuccgccugaucgccaugcucuacacaccccuacgagccaacaacuccggcgacgacgucuucaccgucucaugccgcgucuuaacccgcccuucucccgacuucuccuucaacuuccucgucccacccacuguggaaagcaagaccaaacccuucacccuccccaucuuaacaauauccgaaauguccaacucucgauuccccgugcccaucgacucccuccacacaucucccacugacaacauagucguccaaugccaaaacggccgcgucacacuagacggggaacuaaugggcacaacccaacuccuaccaucacaaaucugcgccuuccgcggcguacucacccaacgaaccucccgcgcguccgaccaagccgacaccgcugucacccccagagcauucgaccaccgcuggcacauccaacucgacaaccuaaacggcacacacuacgacccauccgaagacaucccagguccccuaggcauacccgacuuccgaggccgcgucuacggcgucgcuucccaaagaaacuccgacggauccaccagagcccacgaggccaaaaucgacaccaccagcucacgauucaccccaaaacucggaucucucgaaaucucaaccgaauccgacgacuucgacgaaaacaaacccacccgcuucaccccugucggcaucggagucgacaacgaacgcgaguuccaacaauggucccucccagacuacuccggccaguucacccacaacaugcaccucgcgccagccgucgcuccaaacuucccgggcgaacaacuccucuuuuuccgcucgcaccuccccuccucaggagguuggguagacggaacccuagacugccuccucccacaagaguggauacaacacuucuaccaagaaucagccccaucacaaacacagguagcccucguacgauaugucaaccccgacaccggccgcguacucuucgaagccaaacuccauaaaucuggcuucaugacuaucgcccgaucaggagacucacccaucaccgucccacccaacggcuacuuccgauucgaaucuuggguaaacccuuucuacacccuggcacccauggguaccggcaacggccgccgacgcauucaauag

SEQ ID NO: 35441 - RNA, 1623 nt, Artificial Sequence
  derived and/or modified sequence opt11 from capsid_protein_VP1__Norovirus__AGK36311
augaaaauggcaagcaacgacgccaaucccuccgauggauccgccgcaaaccuaguccccgaagucucaaacgaagucauggcccucgaacccguggucggcgccgcaauugccgcacccgucgcagggcaacagaacgucauagacccauggaucagaaacaacuucguucaagcccccggcggcgaguucaccgucagcccacgcaacgccccaggcgaaauacucuggucagcaccccucggccccgaucuaaaccccuaccucucacaccucgcccgaauguacaacggcuacgccggcggcuucgaaguacgagucauacucgccggaaacgcauucacagcaggcaaaaucaucuucgcagccgucccacccaacuuccccacagaaggccucucucccucccaaguaaccauguucccccacaucaucgucgacguccgccaacuagaacccguccucauuccccuccccgacguccgaaacaacuucuaccacuacaaccaaaccaacgacucaacuaucaaacucaucgcuaugcuuuacacuccccuacgcgcaaacaacgcuggagaggacgucuucaccguuuccugccgagugcuuaccagaccauccccagauuucgacuucaucuuccucgucccuccaaccguagaaucacgaaccaaaccguucaccguccccauccucacugucgaggaaaugaccaacucaagauuuccuaucccccucgaaaaacucuucacaggccccucauccgccuuugucguccaaccccaaaacggccgaugcaccacugauggaguacuccucggcaccacgcagcucucacccgucaauaucugcacuuuucgcggcgacgucacccacaucgccggcucccgaaacuacaccaugaaccuagccucacucaacuggaacaacuacgaccccaccgaggaaauccccgcuccccucggcaccccagacuucgucggcaaaauccaaggaguccuaacacaaaccacgaaaggcgacggcucaacacguggccacaaagccacugucuacaccggcuccgccccauucaccccuaagcuaggcuccguucaauucucaaccgacaccgagaacgauuucgaaauccaccaaaacaccaaauucacccccguuggcgucauccaagacggcggaacaacccaccgaaaugaaccccaacaaugggugcuucccucauauagcggccgcgauguccacaacguccaccucgcccccgccgucgcccccaccuuccccggcgaacaacuccucuucuuccgcucaacuaugccaggauguucaggauacccaaacauggaucucgacugccugcucccccaagaauggguacaacacuucuaccaagaagcagcgccggcccaaucagacgucgcccuccuacgcuucgucaacccagacaccggccgcguacuauucgaaugcaaacuccacaagucaggcuacgugacggucgcucacaccggacaacacgaccucgucaucccucccaacggcuacuuucgcuucgacuccugggucaaucaauucuacacccucgcuccaaugggcaacggaaccggccgacgccgagcccuauaa

SEQ ID NO: 35442 - RNA, 1623 nt, Artificial Sequence
  derived and/or modified sequence opt11 from capsid_protein_VP1__Norovirus__AGK36314
augaaaauggcuuccuccgacgccaaccccagcgacggcucuacagccaaccucguacccgaaguaaauaacgaaguaauggcacucgaacccgucgucggcgccgccauagccgcccccgucgccggccaacaaaacgucaucgaccccuggaucagaaacaacuucguacaagccccgggcggagaauuuaccguaucuccccgcaacgcacccggagaaauacucugguccgcaccccucggccccgaccucaauccauaccuaucccaucucgccagaauguacaacgguuacgccggaggcuucgaaguccaaguaauccuggcaggcaacgccuucaccgccggcaaaaucaucuucgccgcagucccucccaacuuccccaccgaaggacuuucccccucccaagucaccauguucccccacauuaucguagacguccgacagcucgaacccguccuuaucccacuccccgacguccgaaacaacuucuaccacuacaaucaauccaacgacccaacuaucaaacucaucgccaugcuauacacaccacuucgcgccaacaacgcaggcgacgacguauucaccgucuccugccgcguccucacccgacccucacccgacuuugacuucaucuucuuagucccucccaccgucgaauccagaaccaaacccuucucagucccaguccugacagucgaagaaaugaccaacucacgcuucccaaucccucucgaaaaacuauuuacaggccccucauccgccuucgucguacaaccccaaaacggccgcuguaccacagacggaguacuccucgguacaacccaacuaagccccgucaacaucugcacauuccgcggagacgucacccacauacccggaucccgaaacuacacuaugaaccucgccucacaaaacuggaacuccuacgaccccacugaagaaauaccugcaccccucggcaccccagauuucgucgguaaaauccagggaguccucacccaaacuacacgaaccaacggaagcaccagaggacacaaagccaccgucuacacugggucagccgacuucucccccaaacucggacgaguccaauucgccacagacaccgacaacgacuucgaaaccaaccaaaacaccaaauucaccccaguaggaguaauccaagacggauccaccacaccccgcaacgaaccccaacaauggguacucccaucauacagcggccgcaacauccacaacguacaccuagcaccagccgucgccccaaccuuccccggcgaacaacuccucuuuuuccgcucaaccaugcccggaugcuccggcuaccccaacauggaccuagacugccuccuaccucaagaauggguccaauacuucuaccaagaagccgcuccugcacaaucugacgucgcccuccuccguuucgucaacccugauacaggccgcguucucuucgaaugcaaacuacacaagucuggauaugucaccgucgcgcacacgggccaacaugaccucguaauaccacccaacggcuacuuccgauucgauucauggguaaaccaauucuacacacuagcacccaugggaaacggcacaggccggcgccgcgcccuguaa

SEQ ID NO: 35443 - RNA, 1593 nt, Artificial Sequence
  derived and/or modified sequence opt11 from capsid_protein_VP1__Norovirus__AGM33208
augaugauggccuccaaagacgccacauccucugucgacggcgccucaggagcaggucaacucguccccgaaguaaaugccuccgacccccucgcuauggaccccguagcagguucuuccaccgccguugccacagcaggccaaguaaaccccaucgaucccuggauuaucaacaacuucguacaagcuccgcaaggcgaauucaccaucuccccuaacaauacccccggcgacguccucuucgaccuaucucucggaccacaucuuaaccccuuccuccuccaccucucccaaauguacaacggcuggguugguaacaugcgcguccgaaucauguuagccggcaacgccuucaccgccggcaaaauuauaguauccugcaucccccccggcuucggaucccacaaccucaccauagcccaagccacucucuucccccacgucaucgccgacguccgcacacucgacccuaucgaaguucccuuagaagacguccgcaacguccucuuccacaacaacgaccgcaaccaacaaaccaugcgccuaguuugcaugcuauacaccccacuccgcaccggcggcggcaccggugacagcuucgucguugccgggagagucaugacaugccccucuccagacuucaacuuccucuuccucgucccccccacagucgaacaaaaaacuagacccuucacucuaccaaaccuaccccuuuccucccuauccaacucccgugccccccuccccaucuccuccaugggcauauccccagacaacguacaauccguacaauuccagaacggucgcuguacccucgacggucgccuagucggcaccacccccguuucacucucccacgucgccaaaauuagaggcaccuccaacggaaccgucaucaacuuaacugaacucgacggcacacccuuccacccauucgaaggacccgcaccaauaggcuuccccgaccuaggaggcugcgacuggcacaucaacaugacccaguucgggcacagcucccaaacgcaauacgacgucgacaccacccccgacaccuucgucccccaccuaggcuccauccaagcaaacggaaucggcucggguaacuacgucggaguacucuccuggauuuccccucccucucacccuucaggcucacaagucgaccuuuggaaaauccccaacuacggauccucaauaaccgaagcuacccaucucgccccuucagucuacccacccggcuucggugaaguacuagucuuuuucauguccaagaugcccggaccaggcgccuacaaccuuccaugucuccucccacaagaauacauaucccaccucgcaagcgaacaagcacccaccgucggcgaagccgcccuccuccacuacgucgaccccgacaccggacgcaaccucggcgaauucaaagcuuauccagacggcuuccucacuugcguacccaacggcgccucuuccggaccccagcaacuaccuaucaacggcgucuucgucuucgucuccugggucucacgcuucuaccaacucaaaccagucggcacugcuuccuccgcccgcggccgccucggccuccgcagauaa

SEQ ID NO: 35444 - RNA, 1593 nt, Artificial Sequence
  derived and/or modified sequence opt11 from capsid_protein_VP1__Norovirus__AGM33214
augaugauggcuuccaaagacgccaccuccuccgucgacggcgccucaggagcaggccaacuugucccagaaguuaacgccucagacccccucgccauggaccccguagcaggcuccucaaccgccgucgcaaccgccggccaggucaaucccaucgacccauggauuauuaacaauuuuguacaagcaccccaaggagaauuuaccaucucccccaacaacaccccaggcgacgugcuuuucgaccucucccucgggccacaccucaacccauuucuccuucaccucucccaaauguacaacggcuggguaggcaacaugcgcguaagaaucaugcuagccggaaacgccuucaccgccggcaagaucaucgucucaugcaucccacccggcuucggcucacacaaccucacaaucgcucaagccacccucuucccccacgucaucgccgacguccgcacccuugacccaaucgaaguaccacuggaagacguucgcaacguccucuuccacaacaaugaccgcaaccaacaaaccaugcgccuuguaugcaugcuauacacaccccuccgcacuggcggcggaaccggugacucuuucgucgucgccggccgcgucaugacaugccccagucccgacuucaacuuccucuuccucguaccaccaaccguagaacagaaaacccgccccuuuacucucccuaaucuaccccucuccucccucucaaacuccagagcaccccuccccaucuccucuauggguauuucccccgacaacguccaaucaguccaauuccaaaacggacgaugcacacucgacgggcgccuaguaggcaccacccccgucuccuuaucccacgucgccaagauaagaggcaccuccaacggcaccgucaucaaccuaaccgaacucgacggcacccccuuucaucccuuugaaggucccgcaccaauaggauuucccgaccucgguggcugcgauuggcacaucaauaugacacaauucggacacagcucacaaacccaauacgacguuaacaccaccccagacaccuucgucccacaucuaggauccauccaagccaacggaaucggcucgggaaacuacgucggaguacucuccuggauauccccacccucccaccccuccggaucacaagucgaccucuggaaaauccccaacuaugguucgucaaucacagaagccacccaccuggcccccuccgucuacccucccggcuucggcgaaguccucguauucuucauguccaaaaugccgggacccggcgccuacaaccucccuugccuccuaccccaagaauacaucucccaccuugcauccgaacaagcccccaccguaggcgaagccgcccuacuucacuacgucgacccagacacaggccgcaaccuuggcgaguucaaagccuacccagacggcuuccucacaugcguccccaacggcgccucaucuggcccacaacaacuccccauaaacggcgucuucguuuucguauccuggguauccagauucuaccaacucaaacccgucggcacugcauccuccgcccgcggccgccucggccuccgccgcuaa

SEQ ID NO: 35445 - RNA, 1593 nt, Artificial Sequence
  derived and/or modified sequence opt11 from capsid_protein_VP1__Norovirus__AGM33217
augaugauggcauccaaggacgccaccuccuccgucgacggggcuuccggcgccggccaacucgucccagaaguaaacgcaucagacccccucgcaauggaccccguagccgguagcuccaccgcgguagccaccgcuggccaagucaaccccaucgacccguggaucaucaauaacuucguacaagcaccccaaggcgaauuuacuaucucccccaacaacacccccggcgacguccucuucgaccucucccucggaccucaucucaaucccuuccuccuacaccucucccaaauguauaacggcugggucggaaacaugcgagucagaaucaugcucgccggaaacgccuucaccgcaggcaagaucaucgucucgugcaucccucccggcuucggaucccacaaucucaccaucgcccaagccacccucuucccccacguaaucgcagacguccgaacccuugaucccaucgaaguacccuuggaagacguuagaaacguucucuuccacaacaacgaccgcaaccaacaaaccaugcgucucgucugcaugcucuacacuccacuccgcacuggcggaggaacaggcgacucuuucgucgucgccggacgcgucaugacuugccccucucccgacuucaacuuccucuuucuagucccacccacaguugaacagaaaacccgacccuucacacuccccaaccuaccccucuccucacucuccaacucccgcgcaccccuucccauaucaagcauggguaucucuccagacaacguccaauccguacaauuccaaaacggccgcugcacccucgacggccgacucgucggcaccacccccguaucccugucccacgucgccaaaauccgcggaaccucaaacggcaccgucaucaaccucacagaacucgacggaacaccauuccaccccuucgaagguccagcccccauuggauuuccagaccucggagggugcgacuggcacaucaacaugacccaauucggccacucgucacaaacccaauacgaugucgacacaacccccgacaccuucgucccacaccucggcucuauacaagccaacggcaucggcuccggcaacuacgucgguguccucuccuggaucucacccccuucccaccccucuggcucacaaguagaucucuggaaaaucccaaacuacggauccucgaucacugaagccacccaucucgcccccuccguuuacccacccggauucggcgaaguccucgucuucuucaugagcaagaugcccggcccaggcgccuacaaccuccccugccuccuuccccaagaauacaucucccaccuagcauccgaacaagcccccaccguaggagaagccgcccucuuacacuacguggacccggacacuggccgcaaccucggagaauuuaaggcuuaccccgacggauuccucacaugcguccccaacggagcauccuccggcccacaacaacucccuaucaacggaguuuucgucuucgucuccugggucucccgcuucuaucaacucaaacccgucgguacagcuuccucugcacgcggccgacucggacuccgccgcuaa

SEQ ID NO: 35446 - RNA, 1593 nt, Artificial Sequence
  derived and/or modified sequence opt11 from capsid_protein_VP1__Norovirus__AGM33220
augaugauggccuccaaggacgcuaccucguccgucgacggcgccuccggagccggccaacucguccccgaaguuaacgcauccgacccacucgcuauggacccagucgcgggcucaucuaccgcaguggccaccgcgggacaaguaaacccaaucgauccauggauaauaaacaacuucguccaagcaccccaaggcgaguucaccaucucccccaacaacacccccggcgacguacucuucgaccucucccuaggaccacaccucaaccccuuccuccuccacuuaagccaaauguacaacggcugggugggcaacaugcgcguacggaucaugcucgccggcaacgccuucacagcaggcaaaaucauugugucaugcauaccacccgguuucggaucacacaaucuaacaaucgcccaagcaacccuuuucccccacgucaucgcagacguccgcacccucgaccccaucgaagucccccucgaagacguccgcaacguacucuuccacaacaaugaccgaaaccaacaaaccaugcgccucgucuguaugcucuacacaccucuccgcacaggcggcggaacaggagacagcuucgucguagccggccgcgucaugacaugccccucacccgacuucaacuuccuauuucuuguaccacccaccguagaacagaaaacacgccccuucacacuccccaaccucccccucucaucccucucaaacucaagagcaccccuacccaucuccuccaugggcaucucacccgacaacguacaauccguacaauuccaaaauggacgaugcacucucgacgggcgccucguaggcaccacucccgucagccuaagucacgucgccaaaauccgcggcaccuccaaugggaccgucaucaaccuuaccgaacuagacgguacaccauuccaccccuucgaaggccccgcccccaucggcuuccccgaucucggaggcugcgacuggcacaucaacaugacccaauucggacacucuagccaaacccaauacgacgucgacaccaccccagacaccuucgucccacaccuuggcuccauccaagccaacggcgucggcuccggcaauuaugucggcguccuuucuuggaucagcccacccucccaccccuccggcagccaagucgaucucuggaaaauucccaacuacggaucauccaucaccgaagccacacaccuagcccccucuguauaucccccaggcuucggcgaaguacucguauucuucauguccaaaaugccaggccccggcgcuuacaaccuaccaugccuucucccacaagaauacaucagccaccuagcauccgaacaagcccccaccgucggcgaagccgcccuccuccacuacgucgacccagacaccggccgcaaccuaggagaguucaaagccuacccugauggcuuccuaaccugcgucccaaacggcgcauccucaggcccacaacaacuucccaucaacggcguauucgucuucguauccuggguuucccgcuucuaccaacucaagccuguaggcacagccuccuccgcccgcggccgacucggccuacgccgcuaa

SEQ ID NO: 35447 - RNA, 1593 nt, Artificial Sequence
  derived and/or modified sequence opt11 from capsid_protein_VP1__Norovirus__AGM33226
augaugauggcauccaaagacgccaccucuucagucgacggagccucgggcgccggccagcucguccccgaaguaaacgccucugacccacucgccauggaccccguagcaggcucauccacagcagucgccaccgcgggccagguaaaccccauagacccuuggauaauaaacaacuuuguccaagcaccucagggggaauuuaccaucuccccaaacaacaccccaggcgacguacuuuucgaucugucccuuggcccccaccuaaaccccuuccuccuacaccuaucccaaauguacaacggcuggguaggaaacaugcgaguccguauaaugcucgcaggaaacgccuuuaccgccggcaagaucauaguaucaugcaucccacccggauuuggaucccacaaccuaaccauugcccaagccacccuauucccccacgucaucgccgacguccgcacccuagaccccaucgaagucccacuagaagacguacgcaacguccuauuucacaacaacgaccgcaaccaacagaccaugcgccucguaugcaugcucuacacaccccuccgaaccggcggaggcaccggcgauuccuucgucgucgccggacgagucaugaccugccccucaccagacuucaacuuccuauuccuuguacccccuaccgucgaacagaaaacacgacccuucacacuccccaaccucccccuuuccucccuauccaacucccgcgcaccccucccaaucagcuccauggguaucucucccgacaacguccaauccguccaauuccaaaacggccguugcacccucgauggacgacucgucggcaccaccccugucucacucagccacgucgccaaaauccgaggaaccucaaacggaacugucaucaaccuuaccgaacuagacggaacccccuuccauccauuugaagggccagcaccaauuggcuuccccgaccucggaggcugcgacuggcauaucaacaugacacaauuuggacacuccagccaaacccaauacgacgucgacaccacaccagacaucuucgucccccaccuuggcucaauccaagccaauggaaucggcuccggaaauuacgucggcguccucucuuggaucagcccucccucccaccccagcggcucccaaguagaccucuggaaaauccccaacuacggaucauccauuaccgaagccacccaccucgcccccagcgucuacccacccggcuucggagaaguacucgucuucuucauguccaaaaugcccggacccggcgccuacaaccucccaugccugcucccccaagaauacaucagccaccucgccucagaacaagcccccacagucggagaagcagcacuucuacacuacgucgacccagacacuggccgcaaccucggagaguucaaagccuacccugacggcuuucuaaccugcguccccaacggagcaucaucuggcccacaacaacucccaaucaacggcguauucguauucguaucaugggucuccagauucuaccaacucaaaccaguuggaaccgccuccucagcccgaggaagacuaggccuccgacgcuaa

SEQ ID NO: 35448 - RNA, 1593 nt, Artificial Sequence
  derived and/or modified sequence opt11 from capsid_protein_VP1__Norovirus__AGM33229
augaugauggccuccaaagaugcaaccuccuccguugacggagccuccggcgccggccaacucguuccugaagucaaugccuccgacccuuuagcaauggaccccguggccggguccucuaccgcagucgcuaccgcaggccaagucaaccccauugaucccuggauaaucaacaacuucguccaagccccacaaggcgaauuuacuaucucccccaacaacacaccaggagacguccuauucgaccugucacuaggaccccaccucaaucccuuccuccuccaccucucacaaauguacaacggaugggucggcaacaugagaguccgcaucaugcuagccggaaacgccuucaccgccgguaaaaucaucguuuccugcauacccccuggauucggcucacacaaccucacaaucgcacaagcaacccuuuucccccacgugaucgcagacguacguacucucgacccaauugaagucccacucgaagauguccgcaacguacucuuccacaacaacgaucgaaaccaacaaaccaugcgacucgucugcaugcucuacacuccccuccguaccggaggaggcaccggcgacuccuucgucgucgccggccgagucaugaccugcccuucccccgacuuuaacuuccucuuccucgucccucccaccgucgaacaaaagacccgccccuucacccuacccaaccuuccccuauccucucuuucaaacucucgcgccccacuccccaucuccuccaugggaauaucacccgacaauguucaaucgguccaauuccaaaacggccgcuguacccucgacggacgucucguagguacaacgccagucucacuaucacacgucgcaaaaauacgcggaaccuccaauggaaccgugaucaaccucacagaacucgacggcacacccuuccacccauucgaaggccccgcucccauaggcuuccccgaccuuggcggcugcgacuggcacaucaacaugacccaauucggccacuccucccaaacucaauacgacgucgacaccacccccguaacuuucguaccccaccuagguucaauacaagcaaauggcaucggauccgguaacuacgucggcguccucucauggaucagcccaccaucucacccauccggaucccaagucgaccuauggaaaaucccaaacuacggcuccucuaucaccgaagcaacccaccuagcacccuccgucuauccacccggcuucggcgaaguacucgucuucuucauguccaaaaugcccggccccggcgccuacaaccuacccugccucuuaccccaagaauacauaagccaucuagccuccgaacaagccccuaccgucggagaagcagcccuucuacauuacgucgacccagacacuggccgaaaccuuggcgaauuuaaagccuaccccgacggcuuccuaaccugcguccccaauggcgcuuccuccggcccccaacaacucccuaucaacggagucuucgucuucgucuccuggguauccagauucuaccaacuuaaacccgucggaacagccuccuccgcucgaggacgccucggccuacgccgcuaa

SEQ ID NO: 35449 - RNA, 1593 nt, Artificial Sequence
  derived and/or modified sequence opt11 from capsid_protein_VP1__Norovirus__AGM33232
augaugauggccucaaaagacgccaccuccuccgucgauggcgcauccggcgccggccaacucgucccagaagucaacgccucugacccccucgccauggaccccguagcaggcucaucaaccgccgucgccacagccggccaagucaaucccauagaccccuggaucaucaacaacuucguacaggccccacaaggagaguucacaauaucucccaacaacacuccaggcgacguauuauucgaccuaucccucggaccacaccucaaccccuuccuccuucaccucucccaaauguacaacggcuggguuggcaacaugcgcgucagaaucaugcuagcaggcaacgccuucacagcuggcaaaaucaucgucucuugcaucccacccggauucggcucccauaaccucacaaucgcccaagccacccucuucccccacguuaucgccgacguccgcacccucgaccccaucgaagucccucuagaagacguccgcaacguccucuuccacaacaacgaccgcaaccaacaaaccaugcgccuagucugcaugcucuacacaccccuacgaaccggaggcggaaccggcgacucauuugucguagccggccgagucaugaccugcccuuccccggacuucaacuuccuauuccucguucccccaaccgucgaacagaaaaccagacccuucacccuuccaaaccugccacuauccucgcucuccaacucgcgagcgcccuuacccaucuccagcaugggcaucucucccgacaacguucaaucaguccaauuccaaaacggccgcugcacacucgacggucgacucgucggcaccacacccgucagccuaucccacgucgcaaaaauucgcggcacauccaacgguacagucaucaaccucaccgaacucgacggcaccccuuuccaccccuucgaaggucccgcccccaucggcuuccccgaccuuggaggcugcgacuggcauauuaacaugacucaauucggccacuccucacaaacccaauacgacguagauaccacccccgacaccuucgucccccaccuaggcucaauccaagccaacggcaucggauccggcaacuacgucgguguccuaucauggauauccccucccucucgcccauccggaucacaagucgaccuuuggaaaauccccaacuacggauccucaauaacggaagcaacacaccuagccccaucagucuacccacccggcuucggcgaaguccucguauucuucauguccaaaaugcccggcccaggagccuacaaccuuccaugccuccucccccaagaauacaucucccacuuagccucagaacaagcccccaccguaggcgaagcagcccuccuccacuacguagaccccgacacuggccgcaaccuaggcgaguucaaagccuaccccgacggcuuccuaaccugcguucccaacggagccagcuccgggccccaacaacuaccaaucaacggaguguucgucuucguuuccuggguuucacgauucuaucagcucaaacccguaggcacagcaucgucugcucgaggccgacuaggacuccggcgcuaa

SEQ ID NO: 35450 - RNA, 1593 nt, Artificial Sequence
  derived and/or modified sequence opt11 from capsid_protein_VP1__Norovirus__AGM33235
augaugauggcauccaaagacgccaccucauccguagacggugcuuccggugccggccaacuuguccccgaagucaacgcuucagacccccucgccauggacccaguagccgggucauccaccgccgucgcaaccgccggacaagucaaccccauagaccccuggaucauaaacaauuucguccaagcaccccaaggagaauuuaccaucucacccaacaauacacccggcgacguccucuucgaccuuucccuuggcccccaucuaaaccccuucuuacuccaccuaucccaaauguacaacgggugggucggcaauaugcgcgugcgaaucaugcucgccggaaacgcuuucaccgcaggcaaaaucaucgucucuugcauuccucccggcuucggcucacacaaccucaccaucgcccaggcaaccuuauucccucacgucaucgcagacguccguacacucgaccccaucgaaguuccccuugaagacguacgcaacguacucuuccacaauaacgaccgcaaccaacaaaccaugcgacucgucugcaugcucuacacaccccuacgcaccggcggcggcaccggugauuccuucguuguagccggccgcguaaugaccugcccaucccccgacuucaacuuccuguuccucguacccccaaccgucgaacagaaaacccgacccuucacccucccaaaccuaccucuauccucccuuucuaacucccgcgcuccccuccccaucuccucaaugggcauuuccccagauaacguacaauccguucaauuccaaaacggccgcugcacccuagacggccgacuugucggcaccaccccagucucacuuucucacguagccaaaauacgaggcaccucaaacggcaccgucaucaaccuaacugaacuagacggcacuccauuccaccccuucgaaggccccgccccaaucggcuuccccgaccuuggaggaugcgacuggcacauaaacaugacccaauucggacacucaucacaaacacaauacgacgucgacaccacccccgacaccuuuguaccccaccuaggcucuauccaggccaacgguaucggcuccggcaacuacguagguguacucucauggaucagcccuccaucccgucccuccggaucacaggucgaccucuggaaaauccccaacuacggcucauccaucacugaagcuacccaucucgcacccuccgucuaucccccaggcuucggcgaaguccuggucuucuucauguccaaaaugccaggaccaggcgccuacaaccuccccugccuccucccccaagaauacaucucccaccuagcaucugaacaagccccaaccgucggggaagcugcccuccuccacuacgucgaccccgacacaggccgaaaccugggcgaauuuaaggccuaccccgacggcuuccuaaccugcguaccaaacggagcuuccucaggcccucaacaacucccaaucaacggaguauucguuuucguauccugggucucucgcuucuaccaacucaaacccgucggcacagccucauccgcccgagggcgccucggccuccgccgauaa

SEQ ID NO: 35451 - RNA, 1593 nt, Artificial Sequence
  derived and/or modified sequence opt11 from capsid_protein_VP1__Norovirus__AGM33238
augaugauggccuccaaagacgcaacaucaagcguagacggcgcuucuggcgccggccaacucguccccgaaguuaacgcaagcgacccccucgccauggacccaguagccggauccucaacagccguagcuaccaccggccaagucaaccccaucgaccccuggaucaucaauaacuuuguccaagcuccccaaggcgaauuuaccaucucacccaacaacacccccggcgacguccucuucgaccucucacuugguccccaccucaacccauuccuccuacaccuaucgcaaauguacaacggaugggucggcaacaugcgaguccgcaucaugcucgccggaaaugccuucacagcaggcaaaaucaucgucuccuguauaccgccagguuucggaucccacaaccucaccaucgcacaggcaacacucuucccucacgucaucgccgacguccgcacccucgacccaauagaagucccccucgaagacguccgcaacguccuauuccacaacaacgacaggaaccaacagacaaugcgccucguauguaugcucuacacuccccuacguaccggaggcggaaccggagacucauucgucguagcaggccgcgucaugaccugccccuccccagacuucaacuuccuauuccucgucccucccaccguagaacagaaaacccgccccuucacccuccccaaccucccccuaagcucacucuccaacagccgagcaccacuacccaucuccucuaugggcaucucucccgacaacguccaauccguucaauuccaaaacggacgcugcacccuagacggacgccuaguaggcacaaccccagucucacuuucccacguggcgaaaaucagaggcacauccaacggcacggucaucaaccuuaccgaacucgacggcacccccuuccaccccuucgaaggccccgcgcccauagguuuccccgaccuuggaggcugcgacuggcacauuaacaugacucaauucggacacucaucacaaacccaauaugacguagacaccacaccagacaccuucguaccacaccucggaaguauacaagcuaauggcaucgguucaggcaacuacguuggcguccucucauggaucucacccccaucucacccauccggaucccaagucgaccuauggaaaauccccaacuacggcuccucaauaacagaagccacccaccucgcacccucagucuacccacccggcuucggagaaguucuagucuucuucauguccaaaaugcccggccccggcgcauacaaccuaccuugucuccuaccccaagaauacauaucccaucucgccucugaacaagccccaaccguaggcgaagccgcccuccuucacuacguagacccugacacaggccgcaaucucggcgaauuuaaagccuaccccgacggcuuccuaacaugcguccccaacggcgccuccucaggaccacaacaacucccaauaaacggcguuuucgucuucguuuccugggucagucgauucuaccagcucaaacccgucggcaccgccagcuccgcccgcggccgccucggccuccgccgauaa

SEQ ID NO: 35452 - RNA, 1593 nt, Artificial Sequence
  derived and/or modified sequence opt11 from capsid_protein_VP1__Norovirus__AGM33241
augaugauggcauccaaagacgccaccucguccguugauggagccuccggcgcaggacaacucguccccgaagucaacgccuccgacccccucgcaauggaccccgucgccggcucaagcaccgccgucgcuaccgccggucaagucaacccaaucgauccauggauaaucaacaacuucguacaagcgccucaaggcgaauuuacaaucucccccaacaauacacccggcgacguccucuucgaccucagccucggcccacaccugaaccccuuccuccugcaccucucacaaauguacaacggcuggguagggaacaugagagucagaaucaugcucgccggcaacgccuucaccgcaggcaaaaucaucgucuccuguauaccacccgguuuuggaucccacaacuuaacaaucgcacaagccacacucuucccccacguaauagcugacguaaggacacucgaccccaucgaagucccccuugaagauguucgaaacguacuuuuccacaacaacgaccgcaaccaacaaacuaugcgucuagucugcaugcucuacacacccuuacgcaccggcggcggaacaggagacucauucgucguagcaggccgcgugaugacuugcccaucccccgacuucaacuuccuauuucucgucccacccaccgucgaacagaaaacgcgccccuucacccuccccaaccucccccucucaucccucuccaacucacgcgcaccccuccccaucuccucuaugggaaucucccccgacaacguccaauccguccaauuucaaaacggacgaugcaccuuagacggccgccucgucggaacaacccccguuucccucucccaugucgcaaaaauccgcggcaccuccaacggcaccguaaucaaucucaccgaacuagauggcacccccuuccaccccuucgaaggacccgcccccauuggauuucccgaccucggcggcugugacuggcacaucaacaugacucaauuuggccacuccucccagacccaauacgacguugacaccaccccugacaccuucguaccccaccucggcucaauccaagcuaacggcaucggcuccgguaacuacgucggcguccuuuccuggauaucaccacccucccaccccuccggaucacaagucgaccuauggaaaaucccaaacuacggauccaguauaaccgaagcaacccaccuagccccuuccguauacccacccggcuucggcgaaguccuuguauucuucaugagcaaaaugcccggccccggcgccuacaaccuacccugccugcuaccccaagaauacaucucacacuuagccucagaacaagcccccaccgucggcgaagccgcucuacuacacuacgucgaccccgacaccggacgcaaccuaggcgaguucaaagccuaccccgacggcuuccuuaccugcgucccaaacggcgcaucgucaggcccucaacaacuccccaucaacggcgucuucgucuuugucagcugggucuccagauucuaccaacucaagcccguuggcacugcgucgagcgcacgcggccgccucggccuacgccgcuaa

SEQ ID NO: 35453 - RNA, 1593 nt, Artificial Sequence
  derived and/or modified sequence opt11 from capsid_protein_VP1__Norovirus__AGM33244
augaugauggcauccaaagacgccacuuccucagucgacggcgccuccggugcaggccaacucguccccgaagucaacgccucugauccccucgccauggacccagucgccggcucaucaacagccgucgcuaccgccggccaagucaaccccauugaccccuggaucaucaacaacuucguccaggcaccacaaggcgaauuuacuauauccccgaacaacaccccaggcgacgucuuauucgaccucucccucggcccacaccucaaucccuuccuccuccaccucucacaaauguacaacggcugggucggcaacaugcgcguccggaucaugcucgccggcaacgcauucaccgcuggcaaaaucauaguauccugcauaccacccggauucggcucccacaaccuuaccaucgcacaagccacccuauucccccacgucaucgcugacguucgcacccucgaccccauagaagucccccucgaagacguacgaaacguacucuuccauaacaaugaccgcaaccaacaaacaaugcgacucgucugcaugcuguacacaccccuccgcacaggcggaggcaccggcgacuccuucgucgucgccggccggguuaugacaugccccucuccagacuucaacuuccuuuuccucgucccucccaccguagaacagaaaacacgcccauuuacacuuccaaaccucccccuaucuucacucucaaacucccgagcaccccugcccauaagcuccaugggcaucucucccgacaacguccaauccguccaauuccaaaacgggcgcuguacccucgacggacgccucguaggcaccacccccgucucccucucacacguagcaaagauacguggcaccucuaacggcaccgucaucaaucucacagaacucgacggcacccccuuucaccccuucgaaggacccgcaccgauaggcuucccugaccuaggaggaugcgacuggcacaucaacaugacccaguucggacacuccucccaaacccaguacgacgucaacaccacccccgacaccuucgucccccaccucggcuccauccaagccaacggcaucggcuccggaaacuacgucggcguccuuucuuggaucucaccacccucacaccccagcggcagucaagucgaccucuggaaaauucccaacuacggaagcagcaucaccgaagccacacaccucgccccauccgucuacccgcccggauucggagaaguccuaguauucuucaugagcaaaaugcccggccccggcgcauacaaucuccccugccuacucccacaagaauacaucucacaccuagcauccgaacaagcaccaacugucggcgaagccgcccuccuacacuacgucgaccccgacacaggucgcaaccucggcgaguucaaagccuaccccgacggauuccucacuugcguccccaacggcgcauccucuggcccacaacaacugcccaucaacggcguauucgucuucgucuccugggucucccgauucuaucagcucaaaccagucggcacagccuccuccgcccgaggccgccuaggccuacgccgauag

SEQ ID NO: 35454 - RNA, 1626 nt, Artificial Sequence
  derived and/or modified sequence opt11 from capsid_protein_VP1__Norovirus__AGO59890
augcgcaugagcgacggcgccgcacccaaagccaauggcuccgaagcaagcggccaagaccuaguuccugccgccguagaacaagccguccccauccagccaguagccggagccgcccucgccgcacccgccgcuggacaaauaaaccaaaucgacccauggaucuuccaaaacuuuguccaaugcccccucggcgaguucuccaucagcccacgcaacacaccaggcgaaauccuauucgaccucgcccucggcccaggccucaaccccuaccucgcccaccuguccgccauguacacaggaugggucggaaacauggaaguccaacucguccucgccggaaacgcuuucaccgccggcaaaguuguagucgcccuaguaccucccuacuucccaaaaggaucccucacaaccgcacaaauaaccugcuucccccacgucaugugugacguccguacacuugaaccaauccaacucccccuucucgacguucgacgcguccuguggcacgccacccaagaccaagaagaaucaaugcggcucgucuguaugcucuacacaccccuucgcaccaacucacccggagacgaauccuucgucgucuccggacgacuccuauccaaaccugccgccgacuucaacuucgucuaccuaaccccucccaucgaacgcaccauauaucgaaugguagaccuacccgucauccaaccccgccucugcacccacgcacguuggcccgcucccgucuacggccuacucguagaccccucccuucccuccaacccucaauggcaaaacggucguguccacgucgacggcacccuccuagguaccacccccaucucaggcucaugggucucuugcuucgccgccgaagcagcauacaaauuccaaagcggcaucggcgaagucgccaccuucacccuuaucgaacaagacggaucggccuacguccccggcgaccgcgcagcaccacucggauaccccgacuucucaggacaacucgaaaucgaaguacaaacagaaacaacaaaaaccggagacaagcucaaaguaacaaccuucgaaaugauccucggcccaacaaccaaugcagaccaagccccauaccaaggccgcguauucgccuccgucacagccgcagccucccucgaccucguagacggccgcguccgagccgucccacgcucaaucuacggcuuccaagacaccauaccggaauacaacgacggucuauuagucccgcucgccccacccauaggcccauuccuccccggagaaguccuacuccgcuuccgcaccuacaugagacaaauugacaccgcagacgccgccgccgaagccauagacugcgcccucccucaagaguucgucuccugguucgcuuccaacgccuucacaguacaaagcgaagcccuccuccuacgcuaccgcaacacccucaccggccaacuccuauucgaauguaaacucuacaacgaaggauacaucgcacucuccuacucuggcuccggaccccucacuuucccaacggauggcauauucgaaguugucucaugggucccacgccucuaccaacucgccagcgucggcagccuagccacgggccgcaugcucaaacaauaa

SEQ ID NO: 35455 - RNA, 1620 nt, Artificial Sequence
  derived and/or modified sequence opt11 from capsid_protein_VP1__Norovirus__AGT17782
augaaaauggccucaaacgacgccacccccucugacggguccucagccaaccuuguccccgaagucaauaacgaaguuauggcccucgaacccguagcaggagccgcaaucgcugcccccguagccggacaacaaaacgucauagaccccuggauacggaacaacuucguacaagcacccggcggugaguucaccgucucuccccgcaacgcacccggcgaaauacucugguccgccucccucggccccgaccucaaccccuaccuaagccaccuaucccguauguacaacggcuacgccgguuccuuugaaguccaagucauccucgcaggaaaugcauuuaccgcaggaaaaaucaucuucgcagcggucccacccaauuuccgcaccgaaggccuaucacccucacaaaucaccauguucccccacaucauaaccgacguccggcaacucgaacccguacuaaucccccuacccgacauccgcaacaacuucuaucacuacaaccaauccaacgacccuacuauaaagcuaaucgcuaugcuauacacaccccuacgcgccaacaacgccggcgacgacguauucaccgucuccugucgcguccucacccgacccucacccgacuucgacuucaucuuccucgucccacccaccguugaaucccgcaccaaacccuucuccgucccgguacucaccgucgaagaaaugaccaacucucgauucccaaucccacuugaaaaacucuucacaggccccuccuccgcauucgucguccaaccacaaaacggccgcugcacgaccgacggcguccuccucggaaccacacaacuauccccagucaacauaugcacauuucgcggcgacgucacccgcaucgggaacucccgggaauaccgcaugaaccucgccucacucaacuggaacaacuacgacccuacagaagaaauacccgcaccccucggcacccccgacuucgccggaaaaauacaaggagugcugacucaaaccacccgacacgauggaucuacccgaggacacaaggccaccgucuacaccggcuccgccggauucacacccaaacucggcuccguccaauucuccaccgacaccgacaaugaccuugaagccaaccagaacacccgauucacccccguaggcguuauacaagacggcaacgcacaccagggcgaaccccaacaauggguacuacccaacuaugcaggacgcgauggccacaacguccaccuagcccccgcagucgccccuacauuccccggugaacaacuccuauucuuccgcuccaccaugcccggcugcuccggauacccuaacaugaaccucgauuguuuacucccucaagaauggguccaacacuucuaccaagaauccgcccccgcacaaagcgacguugcacuccuccgcuucgucaaccccgacacaggccgaguccucuucgaaugcaaacuccacaaauccggcuacgucacaguagcccacacaggcccccaugaccuaguaaucccacccaauggcuacuucagauuugacucauggguaaaccaauucuauacccuagcccccaugggcaacggagccggucgccgacgcgcccucuaa

SEQ ID NO: 35456 - RNA, 1593 nt, Artificial Sequence
  derived and/or modified sequence opt11 from capsid_protein_VP1__Norovirus__AGT17785
augaugauggccucaaaagacgcaacaucaagcguagacggagccucaggcgcaggccaacucguuccagaagucaacgccucugacccccucgcaauggaccccgucgcaggaucaucuacagcagucgcuaccgcaggccaagucaaccccaucgaccccuggaucaucaacaacuucguccaagcaccccaaggagaauuuaccaucagcccaaacaacacccccggagacguccucuucgaccucucauuagggccccaccucaaccccuuccuccuacaccucagccagauguacaacggauggguaggaaacaugcguguccgaaucaugcuagccggcaacgcauucaccgccggaaaaaucaucgucucuugcauaccacccggcuucggcucccauaaccuuaccaucgcucaagccacccuauucccccacguaaucgcugacgugagaacccucgacccaauugaagucccccuagaagacguccgaaacguacucuuccacaacaacgaccgcaaccaacaaaccaugagacucguaugcaugcucuacacaccccuccgaaccggcggcggcaccggcgacuccuucgucguagcaggccgcguaaugaccugucccucccccgacuucaacuuccuauuccuagugcccccaaccgucgaacagaaaacccgacccuucacacuccccaaccuaccccucuccuccuuaucuaacucucgcgcaccccuucccauauccucaaugggcauaucacccgacaacguucaauccguccaauuccaaaacggacgcugcacccuagacggccgccuagucggcaccaccccagucagccugucccacgucgccaaaauacgcggcaccagcaacggaacaguaaucaaccuaaccgaacuagacgguacaccguuccaccccuucgaaggcccagccccuaucgguuuucccgaucuaggcgguugcgacuggcacaucaacaugacucaauucggccacagcucccaaacccaauacgacguugacaccaccccugacacauucgucccccaccucggcucaauccaagccaacggcaucggcucaggaaacuacguaggcguccucucuuggauauccccacccucccaccccuccggcucccagguagaccucuggaaaauccccaacuacgguagcucaaucacagaagcaacccaccuugccccgucaguuuaucccccaggauucggcgaaguccuugucuucuucauguccaaaaugccaggcccaggcgcauacaaccucccaugucuccucccccaagaauacaucagccaccucgcauccgaacaagcaccaacaguaggugaagccgcccuucuccacuacgucgacccagacacuggucgcaaccuaggcgaguucaaagccuacccagacgguuuccuaaccugcguccccaacggagcaucuucuggcccgcaacaacuccccaucaacggcgucuucgucuucgucagcugggucucacgcuucuaccaacucaaaccagucgguaccgccucuagcgcccggggaagacucggccuccgccgauaa

SEQ ID NO: 35457 - RNA, 1623 nt, Artificial Sequence
  derived and/or modified sequence opt11 from capsid_protein_VP1__Norovirus__AGT17788
augaaaauggcaucuaacgacgccaacccuuccgacggcucggccgccaaccuagucccagaagucaacaacgaaguaauggcucuggaacccgucgucggcgcagcaaucgcagccccugucgcaggccagcaaaacgucaucgauccauggauccgcaacaacuuuguccaagcacccggcggcgaauuuaccgucucaccccgcaacgcccccggcgaaauccuuugguccgcaccccuaggaccugaccucaaccccuaccuaucacaccucgccagaauguacaacggcuacgccggcgguuucgaaguccaagucaucuuagccggaaacgccuucaccgccggcaaaaucauauucgccgcagucccacccaacuuccccaccgaaggccucucuccgucccaagucaccauguucccccacauaaucguagacguuagacaacuugaacccguccuaauaccacuaccugacguacgcaacaacuuuuaucauuacaaccaauccaacgacuccacaaucaaacucaucgccaugcucuacaccccacuaagagcuaacaacgcaggcgaugacgucuuuaccgucucaugccgcguucuuacccgccccuccccagacuucgacuucauauuccuagucccacccacuguagaaucacgcacaaaacccuuuucagucccuauucucaccguagaagaaaugacaaacucccguuuccccauuccacucgaaaaacucuucaccggccccucauccaccuucguaguacaaccccaaaauggccgcugcaccaccgacggcguacuccucggcaccacacaacuauccccagucaacauuugcaccuuccgcggcgaugucacccacauaacuggcucccgcaauuacacaaugaaccuagccucccaaaacuggaacucauacgacccgaccgaagaaauuccagcaccccuaggcaccccagacuucguuggcaaaauacaaggcguucucacucaaacaacccgcaccgacggaucaacccggggccacaaagccacugucuauaccggcuccgccgacuucucccccaaacuuggccgcguccaauucgccacagacacagacaacgacuucgaugccaaccaaaacacuaaguucaccccaguaggcgucauccaagacggcggaacuacccaccgcaacgaaccccaacaauggguccuuccauccuacuccggccgcaauacccacaacguccaccucgcccccgccguagcccccaccuuccccggcgaacaacuccucuucuuccguuccacaaugcccggcugcagcggauacccaaacauggacuuagacugccuccuuccucaagaauggguacaacauuuuuaccaagaagccgcccccgcccaaucagacgucgcccuccuccgauucgucaacccugacacuggccgaguccucuucgaaugcaaacuccacaaaucaggcuacgucaccgucgcccauaccggccaacaugaccucgucaucccacccaacgguuacuuccgcuuugacuccugggucaaccaauucuacacccuugcucccaugggcaacggcacgggccgcagacgcgccguauaa

SEQ ID NO: 35458 - RNA, 1593 nt, Artificial Sequence
  derived and/or modified sequence opt11 from capsid_protein_VP1__Norovirus__AGT17792
augaugauggcauccaaggacgccaccucauccgucgacggcgcaucaggggccggccagcucgucccagaagucaacgcuucagacccccucgccauggaucccguagccggcuccuccaccgcaguugcaaccgcuggccaagucaaccccaucgaccccuggauaaucaacaacuucguacaagccccccaaggugaauucaccaucucacccaacaacacacccggcgacguccucuucgaccucucccuugguccccaccucaaccccuuccuccuccacuuaucccaaauguacaacggcuggguuggaaacaugcgaguccgaaucauguuggccggcaacgccuucaccgccgguaagauaaucgucuccugcaucccccccggcuucggcucccacaaucucacaaucgcccaagccacccuauucccccacguaaucgcagacguccgaacucuagauccaaucgaagucccccucgaagacguccgaaacguccucuuccacaacaacgaucgcaaucaacagaccaugcgccuugucugcaugcuauacaccccucuacgaacuggcggaggcaccggcgacucauucguugucgccggucgcgucaugaccugcccuucaccagacuucaacuuccucuuccuaguaccaccgacggucgaacaaaagacccgccccuucacacuccccaaccuaccccuauccucccucuccaacucccgcgccccccugccaauaucauccaugggcaucucccccgacaacguccaauccguucaauuccagaauggacgcugcacccuugacggucgacugguaggaacaacccccgucucccuaucccacgucgccaaaauccgcggcaccuccaacggcaccguuaucaaccuuacagaacucgauggcaccccauuccaccccuucgaaggacccgccccaaucggcuucccugauuuaggcggcugcgacuggcacauuaacaugacacaauucggccacucaagccaaacccaauacgacgucgacacuacccccgacacauucgucccccaccuuggcuccauucaagccaacggcaucggcuccggcaacuacgucggcguccuauccuggaucucaccccccucccacccaucaggaucacaagucgaccucuggaaaauccccaacuauggaucauccaucacagaagccacccaccuugccccuuccguauacccccccggauucggcgaaguacuagucuucuucauguccaaaaugccuggccccggcgccuacaaucuacccugccuccucccccaagaauacaucucccaccuagcaucugaacaagcccccacagucggcgaagccgcccuccuacacuacgucgaccccgauaccggccgcaaccucggcgaauucaaagcuuacccugacggcuuccucaccugcguucccaacggcgccucaucaggaccacaacaacucccuaucaauggcgucuucguauucguaucuugggucucucguuucuaccaacucaaaccagucggaacugccucguccgcccgaggccgccucggccuccgccgcuaa

SEQ ID NO: 35459 - RNA, 1623 nt, Artificial Sequence
  derived and/or modified sequence opt11 from capsid_protein_VP1__Norovirus__AGT17795
augaaaauggcuuccuccgacgccaacccaucugacggcucaacagccaaccucguccccgaagucaacaacgaagucauggcccucgaacccgucgucggcgccgcaaucgccgcccccguagcaggccaacaaaacguaauagacccauggauccgaaacaacuucguccaagcccccggcggcgaauuuacugucucuccccgaaacgccccgggcgaaauacuauggucagcaccccucggaccugaccuaaaccccuaccucucccaccucgcccggauguacaacggcuacgccggcggcuuugaaguacagguaauccucgcaggaaacgccuucacagccgguaaaaucaucuucgcugcgguaccacccaauuuucccacugaaggccucucacccucucaaguaaccauguucccucacaucaucgucgacguccgccaacucgaaccuguccucaucccacuacccgacguccguaacaacuuuuaccacuacaaccaauccaacgaccccaccaucaaacucaucgccaugcucuacacaccccuucgcgccaacaacgccggagacgacguauucaccgucucaugccgcguccuuacccgaccaucacccgacuucgacuucaucuuccucguaccuccuaccgucgaaucacgcaccaaacccuucuccguacccguccucaccguugaagaaaugacuaacucccgauuccccauaccauuagaaaaacucuucacaggaccaucaucggcuuucgucguacaaccccaaaacggccgcugcaccacagacggaguccuacucggcacaacccaacucuccccagucaacaucugcaccuuccgcggcgacgucacccacaucuccgguucccgcaacuacacaaugaaccuagccucccaaaacuggaacuccuacgaccccacagaagaaauccccgccccucucggcacacccgacuucgucggcaaaauccaaggcguccucacccaaaccacgcgcaccgacggaucuacucgcggccacaaagccaccguauauaccggcuccgccgacuucucaccuaagcugggacguguccaauucgcuacugacacagacaacgacuucgucaucaaccaaaacacaaaauucacccccguugguguaauccaagacggcuccaccacaccccguaacgaaccccaacaauggguccucccuucauacuccggacguaacacccacaacguccaccucgccccugcaguugccccuaccuuccccggcgaacaacuccucuucuuccgcuccacaaugcccggcugcuccggcuacccgaauauggaccucgacugccuccucccccaagaauggguucaauacuucuaccaagaagccgcacccgcccaguccgacgucgcccuacuccgcuucguaaaccccgacacaggccgcguccuuuucgaaugcaaacuacacaaaucaggcuaugucacugucgcccauaccggacaacacgaccuagucauacccccuaacggcuacuuccgcuuugauuccugggucaaccaauucuacacccucgccccuaugggcaacggcaccggccgcagacgagcccucuaa

SEQ ID NO: 35460 - RNA, 1617 nt, Artificial Sequence
  derived and/or modified sequence opt11 from capsid_protein_VP1__Norovirus__AGT17798
augaaaauggccucguccgacgccaaccccuccgacggcuccacggcaaaccucguccccgaagccaacaaugaaguaauggcccucgaacccgucgugggagccgccauagccgcaccaguagccggccaacaaaacgucaucgacccuuggauccgcaacaacuucguacaagccccaggcggcgaauuuaccgucuccccacgcaacgcccccggugaaguccucuggucagccccacucgguccugaucucaaccccuaccucucacaccuagcacgaauguacaacggcuacgccgguggcuucgaaguacaagucauacucgcaggcaaugccuucgcagcuggaaaaaucauauucgccgccguaccgcccaauuucuccaccgaaggccuauccccaucucaagucacuauguucccgcaucuuaucgucgacguccgccaacucgaacccgucaugaucccacuccccgacauccgaaacaacuucuaccacuacaaccaaagcaacgacccaaccaucaaacucaucgcaaugcucuacaccccacuccgcgcaaacaacgucggugacgaugucuucaccguauccugccgaguccucacucgcccaucaccagacuucgacuucaucuuucuugucccacccaccguagaaucaaaaaccaaccccuucucugucccuauacucacaaucgaagaaaugaccaacuccagauuucccaucccccuagaaaaacuuuucaccggacccuccuccgcccuaguaguacaaccccaaaacggccggugcacuacugacggcguccuccuagguaccacacaacuuucuccaguaaacaucugcacauuccgcggagacgucacccacacaaccaaaacccacacauaccaaaugaaccucgcagcacaaaacuggaacucauacgacccuaccgaagaaaccccagccccacucggcacacccgacuuugucgguaaaauacaaggcguccuaacccaaaccacaaaaggaaacggcagcacuagagcacauaaagcaaccguuuacacaggcacaguugaauuuacccccaaacucggacgcauacagcuauucacagacaccgacaacgaccucgaagccaaccaaaacaccaaauucacccccgucggagucauccaagacggcgaccaccaaaacgaaccgcaacaauggguccuuccuuccuacucaggacgcaacaaccacaacguccaccuugcaccagcagucgcaccgacuuucccuggcgaacaacuacuuuucuuccgcuccacaaugccaggauguucgggauaccccaacaugaaucucgacugccuccucccacaagaauggguacaauacuucuaccaagaagcagcccccgcucaaucugacgucgcccuccuacgcuucguaaaucccgacaccggccgcguccucuucgaaugcaaacuccacaaauccgguuacguaaccgucgcccacaccggucaccacgaccucgucaucccacccaacgguuauuuccgcuucgacuccugggucucccccuucuacacccuagcccccaugggaaacggcaccggacgccgacgcgcccucuaa

SEQ ID NO: 35461 - RNA, 1593 nt, Artificial Sequence
  derived and/or modified sequence opt11 from capsid_protein_VP1__Norovirus__AGT17803
augaugauggccuccaaagacgcaaccuccuccgucgacggcgcuuccggcgcaggccaacuugucccagaaguaaacgcauccgacccacuagcaauggaccccgucgccggcucaagcaccgccguugccacagccggccaagucaacccaaucgaucccuggaucaucaauaacuucguccaagcaccccaaggcgaguucaccaucucccccaauaacacccccggagacguccuuuucgaccucucgcucggcccccaccuaaacccauuccuucuccaccucucccaaauguacaacggcuggguaggaaauaugcgaguccgcaucaugcuagccggcaacgccuucaccgccggcaaaaucaucgugucaugcaucccacccggcuucggcucacauaaccuuacaaucgcccaagcaacccuauucccacacgucauagcagacguaagaacccucgaccccauagaaguaccccucgaagacguucgaaacguacuuuuccacaacaacgaucgcaaccaacaaaccaugcgccucgucugcaugcuauacacaccccuccguaccggcggaggaaccggagacuccuucguuguagccggccgcgucaugacaugccccuccccagacuucaacuuccuauuucucgucccucccaccguugaacaaaagacacgacccuucacacuucccaaccucccccucucaucccuauccaacucacgcgccccacucccaaucagcucaaugggcauaagucccgacaacguacaaucgguccaauuccaaaacggccgcugcacccucgacggccgacucgucggcaccacacccgucucauuaucccacgucgcaaaaauccgagggaccuccaacggaaccgucaucaaccuaaccgaacuggacggcacacccuuccaccccuucgaaggaccugcccccaucggcuuccccgaccucggaggaugcgacuggcacaucaacaugacccaauucggccauuccucccaaacccaauaugacguagacaccacacccgacaccuucguaccccaucuaggauccauucaagccaaugguaucggcuccggcaacuacgucggcgugcuaucauggaucuccccucccucccaccccagcggcucccaagucgaccucuggaaaauccccaacuacggaucaagcaucacagaagcaacccaccuagcccccucagucuaucccccuggcuucggcgaaguccucgucuucuucauguccaaaaugccaggacccggcgcuuacaaccuaccgugccuccucccacaagaauacaucucucaccucgccucugaacaagcccccaccgucggcgaagccgcacuacuccacuacgucgaccccgacacaggcagaaaccuuggcgaguucaaagccuaccccgacggcuuucuaaccugcgucccuaauggcgccagcuccggcccccaacaacuaccuaucaacggcgucuucgucuucgucucauggguuucacgguucuaccaacucaaacccgucgguacagcuucaucagcacgaggccgccuaggccuccgaagauaa

SEQ ID NO: 35462 - RNA, 1593 nt, Artificial Sequence
  derived and/or modified sequence opt11 from capsid_protein_VP1__Norovirus__AGT17806
augaugauggccucuaaagacgcuaccuccuccguagacggagcuucuggcgccggacaacucgugcccgaaguaaacgccucugacccccuugccauggaccccguagcagguuccuccaccgcuguugccacagcuggccaagucaaccccauagaccccuggaucaucaacaacuucguccaagcaccccaaggagaauuuaccaucucccccaauaacaccccaggcgacguccucuucgaccuaucccucggcccucaucucaaccccuuccuccuccaccucucccaaauguauaacggauggguaggcaacaugcgaguccgaauaaugcuugccggcaacgccuuuacugccggaaaaaucauagucuccugcauaccacccgguuucggcucccauaaccuuacaaucgcccaagcaacauuauucccccacgugaucgcagauguacgcacccuugaccccaucgaaguaccacuugaagacguccgaaacguccucuuccacaacaacgaccgcaaucaacaaaccaugcgacucguaugcaugcucuacacaccccuacgaacaggcggcggcaccggagacuccuucgucgucgccggccgcguaaugacuugcccaagccccgacuucaacuuccucuuccuagucccucccacugucgaacagaaaaccagacccuucacucuacccaaccucccccucuccucccucuccaacucccgcgccccacuacccaucuccuccaugggcaucucccccgacaacgugcagucaguccaguuccaaaacggacgcugcacccuugacggacgccuugucgggaccaccccaguaucccuuucccaugucgcaaagauccgcgguaccuccaacggcacagucaucaaccucaccgaacucgacggaaccccauuccacccuuuugaaggacccgcccccauaggcuuccccgaccucggcggcugugacuggcacauuaacaugacccaguucggccacaguagccagacccaauacgacgucgacacaacacccgacaccuucgucccccaccucggcaguauccaggccaacggcauaggcucaggaaacuacguaggcguccucuccuggauuuccccucccucucaccccuccggcucacaagucgaccucuggaaaauccccaacuacggcuccucuaucacagaagccacacaccucgcgccaucggucuaucccccgggcuucggcgaagucuuagucuucuucauguccaaaaugcccggcccaggugccuacaaccuucccugccuccucccucaagaauacauaucacaccuugccuccgaacaagcccccaccgucggagaagcagcccuucuucacuacguugacccugacacagguagaaaccucggagaauuuaaagccuaccccgaugguuuccuaaccugcguccccaacggcgccucaucagguccccaacaacuccccaucaacgguguuuucgucuucgucuccugggucucacgcuucuaccaacucaaacccguaggcacagcauccucugccagaggccgacucggccuacgccgauaa

SEQ ID NO: 35463 - RNA, 1593 nt, Artificial Sequence
  derived and/or modified sequence opt11 from capsid_protein_VP1__Norovirus__AGT17809
augaugauggcauccaaagacgccacauccucaguagacggugccucgggcgccggucaacucguccccgaaguaaaugccuccgacccccuggccauggacccugucgccgguagcucuacagccgucgcaaccgccggccaagucaacccuaucgacccguggaucaucaauaacuuuguucaggcaccccaaggcgaauuuaccaucucacccaacaacacccccggcgacguccucuucgaccucucccucggaccccacuuaaaucccuuccucuuacaccucagccaaauguacaacggauggguaggaaacaugcgcguccgcaucaugcucgccgguaacgccuucacugccggaaaaauaaucgucucuugcaucccacccggcuucggaucccacaaucuaaccaucgcccaagcaacccuguucccucacguaaucgccgacguccgaacucucgacccaaucgaaguuccccuugaagaugucagaaacguacuauuccacaacaacgaccgcaaucaacagacuaugcgccucgucugcaugcucuacacuccccuccgcacaggaggcggaaccggcgacaguuucgucgucgccggcagaguaaugacaugccccagcccggacuucaacuuccucuuccucguacccccaaccgucgaacagaaaacacgccccuucacccuacccaaccuuccccucuccucucuauccaacucacgcgccccucuccccauauccucgaugggcaucucccccgauaacguacaauccguccaauuccaaaacggacgcugcacacucgacggacgccucgucggcacaacaccagucucccuaagccacgucgccaaaauccguggcacaucaaacgguaccgucaucaaccucaccgaacucgacggcaccccuuuccauccauucgaaggacccgcucccaucggauuucccgaccuaggcggaugcgacuggcacaucaacaugacccaauucggacacucuucacaaacccaauaugacgucgacaccaccccagauacauucgucccucaccucggcuccauccaagccaacggaauuggauccggaaacuacguaggcguccucuccuggaucucacccccaucccaccccuccggcagucaagucgaucuauggaaaauacccaacuacggcuccuccauuacagaagccacacaucuagcccccuccgucuauccacccggcuucggcgaaguccuaguguuuuucaugucaaaaaugcccggaccaggcgccuacaaccucccaugccuacucccccaagaauacaucagccaccuagcguccgaacaagcgcccacaguaggcgaagccgcacuacuccacuacgucgaccccgacacaggccgcaaccucggcgaguucaaagcauacccagacggcuuccuaaccugcgucccaaacggcgcauccucaggaccccaacaacucccaaucaacggcgucuucgucuucgucagcuggguaucacgcuucuaccagcuuaaaccagucggaacugccuccuccgcccgagggcgccuaggccuacguagauaa

SEQ ID NO: 35464 - RNA, 1623 nt, Artificial Sequence
  derived and/or modified sequence opt11 from capsid_protein_VP1__Norovirus__AGT17813
augaaaauggccucaaaugacgcaaaccccucagacggcucggccgccaaccuuguccccgaggucaacaaugaagucauggcccucgaacccgucgucggcgccgcaaucgccgccccaguagccggccaacaaaacgucauagacccauggaucagaaacaacuuuguucaagcccccggcggagaauuuaccgucucuccccgcaacgcccccggagaaauccucugguccgcaccccucgguccagaccuaaauccauaccuaucacaccucgcccgcauguauaacggauacgccggaggcuucgaaguccaaguuauccucgccggcaacgcauucaccgccggaaaaaucaucuucgcagcagucccacccaacuuccccaccgaaggccucucacccagccaagucaccauguucccccauauaauaguggacguccgucaacucgaaccuguccuaaucccacuucccgauguccgcaacaauuucuaucacuacaaccaaucaaacgacucuaccauaaaacucauagcaaugcucuacacaccccuacgugccaacaacgccggcgacgacgucuucaccgucuccugccgcguccuaacccgcccuucaccggacuucgacuuuaucuuccuaguaccucccaccguagaaucccggacaaagcccuucucaguucccauccuaacuguagaagaaaugaccaacucacguuucccuaucccccuagaaaaacucuucaccggucccucauccacuuucgucguacaaccccaaaacggccgaugcaccaccgacggcguccuccuugguaccacacaacucagcccaguaaacaucugcaccuuccgcggagacgucacucacaucgccggcucuagaaacuacacaaugaaccucgcuucccaaaacuggaacuccuacgaccccaccgaagaaaucccagcaccccucggcacacccgacuucguaggcaaaauacaaggaguccucacccagacaacccggacugacggauccacaagaggccacaaggccacagucuacaccggauccgccgacuucagccccaaacuuggccggguacaauucgcaacugacaccgacaacgacuuugaugcaaaccaaaacacaaaauucacaccagucggcgucauacaagacggcggaaccgcccaccggaacgaaccccaacaguggguccucccaagcuacuccggccgcaacacacacaacguucaccucgcccccgccgucgcaccaaccuucccaggcgaacaacuccuuuucuuccgcucaaccaugccgggaugcucgggauacccuaacauggaccucgacugccuacucccacaagaauggguacaauacuucuaccaagaagcagccccagcccaauccgacgucgcacugcuacgcuucgucaauccagacaccggucgcgucuuauucgaaugcaagcuacacaaacccggcuacgugacagucgcccacaccggccaacacgaccucguaaucccacccaacggcuacuuccgcuucgacuccuggguaaaccaauucuacacccuagcccccaugggcaacggcaccggccgccguagagcacucuaa

SEQ ID NO: 35465 - RNA, 1623 nt, Artificial Sequence
  derived and/or modified sequence opt11 from capsid_protein_VP1__Norovirus__AGT17816
augaagauggccucaucugacgccaaccccagcgacgguucagcagcgaaccuggucccagaggucaacaacgaggucauggcccucgaaccagucguaggcgccgcuaucgccgccccaguugccggccagcaaaacguaaucgaccccuggauccgcucaaacuucguccaagcccccggcggcgaguucaccguaucaccccgcaacgccccaggagaaauccucugguccgcaccccucggacccgaccuuaacccuuaucuaucacaccuugcccgcauguacaacggauacgccggaggcuucgaaguccaaguaauacuagccggaaacgccuucaccgccggcaaaauaauauucgccgccgucccacccaacuuccccacagaaggacucucccccucacaaguuacuauguucccccacaucauugucgacguccgacaacuagaacccguccucaucccguuaccagacguccgaaacaacuucuaccacuacaaccaaagcaacgacuccaccauaaaacuaauugccaugcucuacacuccccuccgcgccaacaacgccggcgacgacgucuucaccguaaguugccgaguacucacccgcccaucacccgacuucgacuucaucuuccuagucccucccaccgucgaaucacgaacaaaaccauucaccgucccaauccuuacgguugaagaaaugacaaacucacgcuuccccaucccacucgaaaagcuauucacaggccccucaucagccuucguaguccaaccccagaacggucgcuguaccaccgacggcguccuacuaggcacgacccaauuaucccccgucaacaucugcaccuuccgcggagacguaacacacaucgcaggcucccgcaacuacacuaugaaucucgccucucuaaacugguccaacuacgacccaacagaagaaauccccgccccacuaggcacccccgauuucguaggcaaaauccaaggcguccugacccaaaccaccaaaggagacggcucaacccgaggccacaaagccaccguauacacagguuccgccgacuucacccccaaacuaggcagcguccaauucgcuacagacaccgaaaacgacuucgaaacccaccaaaacacacguuucacacccgucggugucauccaagacggaggcaccacccaucgcaacgaaccccaacaauggguacuccccagcuacucaggccgaaauguccacaacguucaccuagcccccgccgucgcccccaacuuuccaggcgaacaacuccucuuuuuccgauccacaaugcccggcugcuccggcuaccccaacauggaucuugacugccuccuaccccaagaauggguacaacacuucuaccaagaagccgcaccagcccaaucagacguagcacuauuacgguucguaaaccccgacaccggacgcguccuauucgaaugcaaauuacacaaauccggauacguuacagucgcacacaccggccaacacgaccucgucaucccacccaacggcuacuuccgcuucgacuccuggguaaaucaauucuacacacuugcacccaugggcaacgguaccggccgccgccgcgcacuguaa

SEQ ID NO: 35466 - RNA, 1623 nt, Artificial Sequence
  derived and/or modified sequence opt11 from capsid_protein_VP1__Norovirus__AGT17819
augaaaauggcaucgucagacgccaacccauccgacggaucaaccgccaaccucguccccgaagucaacaacgaagucauggcccuagaaccaguaguaggcgccgccauugcugcccccgucgccgggcaacaaaacguuauugacccauggauacgcaauaauuucguucaagcccccggcggcgaguucacagucucaccacgcaacgcccccggugaaauccucuggucugccccacucggccccgaccuaaacccuuaccuaucccaccuagcccguauguacaacggauacgcuggaggauucgaaguccaagucauccuagcaggcaacgccuucaccgcgggcaaaaucauauucgcagcagucccacccaacuuccccaccgaaggccugucccccucccaagucaccauguucccacacauaaucgucgacguacgccaacucgaacccguucucaucccccuacccgacguccgcaacaacuucuaucacuacaaccaauccaaugaucccacaaucaaacugauugccaugcuauauacaccccuuagagccaacaacgccggcgaugaugucuucacagucucaugccgcgugcucacucgucccuccccugacuucgacuucauauuccucgugcccccgaccgucgaaucccgcacaaaacccuuuucagucccaguccucaccgucgaagaaaugaccaacucccgcuuccccaucccacucgaaaaacucuucaccggcccauccucagccuucgucguccaaccucaaaacggccgaugcacaaccgacggcguccuacuuggaaccacccaacucucucccgucaacauaugcaccuuccgaggagacgucacccauaucgcaggaucacgcaacuacaccaugaaccuagccucacaaaacuggaacuccuaugaccccacagaagaaaucccagccccgcuuggcaccccagauuucgucggaaaaauccaaggaguccuaacacaaaccacacguaccgacggaagcacccguggccacaaagcuaccgucuacacgggauccgccgacuucuccccuaaacugggccgcguccaauucgccaccgacaccgacaacgauuucgucacaaaccagaacacaaaauucacccccgucggcgucauccaggacggcggcaccacuccacguaacgaaccacaacaauggguccuacccuccuacucaggccgcaacacccacaacgugcaucuagcucccgccguugccccgaccuuucccggcgaacaacuacuauucuuccgaucaaccaugccaggcugcagcggcuacccaaacauggaccucgacugccuccucccccaagaauggguacaauauuuuuaccaggaagcugccccagcacaaagcgaugucgcccucuuacgcuucgucaauccagauaccggccgaguccuauucgaaugcaagcuccacaaauccggcuacguaaccguugcccacaccggccaacacgaccucgucaucccaccuaacggcuacuuccgcuucgacucaugggucaaccaauucuacacgcucgccccaaugggcaacggcaccggccgccgacgagcccucuaa

SEQ ID NO: 35467 - RNA, 1623 nt, Artificial Sequence
  derived and/or modified sequence opt11 from capsid_protein_VP1__Norovirus__AGT17823
augaaaauggcguccuccgacgccaaccccuccgacggauccaccgccaaccucguccccgaaguaaacaacgaaguaauggcccucgaacccgucgucggagccgccauagccgcccccgucgccggccaacaaaacguaaucgaccccuggauccgaaauaacuucguccaggcccccggcggagaguucacugucucuccccgaaacgcacccggcgaaauccucugguccgcaccccucggacccgacuuaaauccauaucucucccaccuagcccgcauguacaacggcuacgcaggaggauucgaaguccaagucauccucgcaggcaacgccuucacagcaggcaaaaucaucuucgcagccguaccacccaacuuccccacagaaggacucucccccucacaaguuacaauguucccacacaucauaguagacguacgccaacucgagccccuacucaucccccuccccgacguuagaaacaacuucuaccacuauaaccaauccaacgacccaacaaucaaacuaauagccaugcuuuacacaccacuccgcgccaacaacgccggagacgacgucuuuacagucucgugccgcguacucacacgcccauccccugacuucgauuucauauuccuagucccacccacugucgaaucccgaacaaaaccauucuccguccccauccucaccaucgaagaaaugaccaacucacgcuuucccaucccccucgaaaaacucuucaccggacccucaucagccuucguaguccaaccacaaaacggccgcugcaccaccgacggcguacuccucggcaccacccaacuuucccccguaaacaucugcaccuuccgcggugacguaacccacaucaccggaacccacaauuacgccaugaacuuagccgcccaaaacuggaacuccuaugaccccaccgaagaaaucccagcaccccuagggaccccagacuucgucggaaagauccaaggcguucucacccaaaccacccgcgcagacggcuccacccgcgcccacaaagccaccguauacaccggcucagcagaguucgcccccaaacuaggacgcguccaauucgcaaccgauacagacuccgauuucgacacaaaccaaaacacaaaauucacacccgucgggguaauccaagacggcaacaccgcccaucagaacgaaccacaacaauggguccuucccucauacuccggcagaaacaaccacaacguccaccuagccccagcagucgccccaacguuuccaggagaacaacuauuauucuucagauccaccaugcccgguugcuccggcuaccccaacaugaaccucgacugccuauuaccacaagaauggguccaguacuucuaccaagaagccgcccccgcacaauccgacgucgcccuccuucgauucgucaaccccgacacaggacgcguucuauucgaaugcaaauuacacaaaucaggcuacgucaccgucgcacacaccggccaacacgaccucguaaucccgcccaacggcuacuuccgauucgacuccuggguuucacccuucuacacccuugcccccauggggaacggcacaggccgacgacgagcccucuaa

SEQ ID NO: 35468 - RNA, 1593 nt, Artificial Sequence
  derived and/or modified sequence opt11 from capsid_protein_VP1__Norovirus__AGT17826
augaugauggccuccaaagacgccacauccuccguagacggugccucaggcgcaggacaacucguccccgaaguaaacgccuccgacccacucgcaauggacccugucgccggaaguucaaccgccgucgcaaccgcaggccaagucaacccaaucgaccccuggauaauaaacaacuucguccaagcuccccaaggcgaguucacaauauccccaaacaacacccccggcgacguacuauucgaccucucccuaggaccccaucucaaccccuuccucuuacaccuaucccaaauguacaacggaugggucggaaacaugcgaguccgcaucaugcucgcaggaaacgccuucaccgccggaaaaaucaucgucucaugcaucccucccgguuucggcucccacaaccucacgauagcccaagccacccuauucccccacguuaucgcagacguccgcacccucgaccccauagaagucccccuagaagacguccgaaacguccucuuccacaacaacgaucgaaaccaacaaaccaugagauuagucugcaugcuauacacaccacuccgaaccggaggaggcaccggcgacucuuucgucgucgccggccgcgucaugaccugcccaucacccgacuucaacuuccuuuuucuagucccacccacggucgaacagaaaacccgccccuucacacucccuaaccuuccccuauccucccucuccaauucgcgcgccccacucccuauaagcuccaugggaauuuccccagauaacguccaauccguccaauuccaaaacggacgcugcacacuagacggccgccuugucggcacaacacccgucucccucucccacguagcaaaaauacgcgguacauccaacggcaccguaaucaaucuuacagaacucgacggcacccccuuccaccccuucgaaggccccgcccccauaggcuuccccgaccuaggaggcugcgacuggcacaucaacaugacccaguucggccacuccagccaaacccaauacgacguagacaccaccccagacaccuucgucccccaccucggauccauccaggccaacgguauaggcuccggcaacuacgucggcgugcucuccuggaucuccccucccucucaccccagcgguucccagguagaccuuuggaaaauacccaacuacggcuccuccaucacagaagccacccaucuagcucccucagucuacccacccggcuucggcgaaguauugguguucuucaugagcaaaaugcccggccccggagccuacaaccuacccugccuacuuccacaagaauacaucucccacuuagccagcgaacaagcacccaccgucggcgaagccgcacuccuccacuacguagaccccgauacuggccgaaaucucggcgaauuuaaagcauaccccgacggcuuccuaaccugcguccccaacggcgcuuccuccggaccacaacaauugccgaucaacggcguauucguuuucguaucaugggucucccgcuucuaccaacuaaaaccaguaggcaccgccuccagcgcccgcggacgccugggccuucgucgauaa

SEQ ID NO: 35469 - RNA, 1620 nt, Artificial Sequence
  derived and/or modified sequence opt11 from capsid_protein_VP1__Norovirus__AGT17830
augaaaauggccagcaacgacgcaacgcccucagacggcucaucggccaaucuaguccccgaagccaacaacgaagucauggcacucgagcccguagcaggagccgcaaucgccgcucccguagcuggccaacaaaacguaauagaccccuggauacgcaacaacuucguccaagccccaggcggcgaguucacaguaucaccccgcaacgcacccggagaaauccugugguccgccucacucggccccgaccucaaccccuaccucucccaccugucgcgcauguauaacgguuacgccgguucuuucgaaguacaagucauucuagcaggaaacgcauucaccgccggcaaaaucauauuugccgcaguacccccaaacuuccgaacagaaggccucucccccagccaaaucaccauguucccccacaucaucaccgacguacgccaacucgaacccguacugauaccccucccagacauccgcaacaacuuuuaccacuacaaccaauccaacgaccccaccauaaaacucaucgccaugcucuacacaccacuccgcgccaacaacgccggcgaugacguauucaccguauccugccgcguacuaacccgccccagcccagacuucgacuucauauuccucgugccacccacagucgaaucccgaaccaaacccuucucaguaccaguccuuacagucgaagaaaugaccaacuccagauucccaauuccacucgaaaagcuauucacugggcccuccuccgcauucgugguccaaccccaaaacggcagaugcacaacagacggcgugcuccucggcacaacccaacucucccccguaaacauaugcacauuccgcggcgacgucacccguauuggcaacagccgcgaauaccgcaugaaccuagcgucccucaacuggaacaacuacgaccccaccgaagagauccccgcaccccuuggcacacccgacuuugccggcaaaauacagggcguuuuaacucaaaccacccggcacgacggcuccacaagaggccacaaagccaccgucuacacaggcuccgccggauucaccccaaaacuagguuccguacaauucucaacagacacagacaaugaccucgaagcaaaccaaaacacccgcuucacacccgucggcgucauccaagacggcaacgcccaccaaggagaaccacaacaguggguccuacccaacuacgcaggccgagacggacauaacguacaccuugccccagccguagcaccuacauuucccggugaacaauuacuauuuuuccgcucaacaaugcccggcugcucaggcuaccccaacaugaacuuagacugccuucuaccccaagaauggguccaacacuucuaccaagaauccgcccccgcccaaagcgacgucgcacuacuacgauucgucaacccagacacaggccgcguccuauucgaaugcaaacuccauaaguccggauaugucacugucgcccauaccggcccccacgaccuagucauaccacccaacggcuacuuccgcuucgacuccugggucaaccaauuuuauacccucgcacccaugggaaacggcgccggccgacgacgggcccucuaa

SEQ ID NO: 35470 - RNA, 1623 nt, Artificial Sequence
  derived and/or modified sequence opt11 from capsid_protein_VP1__Norovirus__AGT17833
augaaaauggccuccuccgacgccaaccccuccgacggcuccaccgcaaaccucguccccgaaguaaacaacgaagucauggcccucgaacccguugucggggcagccaucgccgcccccgucgcaggccagcaaaacguaaucgacccauggauacgaaacaacuuuguccaggcccccggcggugaauuuaccgucucacccagaaacgcaccuggcgaaauccucuggucagcuccccucggccccgaccuaaacccuuaccucucccaccuugcccgaauguauaacggcuacgccggcggcuucgagguccaagucauacucgccggcaacgccuucaccgccggcaaaaucauauuugccgcagucccacccaacuuccccacugaaggccucucacccucccaaguaaccauguucccccauaucauaguggacguucgacaacuagaaccaguccucaucccacucccagacguacgaaacaacuucuaucacuacaaccaaagcaacgacucaaccaucaaacucaucgccaugcucuacacaccccuuagagccaacaacgccggugacgacgucuuuaccguuuccugccgcguccucacaagaccaucucccgacuucgacuucauuuuccucgucccucccacagucgaauccagaacaaaacccuucuccguacccguacucaccguagaagaaaugacgaacucccgcuucccuaucccccuagaaaaacuauucaccggcccauccuccgccuucgucguacaaccccagaacggccguugcaccaccgacggaguacuacugggcacaacccaacucucccccgucaacaucugcacauucagaggagauguaacccacaucgcaggcucacgcaacuacaccaugaaccucgccucacaaaacuggaacuccuacgacccaacagaggaaaucccagccccacucggcaccccugacuucgucggcaaaauacaaggcguccucacucaaaccacccgcacugacggauccacccgcggacacaaggccaccguuuacacaggaagcgccgacuuuucacccaaacucgguagaguacaauucgccaccgacacugacaaugacuucguuaccaaccaaaacaccaaauucaccccagucggcgucauccaagacggaucaacaacaccccgcaacgaaccccaacaauggguacuacccuccuacucgggccgcaacacacacaacguacaccuagcacccgccgucgcucccaccuucccaggcgaacaacuauuauucuuccgaucaacaaugcccggcugcucaggcuacccaaauauggaccuagacugccuccucccccaagaauggguccaauauuucuaccaggaagccgcccccgcccaaagcgaugucgcacuccuccgauucguuaacccagacaccggccgcguccucuucgaaugcaaacuccacaaaagcggcuacgucaccguagcccacaccggccaacacgaccucguaauacccccaaacggauauuucagauucgauucgugggucaaccaauucuacacacuagcccccaugggcaacggcacuggccgccgucgcgcacuauaa

SEQ ID NO: 35471 - RNA, 1593 nt, Artificial Sequence
  derived and/or modified sequence opt11 from capsid_protein_VP1__Norovirus__AGT17836
augaugauggccuccaaagacgccaccuccagcgucgacggcgcauccggugccggucaacucguacccgaagucaacgcauccgacccacucgccauggacccggucgccggauccuccacagccgucgcuacagccggccaaguuaaucccaucgauccauggauaauaaauaauuuuguccaagccccacaaggugaguucacaaucucucccaacaacaccccuggagacguccuauucgaccucucucuaggcccacaccuuaacccuuuccugcuacacuugucccaaauguacaacggcugggucggaaacaugcgcguccgcaucaugcucgccggcaacgccuuuacugcaggcaaaauaaucgucucaugcaucccacccggauucggaucccacaaccucaccaucgcccaagccacccuauucccccacgucaucgcagacguacguacucuugaccccaucgaagucccccuagaagacguuagaaauguccucuuccacaauaacgaccgcaaccaacaaacaaugcgccucgucugcaugcucuacacuccacuacgcaccggcggcggcacuggagacucuuucguagucgcaggccgcguuaugaccugccccucacccgacuucaauuucuuauuccucguaccaccaacagucgaacagaaaacccgccccuucacccuccccaaucuaccacuguccucccucuccaacucccgcgcaccccuccccauuucuucaaugggcauauccccugacaauguccaauccguacaauuccaaaacggccgcugcacacucgacggacgccucgucggcaccaccccaguaucucuaucccacguagccaaaauccgcggaaccuccaacggaaccguuaucaaucuaaccgaacucgacgggacccccuuccaccccuucgaaggccccgcccccaucgguuuucccgaccucggcggaugcgacuggcacaucaacaugacccaauuuggccacucaucgcaaacccaauacgaugucgacaccacacccgauaccuucgucccccaccugggcucuauacaagcaaacggaauaggcuccggcaacuacguaggcguacucuccuggaucucaccacccucccacccaucaggcucccaagucgaucuauggaaaaucccaaacuacgguuccuccaucacagaagccacccaucucgcacccuccguauacccacccggcuucggcgaaguccucgucuucuucaugagcaaaaugcccgggcccggagccuacaaccuccccugucuacuaccccaagaauacaucucccaccuagcuuccgaacaagcacccacagucggagaagccgcccuacuccacuaugucgaccccgacaccggcagaaaucucggcgaguuuaaggcauacccagacggcuuccuaacauguguccccaauggugccuccuccggaccccaacaacuacccauaaacggcgucuucgucuucgucuccugggucucacgauucuaccaacuuaaaccagucggcaccgccuccucagcccguggacgacuaggccuacgccgauaa

SEQ ID NO: 35472 - RNA, 1620 nt, Artificial Sequence
  derived and/or modified sequence opt11 from capsid_protein_VP1__Norovirus__AGT17842
augaaaauggccuccagugacgcaaaccccucagacggcuccacagccaaccucgucccagaagucaacaaugaaguaauggcccuugaacccgucgucggcgccgccauagcagcacccguugcuggacaacaaaacgucaucgaccccuggauccgcaauaacuucguccaagcccccggaggcgaguucaccgucagccccagaaacgcccccggagaaauccucugguccgcuccccuagguccagaccucaaccccuaccuaucccaucucgcccgaauguacaacggcuacgccggcggcuucgaaguccagguaauauuagcaggcaacgcauucaccgccggcaaaauaaucuucgcagccguaccacccaacuuccccacagaaggccuuucccccggccaagucaccauguucccacacaucaucgucgacguccgacaacuugaaccaguccucauaccccucccagacguccgcaacaacuucuaccacuacaaccaaucaaacgacccuaccaucaagcuagucgcaaugcucuacaccccacuacgagcaaacaaugcuggcgaugacgucuucaccguauccugcagaguccucacccgccccagccccgauuucgacuucauauuccuagucccuccuaccaucgaguccaaaaccaaaucauucuccguccccauccuuaccaucgaagaaaugaccaacucucgcuuccccaucccccuagaaaaacuauucaccggccccuccuccacacucgucguacaaccacaaaacggccgauguaccaccgacggcguccugcuaggaacaacccaacuaagcccugucaacaucugcacguuccgcggcgacgucacccaaaucacuaacacccacucauacgaaaugaaccucgcggcacaaaacuggaacuccuacgaccccaccgaggaaauccccgcaccucucggaacccccgacuucguaggcaaaauacaaggcguccucacccaaaccacaaaagaaaacggcucaacccgcgcucacaaagccacuguauacaccggauccacuggcuucacccccaaacucggccgcguacaauucguaacagacacggaccgcgaucucgaaaccaaccaagacacaaaauucacaccagucggcguaauccaagacggugacgcccaccaaaacgaaccccaacaauggguccuacccagcuaccuaggcacaaacaaccacaacguccaccuugcuccagccgucgccccuacauucccuggcgaacaacuacucuucuuccgaucaacaaugcccggauguagcggcuacccaaacaugaaccuagacugccuccucccucaagaauggguccaguacuucuaccaagaagcggccccagcccagagugacgucgccuuacuaagauucgucaaccccgacacaggccguguccuauucgaaugcaaauuacauaaauccggauacgucaccgucgcccacacaggccgacaugaccucgucaucccuccgaacggcuacuuccgauucgacuccugggucucaccauucuacacacuagcccccaugggcaacggaaccggccgccgacgagcacuuuaa

SEQ ID NO: 35473 - RNA, 1623 nt, Artificial Sequence
  derived and/or modified sequence opt11 from capsid_protein_VP1__Norovirus__AGU68328
augaaaauggccucaagcgacgcaaacccuuccgacggcucugccgcaaaccuuguacccgagguaaacaacgaagucauggcccucgaacccgucgucggcgccgccaucgccgcaccugucgcaggucaacaaaacgucaucgacccauggauucgcaacaacuucguccaagcccccggcggcgaguucacaguuagcccccgcaacgcacccggcgaaauacucugguccgcuccccucggaccugaccuaaacccauaccucucccaccucgcccgcauguacaacgguuacgccggcggauucgaaguacagguaauacucgcaggcaacgccuucgcagccggcaaaauaauuuucgccgccgucccaccaaacuucccaaccgaaggccucucaccaucccaagucaccauguucccacacaucaucguagacguccgccaacucgaacccguacuuaucccccucccagacguccgcaacaacuucuaccacuacaaccaauccaacgacucuaccaucaaacuuauagccaugcucuacacaccccuccgagcgaacaacgccggcgacgacgucuucaccgucuccugucggguacuaacacgcccgagcccugacuucgacuucauauuucucguacccccaacggucgaaucccgcaccaaacccuuuuccgucccagucuuaacaguagaagaaaugacaaacucaagauuccccaucccccucgaaaaacucuucaccgggcccuccuccgcauucgucguccagccccaaaacggacgaugcaccaccgacggcgugcuccuaggaaccacccaacucagccccgucaacaucuguacccuaagaggcgacgucacccauauaaccggaucccgcaacuacaccaugaaccuagccucccaaaacuggaacaacuacgacccaacugaagaaaucccagcaccccucggcaccccagacuucguagguaagauucaaggcaugcucacacaaaccacucgcaccgauggaucuacccgcggcuacaaggccaccgucuacaccggcuccgccgacuucgccccaaaacucggucgcguccaauucgaaacagacaccgaccacgacuucgaagccaaccaaaauaccaaauucacaccagucggagucauccaagacggauccacaacucaucgcaaugaaccccaacaaugggucuuacccuccuacucuggccguaacacccacaacguccaccuggcccccgccgucgccccgaccuucccaggcgaacaacuccuauucuuucgauccaccaugccaggcugcucuggauauccaaacauggaccucgacugccuccucccccaagaauggguacaauacuucuaccaagaagcagcccccgcccaauccgacgucgcccucuuacgcuucgucaacccagacacaggccgcguccucuucgaaugcaaacuccacaaauccggcuacguaacagucgcacacaccggacaacacgaccuagucaucccacccaacggcuauuucagauucgacuccugggucaaccaauucuacacacuugcccccaugggaaaugguacaggccgccgacgcgucgucuaa

SEQ ID NO: 35474 - RNA, 1620 nt, Artificial Sequence
  derived and/or modified sequence opt11 from capsid_protein_VP1__Norovirus__AGX85889
augaaaauggcaucuuccgacgccaacccauccgacggcuccacugccaaccucguacccgaagcaaacaacgaaguaauggcacucgaacccguagucggagcagcuauugccgccccagucgccggacaacaaaacgucaucgaccccuggaucagaaacaacuucguccaagccccugguggcgaguucacagucucgccccgaaacgcccccggcgaaauccucugguccgccccacucgguccagaccucaacccuuaccuaucccaccucucccgcauguacaacggcuacgccggcggcuuugaaguccaagucauacucgccggcaacgccuucgccgcaggaaaaaucauauucgccgccguaccacccaacuuccccacugaaggacuaucacccucccaagucaccauguucccccaccucauaguugacguacgucaacuagaacccgucaugaucccacuccccgacauccgcaacaacuucuaucacuacaaccaauccaacgaccccaccaucaaacuaauugcaaugcucuacacuccccuccgcgccaacaacgucggcgacgacguuuucacugucucuugucgcguauuaacccggcccuccccagacuucgauuucaucuuccucguaccacccaccguugaauccaaaaccaaccccuucuccguaccaauccuuaccauagaagaaaugacaaacucccgcuuccccaucccccuagaaaaacucuucaccggccccucauccgcucuagucguccaaccccagaacggacgaugcaccaccgacggcguacuccucggaacaacacaacuaucccccguuaacauaugcacguuccgcggcgacgucacccacacaaccaaaacucacaccuaccaaaugaaccuagccgcccaaaacuggaacuccuacgaccccaccgaagaaaucccagcacccuuaggcacccccgauuucgucggcaaaauucaaggcguccuuacccaaacaacuaaaggcaauggauccacacgcgcccacaaagccaccguauacaccggcucugccgaguucaccccuaaacuaggacguauucaacuauucaccgacacagacaacgaccuugaagccaaccaaaacacaaaauucacaccuguuggagucauccaagacggcgacacccaccaaaacgaaccccaacaauggguccuaccaucauauagcggcagaaacaaucacaacguccaccucgcacccgccguagccccaacauucccuggagaacaacuccuauucuuccgcuccaccaugccgggaugcuccggcuaccccaacaugaaccuagacugccuccucccccaagaauggguccaauacuucuaccaagaagccgcccccgcacaaagcgacgucgcacugcuacgcuuugucaacccagacacaggacgaguucucuucgaaugcaagcuccacaaauccggcuacgucaccgucgcacacaccggacaccacgacuuauucauuccacccaacggcuacuuucgcuucgacuccugggucucacccuucuacacacuagcccccaugggcaacggaaccggccgccgacgcgcccucuaa

SEQ ID NO: 35475 - RNA, 1620 nt, Artificial Sequence
  derived and/or modified sequence opt11 from capsid_protein_VP1__Norovirus__AGX85892
augaaaauggcaucgucagacgccaacccauccgacggcuccacugccaaccuagucccggaagcaaacaacgaaguaauggcccuggaacccguaguuggugccgcuauagccgcacccgucgccggccaacaaaacgucauagaucccuggauacgaaauaacuucguccaagccccaggcggggaauuuacugucucaccccgaaacgcccccggcgaaguccuaugguccgccccucucggcccggaccuaaaccccuaccuuucccaccuagcacgaauguacaacggcuacgccggcggguucgaaguacaagucauccucgccggcaacgcauucgcagcugguaaaauaauauucgcagccguaccucccaacuucccaaccgaaggacucuccccaucacaagucaccauguucccccaccucaucgucgacguccgacaacucgaaccugucaugaucccacuccccgacauccgcaauaacuucuaccacuacaaccaauccaacgaccccaccaucaagcuaauagccaugcuuuacacaccccuacgcgccaacaacguaggagacgacgucuucacaguuuccugucgaguacucacccgacccucucccgacuucgacuucauuuuccucguaccacccaccgucgaaucgaaaacaaaucccuucucaguacccauccucaccauagaagaaaugaccaacuccagauuccccauaccccucgaaaaacucuucaccggccccuccucagcccuagucguccaaccccaaaacggccgaugcacaaccgauggcguccuacuaggaacgacccaacucucgccagucaacauaugcacauuccgcggcgacgucacccacacaaccaaaacacacaccuaucaaaugaaccuagccgcacaaaacuggaacuccuacgacccuacagaagaaauccccgcaccccuaggcacacccgacuucguaggaaaaauccaaggcguccuaacgcaaaccacaaaaggcaacggcucaacacgcgcccacaaagccacagucuacaccggcggcguugaguucacccccaaacucggccguauacaacucuucaccgacacagacaacgaccuugaagccaaccagaacaccaaauucacccccguuggcguuauacaagacggagacacccaccaaaaugaaccgcaacaauggguacucccauccuacuccggccgcaacaaccacaacguacaccucgccccugcagucgcuccaacauuccccggagaacaauuacuuuucuuccgaucgacaaugccaggcugcucaggcuacccaaacaugaaccucgacugccuacuaccccaagaauggguucaauacuucuaccaagaagcugccccugcucaauccgacgucgcccuccuccgauucgucaaccccgauaccggccgaguccucuucgagugcaaacuacacaaaucaggauacguaaccguagcccacacuggccaccacgaccucuucaucccaccaaacggauacuuccgcuucgacucaugggucucccccuuuuacacccucgccccaaugggcaacggaacaggacgacgcagagcacuauaa

SEQ ID NO: 35476 - RNA, 1620 nt, Artificial Sequence
  derived and/or modified sequence opt11 from capsid_protein_VP1__Norovirus__AGX85895
augaagauggccuccuccgaugccaaccccagcgacggcucaacagcaaaccucguccccgaagccaacaacgaagucauggcccucgaaccugucguuggcgccgcuaucgcagcacccgucgccggccaacaaaacgucaucgaccccuggauacgcaacaacuucguacaagccccaggaggcgaguucacagugucccccagaaacgcacccggcgaaguccucugguccgcuccccuaggccccgaccuaaaccccuaccucucccaccucgccagaauguacaacggauacgccggcggcuucgaaguacaggucauccucgccggaaacgccuucgcagcuggcaaaaucaucuucgccgcaguacccccaaauuuccccaccgaaggacuuagcccaucccaagucaccauguuuccacaccuaaucaucgacgucagacaacucgaacccgucaugauaccacuuccagacguccgcaacaacuucuaccacuacaaucaaagcaacgacccaaccauaaaacucaucgccaugcucuauacaccccuacgagccaacaacgucggcgacgauguauucaccgucuccugccgcguacuuacccgacccuccccagacuucgacuucauauuccuaguacccccaaccgucgaaucaaaaaccaacccauucucagucccaauccucacaauagaagaaaugacgaacucccgcuucccaauaccccuagaaaaacucuucaccggccccucuuccgcccucgucguacaaccccagaacggccgcuguaccaccgacggcguccucuuaggaacaacccaauuaucgccagucaacaucugcacauuccgcggcgacgucacccacauuaccaaaacccacucauaccaaaugaaccucgccgcucaaaacuggaacuccuacgaccccacagaagaaaucccugcaccccuagguacccccgacuuuguaggcaaaauccaaggaguacuaacacaaacaaccaaaggcaacggcucuacacgugcccacaaagcaacagucuacaccggaucaaccgaguucacccccaaacucggucgcauccaacucgucaccgacaccgauaacgaccuagaaaccaaccaaaacaccaaauucaccccagucggagucauccaagacggcgacacccaucaaaacgaaccccaacaauggguacucccaucuuaccucggccggaauaaccauaacguacaccuggccccagcagucgcaccaacguucccaggcgaacaacuacuauucuuccgcagcacuaugccuggaugcuccggcuaccccaacaugaaccuagacugccugcuaccccaagaauggguccaauacuucuaucaggaagccgcccccgcccaaucagacguugcccuccugcgcuucgucaaccccgacaccggacgcguccucuucgaaugcaagcuccauaaaucagguuacgucacagucgcccacaccggccaccacgaccucuucauacccccaaacggcuacuuccgcuucgacagcuggguaucccccuucuacacccuagccccaaugggcaacggcaccggucgaagacgagcacuauaa

SEQ ID NO: 35477 - RNA, 1623 nt, Artificial Sequence
  derived and/or modified sequence opt11 from capsid_protein_VP1__Norovirus__AGX85904
augaaaauggcauccuccgacgccaaccccucagacggcucugccgcaaaccucguccccgaagucaacaacgaagucauggcccucgaaccaguugucggagccgcaauugccgcccccgucgccggccaacaaaaugucauagaccccuggauccgcagcaauuucguccaagcccccggaggagaguucacaguuucaccccgcaacgcccccggcgaaauacucugguccgccccgcucggucccgacuuaaaucccuacuuaucucaccucgcccguauguacaacggcuacgccggcggauucgaaguacaagucauccucgccggcaacgcauuuaccgccggcaagaucaucuucgcugccguacccccaaacuuccccaccgaaggacucuccccaucucaagucaccauguucccccacauaaucguagacgucagacaacucgaaccaguacucaucccccuaccugacguccgcaacaacuucuaccacuacaaucagucaaacgacuccaccaucaaacucauagccaugcucuacacaccccuccgcgcuaacaacgccggcgacgacgucuucacuguauccugucgcguacucacccgcccuagccccgacuucgacuucaucuuucuagucccaccaaccguggaaucccgcacaaaacccuucaccguacccauccucaccgucgaagaaaugacgaacucacgauuccccaucccacuugaaaaacuauuuacaggcccaucauccgccuucgucguccaaccacaaaacggccgcugcaccacagacggcguccuacuaggcaccacucaacuaagcccugucaacaucugcaccuuccgcggugacgucacgcacaucgccggcagccgcaauuauaccaugaaccuagcaucccucaauuggucuaacuaugaccccaccgaagaaauccccgccccacucggcaccccagacuucgucggaaaaauacaaggaguccucacccaaaccaccaaaggcgacggauccacccguggccacaaagccaccgucuacacuggcucagccgauuucacacccaaacucggcucuauccaauuugcuaccgacaccgaaaacgacuucgaaacccaccaaaauacaagauucacacccguuggcguuauccaggacggaggcacuacccaccggaaugaaccccaacaauggguccuucccuccuacuccggccgaaacguccauaacguccaccucgcccccgccguagcccccaacuuccccggcgaacaacuauuauucuuccgcuccacgaugcccggcugcagcggauaccccaacauggaccuagacugccuccucccccaagaauggguacaacacuucuaccaagaagccgcucccgcacaauccgacgucgcccuccuccgauucgucaacccagacaccggaagaguucucuucgaaugcaaacuccacaaaucuggcuacgucacaguugcccacacaggccaacaugaccucgucauaccacccaauggcuacuuccgcuucgacucuugggucaaccaauuuuacacacucgcccccaugggcaacggcacaggacgccgccgugcccuauaa

SEQ ID NO: 35478 - RNA, 1617 nt, Artificial Sequence
  derived and/or modified sequence opt11 from capsid_protein_VP1__Norovirus__AGX85913
augaaaauggccucaucugacgccaaccccuccgacggaucaaccgcaaaucucguccccgaagccaacaacgaaguuauggcccuagaacccguagucggagccgcaaucgcagcacccguagccggccaacaaaacgucauagaccccuggauacgaaacaauuucguacaagcacccggaggcgaguucacaguuaguccccgcaacgcccccggcgaaguccuaugguccgccccacucggccccgaccugaaccccuaccuuucccacuuagcacgcauguacaacggauacgcuggcggauucgaaguccaagucauccucgcaggcaaugccuucgcagcaggaaaaaucauauucgcagcuguucccccaaacuucuccaccgaaggccuaucccccucucaaguaaccauguucccccaccucauagucgacguccgccaacucgaacccgucaugaucccacucccagacauccgcaauaacuucuaccacuacaaccaaagcaacgauccaaccaucaaacuaaucgccaugcuauauaccccacuccgcgccaacaacgucggggacgacgucuucaccgucucgugccgcguucuaacucgccccuccccagacuucgacuucauauuccuaguacccccaacagucgaauccaaaaccaacccauucuccguacccauacuuaccaucgaagaaaugaccaacucccgcuuccccaucccccuugaaaagcuauuuacaggaccaagcuccgcccuggucguacaaccccaaaacggccgcugcaccaccgacggaguauugcucggcaccacacagcucucacccgucaacaucugcacauucagaggcgacgucacacacacaaccaaaacccacaccuaucaaaugaaccucgcagcccaaaacuggaacucauacgacccaacagaagaaauccccgccccacuaggaacacccgacuucgucggcaaaauucaaggcguccucacccaaacaacuaaggaaaacggcuccacaagagcccacaaagccaccgucuauaccggaaccguagaauuuaccccuaaacucggccgaauccaacucuuuaccgacaccgacaaugaccucgaagcaaaccaaaacaccaaauucacacccgucggcgucauacaagacggagaccaccaaaacgagccccaacaguggguccuccccucauacuccggccgaaacaaucacaacguccaccucgcccccgcagucgcccccaccuucccaggcgaacaacuacucuucuucagaucaaccaugccaggcugcuccggauacccaaacaugaaccuugacugccuccucccccaagaauggguccaauacuucuaccaagaagccgcgcccgcccaauccgacgucgcacuccugcguuucgucaacccagacaccggcagaguccuauucgaauguaaacuacacaaauccggauacgucacagucgcccacacaggccaucacgaccuaguuaucccacccaacggauauuuucgcuucgacaguugggucagccccuucuacacucuugccccaaugggaaacggcacaggccgcagacgcgcccucuaa

SEQ ID NO: 35479 - RNA, 1623 nt, Artificial Sequence
  derived and/or modified sequence opt11 from capsid_protein_VP1__Norovirus__AGX85916
augaaaauggccucaaacgacgccaacccaucugacggaucagccgcaaaccuuguaccggaagucaacaacgaggucauggcccuugaacccgucgucggcgccgcaauugccgcccccgucgccggccaacaaaacguaaucgaccccuggauacgcaacaacuucguacaagcucccgguggagaguucacaguuagcccccgaaacgccccaggagaaauccucugguccgcaccgcucggccccgaccucaacccauaccucucacaccucgcccgcauguacaacggauacgcaggcggcuucgaaguccaaguaauacuugcaggcaacgcuuuuaccgccggcaaaaucaucuucgcagccgugccacccaacuuccccacagaaggccucucccccucacaaguaaccauguucccccacauaaucgucgauguucgucaacucgaaccuguccuaaucccacuccccgauguccgcaacaacuucuaccacuacaaccaauccaacgacuccacaaucaaacuaaucgcaaugcuauacacaccccuaagggccaacaacgcuggugacgacgucuucacagucagcugcagaguccucacccgacccuccccagacuucgacuucaucuuccucgucccacccaccguagaaucccgaacuaagcccuucuccguccccauccuaaccguagaagaaaugacaaacucccgcuuccccaucccucuagaaaaacuguucaccggcccuagcuccaccuucgucguacaaccccagaacggacgcugcaccaccgacggcguccuccucggaaccacccaauuauccccugucaacaucugcaccuuccgcggagacguuacccauaucacuggcucaagaaacuacaccaugaaccuagccucccaaaacuggaacucauacgaccccacagaagaaauccccgcaccccucggcacacccgacuucgucggaaaaauccaaggaguccucacccaaaccacccgaacugacggcagcacccgaggacacaaagcaaccgucuacaccgguucagccgacuucucuccuaaauuaggucgaguacaauucgcaacggacaccgacaacgacuucgacacuaaccaaaacaccaaauucaccccagucggcgucauccaagacggaggaaccacacaccgcaacgaaccacaacagugggugcuacccuccuacuccggccgcaauacccacaauguucaccuugccccagccgucgccccuaccuucccaggcgaacaacuccuguucuuccgaagcacuaugcccggcaguuccggcuaccccaacauggaucucgacugucugcuaccccaagaauggguccaauacuuuuaucaagaagcagcaccagcucaauccgacgucgcacuccuuagauucgucaacccagacacuggacgcguccuauucgaaugcaaacuacacaaauccggcuacgucaccguagcacacaccggacaacacgaccuaguaauaccaccaaacggcuacuuccgcuucgacucuuggguaaaucaauucuacacacuugccccgaugggcaacggcaccggccgccgccgcgccgucuaa

SEQ ID NO: 35480 - RNA, 1617 nt, Artificial Sequence
  derived and/or modified sequence opt11 from capsid_protein_VP1__Norovirus__AGX85931
augaagauggcauccucagacgccaaucccuccgacggguccaccgccaaccucguacccgaagccaauaacgaagucauggcccucgaaccugucguaggugcagccaucgcagcccccguagccggccaacaaaacgucaucgaccccuggauccgcaacaacuucguccaagcaccaggaggcgaguucaccgucucaccccgaaacgcccccggcgaaguccucugguccgccccacucggucccgaccuaaacccauaccucucccaccuagcccgcauguacaacggauacgccggcggcuucgaaguccaagucauccucgccggcaacgccuucgcagcagguaaaauaauuuucgcagccguaccacccaacuucuccaccgaaggccucucccccucccaagucaccauguucccccaccucauugucgacguacgacaacucgaacccgucaugaucccccuccccgacauucgaaauaacuucuaccauuacaaccaaucaaacgacccaaccaucaaacucaucgcaaugcucuauaccccacuccgugcaaacaacgucggcgaugaugucuucacaguauccugccgaguccucacccgaccaucacccgauuucgacuucauauucuuagucccaccaacaguagaaucaaaaacaaaccccuucuccguacccauacucaccaucgaagaaaugaccaacuccagauuccccauuccacucgaaaaacucuucaccggccccagcucugcccuaguuguccaaccacagaacggacgcugcacaacugacggcguacuccuuggcaccacccaacuaagcccggucaauauaugcacauuccgaggcgacguaacacacaccacaaagacacacaccuaccaaaugaaccucgccgcucaaaacuggaacucuuacgaccccaccgaagaaauccccgcaccccucggcacacccgacuucgucggcaaaauccaaggcguccuuacccaaacaaccaaagaaaacggauccacccgagcccacaaagccaccgucuacaccggcacagucgaguucacccccaaacucggccgcauacaacuauucacagacaccgauaacgaccucgaagcaaaccaaaacaccaaauucacccccguaggcguaauacaagacggagaccaccaaaacgaaccacaacaauggguccuaccauccuacuccggccgcaauaaccacaacguacacuuagccccagccgucgccccuacauucccuggagaacaacuccucuucuucagaucaaccaugccaggcugcuccggcuaccccaacaugaaccuagacugccuucucccucaggaauggguccaauacuucuaccaagaagcagcuccggcacagucagacguagcccuccuccgauucguaaaccccgacaccggccgaguacucuucgagugcaaacuacauaaaucaggcuacgucacuguagcccacacuggccaccacgaccucguaaucccaccaaacggauauuuccgauucgacuccuggguaagcccauucuacacccucgccccaaugggaaacggcaccggccgaaggcgcgcccucuag

SEQ ID NO: 35481 - RNA, 1617 nt, Artificial Sequence
  derived and/or modified sequence opt11 from capsid_protein_VP1__Norovirus__AGX85934
augaaaauggcauccucugacgccaaccccuccgacggcuccaccgccaaccuaguacccgaagccaacaacgaagucauggcgcucgaacccgucgucggagccgcaaucgccgcccccgucgccggacaacaaaacgucaucgaccccuggauccggaacaacuucguacaagccccuggcggcgaguucaccgucucaccccgcaacgcccccggcgaaguccuaugguccgcaccucucggccccgaccuaaacccauaccuaucucaccucgcacgcauguacaacggcuaugccggcggcuuugaaguccaagugauccucgccggaaacgcauucgccgcaggaaaaaucaucuuugcagccgucccacccaacuucuccacagaaggccucucucccagccaagucaccauguucccccaccuuaucgucgacguccgccaacuggaacccguaaugauaccccuuccagacauccgaaacaacuucuaccacuacaaccaguccaacgaccccaccaucaaacucauagcaaugcuauacacaccccuuagagcaaacaacgucggcgacgacguauucaccgucuccugccgcguccucacccgaccaucuccugacuuugacuucaucuuccuagucccacccaccgucgaauccaaaacgaacccauuuuccguccccauauuaaccaucgaagaaaugaccaacucccgcuucccgaucccucucgaaaaacucuucacaggccccagcuccgcucucgucguccaaccccagaauggccgcugcacuacagacggcguccuacucggcaccacccaacucucccccguuaacauaugcaccuuccgcggagacgucacccacaccaccaaaacccacaccuaccaaaugaaccucgccgcucagaacuggaacuccuacgacccaaccgaagaaauccccgcaccccucggcacacccgacuucgucgguaaaauacaaggcguccucacucaaaccaccaaaggcaacggauccaccagagcacacaaagccaccgucuacacgggcaccgucgaguucacaccgaaacucggacgcauccaacuauuuacugauacugacaacgaccuugaagcaaaccaaaacacuaaauucacccccgucggagucauacaagauggagaccaccaaaacgaaccccaacaauggguccuccccaguuacucaggaagaaauaaccacaacguacaccuagcacccgccgucgcaccaaccuucccaggagaacaacuccuauucuucaggucaaccaugccuggcugcucugguuacccaaacaugaaccuagacugccuccuaccacaagaauggguccaauacuucuaccaagaagcagcacccgcccaaucagacgucgcucuccuucgcuucgucaaccccgacacgggacguguccucuucgaaugcaaacuacauaaauccgguuacguaaccgucgcacacaccggacaccacgaccuagucaucccacccaacggcuacuuccgcuucgacagcugggucucucccuucuacacucuagcccccaugggcaacggaacaggccgacgccgcgcccucuaa

SEQ ID NO: 35482 - RNA, 1644 nt, Artificial Sequence
  derived and/or modified sequence opt11 from capsid_protein_VP1__Norovirus__AHI59154
augaaaauggcauccaacgacgccgcccccagcaacgacggagcagcaaaccucgucccagaagcaaacaacgaagucauggccuuagaacccgugguuggcgccuccaucgcugcccccguaguaggccaacaaaacaucauagaccccuggauacgagagaacuucguccaagcaccccaaggcgaguucaccgucagcccccgcaacagccccggagaaauguuacucaaccucgaacucggacccgaacucaacccauaccucucccaccuuucacgcauguacaacggcuacgccggcgguaugcaaguucaagucguacuugccggaaacgccuucaccgcugguaaaauaauauucgcagccguaccaccccacuucccagucgaaaacaucuccgccgcccagaucacaauguguccccacgucaucgucgauguacgccaacucgaacccguacuacuaccccuccccgacauucggaaccgcuucuuccacuacaaccaagaaaacacgccccgaaugcgacucgucgcgaugcucuacaccccucuccgcgccaacucuggcgaagacgucuucaccgucucaugccgcguccucaccagacccgcccccgacuucgaauuuaccuuccucgucccacccaccgucgaaucaaaaacaaaacccuucacccuccccauccuaacacucggcgaacuauccaacagcagauuccccgcacccaucgacaugcuauacacagaccccaacgaagguauaguaguccaaccccaaaacggccgaugcacccucgacgguacccuacaaggcaccacgcaacucguccccacucaaaucugcgcuuuccgcggcacccuaaucggccaaacuucacgcucauccgacucuaccgacucagcaccccgccgucgagaccacccccuacacguccaacucaaaaaccuugacgguacccaauacgaccccaccgacgagguaccggccguacucggcgccaucgacuucaaaggaaccgucuucgguguggccagccagagagacguaucgggccaacaagucggcgccacaagagcacacgaaguccacauaaacacaaccgacccacgguacacccccaaacucggauccauccucaugcacuccgaaucagacgacuucgucaccggacaaccaguccgcuucaccccaaucggcaugggcgauaacgacuggcaccaaugggaacucccugacuacucuggccaccucacccuuaacaugaaccucgcaccagcagucgcccccgccuucccaggcgaacgcauccucuucuuucgauccaugguaccaagcgcaggcgguuacggcaguggccaaaucgacugccucaugccccaagaauggguccaacacuuuuaccaagaagcagcccccagccagucagccgucgcacucauccgcuacguuaaccccgacaccggacgcaacaucuucgaagcaaaacuacacagagaaggcuucauaaccgucgcaaacucaggaaacaacccaaucgucguucccccgaacggauacuuccgauucgaagcgugggucaaccaauuuuacacacucaccccuaugggcacaggacaagggagacggcgaaaccaauaa

SEQ ID NO: 35483 - RNA, 1623 nt, Artificial Sequence
  derived and/or modified sequence opt11 from capsid_protein_VP1__Norovirus__AHI59157
augaaaauggcguccaaugacgccaaccccucagauggcucuaccgccaaccuaguacccgaagucaacaacgaagucauggcgcucgaacccgucgugggcgccgcaaucgcagccccaguagcuggucaacaaaacgucaucgaucccuggauccggaacaacuuuguacaagcccccggcggagaauuuaccguaucaccccgcaacgccccaggcgaaauccuuugguccgcuccccucggcccagaccuuaaccccuaccucucacaccucgccagaauguacaacggauacgccggaggcuucgaaguccaaguaauucuugccggcaacgccuucacagccggcaaaaucaucuucgccgccgucccacccaacuucccaaccgaaggccucuccccgucccaaguaacaauguucccucauauuaucgucgacguccgccaacucgaacccguucuaauaccccuccccgacguacgaaacaacuucuaccacuacaaccaaagcaaugaccccaccauaaaacucauugccaugcucuacacaccacuccgagcaaauaacgcaggagacgacgucuuuaccgucuccugccgcguccuuacccgaccuagccccgauuucgauuucaucuuccucguucccccgacagucgaaucucgcaccaaaccuuucuccgucccaguacuaaccguagaagaaaugaccaacucacgcuuccccauuccccuagaaaaacucuucaccggacccagcucugccuucgucguacaaccacaaaacgggcgcugcacaaccgacggcguucuacucggaacuacacaacucuccccugucaauaucugcacauuccgcggcgacgucacccacaucaccggcucaagaaauuacaccaugaaccucgccucccaaaacuggaacucauacgaccccacggaagaaaucccugcaccacucggcacccccgauuucgucggaaaaauacaaggcguccuaacacaaaccacccgaacagacggauccacaagaggacacaaagcuaccgucuacaccggcuccgcagauuucucccccaaauuaggacgcguccaauucgccaccgacacagacaacgacuucgaaaccaaccaaaacacuaaauucaccccugucggaguaauccaagacgguggaaccacacaccgcaacgaaccacaacaauggguucuacccucauacucagguagaaauacacauaacgugcaccucgcaccagccguagcacccacguuccccggagaacaacuccuauucuuccgcucaaccaugccagguugcuccggauaccccaauauggaccucgacugccuccucccccaagaauggguccaauacuucuaccaagaagcagcccccgcccaaagcgaugucgcccuccuccgcuucgucaaccccgacacaggccgaguccucuucgaaugcaaacuccacaaauccggauacguaaccgucgcccacacaggccaacaugaccucguaaucccacccaacggauacuuucguuucgacuccugggucaaucaauucuacacacucgcaccaaugggcaacggcaccggccgccgccgugcccucuaa

SEQ ID NO: 35484 - RNA, 1629 nt, Artificial Sequence
  derived and/or modified sequence opt11 from capsid_protein_VP1__Norovirus__AHI59159
augaaaauggcuuccaacgaugccgcucccucaaccgacggcgcagccggccuaguccccgaguccaacucagaagucauggcccucgaaccugucgccggcgccgcccuagccgcccccguuacaggccaaacaaacaucaucgacccauggauccgcgccaacuucguacaggcccccaacggcgaguucaccgucucaccccgaaacgccccuggcgaaguacuccuuaaccucgaacucggccccgaacucaacccauaccuagcccaccuagcccgaauguacaacggcuacgccggcggaauggaaguccaagucaugcucgccggcaacgccuuuacagccggaaagcucguauucgccgccgugcccccacacuuccccgucgaaaaccuaucgccacaacaaauaacaauguucccccacgucaucaucgacgugagaacacuagaacccguccuucucccccucccagacguacgcaacaacuucuuccacuacaaccaaaaagacgaccccaaaaugcgcaucgucgccaugcucuacacaccauuacgaagcaacggcucgggggacgacguauucaccguaucaugccgaguacucacucgccccucccccgacuucgacuuuaccuaccuaguacccccaaccgucgaaucuaaaacaaagcccuucacacuaccuauacucacccucggcgaacucaguaacucacgcuuccccgucucuauagaccaaauguacaccucccccaacgaggucauaagcguccaaugccaaaacggccgcugcacucucgacggcgaacuccaaggcaccacccaacuacaaguaucuggaaucugcgccuucaaaggcgaagucacagcccaucuccacgauaacgaucaccucuacaacgucaccaucaccaacuuaaacggcuccccauucgacccaucugaagacgucccagcaccccuaggaguccccgacuuccaaggacgcguuuucggcguaaucagccaaagagacaaacacaacucccccggccacaacgaacccgcaaaccgcggccacgacgccgucguucccaccuacacagcccaauacacccccaaacucggacaaguacaaaucggaacguggcaaaccgacgaccucacagucaaucaacccgucaaauucaccccagucggucucaacgacacagaacauuuuaaccaaugggucguccccagauacgccggagcccucaaccucaacaccaaccuagcacccuccgucgcacccgucuuccccggagaacgccuacuauucuuccgcuccuacguaccccucaaaggaggcuacggcaaccccgccauugacugccuccucccccaagaauggguccaacacuucuaucaagaagcagccccauccaugucugaaguugcccuagugcguuacaucaaccccgacacaggccgcgcucucuucgaagccaaacuccaccgcgcaggcuucaugaccgucuccucaaauaccuccgcacccguggucgucccagccaacggcuacuucagauucgacuccuggguaaaucaauucuacucacuagcucccaugggaaccggcaacggccgcagacggguccaauaa

SEQ ID NO: 35485 - RNA, 1623 nt, Artificial Sequence
  derived and/or modified sequence opt11 from capsid_protein_VP1__Norovirus__AHK24788
augcggaugucagacggcgccgcacccaaagcuaacggcucagaagccuccggacaagaccucguccccaccgccgucgaacaagcagucccaauccaacccgucgccggcgccucucucgccgcccccgcugccggacaaaucaaccaaauagaccccuggauauuccaaaacuucguccaguguccucuaggcgaauucucuaucuccccccgaaacacaccgggcgaaauccucuucgaccucgcacucggcccuggccuaaaccccuaccucgcucaucuuagcgccauguacacaggcuggguaggcaacauggaaguccaacuuguacucgccggaaacgccuucaccgcaggcaagguugucgucgcacuagucccccccuacuuccccaaaggcucacuaacggcagcacaaauaacauguuucccccauguaaugugugacguacgcacccucgaaccaauccagcucccccuacucgacguucgacgcguucucuggcacgcaacccaagaccaagaagaaagcaugcgccuuguaugcaugcucuacaccccuuugcgcaccaacuccccuggagacgaaucauucgucgucucaggccgacuacucuccaaacccgccgccgacuucaacuucgucuaccucacccccccuauagaacgcacaaucuaccgaauggucgaccucccuguacuacagccacgccucugcacccacgcccgguggcccgccccaguauacggucuccucgucgacccaucauuacccuccaauccacaauggcagaauggacgcguccacgucgacggaacgcuccuuggcaccacccccgucagcggcuccugggucuccugcuucgcagcagaagcugccuaugaauuccagucaggcacaggcgaagucgccacauucacccucaucgaacaagacggcuccgccuacgucccaggcgaccgcgcugccccacucggauaccccgacuuuagcggccaacucgaaaucgaaguccagaccgaaaccaccaaagccggcgacaaacuaaaagucaccaccuucgaaaugauccucggaccaacgacaaacgucgaccaagccccauaccaaggcagaguuuacgcaucccucacugcagcagccucccucgaccucgucgacggucgaguccgcgccgucccacgauccaucuauggauuccaagaccaaauacccgaauacaacgacggccuacucguaccccucgccccucccgucggcccauuccuacccggagaacucuuacuucgcuuccgcacauacaugcgacaaaucgacuccgccgacgccgccgccgaagccaucgacugcgcccuaccccaagaauucauauccugguucgcaucaaacgccuucaccguacaaagcgaagcauuacuccuaagauaccgcaauacccugaccggccaacuccucuucgaauguaaacucuacuccgaaggcuauaucgcccucagcuacucaggcucaggcccacucacauucccaaccgacggauucuucgaggucguuucaugggugccacgucucuaccaacucgccucaguaggcucacucgccaccggacgcaccuuaaaauaa

SEQ ID NO: 35486 - RNA, 1623 nt, Artificial Sequence
  derived and/or modified sequence opt11 from capsid_protein_VP1__Norovirus__AHX22018
augaaaauggcuuccuccgacgcaaaucccucagacggcuccgccgccaacuuagucccugaagucaauaacgaagucauggcacuagaacccguagucggugcagcaaucgccgccccaguagccggccaacaaaacgucaucgaccccuggauccgcaacaacuucguccaagccccggguggcgaguucacaguaucaccccgcaacgcgccuggcgaaauccucugguccgccccucucggccccgaccucaacccauaccucucccaccucgccagaauguacaauggcuacgcugguggauucgaaguacaaguaauccucgccggaaaugccuucaccgcaggaaaagucaucuucgcugccgucccgccuaacuuccccaccgaaggccucucacccucccaagucaccauguucccccacaucguugucgacguacgacaacucgaacccguucucauaccccuaccagacguccgcaacaacuucuaccacuacaaccaaucgaacgacccaaccaucaagcuaaucgcgaugcucuacaccccacuacgcgccaacaacgccggcgacgauguuuucaccgucucuugccguguucuuacacgccccagcccugacuucgacuucauauuccucguaccaccaaccguagaaucccgcaccaaacccuucuccguaccaguccucacagucgaagaaaugacaaacucacgcuuccccauaccccucgaaaaacucuucaccggcccgagcggugcauucgucguccaaccccaaaacggccgaugcacaaccgacggugucuuacucggcaccacccaacuaucccccgucaauaucuguaccuuucgcggagacgucacccacaucaccggcucgcguaacuacaccaugaaccucgcaagccaaaacuggaacaacuacgaccccaccgaagaaauccccgcuccccucggcacacccgacuucgucggcaaaauccaaggcaugcuaacccaaaccacccgaaccgacggcuccacacgaggccauaaggccacaguauauaccggauccgccgacuuugcccccaaacucggccgcguucaauucgaaaccgacacagaccacgacuucgaagcaaaccaaaacacaaaauucaccccggucggagucauacaagacggauccaccacccaccgcaacgaaccgcaacaauggguucucccauccuacuccggccgaaacacccacaacguccaccuagcccccgcagucgcccccacuuuucccggcgaacaacuccuuuucuuccgcuccacaaugccaggcugcucaggcuaccccaauauggaccuagacugccuccuuccccaagaauggguucaauacuucuaccaagaagccgcccccgcccaauccgacguagcccucuuacgauucguaaacccugacaccggccguguccuauucgaaugcaaacuccacaaaucaggcuaugucaccguugcacacaccggccaacacgaccucgucaucccacccaacggauacuucagauucgacagcugggucaaccaauucuacacccucgcacccaugggaaacggcaccggcagacgccgcguggucuga

SEQ ID NO: 35487 - RNA, 1623 nt, Artificial Sequence
  derived and/or modified sequence opt11 from capsid_protein_VP1__Norovirus__AHX22021
augaaaauggccagcucagacgccaaccccucagacggcuccaccgccaaccucguccccgaagucaacaacgaagucauggcccucgaaccugucguuggcgcagcaaucgcagcacccgucgcaggccaacaaaacgucauagaccccuggauccgcaacaacuucguccaagccccaggcggagaguucaccgucucaccccgaaacgcccccggcgaaauacucugguccgccccacucggcccagaccuuaacccuuaccucucccaucucgccagaauguacaacggauacgcaggcggauucgaaguucagguaauacucgcaggaaaugccuuuaccgccggcaaaaucaucuucgccgccgucccacccaacuuccccacagaaggccuaucccccucacaaguaacuauguucccucacauaaucgucgacguacgccaacuagaaccaguccucaucccgcuccccgacguacgcaacaacuucuaccacuacaaccaauccaacgaccccaccaucaaacucauagccaugcucuacaccccacugcgcgcuaacaacgccggcgacgacguuuucacagucuccugcagaguccuaacccgccccucccccgauuucgauuucaucuuccuagucccaccaaccguagaaucccgcacaaaaccauucuccguccccguacucacagucgaagaaaugacuaacucacgauucccaaucccccuugaaaaacucuucaccggccccuccagcgccuucgucguccaaccccaaaacggaaggugcaccacugacgggguccugcuaggcaccacccaacuaucuccaguaaacaucugcaccuuccgcggcgacgucacucacaucucaggaucccgcaacuacacuaugaaccucgccucccaaaacuggaacuccuacgaccccacugaagaaauccccgcuccccucggaacacccgacuuugucggcaaaauucaaggcguccucacacagaccacacgcacagacggauccaccagagggcacaaagccaccguauacacaggcuccgccgacuucucucccaaacugggacgcguacaauucacaacagacaccgauaacgacuucgucacaaaccaaaacacaaaauucacaccagucggcgucauccaagacgguucaacgacaccccguaacgaaccccagcaauggguccuccccagcuacucaggccgcaacacccacaacguacaccucgcccccgccguagcaccuaccuucccaggcgaacaacuacuauucuuccgauccaccaugcccggcugcuccggcuaucccaacauggaccuagacugccuccucccccaagaauggguucaauacuucuaccaagaagccgcacccgcacaaucggacgucgcauuacuccgcuucguuaacccagacaccggccgcguccuauucgaaugcaaacuccacaaauccggauauguuaccguagcccacacaggacaacacgaccuuguaaucccacccaacggcuauuuccgcuucgacagcuggguaaaucaauucuacacgcucgccccuaugggcaacggcacagggcgccgacgagcacuauaa

SEQ ID NO: 35488 - RNA, 1623 nt, Artificial Sequence
  derived and/or modified sequence opt11 from capsid_protein_VP1__Norovirus__AHX22025
augaaaauggcaagcuccgaugcaaaccccuccgacggauccacagcuaaccucgucccagaaguaaacaacgaagucauggcgcucgaaccagucgucggagccgcaaucgccgcccccgucgccggccaacaaaacgucaucgacccuuggauccgaaacaacuucguacaagcccccggaggcgaguucacaguaucuccccgcaaugcaccaggcgaaauccugugguccgccccacuaggacccgaccucaaucccuaucuaucacaccucgcaagaauguacaacggauacgcaggcggauucgaaguccagacaauccuagccggaaaugccuucaccgccggaaaaaucaucuucgcugccguaccacccaacuuucccaccgaaggccucuccccaucacaagucaccauguucccacacaucaucgucgacguacgccaacuagaacccguccucauaccccuuccagacguccgcaacaacuucuaccacuacaaccaaacuaacgaccccaccaucaaacucaucgcuaugcuauacaccccgcuccgagcaaacaacgccggugaugacgucuuuacuguaagcugccgaguccuaacacgcccaucacccgacuucgacuucauauuccucgucccacccacaguagaaucccgcacaaaacccuucuccguccccguccuaacagucgaagagaugaccaacucacguuuccccaucccccuagaaaaacuauucacaggccccuccagcgcguucgucguccaaccacaaaacggccgaugcaccaccgacggcguccuacucgguacaacucaacucucacccgucaauauaugcaccuuccgaggcgacgucacccacaucuccgguucccgaaacuacacuaugaaccucgcgagccaaaacuggaacucauacgaccccaccgaagaaauuccagcaccccucggaacacccgacuuuguaggcaaaauccaaggaguccuaacccaaaccaccagaacagacggauccacacgcggacacaaagcaaccgucuauaccggcuccgccgacuuuucacccaaacucgggcgaguccaauucgcuacugauaccgacaacgacuucgaaaccaaccaaaacaccaaauucacccccgucggcguaauccaagacggcgguacuacccacagaaacgaaccgcaacaauggguacuacccuccuacuccggacgcaacacccauaacguacaccucgcacccgccguagccccuaccuuccccggcgaacaacuccuauucuuucguuccaccaugccaggauguucaggcuacccgaacauggaccucgacugccuccucccacaagaauggguccaauacuucuaccaagaagcggcaccagcccagucagacguugcgcuccugcgcuucguuaacccagacaccggccgaguccucuucgagugcaaacuccacaaauccgguuacguaaccgucgcccacacaggccaacacgaccucguaaucccacccaacggauacuuccgcuucgacagcugggucaaccaauucuacacccucgcacccaugggcaacggaaccggccgccgacgagcccuguaa

SEQ ID NO: 35489 - RNA, 1623 nt, Artificial Sequence
  derived and/or modified sequence opt11 from capsid_protein_VP1__Norovirus__AHX22028
augaaaauggcauccuccgaugccaaccccucagacgguucagccgcaaaccuaguccccgaagucaacaacgaagucauggcacucgagcccgucguuggugccgcaaucgccgcucccguagccggucagcaaaacgucauagacccauggauccgcaacaacuucguccaagccccaggcggugaguucacugucuccccucgcaacgcacccggagaaauccucuggucagcuccccucggccccgaccucaaccccuaccucucacaccuugcccggauguacaacggcuacgccggcggauucgaaguucaaguuauccucgccggaaacgccuucacagccggcaaagucaucuucgccgccgucccacccaacuuccccaccgaaggucucucaccuucacaaguaacaauguuuccacacauaguagucgacguccgccaacucgaacccguccucaucccccucccagacguccguaauaacuucuaccacuacaaccaauccaacgaccccacuaucaaacucaucgccaugcuauacacaccccuccgcgccaacaacgccggcgacgacgucuucacagucuccugcagaguacucacccgccccagccccgacuucgacuuuauauuccucguaccacccaccgucgaaucucgcaccaaacccuucuccguuccgguccucaccgucgaagaaaugaccaacucccguuuccccaucccccucgaaaaacucuucacaggacccucauccgccuuuguaguccaaccccagaacggccguugcacaacagacggaguccuacucgguaccacccaacucucacccgucaacaucugcacauuccgaggagaugucacccacauaaccggaucccgcaacuacaccaugaaccucgccucccaaaacuggaacaauuacgauccuaccgaagaaauccccgcaccccucggcacacccgacuucgucggaaaaauacaaggaguacucacccaaacuacacgcaccgacggcuccacccgcggccacaaagcaaccguauacacaggauccgcagacuucgcacccaaacuaggacgaguacaauucgaaacugacacagaccacgacuuugaagcaaaccaaaacaccaaauucacucccguaggagucauacaagacggcggcaccacacaccguaacgaaccucaacaauggguccuacccuccuacagcggccgaaacacccacaacguccaccuagcccccgccgucgcccccacauuccccggcgaacagcuacucuucuuccgcuccaccaugccaggcugcuccggcuaucccaacauggaccuagauugccuccuaccccaggaauggguccaauacuucuaccaagaagcagcccccgcccaauccgacgucgcccuccuccgcuucgucaaccccgacaccggccgaguccucuucgaaugcaaacuccacaaauccggauacguuacagucgcccauacaggacaacacgacuuaguaaucccucccaacggcuacuuccguuucgacuccuggguuaaccaauuuuacacacuagcucccaugggcaacggcaccggccgccgccgcgucgucuaa

SEQ ID NO: 35490 - RNA, 1623 nt, Artificial Sequence
  derived and/or modified sequence opt11 from capsid_protein_VP1__Norovirus__AHX22032
augaaaauggcuuccuccgacgcaaaucccagcgacggcuccacagccaaccucguccccgaagucaauaacgaagucauggcccuagaaccuguaguaggagccgcaaucgcggcacccgucgcuggccagcaaaacgucaucgaccccuggauccgcaacaacuucguccaagcccccggcggcgaauuuacagucagcccccgcaaugccccaggcgaaauacucugguccgccccacuaggaccagaccucaaccccuaccucucucaucuggcacgaauguauaacggcuacgcaggcggcuucgaaguacaaaccauccucgcaggcaaugccuuuaccgcaggcaaaauaaucuucgccgcugucccucccaacuuucccaccgaaggauuaagccccucacaagucaccauguuuccccacaucaucgucgacguccgccagcuagaacccguccucauaccccuacccgauguccguaacaacuucuaccacuauaaccaaaccaacgaccccacaauaaaacucaucgccaugcuuuacaccccacuccgcgccaauaacgccggagacgacgucuucaccgucucaugcagagugcucacccgccccuccccggacuucgacuucauauuccuaguacccccaacagucgaaucucgcaccaaacccuucuccgucccaguccuuaccgucgaagaaaugaccaacucacguuuccccauaccccucgaaaaacuguucacuggcccaucaagcgccuucgucguacaaccacagaacggccgcugcacaaccgacggggugcuacucggaacaacacaacucuccccuguaaacaucugcaccuuccgcggcgacgucacccauaucuccggcucccgaaauuacacaaugaaccucgccucccaaaacuggaacucauacgaccccacagaagaaaucccugcaccacuaggcacccccgauuucgucgggaaaauacaaggcguccuaacccagaccacccgaaccgacggauccacacgcggccacaaagccacugucuacacaggcuccgcagacuucuccccaaaacugggccgcguccaauucgccacagacaccgauaacgacuucgaaaccaaccaaaacacaaaauuuacccccgucggcguaauccaagacggaggcaccacccaccaaaaugaaccucaacaauggguccuucccucuuacucaggacgagacacccacaacguacaccuugccccagccgucgcacccacauuccccggcgaacaacuacuauucuuccgcuccaccaugccaggcugcuccggcuaccccaacauggaucucgacugccucuuaccucaagaauggguccaauauuucuaccaggaagccgccccagcucaaucagacguugcccuucuccguuucgucaaccccgacaccggacgcguacucuucgaaugcaaacuccacaaauccggcuacgucaccgucgcucacacuggacaacacgaccuaguuaucccuccaaacggcuacuuccgcuucgacuccugggugaaccaauucuacacccucgcacccaugggcaacggcaccggccgucgccgcgcucuauaa

SEQ ID NO: 35491 - RNA, 1623 nt, Artificial Sequence
  derived and/or modified sequence opt11 from capsid_protein_VP1__Norovirus__AHX22038
augaagauggcauccucagacgcuaaccccuccgacggcucggccgccaaccuaguucccgaagucaacaacgaaguaauggcacucgaacccgucgucggugccgccaucgcagcccccguagccggucaacaaaaugucauagacccauggauccgcaauaacuucgugcaagcccccggaggugaguucacugucucaccccgaaacgcuccaggagaaauccucugguccgcaccucucgggcccgaccuaaacccguaccuaucccaccuagcacgcauguacaacggcuacgcaggagguuucgaaguucaagucauccuagccggcaacgcuuucaccgccggaaaagucaucuucgccgcuguacccccaaacuuccccacagaaggccuaucccccucgcaagucaccauguucccccacaucgucguggacguccgccaacuagaaccaguccuaaucccccucccagacguccgcaacaacuucuaucacuacaaccaauccaacgaccccaccaucaaacuaauagccaugcuauacacaccccuccgagcaaacaacgccggugacgacgucuuuaccguuucaugccgaguucucacccgacccuccccagacuucgacuucaucuuccucguacccccaaccgucgaaucacguacaaaacccuucucuguccccguccucacggucgaagaaaugacaaauucaagauuccccauaccacuagaaaaacucuuuacgggacccuccuccgccuucguuguacaaccccaaaacggccgcugcaccaccgacggaguccuacucgguacaacccaacucuccccaguaaacaucugcacauuccguggcgacgucacacacaucaccggcagccgcaacuacaccaugaaccucgcaucccucaacuggaauaacuacgaccccaccgaagaaaucccugcuccccucggcacccccgacuucguaggcaaaauccaaggcaugcuaacccaaacaacccgcacugacggcucuacacgcggccauaaagccaccgucuauaccggaagugccgacuuugcccccaaacucggccguguccaauuugaaaccgacaccgaccaugacuuugaagccaaccaaaacacgaaauucacacccgucggagucauccaagacggcucgacuacucaccgcaacgaaccacaacaguggguucuccccuccuacuccggucgaaacacccacaacguacaccucgcaccagccgucgcccccaccuucccaggcgaacaacuccuauucuuccgauccacaaugccaggcugcucuggauaccccaauauggaccucgacugccuacucccacaagaauggguccaauacuuuuaccaagaagccgccccagcccaaucagacguagcccuccuucgcuucgucaaccccgacacaggacgcguccucuucgaaugcaaacuccacaaauccggcuacgucaccguugcccacaccggccaacacgaccucgucaucccaccuaacggcuacuuccgcuucgauucaugggucaaccaauuuuacacccucgccccaaugggcaacggaacaggacgacgccgagucgucuaa

SEQ ID NO: 35492 - RNA, 1623 nt, Artificial Sequence
  derived and/or modified sequence opt11 from capsid_protein_VP1__Norovirus__AHX22041
augaaaauggcauccucagacgccaacccaucagacggcucugccgccaaccucguccccgaaguaaacaacgaagucauggcucuagaacccgucgucggcgccgcaaucgcagcccccgucgcaggccagcaaaacgucauagacccauggauacgcaacaauuuuguccaagcccccggcggcgaauuuaccguaagcccccgcaacgcacccggcgagauccucugguccgcaccacucggccccgaccuaaaccccuaccucucccaccucgcaagaauguacaacggcuacgcaggcggcuucgaaguccaaguuauacucgccggcaacgccuucaccgccggcaaaguaaucuuugcagccguucccccaaauuuccccacagaaggccucuccccaucccaagucaccauguucccacacaucgucguagacguacgccaacuggaacccgugcuaaucccacuaccagacguccgaaacaacuucuaccacuacaaccaaucaaacgaccccacaaucaaacuaaucgccaugcucuacaccccacuccgcgccaacaaugccggcgacgaugucuucaccgucucaugccgaguacucacccgccccuccccagacuucgacuuuaucuuccucguacccccaacugucgaaucucgcacuaaacccuucucaguccccguccuaaccgucgaagagaugacuaacucccgcuuccccauuccccuugaaaagcuauucaccggacccucauccgccuucgucguccaaccccaaaacggccgaugcaccaccgacggcguauuacucggaaccacccaacuaagcccaguaaacaucugcacauuccgaggcgacgucacucacaucacaggcucucacaacuacaccaugaaccuugccucccagaacuggaacaacuacgacccgaccgaagaaauccccgccccacuaggaacccccgacuucgucggaaaaauucaagguguucuaacccaaacaacccgaacagacgggagcacccgaggccacaaagcaaccgucuacaccggcuccgccgacuucgccccaaaacucggccgcguccaguucgccaccgacaccgaccacgacuucgaagccaaccaaaacaccaaauucacuccagugggggucauacaggacggugggacaacccaccguaacgaaccccaacaauggguccuacccucauacagcggcagaaacacucauaacguccaccucgcaccagccguagcaccaaccuuccccggcgaacaacuccucuucuuccgcucaaccaugccaggcugcuccggauaccccaacauggaccucgacugcuuacuaccacaagaguggguccaauacuucuaccaggaagccgccccagcacaaucagacgucgcccuacuucgauucguaaaccccgauacgggcagagucuuauucgaaugcaagcuccauaaauccggcuacguaacagucgcccacaccggccaacacgaccucgucaucccacccaacggcuacuuccgcuucgacucaugggucaaucaauucuacacauuagcaccaauggguaacgggaccggucgcaggcgcguagucuaa

SEQ ID NO: 35493 - RNA, 1623 nt, Artificial Sequence
  derived and/or modified sequence opt11 from capsid_protein_VP1__Norovirus__AHX22047
augaaaauggccuccucagacgccaaccccuccgacggcuccaccgcaaaccucguccccgaaguuaacaacgaaguaauggcccuagaacccguuguuggcgccgccaucgcagcacccguagccggccagcaaaacgucaucgaccccuggauacgcaacaacuuuguccaggcccccggaggcgaguucacuguuuccccacgaaaugcacccggcgaaauacuuugguccgcuccccucggccccgaccugaacccauaccuaucccaccuugcccgcauguacaacggcuacgccggaggauucgaaguacaagucauucuugcaggcaacgccuucacagccggcaaaaucaucuucgcggcagucccacccaacuuccccacagaaggacucucccccucucaaguaaccauguucccccacaucaucguagacguccgccaacucgaacccguccuuaucccccuccccgacguccgcaacaacuucuaccacuacaaccaaagcuccgaccccacaauuaaacucaucgccaugcuuuacacaccccuccgcgccaacaacgccggcgacgacgucuucacugucucuugccgcguccucacccgccccucccccgacuucgacuucauauuucuuguaccaccaaccgucgaaucccgcacaaaaccauucuccgucccaguauuaacagucgaagaaaugacaaauucucgcuucccaaucccacuagaaaaacucuucaccggacccuccuccgcauucguaguacaaccccaaaacggccgcugcaccacagacggcguccuccucggaacgacccaacucucccccguaaacaucugcacauucagaggcgacguuacccacauaccuggaucacgcaauuacaccaugaaccucgccucccaaaacuggaacagcuacgacccuaccgaagaaauccccgcaccccuaggcacccccgacuucgucggaaaaauccaaggcgugcucacccaaacgacccguaccaacggcucaacccgcggccacaaagccacagucuauaccggcucagccgacuuuagcccaaaacucggacgaguccaauucgccaccgacaccgacaacgacuucgaaaccaaccaaaauacuaaauucacucccgucggcguuauacaagacggcucuacaaccccacgcaacgaaccccaacaauggguccucccaucauauuccggccgaaacauucacaacguccaccucgccccugccgucgcacccaccuuccccggcgaacaacuccucuucuuccgcuccaccaugcccggcugcuccggcuaccccaacauggaccucgacugucuccuuccccaagaauggguccaguacuucuaccaagaagcugcccccgcccaauccgauguugcacuccuucgcuucgucaacccagacacaggacguguccuauucgaauguaaacuccacaaguccggcuacgucacagucgcucacaccggccaacacgaccucgucaucccacccaacgguuacuuccgcuucgacuccuggguaaaccaauucuacacgcucgcccccaugggaaauggcacuggacgacgccgcgcacucuaa

SEQ ID NO: 35494 - RNA, 1623 nt, Artificial Sequence
  derived and/or modified sequence opt11 from capsid_protein_VP1__Norovirus__AHX22050
augaaaauggccagcucagacgccaaucccuccgacggcucaaccgcaaaccucguacccgaagucaacaacgaaguaauggcccuagaacccguagucggcgccgccaucgccgccccagucgccggccaacaaaacgucaucgaccccuggauccgaaacaacuuuguacaagcuccugguggagaguucaccgucucaccucgaaacgcccccggcgaaauacucuggucagcaccacucggccccgaccucaacccauaccuuucacaccuagcccgaauguacaacggcuacgccggcggauucgaaguccaaguaauacuagccggcaacgcauucaccgccggcaaaaucauauucgccgccgucccacccaacuuccccaccgaaggacuuucccccucccagguaaccauguucccccacaucaucgucgacguccgacagcucgaacccguccuaauccccuuacccgacguccguaauaacuucuaucacuacaaccaauccaacgaccccacuauaaagcuaaucgccaugcuauacacaccucugcgggccaacaacgcaggagacgacgucuucaccguuuccugccgcguccuuacccgaccuucacccgacuuugacuucaucuuccuaguaccacccaccgucgaaucccgaacaaaaccuuuuuccguccccguccuaaccgucgaagaaaugacaaacucccgcuuccccaucccacuagaaaaacuuuucacagguccauccuccgccuucgucguccaaccacaaaacggucgcugcacaaccgacggcguccuacucggcaccacccaacuaucccccgucaacauaugcacauucagaggugacgucacccacauaucaggcucccguaacuacaccaugaaccuagcaucgcaaaacuggaacuccuaugacccaaccgaagagauccccgcaccccucggcacaccugauuuugucgggaaaauccaaggaguacuaacacaaaccacacgcaccgacggcuccacccgcggccacaaagccaccgucuacacaggcuccgcagacuucucccccaaacucggccgcguccaauucgccacagacaccgauaacgauuucgucaccaaccaaaauacuaaauucaccccaguaggagucauccaagauggcuccaccacaccccgcaacgaaccccaacaauggguccucccauccuacucaggucgcaauacccacaauguucaccucgcgccagccgucgcccccaccuuccccggcgaacagcuccucuucuuccgcuccacuaugcccggaugcuccggguaccccaacauggaccuugacugccuccucccccaggaguggguacaguacuuuuaccaagaagcagcccccgcacagucagauguagcccucuuacgcuucgucaacccugacaccggccgcguccucuucgaauguaaacuccacaaaucuggcuacguuaccgucgcacauaccggccaacacgaucucgucaucccucccaacggauacuuccgcuucgacuccugggucaaccaauucuacacccuagcacccaugggaaacggaaccggacgccgccgcgcacuuuaa

SEQ ID NO: 35495 - RNA, 1623 nt, Artificial Sequence
  derived and/or modified sequence opt11 from capsid_protein_VP1__Norovirus__AHX22054
augaaaauggccucaucagacgccaauccauccgacggaagcacagcgaaccucgucccugaagucaauaacgaagucauggccuuagaacccguagucggcgcagcuaucgcugcaccagucgccggccaacaaaacgucaucgaccccuggauccgcaacaacuucguccaagccccaggcggcgaguucaccgucucuccucgcaacgccccaggagaaauacucugguccgccccacucggccccgaccuaaacccauaccucucccaucucgcccgaauguacaacgguuacgcuggcggcuucgaaguccaagucauccucgccggcaacgccuucaccgccggcaaaauaaucuucgccgcagucccucccaacuuccccaccgaaggccucagccccucccaaguuaccauguucccccacauaaucguagacguucgccagcuagaacccgucuuaauaccccuccccgacguccgaaacaacuucuaccacuauaaccaauccaaugacucaaccaucaaacuuauagccaugcucuauacaccccuccgcgcaaacaacgccggagacgacgucuuuaccguauccugcagaguacucacacgaccaucgcccgacuucgacuucaucuuccucguucccccaaccgucgaaucacgcacaaaacccuucucaguccccguccucaccgucgaagaaaugacuaacucucgauucccaauaccacuagaaaaacucuucaccggccccucauccgccuuugucguacaaccccaaaacggccgaugcaccaccgacgguguccuccucggcaccacacagcucucccccguaaacaucugcaccuuucgcggagacgugauacacauuucuggcucucgcaacuacaccaugaaccuagcaucacagaacuggaacucauacgaccccaccgaagaaauaccagccccucugggaaccccagacuucguaggcaaaauacaaggcguccugacccagaccacccgaaccgacggcuccacccgaggccacaaagccaccgucuacaccggcucggccgacuucucucccaaacuaggccgaguccaauucgcuaccgacacugacaacgauuucgucaccaaccaaaacaccaaauucacccccguaggcgucauccaagacggcucaacaacccccagaaacgaaccccaacaguggguacucccauccuacuccggucguaacacacacaacguccaccuagcccccgccguagcacccacauuccccggcgaacaacuacuauucuucagaucaaccaugcccggcugcucaggcuaccccaacauggaccucgacugccuacucccccaagaauggguccaauauuucuaccaagaagccgcccccgcgcaauccgauguagcucuccuacgcuucguaaacccugacacuggcagaguccucuucgagugcaagcuccacaaauccggcuacgucacagucgcccacaccggccaacacgaucucguuauacccccaaacggauacuuccgcuucgacuccugggucaaccaauucuacacacuugcuccuaugggcaacggcacaggccgacgacgcgcccucuaa

SEQ ID NO: 35496 - RNA, 1647 nt, Artificial Sequence
  derived and/or modified sequence opt11 from capsid_protein_VP1__Norovirus__AIA96988
augaaaauggccucaaaugaugccgccccauccaacgacggagcagccggccucguaccagaaaucucaaacgaagcuauggcccucgaccccguagccggugccgccauagcagccccacuaacaggacaacaaaacaucauugaccccuggauaaugaacaacuucguccaagccccuggcggcgaguucaccgucucgcccagaaauucaccgggcgaaauacuccucaaccucgaacucggcccagagaucaaccccuaccuagcacaccuagcccgaauguacaauggcuacgccggcggcuucgaaguacaagucguccuagcuggcaacgccuuuacagcaggaaaagucaucuucgccgccaucccucccaacuuccccaccgacaaccucagcgccgcccaaaucacuaugugcccacacgucaucgucgacgucagacaacucgaacccaucaauuuaccaaugccagacgucagaaacaauuucuuccauuacaaccaaggaucagacucacgucuccgccuaauagccaugcucuacacgccccuucgcgccaacaacucgggcgacgacguauucaccguaucaugcagaguccuuacccgacccucacccgacuucuccuucaacuuccuugucccacccaccguagaaucaaaaacuaagcccuucacccuccccauacucaccaucuccgaaauguccaacucccgcuuccccguccccaucgacucacuccacacuagccccaccgacaacauugucguccaaugccaaaacggccgcgucacacucgacggugaacuaauggguaccacucaacuccuacccucccaaaucugcgccuucagaggcguccucacccgcuccaccagccgcgccuccgaccacgccgacacugccacaccccgucuauucaacuacuacuggcacauucaacucgacaaccucaacggcacccccuacgaccccgccgaagacauccccgcaccccuuggcaccccugacuuccgcggaaaagucuucggcgucgcaucacaacgcaaccccgacagcacaacccgcgcccacgaagccaaagucgacacaacauccggccgauucacccccaaacuuggauccuuagaaaugucaacagaaucagacgacuucgaccaaaaccaaccuacacguuucacaccagucggcaucggagucgacaacgaagcagacuuccaacaauggacccuccccgacuacucaggacaauucacacauaacaugaaccuagcacccgccgucgccccaaacuucccaggcgaacaacuccuauucuuucgcucacaacucccaucaucuggaggccguuccaacggcauacuagacugccucguaccccaagaauggguccaacacuucuaccaagaauccgcuccggcucaaacacaagucgcccucguacgcuaugucaaucccgacaccggccggguccuuuuugaagcaaagcuccacaaacucggauacaugaccauugccaaauccggagauuccccuaucaccgucccacccaacggcuacuuccgcuucgaaucaugggucaaccccuucuacacacucgcccccaugggcacgggcaacggucgacgcagaauccaauaa

SEQ ID NO: 35497 - RNA, 1623 nt, Artificial Sequence
  derived and/or modified sequence opt11 from capsid_protein_VP1__Norovirus__AII02569
augaaaauggccucaaacgacgccaaccccuccgacgggucugccgccaaucuaguccccgaagucagcaacgaaguaauggcacuagaacccguggucggagcagccaucgcagcccccguugccggccagcaaaacgucaucgaccccuggauccgcaauaacuucguccaagcacccggcggcgaguucaccgucucuccacgcaacgccccuggcgaaauccuaugguccgcaccccucgggccagaccucaaccccuaccucucccaccucgcccgcauguacaacggcuacgccggcggauucgaaguacaaguaauccuggccggcaaugccuucaccgcgggaaaaaucauauucgccgccgucccacccaacuuccccacugaaggccucucccccucacaagucaccauguucccccacaucaucguagacguacgucagcuugaacccguucugauaccccuacccgacguacgcaacaacuucuaccacuacaaccaaacaaacgacuccacaaucaaacuaaucgcaaugcuuuacacaccccucagagccaacaacgccggcgaagacgucuucacaguauccugccgaguacucacccgccccucccccgacuuugauuucaucuuccuaguaccacccaccgucgaaucccgcacaaaacccuucacgguucccauccucacaguagaagaaaugacaaacucucgauuccccauccccuuagaaaaacucuuuaccggccccucaggcgccuucgucguccaaccccaaaacggacgcugcaccaccgacggcguacuccucggcacaacccaacucucgccaguuaacauauguaccuuccgaggcgacgucacacacaucgccggcuccagaaacuacacaaugaaccucgcaucccucaacuggaacaacuacgaccccacagaagaaauccccgcaccucuuggcaccccagacuucgucggcaaaauccaaggcguccucacacaaaccaccaaaggagacgguagcacuagaggacacaaagccaccgucuacacaggcuccgcccccuucacucccaaacucggauccguacaauucucaaccgacacagaaaacgauuucgaaacccaccaaaacaccaaguucacacccguaggaguaauacaagacggagggacuacccaccgcaacgaaccacaacaauggguccuaccaucauacuccggccgcgacguccacaacguccaccucgcaccagcaguagccccaacuuuucccggugaacaacuccucuucuuccgaucaaccaugccgggcugcuccggcuacccaaacauggaccucgacugccuacucccucaagaauggguacaacacuucuaccaagaagccgcuccagcccaauccgacguagccuuacuacgauucgucaacccagacacuggaagaguacuauucgaaugcaaacuauacaaauccggauauguuacugucgcccacaccggccaacacgaccucgugauuccacccaacggcuacuuccgauucgauuccugggucaaccaauucuacacccucgcacccaugggcaauggaaccggacgacgccgcgcucucuga

SEQ ID NO: 35498 - RNA, 1623 nt, Artificial Sequence
  derived and/or modified sequence opt11 from capsid_protein_VP1__Norovirus__AII02572
augaagauggcauccaacgacgcuaacccuuccgacggcuccgccgccaaccucguacccgaagucuccaacgaaguaauggcacucgaaccugucgucggcgccgcaauagccgcccccgucgcaggccagcaaaacgucaucgaccccuggauccgcaacaacuuuguacaagcccccggcggcgaguucacaguaagcccccgaaacgcccccggagaaauacuaugguccgcuccccucggaccagaccuaaacccauaccucagccaccuagcgcgaauguacaacggcuacgccggagguuucgaagugcaagucauccucgccggaaacgcauucaccgcaggaaaaaucauauucgccgccguaccacccaacuuccccacagaaggccucucccccucucaagucacaauguucccccacauaauaguagacguccgccaacuugaacccguacuuauaccacuucccgacguccgaaacaacuucuaccacuacaaccaaacuaacgacuccacaaucaaacuaauagcuaugcucuacacaccccuccgagccaacaacgccggcgaagacgucuucaccgucucaugccgcguacucacacgcccgucucccgacuucgacuucaucuuccucguucccccaaccguagaaucccgcaccaaacccuucaccguccccauacucacagucgaagaaaugaccaacucacgauucccaauaccucucgaaaaacucuucaccgguccauccggcgccuucguuguacaaccccaaaauggucgcuguaccacagacggcguacuacucggcaccacacagcucuccccagucaacaucugcaccuuccgcggugacguaacccauauagccggcagucgcaauuacacaaugaaccuagccucccuuaacuggaacaacuacgacccaaccgaagaaauaccagcuccucucggcacacccgacuucgucggcaaaauccaaggcguucucacccaaaccaccaaaggcgacggcucaacaagaggucacaaagccaccgucuacacagguuccgcccccuuuacccccaaacucggcucaguccaauuuucaacagacaccgaaaacgacuucgaaacccaccaaaacaccaaauucacccccguuggcgucauucaagacggcggaaccacacaccguaacgaaccacaacaauggguccuacccucauauuccggccgagacguccacaacguccaccucgccccggcaguugcaccaaccuucccgggcgaacaacuccuuuucuuccgauccaccaugccaggaugcuccggcuacccaaacauggaccucgacugccuacucccacaagaauggguccaacacuucuaccaagaagccgcccccgcucaauccgacgucgcacuucuacgcuucguaaaccccgauaccggacgcguccucuucgaaugcaagcuccacaaaucaggcuacgucaccgucgcccacacaggucaacacgaccuugucaucccucccaacggcuacuuccgcuuugacucaugggucaaucaauuuuacacccucgcacccaugggcaacggaaccggccgacgccgagcccucuaa

SEQ ID NO: 35499 - RNA, 1623 nt, Artificial Sequence
  derived and/or modified sequence opt11 from capsid_protein_VP1__Norovirus__AII02575
augaaaauggccuccaacgacgccaaccccucagacggaucugcugccaaccucguacccgaagucucaaacgaagucauggcccuugagcccguugucggagccgccauagcugcacccguagccggccaacaaaacguaaucgaccccuggauacgaaauaacuucguacaagcucccggcggcgaguuuacaguauccccgcgcaacgccccuggugaaaucuuaugguccgcaccccuaggccccgaccucaaccccuaucucucacaccucgcccgcauguacaacggcuacgccggaggcuucgaaguccaaguaauccucgccggcaacgccuucaccgccggcaaaaucauauucgccgccguuccucccaacuuccccacggaaggccucucaccaucucaaguaaccauguucccucacauaauaguugacguccgccagcucgaacccguccucaucccacuacccgacguacguaacaauuucuaccacuacaaccagaccaacgauuccaccaucaaacuaauugccaugcucuacacaccccuccgagcaaacaacgccggagaagacguguucaccgucuccugccgcguccuaacccgacccucacccgacuucgacuucaucuuccuaguuccacccaccguagaaucacgcaccaaacccuucaccguccccauccucaccgucgaggagaugaccaacucccgauuccccaucccccucgaaaaacucuuuaccggcccaucaggcgccuucguaguacaaccgcaaaacggacgcugcaccacugacggcguccuucucggcacaacccaacuaucccccgucaacaucugcacauuccgcggcgacgucacccacauagccggaucccgcaacuacaccaugaaccucgccucucuaaauuggaacaacuacgacccuaccgaagaaaucccagcuccccucggcacccccgacuucgucggcaaaauccaaggcguccuaacacaaaccacaaaaggagacggcuccacccgcggacacaaagccaccguauauaccggcuccgcccccuucacuccaaaacucggcuccguccaauuuagcaccgauaccgagaacgacuucgaaacgcaccaaaacacaaaauucacccccguaggcguaauccaagacggcggcaccacacaccggaacgaaccacaacaauggguccucccuuccuacuccggccgcgacguccauaacguccaccuagcaccagcagucgcucccacauuccccggagaacaacuccucuucuuccgcuccacuaugcccgguugcuccggcuaccccaacauggaccucgacugccuacucccacaagaauggguacaacacuucuaccaagaagcagcuccagcccaauccgacgucgcccuacuccguuucgugaaccccgacacaggccgcguacuuuucgaaugcaaacuccacaaauccgguuaugucaccgucgcccacaccggccaacacgaccuaguuaucccucccaauggauacuuccgcuucgacagcuggguuaaccaauucuacacacuagcccccauggguaacggcacaggacgccgccgggcccucuaa

SEQ ID NO: 35500 - RNA, 1623 nt, Artificial Sequence
  derived and/or modified sequence opt11 from capsid_protein_VP1__Norovirus__AII02578
augaaaauggccuccuccgacgcaaaccccuccgacggaucaacugcaaaccucguccccgaaguaaacaacgaagucauggcccucgaacccgucgucggcgcagccauagccgccccaguagccggccaacagaacgucaucgaccccuggauccgcaacaacuucguccaagcccccgggggagaauuuacagucucaccccgcaacgcccccggagaaauccucugguccgcaccacuuggccccgaccuaaacccauaccucagccaccucgcacgaauguacaacggcuacgccggcggauucgaaguacaggucauccucgccggaaacgccuucaccgccggcaaaauaauauucgcugcagucccucccaacuuccccaccgaaggccucucacccucacaaguaaccauguucccacacauaaucgucgacguaagacaacuugagcccguccucaucccacuacccgacguacguaacaacuucuaccacuacaaccaauccaacgaccccaccaucaaacucaucgccaugcucuauacgccccuccgagcaaacaacgccggcgaugacguauucaccgucuccugccgaguacuaacccguccaagccccgacuucgacuucaucuuccucgucccacccacaguagaaucucgaacaaaacccuucagcgucccaguacuaacaguugaagaaaugacuaauagccgcuucccaauaccccucgaaaaacuuuucacaggaccaucaucagccuucgucguacaaccccagaacggccgcugcaccacagacggagucuuacuugguaccacccaacuaagcccugucaacaucugcacauuccguggugaugucacacacaucuccggcucccgaaacuacacaaugaaccuagccucucaaaacuggaacuccuacgaccccaccgaagagauccccgcaccccuuggaacccccgacuuuguaggaaaaauccaaggaguccucacccaaacaacacgcacaaacggaucaacccgcggccacaaagccaccgucuacacaggcuccgcagacuucucuccaaaacuaggccgcguccaauucgcaaccgacaccgacaacgacuucgaaacaaaccaaaacacaaaauucaccccaguaggagucauccaagauggcuccaccacgccccgaaacgaaccccaacaauggguacuccccuccuacuccggacgaaacauucacaacguccaccuagcccccgcugucgcacccacauuccccggcgaacaacuacucuucuuccgaucaaccaugcccggaugcuccggcuaccccaacauggaccucgacugccugcucccacaggaauggguacaguacuucuaccaagaagccgccccagcccaauccgacgucgcccuccugcgcuucgucaaccccgauacaggccgcguccucuucgaaugcaaacuccacaaaucaggauacgucacagucgcccacaccggccaacacgaccucgucauuccgccaaacggcuacuuccgcuucgauuccugggucaaccaauucuacacacuagcacccaugggcaacggcacaggccgucgccgcgcccucuaa

SEQ ID NO: 35501 - RNA, 1647 nt, Artificial Sequence
  derived and/or modified sequence opt11 from capsid_protein_VP1__Norovirus__AII02581
augaaaauggccuccaacgacgccgcaccaucgaacgauggcgccgccggacuuguuccagaaaucaacucugaagccauggcccuagaaccugucgcaggcgccgcaauagccgcaccccucaccggucaacagaacaucauagaccccuggaucaugaacaauuucguucaggcccccggcggcgaauuuacuguaucccccagaaacucacccggagaagucuuacucaaccuagaacucggccccgagauaaacccauaccucgcccaccucgcccgcauguacaauggcuacgccggcggcuucgaaguacaaguucuucucgcaggaaacgcauucacagccggcaaaaucaucuucgccgccauacccccuaauuuucccauagacaaccucuccgccgcccaaaucaccaugugcccccacgucauagucgacguccgacaacuugaacccgucaaccuacccaugcccgacguacgcaacaacuucuuccacuacaaccaaggcuccgacucacgauuacgccugauugccaugcuauacaccccacuucgagccaacaacucaggcgaugacgucuucaccguuucaugccgcguccuuacccgccccucccccgacuucuccuucaacuuccucgucccacccaccguagaaucaaaaacuaagcccuucucccuacccauccucaccaucucugaaaugucaaacucacgauuccccguacccaucgacucccuccacaccucccccacugaaaacaucgucguccaaugccaaaacggccgcgucacccucgacggcgaacucaugggcaccacccaacuccucccaucccaaaucugcgccuucagaggaaugcucacccgaucaacaucccgcgccagcgaccaagcggacacugcaaccccacgccucuucaacuauuacuggcauauacaacucgacaaccuaaacggaaccccauacgaccccgccgaagacauccccggaccacucggcacccccgacuuccgugguaaagucuuuggagucgccucucaacgaaaccccgacgccacuacccgcgcacacgaagccaaaauagacaccaccagcggccgguucacacccaaacucggcucucuagagaucucuaccgaauccggcgacuucgaccagaaccaaccaacccgcuucacccccgucggaaucggcguugaccacgaagcagacuuucaacaauggacacucccagauuacgcaggccaauucacccacaacaugaaccucgcuccagccguagcccccaacuucccgggcgaacaacuccuuuucuuccgcagccagcuccccuccagcgggggacgcuccaacggaauccucgacugccucgucccacaagaauggguacaacacuucuaccaagaguccgcccccucccaaacccaagucgcccucguccgcuacgucaacccagacaccggucguguccucuucgaagccaaacuccacaaacuaggcuucaugaccauugccaaauccggagacucacccauaaccgucccacccaauggcuacuucagauucgaauccugggucaaccccuucuauacucuagcucccaugggaacuggcaacggcagacgcagaauacaauaa

SEQ ID NO: 35502 - RNA, 1623 nt, Artificial Sequence
  derived and/or modified sequence opt11 from capsid_protein_VP1__Norovirus__AII02584
augaaaauggccucaaacgacgccaaccccuccgacgguuccgcagccaaccuagucccugaagucaacaacgaagucauggcacucgaacccguggucggagccgccauagcugcccccguagccggccaacaaaacguaauagaccccuggauccgaaauaacuucguccaagcccccggaggcgaguucacagucucuccccgcaacgcacccggcgaaaucuuaugguccgcaccucucggacccgaucucaaccccuaccucucccaccucgcccguauguacaacggcuacgcaggaggcuucgaaguacaaguaauucucgccggcaacgcauucaccgccggcaaaaucaucuucgcagccgucccacccaacuuccccacagaaggccucucccccucccaagucaccauguucccucacaucaucgucgacguaagacaacucgaacccguccucauaccccuccccgacguacgaaacaacuucuaccacuacaaccaaacaaacgacuccacaauaaaacucaucgccaugcuuuacacaccccuccgcgccaacaacgccggcgaagacgucuuuaccgucucaugccgaguccuaacccgccccagccccgacuucgacuucaucuuccucgucccucccaccguugaaagccgaaccaaacccuucaccguccccauccucaccguagaagaaaugaccaacagcagauuucccauaccccucgaaaaacuauucaccggacccucuucagcauucgucguccaaccccaaaauggccgcugcaccaccgacggcguacugcuuggcaccacccaacuaucccccguaaacaucuguacauuucgaggagacgucacccacauagccggcucccgcaacuacaccaugaaccucgccucacucaacuggaacaauuacgaccccaccgaagaaaucccagcaccccucggcacaccggacuucguaggcaaaauccaaggcguacuaacccaaacaacaaaaggagacggcagcacacgaggccacaaagccaccgucuacaccggcuccgcccccuucacacccaaacuaggaucuguacaauucucaaccgacacagaaaacgacuucgaaacucaccaaaacaccaaguucaccccagugggcguaauccaagacggcggcaccacccaccgaaaugaaccucaacaauggguacuccccuccuacuccggaagaaauguccacaacguccaccucgcccccgcagucgcccccaccuuccccggcgaacaacuccuauucuuccgcagcaccaugcccggcugcuccggauauccaaacauggaccuagacugccuccucccacaagaauggguacaacacuucuaccaagaagccgcccccgcacaaucagauguagcucuccuccgcuucguaaacccagacaccggccgaguccuauucgaaugcaaacuccacaaauccggauacgucaccgucgcccacaccggacagcacgaccucguaauuccuccaaacggauauuuccgcuucgacuccugggucaaccaauucuacacacucgcacccauggguaacggaacagguaggcgccgagcacucuga

SEQ ID NO: 35503 - RNA, 1623 nt, Artificial Sequence
  derived and/or modified sequence opt11 from capsid_protein_VP1__Norovirus__AII02590
augaaaauggcuucaaacgacgccaacccaucagacggcuccgccgcaaaccucguccccgaaguuuccaacgaagucauggcacucgaacccgucguaggcgcagccaucgccgcccccgucgcaggacaacaaaacgucauagaccccuggauccgaaacaacuucguacaagcaccaggcggcgaguucacaguuucuccacgcaacgccccaggagaaauccucugguccgcaccccucgguccugaccucaaccccuaccucucccaccuagcacguauguacaacggcuacgccggaggauucgaaguccaaguaauacucgccggcaaugccuucacagcaggaaaaaucaucuucgccgccgucccuccaaacuuucccacugaaggccucucccccucucaaguuaccauguucccacacauaaucgucgacguacgccaacucgaacccgucuuaauaccccuacccgauguccgcaacaauuucuaccacuauaaccaaaccaaugacucaaccaucaaacuaaucgccauguuauacaccccacuccgcgccaacaaugccggggaagacgucuucacaguauccugcagaguccuaacacgcccaucccccgacuucgacuucauuuuccucguaccucccaccgucgaaucacgcaccaaacccuucacaguccccauacucaccgucgaagagaugaccaauucccgcuuuccaauaccacuagaaaaacucuucaccggacccucaggcgccuucgucguccaaccacaaaacggucguugcacaaccgacggcguccuccucggcacaacccaacuaagccccgucaauaucugcaccuuccgcggggacgucacccauaucgcagguucacgcaacuacacuaugaaccuagcaagucuuaacuggaacaacuacgacccaaccgaagaaauccccgcaccccucggaaccccagauuucgucggcaaaauacagggaguacucacccaaacaaccaaaggcgacggcucgacucgcggacacaaagccaccgucuacacaggcuccgcccccuucacaccaaaacucggcuccguccaauucucaacagacaccgagaacgacuucgaaacccaccaaaacacaaaauucacccccguaggcgucauucaagacgguggaacaacccaccgcaacgaaccacaacaauggguucuacccucauacucuggccgcgacguacacaacguacaccucgccccugcugucgccccaaccuuccccggcgaacaacuccuuuucuucagauccaccaugcccgguugcucuggauaccccaacauggaccuagacugccuccuuccacaagaauggguucaacacuuuuaccaagaagcagcccccgcccaauccgacguagcacuccuacgguucgucaaccccgacacuggaagaguacuguucgagugcaaacuccacaaaagcggcuacgucaccgucgcacacaccggccaacacgaccuagucauaccacccaacggcuacuuccgcuuugacuccugggucaaccaauucuacacacucgcacccaugggaaacggcaccggacgacgcagagcccucuaa

SEQ ID NO: 35504 - RNA, 1623 nt, Artificial Sequence
  derived and/or modified sequence opt11 from capsid_protein_VP1__Norovirus__AII02593
augaaaauggcuuccagcgacgccaaccccuccgacggauccaccgcaaaccucgucccagaagucaacaacgaagucauggcgcuagaacccgucguaggggccgcaaucgcagcccccgucgccggccaacaaaacguaaucgaccccuggauccgcaacaacuucguccaagcaccaggcggagaguucacagucucaccccgcaacgcccccggcgaaauccuuugguccgcaccccucggcccagaccucaaccccuaccucucucaccuggcccgcauguacaacggauacgccggcggcuucgaaguacaagucauccuagccggaaacgcauucaccgccggcaaaaucauuuucgccgcaguacccccuaacuuccccacagaaggccuuucccccucacaggucaccauguucccacacaucaucgucgauguccgucaacucgaacccguccuaaucccccuacccgacguccgaaacaacuuuuaccacuacaaccaauccaacgacccaacuauaaaacuaauagccaugcuauacacaccacuacgagccaacaacgccggcgacgacgucuucaccguuuccugccguguacucacccgccccucaccagacuuugacuucaucuuccuggucccucccacagucgaauccagaacuaaacccuuuuccguccccguccuuaccgucgaagaaaugaccaacucccgauuccccaucccccucgaaaaacucuucacaggccccucuuccgcauucgucguccaaccacagaacggccgcuguaccaccgauggcguccuccuaggcaccacccaacucucaccaguaaacauaugcaccuuccgcggugacgucacccacauacccgguucccguaacuacaccaugaaccucgccucucaaaacuggaacuccuacgacccuaccgaagaaaucccagcaccacuaggcaccccagacuuugucggaaaaauacaaggcguccuaacucaaaccacccgcaccaacggcucuacgcgcggccacaaggccaccgucuacacuggcucagccgacuucuccccaaaacucggucguguccaauucgccacagacacagacaacgacuucgaaaccaaccaaaacaccaaauucaccccugucggaguaauccaagacggcuccaccacaccccgcaacgagccacaacaauggguccuccccuccuacuccggacgcaacauccauaacguccaccuagcucccgccguagcaccaaccuuccccggugaacaacuacucuucuuccgcucaaccaugcccggcugcuccggcuaccccaacauggaccucgacugccuccucccccaagaauggguccaauacuucuaccaagaagccgccccagcccaguccgacgucgcccuccuacgauucgucaaccccgacacuggcagaguccucuucgaaugcaaacuacacaaaucuggcuacguaacaguagcccacacaggccaacacgaccuaguaaucccacccaacggcuauuucagauucgacucauggguuaaccaauucuauacacucgcccccaugggaaauggaacuggccgacgacgcgcacuuuaa

SEQ ID NO: 35505 - RNA, 1623 nt, Artificial Sequence
  derived and/or modified sequence opt11 from capsid_protein_VP1__Norovirus__AII02596
augaaaauggccagcaacgacgcaaaccccagcgacggcuccgccgcgaaccucguccccgaaguaagcaacgaaguuauggcacucgaaccagucgucggcgccgccaucgcagccccagucgccggacaacaaaaugucaucgacccauggauaagaaacaacuucguccaagcccccggcggcgaguucacagucuccccucgcaacgccccaggagaaauacuuuggucagcaccccucggucccgaccucaaccccuaccucucccaccucgcccgaauguacaacggcuacgcuggaggauucgaaguacaagucauacuagcaggaaaugcauucaccgcaggcaaaaucaucuucgcagccguacccccgaacuuuccuaccgaaggccucuccccaucccaagucaccauguucccacacaucauaguugacguccgccaacuugaacccguccucauuccccuuccagauguccgcaacaauuucuaccacuacaaccaaacuaacgacuccaccauaaaacugaucgccaugcuauacacaccccuacgcgcaaacaacgccggcgaagacgucuuuaccgucucaugccgaguccuaacccgucccuccccugacuucgauuucaucuuccucguacccccaacagucgaaucccgcacaaaacccuucacaguccccauccuuaccguagaagaaaugacaaacagccgcuuccccaucccccuugaaaaacucuucaccggcccaucuggcgccuucguuguucaaccccaaaacggccguugcaccacagacggaguccuccuaggaacaacccaacuuucccccgucaacaucugcacauuccgcggagacgucacccacaucgccggaucacgaaacuauaccaugaaucuagcaagccucaacuggaacaacuacgaccccacagaggaaauccccgcaccccuaggcacccccgacuucguaggaaaaauacaaggcguccucacccagaccacaaaaggugacggaagcacccgaggccacaaagccaccgucuacaccggguccgcccccuucaccccgaaacuaggcuccguacaauucagcaccgacacagaaaacgacuucgaaacccaccaaaacaccaaauucacccccgucggcgucauccaagauggcggcacaacccaccgcaacgaaccccaacaguggguccucccauccuacucaggccgagacguacauaacguacaccucgcccccgcagucgcaccaaccuucccaggagaacaacuccucuucuuccgcucaaccaugcccggcuguuccgguuacccaaacauggaccuagacugucuccucccacaagaauggguacagcacuucuaucaagaagccgcaccagcccaaucugacgucgcacuccuccgauucgucaaccccgauacgggccgcguacucuucgaaugcaaacuacacaaauccggcuacguaacagucgcacacacaggccaacacgaccucgugaucccucccaauggcuacuuccgcuucgacuccugggucaaccaauucuacacccuugcacccaugggcaacggaaccggacgaagacgagcccucuaa

SEQ ID NO: 35506 - RNA, 1623 nt, Artificial Sequence
  derived and/or modified sequence opt11 from capsid_protein_VP1__Norovirus__AII02599
augaaaauggccuccaaugacgcaaaccccuccgacggcucagccgccaaccuaguaccagaagucucaaacgaaguaauggcccucgaacccguaguaggagccgcaauugcagcacccgucgcaggccaacaaaacgucaucgacccauggauccgaaacaacuucguccaagcccccggcggcgaguucaccguaucacccagaaacgcucccggagaaauacucuggucagcgccccucggccccgaucucaacccauaccucucccaucucgcccgaauguacaacggcuacgccggcggauucgaaguccaagucauccuagccggcaacgccuucaccgccggcaaaaucaucuucgccgcagucccacccaacuuccccaccgaaggacuuucccccagucaagucaccauguuuccccacaucaucguagacguacgccaacuagaacccguccucaucccccuccccgauguuagaaacaacuucuaccacuacaaccaaaccaacgauuccacaaucaaacuaaucgccaugcuguacacaccccuaagagccaacaaugcuggcgaagacgucuuuaccgucucaugcagaguccucacccgccccucuccagauuucgacuucaucuuccuaguacccccaaccgucgaaucccgcaccaaaccauucaccguccccauccuaacagucgaagaaaugacaaacucccgauucccgaucccgcucgaaaaacuuuucaccggacccucgggcgccuucgucguccaaccccaaaacggccgcugcaccaccgacggaguccuucuugggacaacccaacucagcccagugaacauaugcacuuuccgaggagacaucacccacauagccggaucccgcgauuauaccaugaaccuagcaagccucaacuggaacaacuacgaccccacggaagaaauacccgcaccccucggcaccccagacuucgucggaaagauccaaggcguccucacccaaacaacuaaacgagauggcagcacacgaggacacaaagccacagucuacacaggaucagccccauuuacaccaaaacucggauccguucgcuucucaaccgacacagaaaacgacuucgaaacacaccaaaacaccaaauucaccccugucggcgucauacaagacggcuccacuacccaucgcaacgaaccccaacaauggguacuacccucauacuccgguagagauguucacaacguacaccucgccccagccgucgcacccaccuucccaggcgaacaacuccuauucuuucguucaaccaugcccggaugcucaggauacccaaacauggaccucgacugccuccucccacaagaauggguacaacacuucuaccaagaagccgcccccgcccaauccgacguggcccuccuacgcuucguuaaccccgacaccggccgaguccuguucgaaugcaaacuacacaaauccggauacgucacugucgcccacacaggccaacacgaccucgucaucccacccaacggcuacuuccgcuucgacucauggguaaaccaauucuacacccucgcacccaugggcaauggcaccggccggcgcagagcccucuga

SEQ ID NO: 35507 - RNA, 1623 nt, Artificial Sequence
  derived and/or modified sequence opt11 from capsid_protein_VP1__Norovirus__AII02602
augaaaauggccagcucagacgcaaacccaucagacggcuccacagcaaaccucgucccugaagugaauaacgaagucauggcacucgaaccggucgucggcgccgcgaucgccgcccccgucgccggucaacagaacguaauagaccccuggauacgcaacaauuucguccaagccccuggcggcgaguucaccguaucaccccgaaacgcaccuggagaaauccuuugguccgcaccccuuggacccgaccuaaaucccuaccucucgcaccucgcccgcauguauaacgguuacgccggcggcuucgaaguccaagucauacuagccggcaacgcauucaccgccggcaaaaucauauucgccgcagucccucccaacuuccccaccgaaggccucucgcccucucaggugaccauguucccucauauaauaguagacguccgccagcucgaacccguccucaucccccucccagacguccgcaacaacuucuaccacuacaaucagagcaaugaccccacaauaaaacuaaucgccaugcuguacaccccacugcgagcgaacaacgccggcgacgacgucuucaccgucuccugccgcguucucacccgcccaucccccgacuucgacuuuaucuuccucguaccaccuaccguagaaucaagaacaaaacccuucucuguccccguacuaacaguagaagaaaugacaaacucccgauuccccauaccacucgaaaaacucuucaccggacccuccuccgccuucguaguccaaccccaaaauggccgaugcacaaccgacgguguucuccucggcaccacccaacuaagccccguaaauaucugcaccuuccgaggagacguaacccauauccccggaucgcgcaacuacaccaugaaccucgcaucccaaaacuggaacucauacgacccaaccgaagaaaucccugccccacucggcacaccggacuucgucggcaaaauccaaggcguccuuacucaaaccacccguaccaacggcuccacccgaggucacaaagcgaccgucuauacaggaagcgccgacuuuucaccaaaauuaggccgcguacaauucgcaacagauaccgacaacgacuucgaaaccaaccaaaacacaaaauucacccccguuggcgucauccaagacggauccacaacaccacgcaacgaaccccaacaauggguccuacccuccuacagcggccgaaacauccacaauguacaccucgccccggccgucgcccccaccuuccccggagaacaacuccucuucuucagauccacaaugcccggaugcuccggcuaccccaacauggaccuagauugccuccucccacaagaauggguacaauacuucuaccaagaagccgcacccgcucaauccgacgucgcccuccuccgauucgucaaccccgacaccggacgaguccuauucgagugcaaacuccauaaaagcggauacgucaccgucgcccacaccggacaacacgaccucgucaucccucccaacggcuacuuccgauucgacuccugggucaaccaauucuacacacuagcccccaugggcaacggaaccggccgcagacgggcacuauaa

SEQ ID NO: 35508 - RNA, 1608 nt, Artificial Sequence
  derived and/or modified sequence opt11 from capsid_protein_VP1__Norovirus__AII02605
augaaaauggcauccaacgacgccgccccaucaaacgacggcgcggccggccuaguccccgaagucaacaacgaaaccauggcccucgaacccguagccggcgccuccaucgccgccccucuaacaggccaaaacaacguaaucgacccauggauaaggcuaaacuucguccaagcgcccaauggagaguucacagucucuccacgaaacucccccggcgaaguacuccuaaaccucgaacuaggccccgaacuaaacccuuaccuagcacaccucuccagaauguacaacggcuacgccggcggcguagaaguccaaguacuauuagcaggcaacgccuucaccgccggcaaacucgucuucgccgccguuccaccccacuucccccuagaaaacaucucccccggccaaaucacuauguucccucacgucauaaucgacguccgcacacuagaaccgguccuacucccgcugccagacguacgcaacaacuucuuccacuacaaccaacaaaaugaaccacgcaugcgacuuguugccaugcuguacacaccccuacgcuccaacggcuccggcgacgacgucuucaccgucuccugccguguacuaacccgccccucccccgacuucgacuucaacuaccuuguacccccgaccgucgaaagcaaaaccaaaccauucacccuccccauacucaccauaggagaacuaacaaacucccgcuuccccguccccauagacgaacucuauacaucaccaaacgaaucccuagucguccaaccccaaaacggucguugugcccucgacggugaacuccaaggcaccacccaacuccucccuacagccaucugcucauuccgaggucguaucaaucaaaaagucucaggagagaaccacgucuggaacaugcaagucaccaacauaaacggcacccccuucgaucccaccgaagacguucccgccccacuaggcaccccagacuucuccgguaaacucuucgguguccuuucacaacgcgaccaugauaacgccugccguucacacgacgcagucaucgcaacuaacuccgccaaauucaccccaaaacugggagcuauccaaaucggcaccugggaacaggacgacguccacauuaaccaacccacaaaauucaccccaguuggacucuucgaaucagaagguuucaaccaguggacccucccgaacuacucaggcgcccucacccucaauaugggacuagcaccacccgucgcccccaccuuccccggugaacaaauccucuucuuccgcucacacauaccacucaaagguggcguagcagacccagucauagacugucuacuaccacaagaauggauccagcaccucuaccaggaaucagccccaucccaaacagacgucgcccucauccgauucaccaaccccgacacuggccgcguccucuucgaagccaaacuccaucgcucaggcuacauaaccguagcaaacaccggcucccgacccauaguuguacccgccaacgguuacuuccgcuucgacuccugggucaaccaauucuacucccuagcccccaugggcacaggcaacgggagacgccgcgugcaauga

SEQ ID NO: 35509 - RNA, 1647 nt, Artificial Sequence
  derived and/or modified sequence opt11 from capsid_protein_VP1__Norovirus__AII02608
augaaaauggccucuaacgacgcggcccccuccaacgacggcgcagccggccuuguacccgaaaucaacuccgaagccauggcccucgaacccguagccggcgcagcaauagccgcaccccuaaccggccaacaaaacaucaucgacccauggauaaugaauaacuucguccaagccccaggcggcgaauuuaccgucucaccccgaaacucucccggagaagucuuacucaaccuagaacuuggcccagaaaucaaucccuaccucgcccaucuggcacgcauguacaacggcuacgcuggcggauucgaaguucaagucguccucgcuggcaacgccuucacagccggcaaaauaauauucgccgccaucccacccaacuucccuaucgacaaccucuccgccgcccaaaucacuaugugcccccacgucauagucgacgucagacaacuagaacccgucaaccucccaaugccugauguacgcaacaacuucuuccacuacaaccaaggcucagacucacgccuccgauuaauagccaugcucuacaccccacuccgcgccaacaacucuggcgacgacguauucaccgucucaugccggguccuaaccagaccuucccccgacuucucuuucaacuuccucguaccacccaccguugaaagcaaaaccaagcccuucucccuccccauccuaacaaucucugaaauguccaauucucgcuuccccguccccauagacucccuacacacaucucccaccgaaaacaucgucguucaaugccagaauggccgaguuacccuagacggcgaacucaugggcaccacccaacuucuaccaucccaaauuugcgcauuccgcggaaugcuaacacgguccaccucuagagccuccgaccaagccgacaccgccacaccccgccucuucaacuacuacuggcacauucaacuagacaaccuaaacgguacccccuacgaccccgccgaagacauaccuggcccacucggaacacccgauuuccgaggcaaaguauucggcgucgcaucgcaaagaaaccccgacgcuaccacccgcgcccacgaagccaaaauagacaccacauccggccgcuucacccccaaacuuggaucccucgaaaucuccaccgaauccggagauuucgaccaaaaccaacccaccagauucacaccuguuggcaucggagucgaccaugaagcagaccuccaacaauggacccuacccgacuacgcaggccaguucacccauaacaugaaccucgcucccgccgucgcacccaacuucccaggagaacaacuccucuucuuccgcagccaacucccaucuuccggaggccgcuccaacggaauccuagacugucucgucccacaagaauggguacagcacuuuuaccaagaaucagcuccaagccaaacccaaguagcccucguccgcuacguaaaccccgacacuggacgcgucuuauucgaagccaaacuccauaagcucggcuucaugaccaucgccaaauccggagacucuccuaucacgguuccacccaauggcuacuuccgcuucgaaucuuggguaaaccccuucuacacacucgcccccauggggacaggaaacggacgacgacggauacaauaa

SEQ ID NO: 35510 - RNA, 1623 nt, Artificial Sequence
  derived and/or modified sequence opt11 from capsid_protein_VP1__Norovirus__AII02614
augaaaauggccucaaacgacgccaacccaucagacggauccgcagccaaccucgucccagaagucuccaacgaaguaauggcccuagaacccgucguaggcgccgccaucgcagcaccagucgccggucaacaaaacgucaucgaccccuggaucagaaacaacuuuguccaagcgcccgguggcgaguucacugucucaccucgcaacgcaccaggagaaauccucuggucagcaccccucggacccgaccucaaccccuaccuaucccacuuagcccgcauguauaacgguuacgccgguggauuugaaguccaagucauccuagccggcaacgcauucacagccggaaaaauaaucuucgcagccguacccccuaacuucccaacugaaggucucucacccucccaagucaccauguucccccacaucaucgucgacgucagacaacuagaacccguccucauaccacuccccgacguacguaauaacuucuaccacuacaaccaaaccaaugacucuaccauaaaacuaaucgccaugcuguacacccccuuacgagcaaacaacgcgggugaagacguguuuaccgucuccugccgaguauuaacccgcccgucaccagacuucgacuucaucuucuuaguucccccaaccgucgaaucuaggacaaaacccuucacagucccaauccuaaccgucgaggaaaugacaaacagccgcuuucccaucccccucgagaaacucuucaccggcccauccggugcauucgucguccaaccacaaaauggccgcugcaccaccgacggcguccuacucggcaccacccaacucucgccagugaacaucugcaccuuccgaggcgacguaacccacauagccggaucccgcaauuacaccaugaaccucgccucucucaacuggaacaacuacgaccccaccgaagaaaucccagcgccccuugguacccccgacuucgucggcaaaauccaaggcguccuuacgcaaacaaccaaaggagacggaucaacccguggccacaaagccaccguauauaccggcucagcccccuucacccccaaacucggauccguccaauucuccacagauacugaaaaugacuucgaaacccaccaaaacacaaaauucacccccgucggagucauccaagacggcucaacaacccaccgcaacgaaccccaacaauggguccuccccuccuacucuggccgagacguccacaacguacaccuagccccagccgucgcuccaacauuccccggugaacagcuacucuucuucagauccacaaugcccggcugcucugguuacccaaauauggaccuugacugccuccuaccacaagaauggguacaacacuuuuaccaagaggcugcaccagcccaauccgacgucgcacuccuccgcuuugucaaccccgacacuggacgaguccucuucgaaugcaaacuccauaaauccggcuacguaaccgucgcccacaccggccaacacgaucucguuaucccacccaacggcuacuuccgauucgacuccuggguaaaccaauucuacacacucgcacccaugggaaacggcacaggccgccgccgcgcacuauaa

SEQ ID NO: 35511 - RNA, 1653 nt, Artificial Sequence
  derived and/or modified sequence opt11 from capsid_protein_VP1__Norovirus__AII02623
augaaaauggccagcaacgacgccaccccaucuaacgacggcgccgcaaaccuagucccagaagcaaacaacgaaguuauggcccucgaacccgucgucggcgccuccaucgccgccccagucgucggccaacaaaacaucauagaccccuggauucgcgaaaauuucguccaagcgccccaaggcgaguucaccgucucaccacgaaacuccccaggcgaaaugcugcuaaaccuagaacucggacccgagcucaaucccuaccucucccaccucucccgcauguacaacggauaugccggcggcaugcaaguccaagucguacucgccggcaacgccuucaccgccggcaaaaucauauucgcagcggucccuccccauuuccccguugacaauauauccgccgcacaaauaaccaugugcccccacguaaucguagacguccgccaacucgaacccguacuccuaccccucccugacauucgcaaccgauucuuccacuacaaccaagaaaacacaccccgaaugagacuugucgcgaugcucuacaccccauuaagagccaauuccggugaagacguauucacgguaucaugccgaguacucacccgcccagcccccgacuucgaguucaccuuccuagucccacccaccgucgaauccaaaacaaaacccuucacccuacccauccuaacgcucggagaacuguccaauucucgcuucccugccgccaucgacaugcucuacaccgaccccaacgaaucaaucgucguccagccccaaaauggacgcugcacgcucgacggaacccuccagggaaccacccagcuaguccccacacaaauuugcgccuuccgcggcacucucaucucccaaacagcacgcgccgccgauucaacggacuucccccaacgcgcgcgaaaccacccccuccacguacaagucaaaaaccucgacggcacucaauacgaccccacagacgacaucccagcuguacuuggagcuauagacuucaaaggcaccguuuucgguguugccucccagcgcgacgucuccggcacacaagaacaaggacacuacgccacccgugcccacgaagcccacaucgacacaaccgacccgaaauacgccccaaaacucggaacaauccuaaucaaauccgaaucaaccgacuucaacacaaaccaacccauucgcuucacccccgucggcaugggagacaauaacuggcgccaaugggaacuaccagacuacuccggaucccucacccugaacaugaaccucgcacccgccgucucaccuucauucccuggggagcgcauucuauucuuccguucaauaguacccuccgccggcggauacggcucaggcuacaucgacugccucauaccucaagaguggguacaacacuucuaccaagaagcagcacccucccaaucagccguagcccucguacgcuacguaaauccagacaccggccgaaacauauucgaagccaaacuacaccgagaaggcuuccucaccguagccaacucaggaaacaacccaaucguagucccacccaacggcuacuuccgcuucgaggcaugggucaaucaauucuacacccucgcccccaugggcuccggccagggccgccgccgcgcccaauaa

SEQ ID NO: 35512 - RNA, 1623 nt, Artificial Sequence
  derived and/or modified sequence opt11 from capsid_protein_VP1__Norovirus__AII02626
augaaaauggccuccaacgacgccaaucccucagauggauccgccgccaaccuugucccagaaguaagcaacgaagucauggcccucgaacccgucgugggcgcagccaucgccgcaccggucgccggccaacaaaacgucauagacccauggauacgaaacaacuucguucaagcccccggcggcgaguucaccguaucaccccgaaacgccccuggcgaaauccuuugguccgccccacucggcccagaccucaacccauaccucucccaccuagcccgcauguacaacggauacgccgguggguucgaaguacaagucauccucgcuggcaacgccuucaccgccggcaaaaucaucuucgcagccguaccacccaacuuccccacagaaggacuauccccuucacaagucacaauguucccccauaucauagucgacguccgccaacuagaaccaguucucauaccccuccccgauguacguaacaauuucuaucacuauaaucaaaccaacgacucaaccauuaaacucaucgccaugcucuacacaccccuucgcgcgaacaacgcuggcgaagacgucuucaccguauccugucgcguccuaacccggccaucaccagacuucgacuucaucuuccucgucccacccaccgucgaaucacgcacgaaacccuucaccguaccaauacucacaguugaagaaaugacuaacucacgcuuccccaucccucucgaaaaacucuucaccggccccucaggcgcuuucguaguccaaccccaaaauggcagaugcaccaccgacggcguccuacucgguaccacccaauuaucuccagucaacauaugcaccuuccgcggagacguaacccacaucgccggcucacgcaacuacacuaugaaccucgccucccuaaacuggaacaacuacgaccccacagaagaaauacccgcccccuuaggcacccccgacuucgucgguaaaauacaaggaguccucacccaaaccacuaaaggagauggcuccacuagaggacacaaagccaccgucuacaccggaucagcacccuucaccccgaaacuaggcucuguccaguucuccaccgauaccgaaaacgacuucgaaacccaccaaaauaccaaauucacacccguaggcgucauacaagauggcggcacaacccaccgcaacgaaccccaacaauggguccuacccuccuacuccggccgcgacguccacaacguacaccuagcccccgccgucgccccaaccuucccuggagaacaacuccucuucuuucgaucaaccaugccugguugcucaggcuaccccaacauggaccucgauugucuccucccccaggaauggguccaacacuucuaccaagaggcugcccccgcacaauccgacguagcucugcuccgcuucguaaaccccgauacaggcagaguccucuucgaaugcaagcuacacaaauccggcuaugucaccgucgcccacacaggacaacacgaccugguaauacccccaaauggcuacuuucgcuucgacagcuggguaaaccaauucuacacccuagcacccaugggaaauggcaccggccgccgccgcgcacucuaa

SEQ ID NO: 35513 - RNA, 1647 nt, Artificial Sequence
  derived and/or modified sequence opt11 from capsid_protein_VP1__Norovirus__AII02629
augaagauggccuccaacgacgccgcccccucgaacgacggugccgccggacucguccccgaaauaaauuccgaagccauggcccuagaacccgucgccggcgccgccauagccgccccacucacaggacaacaaaacauaauagaccccuggaucaugaauaacuucguccaagcucccggcggcgaguucaccgucagcccccgcaacucccccggcgaaguccuccugaaccucgaacucggcccagaaaucaaccccuaccuugcucaccuugcacgcauguauaacggcuacgcaggcggcuucgaaguccaagucguccuagcuggaaacgccuucaccgcaggcaaaaucaucuuugcggcaaucccacccaacuuccccaucgacaaccucuccgcagcccaaaucaccaugugcccacacgucauagucgacguccgacaacucgaaccuguaaaccuaccaaugccugacguccgcaacaacuucuuccacuacaaccagggauccgauuccagacuccgccucauagccaugcuuuacaccccucucagagcaaacaacuccggcgacgacgucuucacaguuucaugccgcguccucacccgaccuucccccgacuucucuuucaacuuucuaguucccccaaccgucgaauccaagacuaaacccuuuucccuccccauccuaacaauuuccgaaauguccaacucccgcuucccaguacccauagacucccuucacaccucacccaccgaaaacauaguaguccaaugccaaaacggccgcgucacccucgacggcgaacuaaugggaaccacccaacuucuaccaucccaaaucugcgcauuccgcgguaugcucacccgcuccaccucacgcgccuccgaccaagcagauacagccacuccacgccucuucaacuacuacuggcacauccaacucgacaaccucaacggcacacccuacgaccccgccgaagacauaccaggcccacuaggcacccccgacuuccgcggaaaagucuucggcguugcaucccaacgaaaccccgacgcaaccaccagagcccacgaagcaaaaaucgacacaaccucaggucgcuucaccccuaaacucggcucccucgaaauuucgaccgaaucaggcgacuucgaccaaaaccaaccaacccgcuucaccccagucggaauuggcgucgaccacgaagccgacuuccaacaauggacccuacccgacuacgccggccaauucacccauaacaugaaccucgcccccgccguagcacccaacuuccccggcgaacaacuccucuucuuccgcucccaauuaccuuccuccggcggacgaucaaauggcauccuagacugccuagucccucaagaauggguccaacacuucuaccaggaauccgcccccucccaaacccaagucgcccuaguccguuacgucaacccugacaccggacguguccuuuucgaagcaaaauuacacaaauuaggcuucaugaccaucgcaaaauccggagacucccccaucaccguacccccaaauggcuacuuccgauucgaauccugggucaacccuuucuacacccucgcccccaugggcaccggcaacggccgccgucgcauccaauaa

SEQ ID NO: 35514 - RNA, 1623 nt, Artificial Sequence
  derived and/or modified sequence opt11 from capsid_protein_VP1__Norovirus__AII02632
augaaaauggcuuccaaugacgccaaccccucugacggaucagcagccaacuuagucccggaaguuucuaacgagguaauggcccucgaacccgucgucggcgccgccaucgcagcacccgucgccggacaacaaaacgucauagacccuuggauucgcaacaauuucguccaagcccccggcggcgaguucaccgucaguccacgaaacgcccccggcgaaauacuuugguccgccccacuuggccccgaccucaacccguaccuuucucaccucgcccgcauguacaacggcuacgccggcggcuuugaaguccgugucauacucgccgguaacgccuucacagcaggaaaaaucaucuucgccgccguacccccaaacuuccccacagaaggacucucacccucccaagucaccauguucccccacaucauagucgaugucagacagcucgaaccuguucuaaucccccuacccgacguccgaaacaauuucuaucauuacaaucaaacaaacgacuccaccaucaaacucaucgcuaugcuauacacaccccuacgcgccaauaacgcaggagaagacgucuucaccgucuccugcagaguccuuacucgacccucccccgacuucgacuucaucuuccucgucccucccaccgucgaauccagaacaaaacccuucaccguccccauacuaaccguagaagaaaugaccaacucccgcuucccaaucccccucgaaaaacucuucaccggcccaagcggcgcauucgucguccaaccacaaaacggccgcugcaccacagacggcguacuccucggcacgacucaacucucacccgucaacaucugcacauucagaggagacgucacccacauagccggcucacggaacuacaccaugaaccucgcaucacuaaacuggaacaacuacgaccccacagaagaaauaccagcaccacuaggaaccccagacuucgucggaaaaauccaaggcguacuaacacaaaccaccaaaggcgacggauccacccguggacacaaagccaccgucuacaccgguuccgcucccuucacaccaaaacuaggcuccguacaauucuccaccgacacagaaaacgacuucgaaacccaccaaaacacaaaauucacccccgucggcgucauacaagacggcggcacaacccaccgcaacgaaccccaacaauggguccuuccuucauacucaggccgcgacguccacaacguccaccucgcacccgcagucgcccccaccuuccccggcgagcagcuccucuucuucagaagcaccaugcccgguugcagcggcuaccccaacauggaccucgauugccuacuaccucaagaauggguacaacauuucuaccaagaagcugcaccagcccaauccgacguagcccuacuucgcuucgucaaccccgacacaggccgcguacucuucgaguguaaauuacacaaaucuggcuacguuacagucgcucacacaggccaacacgaccuugucaucccucccaacggcuauuucagauucgacuccuggguaaaccaauucuacacccucgcccccaugggcaacgguacaggacgccgccgcgcccuuuaa

SEQ ID NO: 35515 - RNA, 1623 nt, Artificial Sequence
  derived and/or modified sequence opt11 from capsid_protein_VP1__Norovirus__AII02635
augaaaauggcuuccaacgaugcaaaccccucagacggauccgccgccaaccuaguccccgaagucuccaacgaaguaauggcccucgaaccaguaguaggcgccgccaucgcagcuccaguagccggacaacaaaacgucaucgaccccuggauccgaaauaacuucguccaagccccgggcggugaguucacaguauccccacgcaacgcacccggugaaauacucugguccgccccucucggccccgaucuuaacccuuaccucucccaccucgcccgcauguacaacggcuacgcaggcggauucgaaguacaagucauacuagcaggcaacgcauucacagccggaaaaaucaucuucgccgccgucccaccaaacuuccccaccgaaggccuguccccaagccaaguaacaauguucccccacaucauagucgacguccgccagcucgaaccaguucuaauacccuuacccgacguccgcaacaacuucuaccauuacaaccaaaccaacgacuccaccauuaaacucaucgccaugcuauacacuccccuccgagccaacaacgccggcgaagacguauucaccguauccugccgcgugcuuacccgcccaagccccgacuucgacuuuaucuuccuaguacccccaaccgucgaaucgcggaccaaacccuucaccguaccaauucucaccgucgaagaaaugaccaacucccgauuucccauaccccucgagaaacuauucaccggcccaucaggcgcauucgucguacaaccccaaaacggcagauguaccaccgacgggguacuccucggcaccacacaacuaucucccgucaacauaugcacauuccgaggagaugucacccacauagccggcucacgaaacuauacaaugaaccuggcgucacucaacuggaacaacuacgaccccacagaagaaauuccagccccucucggcacccccgacuucguaggcaaaauccaaggcguucugacccagaccaccaaaggugacggaagcacacgcggccacaaagccacugucuacacaggcuccgcaccuuucacacccaaacucggcuccguccaauucuccaccgacaccgaaaacgacuucgaaacucaccaaaacaccaaauucacccccguaggcguaauccaagacggcggcacaacccaccgcaacgaaccacaacaauggguacuacccagcuauuccggccgcgacguccacaacguccacuuagccccugccgucgcacccaccuucccuggcgaacaacuccucuucuuccgaucuacaaugcccggcugcuccggcuaccccaacauggaccuagacugccuacucccccaggaauggguccaacacuucuaccaagaagcagcacccgcacaauccgacgucgcccuacuccgcuucgucaacccagacacuggacguguccucuucgaaugcaaacuacauaaaucaggauacguaacugucgcacacaccggccaacacgaccucgucauacccccaaacgguuacuuccgauucgauuccugggucaaccaauucuacacacucgcuccuaugggaaacggcacuggccgucgccgcgcccuauag

SEQ ID NO: 35516 - RNA, 1608 nt, Artificial Sequence
  derived and/or modified sequence opt11 from capsid_protein_VP1__Norovirus__AII02638
augaaaauggcaucuaacgaugcugcccccucuaaugacggagccgccggccucgucccugaagucaacaacgaaacaauggcuuuagaaccugucgccggagccucaaucgccgcaccccucaccggccaaaacaaugucauagaccccuggauacgccucaacuucguccaagcccccaacggcgaauuuaccgucucccccagaaacucucccggagaaguccugcucaacuuagaacuaggccccgaacuaaacccuuaccucgcccaccucuccagaauguacaacgguuacgcuggcggcguggaaguccaaguacuacuagccggcaaugccuucaccgccggaaagcuagucuucgccgccguaccaccccacuucccccucgaaaacaucucccccggccaaauaaccauguucccccaugucaucaucgacguccgcacucuagaacccguacuccuuccccuccccgacguacgcaacaacuucuuccacuacaaccaacaaaacgaaccccgaaugcgucuaguugccaugcuauacacacccuuaaggucaaacggcuccggcgaugacgucuucacagucucaugccgaguacuuacccgaccaucaccagacuucgacuucaacuaucucguaccacccaccguagaaucaaaaacaaaacccuucacacuccccauacuaaccaucggcgaacucaccaacucacgcuucccuguccccauagacgaacucuacacaucaccgaacgaaucacucgucguacaaccgcaaaacggccgcugcgcccucgacggcgaacuacaaggcaccacccaacuccuccccaccgccaucugcuccuuccgcggccgcaucaaucaaaaagucucaggagaaaaccacguauggaacaugcaagucacaaacaucaauggcacaccauucgauccaaccgaagacguuccagcaccccucggcacacccgacuuuuccggcaaacucuucggaguccucucccaacgcgaccacgacaaugccugccgcucccacgaugccgucaucgccaccaacuccgccaaauucacacccaaacuaggcgccauccaaauagguaccugggaacaagacgacguccacaucaaccaacccacuaaauucacucccgucggccucuucgaaucagaaggcuucaaccaauggacccuccccaacuacucaggcgcccuaacccucaacaugggccucgcuccaccuguugcgcccaccuuccccggagaacaaauccucuucuuccgcucucacaucccccucaaaggcggagucgccgaccccgucaucgacugccucuuaccacaagaauggauucaacaucucuaccaagaauccgccccuucucaaaccgacgucgcccucauccguuuuaccaacccugauacaggccgaguacuuuucgaagccaaacuccaccgcuccggcuacaucaccgucgcaaauacuggcucccgaccaauaguuguccccgccaacggcuacuuucgcuucgacuccugggucaaccaauucuacucccucgcacccaugggcaccggcaacggacgcagacgcguccaauaa

SEQ ID NO: 35517 - RNA, 1623 nt, Artificial Sequence
  derived and/or modified sequence opt11 from capsid_protein_VP1__Norovirus__AII02641
augaagauggcaagcaacgacgcaaaccccuccgacggcagcgccgccaaccuaguccccgaagucucuaacgaagucauggccuuagagccaguagucggcgccgcaaucgccgcccccguagcaggccaacaaaaugucauagaccccuggauccgcaacaacuucguacaagcccccggcggcgaguucacagucucaccccgcaacgccccaggagaaauccucugguccgcaccccuaggccccgaucucaacccuuacuuaucacaccuagcacgcauguacaacggcuacgccggcggauucgaaguccaagucauccucgcgggaaacgcauucaccgccggaaagaucaucuucgcugcagucccacccaacuucccaaccgaaggccucucacccucccaaguaacaauguucccccacaucaucguagacguccgccaacucgaacccguacucauaccccuaccagacguccgaaauaacuucuaccacuauaaccaaaccaacgacuccaccaucaaacucaucgcuaugcucuacaccccacuccgcgccaacaacgccggcgaagacguauucaccguaucaugccgcguccucaccagacccucccccgacuucgacuucauauuccucguaccgcccacaguagaaucccgaaccaagcccuucacagucccaaucuuaacugucgaagaaaugacuaacucacgcuucccaauuccccuagaaaaacucuucacaggccccagcggugcuuuuguaguccaaccccaaaacggccgcugcaccacagacgggguccuccucggcaccacacaacucucacccgucaacauuugcaccuuccgcggcgacgucacccacauagcaggcucccgcaacuauacaaugaaccucgcaucucucaacuggaacaacuacgaccccaccgaagaaauaccugcuccccuuggcacacccgauuucguuggcaaaauccaaggaguacucacccaaacaacuaagggagacgguuccacccgcggccacaaagccacaguuuacaccggcucagcccccuucacccccaaacuaggcuccguacaauucuccaccgacacagaaaacgacuucgaaacacaccaaaacaccaaguucacccccguaggugucauccaagacggcgguaccacccaccgcaacgaaccacaacaauggguccucccauccuacuccggccgcgacguccauaacguacaucucgcacccgccguggcccccaccuuccccggcgaacagcuacuguucuuccgcucaacaaugcccggcugcucaggcuaccccaacauggaccucgacugccuccucccccaagaguggguacaacauuucuaccaagaagccgccccagcccaauccgacgucgcccuacuacgcuucguaaaccccgacaccggccgcguccucuucgaaugcaaacuacauaaauccggguaugucaccguagcacacaccggccaacacgaucucguuaucccacccaauggcuacuuccgcuuugauuccuggguaaaccaauucuacacccuugccccaaugggcaacggcacgggacgccgccgcgccuuauag

SEQ ID NO: 35518 - RNA, 1647 nt, Artificial Sequence
  derived and/or modified sequence opt11 from capsid_protein_VP1__Norovirus__AII02644
augaaaauggccucuaacgacgccgcacccucaaaugacggcgccgcaggauuaguccccgaaaucaacuccgaagccauggcacucgaacccguugcuggggccgcaaucgcagcaccccucaccggacaacaaaacaucaucgacccauggaucaugaacaacuucguccaagcccccggaggugaauuuacaguaagcccccgcaacucacccggcgaaguacuccuaaaccucgaacucggcccugaaauaaaccccuaccuugcccaccuagcccgaauguacaacggcuacgccggaggcuucgaaguccaagucguucucgcaggaaacgcauucaccgcuggcaagaucaucuucgcugccaucccacccaacuuccccaucgacaaccucuccgccgcccaaauuaccaugugcccccacgucaucgucgacguucgccaacucgaacccgucaaccuccccaugccugauguccguaacaacuucuuccauuacaaccaaggauccgauucacgccuccgacucaucgcgaugcucuacacaccccuccgcgcuaacaacagcggagacgacguauucaccgucuccugccgcguccucacccgcccaucccccgacuucuccuuuaacuuccuaguaccacccaccguugaaagcaaaacgaaacccuucucucuaccaauccucaccauaagcgaaaugucaaacucacgauuccccguacccaucgacucacuacacaccagcccaaccgaaaacaucguaguccagugccaaaacggacgagucacacucgacggugaacucaugggcacaacacaacuccucccaucccaaauaugcgccuuccgcggcaugcucacacgcuccaccucccgcgccuccgaccaagcugacacagccacaccccgccucuucaacuacuacuggcacauccagcuagacaaccuaaauggaacccccuaugacccagcugaagauauaccaggcccccucggcacccccgacuuccguggcaaaguuuucggcgucgccucccagcgcaaccccgacgcuaccacccgugcccacgaagccaaaauagacacaacauccggccgcuucacacccaaauuaggcucccucgaaauaucaacagaauccggcgacuucgaccaaaaccaacccacccgcuucacaccugucggcauaggaguagaccaugaagccgacuuccaacaauggacccuacccgacuacgccggccaauucacacacaacaugaaccuugcacccgccgucgcacccaacuuccccggugaacaacuacucuucuuccgcagccaacucccauccuccggaggacggucuaacggaauacucgacugccucguaccccaagaauggguccaacacuucuaccaagaauccgcccccucccaaacacaaguagcccucguccgcuacgucaaccccgacaccggacgcgucuuauucgaagccaaauuacacaaacuaggauuuaugacaaucgcaaaguccggcgacucaccaaucacaguuccacccaacggcuauuuucgguucgaaagcuggguaaaccccuucuacacccuugccccaaugggcacaggcaacggccgacgccgcauccaauaa

SEQ ID NO: 35519 - RNA, 1623 nt, Artificial Sequence
  derived and/or modified sequence opt11 from capsid_protein_VP1__Norovirus__AII02647
augaaaauggcguccaaugacgccaacccauccgauggcucugcagcuaaccuaguucccgaaguauccaacgaagucauggcgcuagaaccaguugucggagccgccaucgccgccccagucgcaggacagcaaaacgucaucgaccccuggaucagaaacaacuucguccaagcaccuggcggcgaguucaccgucucaccccgcaacgccccaggcgaaauacuauggagcgcaccacuaggcccagaccuaaauccauaccuaucccaccuagcccgcauguacaacggcuacgccggcggauucgaaguacaagucauccucgcaggaaacgcauucaccgccggcaaaaucauauucgcugcuguaccacccaacuuccccacugaaggccucucacccucacaggucaccauguucccccacaucaucgucgacguccgccaacuugaaccaguacuaaucccccuccccgacguacgcaacaacuucuaccacuacaaccagaccaacgacuccacaaucaaacuaauagcaaugcucuacacuccccuccgcgccaacaacgccggcgaagacgucuucaccgucuccugccgaguccucacccgaccaucccccgacuucgacuucauuuuccuagucccaccaaccgucgaaucccgaaccaaaccauucaccguccccauccuaaccgucgaagaaaugacuaacagccgauuucccaucccccucgaaaaacuauucacaggacccagcggcgccuuuguaguacaaccacaaaacggaagaugcaccaccgacggcgugcuccucggcaccacccaacucucccccguaaacaucugcacauuccgcggagauguuacccacaucgcaggcucccgaaacuacacuaugaaucuagccucucucaacuggaacaacuacgacccuaccgaagaaaucccugcacccuuaggcacacccgacuucgucggaaaaauacaaggcguccuaacccagacaaccaaaggcgacggcucuacccggggccacaaagccaccgucuauaccggcuccgcccccuucacccccaaacuaggcuccguccaauuuuccaccgacacagaaaacgacuucgaaacacaccaaaacaccaaauucacccccguaggcgucauccaagacggaggaacaacccaccgcaacgaaccacaacaaugggcacuccccuccuacuccggccgcgacguccacaacguccaccuagccccggccguagcacccaccuuccccggcgaacaacucuuauucuucagaucaaccaugccaggcuguuccggauaccccaauauggaccuugacugccuacucccacaagaauggguccaacacuucuaccaagaagcagccccagcccaauccgacguagcccuccuucgcuucgucaaccccgacacaggacgaguucucuucgaaugcaaacuccacaaaucuggcuacguuaccgucgcccauacaggccaacacgaccucguaauucccccaaacggcuacuucagauucgacagcugggucaaccaauucuacacccucgccccuaugggaaacgguacaggcagacgccgcgcccucuag

SEQ ID NO: 35520 - RNA, 1623 nt, Artificial Sequence
  derived and/or modified sequence opt11 from capsid_protein_VP1__Norovirus__AII02650
augaaaauggccucaagcgacgccaaccccuccgaugguuccaccgcaaacuuagucccugaagucaacaacgaagucauggcccucgaacccgucgucggcgcggccaucgccgcacccgucgcaggacaacaaaacgucauagacccauggauccgcaacaacuucguccaagccccaggcggcgaguucaccguaucaccucgaaacgccccaggugaaauucuaugguccgcaccccucggaccagacuugaaccccuaccucucacaccucgcccggauguacaacggcuacgccggcggauucgaaguccaaguaauacuagccgguaacgcguucacugccggcaaaaucauauuugccgccguuccacccaacuuccccacagaaggccucucccccucccaggucacaauguucccccacaucaucgucgauguucgccaacucgaacccguccuaaucccccugccagacguccgcaacaacuucuaccacuacaaccaauccaacgaccccaccaucaaacuuauugccaugcucuacacaccccuacgcgcuaacaacgccggagacgacgucuucaccgucuccugccgcguccugacccgacccucaccugacuuugacuucaucuuucucguaccacccaccgucgagucccgcaccaaaccguucucaguaccuguccucaccguugaagaaaugaccaacucccgcuuuccuaucccccuagaaaagcucuuuaccgguccuagcuccgcauucgucguccaaccccaaaacggacgauguaccaccgacggaguccuacucggcacaacacaacucucaccagucaauaucugcaccuuccgaggcgacguaacacacaucccaggcucccgcaacuacacgaugaaccuagcuucacaaaacuggaacucuuacgauccaaccgaagaaauccccgccccacuaggcacccccgacuuuguaggaaaaauccaaggcguacucacccagacaacccgaacaaacggcuccacccgcggccacaaagcaaccgucuacaccggcuccgccgacuucucccccaagcucggccgaguucaauucgcaaccgacaccgacaacgacuucgaaaccaaccaaaacacaaaauuuacaccagucggcgucauacaagacggcuccaccacaccacgcaacgaaccucaacaauggguccuacccucauacucaggacgaaauauccacaacguacaccucgcccccgccgucgcaccaaccuucccaggcgaacaacuccucuucuuucgauccaccaugcccggcugcucaggcuacccaaacauggaccucgacugccuccucccccaagaauggguccaauacuucuaccaggaagcagcucccgcccaaucagacguagcccuccuacgauucgucaaccccgauaccggccgcguuuuguucgagugcaaacuacacaaauccggcuacgucaccgucgcccacaccggccaacacgaccuagucauaccacccaacggcuacuuccgcuucgacucaugggucaaccaauucuacacacucgcccccaugggaaacggcacuggccgacgccgugcccucuaa

SEQ ID NO: 35521 - RNA, 1623 nt, Artificial Sequence
  derived and/or modified sequence opt11 from capsid_protein_VP1__Norovirus__AII02653
augaaaauggccuccaacgaugccaacccauccgauggcuccgccgcaaaucucguaccugaagucucaaaugaagucauggcacuagagcccgucguaggcgccgccaucgccgccccaguugcaggccaacaaaacgucaucgacccauggauccgaaauaacuucguccaagcccccggcggugaguucacaguaucaccccgcaacgcucccggcgaaauccucugguccgccccucuaggccccgaccuuaaccccuaccuaagccaccuagcccgcauguacaacggauacgccggcgguuucgaaguccaagucauccuugccggcaacgccuucaccgccggcaaaaucaucuucgcagccguaccaccuaacuuccccacagaaggccucucccccucucaagucacgauguucccacacaucauaguugacguccgucaacucgaacccguacuuauaccccuccccgacgucagaaacaacuucuaucacuacaaccagaccaacgacucaaccaucaaacuaaucgccaugcucuacacaccccuccgcgcaaacaacgccggagaagacgucuucaccgucucaugccgcguccuaacccgacccucacccgacuuugacuucauauuccucguaccacccacagucgaaucccgcacuaaacccuucacaguccccauccucaccgucgaggaaaugaccaacucccgcuuccccaucccccuagaaaaacuauucaccggccccuccggugccuucguaguccaaccccaaaacggacgcugcaccacugacggcguccuacucggcaccacccaacugucccccguaaacaucugcaccuuccgcggcgacguuacucacaucgccgggucccgcaacuacacaaugaaucuggccucccucaacuggaacaacuacgaucccaccgaagaaaucccagccccacucggcaccccugacuucguaggcaaaauccaaggcguccucacacaaaccacaaaaggagacggcuccacccgaggccauaaagcaacaguauacacugggucugccccuuucacaccuaaacucggcuccguccaauucuccaccgacaccgaaaacgacuucgaaacccaccaaaacacaaaauucacaccagucggcgucauacaagacggcggcaccacccaccggaaugaaccccaacaauggguccuaccauccuacuccggccgcgacguccauaauguucaccucgcaccagcaguugccccaacauuccccggcgaacaacuacuauucuucagauccacaaugcccggaugcaguggcuaccccaacauggaucuagacugccuccuaccccaagaauggguacaacacuucuaccaggaagccgcccccgcccaaucugacgccgcacuucuccgauucgucaaccccgacaccggccgaguccuuuucgaaugcaagcuccacaaauccggcuacgucacaguagcucacaccggccaacacgaccucgucauucccccaaacggauauuuccgcuuugacucauggguaaaccaauucuacacccucgccccaaugggcaacggcacaggccgccgccgagcccuauaa

SEQ ID NO: 35522 - RNA, 1647 nt, Artificial Sequence
  derived and/or modified sequence opt11 from capsid_protein_VP1__Norovirus__AII02656
augaaaauggccagcaacgacgcagccccgucaaacgacggcgccgcaggccucguacccgagauaaacucagaagcaauggcacuagagcccgucgccggcgccgccaucgcugccccacuaacaggccaacagaacaucaucgaccccuggaucaugaacaacuucguccaagcccccggcggcgaguucaccguaucaccacgcaacuccccaggcgaaguccuccucaaccucgaacucggcccagaaaucaacccauaucuggcacaccuggcacgaauguacaacggcuacgccgguggauucgaaguccaagugguacucgccggcaacgcauucaccgcaggcaaaaucaucuucgccgccauaccacccaacuuucccauugacaaccucucugccgcucaaaucacaaugugcccccacgucaucgucgacgucagacaacuagaaccagucaaccucccaaugcccgacguccgcaacaacuucuuccacuauaaccaaggcucagacuccagauuacgauuaauagccaugcucuacacuccccuaagagccaacaacucaggugacgacgucuucaccguauccugccgcguccuaacccgacccucccccgacuucucauucaauuuccucguaccaccgacugucgaguccaaaaccaaaccuuucucccuacccauccuaacaauauccgaaauguccaacucccgauuccccguccccaucgacucccuacacaccuccccaaccgaaaacaucguaguccaaugccaaaacggacgcguuacccucgacggagaacuaaugggaacaacucaacuccucccgagucaaaucugugccuucagaggcaugcuaacccgcuccacuucccgcgcauccgaccaagccgacacggccacaccccgucucuucaacuacuauuggcacauccaacucgacaaccucaacggcacccccuacgaccccgcagaagacauccccggaccucuuggaaccccagacuuccgcggcaaggucuucggcgucgcaucccaacgcaaccccgacgccaccacacgagcccacgaggcuaaaaucgacaccaccuccggaagauucacuccuaaacucggcucacucgaaaucuccaccgaauccggagacuucgaccaaaaccaacccacucgcuucacccccguuggcaucggcguagaccacgaagcagacuuccaacaauggacucuaccagauuacgccggccaauucacucacaacaugaacuuagccccagcuguagcccccaacuuccccggcgaacaacuccuauuuuuccgcucacaacuaccauccucaggaggacgcagcaacggaauccuugacugccucguuccacaagaauggguccaacauuucuaccaagaaagcgcacccucccaaacccaagucgcccucguaagauacgucaacccagacaccggacgaguacucuucgaagcaaaacuccauaaacucggauucaugacaaucgcuaaaagcggcgacucaccaauuacaguaccucccaacggauacuuccgauuugagucuugggucaacccuuucuauacacucgccccaaugggcacaggcaacggccgccgccgaauacaauaa

SEQ ID NO: 35523 - RNA, 1623 nt, Artificial Sequence
  derived and/or modified sequence opt11 from capsid_protein_VP1__Norovirus__AII02659
augaaaauggccagcaacgacgccaaccccuccgacggcuccgccgcaaaccuaguccccgaagucuccaacgaaguaauggcccuugaacccguagucggagcugcaauagcagcccccguagcaggccaacaaaacgucauagaccccuggauccgcaacaacuucguccaagcccccggaggcgaauuuaccguuaguccacgaaacgcccccggcgaaauacuauggagcgcaccccuaggaccagaccucaaccccuaccucucccaccucgccagaauguacaacggauacgccggcggauucgaaguccaagucauccuagcaggcaacgcauucaccgccgguaaaaucaucuucgccgcuguacccccaaacuuccccaccgaaggccucuccccaucccaagucacaauguucccacacauuauagucgacguccgacaacucgaacccguccucaucccccuaccugacguccgcaacaauuucuaucacuacaaccaaaccaaugacagcacuaucaaacucauagccaugcucuacaccccacuucgcgccaacaacgcuggagaagacguguucaccguauccugccgagucuuaacccgcccuuccccagacuucgacuucauauuccucgucccucccaccguugaaucacgaacaaaacccuucaccguccccauccucaccgucgaagaaaugaccaacucacgauuccccaucccccuugaaaaacucuucaccggcccuucaggcgccuucgucguacaaccucagaacggccgcugcacaacagacggcguccuacucggcaccacacaacucuccccagugaacaucugcaccuuccgcggcgacguuacacacaucgccggcucccgaaacuacacaaugaaccucgccagccucaauuggaacaauuacgaccccaccgaagaaauccccgcaccacucggcacucccgacuucgucggaaaaauacagggcguacuuacccagacaaccaaaggagacggaucaacccgaggacacaaagccaccguauauaccgguuccgcccccuucacccccaaacucggcuccguccaauucagcaccgacacagaaaacgacuucgaaacacaccaaaacaccaaguucacucccguaggcguaauacaagacggcggcacuacccaccgaaacgaaccccaacaauggguccuccccagcuacaguggacgagauguccacaacguacaccucgcccccgccgucgccccuacuuuccccggcgaacaauuacucuucuuccgauccacaaugcccggcugcagcggauaucccaacauggaccucgacugccuccuaccucaagaauggguucaacacuucuaccaagaagcugcccccgcccaaagcgauguagcccucuuacgauucgucaaccccgacacaggacgaguacucuucgaaugcaaacuccacaaaucaggauacgucacaguagcccacaccggccaacacgaccucgucaucccuccaaacggcuacuuccgcuucgauuccugggucaaccaauucuacacccucgccccaaugggcaacggaaccggacgccgccgcgcacuauaa

SEQ ID NO: 35524 - RNA, 1647 nt, Artificial Sequence
  derived and/or modified sequence opt11 from capsid_protein_VP1__Norovirus__AII02662
augaaaauggcuagcaacgacgcagccccguccaaugacggcgcagcaggacucguacccgaaauaaacucagaagccauggcccucgaaccagucgccggugccgccauagcagcaccccugaccgggcaacaaaacaucauagacccuuggaucaugaacaacuucguccaagccccuggaggcgaguucacagucagcccccgaaacucccccggcgaaguccuacuuaaccucgaacuaggaccagaaaucaacccauaucuugcccaccuagcccgcauguacaacggcuacgcaggcggcuuugaaguccaagucguacucgcaggaaacgccuucaccgcaggaaaaaucaucuucgccgccauacccccaaacuuccccaucgacaaccuauccgcagcccaaauaaccaugugcccccacgucaucgucgacguccgccaacuagaacccgucaaucuacccaugcccgauguacgcaacaacuucuuccacuacaaccaaggcuccgacucacgacuccgccucaucgccaugcuauacacaccccuacgcgcaaauaacuccggagacgacguuuucaccgucuccugccgaguccucacccgccccucacccgacuuuucauucaacuuccuugucccacccaccguagaauccaaaacaaaacccuucagccuacccauccucacuaucuccgaaaugucaaacucccgcuucccaguacccaucgacagccuacacacauccccaacugaaaacauagucguccaaugccaaaacggccgaguaacucucgacggggaacuuaugggcacaacccaacuccuccccucucaaaucugcgcauucagaggcaugcuaacacgcuccacaucccgcgcaucggaccaagccgacaccgccaccccucgccucuucaacuacuacuggcacauccaacuagacaaccuaaacggcacccccuacgaccccgcagaagacauaccaggcccccucggaacaccugacuuucgcggaaaagucuucggugucgccagccaacgaaaccccgacgcaaccacaagagcccacgaagccaaaauagacacaaccucaggccgcuucacccccaaacucggcucacucgaaaucuccaccgaauccggcgacuucgaccagaaucaaccuacccgcuucacccccgucggaaucggcgucgaccacgaagcugacuuccaacaauggacccucccugauuacgccggucaauucacacacaacaugaaccucgccccagcaguagcaccaaacuucccaggagagcaacuccucuucuuccgaucccaauuacccucuuccggaggacgcucgaacggaauccuagacugucucgucccccaagaauggguacaacacuucuaucaagaauccgcacccucacagacccaagucgcccuaguacgcuacgucaaccccgacaccggacgcguccuauucgaagccaaacuacacaagcucggcuucaugaccaucgcaaaauccggcgacucaccaaucaccgucccacccaacggauacuuccgcuucgaaagcugggucaaccccuucuacacacucgcccccaugggcacaggcaacggacgccgacgcauacaauaa

SEQ ID NO: 35525 - RNA, 1623 nt, Artificial Sequence
  derived and/or modified sequence opt11 from capsid_protein_VP1__Norovirus__AII02665
augaaaauggcauccaacgacgcuaaccccucagacggcucagccgccaaucuaguccccgaaguauccaacgaaguaauggccuuagaaccaguagucggcgccgcuauagcagcacccguugccggccaacaaaacgucaucgacccauggauacgcaauaacuucguacaagccccuggcggugaguucaccgucucaccccguaacgcccccggcgaaauacuaugguccgcuccacucggcccagaccucaacccauaccucucccaccucgcccgaauguacaacggcuacgcgggcgguuucgaaguccaagucaucuuagccggcaacgccuucacagccggcaaaaucaucuuugcagccgugccacccaacuuccccacagaaggacuaucccccucacaagucaccauguucccccacauaaucgucgacguuagacaacuagaacccguacucaucccccuccccgacguccguaacaacuucuaccacuacaaccaaacuaacgacagcaccauaaaacucaucgccaugcucuacaccccacuccgugcaaacaacgcaggcgaagacguauucacagucuccugccgcguccucaccagacccuccccagacuucgacuucaucuuccucguaccuccaaccguugaaucucgcaccaaacccuucaccgucccuauacucacagucgaagaaaugacaaacucccguuuuccaaucccacucgaaaaacuauucacuggucccuccggggcauucgucguacaaccccaaaacgggcgcugcaccaccgacggcguacuccucggcaccacucaacuuucccccgucaacaucuguaccuucagaggugacgucacacacauagccggcucacgcaacuauaccaugaaccucgccucccucaacuggaacaauuacgaccccacugaagaaaucccggcaccucuuggcacccccgacuuuguaggcaaaauccaaggcguccucacacaaaccaccaaaggcgacggcuccacaagaggccauaaagccacaguauauaccggauccgcacccuucacccccaaacucggauccguacaauucuccaccgacacagaaaaugacuucgaaacccaccaaaacacaaaauucacuccagucggcgucauacaagacggaggcacaacccaccgcaacgaaccccaacaauggguccucccaucauauagcggucgcgacguacacaacguccaucucgcccccgccguagcccccacauuccccggagaacaacuccucuucuuccgcuccaccaugccaggcugcagcggauaccccaauauggaccuugacugccuccuaccacaagaauggguucaacacuucuaccaagaagccgcccccgcccaauccgacguggcacuccuaagauucguaaaccccgacacaggacgcguccucuucgaaugcaaacuucacaaauccggcuacgucaccgucgcacauacaggacaacacgaccucguaaucccacccaacggcuacuuccgauucgacuccugggucaaccaauucuacacucuagcacccaugggcaacggaaccggacgccgccgcgcccuuuaa

SEQ ID NO: 35526 - RNA, 1623 nt, Artificial Sequence
  derived and/or modified sequence opt11 from capsid_protein_VP1__Norovirus__AII02668
augaaaauggccuccaacgacgcgaacccuuccgacggcuccgccgccaaccucgucccagaaguguccaacgaagucauggcccucgaacccgucguuggugccgcaaucgccgcccccgucgccggccaacaaaacgucauagacccauggauucgcaacaacuucguacaagcacccggaggcgaguucacggucucccccagaaacgcccccggcgaaauauuauggucugccccucucggacccgaucugaacccuuaccuaucacaccuagccagaauguacaacggcuacgcuggcggguuugaaguccagguaauccucgccggcaacgccuucaccgccggaaaaaucaucuucgccgccguaccaccaaacuuccccaccgaaggacuuuccccaucacaagucacuauguucccccacauaauagucgacguccgccaacuugaaccaguccucaucccacucccugacguccgaaacaacuucuaccacuacaaccaaacaaaugauuccaccaucaaacuaaucgcaaugcuuuacacaccccuacgcgccaacaaugcuggugaagacguauucaccgucagcugccgcguccucacacgcccuucucccgacuuugacuucaucuuccuaguucccccaaccgucgaaucacgcaccaaaccauucaccgucccaauacucaccguagaagaaaugacaaauucccgcuuccccauaccccucgaaaaacuauucaccggacccuccggcgcguucgucguccaaccacaaaacggucgcugcaccaccgacgguguacugcucggcaccacucaauuaucucccgucaacaucuguaccuuccgcggcgacgucacccacaucgccggcucacgaaacuacacuaugaaccucgcuucgcucaacuggaacaacuacgaccccacagaagaaaucccugcaccccucggcacccccgacuucguaggcaaaauccaaggcgucuuaacccaaacaaccaaaggagacggcucaacuagaggccacaaagccacagucuacaccggcucagcaccauucaccccaaagcucggcucaguccaauucucaaccgacaccgaaaacgacuucgaaacccaccaaaacaccaaauucacccccguaggcgucauccaagacggcggaaccacccaccgcaacgaaccccaacaauggguccuucccuccuacuccggacgagacguacacaacguccaccucgccccugccguugcaccaaccuuuccgggcgaacaacuccuuuucuuuagaucuacaaugccaggaugcucaggauacccaaacauggaccucgacugccuacucccccaagaauggguccaacauuucuaccaagaagccgcacccgcacaauccgacgucgcacuacuacgauuugucaauccagacaccggccgcguccuauucgaauguaaacuucacaaauccggcuacguaaccgucgcccacacaggacaacacgaccucgucauaccucccaacggauacuuccgauucgacagcugggucaaccaauucuacacacuugcacccaugggaaacggcaccggccgccgacgagcccucuag

SEQ ID NO: 35527 - RNA, 1623 nt, Artificial Sequence
  derived and/or modified sequence opt11 from capsid_protein_VP1__Norovirus__AII02671
augaaaauggccucaaacgacgccaaccccuccgacggauccgccgcgaaccucguccccgagguuuccaacgaaguuauggcccuagagcccgucguaggcgcugccaucgccgcgccaguggccggacaacaaaacguuaucgaucccuggauucgaaacaacuucguccaagccccaggaggcgaguucacaguaucccccagaaacgcccccggagaaauccuauggucggcaccccucggccccgaucucaacccauaccucucccaccuagcccgcauguacaauggauacgccggcggauucgaaguccaagucauacuagccggcaacgccuucaccgccggcaaaaucauauucgccgccgucccacccaacuuccccaccgaaggcuuaucccccucacaagucaccauguucccccacauuauagucgacguccggcaacucgaacccguccucaucccccuccccgacguccgcaacaauuuuuaccacuacaaccaaaccaacgacucgacaauaaaacucauagccaugcucuauaccccacuacgggccaacaacgccggcgaagacguauucaccguguccugccgaguacucacccggcccucccccgacuuugacuucauauuccuagucccucccacgguugaaucccguaccaaacccuucacagucccuauccucacagucgaagaaaugacaaacucucgcuuccccauaccccuagaaaaacuauucaccggacccuccggagccuucguaguccaaccccaaaacgguaggugcaccaccgacggcguccuccucggcacaacucaacucucucccgucaacaucuguaccuucagaggcgaugucacccacaucgcuggcucuagaaacuacaccaugaaccuagccuccuuaaacuggaacaacuacgaccccacagaagaaauccccgcaccacucggcacacccgacuucgucggcaaaauccaaggaguccucacccaaaccaccaaaggagacggcucaacacgcggccacaaagcgacugucuacaccggcagcgcccccuuuacccccaaacucggauccguacaauucuccacagacaccgaaaacgacuucgaaacccaccaaaacaccaaauucaccccagucggcgucauccaagacggaggaaccacccaucguaacgaaccccaacaauggguacuaccaucuuacucaggucgagacguacacaacguacaccucgcuccagcaguagcccccacauuccccggcgaacaacuacuauucuuccgcuccacaaugccaggcugcuccggcuaccccaacauggaccucgacugccuccuaccucaggaauggguccaacacuucuaccaagaagccgcacccgcucaguccgacgucgcucuccuccgcuucguaaacccagacaccggccgaguccuguucgaaugcaaacuacacaaauccggcuaugucaccgucgcccacaccggacaacacgaccuagucauaccacccaacggcuacuuccgcuucgacuccugggucaaccaauucuauacccuagcccccaugggaaacggaaccggacgaagacgcgcucuuuaa

SEQ ID NO: 35528 - RNA, 1623 nt, Artificial Sequence
  derived and/or modified sequence opt11 from capsid_protein_VP1__Norovirus__AII02674
augaaaauggcauccaacgacgccaaccccuccgacgggucagcugccaaccucguccccgaagucaacaacgaaguaauggcccucgaacccguagucggagccgccauagccgcaccagucgccggccaacaaaacgucaucgacccauggauccgcaacaacuucguccaagcacccggcggcgaauuuaccguaagcccccggaacgcgccuggcgaaauccuaugguccgcucccuuagguccagaccucaacccauaccucucccaccucgcccgcauguauaacggcuacgcaggcggcuucgaaguacaaguaauccuagccggcaacgcauucaccgccgguaaaaucaucuucgccgccgucccacccaacuuccccacugaaggccuaucaccaucccaaguaaccauguucccccacaucaucguagacguccgccaacucgaaccaguucuaaucccccuaccggauguacgaaacaacuucuaccacuacaaccaaucaaacgacucuaccaucaaacucaucgccaugcuguacacaccccuccgcgccaacaacgcaggcgaagacgucuucaccguauccugccgcguccuuacaaggccauccccagacuucgacuucaucuuccuagucccacccaccguagaaagcagaacuaaacccuucaccgucccaauccuaaccgucgaagaaaugacaaauucccgauuccccaucccccucgaaaaacucuucaccggacccucuggcgccuucaucguucagccccaaaacggcagaugcaccaccgacggcguccuacucggcaccacccaacuaucccccguaaacauaugcaccuuccgcggcgacgucacucacaucgccggcagccgcaacuacacaaugaaccucgcuucacucaacuggaacaacuacgacccaacagaagaaauccccgcaccccuuggcaccccugacuucgucgguaaaauucaaggcguacucacccaaaccaccaaaggcgacggcuccacccgaggacauaaagccaccguauacacaggcuccgcccccuucacccccaaacucggauccguacaauucagcacagacaccgaaaacgacuucgaagcccaccaaaauacaaaauucaccccaguaggcgucauacaagauggaggaaccacacaccgaaaugaaccccaacaauggguccuccccuccuacucuggacgagacguccauaacguucaccucgcaccagccgucgcccccaccuuucccggcgaacaacuccucuucuuccgcucaacaaugccaggcugcuccggcuaccccaacauggaccuagacugcuuacuaccacaagaauggguucaacacuucuaucaagaagcagccccagcacaguccgacgucgcacuacuucgcuucgucaaccccgacaccggccgcguccucuuugaaugcaaacuccacaaauccggcuacgucacaguggcacacaccggccaacaugaucucgucaucccacccaacggcuacuuccgcuuugacuccugggucaaccaauucuacacccuugcccccaugggcaacggaaccggacgccgucgcgcccucuaa

SEQ ID NO: 35529 - RNA, 1623 nt, Artificial Sequence
  derived and/or modified sequence opt11 from capsid_protein_VP1__Norovirus__AII02677
augaaaauggcgucauccgacgccaaccccuccgacggaucgacugccaaccuaguacccgaaguaaacaacgaagucauggcacuagaacccgucgucggcgccgccaucgccgcccccguagcaggccaacaaaacguaaucgacccuuggauacgcaacaacuucguccaagcccccggcggagaguucaccgucucaccacguaacgcccccggcgaaauccucuggucagcaccccucggcccugaccuaaacccauaucucagccaccucgcccgcauguacaacggcuacgccggcggcuucgaaguccaaguaauacuagccggaaacgccuucaccgccggaaaaauaaucuucgcagccguuccgcccaauuuccccacagaaggccucagcccaucccaagucaccauguuuccacacaucaucguagacguccgccaauuagaaccagucuuaaucccccuucccgacguacgcaacaacuucuaccacuacaaucaauccaacgacccgacaaucaagcuaaucgccaugcucuacacaccccuccgcgcaaacaaugccggcgacgacgucuucaccguuuccugccgaguacucacccgcccuucucccgacuucgacuucaucuuccucgucccacccaccguagaaucccgcaccaaacccuucucaguccccguccucaccguagaagaaaugacuaacagccguuuccccauaccccuagaaaaacucuucacgggacccuccuccgcuuucguaguacaaccccaaaacggccgaugcacaaccgacggaguccuacucggaaccacccaacuuucaccaguaaacaucugcaccuuccgcggcgacgucacccacauaucaggcucccgcaacuacaccaugaacuuagccucacagaacuggaacuccuacgauccuaccgaagaaaucccugccccucuagguaccccugacuuugucggcaaaauccaaggaguccucacacaaaccacacgcaccaacggauccacacgagggcacaaagcaacagucuacacaggaagcgcugacuucagcccaaaacuaggacgaguccaauuugcaaccgacacagacaacgacuucgaaaccaaccagaacacgaaauucacucccguaggcgucauacaagacggcuccaccacaccccgcaacgaaccccaacaauggguacucccuagcuacuccggccguaacauccacaacguacaccucgcccccgccgucgcaccaaccuucccaggcgaacaauuacucuucuuccgcucaaccaugcccggcugcuccggcuaccccaacauggaccuugacugcuuacucccccaagaauggguccaauauuucuaucaagaagcggcccccgcucaauccgacgucgcccuucuccgguucgucaaccccgacacaggccgaguccucuucgaaugcaaacuccacaaaucaggcuacgucacaguagcccacacaggccaacacgaccuagucaucccacccaacggcuacuuccgcuucgacuccugggucaaccaguucuacacccuagcacccaugggcaauggcacgggcagacgccgcgcccucuaa

SEQ ID NO: 35530 - RNA, 1623 nt, Artificial Sequence
  derived and/or modified sequence opt11 from capsid_protein_VP1__Norovirus__AII02680
augaaaauggcguccaacgacgccaaccccuccgacggauccgcggccaaccucguccccgagguuucaaacgaaguaauggcccuugaacccguugucggagcugccaucgccgccccugucgccggucaacaaaacguaauagacccauggauccgcaacaacuuuguccaagccccuggaggcgaguucaccgucucaccccgcaacgcucccggcgaaauucucuggucagccccucucggccccgaccucaaccccuaccucucccaccucgcaagaauguacaacggcuacgccggaggauucgaaguacaagucauccucgcuggcaacgccuucacagcuggcaagaucaucuucgccgcaguaccacccaacuuccccaccgaagguuuaucccccucccaagucacaauguuuccccacaucaucgucgacguccgccaacuagagcccguccucauaccccuuccagacgucagaaacaacuucuaccacuacaaccaaaucaacgaccccaccaucaaacuaaucgcaaugcuuuacacgccccuccgcgcaaacaacgcuggcgaagacgucuuuaccgucuccugccgaguucucacccgaccaagcccagacuucgauuucaucuuccucgucccacccaccgucgaaucucgcacaaaacccuucaccguaccuauccucacaguagaagaaaugacaaacucccgcuuccccauacccuuggaaaaacucuucacaggccccucaggagccuucguuguccaaccccaaaacggccgcugcaccaccgacggcguccuccuuggcaccacccaacucucccccgucaacaucugcaccuucagaggcgacgucacccacaucgccggaucacgaaacuacaccaugaaccuggccagccucaacuggaacaacuacgaccccacugaagaaauacccgccccacucggaacccccgacuucgucggaaaaauccaaggcguacuaacacaaaccacaaaaggagacggauccacacgcggccacaaagccacugucuacacaggcagcgcccccuucacccccaaacucggauccguccaauucuccacugacaccgaaaacgacuuugaaacccaccaaaacacuaaauucacacccguaggcgucauccaagacggauccaccacacaucgcaacgaaccucaacaauggguacuuccaagcuacuccggccgcgacauccacaacguacaccuagcacccgccguugcacccacuuucccaggcgaacaacuucucuucuuccggucaaccaugccaggcugcucaggcuacccaaacauggaccuagacugucuacuaccccaggaauggguacaacacuucuaccaagaagccgcccccgcacaauccgaugucgcacuccuccgcuucgucaaccccgauacuggcagaguccuauucgaaugcaaacuacacaaaucaggcuacgucaccguggcacacacaggccaacacgaccuagucauaccacccaacggcuacuuccgcuucgacuccugggucaaccaauucuauacacucgcgcccaugggaaacggcaccggccgccgccgcgcccucuag

SEQ ID NO: 35531 - RNA, 1623 nt, Artificial Sequence
  derived and/or modified sequence opt11 from capsid_protein_VP1__Norovirus__AII02683
augaaaauggcaaguaacgacgcuaaccccuccgacgggucagccgccaaccuagucccugaagucucaaacgaagucauggcccucgaacccguugucggcgccgcuaucgccgcccccgucgccggccaacaaaaugucaucgacccauggauccgcaauaacuucguacaagccccuggaggggaguucacugucagcccccgaaaugcccccggagaaauccucuggucagcaccacuaggacccgaccuuaaccccuaccucucacaucuagcacgcauguacaacggauacgccggaggcuucgaaguccaaguaauacucgcaggcaacgccuuuacugccggaaaaaucaucuucgcagcuguucccccaaacuuccccacugaaggccuauccccaucccaagucacaauguucccacacaucaucguagacguccgucaacucgaacccguccucauaccccuccccgacguacgcaacaauuucuaccacuacaaccagacaaacgacucaacaauaaaacucaucgccaugcucuacaccccacuacgcgccaacaacgccggagaagacgucuucaccgucucaugccgaguccucacccgacccucuccugacuucgacuucaucuuccuaguaccgcccaccgucgaaucacgcacgaaacccuucaccguccccauacuuaccguagaagaaaugaccaacucccgcuuccccaucccucucgaaaaacucuucaccggccccuccggcgccuucgucguccaaccccaaaacggacgcugcaccaccgacggcguacuccucggaacaacgcagcuauccccagucaacaucugcacuuuccgcggcgacgucacacacauagcaggcucaagaaacuacaccaugaaccuugccagccuuaacuggaacaacuacgacccaacagaagaaaucccagcaccccuaggcaccccagacuuuguaggcaagauacaaggcguccuuacccaaacaaccaaaggcgacggcuccacccgaggacacaaagcuaccguauacaccggcagcgccccuuucacacccaaacuaggaucaguccaauucuccacugacaccgaaaacgacuucgaaacccaccaaaacacuaaauucacacccgucggagucauccaagacggcggcaccacacaucguaacgagccacaacaauggguccucccaucauacuccggccgugacguacacaauguccaucuugcccccgccgucgccccaacauuccccggcgaacaacuccuauucuuccgcucaaccaugccaggcugcuccggcuacccaaacauggaccucgacugccuccucccccaagaauggguacaacacuuuuaccaggaggccgcacccgcccaguccgacgucgcccuacuccgcuucgucaacccugacacaggccgcguccuauucgaaugcaaacuccacaaauccggcuacguaacaguugcccacacaggccaacacgaccucguaauacccccaaauggauacuuccgcuucgacuccugggucaaccaauucuacacucucgccccaaugggcaacggcaccggccgccgacgagcccuauaa

SEQ ID NO: 35532 - RNA, 1623 nt, Artificial Sequence
  derived and/or modified sequence opt11 from capsid_protein_VP1__Norovirus__AII02689
augaaaauggcuuccaacgacgccaaccccuccgacggcucugccgccaaccucguccccgaaguuuccaacgaagucauggcacucgagcccguagucggagccgccaucgccgcaccagucgccggucaacaaaacgucaucgacccauggauccgcaacaacuucguccaagcccccggcggagaguucaccguaagcccccggaacgcccccggcgaaauacucuggucagccccacuaggaccagaccucaacccuuaccuuucccaccuagcgcgaauguacaacggcuacgccggcggauucgaaguccaaguaauacucgccgguaacgcauucacugccggaaaaaucaucuucgccgcagucccaccaaacuuccccacugaaggucucucccccucucaaguaaccauguucccccacaucauagucgacguccgccaacucgaacccguccucauaccccuccccgacguccgcaacaacuucuaccacuacaaccaaacaaacgauuccaccaucaaacucauagccaugcuauacacaccccuucgcgccaacaacgccggcgaagacgucuucaccgucucaugccgaguucuaacccgccccuccccggacuucgacuucaucuuccucguacccccgaccgucgaaucccgaaccaaacccuucacaguccccauccucaccgucgaagaaaugaccaacucccguuucccaauuccacuagaaaaacucuucaccggccccuccggcgccuucgugguccaaccccaaaacgguagaugcaccaccgacggcguccuccuaggcaccacccaacugucccccgucaacauaugcacauuccguggagacguaacucacaucgccggaucgcgcaacuacaccaugaaucucgcgucccucaacuggaacaacuacgacccaaccgaagaaauccccgcuccccuaggcacccccgacuucguaggcaaaauccaaggcguccucacccaaaccaccaaaggagacggaagcacccgaggccacaaagccaccguauacacuggcucagccccuuuuacacccaaacucggauccguccaauucuccaccgacaccgaaaacgacuucgaaacacaccaaaacaccaaauucaccccagucggcguaauacaagacggcggcaccacgcaccgcaacgaaccccaacaauggguccucccaucauacucgggccgcgacguacacaacguacaccuagccccagcuguagccccuaccuucccaggagaacaacuccuauucuuucgcucaacaaugccaggaugcuccggcuaccccaacauggaccucgacugccugcucccccaagaauggguucaacacuucuaucaagaagcagcgcccgcccaaagcgacgucgcacuccuccgauucgucaaccccgacacaggacgaguacuuuucgaaugcaaacuacacaaaucaggcuacgucaccgucgcccauaccggccaacaugaccucgucaucccacccaacggcuacuuccgauucgacuccuggguaaaccaauucuacacucucgcucccaugggcaauggaacaggacgacgccgcgcacucuaa

SEQ ID NO: 35533 - RNA, 1623 nt, Artificial Sequence
  derived and/or modified sequence opt11 from capsid_protein_VP1__Norovirus__AII02692
augaaaauggcuucaaacgacgccaaccccagcgacggcagcgccgcuaacuuggucccagaagucuccaacgaagucauggcacuugaacccguagucggagccgccaucgcagcacccgucgccggccaacaaaacgucaucgacccauggauccgcaacaacuucguacaagcaccgggcggcgaguucacagucuccccaagaaacgcccccggagaaauccucugguccgcaccccucggcccugaucucaaccccuaccucucccaccucgcccgaauguacaacggcuacgcaggaggcuuugaaguccaggucauacucgcagguaacgcauucacugccggcaaaaucauauucgccgccgucccacccaacuuccccaccgaaggccucucccccucacaaguaaccauguucccccacaucauugucgacguacgccaacucgaaccaguacucauaccccucccagaugucagaaacaacuuuuaccacuauaaccaaacaaacgacuccacaaucaaacucaucgcaaugcuuuacacaccccucagagcaaacaacgccggcgaagauguauucaccgucuccugccgaguucucacccgccccucccccgacuucgacuucauuuuucucguacccccaacagucgaauccagaaccaaaccuuucaccgucccuauacucaccgucgaagaaaugacaaacucacgauucccuaucccacucgaaaaacucuucaccggacccuccggcgccuucgucguccaaccccaaaacggccgcugcacaacugacggcguccuccucggaaccacucaacucuccccgguaaacaucugcgcuuucagaggagacguaacccacaucgcugguuccagaaacuacaccaugaaccucgcauccuuaaacuggaacaacuacgacccaaccgaagaaauaccagcaccccuuggcacacccgacuucguaggaaaaauacaaggcguccucacacaaaccacuaaaggggacggcagcacccgcggccacaaagccacaguauacaccggaagcgcacccuucacacccaaacucggauccguccaguucuccaccgacaccgaaaacgacuucgaaacccaccagaacaccaaauucacccccgucggcgucauccaagacggcggaaccacacacagaaacgaaccacaacaguggguacucccuucauauagcggcagagauguccauaacguccaccucgccccagccgucgcccccaccuuccccggugaacaacuucucuucuuccguuccaccaugcccggaugcuccggauacccuaauauggaccucgacugccuccucccccaagaauggguccaacacuucuaccaagaagccgcccccgcccaaucagacgucgcacuacuaagauucgucaaccccgauaccggucgaguccucuucgaaugcaaacuccacaaauccggcuacgucaccguugcucacacaggccaacacgaccuaguaaucccucccaacggcuacuucagauucgacagcugggugaaccaauucuacacucuagcgcccaugggaaacggaaccggacgaagacgcgcccucuaa

SEQ ID NO: 35534 - RNA, 1623 nt, Artificial Sequence
  derived and/or modified sequence opt11 from capsid_protein_VP1__Norovirus__AII02695
augaagauggccucuaacgacgccaaccccuccgacggcuccgcugcaaacuuaguacccgaaguauccaacgaaguuauggcccuugaacccgucgucggcgccgccaucgccgcccccguagcaggacaacaaaacguaauagaccccuggauacgaaauaacuucguccaagcccccggcggagaguucaccgucucuccacgcaacgcccccggcgaaauacuaugguccgcuccccuaggacccgaccuaaauccauaccucucccaccucgcccguauguacaacggauacgccggcggcuucgaaguccgcgucauccucgccggcaacgcuuucaccgcaggaaaaaucaucuucgcagccguaccacccaacuuccccacagaaggccuaagcccaucccagguuaccauguucccccacaucauagucgacguuagacaacuagaacccguccucaucccccuccccgacguacguaacaacuucuaccacuauaaccagaccaacgacucaaccauuaaguuaauagcuaugcuauacacuccccuaagagccaacaacgccggagaagacguauucaccguauccugccgaguccucacccgcccaucccccgacuucgacuuuaucuuccucguacccccaaccgucgagucccgaaccaaacccuucacaguucccauccucaccgucgaagaaaugacaaauucccgcuuccccaucccccucgaaaaacucuucaccggccccucuggcgcauucguaguccaaccccaaaacggacgcugcaccaccgacggcguccuccuaggcaccacccaacuaucaccggucaacauuugcaccuuccgaggagacguaacccacauagcaggcucccgcaacuacaccaugaaccucgccagccuuaacuggaauaacuacgaccccaccgaagaaauccccgcaccacucgggacccccgacuucgucggaaaaauacaaggcguccucacccaaaccacaaaaggcgacggcagcacccguggccacaaagccacaguauacaccggcuccgcgcccuucacccccaaacucggauccguacaauucucaacagauaccgaaaacgacuucgaaacccaccaaaacacaaaauuuacacccgucggcgucauacaagacggaggcacaacacaccgcaaugaaccccaacaauggguucuccccuccuacucaggucgcgacguacacaauguccaccucgcacccgcuguagccccaacauuccccggagaacaacuacucuucuuccgaucaaccaugccaggaugcuccggcuaccccaacauggaccuagacugccuccuaccccaagaauggguccaacacuucuaccaagaagcugcccccgcccaaucagacgucgcacuacuacgcuucgucaacccagacacaggccgagugcuuuucgaaugcaaacugcacaaauccggauacgugaccgucgcacacaccggccaacacgaccucgucaucccucccaacgguuacuuccgcuucgacucuugggucaaccaauucuacacccucgcccccaugggaaacggaaccggccgccggcgugcccucuga

SEQ ID NO: 35535 - RNA, 1623 nt, Artificial Sequence
  derived and/or modified sequence opt11 from capsid_protein_VP1__Norovirus__AII02698
augaaaauggccucuaacgacgccaaccccuccgacggcucagccgcuaaccucguccccgaaguaucaaacgaagucauggcacuugaacccgucgucggagcugcgaucgccgcccccguagccggucaacaaaacgucaucgaccccuggaucagaaacaacuucguccaagcccccgggggcgaauuuacagucucaccccgcaacgcccccggcgaaauacucuggucugcaccccuaggucccgaccucaaucccuaccucucccaccuugcccgcauguacaacggauacgccggcggcuucgagguccaggucauccucgcaggaaacgccuuuacagccggcaaaaucaucuucgccgccguaccucccaacuucccaaccgaaggccuauccccuucacaaguaacaauguucccccacaucaucguugauguccgacaacucgaacccguccucaucccccuccccgacguccgcaauaauuucuaccacuauaaccagaccaaugacuccacuauaaaauuaaucgccaugcuauacacuccacuccgcgccaacaacgccggcgaagacgucuucaccguauccugccgcgugcuaacacgccccucccccgacuuugauuucauauuccucguuccacccaccgucgaaucucgaacaaaacccuucacggugccaauccucacagucgaagaaaugacaaacagccgauuccccaucccccucgaaaaacuauucaccggacccuccggcgccuucguaguucaaccccaaaacggccgaugcacuaccgacggcguccuacucggcaccacucaacuuucccccguuaacaucugcacauuucgcggagacgucacccacauagcgggcucacgcaauuacaccaugaaccuagcaucgcucaacuggaacaacuacgaccccaccgaagaaauccccgccccacucggcacccccgacuucgucggaaaaauccaaggaguacuaacacaaaccacaaaaggagacggauccacccgcggacacaaagccacaguuuacaccgguuccgcccccuuuacaccaaaacuaggcuccguccaauucucaaccgauaccgaaaacgacuucgaaacccaccaaaacaccaaauucacacccguaggugucauacaagacggcgggaccacccaccgaaaugaaccacaacaauggguccucccauccuacuccggacgagacguucauaacguccaccuagcccccgccgucgccccaacuuuccccggcgaacaacuccucuucuuucguuccaccaugccuggaugcuccggcuauccaaacauggaccuagacugccuccucccacaagaauggguccaacacuucuaccaagaagccgcacccgcccaaucagacguagcccuccuccgauucgucaaccccgacacuggccgcguacuauucgaaugcaaacuccacaaaucaggcuaugucaccguugcccacaccggccaacacgaccucgucaucccucccaacggauacuuccgauucgacuccuggguaaaccaauucuacacacucgcacccaugggcaacggcaccggccgacgacgugcccucuaa

SEQ ID NO: 35536 - RNA, 1623 nt, Artificial Sequence
  derived and/or modified sequence opt11 from capsid_protein_VP1__Norovirus__AII02701
augaagauggccucuaacgacgcaaaccccucagacggcuccgcagcaaaucucguucccgaagucucaaacgaagucauggcacucgaacccguugucggcgcugcuauagccgcccccgucgcuggccagcaaaacguaaucgacccuuggauccgaaacaacuucguccaagcacccggaggcgaguucaccgucucaccccguaacgccccgggcgaaauccucuggucagccccucucggaccagaccuuaaccccuaucucucccaucuagcacgcauguacaacggcuacgcaggcgguuucgaaguacaagugauccucgcaggcaacgccuucaccgccggcaaaaucaucuucgccgccgucccacccaacuuccccaccgagggccuauccccaucccaagucacgauguucccacacaucauaguagauguacgccaacucgaacccguccucauuccccuacccgacguccgcaauaacuuuuaccacuacaaucaaaccaacgacucaaccauaaaacuuaucgccaugcuuuacacaccccuucgagccaacaacgccggggaggacguguuuaccgucuccugucgaguacucacacgcccaucaccagacuucgauuucauauuccucgucccacccacagucgaaucgagaaccaagccuuucaccgucccuauccucaccguagaagaaaugacaaacuccagauuucccaucccccuagaaaaacuauucacaggccccuccggcgccuucgucguccaaccacaaaacggccgcugcaccacagacggcguacuacucggcaccacccaacucucacccgucaacaucuguacuuuccgaggcgacguaacucacaucgccggcucccgcaacuacaccaugaaccucgcaucccucaacuggaacaacuacgacccaaccgaagaaauccccgcaccccucggcaccccagacuucgucggcaaaauucaaggcguacugacccaaaccaccaaaggagacggcucuacccgaggacacaaagccaccgucuauaccgguucagccccauucacaccaaaacucggcucuguccaauucuccaccgacaccgaaaacgacuucgaaacccaccaaaacaccaaauucaccccagucggaguaauacaagacggcggcacaacucaccgcaacgaaccucaacaauggguccuccccucauacuccggcagagacguccacaacguacaccuagcacccgccgucgcacccacuuuccccggagagcaacuccuauuuuuccgcagcacaaugccuggcugcucuggauaccccaacauggaccucgacugccuccucccccaagaauggguacaacacuucuaccaggaagccgcaccagcacaaucggacgucgcccuccucagauucgucaaccccgacaccggccguguccuauucgaaugcaagcuccacaaauccggcuauguuacagucgcccauaccggccaacacgaccucgucauuccacccaacggguauuuccgcuucgacucuugggucaaccaauucuacacccucgcacccaugggcaacggcaccggccgcagacgcgcccuuuaa

SEQ ID NO: 35537 - RNA, 1623 nt, Artificial Sequence
  derived and/or modified sequence opt11 from capsid_protein_VP1__Norovirus__AII02707
augaaaauggccuccaacgacgcaaaccccagcgacggcuccgccgccaaccucguaccagaagucuccaacgagguaauggcccucgaacccgucgucggcgcagcaaucgccgccccagucgccggacaacaaaacguaaucgaccccuggauccggaacaacuucguacaagcaccaggaggcgaguucacugucucuccgcgcaacgcccccggagaaauccuaugguccgcuccccucggacccgaccucaacccguaccucucucaucucgcccgcauguacaacggauacgccggggguuucgaaguccaaguaaucuuagcuggaaacgcauucaccgccggcaaaaucaucuucgccgcagucccacccaacuuucccaccgaaggucucucacccucccaaguuaccauguucccacacaucaucgucgauguccgucaacucgaaccaguccucaucccccuccccgacguacgcaacaacuucuaccacuacaaccaaacaaaugacucaaccaucaaacucaucgcaaugcuuuacaccccucuacgagcaaacaacgccggugaagacgucuucaccgucuccugccgaguucucacccgcccuuccccagacuucgacuucaucuuccucguuccuccaacagucgaaucccgcaccaaacccuuuacuguacccauccuaaccgucgaagaaaugaccaacuccagauuccccaucccccucgaaaaacucuucaccggaccaucuggcgccuucgucguccaaccccaaaacggccgaugcaccaccgacggaguacuacucgguacaacccaacucuccccagucaacaucugcaccuuccguggcgacgugacccacauugcgggcucccgcaacuacacaaugaaccuagcaucacucaacuggaacaacuacgaccccaccgaagaaauccccgcuccgcucggaacacccgacuucgucggcaaaauccaggggguccuaacccaaacaacaaaaggcgacggcuccacccgcggccacaaagccaccgucuacacugguucagcucccuuuacccccaaacuagguucaguccaauucuccaccgacacagaaaacgauuucgaaacacaccagaacacaaaauucacccccgucggugucauacaagacggcggcaccacccaccgcaacgaaccccaacaauggguccucccaucauacagcggccgcgacguccacaacguccaccuagccccagcagucgcccccaccuucccaggcgaacaacuccucuucuuuagaucuacaaugcccggcugcucaggauaccccaauauggaccuagacugccuucuaccacaagaauggguucaacacuucuaucaagaagccgcaccagcacaauccgauguagcucuccuccgauucguaaacccugacaccggccgcguccuauucgaaugcaaacuucacaaaucaggcuauguuaccgucgcccacaccggacaacacgaccucgucauacccccaaacggcuacuucagauucgacuccugggucaaccaauucuacacccucgcacccaugggcaauggcaccggccgcagacgagcccucuag

SEQ ID NO: 35538 - RNA, 1623 nt, Artificial Sequence
  derived and/or modified sequence opt11 from capsid_protein_VP1__Norovirus__AII02710
augaaaauggcauccaacgacgccaaucccuccgacggaucagcagccaaccuagucccagaagucagcaacgaagucauggcccuagaaccuguagugggugccgccauagccgcccccguagcaggccaacagaacgugaucgacccauggauacgcaacaacuucguucaagcacccggcggagaguucaccguuucgccccgcaacgcuccuggcgaaauauuaugguccgccccacucggacccgaccucaauccuuaccuuucccacuuagcccgcauguacaauggauacgccggcggcuucgaaguccaagucauccuagccggcaacgcauucacagcuggcaaaaucaucuucgcagccguacccccaaacuuccccaccgaaggccucuccccaucccaagucaccauguucccgcacauaaucgucgacguccgccaacucgaacccguccucauaccccugcccgacguaagaaacaacuucuaccacuacaaccaaacaaacgacuccacaaucaaacucaucgcaaugcucuacacaccccuccgcgcaaacaaugccggcgaagacgucuucaccgucuccugccgcguacuaacccgcccaucaccagauuucgacuucaucuuccucguaccacccacagucgaaucgcgcaccaaacccuucaccguccccauccuuaccgucgaagaaaugaccaacucccgauucccaauaccccucgaaaaacucuucaccggacccucuggagccuucgucguccaaccccaaaauggucggugcaccacagacggcguccuccucggcaccacacaacuaagcccggucaacaucugcaccuuccgaggagacgucacccacaucgccggaucccgcaacuacaccaugaaccucgcauccuuaaacuggaacaacuacgauccgaccgaagaaaucccggcaccccucggaacccccgacuucguaggaaaaauccaaggcguccucacacaaaccacaaaaggagacgguuccacccgcggacacaaagccacaguuuacaccggauccgcccccuucaccccaaaacuuggaucaguacaauuuuccaccgacacagaaaacgauuucgaaacacaccaaaacaccaaguucacacccgucggaguaauccaagacggcuccaccacccaccgaaacgaaccacaacaauggguucuccccagcuacuccggccgagauguccauaacguccaccucgcucccgcggucgcacccacuuuccccggagaacagcuucucuuuuuccgaucaaccaugccaggaugcuccggcuaccccaacauggaccuagauugcuuacucccccaagaauggguccaacacuucuaccaagaagccgcccccgcucaauccgauguagccuuacuccgcuucguaaaccccgacaccggaagaguccuauucgaaugcaaacuucacaaauccggauacgucaccgucgcccacacaggccaacacgaccucguaaucccucccaacggcuacuuccgcuucgacagcuggguaaaccaauucuacacccucgcccccaugggcaacggcaccggacgacgacgagcacucuaa

SEQ ID NO: 35539 - RNA, 1647 nt, Artificial Sequence
  derived and/or modified sequence opt11 from capsid_protein_VP1__Norovirus__AII02713
augaaaauggccuccaacgacgccgcacccuccaacgacggagccgcaggccucguccccgaaauaaacagcgaagccauggcacucgaacccgucgccggagcugccaucgccgccccacucaccggacaacaaaacauaaucgacccauggaucaugaacaauuuuguccaagccccaggaggcgaguucaccgucucaccccgaaacucccccggcgaaguucuccucaaucucgaacuaggcccagaaaucaacccauaccuugcccaucucgcccgaauguauaauggcuacgcuggaggauucgaaguucaagucguacuugcgggcaacgccuuuaccgcaggcaaaaucauauuugccgccauacccccuaacuuuccaaucgacaaucucuccgcagcccaaaucacaaugugcccccacgucauagucgacguccgccagcucgaacccguuaaccugccaaugcccgacguccguaacaacuucuuucacuacaaccagggcuccgacuccagacuucgccuaauugccaugcucuacacgccccuccgugccaauaacucaggcgacgacgucuucaccgucuccugccgcguucuaacccgccccuccccagacuucuccuucaacuuccucgucccacccacugucgaaucaaaaacaaaacccuucucacuccccauccucacaaucucagaaaugucaaacucacgauuccccguccccaucgacucccuacacaccuccccaaccgagaacaucgucguccaaugccaaaacggccgcguuacacucgacggagaacucauggguacaacacaacuacuccccucccaaaucugcgccuuccgaggcaugcuaacacgcucaaccucucgagcaucggaccaagccgacaccgccaccccacgccuauucaacuacuacuggcacauccaacuagacaaucucaacggcaccccauacgacccugcugaagacauaccgggcccacuaggaacccccgacuuccgaggcaaagucuucggaguagccucccaacgcaacccagacgccaccaccagagcucaugaagccaagauagacaccacauccggccgcuucaccccgaaacuuggcucccuggaaauauccacugaauccggagacuucgaccaaaaccagcccaccaucuucacccccgucggcaucggcgucgaccacgaagcagacuuccaacaauggacccuccccgauuacgccggccaguucacccauaacaugaaccucgcacccgccguagccccaaacuuccccggagaacaacuccucuucuuccgcucgcaacuccccucauccggaggccgaucaaacggcauacucgauugccuagucccccaagaauggguucaacacuucuaccaagaaucggcccccucccaaacccaaguggcccucguucgcuacgucaaucccgacaccggacgaguacucuucgaggccaagcuccacaaacuaggcuucaugaccaucgcuaaaucaggagacuccccaaucaccguacccccaaacggcuacuuucgcuucgaaucuugggucaaccccuuuuacacccuggcccccaugggcaccggcaacggacgacgccguauccaauaa

SEQ ID NO: 35540 - RNA, 1647 nt, Artificial Sequence
  derived and/or modified sequence opt11 from capsid_protein_VP1__Norovirus__AII02716
augaaaauggcuucuaacgacgccgcccccuccaacgauggcgcagccggacucguacccgaaaucaacuccgaagccauggcccuagaaccagucgcaggcgcugccauugcagcaccccuaacaggacagcaaaacauaauagacccuuggauaaugaacaacuucguccaagcccccggcggcgaguucacagucucuccccgcaacuccccaggcgaaguacuucucaaccuagaacucggucccgaaauaaaccccuaccuugcccaccucgcccgcauguacaauggauacgccggcggauucgaaguccaagucguucucgccggaaacgccuuuaccgcaggcaagaucaucuucgccgcaauaccacccaacuuccccauagacaaccuauccgccgcccaaauaacgaugugcccucacgucaucguagacguccgccaacuggaaccagucaaccucccaaugccagacguaagaaacaauuucuuccacuacaaucaaggcucugacucccgccucagacuaaucgccaugcuuuacacuccccuccgagccaacaacuccggcgacgaugucuucaccguaucaugccgcguccucacccgacccucacccgauuucuccuucaacuuccucguacccccaaccgucgaauccaaaacaaaacccuucucccuccccauccucacaauauccgaaauguccaacucucguuuccccguccccaucgacucccuccacacgucacccaccgaaaacaucguaguccaaugccaaaacggccgcgucacccuggacggcgaacuaaugggcacaacccaacuacuccccucccaaauaugcgcauuccgcggcaugcucacacgcucaacaucccgcgcuucagaucaagccgacaccgccaccccacgacuauuuaacuacuacuggcacauccaacuggacaacuuaaacgguaccccguacgacccagcugaagacauccccggaccccuaggcacccccgacuuccgcgguaaagucuucggcgucgccucccaacgcaaccccgacgccaccaccagagcccacgaagcaaaaaucgacaccacaagcggucgcuucacccccaaacuuggcucccuggaaaucuccaccgaaucgggcgacuucgaccaaaaucaacccacccgcuucaccccagucggaaucggcgucgaccacgaagccgacuuccaacaauggacccugccugacuacgcaggccaauucacccacaacaugaaccuagcacccgcagucgccccaaacuuccccggagaacaacuacuuuucuuccgcucacaacuuccaagcuccgguggccgcuccaacggaauccucgacugucucguaccccaagaauggguccaacacuucuaccaagaauccgcccccucccaaacacaagucgcucucguacgcuacgucaaccccgacacuggacguguacucuucgaagccaaacuccacaaacucggauucaugacaaucgcaaaauccggcgacuccccaaucaccgucccacccaacggauauuuccgcuucgaaucauggguaaauccauucuacacacuugcccccaugggcaccggcaauggacgccgccgaauccaguaa

SEQ ID NO: 35541 - RNA, 1650 nt, Artificial Sequence
  derived and/or modified sequence opt11 from capsid_protein_VP1__Norovirus__AII02719
augaaaauggccagcaacgacgccgcaccuucaaacgacggugccgccaaccuagugcccgaagccaacaacgaaguaauggcccucgaacccgucguaggcgcauccaucgccgcccccgucgucggccaacaaaacaucauugacccauggauccgagaaaacuucguccaagcaccccaaggggaguucacagucagcccccgaaacucccccggagaaaugcuccuaaaccucgaacuaggccccgaacuuaaucccuaucucucacaccucucacgaauguacaauggcuacgcaggaggcaugcaaguucaagucgugcuagcaggaaacgccuucacagccggcaaaaucauauucgccgcaguaccaccccacuuccccgucgaaaacaucaaugccgcccaaauaacuaugugcccccacguaauugucgacguucgucaacuagaacccguccuccuuccucuaccagacauccgcaaccguuucuuccacuacaaccaagaagauacuccccgcaugcgccuagucgcaaugcuauacacgccccuacgcgccaauuccggcgaagacgucuucaccguauccugccgaguccuaaccagaccagcacccgacuucgaguucacguuccuaguaccgcccaccgucgaauccaaaaccaaacccuucacccuacccauucucacacucggcgaacuaucaaacucccgauuccccgcucccaucgacaugcuauacaccgacccaaacgaaggcaucgucguacaaccccaaaacggcagaugcacccucgacgguacccuccaaggcacuacacaacuuguucccacacaaaucugcgccuucagaggcauccucauaggccaaaccucacgcucacccgauuccgauuccaccgacucagcaccccgacgccgcgaccacccccuccacaugcaacuagaaaaccucgacggcacccaauaugacccaaccgacgaagucccggccgcccucggagcugucgacuucaaaggaaccaucuucggcguugcuucccaacgcgacacaucaggcacccaaguaggcgcaacccgcgcccacgaagucauaaucaacaccaccgacccacgauacacacccaaacugggcuccguccucauguacuccgaaucacaagacuucgaaacaggccaacccauacgauucacccccaucggcaugggcgaaaacgacuggcaccaaugggaacuucccaauuacuccggccgacucacacuaaacaugaaccuagcccccgccgucgccccagccuuccccggcgaacgaauacucuucuuucgcuccaucguccccuccgcaggcggcuaugguucaggacaaaucgauugccuccucccucaagaauggguccaacauuucuaccaagaagccgcacccagccaauccgccguagcccucauccgcuacgucaacccagacaccggccgcaacaucuucgaagccaaacuacacagagaagguuucaucaccgucgccaauucaggcaacaacccaaucgucguacccccuaacggcuacuuccgcuucgaagcguggguuaaccaauucuacacacuaacuccaaugggaaccggacaaggccgacggcguaaccaauaa

SEQ ID NO: 35542 - RNA, 1650 nt, Artificial Sequence
  derived and/or modified sequence opt11 from capsid_protein_VP1__Norovirus__AII02722
augaaaauggccuccaacgacgccgcacccuccaacgacggcgcugcgaaccucguacccgaagccaacaacgaagucauggcccucgaacccgucgccggugcauccaucgcagcaccagucguuggucagcaaaacaucaucgacccguggauccgagaaaacuucguccaggccccacaaggugaauuuaccguaucaccacgcaauucuccgggcgaaaugcugcucaaccucgaacucggccccgaacuuaaccccuaccuaucacaccucucacgcauguacaacggauacgccggcggcaugcagguccaagucguccucgccggcaacgcauucacagcaggcaaaauaauauucgcagcagucccuccccacuucccaguggaaaauaucaacgccgcacaaaucaccaugugcccccacgucaucgucgacguacgccaacucgaacccguccuccucccccuccccgacauccgaaaccgcuucuuucacuacaaccaggaagacacaccccgcaugcgccuuguagcaaugcucuacacaccccugcgcgcaaacucaggcgaagacgucuucaccgucagcugcagaguacucacacgaccagccccagauuucgaguucaccuuccuugucccgcccaccgucgaauccaaaaccaaacccuucacccuacccauacucacucuaggcgaacuuucuaacucccgcuuccccgcccccaucgauaugcuauacacagacccaaacgaaggaaucguaguacaaccccaaaauggcagaugcacacucgacggaacacuucaaggcacuacccaacucguccccacccaaaucugcgcauuccgaggccgccucauuggccaaaccucccgaucacccgaccucgacuccaccgacuccgcaccacgccgacgcgaccacccccuccacaugcaacucgaaaaccuugacggaacucaauacgaccccaccgacgaaguucccgcagcccucggagccgucgacuucaaaggcaccaucuucggagucgcaucccagcgagauaccucuggcucacagguaggagcaacccgagcccacgaagucacaaucaacaccaccgacccgcgauacacacccaaacuuggaagcguccuaauguacuccgaaucacaagacuucgaaaccggccaaccaauacgcuucaccccaauaggaaugggcgaagacgacuggcaccaaugggaacugccaaacuacuccggccgccucacucuaaacaugaaccuagcccccgccguagcaccagcuuucccgggagagcgcauacucuucuuccgaagcaucguuccauccgccggcggcuacggaucaggacaaaucgacugccuccuuccccaagaauggguacaacauuucuaccaagaagccgccccaucccaaucagcuguggcacucauccgauacguaaaccccgacaccgggcgcaacaucuucgaagcaaaacuccaccgggagggauuuaucacagucgccaacuccggcaacaaccccauugucgugcccccaaacggauauuuucgcuucgaagcaugggucaaccaauucuauacccucacccccaugggcaccggacagggccgcagacgcaaccaauaa

SEQ ID NO: 35543 - RNA, 1623 nt, Artificial Sequence
  derived and/or modified sequence opt11 from capsid_protein_VP1__Norovirus__AII02725
augaaaauggccuccaaugacgccaaccccuccgacgguucagccgccaaccucguaccagaaguaucuaacgaagucauggcccuagaaccaguagucggugccgcaauagccgcccccgucgccggccaacaaaacgucaucgacccuuggauacgaaacaacuucguccaagcgcccggcggcgaguucaccguauccccacgaaacgcccccggcgaaauucucugguccgcaccccuaggaccagaccucaaccccuaccuaucccaucucgcccgcauguacaacggcuacgcaggaggcuucgaaguccaagucauacucgccgguaacgcauucaccgccggcaaaaucaucuucgccgccgugccucccaacuuccccacagaaggccucucacccucacaagucaccauguucccccacauaaucgucgacguacgccaacucgaaccaguacuaaucccccuccccgauguccgaaauaauuucuaccacuacaaucaaaccaacgacuccaccaucaaacucaucgccaugcucuacacaccccuccgagccaacaacgccggcgaagacgucuuuaccgucuccugcagagugcucacccgccccagccccgacuucgacuucauauuccucguaccacccacgguagaaucccgcaccaaacccuucaccguccccauacucaccgucgaagaaaugaccaacucccgauuccccgucccacucgaaaaacucuucaccggccccuccggcgccuuuguaguccaaccccaaaacggccguugcacaacagacggcguacuacuaggaaccacacaacucucaccugucaacauaugcacauuccgaggugacguaacucacaucgccggcucccgcaacuacaccaugaaccuagcaucucuaaacuggaacaacuacgaccccaccgaagaaauaccagcaccccucggaaccccagacuucgucgggaaaauccagggaguacucacccaaaccaccaaaggagacggcuccacacguggccacaaagccacaguauacaccggcuccgccccguucacucccaaacuagguucgguucaauucuccacugacacagaaaacgacuucgaaacccaccaaaacaccaaauucaccccugucggagucauacaggacggaggaacaacccaccgaaaugaaccccaacaauggguacuacccuccuacucuggacgcgacguacacaacguccaccuugccccagccgucgcccccaccuuccccggcgaacaacuccuguucuuccgaucuacaaugcccggcugcuccggauacccaaauauggaccucgacugccuacucccucaagaauggguccaacacuucuaccaagaagccgccccagcccaaucggacgucgcccuacuccgcuucguaaaccccgacaccggccggguccucuucgaaugcaaacuccacaaauccggauacguaacgguagcccacaccggccaacacgaccucgucauaccaccaaacggcuacuuucguuucgacuccugggucaaccaauucuacacucucgccccaaugggcaacggaacaggccgccgacgcgcccuauaa

SEQ ID NO: 35544 - RNA, 1623 nt, Artificial Sequence
  derived and/or modified sequence opt11 from capsid_protein_VP1__Norovirus__AII02728
augaaaauggccagcaacgacgccaacccguccgacggauccgccgccaaccucguaccugaagucuccaacgaagucauggcacucgaaccagucguaggcgccgccaucgccgccccggucgcaggccaacagaacgucaucgaccccuggauccgaaacaacuucguucaagcaccuggcggcgaguucacagucucaccccgcaacgcccccggcgaaauccuaugguccgcaccccucggcccagacuuaaaccccuaccucucccaccuugcccgaauguacaacggauacgcaggagguuucgaaguccaagucauucuagccggcaacgcauucaccgccggcaagauaaucuucgcagccguuccucccaacuuccccaccgaaggacucucccccucccaaguuacaauguucccccauaucaucguugacgugcgacaacuugaacccguccucauuccccuccccgauguccgaaauaacuucuaucacuacaaccaaaccaacgacccuacaaucaaacuaaucgccaugcucuacaccccucugcgcgccaacaacgccggcgaagacgucuucaccgucuccugccgaguucucacacgccccucacccgacuucgacuucaucuuccucguuccaccaaccgucgaaucccguaccaaacccuucacggucccaauccucaccgucgaagaaaugacuaacucccgcuuccccaucccacucgaaaaacucuucaccggccccuccggugccuucguaguacaaccacagaacggccgaugcaccacagacggcguacuacucggaaccacacaacucucccccguaaacaucugcacauuccgcggggacguuacccacaucgccggcucccgcgacuacaccaugaaccucgcuucccuuaacuggaacaauuacgacccaacagaagaaauucccgccccacuaggaaccccagacuucgucggcaaaauccaaggcguacucacccaaaccacccgaggcgacggcagcacccgcggacacaaagccaccguauacaccggcuccgcccccuucgcccccaaacucggcucuguccaauucucaacugacaccgaaaacgacuucgaaacccaucaaaacaccaaauucacaccagucggaguaauacaagauggcgguaccacccacagaaacgaaccacagcaauggguccuccccuccuacucaggccgcgacguccacaacguacaccuagcaccagccgucgcccccacuuucccaggcgaacaacuccucuucuuccgaucaaccaugcccgguugcuccggauaccccaacauggaccucgacugccuccuuccccaagaauggguccaacacuucuaccaagaagcagccccagcgcaaucggacguagcacuacuaagauucgucaaccccgacaccggccggguccuauucgaaugcaagcuacacaaaucuggauacgucaccgucgcccacaccggccaacacgaccuaguaauaccucccaacgguuauuuccgcuucgacuccugggucaaccaauucuacacacucgcccccauggguaacggaacuggacgccgccgcgccuuauag

SEQ ID NO: 35545 - RNA, 1653 nt, Artificial Sequence
  derived and/or modified sequence opt11 from capsid_protein_VP1__Norovirus__AII02731
augaagauggccuccaacgacgccgccccuagcaaugacggagccgccaaccucgucccugaagccaacaacgaagucauggcccuagaaccugucgucggcgcaucaaucgccgcuccagucgucggacaacaaaacaucauagaccccuggauccgggaaaacuucguccaagccccacaaggcgaauuuacaguauccccacgcaacucccccggagaaaugcuacuuaaccucgaacucggaccugaacucaaccccuaccucucucaccucucacgcauguauaacggguaugccggaggcaugcagguccaagucguucucgccggcaacgcauucacagccggcaaaaucaucuucgcugccguaccaccccacuuccccgucgacaacaucucagcagcucaaauaaccauguguccccacgucaucgucgacguaaggcaacucgaacccguacuccuuccccuccccgacauccgcaaccgcuucuuccacuacaaccaagaaaacacccccagaaugcgccuagucgcgaugcuauacacaccccuaagagccaacaguggcgaagacgucuucaccgucagcugccggguccucacccgacccgcccccgacuucgaguucacauuucuagucccaccaacagucgaauccaaaaccaaacccuucacacuccccauccucacccuaggugaacucucaaacuccagauuccccgccgccaucgauaugcuauacacagacccaaacgaauccauaguaguacagccacaaaacggacgaugcacucucgacggcacgcuccagggcaccacucagcuagucccaacccagaucugcgccuuucgaggcacccucauaucccaaaccgcccgcgccgccgacuccaccgacucaccccaacgcgcacgcaaccacccccuccacguccaaguaaagaaccuugacggcacccaauacgacccaacagacgacaucccggccguccucggcgccauugacuuuaaaggaaccgucuucggaguagccucccaacgcgacguauccggcacccaagaacaaggacacuacgcaaccagagcacacgaagcccacaucgauaccacggacccaaaauacgccccaaaacucggaaccauccucaucaagucugaauccaccgacuucaacaccaaccagccaauccgcuucaccccagucggcaugggcgacaacaacuggcgccagugggaacucccagacuacucaggcucgcuuacacuaaacaugaaccuagcccccgcaguaucccccucauuccccggcgaacgcauccucuucuuccgcucaaucguaccauccgccggcggauacggcucaggcuacauagacugucucauaccacaggaauggguacaacacuuuuaccaagaagcagcucccucgcaguccgccguagcacucguacgcuaugucaaccccgacaccggccgcaacaucuucgaagcaaagcuccaucgcgaagguuuccucaccgucgcuaacagcggaaauaaccccaucguagucccaccuaacggcuauuuccgcuucgaagccugggucaaccaauucuacacucucgcccccaugggcucaggccaaggccgucgacgcgcccaguaa

SEQ ID NO: 35546 - RNA, 1623 nt, Artificial Sequence
  derived and/or modified sequence opt11 from capsid_protein_VP1__Norovirus__AII02734
augaaaauggcaucaaaugacgccaaccccuccgacgggucugccgcaaaccuaguaccagaaguaucaaacgaagucauggccuuagaacccgucgucggagccgccaucgccgccccagucgcaggccaacaaaacguaaucgaccccuggauacgcaacaacuuuguccaagcuccaggcggagaguucaccgucucgccccggaacgcccccggcgaaauauuaugguccgcaccccucgggccagaucucaaccccuaccuuucccaccucgcccgcauguacaacggguacgccggcggcuucgaaguccaagucauccuagcaggcaacgccuucacggccggcaaaauaauuuucgcggccgucccacccaacuuccccacagaaggucuauccccaucccaagucaccauguucccacacauaaucgucgacguccgccaacucgaaccaguacuuauaccacuaccagacguccgaaacaacuuuuaccacuacaaccaaaccaacgacucuaccaucaaacucaucgcgaugcuauacaccccacuacgagccaacaacgccggagaagacgucuucaccgucuccugccgcguccuaacccgccccucaccugauuucgacuucaucuuccucguaccacccaccgucgaaucacgaaccaaacccuucaccguccccauccucacaguugaagaaaugaccaacucccgauucccaaucccccuagaaaaacucuucaccggaccuuccggagcauucgucguccaaccccaaaacggccgaugcacaaccgacggcguccuacuagguaccacccaacucucacccgucaacaucugcacuuuccguggugacgucacccacauagcaggcucccgcaacuacaccaugaaccuugccucccucaacuggaacaacuacgacccuaccgaagaaaucccugccccacucggcacacccgacuucgucggcaagauccaaggaguacucacccaaaccaccaaaggugacggcuccacacgcggccacaaagccaccgucuacaccggcuccgccccuuucaccccuaaauuaggcuccguccaauucuccaccgacacagaaaaugacuucgaaacccaccaaaacaccaaauucaccccaguaggagucauccaagacggcggaacaacgcaccguaacgaaccccaacaauggguucuccccuccuacuccggucgcgacguccauaacguccaccuagcaccagccguagcccccaccuucccaggggaacaacuucuauucuucagauccaccaugcccggcugcuccgguuaccccaacauggaccuagacugccuccuaccacaagaauggguacaacauuucuaccaagaagcagcccccgcgcaaucagacgucgcucuacuccgauucgucaaccccgacacaggcagaguacucuucgaaugcaaauuacacaaaucaggcuacgucacagucgcccacacaggccaacacgaucucguaaucccaccuaacggauacuuuagauucgacuccuggguuaaccaauucuacacccucgcccccaugggcaacgguaccggccgccgccgcgcccuauaa

SEQ ID NO: 35547 - RNA, 1623 nt, Artificial Sequence
  derived and/or modified sequence opt11 from capsid_protein_VP1__Norovirus__AII02737
augaaaauggccagcaacgaugcuaaccccucagacggaucugcugcaaaccucguccccgaaguuuccaacgaaguaauggcccuagaacccgucgucggcgccgccaucgcugcccccgucgccggccaacaaaacgucauagacccauggauccgcaacaacuucguccaagcaccgggaggagaauuuaccgucucaccccgcaacgcccccggcgaaauccuuugguccgcgccccuuggacccgaccucaauccauaccucucccaccuagcccgaauguacaacggcuacgccggcggcuucgaaguccaagucauccucgccggcaacgcauucacagcaggcaaaauaauauucgcagcaguaccucccaacuuucccacagaagguuuaucccccucccaaguuaccauguuuccucacaucauagucgacguccgacaacucgaacccguacucauuccccuccccgacguacgcaacaacuucuaccacuacaaucaaaccaacgacucaaccauuaaacucaucgcgaugcuauacacaccccuacgcgcuaacaacgcaggcgaagacgucuucaccgucuccugcagaguacuuaccaggccauccccugacuuugacuucaucuuccucguucccccuacugucgaaucccgcacaaaacccuucaccguccccauccucaccgucgaagaaaugaccaacucccgauuccccauacccuuagaaaaacucuucacaggacccuccggagccuucguaguacaaccacagaacggacgaugcaccaccgauggcguccuccucgguaccacccaacucucccccgucaauaucugcaccuuccgcggcgacgucacacacaucgcuggcucccgcaacuacaccaugaaccucgccucccuaaacuggaacaacuacgaccccacagaagaaauaccugccccucuaggcacaccagacuucgucggcaaaauccaaggcguccucacacaaacaacaaaaggcgacggcuccacccgaggccacaaagcuaccguauacaccgguucggcaccuuucacgccgaaacucggaucuguccaauucucaaccgacaccgaaaacgacuucgaaacccaccaaaacacaaaauucaccccagucggcgucauccaagacggaggcaccacucaucgcaacgaaccacaacaauggguccuccccucguacuccggucgagacguccacaacguccaccucgcccccgccguagcccccacauuccccggcgaacaacuauuauucuuccgcucuaccaugcccggaugcuccggcuaccccaacauggaccucgacugccuccuaccccaagaauggguccaacacuucuaccaagaagccgccccagcccaaucagauguugcccuccuccgcuucguuaacccugacaccggucgaguccuauucgaaugcaaacuccacaaaucaggauaugucacaguagcucacaccggacaacacgaccuagucaucccacccaacggauacuuccgcuucgacucaugggucaaccaauucuacacacuugcccccaugggaaacggcacuggccggcgacgagcccuauaa

SEQ ID NO: 35548 - RNA, 1623 nt, Artificial Sequence
  derived and/or modified sequence opt11 from capsid_protein_VP1__Norovirus__AII02740
augaaaauggccccgaacgacgcuaacccauccgacggaucagcagcaaaccuaguccccgaaguuuccaacgaaguaauggcacucgaacccguagucggcgccgcaaucgccgcucccguagccggccaacaaaaugucaucgaccccuggauccgcaacaacuucguacaagccccaggcggcgaguucacugucuccccucgaaacgcccccggcgaaauccucuggggcgccccucuaggcccagaccucaaccccuaccucucacacuuagcucgcauguacaacggauaugccggcggcuucgaaguccaagucauccuggccggcaacgccuucacagccggaaaaaucaucuucgcagcaguaccacccaacuuccccaccgaaggccuaagccccucucaagucacaauguucccccacaucauagucgacguacgccaacucgaacccguccucaucccccuucccgaugucagaaauaacuucuaccacuacaaccaaaccaacgacuccacaaucaaacugaucgccauguuauacacaccccuccgagcaaacaaugccggcgaagaugucuucacaguauccugccgcguacucacccgccccucaccggacuucgacuucauuuuccuugucccaccaacagucgaaucccgcaccaaacccuuuaccguccccauccucacagucgaagaaaugacaaacucccgcuuccccaucccccuugaaaaacuauucaccggcccauccggugcauucgucguccaaccacagaacggccgcugcacaacugacggaguccuacuaggcaccacccaacucucccccgucaacaucugcaccuuccgaggcgacguaacccacaucgccgguucacguaacuacacaaugaaccuagcuucccucaacuggaacaacuacgaccccaccgaagaaauccccgccccacucgguaccccagacuucguaggaaaaauucaaggcguacugacccaaaccaccaaaggagacggcuccacccgcggccacaaagcaaccgucuacaccggaucugcaccauucaccccaaaacuaggcagcguccaauucucaacggacacagaaaacgacuucgagacccaccaaaacaccaaauucacccccgucggcgucauccaagacggcggcacaacacaucgaaacgaaccccaacaauggguccuccccuccuacucaggacgcgauguccacaacguccaccuagcccccgcagucgcaccgacauucccuggagaacaauuacuauucuuccgauccaccaugcccggaugcagcggauauccaaacauggaccucgacugccuucuaccacaagaauggguacaacacuucuaccaagaagccgcccccgcgcaauccgacguagcccuacuccgcuucguaaacccagauaccggccgcgucuuguucgaaugcaaacuacauaaauccggauacgucacagucgcccacaacggacaacacgaccuagucaucccaccaaacggcuacuuccgcuucgacuccuggguaaaccaauucuacacccucgcgccuaugggaaacggcaccggccgccgcagagcccuauaa

SEQ ID NO: 35549 - RNA, 1623 nt, Artificial Sequence
  derived and/or modified sequence opt11 from capsid_protein_VP1__Norovirus__AII02743
augaaaauggccaguaacgacgccaacccgucugacggcucagccgcuaaccuaguccccgaagucuccaacgaaguaauggcucuugaaccuguaguuggcgcagccaucgcagcccccguagccggucaacaaaacgucaucgaccccuggaucaggaauaacuucguccaagccccaggaggagaauuuacugucucuccccgcaacgcaccaggcgaaauccucugguccgcaccccuagguccugaucucaacccauaucuuucacaccuagcccguauguacaacggauacgccggcggcuucgaaguccaagucauacucgccgggaacgccuucacugccgguaaaaucauauucgcagcagucccaccaaacuuccccaccgaaggccucuccccaucccaagucaccauguucccucacaucaucguagacguccgccaacucgaaccaguacucaucccacucccagacguccgcaacaacuucuaccacuacaaccaaaccaaugauucaaccaucaaacuuauagcuaugcuauacacaccccuucgcgcaaacaacgccggugaagacgucuucaccguauccugccgcguccucacuagaccauccccugacuucgacuucauauuucucgucccacccaccgucgaaagccgcacuaaacccuucacggucccaauccucaccgucgaagaaaugaccaacucaagauuccccauuccucucgaaaaacuauucacaggucccuccggcgccuucgucguccaaccccaaaacggccgcugcacaacagacggcguacuacucggcaccacccaacugucccccguuaacauaugcacauuccgcggagacgugacccacaucgccggcucccgggacuacaccaugaaccucgcuucccucaacuggaacaacuacgaccccaccgaagaaauacccgcuccccuuggcacccccgacuucgucggcaaaauucaaggcguucucacccaaaccaccaaaggcgacggcuccacccgaggacacaaagccaccguguacaccggcucagcccccuucaccccaaaacugggcucaguccaauucuccacagacaccgaaaacgauuucgaaacccaucaaaacacaaaauucacucccgucggcguaauccaagacggcgguacuacacaccgcaacgaaccccaacaauggguucuuccauccuacucaggccgcgacguccacaacguccaccuugcccccgccguagccccuaccuuccccggcgaacaacuccuauucuuccguuccacaaugcccggaugcuccggcuaucccaauauggaccucgacugccuccucccacaagaauggguccaacacuucuaccaggaagcagccccagcucaauccgacgucgcacuccucagauucgucaacccagacaccggccgaguccuguucgaaugcaaacuacacaaauccggcuacguuacagucgcacacaccggccaacacgaucucgucaucccacccaacgguuacuuccgguuugacucaugggucaaccaauucuacacucuagcccccaugggcaauggcaccggacgccggcgcgcccucuaa

SEQ ID NO: 35550 - RNA, 1623 nt, Artificial Sequence
  derived and/or modified sequence opt11 from capsid_protein_VP1__Norovirus__AII02746
augaagauggccuccaacgacgccaacccuucagacggcuccgccgccaaccucguccccgaagucaacaaugaagucauggcccuagagcccguagucggcgccgcaaucgcagccccagucgccggccaacaaaaugucaucgaccccuggauucgcaacaacuucguccaagccccaggaggagaguucacagucucgccccgcaacgcaccaggcgaaauccucugguccgcaccucuuggaccagaccuaaaccccuaccucucccaccuagcccgcauguacaacggcuacgccggaggauucgaaguucaagucauacuagccggaaacgccuucacagccggcaaaauaaucuucgcagcagucccucccaacuuccccaccgaaggacucucccccucccaaguuaccauguucccacacaucaucguagacguacgccaacucgaaccuguccucaucccccuaccugacguaagaaacaacuucuaccacuacaaccaauccaacgacucuacaauaaaauugauugccaugcuauauacaccucucagagccaauaaugccggcgaagacguuuucaccguuucaugccguguccucacccgaccuucucccgacuucgacuucauauuccucgucccacccacagucgaaucacgcacaaagcccuucacaguccccauccuaacugucgaagaaaugaccaacagccgcuucccuaucccucucgaaaaacucuucaccggcccauccggcgccuucauaguccaaccucagaacggccgcugcaccacugacggaguccuacucggcacuacccaacucucccccgucaacauaugcacuuuccgcggagacguaacacacaucgccggcucccgcaacuacacuaugaaccucgcaucccucaacuggaacaacuacgaccccacagaagaaauucccgcaccccuuggcaccccagacuucguaggcaaaauccaaggcguccucacacaaaccaccaaaggcgacggcucaacccguggacacaaagccaccguuuauacaggaagugccccauucacacccaaacucggguccguccaauucucaaccgacaccgaaaacgacuucgaagcccaccaaaacaccaaauucaccccagucggcgucauccaagacggcggaacuacacaccgcaaugaaccccaacaauggguacuaccauccuacucaggccgcgacguacacaacguucaccucgcacccgccguagcaccaacuuuccccggugaacaacuccuauucuuccgcuccaccaugccaggcugcuccgguuacccaaacauggaccucgacugccuccuaccacaagaauggguccaacacuucuaucaagaagccgcccccgcucaaucugacgucgcacuccuaagauucgucaaccccgacacaggacgcguccuuuucgaaugcaaacuccacaaauccggauacgucaccgucgcacacaccggccaacacgaccuagucaucccacccaacggcuauuuccgcuucgacuccugggucaaccaauucuacacccuggcccccaugggcaacgguaccggacgacgacgcgcccuauga

SEQ ID NO: 35551 - RNA, 1623 nt, Artificial Sequence
  derived and/or modified sequence opt11 from capsid_protein_VP1__Norovirus__AII02749
augaaaauggccuccaacgacgcaaacccauccgacggauccgccgcaaaccuaguccccgaagucagcaacgaagucauggcccuugaacccgucgucggcgcagcaauugccgcccccgucgccggccaacaaaacgugaucgaccccuggauccgaaacaauuucguccaagccccaggcggcgaguucaccgucucuccccguaacgcccccggagaaauccucugguccgcuccccucggaccugaccuaaaccccuaccuaucccaccucgcccgcauguacaacggcuacgccggcggauucgaaguacaggucauccucgccgguaacgccuucacagcaggaaagaucaucuucgcagccgucccgcccaacuuccccacugaaggccugucccccucccaaguaaccauguucccccacauuaucgucgacguacgccaacucgaacccgugcuaauuccccucccagacguccgcaacaacuucuaccacuacaaccaaaccaaugacucuaccaucaaacugaucgcaaugcuuuacacgccgcugcgggcaaacaacgcaggcgaggacguuuucacagucuccugucgaguacucacccgcccuagcccagacuucgacuucauauuccuagucccacccacagucgaaucucguaccaaacccuucaccguccccauccuuaccgucgaagagaugaccaacucacgauuccccaucccccucgaaaaacucuucaccggucccucuggcgccuucgucguucaaccccaaaacggacgcugcacaacugacggaguccuccucggcacuacccaacucuccccagucaacaucugcaccuuccgaggagacgucacacacauagccgggucccgcaacuacaccaugaaccucgcgucucucaacuggaacaacuacgacccaacugaagaaauccccgcaccccucggcacuccugacuucgucggcaaaauccaagguguccuaacccaaacaacaaaaggagacggcuccacccgcggccacaaagccacuguuuacaccggauccgcccccuucacgcccaaacuuggcagcguacaauucucaaccgacacagagaacgacuucgaaacacaccaaaacaccaaauucacccccgucggcgucauccaagacggcggcaccacacaccgcaacgaaccccaacaauggguccuccccaguuacagcggccgcgacguccacaacguacaccuugccccugccgucgccccaacauuccccggcgaacaacuucuauucuuucgcucaacaaugccaggauguuccggcuaccccaacauggaccucgacugccuccuaccacaagaaugggugcaacacuucuaccaagaagccgcccccgcucaauccgacgucgcccuacuccgauuugucaauccugacaccggucgcguccuauucgaauguaaacuacacaaauccggcuacgucacagucgcacauaccggccaacacgaccuugucaucccucccaacggauacuuccgauucgacuccugggucaaccaauucuacacccuagcccccaugggcaacggaacaggucgccguagagcccucuaa

SEQ ID NO: 35552 - RNA, 1623 nt, Artificial Sequence
  derived and/or modified sequence opt11 from capsid_protein_VP1__Norovirus__AII02752
augaaaauggcaucaaacgacgccaaucccuccgacggcuccgcagcaaaccugguccccgaagucagcaacgaaguaauggcucucgagccagucguaggagccgccaucgcagccccaguagcuggccaacaaaacguaaucgacccauggauccgcaauaacuuuguccaagcaccaggcggagaguucaccgucuccccacgcaacgccccaggagaaauacucugguccgcaccccuaggcccugaccucaaucccuaccucucucaccucgcccgcauguacaacggcuacgccggagguuucgaaguccaagucauacuggccggcaacgccuucaccgccgguaaaaucaucuucgccgccgugccacccaacuuccccacagaagggcuauccccaucgcaagucacaauguucccccauaucaucguggacguccgccagcuagaacccguacuuaucccccuuccagauguucgcaacaacuucuaccacuacaaccaaacaaacgacuccacaauaaaacucaucgcuaugcuuuacacaccccuccgcgcaaacaacgccggagaagaugucuucaccguauccugccgaguccuaaccagacccagcccagacuucgacuucaucuuccucguacccccaaccgucgaaucgcgaaccaaaccuuucaccgucccaauauugaccguagaagaaaugaccaacucccgcuuccccaucccccucgaaaaacucuucaccggccccagcggagccuucgucguacaaccccaaaacggacguugcaccacagauggaguccuacucggcacaacccaacucagcccagucaacaucugcaccuuccgcggagaugucacccacauagccggcagccgcaacuacaccaugaaccuugccucccuaaacuggaacaacuacgaccccacagaagaaauccccgcaccccucggcacccccgacuucgucggcaaaauccaaggaguauuaacccaaacaacaaaagaagacggcucaacccgcggacauaaagccacugucuacacaggcucagcccccuucacccccaaacucggaagcguccaauucuccacugacaccgaaaacgacuucgaaacgcaccaaaauacaaaauucaccccagucggcgucauccaggacggaggaacaacccaccgaaacgaaccccaacaauggguucucccauccuacucuggccgcgacguacacaacguccaccucgcacccgccgucgcacccaccuucccaggcgaacagcuccucuucuuccgaucgacgaugcccggaugcucagguuacccgaacauggaccuagacugucuccucccccaagaauggguacaacacuucuaccaagaggccgcccccgcacaaucagacgucgcccuacuccgcuucgucaaccccgacaccggccgcguccuauucgaaugcaaacuucacaaaucaggcuacguaacagucgcccacaccggacaacacgaccucgucaucccgcccaacggcuacuuccguuucgacucauggguaaaccaauucuacacccuggcccccaugggcaauggcacuggacgccgacgcgcccucuaa

SEQ ID NO: 35553 - RNA, 1623 nt, Artificial Sequence
  derived and/or modified sequence opt11 from capsid_protein_VP1__Norovirus__AII02758
augaaaauggccucaucugacgcaaaccccucugacggcuccaccgccaaccuaguccccgaagucaauaacgaagucauggcccuugaacccguuguaggagccgcaauagcggcucccgucgcuggccaacaaaacgucauagaccccuggauccgaaacaacuucguccaagcccccggcggagaguucacaguaucaccacgaaacgcccccggcgaaauccuauggagcgcaccacucggccccgaccuaaacccauaccucucccaucucgcccgaauguacaacggauacgccggcggauucgaaguccaaguuauucucgccggcaacgcuuucacagcaggaaaaaucaucuucgcagcaguacccccaaacuucccaacagaaggacucucaccaucccaagucaccauguucccccacaucaucgucgacguccgacaacucgaaccaguacucauaccccuccccgacguacgcaacaauuucuaucacuauaaccaauccaacgacccaaccaucaaacugaucgcgaugcuuuacacuccccuacgagcaaacaacgccggcgacgaugucuucaccgugucaugccgcguccucacucgcccaucccccgacuucgacuucaucuuccuagucccucccaccgucgaaucccguaccaaacccuucuccguccccguacucaccguagaagaaaugacaaacuccagauucccaaucccccucgaaaaacuguucaccggccccagcuccgccuuugucguccaaccucaaaacggacgaugcaccacugacggcguccuucucggcacuacccaacuuucccccgucaacaucugcaccuuccgcggcgacgucacccacaucccaggaagccguaacuacacaaugaaucucgcaucccaaaacuggaacuccuacgaccccaccgaagaaauccccgccccacucggaacccccgacuucgucgguaaaauucaagguguccucacacaaaccacacguacuaacggcuccacgcgcggacacaaagccaccguauacaccggcagcgccgauuucucacccaaacucggccggguccaauucgcaaccgauaccgauaacgacuucgaaaccaaccaaaacaccaaauucacccccgucggcgucauccaagacggcuccaccacaccucgcaacgaaccacaacaauggguacuccccuccuacuccggccgaaauauccacaacguccaccucgcccccgccgucgcacccaccuucccaggcgaacaacuccuguucuuucggucaacaaugcccggcugcucaggcuaccccaacauggaccucgacugccuccuuccgcaagaauggguacaauacuucuaccaagaagcagcaccagcucaauccgaugucgcccuacuacgcuucgucaacccugacaccggacgcguacucuucgaaugcaaacuccacaaaucaggcuauguaaccguagcacacaccggccaacacgaccucgucaucccucccaacggcuauuucagauucgacuccuggguaaaccaauuuuacacccuagcccccaugggcaacgguaccggccgacgcagagcccuguaa

SEQ ID NO: 35554 - RNA, 1623 nt, Artificial Sequence
  derived and/or modified sequence opt11 from capsid_protein_VP1__Norovirus__AII02761
augaaaauggccuccuccgaugccaaccccuccgacggaucaaccgccaaccucgucccagaaguaaacaacgaagucauggcacuagaaccugucgucggcgcugcaaucgcagccccagucgccggccaacaaaacgucaucgaccccuggauccgcaacaacuucguccaagcacccggcggagaauuuaccgugucaccccguaacgccccaggugaaauccugugguccgcaccccucggacccgaccuaaacccauaccucucccaccuugcccgcauguauaauggcuacgccggcggcuucgaaguucaaguaauccucgccggcaacgccuucaccgccggaaaaaucauauucgcagcagucccacccaauuuccccaccgaaggacuaucccccucacaaguuaccauguuuccccaccucaucgucgacguucgccaacuggaacccguacuuaucccccuuccagacguccgcaacaacuucuaccacuacaaccaauccaaugacccaacaaucaaacucauagccaugcucuacacuccccuacgcgcaaacaacgcuggcgacgacguguucaccgucucuugccgcguccuaaccagaccaucacccgacuucgacuucauuuuccucgucccaccaaccgucgaaucacgcaccaaacccuuuucaguaccgguccucaccgucgaagaaaugaccaacucacgcuucccgauaccccuagaaaaacucuucaccggccccucuuccgccuucguaguacaaccccaaaacggucguuguaccaccgacgguguccuccucggaaccacucaacucucccccgucaacauaugcaccuuccgaggcgacguuacccacaucucaggcucccguaacuacacaaugaaucuagccucacaaaacuggaacuccuacgaccccaccgaagaaauucccgcaccccucggcacccccgacuucgucggcaaaauccaaggcguacucacacaaaccacacgaaccaauggcuccacccgcggccacaaggccaccgucuacaccggcuccgccgacuuuucccccaaacucggaagaguacaauucgccaccgacacagauaacgacuuugaaacuaaccaaaacaccaaauucacacccgucggcgucauccaagacggcuccaccacaccccgaaacgaaccccaacaauggguacuacccuccuacuccggacgcaacauccacaacguccaccucgcccccgcagucgcaccuaccuuccccggagaacaacuccucuucuuccgauccaccaugcccggcugcucaggcuaccccaacauggaccuugacugccuacucccacaagaauggguacaauacuucuaccaagaagccgccccagcccaauccgacguggcauuacuccgcuucgucaaccccgacacuggccgcguacuauucgaaugcaaacuacacaaaucuggauacguaacuguugcacacaccggccaacacgaccucguuaucccaccaaacggcuacuuccguuucgacagcugggucaaccaauucuacacacuagcccccauggguaacggcaccggacgacgccgcgcacuauaa

SEQ ID NO: 35555 - RNA, 1623 nt, Artificial Sequence
  derived and/or modified sequence opt11 from capsid_protein_VP1__Norovirus__AII02764
augaaaauggcaucuaacgacgcgaacccuuccgacggcuccgccgccaaccucguccccgaagucucaaacgaagucauggcacuugaacccguagucggcgccgcuaucgcagcccccguagccggccaacaaaacgucaucgacccauggaucagaaacaacuucguacaagcacccgguggcgaguucaccguaucaccacgaaacgcccccggugaaauccucugguccgccccucucggcccagaccuaaaccccuacuuaucacaccucgcccgaauguacaacggcuacgccgggggauucgaaguccaagucauccucgccggaaaugccuucaccgcaggcaaaaucaucuucgcugcagucccucccaacuuccccaccgaaggacuauccccaucccaagucaccauguucccccacaucaucguugacguccgucaacucgaaccaguccuaaucccacucccagacguccgcaacaacuucuaccacuacaaccaaaccaacgacuccaccaucaaauuaaucgcaaugcuauacaccccacuacgcgcuaacaacgcaggcgaagaugucuucaccgucucaugccgaguccuaacccgacccuccccagacuucgacuucaucuuccuugucccacccacagucgaaucccgaaccaaaccauucacagucccaauccuaaccgucgaagaaaugaccaacucccgcuuccccaucccucuagaaaaacucuucaccggcccaucgggagccuucguaguccaaccccaaaacggccgaugcaccaccgacggaguucuucuugguacaacccaacucucaccagucaacauaugcacauucagaggggacguaacccacaucgccggaucccggaacuacaccaugaaucucgccucccugaacuggaacaacuacgacccaaccgaagaaauacccgccccucuaggcacacccgacuucgucggcaaaauccaaggcguacuuacccaaacuaccaaaggagauggcuccacccgcggccacaaggccaccgucuacaccggauccgcuccauucacaccaaaacucggaucaguccaauucuccaccgacaccgaaaacgacuucgaaacccaccaaaauacuaaauucacccccgucggcgucauccaagacgguggcaccacacaccgaaacgaaccucaacaauggguccuaccauccuacucgggacgcgacguccacaacguccaccucgccccugccguagcuccuaccuucccuggcgaacaacuccuguucuuccgcuccacaaugcccggcugcagcggcuacccgaacauggaucucgacugccuccuaccccaagaauggguccaacacuucuaccaagaagcagcccccgcccaauccgacgucgccuuacuacgauucgucaacccagacaccggacgcguccuuuucgagugcaagcuccacaaauccggcuacgucaccguagcacacaccggucaacaugaccuuguaauaccacccaacggcuacuuccgcuucgacuccuggguaaaccaauuuuacacccuggcacccaugggaaacggcaccggccgccgccgcgcacuauaa

SEQ ID NO: 35556 - RNA, 1623 nt, Artificial Sequence
  derived and/or modified sequence opt11 from capsid_protein_VP1__Norovirus__AII02767
augaaaauggcuagcaacgacgccaaccccuccgacggcucagcagcuaaccuaguccccgaagucuccaacgaagucauggcccuagaacccgucgucggcgcagcaaucgcagccccagucgccggacaacaaaaugugaucgacccauggauccgaaauaauuucguccaggcccccggcggcgaguucacagucucaccacgcaacgccccaggugaaauacuauggucagcccccuuaggcccagaccuuaaccccuaccucagccaccuggcacgcauguacaacggcuacgcaggaggguucgaaguccaagucauccuagcaggcaacgccuucacagccgguaaaauaauauucgccgcagucccacccaacuuccccaccgaaggccucucccccucccaagucaccauguucccccacaucaucguagauguucgccaacucgaacccguucucaucccccuccccgacguacgcaacaacuucuaccacuacaaccaaacaaacgacucaacaaucaaacucauugccaugcucuacaccccacuucgcgccaacaacgccggcgaagacgucuucaccgucuccugccgaguccucacccgcccaucaccagauuucgacuucaucuuccucguaccacccaccguagaaucacgcacaaaacccuucaccgucccaaucuuaacuguagaagagaugacaaacucccgcuuccccaucccccuagaaaaacucuucacugguccuucaggugccuucguaguacaaccccaaaacggccgaugcaccacagacggcguccuucuaggcaccacucagcucucaccagucaacauaugcacauuccgcggagacgucacccauaucgccggcuccagaaacuacaccaugaaccuagccagucucaacuggaacaacuacgacccaaccgaggaaauacccgccccacucggcacccccgacuucguuggcaaaauccaaggaguacucacccaaaccaccaaaggagacggauccacacgcggccacaaagccacagucuacaccgguuccgcaccauucacccccaaacucggauccguacaguucagcaccgauacagaaaacgacuucgaaacccaccaaaacaccaaauucacaccuguaggcgucauccaggacggcggaaccacacaccguaacgaaccccaacaauggguccucccguccuacucuggacgcgauguccacaacguacaccuagcacccgcaguagccccaaccuuccccggugaacaacuccuuuucuuccgcuccacuaugcccggcugcagcggcuacccaaacauggaccucgacugccuccucccccaagaaugggugcaacacuucuaccaagaagcugcgcccgcccaauccgacgucgcccugcuccgauucguaaaccccgacaccggccgcguccucuucgaaugcaaacuacacaaaucuggauacgugacaguagcccacaccggacaacacgacuuaguuauacccccuaacggcuacuuccgcuucgacuccugggucaaccaauucuacacccuugcacccaugggaaacggaacaggccgacgccgugcccucuaa

SEQ ID NO: 35557 - RNA, 1647 nt, Artificial Sequence
  derived and/or modified sequence opt11 from capsid_protein_VP1__Norovirus__AII02770
augaaaauggccuccaacgacgcagcccccagcaacgacggcgccgccggccuaguuccagaaauuaauucagaagcaauggcgcuagaacccguagcaggagcagccaucgccgcaccccuaaccggccaacaaaacaucauagacccguggaucaugaacaacuucgugcaagcccccgguggcgaguucacugucucccccagaaacucacccggagaaguccuccucaaccuagaacuaggacccgaaaucaaccccuaccucgcucacuuagccagaauguacaacggcuacgccggcggcuuugaaguacaagucguacuagccggcaacgcauucaccgccggaaaaauaaucuucgccgcuauacccccaaacuuuccuaucgacaaccuaucagcggcacaaaucaccaugugcccacacguuaucgucgacguccgacaacucgaacccguaaaucucccaaugccagacgucagaaacaacuucuuccacuacaaccaaggaucugacucccgucuccgccucauagccaugcuguacacaccccuacgcgcaaacaauucaggcgacgacgucuucaccgucucaugccguguccuuacacgcccauccccagacuucagcuucaacuuccuagucccacccaccguagaauccaaaaccaaacccuuuucacuacccauccucacaauuucagaaauguccaacucccguuuccccguccccaucgacucccuucacaccucccccaccgaaaacauaguaguacaaugccagaacggccgaguuacccuagacggcgaacuuaugggcaccacucaacuccucccaucccaaaucugcgccuuucgcggcaugcucaccagaucuaccucgcgcgccucagaucaagccgacaccgcaacaccccgccuauucaacuauuacuggcacauccaacucgacaaucuuaacggaaccccauacgacccagcagaagacauccccggcccacuuggaacccccgacuuccgaggcaaagucuucggaguagccucacaacguaaccccgacgcaacaacccgagcccaugaagcaaaaauugacacgacguccggacgauucacucccaaacucggaucccuagaaauuucaaccgaaucaggugacuucgaccaaaaccaacccacccguuucacccccgucggcaucggagucgaucacgaggccgacuuccaacaauggacacuccccgacuacgccggacaauucacccacaacaugaaccucgcccccgccgucgcgcccaacuuccccggagaacaacuccuauucuuccgcucccaacucccauccuccgguggccgauccaacggaauccuagacugccucguaccgcaagaauggguccaacacuucuaccaagaauccgcaccaucccagacccaagucgcccuaguaagauacguaaacccggacaccggccgaguacucuucgaagccaaacuacacaaacucggauucaugaccaucgccaaaagcggcgacucccccaucacuguacccccuaacggcuacuucagauuugaauccugggucaacccuuucuauacucuugccccaauggguacaggaaacggccgccgccgcauucaauaa

SEQ ID NO: 35558 - RNA, 1623 nt, Artificial Sequence
  derived and/or modified sequence opt11 from capsid_protein_VP1__Norovirus__AII02773
augaaaauggccuccaacgacgcaaaccccuccgacggcuccgcggccaaccucguucccgaagucuccaacgaaguuauggcccuagaacccgucguuggcgccgcaaucgccgcacccgucgcaggccaacaaaacgucaucgauccauggauccgcaacaacuucguccaagcccccggcggagaguucaccgucucucccagaaacgcccccggugaaauacucugguccgcaccccuagguccagaccucaacccuuaccuaucccaccuggcccgcauguacaacggcuacgccggcggcuucgaaguacaagucauccuagcaggaaacgcuuucaccgccggcaaaauuaucuucgcugccgucccacccaacuuccccacagaaggccugucacccucacaaguaaccauguucccccacauaauaguagacguacgucaacuagaaccuguguuaauuccccuacccgacguccgaaacaacuucuaccacuauaaccaaaccaaugauucaaccaucaaacucaucgccaugcuuuacacaccccuccgcgccaacaacgcaggagaagaugucuucaccgucucaugccgcgugcucacccgacccuccccagacuucgacuucauauucuuagucccacccaccgucgaaucccgcaccaaaccauucaccguaccaauccucacagucgaagagaugacaaauuccagauuccccaucccacuagaaaaacucuucaccggucccucaggcgcauucguaguccaaccacaaaacggucgaugcaccaccgacggcguccuccucggaaccacacaauuauccccaguuaacaucugcaccuuccgcggcgacgucacccacaucgccgguucccguaauuacaccaugaaccuagccucccucaacuggaacaacuacgaucccaccgaagaaaucccagccccacucggcaccccugacuucgucgguaaaauucaaggcguccucacacaaaccaccaaaggcgacggcuccacccgcggacacaaagcaacaguauacaccggcucagcuccauucacuccuaaacucgguuccguacaauucucaaccgacaccgaaaacgacuuugaaacccaccaaaacaccaaauucacucccgucggcgucauccaagacgggggcaccacacaccgcaacgaaccccagcaauggguccuccccuccuacuccggccgagacguacacaacguccaccuagccccugccgucgccccgaccuuccccggcgaacaacuauuauucuuccguucaaccaugccuggcugcuccggguacccuaacauggaccuagacugccuccucccacaagaauggguccaacacuucuaccaagaagccgcacccgcccaaucagacguugcccuccuucgcuucgucaacccagacacaggccgcguccuguucgaaugcaaacuucacaaauccggcuacgucacaguugcacacacgggccaacacgaccucgucaucccacccaacggcuacuuccgauucgacuccugggucaaccaauucuacacccucgcacccaugggcaacggcacaggccgacgucgugcccucuaa

SEQ ID NO: 35559 - RNA, 1650 nt, Artificial Sequence
  derived and/or modified sequence opt11 from capsid_protein_VP1__Norovirus__AII02776
augaaaauggcuuccaacgacgccgcccccuccaacgacggcgccgcaaacuuaguccccgaagcaaacaaugaaguaauggcacuugaaccuguugucggcgccucuaucgcggccccaguagucggccagcaaaacaucaucgaccccuggauccgcgagaacuucguccaagccccgcaaggcgaguuuaccguaucuccccgcaacucccccggcgaaaugcuucuuaaccuagaacucgggcccgaacuaaaccccuaccuaucccaccuauccagaauguacaacggauacgccggaggcaugcaaguccaaguaguccucgcaggcaacgccuucacagccggcaaaaucaucuucgcugcaguuccaccccacuuccccguagaaaacaucaacgccgcacaaauaaccaugugcccccacgucaucguagauguccgucaacuagaacccguccuccucccccucccugacauccgcaacagauucuuccacuacaaccaagaagacaccccacgcaugcgccuagucgccaugcucuacacuccccuacgugcaaacuccggcgaggacgucuucaccgucucuugccgcguccuuacucgcccagcccccgauuucgaguucacuuuucucgucccucccacagucgaaucuaaaacaaaacccuucacuuuacccauccucacccucggcgaacucuccaacucccgcuucccagcuccuaucgacaugcucuacaccgacccaaacgaaggcaucgucguccaaccccaaaacggccguugcacccucgacggcacacuacaaggcaccacacaacucguccccacacaaaucugcgcauuccgcggcauacuaauaggacaaacaucccgaucucccgacuccgacucaacagacucagccccacgucgccgagaccacccacuacauaugcagcucgaaaaucuagacggcacucaguacgaccccacggacgaaguucccgccgcccucggagcgguagacuucaaaggcaccaucuucggcgucgccagccaacgugacaccuccgguagccaagucggcgccacccgcgcccacgaagucaucaucaauaccaccgacccaagauauaccccaaaacucggaucaguccucauguacuccgaaucccaagacuucgaaaccggccaacccauacgcuucacacccaucggcaugggcgaaaacgacuggcaccaaugggaacuccccaacuauuccggaagacucacauuaaacaugaaccucgcccccgccgucgcccccgcauuccccggcgaacgcauccuauucuucagaucaaucguccccuccgccggcgguuacggauccggccaaauggacugccuacucccacaagaauggauccaacauuucuaccaggaagcagcacccucccaauccgccguggcccucauacgguacgugaaccccgacaccggacgcaacaucuucgaagccaaacugcacagagaagguuucaucaccgucgcaaacuccggaaacaacccaauaguugucccaccaaacggauacuuucgcuucgaagccugggucaaccaauucuacacccucaccccaauggguacaggacaaggccgacgccgaaaccaauaa

SEQ ID NO: 35560 - RNA, 1623 nt, Artificial Sequence
  derived and/or modified sequence opt11 from capsid_protein_VP1__Norovirus__AII02779
augaaaauggccucaaacgacgccaaucccuccgacggaagcgcagcaaaccuagucccagaaguauccaacgaaguaauggcccucgaacccguagucggagccgccaucgccgccccugucgccggacaacaaaacgucaucgaccccuggauccggaacaacuucguacaagcccccgguggagaguucaccgucucgccacggaacgccccaggcgaaauccucuggagcgccccacucggccccgaccucaaucccuaccucucccaccucgcuagaauguauaauggauacgccggcgguuucgaaguacaagucauccucgcagguaacgccuuuaccgcaggcaaaaucaucuucgcagccgucccacccaacuuccccaccgaaggccucucgccaucacaagucaccauguucccccacaucauagucgacguccgccaacuagagccaguccuuauuccccucccagacguccgcaauaacuucuaccacuacaaccaaacaaaugauuccacaaucaaacuaauagcaaugcuauacaccccgcucagagccaacaacgccggcgaagacguauuuacaguaucaugucgaguuuuaaccagaccaucaccagacuucgacuuuauauuucucgucccacccaccguugaaucacgaacaaaacccuucaccguacccauauuaaccguagaagaaaugaccaacucccgcuuuccaauacccuuagaaaaacucuucacaggccccagcggcgccuuugucguccaaccacaaaacggccgaugcacaaccgacggcguacuccuaggcaccacccaacuauccccugucaacauauguaccuuccgaggugacguaacccacaucgcuggcuccagaaacuacacaaugaaccuagccucccuaaacuggaacaacuacgaccccaccgaggaaaucccagcaccacuuggcacccccgacuucgucggcaaaauccaaggaguacucacccaaaccacaaaaggcgacggcuccacacgcggucacaaagccacagucuacaccgguagcgccccauucaccccaaaacucggauccguccaauucucaacagacacagaaaacgacuucgaaacacaccagaacacuaaauuuacccccgucggcguaauucaagacggcggaaccacccaccggaacgaaccacaacaauggguccucccgucauacagcggccgcgacguucauaacgugcaucucgcucccgccguagcccccacauuccccggcgaacaacuccucuucuuccgcuccacaaugcccggcugcucaggauaccccaacauggaccuugacugccuacuaccacaagaauggguccaacacuucuaccaagaagccgcccccgcccaauccgacgucgcacuacuaagauucgucaacccagacacaggccgaguccucuuugaaugcaaacuccauaaaagcggauacgucaccguagcccacaccggccagcacgaccucgucauucccccaaacggcuacuuccgcuucgacucaugggucaaccaauucuacacccucgcccccaugggcaauggaacaggccgccgccgagcccucuga

SEQ ID NO: 35561 - RNA, 1623 nt, Artificial Sequence
  derived and/or modified sequence opt11 from capsid_protein_VP1__Norovirus__AII02782
augaaaauggccuccaaugacgccaaucccuccgauggcuccgccgcaaaccucguccccgaagucuccaacgaaguaauggcucucgaacccgucgucggcgcagcuaucgccgcccccgucgcaggccaacaaaacguuaucgacccuuggauccgcaauaacuucguucaagcacccggaggagaguucaccgucuccccacgaaacgcucccggcgaaauacuauggucagcaccacuaggccccgaccucaaccccuaccucucccaccuagcccgcauguauaacggcuacgccggaggcuucgaaguccaagucaucuuagccggcaacgccuucacagcaggaaaaauuauauucgcagcagucccacccaacuucccaaccgaaggccuauccccaucccaagucacaauguucccucacaucauuguagacguccgccaacuagaaccaguccuaaucccccugccugacguccgcaacaacuucuaccacuacaaucaaacuaacgacucgaccaucaagcucaucgcaaugcuuuacacaccccuccgugccaacaacgccggagaagacgucuucaccgucuccugccguguccucacccgccccuccccagacuucgacuucaucuuccuugucccacccaccgucgaaucacggaccaaacccuucaccguccccauccucaccgucgaagaaaugacuaacucccgcuuccccauaccccucgaaaaacuauuuaccggccccuccggcgcauucgucguccaaccccaaaacggccgaugcacuaccgacggcguccuacugggcaccacccaacucucucccgucaacauuuguacuuuccgaggcgacgucacccacauagccggcucccgcaacuacaccaugaaccucgcaucccuuaacuggaauaacuacgacccuaccgaagaaaucccagcaccccuagguaccccagacuucguagguaaaauccaaggcguccuaacccaaaccacuaaaggcgacggaagcacccgaggccacaaagcuaccgucuacacaggcuccgcccccuucacaccaaaacucggcuccguacaauucagcaccgacaccgaaaacgacuucgaaacccaucaaaacaccaaauucaccccagucggcguuauacaagacggcggcacaacccaccgcaaugaaccacaacaguggguccucccauccuacagcggccgcgacguacacaacguccaucucgccccagccgucgcccccaccuucccuggcgaacaacuccuuuucuuccgcuccacaaugcccggaugcucuggcuacccaaacauggacuuagauugccuccucccucaagaauggguacaacauuucuaccaagaagccgccccugcgcaaucugacgucgcacuccuccgauucguaaaccccgacaccggccguguacucuucgaauguaaacuccacaaauccggcuacgucacugucgcccacaccggccagcacgaccuagucaucccacccaacggauacuuccgcuuugauucaugggucaaccaauucuacacgcucgcacccaugggcaacggcacaggccgcagacgggcccuguga

SEQ ID NO: 35562 - RNA, 1623 nt, Artificial Sequence
  derived and/or modified sequence opt11 from capsid_protein_VP1__Norovirus__AII02785
augaaaauggcauccaacgacgcaaaccccagcgacggcuccgccgccaaccucguacccgaagucuccaacgaagucauggcgcucgaacccgucgucggcgcagccauugccgcccccguagccggccaacaaaacguaaucgacccuuggauccgaaauaacuuuguacaagcccccggcggcgaguucaccgucucaccacguaacgcaccaggcgaaauccuguggucagcuccccucggccccgaccuaaaucccuaccucucccaccuagcccgcauguacaacgguuacgccggcggauucgaaguccaagucauccucgccggaaacgccuucaccgcgggaaaaaucauauucgccgccgucccacccaacuuccccaccgaaggccuaucccccucccaagucaccauguucccccacauaaucgucgacguccgacaacucgaacccguacuaauaccucuacccgacguccgcaacaacuucuaccacuauaaccagaccaacgacuccaccaucaaauuaauagccaugcucuacacaccccuacgagcaaacaaugccggcgaagacgucuucaccgucucgugccgaguccucacccgccccuccccagacuucgacuuuaucuuucuagucccacccacgguagagucaagaaccaaacccuucaccguacccauacuaacaguagaagaaaugacaaacagccgcuuccccauuccccucgaaaaacucuucaccggcccauccggcgccuucgucgugcaaccccaaaacggucgaugcacuacagacggcguccugcuaggaaccacacaacuaucccccgucaacaucugcacauuccgcggagacgucacccacaucgccggcucccgaaacuacacaaugaaccucgcauccaucaacuggaacaacuacgaccccaccgaagaaauacccgcaccccuaggaacuccagacuucgugggcaaaauccaaggcguacuaacccaaaccacaaagggcgacggcucuacccgaggccacaaagcaaccgucuacaccggauccgcccccuucacccccaaacucggauccguccaguucucuacugacaccgaaaacgacuucgaaacccaucaaaauaccaaauucaccccagucggagucauccaggacggaggcacaacccaccgcaaugaaccccaacaaugggugcuacccuccuacuccggccgagacguucacaacguacaccuagcacccgccgucgcucccacauuccccggcgaacaacuucuauucuucagauccaccaugcccggaugcuccggauaccccaacauggaccuugacugccuucugccccaagaauggguccaacacuucuaccaagaagccgcccccgcccaaucagacgcagcccuacuacgauucgucaacccagacaccggccguguccuuuucgaaugcaaacuacauaaauccggauacgucaccgucgcccacacaggacaacacgacuuaguuauaccacccaacggcuacuucagauuugacuccuggguaaaucaauucuacacccucgccccaaugggcaacggcaccggccgacgacgcgccuuauaa

SEQ ID NO: 35563 - RNA, 1647 nt, Artificial Sequence
  derived and/or modified sequence opt11 from capsid_protein_VP1__Norovirus__AII02788
augaaaauggccucuaacgacgccgcaccauccaacgacggcgcagccggccucguuccagaaauuaacuccgaagccauggcccucgaacccgucgccggcgcugccaucgccgcaccccucacaggccaacaaaacaucauagacccguggaucaugaacaauuucguucaagcccccggaggcgaguucaccgucucaccccgaaacucccccggcgaaguccuacuaaaccuagaacucggacccgaaaucaacccauaucuugcccaccuugcccgcauguacaacggcuacgccggcggcuucgaaguccaaguaguacuagccgggaacgcuuucacagccggaaaaauaaucuucgccgccaucccacccaacuuccccauagacaaccucuccgccgcacaaauaacgaugugcccccacgucaucgucgacguucgacaacuagaaccagucaaccugccgaugcccgacguccgaaauaauuucuuccacuacaaccaaggaagugacucccgucuccgacuaaucgcaaugcucuacacaccccuacgagccaacaacucaggugacgacguuuucaccgucuccugccgcguacucacccgacccuccccagacuucuccuucaacuuccucguaccucccaccgucgaauccaaaaccaaacccuucucccuccccauccuuacuauaucugaaauguccaacucacguuuucccguucccaucgacucacuacacaccagccccacagaaaacaucguaguccaaugccaaaacggucgcgucacccuugacggcgaacuaaugggaaccacacaauuacuaccuucacaaauaugcgccuuccgggguaugcuuacacgaucuacgucccgcgcaucggaccaagccgacaccgcaaccccacgccuauucaacuacuacuggcacauccaacuagacaaucucaacgguacccccuacgacccagccgaagacaucccaggcccccuaggcacccccgacuuucgaggaaaagucuuuggcguagccucacaaagaaacccagacgccacuacccgcgcccacgaagcaaaaauagacaccaccuccggucgcuucaccccuaaacuaggcucauuagaaaucuccaccgaaagcggcgacuucgaccaaaaccaacccacccgauuuaccccagucggcaucggcgucgaccacgaagccgauuuccaacaauggacccuaccagacuacgccggacaauucacacacaacaugaaccucgcucccgccguugcacccaacuucccuggugaacaacuccucuucuuccgaucccaacuaccaagcucaggcggccgcuccaacggaaucuuggacugucucgucccacaagaauggguccaacacuucuaccaggaaucagccccaucccaaacacagguagcccuuguccgcuauguaaaccccgacacaggccgcguccucuucgaagcaaaacuccacaaacucggcuucaugaccaucgcuaaauccggagacucccccaucacagucccacccaacggcuacuuccgcuucgaaucguggguaaaccccuucuacacacucgcccccauggguacagguaacggaagaagacgaauccaauaa

SEQ ID NO: 35564 - RNA, 1647 nt, Artificial Sequence
  derived and/or modified sequence opt11 from capsid_protein_VP1__Norovirus__AII02791
augaaaauggccucaaacgacgccgcccccucaaacgacggcgccgccggccuuguacccgaaauaaacuccgaagccauggcccuagaacccgucgccggcgcagcaaucgccgcuccccucaccggccagcaaaacauuaucgauccauggaucaugaacaacuucguucaagcccccggaggcgaguucacagucuccccucgcaacagccccggagaaguacuacucaaccuugaacuaggcccagaaaucaacccauaccucgcacacuuagcccggauguacaacggauacgcaggcgguuucgaaguccaagucguccucgccggcaacgcuuucaccgcaggcaaaaucaucuucgcugcaauacccccaaacuuccccaucgacaaccucuccgccgcccaaaucacaaugugcccucacguaauaguagauguccgccaacucgaaccaguaaaccuccccaugcccgacguccgaaacaacuuuuuccauuacaaccaaggaucugacucacgccuacgccucaucgccaugcuauacacaccccuacgcgccaauaauuccggagacgacgucuuuaccgucuccugccgaguccucacccgccccucccccgacuucuccuuuaacuuccucguaccacccaccguagagucaaaaaccaagcccuucucccuccccauccucaccaucucagaaaugagcaauucucgauucccuguccccaucgacucccuccacaccuccccaaccgagaacaucgucguccaaugccaaaacggacgcgucacccuagauggcgaacuuaugggaacaacccagcuccuccccucccaaaucugugcauuccgcggaaugcucacucgcagcaccucaagagccuccgaccaagccgacacagcuacuccccgccuauucaacuacuacuggcacauucaacucgacaaucucaacggcacccccuacgacccagccgaagacauccccgguccccucggaacccccgacuuccgcggcaagguauucggaguggcaucccagcguaaccccgacgccaccacccgcgcccacgaagcaaaaaucgacaccaccucaggccgauuuacccccaaacucggcucacuagaaaucucgaccgaauccggcgacuucgaccaaaaccagcccaccagauucaccccagucggcauaggcgucgaccacgaagccgacuuccaacaauggacacucccagacuacgccggccaguuuacccacaacaugaaccucgcaccggcagucgccccaaacuuccccggagaacaacuccucuuuuuccgaagucaacuacccucuucuggcggucgauccaacggaauccuugacugccuagucccccaagaauggguccaacacuucuaccaagaauccgccccaagccaaacacaagucgcauuaguacguuacguaaaccccgacaccggcagaguccucuucgaagcuaaacuacacaaacucggcuucaugaccauugccaagucaggagacagcccaauuacuguacccccuaacgguuauuuccgcuucgaauccugggucaacccauucuacacacucgcucccaugggcacgggaaacggccgccgccgcauucaguaa

SEQ ID NO: 35565 - RNA, 1623 nt, Artificial Sequence
  derived and/or modified sequence opt11 from capsid_protein_VP1__Norovirus__AII02794
augaaaauggcaucaucggacgccaaccccucagauggcucaacagcuucacucguccccgaaguaaacaacgaaguaauggcucuagaacccgucgucggcgccgccauagccgcaccugucgccggucaacaaaauguaaucgaccccuggauccgaaacaacuucguacaagccccaggcggcgaguucacagucagccccagaaacgcacccggagaaauccucugguccgcgccccucggaccagaccucaacccauaccuaagccaccuagccagaauguacaacggcuacgccggaggcuucgaaguccaaguuguucucgccggcaaugccuucaccgccggcaaaaucaucuucgccgccgucccgcccaacuuccccacagaaggccucucucccagccaaguaacuauguucccgcacaucauagucgauguacgccaacucgaaccuguccucauaccccucccagacguccgcaacaacuucuaucacuacaaccaauccaacgaccccacaaucaagcucaucgcaaugcucuacacaccccugagagccaacaacgcaggagacgacguauucaccgucucaugccgcguccucacccguccauccccggauuucgacuucauauuccucguaccuccaaccguagaaucgcgcacuaaaccauucuccgucccaguccuaaccguagaagaaaugaccaacagccgauuccccaucccacuugaaaaacucuucacaggcccauccucagcauuugucguccaaccccagaacggccgaugcaccaccgauggcguccuucuuggcaccacucaacucagcccagucaacaucuguaccuuccgaggagacguuacccacauauccgguucacgcaacuacacaaugaaccucgccucacaauccuggaacuccuacgauccaaccgaagaaauccccgccccacucggaucccccgacuucgucggaaaaauccaaggagucuuaacacagaccacacgaacaaacggcucaacccgaggccacaaagccacugucuacacaggcuccgccgacuucucccccaaauuaggacgcguccaauucgcuaccgauaccgacaacgauuucgaaaccaaccaaaauaccaaauucacccccguaggcguuauccaagacgggucaaccacaccacgcaacgaaccccaacaauggguacuaccaucuuacuccgggcgcaacauccacaacguccaccuugcaccagcagucgcuccgaccuuccccggcgaacaacuccuauucuuccguucaaccaugcccggcugcuccggcuaccccaacauggaccucgauugccuccuaccccaagaauggguccaauacuucuaccaagaagcagccccagcccaauccgacgucgcccuccuacgcuucguaaaccccgacacugguagaguacucuucgaauguaaacuccacaaauccggcuacguaaccguagcucacaccggccaacacgaccucgucaucccacccaacggauauuuccgcuucgacucauggguuaaccaauucuacacccucgcacccaugggcaacggaaccggacgacgucgcgcccuguaa

SEQ ID NO: 35566 - RNA, 1623 nt, Artificial Sequence
  derived and/or modified sequence opt11 from capsid_protein_VP1__Norovirus__AII02797
augaaaauggcauccaacgacgcaaaccccuccgacggcuccgcagcaaaccuuguccccgaagucucgaacgaaguaauggcacuagaacccgucguuggugccgccauagccgcccccguugcaggacaacaaaacguuaucgaccccuggauccguaacaacuucguccaagcccccggcggugaguucaccgucucuccucgaaacgcaccuggcgaaauccuuuggucugccccacucggccccgaccucaaccccuaccucucacaccuagcgcgaauguacaacgguuacgccggaggauucgaaguacaaguuauccuagcaggaaacgcauucaccgcaggcaaaaucaucuucgccgcagucccacccaacuuccccaccgaaggucucucccccagccaagucaccauguuuccucacaucaucgucgacguccgccaacuagaaccaguccucaucccacuaccagacguacgcaacaacuucuaccacuacaaccaaaccaacgacagcaccauuaaacuaaucgcaaugcuauacaccccacuucgugcuaacaacgcaggagaagacguauucaccguaucaugcagaguacuuacccgaccaucccccgacuucgacuucauauuccuuguacccccuacagucgaaucccgcacaaaacccuucacuguaccaauucuaaccgucgaagagaugacaaacucccgauucccaaucccccucgaaaagcucuuuacuggcccauccggcgcauucgucguacaaccccaaaacggccgaugcaccaccgacggcguccuccucggaacaacccaacuaucaccagucaacaucugcacauucagaggugacguaacacacaucgccgggucccgcaacuacaccaugaaucucgcaucacucaacuggaauaacuacgaccccaccgaagaaauccccgcaccacucggcacaccagacuucguaggcaaaauacaaggaguccuuacacaaaccacaaaaggcgacggcuccacccgcggccauaaagcaaccgucuacacaggcagcgcccccuucacccccaaacucggcuccguccaauucuccaccgacaccgaaaacgacuucgaaacacaccaaaacacuaaauucaccccaguaggcgucauccaagacggcggaacaacacaccggaacgaaccacaacaauggguccuccccuccuacuccggacgcgacguacacaacguccaccucgcccccgccgucgcccccacauuuccaggcgaacaacuacucuucuuucgcuccaccaugcccggcuguucagguuaccccaacauggaccucgacugccuccucccccaggaauggguacaacacuucuaucaagaagcugcccccgcccaauccgacgucgcccuccuacgcuucguaaaucccgacaccggccgcguccuauuugaaugcaaacuacacaaauccggcuacgucacagucgcacacaccggucaacacgaccucgucaucccacccaacggcuauuuccgcuucgacuccugggucaaccaauucuacacacuagcuccaaugggcaacggcacaggccgacgccgagcccucuaa

SEQ ID NO: 35567 - RNA, 1623 nt, Artificial Sequence
  derived and/or modified sequence opt11 from capsid_protein_VP1__Norovirus__AII02800
augaaaauggcauccaacgacgcaaaccccagcgacggcagcgccgccaaccuggucccugaaguaucaaacgaagucauggcgcucgaaccagucgucggcgccgcaaucgcagcccccgucgcaggccaacaaaacgucaucgaccccuggauccgcaacaacuucguccaagccccaggcggcgaguucaccgucucuccccguaacgcccccggagaaauacucugguccgcccccuuaggccccgaccucaacccauacuuaucccaucuagcccgcauguauaacggauacgccggaggcuucgaaguccaaguuauacuagcaggcaacgccuucaccgccggcaaaaucaucuuugccgcaguuccaccaaauuuccccacagaaggccugucccccucacaagucacaauguucccccacaucauagucgacguucgucaacuagaacccguccucaucccccuccccgacguccgaaacaacuucuaccacuacaaccaaacaaacgacuccaccauaaaacugaucgccaugcucuacacaccacuaagagccaacaaugccggcgaagacgucuucaccguaucaugccgaguacuaacucgacccucccccgacuucgacuucaucuuccucgucccacccaccguagaaagcagaaccaaacccuucacgguacccauccucaccgucgaagaaaugacuaacucccgcuuccccauaccccuagaaaaacucuucaccggacccuccggcgccuucgucguccaaccccaaaacggaagaugcaccacugacggcguacuccucggaaccacccaacucucacccgucaacaucugcaccuucagaggcgauguaacccacaucgcuggcucccgcaacuacacaaugaacuuagcaucccuaaacuggaacaacuacgaccccaccgaagaaaucccagcaccccucggcaccccagacuucgucggcaagauccaaggcguccucacacaaaccacuaaaggcgacggcucgacacgaggccacaaagccacugucuacaccggcuccgccccauucacuccaaaacucggcuccguccaauuuuccacagacaccgaaaacgacuucgaaacccaccaaaacaccaaguucacucccgucggagucauacaggacgguggcaccacccaucgcaacgaaccccaacaauggguacuccccucauacucaggacgcgacguccauaacguccaccucgcccccgccgucgccccgaccuuccccggcgaacaacuacuauucuuccgcuccacuaugcccggcugcucugguuacccaaacauggaccuagacugccuccucccacaagaauggguacaacauuucuaccaagaagccgcgcccgcacaauccgacgucgcccuacuacgcuucgucaaccccgacacaggccgcguucuguucgaaugcaaacuucacaaauccggcuacguaacagucgcccacaccggccagcacgaccucgucaucccacccaacggcuacuuccgguucgacuccugggucaaccaauucuacacccuagcacccaugggcaacggcaccggccgccgacgagcccuuuga

SEQ ID NO: 35568 - RNA, 1623 nt, Artificial Sequence
  derived and/or modified sequence opt11 from capsid_protein_VP1__Norovirus__AII02803
augaaaauggcauccaacgacgcuaaccccagcgacggcucagcagcuaaccucguacccgaaguuagcaacgaagucauggcccucgagcccgucgucggagccgccaucgcagcacccguagccgggcagcaaaacguaaucgacccauggauccgcaauaacuucguccaagcccccggaggugaguucaccgucagcccacgcaacgccccaggagaaauacucugguccgccccacuuggucccgaccucaacccauaucucucucaccucgcacgcauguacaacgguuacgccggaggcuucgaaguucaagucauccuagccgggaacgcauuuaccgccggcaaaaucaucuucgccgcaguaccacccaacuuccccacagaagguuuaucacccucccaagucaccauguucccccacaucaucguagaugucagacaacucgaacccguccucaucccccuacccgacguccgaaacaauuucuaccacuacaaccaaaccaacgacccaacuaucaaacucauagccaugcuauauacuccccuccgcgcuaacaacgccggugaagaugucuucaccgucagcugccgaguucucacccgucccucucccgacuucgacuucaucuuccucgucccaccaaccgucgaaucccgcaccaagccauucaccguccccauccucaccgucgaagaaaugaccaacucacgcuuccccaucccccucgaaaaacuuuucaccggcccuucaggcgcauucgucguacaaccacaaaauggccgauguaccaccgacggcguccuacucggcacaacacaacuaucccccgucaacauuugcaccuuccgaggcgacguaacccacaucgccggcucacgcgacuacaccaugaaccucgcaucccucaacuggaauaacuacgaccccacagaagaaauaccagcaccacucggcacccccgacuucguaggcaaaauccaaggaguccucacccaaaccacccggggagacggguccacccgaggacauaaagccacagucuacaccgggucagcacccuucgcacccaaauuagggucuguucaauucuccaccgacaccgaaaacgacuucgaaacccaucaaaacaccaaauucacacccgucggcgucauacaagacggcgguacaacccaccgaaacgaaccccaacaauggguccuaccauccuacuccggaagagacguccacaacguucaccucgcacccgcaguggccccaaccuuccccggcgaacaacuucucuucuuccgaucaacaaugcccggcugcagcggcuaccccaacauggaccuugacugccuacucccccaagaauggguacaacauuucuaucaagaagccgcaccagcccaauccgacgucgcccuacuucgauucgucaaccccgacaccggccgcguucuuuucgaaugcaaacugcacaaaucaggauaugucaccguagcacacacaggacaacacgaccuggucauaccacccaacggcuacuuccgcuucgacagcuggguaaaucaauucuacacccucgcacccaugggcaacggcaccggacgccgccgcgcccucuga

SEQ ID NO: 35569 - RNA, 1623 nt, Artificial Sequence
  derived and/or modified sequence opt11 from capsid_protein_VP1__Norovirus__AII02806
augaagauggccuccaacgacgcaaaucccagcgacggauccgccgcuaaccucguacccgaaguauccaacgaagucauggcccucgaaccaguagucggcgccgcaauagcugcucccgucgcuggacaacaaaacgucaucgaccccuggauacgaaacaacuucguccaagccccaggcggagaguucaccgucuccccucgcaacgccccuggagaaauccuauggucagcaccccucggucccgaccucaacccauaccuuucacaccucgcccgcauguacaacgguuacgccggcggauucgaaguccaaguaauccuagccggcaacgcauucacagccggcaagaucauauuugccgccguaccacccaauuuccccaccgaaggccuuucacccucccaaguaaccauguucccccacaucaucgucgacguccgacaacuagaacccguucucauaccccuaccagacguccgcaacaacuucuaccacuacaaccaaacaaacgacucaacaauaaaacucaucgcaaugcuauacacaccccuacgcgccaacaacgccggagaagacgucuucaccgucucaugcagaguacuaaccagaccaaguccugacuuugauuucaucuuucuagucccacccaccgucgaaucccgcaccaaacccuucaccguccccauccuaaccgucgaagaaaugaccaacucccgauuccccaucccccucgaaaaacuauucaccggucccucaggagccuucgucguccaaccccaaaacggacgcugcacuacagacggaguccuacucggaaccacccaacuaucuccagucaacaucugcacguuccgaggagacguaacccacaucgccggaucacgcaacuacaccaugaaccuagccucccuaaacuggaacaacuacgaucccacagaagaaauuccagccccucucggcaccccagacuucguaggcaaaauccaaggcguucucacccaaaccaccaaaggagacggaagcacacgaggccacaaagccacugucuacacaggauccgccccauucaccccaaaacucggcuccguucaauucuccacagacaccgaaaacgacuucgaaacccaccaaaauaccaaauucaccccagucggcgucauacaagacgguggcacgacucaccgcaacgaaccacaacaaugggugcuacccuccuacucaggacgcgauguccacaacguccaccuagccccagcaguagccccaaccuucccaggagaacaacuccucuucuuccgauccacaaugccuggcugcagcggcuaccccaacauggaccucgacugccuacucccgcaagaauggguccagcacuucuaucaggaagcagcacccgcacaauccgacguagcccuccuccgcuucgucaaccccgacaccggucgaguccucuucgaaugcaaacuccacaaauccggcuacgucaccgucgcccacaccggccaacacgaccuagucauaccaccaaacggcuacuuccgcuucgacuccugggucaaccaauucuacacccuagcccccaugggcaacggaaccggacgccgacgcgcccuauaa

SEQ ID NO: 35570 - RNA, 1623 nt, Artificial Sequence
  derived and/or modified sequence opt11 from capsid_protein_VP1__Norovirus__AII02809
augaaaauggcauccaaugacgcaaaccccucagacggcucagcagcuaaccucguccccgagguaaacaacgaagucauggcccuugaacccguaguaggagccgccaucgccgcccccgucgccggacaacaaaacgucaucgacccauggauaagaaacaacuucguacaagcccccgggggcgaguucacgguuucuccacgcaacgcacccggcgaaauccuaugguccgcaccccucggcccagaccucaacccuuaccucucccaucucgccagaauguacaacggcuacgccggcggcuucgaaguucagguaauacucgcaggaaacgccuucacagccggaaaaaucaucuucgcagccgucccacccaacuuccccaccgaaggucucucccccagccaagucaccauguuuccacacaucauaguagacguacgccaacuagaaccaguccucaucccucuccccgacguccguaacaacuucuaccacuacaaccaaucaaacgacucuaccaucaaacuaaucgccaugcuuuacaccccacuacgcgcaaacaacgcuggagaagacguauucacaguaucaugccguguccucacacgcccaucccccgauuucgacuucauauuccucguacccccaacagucgaaucccgaaccaaaccuuucaccguccccauccuaacggucgaagagaugaccaacucuagauuccccaucccccucgaaaaacuauucaccggacccuccggcgcauucauaguccaaccgcaaaacggcagaugcaccacugacggaguccuccuaggcacaacacaacucucccccgucaacaucugcaccuuucgcggagacgucacccacaucgccggaucacgaaauuacaccaugaaccuugccucucucaacuggaacaauuacgaccccaccgaagaaaucccugccccacuuggaacccccgacuucgucggcaaaauucaaggcguucucacccaaacaacgaagggcgacggaucuacccgcggacauaaagccaccgucuacaccggauccgcccccuucaccccaaaacuagguuccguucaauucuccaccgacacagaaaacgacuucgaagcccaccaaaacaccaaauucacacccgugggcgucauccaagacggcggcacaacccaccgaaacgaaccccaacaauggguucuaccgucauacuccggccgcgacguccacaacguacaccuugcccccgcaguugcaccuacauuccccggagaacaacuacuauucuuccggagcacuaugcccggaugcucaggauaccccaacauggaccucgacugccuacuaccccaagaauggguacagcacuucuaccaagaagccgcccccgcccaaucagacguugccuuacuacgcuucguaaaccccgacacaggucgcguccuauucgaaugcaaacuccacaaauccggauauguaaccgucgcccacacaggacaacacgaccucguuauaccacccaacggcuacuuccgguucgacuccugggugaaccaauucuacacacuagcccccauggggaacggcaccggacgucgacgagcccucuaa

SEQ ID NO: 35571 - RNA, 1647 nt, Artificial Sequence
  derived and/or modified sequence opt11 from capsid_protein_VP1__Norovirus__AII02812
augaaaauggccucaaaugacgccgccccauccaacgacggagcagccggccucgugccagaaaucaacagcgaagccauggcucuagaaccaguugccggcgcggccaucgcagccccucucaccggacaacaaaacauuaucgaccccuggaucaugaacaacuucgugcaagcccccggcggcgaguucaccguauccccaagaaacucucccggcgaaguccuacuaaaucucgaacucggaccagaaaucaaccccuaccucgcccaccucgcacgcauguacaacggcuacgccggcggcuucgaagugcaaguaguccuugccgguaacgccuucacagccggcaaaaucaucuucgccgccaucccuccuaacuucccaaucgauaaccucagcgccgcucaaauaacaaugugcccccacguuaucgucgacguccgacaacuagaacccgucaacuuacccaugccagacguccgcaauaacuucuuccacuacaaccaaggauccgauucuagacuucgccucaucgccaugcucuacaccccacuccgcgccaacaacuccggcgacgacgucuucaccguauccugccggguucucacccgcccauccccagacuucuccuuuaacuuccucguaccacccacagucgaaucaaaaaccaaacccuucucacucccaauacucacuauaucagaaauguccaacagcagauuucccgucccuaucgauucccuacauaccucaccuaccgagaacaucguaguccaaugccagaacggccgaguaacgcuagauggcgaacucaugggcaccacccaacuccuuccuagccaaaucugcgcauucagaggaaugcucacccguucaaccucucgggcaagcgaccaagccgacaccgccacuccccgccuauucaacuacuacuggcacauacaacucgacaaccucaacggcacccccuaugaucccgcugaagacauacccggaccccucggcacgcccgacuucagaggaaaagucuucggcguagccucucaacgaaacccagacgccacaacccgagcacacgaagccaagaucgacaccaccuccggccgcuucacacccaaacuaggcucgcucgaaaucucaaccgaaucaggcgacuucgaccaaaaccaacccacccguuucacaccagucggcaucggcgucgaccacgaggccgacuuccaacaauggacccuacccgacuacgccggccaauuuacccacaacaugaaccuagcccccgccguagcuccaaacuucccaggcgagcaacuacuauucuuuagaucacaacuccccuccuccgguggccgcucaaacggcauccucgacugccuagucccccaggaauggguacaacacuucuaccaggaguccgcccccucccaaacccaagucgcccuuguccgauacgucaacccagacacaggccguguccucuucgaagccaaacuccacaaacuaggcuucaugaccaucgccaaauccggcgacucacccaucaccguaccacccaauggcuacuuccgcuucgaauccuggguaaaccccuucuacacccucgcaccuaugggaaccggcaacggacgccgccgaauccaauaa

SEQ ID NO: 35572 - RNA, 1623 nt, Artificial Sequence
  derived and/or modified sequence opt11 from capsid_protein_VP1__Norovirus__AII02815
augaaaauggccucaaacgacgccaaucccucagacggcuccgcagccaaccucguccccgaagucaacaacgaagucauggcacucgaacccgucguaggcgcagccauagcagccccugucgccggccaacaaaacgucaucgaccccuggauccgcaacaacuucguccaagcuccaggcggcgaauuuaccgucuccccacgcaacgcccccggcgaaauccucugguccgccccucuaggccccgaccucaacccauaucucucccaccucgcacgcauguacaacggcuacgccggcggauucgaaguacaaguaauccuugcaggcaacgcuuucacugccggcaaaauaaucuucgccgcagugccgccuaacuuucccaccgaaggacucucaccaucccaagucaccauguucccccauaucaucguggacguccgccaacucgaacccguccuaaucccacuacccgacguccgcaacaauuucuaccauuacaaccaaucuaacgacuccacuauaaaacuaaucgccaugcucuauacaccccuacgcgccaacaacgccggcgaagacguuuucacagucagcugccgaguccucacccgccccuccccagacuucgacuucauauuccuaguacccccaaccguagaaucccgcaccaagcccuucacaguccccauacuaaccguagaagaaaugaccaacucccgauucccaaucccccucgaaaaacucuucaccggccccucaggagccuucaucguccagccccagaacggacgaugcaccacagacggcguccuacucgguacgacccaacucucucccguaaauauaugcaccuuucgcggggacgucacccacaucgccggcucacgugacuacaccaugaaccuggccucccucaacuggaauaacuacgaccccaccgaagaaauacccgcgccccuugguacccccgacuucgucggcaaaauacaaggcgugcucacccaaaccacaaaaggcgacggauccacccgaggccacaaagcaaccguauacaccggcucagccccauucacccccaaacucggcuccguccaauucuccaccgacacagaaaacgacuucgaagcccaccaaaacaccaaauucacaccagucggcgucauacaagacggaggaacaacccaccgcaaugaaccccaacaauggguccuccccucauacuccggaagagacguccacaacguccaccucgcacccgccgucgcaccaaccuuccccggagagcagcuacucuucuuccgcagcacaaugccuggcugcuccggcuacccaaacauggaccucgacugccuacuaccacaggaauggguacaacauuuuuaccaagaagcagcacccgcccaaucagacguagcccuacuacgauucgucaaccccgacaccgggaggguacuauucgaaugcaaacuacacaaguccggauacguaacagucgcccacaccggccaacacgaccucguaauaccacccaacggcuacuuuagauucgacagcugggucaaccaguucuauacccuagcccccauggguaauggcacaggccgacgacgcgcccucuaa

SEQ ID NO: 35573 - RNA, 1647 nt, Artificial Sequence
  derived and/or modified sequence opt11 from capsid_protein_VP1__Norovirus__AII02818
augaaaauggccuccaaugacgccgccccuucaaacgacggcgccgccggccuagucccagaaauaaacucagaagcaauggcacucgaaccaguugcaggagccgccaucgcagcuccccucaccggacaacagaacaucauagacccuuggauaaugaacaacuucguccaagccccagggggagaguucaccguaucaccccgcaacucacccggagaaguacuccuuaaccucgaacugggacccgaaauaaaccccuacuuagcacaccuagcccgcauguacaacggcuacgcaggaggcuucgaaguacaagucguauuagccggcaacgccuucaccgccggcaaaauaauauucgccgcaauuccacccaacuuccccaucgauaaccuauccgcagcccaaauaaccaugugcccccacguaauugucgacgucagacaacucgaacccguaaacuuacccaugcccgacguccgcaacaacuucuuucacuacaaucaaggauccgacucacgccuccgccucaucgcaaugcucuacacaccccucagagccaacaacucaggagacgaugucuucaccgucagcugccgaguacucaccagacccuccccagacuucagcuucaacuuccuugucccacccaccgucgaaagcaaaaccaaacccuucagccuccccauacuaacaaucucugaaaugagcaacucacgcuuccccgucccaaucgacucucuccacacauccccaaccgaaaacaucgucguccaaugccaaaacggccgagucacacucgacggcgaacucaugggcacuacacaacuacuccccucucaaauaugcgccuuccgcggaaugcucacccgcuccacaucacgagccagcgaccaagcggacacaguaaccccacgacuuuucaacuacuacuggcacauacaacucgacaaccucaacggcacaccauaugacccugcagaagacauaccaggcccacucggaacccccgacuuucgcggcaaagucuucggcgucgccucccaacgaaacccggacgcuaccacccgcgcacacgaagcaaaaaucgacacaaccuccggacgcuucacaccaaaacuuggaucucuagaaaucuccacagaauccgacgacuuuuaucaaaaucaacccacacgcuucacacccgucggcaucggcgucgaccacgaagcagacuuccaacaauggacccuacccgacuacgccggccaauucacccauaacaugaaccucgcccccgccgucgcccccaacuucccaggcgaacaacuacucuucuucagaucccaacuucccuccucuggcggccgcucuaacggaauccucgacugccuaguaccacaagaauggguccaacacuucuaccaagaaucagcuccgucacaaacccaagucgcacucguacgcuacgucaaccccgacaccggacgcguccucuucgaagccaaacuacacaaacuaggcuucaugaccauugccaagaacggugacucccccauaacagucccucccaacggauacuuccgauucgaaucaugggucaaccccuucuacacccuagccccaaugggcaccgguaacggccgccgcagaauacaauag

SEQ ID NO: 35574 - RNA, 1623 nt, Artificial Sequence
  derived and/or modified sequence opt11 from capsid_protein_VP1__Norovirus__AII02821
augaaaauggcaucaaacgacgccaacccauccgauggcuccgccgccaaccuagucccagaagucaacaacgaagucauggcccucgaacccguagucggagcugcgauagccgcccccgucgcaggccaacagaaugucaucgacccuuggauacgaaacaacuuuguucaagcacccggcggcgaguucacaguaucaccucgcaacgcccccggcgaaauccuuugguccgccccacucggcccugaccuaaaccccuaccucucacaccucgcucgcauguacaacggcuacgcuggcggcuucgaaguacaagucauccucgcuggcaaugccuucacagccggaaagauaauauucgccgccgucccucccaacuuccccacagaaggacuaucacccucucaagucaccauguucccccacauaaucgucgacguucgccaacucgagccaguccucaucccccuuccugauguacgcaacaacuucuaccauuacaaucagucaaacgacucaaccaucaaacuaaucgcaaugcucuauacaccacuccgcgcuaacaacgcaggcgaagacguauucacaguaucaugucgcguacucacccgccccuccccagacuucgacuucaucuuccuugucccaccaaccgucgaaucccgcaccaaaccguucacaguacccauccuaacaguugaagaaaugacaaacucccgcuuccccaucccacuugaaaaacucuucaccggaccuucaggagccuucaucguacaaccccaaaacggacgcugcaccacagacggcguucuuuuaggcaccacccaacucuccccaguaaauaucugcaccuuccgcggagacguaacccacaucgccggcucccgcaacuacaccaugaaccucgccucacucaacuggaacaacuacgaccccaccgaagaaauccccgcgccccuaggcacccccgacuucguaggcaaaauacaaggcguccuaacccaaaccaccaaaggagauggcuccaccagaggacacaaagcaacggucuacaccggcggugccccauucacaccaaaacuuggauccguccaauucagcacugacaccgaaaacgacuucgaagcacaccaaaauacaaaauucacccccgucggcgucauccaagauggcggcacaacacaucgcaacgaaccccaacaauggguucuacccagcuacagcggccgcgacguccacaacguacaccuagcccccgcaguagcccccacauuccccggagaacaacuccuuuucuucagauccaccaugccuggcugcuccggauaccccaacauggaucucgauugccuccucccccaagaauggguccaacauuucuaccaagaagccgccccugcacaauccgacgucgcacuccuccgauucguaaacccagauaccggacgcguccucuucgaauguaaacuucacaaauccggcuacguaaccgucgcacacaccggccagcacgaucucgucauaccuccaaacggauauuuucgcuucgauuccuggguuaaccaauucuacacccucgccccaaugggaaacggcaccggacggcgccgcgcacuuuaa

SEQ ID NO: 35575 - RNA, 1623 nt, Artificial Sequence
  derived and/or modified sequence opt11 from capsid_protein_VP1__Norovirus__AII02824
augaaaauggccuccaaugacgccaaucccuccgacggcagcgccgccaaccucguccccgaagucuccaacgaagucauggcccuagaacccgucgucggcgccgcaauugccgcccccgucgccggccaacaaaacgucauagaccccuggaucagaaacaacuucguacaagcacccggaggcgaauuuaccgucucaccccggaacgcccccggugaaauccuuuggucugcaccccuaggccccgaccucaaccccuaccucucccaccuugccagaauguacaacggcuacgccggaggcuucgaaguccaagucauccucgccggcaacgccuucaccgccggcaaaaucauauucgccgccgucccucccaacuuccccacagaaggucuaucccccucacaaguaacaauguucccacacaucaucgucgacguccgccaacucgaacccguccucauaccgcuccccgacguacgcaacaacuucuaucacuacaaccaaacuaacgacuccacaauuaagcuaauagcaauguuauacacuccccuacgugccaacaacgcaggcgaagacgucuucaccgucuccugccgcguacucacccgacccagccccgacuucgacuucaucuuccucgucccacccaccguagaaagccgcaccaaaccauucaccgucccaauccuaaccguagaagaaaugacaaacucaagauuccccauaccacucgaaaaacucuuuaccggcccuucuggcgcauucgucguccaaccccaaaacggacgaugcacaacagacggaguccuacuuggaaccacccaacuauccccagucaacauaugcaccuuccggggcgacguaacccacauagcuggcucccggaacuacaccaugaacuuagcaucacucaacuggaacaauuacgacccaaccgaagaaauacccgcaccccugggcacccccgacuucguaggcaaaauccaaggcguacugacccaaacaacaaaaggagacggcuccacucgcggccacaaagccaccgucuacaccggcuccgccccauuuaccccaaaacuuggcucaguccaauucuccaccgacaccgaaaacgacuucgaaacccaccaaaacaccaaguucacccccguaggcguaauccaagauggaggcaccacccaucgaaacgaaccgcaacaauggguucuaccauccuacagcggccgcgacguucacaacguacaccuagcuccugccgucgcacccacuuuccccggcgaacaacuccucuucuuccgcucuaccaugccaggcugcucgggcuacccuaacauggaccuugacugccuccuaccucaagaauggguccagcacuucuaccaagaagcugcccccgcacaauccgacgucgcccuccuccgauucgucaaccccgacacuggacgcguccucuucgaaugcaaacuccacaaaucuggauacgucaccgucgcccacacuggccaacacgaccuagucaucccacccaacggcuacuuccgauuugacucauggguaaaccaauucuacacccuagcccccaugggcaacggcacuggccgacgccgagcccucuaa

SEQ ID NO: 35576 - RNA, 1623 nt, Artificial Sequence
  derived and/or modified sequence opt11 from capsid_protein_VP1__Norovirus__AII02827
augaaaauggcuuccaacgacgccaacccuuccgacggcuccgcagccaaccuaguccccgaagucuccaacgaagucauggcccuagaaccagucgucggugccgcaauagccgcccccguagccggucaacaaaacgucaucgacccauggaucagaaacaacuucguccaagccccagguggcgaauuuaccgucaguccucgcaacgcgccaggcgaaauacuaugguccgccccacucggaccagaccucaaccccuaccucucacaccuugcacgcauguacaacggauacgccggugguuucgaaguccaagucauccuagcaggcaacgcguucacugccggcaaaaucauuuucgccgccgucccacccaacuucccaaccgagggacucucacccucacaagucaccauguuuccccacaucauagucgacguccgccaacuagaaccaguacucauaccucugccagacguacgaaacaacuucuaccacuacaaccaaacaaacgacuccacaaucaaacuaaucgccaugcucuacacaccccuucgcgcaaacaacgccggcgaggacgucuucaccgucagcugccgcgugcuaacucgacccuccccagacuuugacuucaucuuccucguacccccaacagucgaaucacgcaccaaacccuucacagucccaauacuaacugucgaagagaugacaaauucacgcuuccccauaccccucgaaaaacuauucaccggcccauccggagccuucgucgugcaaccacaaaauggacgcuguaccacugacgguguacuucuaggcaccacccaacucucacccgucaauauauguaccuuccgaggagacgucacccauauagcaggcucccgcaauuacacaaugaaccucgccucccucaacuggaacaacuacgaccccacagaagaaauccccgcuccccucggcacccccgacuucguagguaaaauccaaggcguccucacacaaacaacuaaaggagacggcucuacucgcggacacaaagccaccgucuacaccggguccgccccauucaccccgaaacuaggauccguccaguuuucuaccgacaccgaaaacgacuuugaaacccaccaaaacacaaaauucacucccgucggcguaauacaagacggaggaaccacucaucguaacgaaccccagcaauggguccuccccuccuacucaggacgcgacguccacaacguacaccucgcacccgcaguugcacccacauucccgggcgaacaacuccuuuucuuccgcagcaccaugccaggaugcuccggcuaucccaacauggaccucgacugccuccuaccacaagaauggguacagcacuucuaccaggaagccgcaccagcccaauccgacgucgcccuacuccgauucgucaaucccgacaccggacgaguucucuuugaaugcaagcuccacaaauccggcuacgucacagucgcacacaccggacaacaugaccuaguaaucccacccaacggauacuucagauucgacuccugggucaaccaauucuacacacuagccccaaugggaaauggcacuggacgccgacgcgcccuuuaa

SEQ ID NO: 35577 - RNA, 1623 nt, Artificial Sequence
  derived and/or modified sequence opt11 from capsid_protein_VP1__Norovirus__AII02830
augaaaauggcauccaacgacgccaaccccucugacggauccgccgcaaaccucguccccgaagucucaaacgaagucauggcccuagaacccgucguaggagccgcaaucgcagcacccgucgccggccaacaaaacguaauagaccccuggauccggaacaacuucguacaagcacccggcggggaguucaccguaucccccagaaacgcaccgggcgaaauccucuggucagcaccccucggccccgaccuaaaccccuaccucucacaccucgccagaauguacaacgguuacgccggcggcuucgagguccaaguaauccuagcaggcaacgccuucaccgccggcaaaaucauauucgccgccgucccacccaacuuccccaccgaaggccucuccccuucacaagucaccauguucccacacaucaucgucgacguacgacaacucgaaccaguccucauaccucuacccgacguccgcaacaacuucuaccauuacaaccaaacaaacgacuccacaaucaagcuaauagcuaugcuauauaccccacuucgcgccaacaacgccggcgaagacgucuucaccguuagcuguagaguacuaacacgcccaucaccugacuucgacuucauauuccucgucccacccaccguagaaucacgcaccaaacccuucaccguccccauccugacagucgaagagaugacuaacuccagauuucccauuccucucgaaaaacuguuuaccggcccauccggcgcauucgucguccaaccccaaaacggccgaugcaccaccgacgggguacuucuaggcaccacccagcucucccccgucaacauuuguaccuuccguggcgacgucacccacauagccggcuccagaaacuauaccaugaaccucgccucgcuuaacuggaacaacuacgacccaacagaagaaauccccgccccacucggaacacccgacuucguaggcaaaauccaaggcguccucacccaaaccacaaaaggcgacggcucaacacgcggccacaaggccaccguuuacaccggcuccgccccauuuacccccaaacuaggcucuguccaauucuccaccgauacagaaaacgacuucgaaacccaucaaaacaccaaguucacaccagucggcguaauacaagacggcggcaccacccaucgaaacgaaccccaacaauggguccugccuuccuacagcggccgcgacguccacaacguccaccuugccccggcaguagccccaacauuccccggcgaacagcuccucuucuucagaucuacuaugcccggaugcucaggauaccccaacauggaccucgacugccuccucccacaagaauggguccaacacuucuaccaagaagccgcccccgcccaauccgacguagcccuccuccgcuucguaaaccccgacaccggcagaguacucuucgaaugcaaacuucauaagagcggcuacguuacugucgcccacaccggacaacacgaucuggucauaccacccaacggcuacuuccgcuucgacuccugggucaaccaauucuacacccucgcgcccaugggcaacggaacagggcgacgacgcgcccucuaa

SEQ ID NO: 35578 - RNA, 1623 nt, Artificial Sequence
  derived and/or modified sequence opt11 from capsid_protein_VP1__Norovirus__AII02833
augaaaauggccuccaacgacgccaaccccagcgacggcucugcagcgaaccuuguaccugaagucaacaacgaaguaauggcccuugaacccgucguuggcgccgccauagccgcccccgucgccggccagcaaaacgucaucgacccauggauccgaaacaacuucguccaagccccaggaggcgaguucaccguaagcccucgcaaugcaccuggcgaaauccucugguccgccccacuaggaccagaucucaauccauaccucucacaucucgcucgcauguacaacggcuacgccggcggcuucgaaguccaagucauacucgcuggaaacgccuucaccgcuggcaaaauaaucuuugcugccgucccacccaacuuccccaccgaaggccucucaccaucucaagucacaauguucccacacaucaucgucgauguaagacaacuagaaccaguucuaaucccgcuccccgacguacgcaacaauuucuaccacuacaaccaauccaaugacuccaccaucaaacucaucgccaugcucuacacaccccuacgcgcaaacaacgcaggagaagacgucuucaccgucucaugccgcguccuuacacgcccaucccccgacuucgacuucaucuuccuagucccaccaacagucgaaucccggacuaaacccuucaccgucccaauccuaacaguagaagaaaugaccaacucccgcuuccccaucccccucgaaaaacuuuucacaggcccauccggcgccuucauaguacaaccccaaaauggccgcugcaccacagacggaguccuccuaggaacaacccaacuuucaccagucaacaucugcaccuuccgcggcggcgucacccacauagccgguucccgaaauuacacaaugaauuuagccucccuaaacuggaacaacuaugacccaacagaagaaauacccgcuccccucggaacacccgacuuugucggcaaaauccaaggcguccucacacaaaccaccaaaggcgacgguuccacccgcggacacaaggcaacagucuacaccggcuccgcaccauucaccccaaaacuuggauccguccaauucuccaccgacaccgaaaacgauuucgaagcccaccaaaacacaaaauucacccccgugggcguaauccaagacgguggcaccacucaccgaaacgaaccacaacaauggguccuuccauccuacagcggccgcgauguccacaacguccaccuagcaccagccguagccccaaccuuucccggcgaacaacuccucuucuuccgcuccaccaugccaggaugcuccggcuacccaaacauggaccucgauugccuacucccccaagaauggguccaacacuucuaccaagaagcagcacccgcccaauccgacgucgcccuccucagauucguaaaccccgacacaggucgcguacucuucgaauguaagcuccacaaaucaggcuacgucacggucgcccacaccggacaacacgacuuagucaucccaccaaacggcuacuucagguucgacuccugggucaaccaauucuauacccuagcgcccaugggcaacggcaccggucgccgccgagcccucuaa

SEQ ID NO: 35579 - RNA, 1623 nt, Artificial Sequence
  derived and/or modified sequence opt11 from capsid_protein_VP1__Norovirus__AII02836
augaaaauggcauccaaugacgccaaccccuccgacggcagcgccgccaaccucguccccgaaguaucaaacgaagucauggcccuagaaccaguagccggagccgcuaucgcagccccuguugccggccaacaaaacgucaucgaccccuggauccgcaacaacuuuguacaagcgccaggcggcgaauuuaccgucucccccaggaacgcccccggggaaauccuuugguccgcccccuuaggccccgaccuuaacccuuaccuaucucaccuagcccguauguacaacggcuaugccggcggcuucgaaguccagguuauccucgccggcaacgccuucaccgccggaaaaauaaucuucgccgccgucccaccgaacuuccccaccgaaggccucagccccagccaagucacaauguuuccgcacaucaucguagacguccgccaacuagaaccuguccucaucccccuacccgacguccgcaacaacuucuaccacuacaaccaaaccaacgacuccaccaucaaacucaucgccaugcuauacacgccccuucgcgcuaauaacgcuggcgaagacgucuucaccgucucgugccgaguccuaacccgccccucccccgauuucgacuucaucuuucuagucccucccacagucgaaagucguacaaaaccuuucaccguacccauccugaccgucgaagaaaugacaaacucacgauuccccaucccacucgaaaaacucuucacaggcccauccggcgccuucguaguccaaccccaaaacggaagauguacaacagacggcguccuucucgguacaacccaauuaucccccguuaacaucugcaccuuccgaggagaugucacacacaucgccggcucacgcaacuacacaaugaaccucgcaucccucaacuggaacaauuacgaccccaccgaagaaauccccgccccacuaggcacccccgacuucguugggaaaauacaaggaguccuuacacaaaccaccaaaggagacggcucaaccagaggccacaaagccaccguuuacaccggcucagcccccuuuacacccaaacucggcuccguccaauucucaacugacacagaaaacgacuucgaaacgcaccaaaacacgaaauucaccccagucggcgucauacaagacggcggcaccacucaucgcaaugaaccacaacaauggguccuccccucauacuccggcagagauguccacaacguacaccucgcuccagccgucgcuccaaccuucccaggcgaacaacuacuauucuucagauccacaaugccggguugcucgggauacccaaacauggaccuugacugccuccucccccaagaauggguccaacauuucuaccaagaagcagcccccgcccaaagcgacgucgcacuccuacgcuucgucaacccagacaccgggcgcguccuauucgaaugcaaacuacacaaauccggauauguaaccguagcacauaccggucaacacgaccucguaaucccgcccaacggauacuuccgauucgacuccuggguaaaccaguucuacacacucgcacccaugggcaacggcaccggacgacgacgcgcccucuaa

SEQ ID NO: 35580 - RNA, 1623 nt, Artificial Sequence
  derived and/or modified sequence opt11 from capsid_protein_VP1__Norovirus__AII02839
augaaaauggccucaaacgacgcaaaccccuccgauggaucugccgcaaaccuaguccccgaagucucaaacgaaguaauggcgcucgaacccguagucggcgccgcaaucgcagcccccgucgccggccaacaaaacguuauugacccauggauccgcaacaauuucguccaagcccccggaggcgaguucacaguaucaccccgcaacgcccccggcgaaauccuauggggcgccccacucggcccagaccucaauccauaccuaucacaccuagcccgaauguacaacggcuaugcaggcggcuucgaaguacaagucauccucgcuggaaacgccuucaccgcaggcaaaaucaucuucgcugccguaccaccaaacuuccccacagaaggacucucacccagccagguaacgauguucccccacaucaucgucgacguccgccaacucgaaccaguacucauaccccuccccgacguacggaacaacuucuaccacuacaaccaaacaaacgacuccaccauaaaacucauagccaugcucuacacaccccuucgcgcaaacaacgcaggagaagacgucuucaccgugagcugccgaguccucacccgaccaucccccgacuucgacuucaucuuccucguaccacccaccguagaaucacgcaccaaaccauucaccguccccauacucaccguagaagaaaugaccaauucgcguuucccaauaccccucgaaaaacuauuuaccggccccagcggcgccuucguaguacaaccccaaaacggacgcugcacaaccgacggcguacuucuaggaaccacccaacucucaccagucaacaucugcaccuuccgaggcgacgucacccacauagccggaucccgcaauuacacaaugaaccuagcgagccucaacuggaacaacuacgacccaacagaggaaauccccgcuccccucggaacccccgacuucgucggcaagauccagggcguccuaacccaaaccaccaaaggagacggcucaacacgaggacacaaagccacagucuauacaggaucagcccccuuuacacccaaacucggaucaguccaguucuccaccgacaccgagaacgacuucgaaacccaccaaaacacaaaguucacccccguaggcguaauccaagacggaggcaccacccaucgcaacgaaccccaacaauggguccuccccuccuauagcggccgcgacguccacaacguccaccuugcccccgccgucgcacccacauuccccggugaacaacuccuuuucuuccguagcaccaugccuggaugcuccggauaccccaauauggaccuugacugucuccucccacaagaauggguccaacacuucuaccaagaggccgcccccgcccaaucagacgucgcccuccuaagauucgugaaccccgacacaggccgcguucuauucgaaugcaaacuacacaaaucaggauacgucaccgucgcccacaacggccaacacgaccucgugaucccacccaacggauacuuccguuucgacuccugggucaaccaauucuacacccuugcccccaugggcaacggcacaggccgccgccgcgcccucuaa

SEQ ID NO: 35581 - RNA, 1623 nt, Artificial Sequence
  derived and/or modified sequence opt11 from capsid_protein_VP1__Norovirus__AII02842
augaaaauggccuccaacgacgccaauccuuccgacggcuccgccgcaaaucuuguccccgaaguaagcaacgaaguaauggcacuugaacccgucgucggcgcagcuaucgccgcccccgucgccggccaacaaaacgucaucgaccccuggauccgcaacaacuucguacaggcccccggaggagaguucacaguaucaccccgaaacgcaccaggggaaauacuaugguccgcaccccuaggcccagaccucaaccccuaccucucccaucucgcccgcauguauaacggcuacgcaggaggcuucgaaguccaagucauccucgccggcaacgcauucacagcaggcaaaauaauuuucgcagccgucccacccaacuuccccaccgaaggacuaucccccucccaagucaccauguucccacacauaaucguugacguccgccaacucgaacccguacucauaccccuccccgacguacgaaacaacuucuaccacuacaaccaaaccaaugacuccaccaucaaacucaucgccaugcuuuacaccccacuccgagcaaacaacgcaggagaagacgucuucaccgucucgugccgcguucuaacccgacccagucccgacuucgacuucauuuuucuagucccacccaccgucgaaucccgcaccaaacccuucaccguccccauccuaaccgucgaagaaaugaccaacucacgcuuucccaucccgcuugaaaaacucuucaccggcccaagcggcgccuucgucguccaaccccagaacggacgcugcaccaccgacggcguacuccuuggaacuacccaacuuuccccagucaacaucugcaccuuucgaggagacguuacccacauagccggcucacgcaauuacacuaugaaccuugccucccucaacuggaacaauuaugaccccaccgaagaaauacccgcuccccuaggcacaccagauuucgucggaaaaauccaaggaguccuaacccaaaccacaaaagaagacggcuccacccgaggccacaaagccaccgucuacaccggcuccgcccccuucaccccaaaacucggcucaguccaauucuccaccgacacagagaaugacuucgaaacccaccagaacaccaaauucaccccagucggagucauccaagacggaggcaccacucaccgaaacgaaccccaacaauggguccuaccauccuacuccggccgcgacguccacaacguacaccuagccccagccgucgcccccaccuuccccggagaacaacuccuauucuuccgcucaaccaugcccggcugcuccggauaccccaacauggaccuugacugccuccucccacaggaauggguccaacacuucuaucaagaggcagcucccgcccaauccgacgucgcacuccuccgauuuguuaacccggacacuggacguguccuuuucgaaugcaaacuucacaaaucaggauacgucaccgucgcacacacuggccaacacgaccucguaaucccuccuaacggauacuuccgauucgacuccugggucaaccaauucuacacacucgcccccauggggaacggcacuggccgccgcagagcacucuaa

SEQ ID NO: 35582 - RNA, 1647 nt, Artificial Sequence
  derived and/or modified sequence opt11 from capsid_protein_VP1__Norovirus__AII02845
augaaaauggccucaaacgacgcagcacccucgaaugauggcgccgccggacuuguccccgagauaaacucagaagcaauggcacuugagcccguagccggcgccgccauagcagcaccccuuaccggccagcaaaacaucaucgaccccuggaucaugaacaacuucguccaagcccccggcggagaguucacaguaucaccccgcaacucccccggagaaguucuacuuaaccucgaacuaggucccgaaauaaaccccuaccucgcccaccuugcccguauguacaacggauaugccggaggcuucgaaguccaaguuguccuagcaggcaacgcauucaccgcuggcaaaaucaucuucgcugccaucccacccaacuuccccauugacaaccucuccgccgcccaaauaacaauguguccccacgucaucguagacguccgccaacuagaacccgucaaucuaccuaugccagacgucagaaacaacuucuuccauuacaaccaaggaagcgacucaagacuccgacuuaucgccaugcucuacaccccacuccgagccaacaacucaggcgacgaugucuucaccgucucuugccguguacucacccgaccaucgcccgacuucucauucaacuuucugguucccccaacugucgaaagcaaaacaaaaccuuuuucccuccccauccucaccaucucggaaauguccaacucccgauuccccguccccaucgacucccuucacaccucacccaccgaaaacaucgucguucaaugccaaaacggccgggucacccuugacggugaacuaaugggcaccacccaacuccuacccucccaaaucugugccuuccgaggcaugcuaacccgcuccaccucacgagccucagaccaagccgacaccgccaccccuagacucuucaacuacuacuggcacauucaacucgacaaccuuaacggaacccccuacgacccagcagaagacauuccaggcccccugggcacccccgacuuucguggcaaagucuucggcgucgccucacaacgcaaccccgacgccaccacccgcgcccaugaagccaaaaucgacaccaccagcggccgcuucacccccaaacuagguucucucgaaauauccacagaauccggugacuucgaccaaaaccaacccacaagauucaccccugucggcaucgguguagaccacgaagccgacuuucaacaauggacccuccccgacuacgccggacaauucacccacaacaugaaccuagcucccgccgucgcccccaacuucccaggugaacaacuccucuucuucagaucacaacuacccucgucaggaggccgauccaauggaauccucgacugccuagucccucaagaauggguacaacacuucuaccaagaauccgccccaucccaaacccaaguggcccuaguacgauacguuaauccggacaccggccgcguucucuucgaagcaaaacuccacaaacuuggcuucaugaccauagccaagucaggcgauuccccaaucaccguaccgcccaacggauacuuccgcuucgaauccugggucaaccccuucuacacccuagcccccaugggcaccggcaacggccgaagacgcauccaauaa

SEQ ID NO: 35583 - RNA, 1647 nt, Artificial Sequence
  derived and/or modified sequence opt11 from capsid_protein_VP1__Norovirus__AII02848
augaaaauggcaucgaacgacgccgcacccuccaacgacggcgccgccggccuaguucccgaaaucaacucugaagccauggcacuagaacccgucgccggcgcagccauagcagcaccccuaaccggccaacagaauaucaucgaccccuggaucaugaacaacuucguacaagcccccggcggcgaguucaccgucuccccacgaaacucacccggcgaaguccuccucaaccucgaacuuggccccgaaauuaaccccuaccuugcccaccucgcccgcauguauaacggcuacgccggcggauucgaaguccaagucguccuagcaggcaacgcauucacagcuggaaaaauaaucuucgcagcaaucccgcccaacuucccaaucgacaaccuuuccgccgcccaaaucaccauguguccccacgucaucguugacguccgccaacuggaacccgucaaccugcccaugcccgacguacguaauaacuucuuccauuacaaccaaggauccgacucccgccuaagacucaucgcuaugcucuacacaccccuucgagcaaacaacuccggcgacgacgucuucaccguauccugccgaguacucacccggccaucccccgacuucuccuucaacuuccuaguacccccaaccgucgaauccaaaaccaaacccuucucccuaccaauacuaaccaucuccgaaaugucuaauucccgcuuccccguaccuauagauucccuacauaccucccccaccgaaaacaucgucguccaaugccaaaacggacgcguuacacucgacggcgaacucaugggaaccacacaauuacuacccucacaaaucugcgccuucagaggcaugcucacccgcucuaccucucgcgcauccgaccaagcagacacugccaccccgcgacuauucaacuacuacuggcacauacaacucgacaaucucaauggaaccccuuacgaccccgccgaagacauaccugggccacucggaacccccgacuuccgcgguaaagucuucgguguagcaucccaaagaaaccccgacgccaccacacgcgcccacgaagccaaaaucgacaccacuuccggccgauucaccccuaaacucggcucacuagaaauaucuacagaaucaggcgacuucgaucaaaaccaacccacucgcuucacccccgucggcaucggcgucgaccacgaagcagacuuucaacaauggacucuacccgauuacgcaggccaguucacccacaacaugaaccuagcacccgccgucgcacccaauuucccuggugaacaacuccucuucuuccgcucacaacuacccuccucaggcggccgcuccaacggcauccucgacuguuuagucccacaagaauggguccaacacuucuaccaagaauccgcccccucccaaacccaaguagcccuaguccgcuacguaaaccccgacaccggccgaguccuauucgaagccaaacuacacaaacucggguucaugaccauugccaaaagcggagacucucccaucaccgucccaccaaauggcuacuuccgauucgaaucaugggucaacccauucuacacacucgcccccaugggcaccggcaacggaagacgccgaauccaauaa

SEQ ID NO: 35584 - RNA, 1623 nt, Artificial Sequence
  derived and/or modified sequence opt11 from capsid_protein_VP1__Norovirus__AII02851
augaaaauggccuccaaugacgccaaccccuccgacggcucagccgccaaccucguccccgaaguauccaacgaagucauggcccuagagcccgucgucggcgccgccaucgccgccccaguagcaggccaacaaaauguaaucgacccauggauacgaaacaacuucguacaagccccaggcggcgaguucacagugagcccccguaacgcccccggcgaaauucuauggucagcaccacucggcccagaucucaaccccuaucucucccaccuagcacgcauguacaacgguuacgccggcggcuucgaaguccagguuauccuagcaggaaaugcauuuaccgccggaaaaaucaucuucgcggccgucccaccaaacuucccaacagaaggccucucacccucccaagucacaauguucccacacaucaucgucgacguccgccaacucgaaccaguccuaauaccccuaccagauguccgcaacaacuucuaccacuacaaccagacaaacgacuccacaaucaaacucauugcaaugcuauauacuccccuacgcgccaacaacgccggagaagacgucuucaccgucuccugccgcguacucacacgcccaucccccgauuucgacuucaucuuucucguucccccaaccguagaaucacgcaccaaaccauucacagucccuauccucaccguagaagaaaugaccaauucacgcuucccaauccccuuagaaaaacucuucaccggccccucaggcgcauucgucguccaaccccagaauggacgaugcacaaccgacggcguacuucucggcacaacccaacucucaccagucaacauuugcaccuuccgcggcgauguaacucacaucgcaggaucacgcgacuacaccaugaaccucgcgucccucaacuggaacaacuacgaucccacagaagaaauccccgcuccccucggcacccccgacuucguaggcaaaauucaaggaguacucacacaaaccacaaaaggcgacggcucaacccgcggccacaaagccaccgucuacacaggcucggccccauucacccccaagcucggcuccguacaauucucaaccgacaccgaaaaugacuucgaaacccaccaaaacaccaaauucaccccagucggcgucauacaagacggcggcacaacccaccgcaacgaaccacaacaauggguacuaccuuccuacagcggacgcgacguacacaacguccaccuagccccagccguagcccccaccuuucccggcgaacagcuccuauucuuccgcucgaccaugccaggcugcuccggcuauccaaacauggaccucgauugccugcucccacaagaauggguacaacacuucuaccaggaagcagcacccgcccaauccgacgucgcacucuuacgcuucguaaaccccgacaccggccgcguccuauuugaaugcaaacuacacaaauccggcuacguaaccgucgcacacacaggccaacaugaccucgugaucccacccaacggcuauuuccgcuucgacuccugggucaaccaauucuacacgcuagcccccaugggcaauggcacaggacgccgacgugcucuauaa

SEQ ID NO: 35585 - RNA, 1623 nt, Artificial Sequence
  derived and/or modified sequence opt11 from capsid_protein_VP1__Norovirus__AII02854
augaaaauggcguccaacgacgccaacccaagcgacggaagugcggccaaucucguaccugaaguaucaaacgaagucauggcacucgagcccguggucggagccgccaucgccgcccccgucgccggccagcaaaacgucauagacccauggauccgcaacaacuuuguccaagcuccaggcggagaguucaccgucucccccagaaacgcucccggcgaaaucuuauggucagcaccccucggucccgaccucaaccccuaccucucccaccuagccagaauguacaacgguuacgccggcggauucgagguccaaguaauccucgccggcaacgccuucacagccggaaaaauaaucuucgcagccgucccacccaacuuccccacggaaggccucucacccucucaaguaaccauguucccucacaucaucgucgacguacgacaacucgagccaguacucauaccccuccccgacguccgaaacaacuucuaccacuacaaccaaaccaacgacuccacuauaaaacuuaucgccaugcucuacacaccccuccgagccaacaacgcaggcgaagacgucuucaccguuucaugccgcguccuaaccagacccucacccgacuucgacuucauuuuccucgucccucccaccgucgaaucccgcaccaaacccuuuacaguccccauccucacagucgaagaaaugaccaacucacgcuuccccauaccccucgagaaacuauucacaggccccagcggcgccuucgucguccaaccccaaaacggacgcugcaccacagacggaguccuucuaggaacaacacaacucuccccagucaacauaugcaccuuccgcggcgauguaacacacauagcaggcucccgcaacuauacaaugaaccucgccucacugaacuggaacaacuacgacccaacagaagaaauccccgcaccccuaggcacacccgacuucguaggaaagauccaaggcguacucacccaaaccaccaaaggagacggcagcacccgcggacacaaagccaccgucuacaccgguuccgccccguucaccccaaaacucggcuccguccaguucuccacagacaccgaaaacgacuuugaaacacaccaaaacaccaaguucacacccguaggcgucauccaagacggaggaacgacacaccguaacgaaccccaacaauggguacuaccaucauacucaggccgcgacguacacaacguccaccuugcccccgccguagcccccaccuuccccggcgaacaacuccucuucuuccgaaguaccaugcccggcugcuccggcuacccaaacauggacuuggacugccuacucccccaagaauggguccaacacuucuaccaggaggccgccccagcccaaucagacgucgcccuccuacgcuucgucaaucccgacacuggccgagucuuauucgaaugcaaacuccacaaaucaggcuacgucaccguagcucacaccggccaacacgaucuagucauaccaccaaauggauacuuccgcuucgauucaugggucaaccaauucuacacccucgcacccaugggcaacggcaccggccgccgacgagccuuauaa

SEQ ID NO: 35586 - RNA, 1623 nt, Artificial Sequence
  derived and/or modified sequence opt11 from capsid_protein_VP1__Norovirus__AII02857
augaaaauggcuucaaacgacgcaaaccccuccgacggauccgcagccaaccucguacccgaagucaacaacgaagucauggcccuagaacccgucgucggcgccgccauagcagcccccguugcgggacaacagaacgugaucgacccauggauccgaaacaauuucguccaagcaccuggcggugaguucacugucucuccacgcaaugcucccggcgaaauccucuggucugcuccccucggccccgaccucaauccuuaccuaucccaccucgcccgcauguacaacggcuacgcaggcggauucgaaguccaagucauccuagccggcaacgccuucacugcaggaaaaaucaucuuugccgccgucccacccaacuuccccaccgaagggcucucacccucgcaagucaccauguucccccauaucaucgucgacguccgacaacucgaacccguccuaauaccacuacccgacguccgcaacaacuucuaccacuacaaccaauccaacgacuccaccauaaaacuaauagcaaugcucuacacuccccuacgcgccaacaacgcaggagaagacguauucaccguuagcugccgaguacuaacccgcccuagcccagacuuugauuucauauuccucguacccccaacugucgaauccagaacaaaacccuucacaguaccaauacucaccgucgaagaaaugacaaauucacgauuccccaucccacucgaaaaacucuucaccggaccauccggcgcguucauaguccaaccccaaaacggucgcugcaccacggacggcguccuccucggcaccacacaacuuucacccgucaacaucugcacauuccggggagacguaacccacaucgcugguucacgaaacuacacaaugaaccucgcaucccuuaacuggaacaacuacgaccccacagaagaaaucccagcaccccuaggcacccccgacuuugucggcaagauacaaggcguccuaacccaaaccaccaaaggcgacgguucaacccgcggccacaaagccaccgucuacacaggcuccgcccccuucacccccaaacucggcucuguacaauucuccaccgacaccgaaaacgacuucgaagcccaccaaaacaccaaguucacccccgucggcgucauacaagacggcggcacaacccaccgcaacgaaccccaacaauggguucuccccuccuacuccggccgcgacguccacaacguacaccuggcccccgccgucgccccaaccuucccaggcgaacaacuccucuucuucagaucuaccaugcccgguugcucaggcuauccaaacauggaucucgacugccuccucccccaagaauggguccaacacuucuaccaagaagcagcuccagcccaauccgacgucgcccuccuccgauucguuaacccagacaccggacgaguccucuucgaaugcaaacuccacaaacccggcuacgucacagucgcacacaccggccaacacgaccucgugauuccacccaacggcuacuucagauucgacuccuggguuaaucaauucuacacccucgcucccaugggaaacggcaccggacgccgccgcgcacuauga

SEQ ID NO: 35587 - RNA, 1623 nt, Artificial Sequence
  derived and/or modified sequence opt11 from capsid_protein_VP1__Norovirus__AII02860
augaaaauggcaucaaacgacgcuaacccuucagacggcuccgccgcaaacuuagucccugaagucucuaacgaaguaauggcccucgaacccgucguaggcgccgcaaucgccgcccccgucgcaggccagcaaaacgucauugaccccuggauccgcaacaacuuuguccaagcccccggcggugaguucaccguaucuccccgcaacgccccuggcgaaauacucugguccgcaccccuuggccccgaccucaaccccuaucuaucacaccucgcccgcauguacaacggauacgcaggaggauuugaaguccaagucauccuugcaggaaacgccuucaccgccggaaaaaucauauucgccgccguacccccaaacuucccaacagaaggccuaucaccaucccaagucaccauguucccccacauaauugucgacguacgccaacuagaacccguccucaucccccucccugacguccgcaacaacuucuaccacuacaaccaaacuaacgacuccacaaucaaacucaucgccaugcucuacacuccccuacgcgccaacaacgcaggagaagacgucuucaccguaucuugccgcgugcucacccgcccgucaccagacuucgacuucaucuuccuugucccacccaccgucgaaucacgcaccaaacccuucaccguacccauccuaaccgucgaagaaaugacuaacucccgauucccaauaccgcuagaaaaacuauucaccggacccuccggcgcuuucguaguccaaccacagaauggacgauguacaaccgacggcgugcuccucggcaccacccaacucuccccagucaauaucuguaccuuccgaggagacgucacccacaucgccggcucccgcaacuacacaaugaaccuugccucucucaacuggaacaacuacgaccccaccgaagaaaucccagcaccacucggcacaccagacuucguuggcaaaauacaaggcguacuuacccaaaccaccaaaggagacggcagcacacgcggacacaaagccacagucuauaccgggucagcccccuucaccccgaaacucggcuccguccaauucucaacagacaccgaaaacgacuucgaaacccaccagaacacaaaauucacacccgucggagugauacaagacggcggaaccacccaccgcaacgaaccccaacaauggguccucccuuccuacagcggccgagacguccacaacguccaccucgcccccgcagucgcccccacguuccccggcgaacaacuccuauucuuucgcuccacuaugcccggcugcuccggguaccccaacauggaccucgacugccuccuuccucaagaauggguccaacacuucuaccaagaagcugcacccgcacaauccgacguagcacuccuccgcuucguuaaccccgacacuggccgcguccuuuucgaaugcaagcuccacaaauccggcuacguaacagucgcccacacaggccaacaugaccucgucauuccuccuaacggcuacuuccgcuucgacuccuggguaaaccaauuuuacacccucgcacccaugggcaauggcacaggucgaagacgagcacuguaa

SEQ ID NO: 35588 - RNA, 1623 nt, Artificial Sequence
  derived and/or modified sequence opt11 from capsid_protein_VP1__Norovirus__AII02866
augaaaauggcauccaaugacgccaaccccuccgacggcuccgcagcuaaccucguccccgaggucucaaaugaagucauggcccucgaacccgugguuggagccgcaauagccgcacccgucgccggccagcaaaacgucauagacccauggauccgcaacaacuucguccaagcacccggcggagaguucaccguaucaccccgcaacgcacccggcgaaauccucugguccgccccucucggacccgacuuaaaccccuaccuuucccaccucgcucgcauguacaacggguaugccggcggauuugaaguacaggucauacucgcuggcaacgccuucaccgcaggcaaaauaaucuucgcagccguuccacccaacuuucccaccgaaggacucucccccucccaggucaccauguucccccacaucaucgucgauguccgccaacucgaacccguacucaucccccuucccgacgucaggaacaauuucuaucacuacaaccaaacaaaugacuccaccauaaaacucaucgccaugcuuuacacccccuuacgagcaaacaacgccggagaagacguauucaccguauccugccgcguccucacccgccccuccccagacuucgacuuuaucuuccucgucccaccaacugucgaaucccgcaccaaacccuucaccgucccaauccuaaccgucgaagaaaugacaaacucccgauucccaaucccacuugaaaaacucuuuaccggccccuccggcgcauucguaguccaaccucaaaacggacgcugcacaaccgacggaguccuccucggcaccacccaacucagccccguuaacaucugcaccuuccguggagacgucacccacaucgcaggcucccgaaacuacaccaugaaucucgccucacuuaacuggaauaacuacgaccccaccgaagagaucccagcaccacuuggaaccccugacuucgucggcaaaauacaaggcguccuaacccaaaccacuaaaggcgacggauccacccgcggccacaaagccaccgucuacaccgguagcgcccccuucacgcccaaauuaggcuccguccaauucuccaccgauaccgaaaacgacuuugaaacacaccaaaacaccaaauucacacccgucggcguaauccaagacggaggcaccacucaccgcaaugaaccccaacaauggguccuacccuccuacagcggccgcgacgugcacaacguccaccucgccccagccguagcccccaccuucccaggcgaacaacuccuauucuuccgcucaacaaugccaggcugcuccggauaucccaacauggacuuagacugccuccuaccacaagaauggguccaacauuucuaccaagaagcagcgcccgcccaauccgacguugcccuccuccgauucgucaaccccgacaccggacgcguacucuucgaauguaaacuccacaaaucaggcuacgucacagucgcccacaccggccaacacgaccuaguaaucccacccaauggauacuuccgauuugacucuugggucaaccaauucuacacccuagcccccaugggcaacgguaccggccgaaggcgagcucucuaa

SEQ ID NO: 35589 - RNA, 1623 nt, Artificial Sequence
  derived and/or modified sequence opt11 from capsid_protein_VP1__Norovirus__AII02869
augaagauggccuccaacgaugccaaccccacagacggauccgcagccaaccucgucccagaaguauccaacgaaguaauggcccuugaaccaguugucggagccgccauugccgcacccguagccggccagcaaaacguaaucgaccccuggauacgaaauaacuucguccaagcccccggcggcgaguucaccgucucaccccgcaacgccccaggcgaaauccucugguccgcaccccucggaccagaccucaacccauaccuaucccaccucgcccgaauguacaacggguacgcuggaggcuucgaaguccaagucauccucgccggaaacgcauucacagccggcaagaucaucuucgcagccgucccucccaacuuuccaaccgaaggccuauccccaucccaaguaacaauguucccacacauaaucgucgacguccgacaacucgaacccguacugaucccccugcccgacguccgaaacaacuucuaucacuacaaccaaaccaacgacucaaccauaaaacuaauagcaaugcucuacacaccccuacgagcgaacaacgccggcgaagacguuuucaccguuucaugccgcguccucacccgcccaucacccgacuucgacuucauauuccucgucccacccaccgucgaaucuagaacuaaacccuucaccguccccauccucacagucgaagaaaugacaaauucccgcuuccccaucccccucgaaaaacucuucaccggccccuccggcgcuuucgucguccagccccaaaacggccgcugcaccaccgacggcguccuccucggcaccacccaacucucccccgucaacaucugcaccuuccgcggagacguaacacauaucgccggcucacgaaacuacacgaugaaccucgcaucacuaaacuggaacaauuacgaccccaccgaagagauccccgcaccccugggaaccccggacuucguaggcaaaauccaaggcguucuuacccaaaccaccaaaggcgacggauccacucgaggacauaaagccaccgucuacaccggcuccgcccccuucacccccaaacuuggcagcguccaauucucuacagacaccgaaaacgauuucgaaacccaccaaaacaccaaauucacaccugucggcgucauccaagacggcggcaccacccaccgcaacgaaccccaacaauggguccuccccuccuauagcggacgagacguccacaacguccaccuugccccugccgucgccccuaccuuccccggcgagcaacuccuauucuuccgaucuaccaugcccggcugcucugguuaccccaacauggaccucgacugccuccuaccgcaagaauggguccaacacuucuaccaagaagccgcacccgcccagucagacgucgcccuccuccgauuuguaaaccccgacacaggaagaguacucuucgaauguaaacuacacaaaucaggcuacgucaccgucgcccacacuggacagcacgaccuagucaucccacccaacggauacuuccgcuucgauucaugggucaaccaauucuacacccucgcaccuaugggaaacggcaccggaagacgccgugccuuauaa

SEQ ID NO: 35590 - RNA, 1623 nt, Artificial Sequence
  derived and/or modified sequence opt11 from capsid_protein_VP1__Norovirus__AII02872
augaaaauggccagcaacgacgccaaccccucagacgguuccgccgcgaaccuaguccccgaagucucaaacgaagucauggcccuagaacccgucgucggugccgccaucgcagcaccagucgcaggacaacaaaacgucauagacccuuggauccguaacaacuucguccaagcucccggaggagaguucacaguuucaccccgcaacgcaccaggcgaaauccucuggucagcuccccucggucccgaccucaacccauaccuuucccaccuagcccgcauguacaacggcuacgcaggcgguuucgaaguacaagucauccucgcaggcaacgccuucaccgccggcaaaaucauauucgcagccguacccccaaacuucccaacagaaggccucucacccucccaagucaccauguucccacacaucaucgucgacguacgacaacuagaacccguacucauaccacuucccgacguccgcaacaauuucuaccacuacaaccaaaccaacgacucaaccauuaaacucaucgccauguuauacacaccacuacgugcgaauaacgccggagaagacguauuuaccguuuccugccgcguccuuacgcgucccuccccagacuucgacuucaucuuccucguucccccgaccgucgaaucccgcacgaaaccuuucacaguaccuauacucacgguagaagaaaugaccaacucccgcuuucccauaccuuuggaaaaacucuuuacagggcccuccggugcuuucgucguucaaccccaaaacggccguugcacuacagauggcguacuccucggcaccacacaacucagcccuguaaacaucugcacauuccgcggcgacguaacccacaucgccggaagccgaaacuacacaaugaaccuagccucacuaaacuggaacaacuacgaccccaccgaagagauccccgcaccccucggcacuccagacuucguaggcaaaauccaaggcguccucacacaaaccaccaaaggcgacggaucaacccguggccacaaagcgacugucuacaccggcucagcccccuucacccccaaacucggauccguccaauucuccaccgacacugaaaacgacuucgaaacccaccaaaacacaaaauuuacccccgucggaguaauccaagacggcggcacuacccauagaaacgaaccacaacaaugggucuuaccaucauauuccggccgugacguccacaacguccaccuagccccagccguagccccaaccuuccccggcgaacagcuacucuucuuccgcuccaccaugcccggauguucaggauacccaaacauggaccuagauugccuacugccccaggaauggguacagcauuucuaccaagaagccgcacccgcccaguccgacgucgcccuccuucgcuucgucaaccccgacaccggccgaguccucuucgaaugcaaacuccauaaauccggauacgucacagucgcccacaccggccaacacgaccuaguaaucccacccaacggcuacuuccgauucgacuccuggguaaaccaguucuacacccuagcucccaugggcaacggaaccggacgccgucgugcccucuaa

SEQ ID NO: 35591 - RNA, 1623 nt, Artificial Sequence
  derived and/or modified sequence opt11 from capsid_protein_VP1__Norovirus__AII02875
augaaaauggccuccaaugacgccaacccaucagacggcucagccgcuaaccuuguaccugaagugagcaacgaaguaauggcccuugaacccgucgucggagcagcaaucgccgcucccgucgcaggccaacaaaacgucauagacccauggauacgaaauaacuucgugcaagcacccggcggcgaguucacugucaguccccguaacgcucccggcgaaauccucugguccgcaccccucggccccgaucuaaaucccuaccucucucaccucgcccgcauguauaacggcuacgccggcggauucgaaguacaggucauccucgccggaaacgccuucacagccggaaaaaucaucuucgccgccgucccuccaaacuuccccacagaaggacuaucccccagccaagucaccauguucccccacaucaucgucgacguacgacagcucgaaccgguacuaauaccccuacccgacguccgaaacaacuucuaccacuacaaucaaaccaacgacucuacuaucaaacuaauagccaugcucuacacaccccuccgcgcuaacaaugcaggagaagacguauucaccgucuccugccgcguucucacccgcccaucacccgacuucgacuucaucuuccuaguacccccaaccgucgaaucaagaacaaaacccuucaccguccccauacucaccgucgaagaaaugaccaacagccgcuuucccauaccccuagaaaaacucuucaccggacccuccggcgccuucguuguacaaccccaaaacggacgcugcaccaccgacggcguccuucuaggcaccacacaacucucccccgucaacauaugcaccuuccggggcgacgucacccacaucgcuggaucacguaacuacacaaugaaccucgccucccucaacuggaauaacuacgaccccacagaagaaauccccgccccucuaggaacccccgacuucgucggcaagauccaaggcguucuaacacaaacaaccaaaggcgacggcucaacccgcggacacaaagcaacaguuuacaccggauccgcccccuuuacccccaaauuaggcuccguccaauucuccaccgacaccgaaaacgauuucgaaacccaccaaaauaccaaauucacccccguaggggucauccaagacggcggaacaacacaucgcaacgaaccccaacaauggguccuaccaagcuauuccggacgagacguacacaacguacaccucgccccagccgucgccccaaccuuccccggagaacaacuccuauucuuccgcucuacaaugcccggcugcuccgguuaucccaauauggaccucgacugccuccuaccucaagaauggguccaacacuucuaccaagaagccgcaccagcccaauccgacguagcacuucuccgcuucgucaacccugacaccggccgcguccuuuucgaaugcaaacuccacaaauccggcuacguaacugucgcccacaccggccaacacgaucucgucaucccgcccaacggcuauuuucgauuugacuccugggucaaccaauucuacacccuagcccccaugggcaacggcacaggccgucgccgagcccucuaa

SEQ ID NO: 35592 - RNA, 1647 nt, Artificial Sequence
  derived and/or modified sequence opt11 from capsid_protein_VP1__Norovirus__AII02878
augaaaauggccucaaacgacgccgcacccuccaacgauggcgccgccggacucguaccugaaaucaacagcgaggccauggcacuagaacccgucgccggcgcugccauugccgccccacucaccggacaacagaacaucaucgaccccuggaucaugaacaacuucguacaagcaccagguggagaauuuacagucuccccuagaaacucccccggugaaguccuacugaaccuagaacucggucccgaaaucaaccccuaccuugcacaccucgcccgaauguacaacggcuacgcuggcggauucgaaguccaagucguccuagccggcaacgccuucaccgccggcaaaaucaucuucgccgccaucccucccaacuucccaaucgacaaccuuuccgccgcccaaauaaccaugugcccacacgucauagucgacguccgccaacuugaacccgucaaucuuccaaugccugacguccgcaacaacuucuuccauuacaaccaaggaucugauucacgccuccgacucauugccaugcuauacaccccacuaagagccaacaacuccggcgacgacgucuucacaguaucaugccgcguccucacccggccuucacccgacuucuccuuuaacuuccuuguacccccaaccgucgaauccaaaaccaaacccuucucccuucccauacuaaccaucucagaaaugagcaacucccgcuucccaguccccaucgacucgcuccauaccucccccaccgaaaauaucguaguccaaugccaaaacggccgugucacuuuagacggcgaacucaugggaaccacacaacuucuuccaucacaaaucugcgccuuccgcggcaugcucacacgcuccaccucacgugcauccgaccaagcugacaccgcaaccccucgucucuucaacuacuacuggcacauacaacucgacaaccucaauggcacacccuacgaccccgcugaagacaucccaggaccacucggaacccccgacuuccgaggaaaagucuucggugucgcuucccaacgcaaccccgacgcgaccacacgagcccacgaagccaaaauagacacaaccuccggucgcuucacccccaaacucggcucucucgaaaucucuaccgaauccggagacuucgaucagaaccaaccaacccgcuucacacccguaggcaucggaguagaucaugaagcggacuuccaacaauggacccuccccgacuacgccggccaauucacccacaacaugaaucuggcccccgcugucgccccaaacuucccaggcgagcaacuacuauucuuccgcucucagcucccaucauccggcggccgcuccaacggcauccucgacugccucguuccacaagaauggguccaacacuucuaccaagaaucagcccccucccaaacacaagucgcccucgucagauacgucaaucccgacaccggucggguccuuuucgaagccaaacuccacaagcuagguuucaugacuaucgccaagucuggagacucccccauaaccgucccacccaacggcuacuuccgauuugaauccuggguaaaccccuucuauacgcucgcaccaaugggaaccggcaacggccgccgucgcauccaauaa

SEQ ID NO: 35593 - RNA, 1623 nt, Artificial Sequence
  derived and/or modified sequence opt11 from capsid_protein_VP1__Norovirus__AII02881
augaaaauggcgagcaacgacgcuaaccccucugacggcucagcagccaaccuaguccccgaagucucuaacgaaguuauggcccucgaaccaguagucggugccgccaucgccgcaccagucgccggccaacaaaacgucaucgaccccuggauacgaaacaacuucguccaagcucccggaggagaauuuacugucucaccccguaacgcccccggcgaaauccugugguccgcaccucucggcccagaccucaaccccuaccucucacaccuagcccgaauguacaacggcuacgccggcggcuucgaaguacaaguaauacuggccgguaacgcauucaccgccggcaagauaaucuucgccgccguaccacccaacuuccccacagaaggccuuucgcccucgcaagucaccauguucccccacaucauagucgacguacgacaacucgaaccaguccucaucccgcuaccugacguccgaaacaacuucuaccacuacaaccaaaccaacgacuccacaauaaaacugaucgccaugcucuacacuccccuucgcgccaacaacgcgggagaagauguuuucaccguuuccugccgcguacuaacccgcccaucaccugauuucgacuucaucuuccucguaccaccaaccgucgaaucacgcacaaaaccuuucaccguccccauccuaacagucgaagaaaugacuaacagccgauuccccaucccccuagaaaaacucuucaccggaccaucuggugcuuucguaguacaaccccaaaacggcagaugcaccaccgacggaguccuacuuggcaccacccaacuaucucccgucaacaucugcaccuucagaggcgacguaacacacaucgcuggcucacgaaacuacaccaugaaccucgccagccucaacuggaacaacuacgaccccaccgaagaaaucccugcccccuugggcaccccagacuucgucggaaaaauccaagggguccuaacucagaccacgaaaggcgacggcagcacacgcggccacaaagcaaccgucuauaccggauccgcacccuucacacccaaacucggaucaguccaauucuccacagacacagaaaacgauuucgaaacccaccaaaacacuaaauucaccccagucggcgucauccaggacggaggcaccacacaccgcaacgaaccccaacaauggguacuacccuccuauuccggccgcgauguacacaacguccaccucgcccccgccguagccccaaccuuccccggugaacaacuccucuucuuccgcucaacaaugcccgguugcuccggcuaccccaauauggaccucgauugccuccucccucaagaauggguacaacacuucuaccaagaagccgccccagcccaaucugacgucgccuuacuucguuucguaaaccccgauaccggccgcguacucuucgaaugcaaacuccacaaauccggauacgucaccgucgcacacacaggacaacacgaccucgucauaccacccaacggcuacuucagguucgacuccugggucaaccaauucuacacacuugcccccaugggaaacggcacaggccgucgacgugcccuauaa

SEQ ID NO: 35594 - RNA, 1623 nt, Artificial Sequence
  derived and/or modified sequence opt11 from capsid_protein_VP1__Norovirus__AII02884
augaaaauggccucgaacgacgccaaucccuccgacgguucugcagccaaccucguucccgaagucuccaacgaagucauggcucucgaacccgucgucggagccgccaucgccgcaccaguagcaggccaacaaaacguaaucgaccccuggauaaggaacaacuucguccaagcacccggaggcgaguucacagucucccccagaaacgcucccggcgaaauccucuggucagcaccccucggcccagaccuaaaucccuaccucucccaccucgccagaauguacaacggcuacgccggcggcuucgaaguccaagucauccucgcaggaaaugccuucaccgccggcaaaauaaucuucgcugcagucccacccaacuucccaaccgaaggauuaucccccucccaaguaaccauguucccccacaucaucguagacguacgucaacuagaaccaguccuaauaccccucccagacguccgcaacaacuucuaccacuacaaccaaaccaacgauuccaccauaaaacucaucgccaugcucuacaccccacuccgugccaacaaugcaggcgaggacgucuucaccgucuccugccgcguccuaacccgucccucgcccgacuucgacuucaucuuccuagucccucccacagucgaaagccgcacaaaacccuucacaguccccauccuaaccguagaagaaaugaccaauucccgcuuccccaucccccucgagaaacuauucaccggucccuccggagccuucguaguacaaccccaaaacggccgaugcacuaccgacggcguacuccucggcacaacacagcucucccccgucaacauaugcacauuccgcggagacguuacccacauagcugggucacgcaacuacacaaugaaccuagccucccuaaacuggaacaacuaugacccaacagaagagaucccagcaccccucgguacccccgacuucgucggcaaaauacaaggcguucucacucaaaccaccaagggagacggauccacccgcggacacaaagccaccgucuacaccggaucagcacccuucacccccaaacuaggaucaguucaauucucaaccgacaccgaaaacgacuucgagacccaucaaaacacuaaauucacacccgucggcgugauucaagauggcggcacaacccacagaaacgaaccccaacaauggguacuccccucauacuccggacgagacguccacaacguccaccucgccccagcaguagcccccaccuuccccggcgagcaacuacuauucuucagauccaccaugcccggaugcucaggauaccccaacauggaccucgacugccuccuuccccaagaauggguccaacacuucuaccaagaagccgcuccugcccaauccgauguggcccuccuccgauucguaaaccccgacaccggccgaguccucuucgaaugcaaacuacacaaauccggcuaugucaccgucgcccacaccggacaacacgaccuagucaucccacccaacggauacuuccguuuugacagcuggguaaaccaauucuacacccuagcacccaugggaaacggcacaggcagacgucgagccuuauaa

SEQ ID NO: 35595 - RNA, 1647 nt, Artificial Sequence
  derived and/or modified sequence opt11 from capsid_protein_VP1__Norovirus__AII02887
augaaaauggccucaaacgacgccgcacccagcaaugacggugccgcaggccuugucccugaaaucaauucagaagccauggcacucgaaccuguugcaggcgcagccauugccgcaccccuaaccggccaacaaaacaucaucgacccauggauaaugaacaacuucguccaagccccaggcggagaguucaccguaucaccccgcaacucuccaggagaaguccuccuaaaccuagaacuagguccagaaaucaaccccuaccuagcccaccucgcccguauguacaacggcuacgccgguggcuucgaaguccaaguaguacucgcagguaacgccuuuaccgccggcaaaauaaucuucgccgcuauaccacccaacuuccccauagacaaccucuccgccgcacaaaucaccaugugcccccacguaauagucgacguccgccaacucgaaccagucaaccuaccaaugccagacguccgcaacaacuucuuucacuacaaucaaggaagcgacucacgucuccgccucauagccaugcuauacaccccacuccgcgccaacaacuccggcgacgacgucuuuaccgucuccugccgcguccucacacgaccaagccccgacuucuccuucaauuuccuagucccucccacagucgaauccaaaaccaaacccuucucccuccccauccuaaccaucucggaaauguccaacuccagauucccaguaccaaucgacagccuacacacaucaccgaccgaaaacaucguaguacaaugucaaaacggcagaguaacacucgacggagaacuaaugggaacgacccaacuccuccccucacaaaucugugccuuccgaggcaugcucacccgauccaccucacgcgcuuccgaccaagcggacacagccacaccccgccucuucaacuacuauuggcacauccaacucgacaaccucaacggcacaccauaugaccccgccgaagacauacccgggccccuaggaacccccgacuucagaggaaaagucuuuggagucgcgucucaacgaaaccccgacgcaacaacccgugcacacgaagccaaaaucgacacaacauccggccgcuucaccccaaaacuaggcagccucgaaauauccaccgaguccggcgacuucgaccaaaaccaacccacucguuucacacccgucggcauaggcgucgaccacgaggcagacuuccaacaauggacacuccccgacuacgcgggccaauucacccacaacaugaaccucgcaccagccgucgccccuaacuuucccggagaacaacuccucuucuuccgcucccaacuucccucaagcggaggccgaucaaacggaauccucgacugccucguuccccaagaauggguacaacacuucuaccaagaauccgccccaagccaaacacagguugcucucguccgcuaugucaaccccgauaccggacgcguucucuucgaagcaaaacuucacaagcuaggcuucaugacaaucgccaaaucaggcgacucccccauuaccguacccccaaacggauacuuccgauuugaauccugggucaaccccuucuacacacucgcacccaugggcaccgguaauggucgccgccgcauacaauaa

SEQ ID NO: 35596 - RNA, 1623 nt, Artificial Sequence
  derived and/or modified sequence opt11 from capsid_protein_VP1__Norovirus__AII02890
augaaaauggccuccaacgacgcuaacccauccgacgguuccgccgcuaaucuaguaccagaagucuccaaugaaguaauggcccucgaacccgucgucggcgcagcuauagccgcccccgucgccggucaacaaaaugucaucgauccauggauacgaaauaacuucguccaagccccaggcggcgaguucaccgucucuccccggaacgccccuggagaaauccucugguccgcaccccucggacccgaccucaacccauaucucucccaccuagccagaauguacaacgguuaugccggcggauucgaaguccaagucauacucgccggcaacgccuucacagccggaaagauaaucuuugccgccgucccucccaacuuccccaccgaaggccuuucacccucacaaguaacaauguucccccauauaaucgucgacguccgccaacucgaacccguacucauaccccuaccagauguacgcaacaacuucuaccacuacaaccaaaccaacgacuccaccaucaaauuaauugccaugcucuacacaccccucagagccaauaacgccggagaagacgucuucaccguauccugccgcguacucacccgcccuucccccgacuuugacuucauauuccuugucccucccaccgucgaauccagaaccaaacccuuuaccguacccauccucacugucgaggaaaugacaaacucccgcuuccccauuccacucgaaaaacucuucacaggccccagcggcgccuuugucguccaaccccaaaauggccgcugcaccaccgacggaguccuccucggcaccacccagcucucccccgucaacaucugcaccuuccgcggagacguuacccacaucgccgguucgcgcaacuacaccaugaaccucgccucccucaacuggaauaacuacgaccccaccgaagagauccccgcaccacucgguacccccgauuucgucgggaaaauacaagguguccucacacaaaccacaaaagaagacgguuccacccgcggccacaaagcaacagucuacacaggcagcgcaccauucaccccaaaacucggcucaguccaauuuucaaccgacaccgaaaacgacuucgagacccaccaaaacacuaaauucacccccgucggcgucauucaagaugguggaacaacccaccgcaacgaaccccaacaauggguccuccccuccuacucaggacgagacguccacaacgugcaccucgcaccagcugucgcccccacauuccccggcgagcaacuccuuuucuuccgcucaacuaugccuggcuguuccggcuacccaaacauggaccuagacugccuucuuccccaagaauggguccaacacuucuaccaagaagccgccccugcccaauccgacgucgcccuccuaagauucguaaaccccgacaccggccgcguuuuauucgaaugcaaacuccacaaauccggcuaugucaccgucgcccacacaggccaacacgaccucguuaucccacccaauggcuacuuccgauucgacagcugggucaaccaauucuacacccucgcccccaugggcaacgggacgggcagacgccgagcccucuag

SEQ ID NO: 35597 - RNA, 1623 nt, Artificial Sequence
  derived and/or modified sequence opt11 from capsid_protein_VP1__Norovirus__AII02893
augaaaauggccucuaacgacgcaaacccauccgacggguccgccgccaaccucguucccgaagucuccaacgaaguaauggcccucgaacccgucgucggggcagccaucgcagccccagucgcaggccaacagaaugucaucgacccauggauccgcaacaacuucguccaagccccaggcggagaauuuaccgucucaccccgcaacgcacccggcgaaauccucugguccgccccacuaggcccagaccuaaaccccuaccucucacaccucgcccgaauguacaacggcuaugcaggcggauucgaaguccaagucauccuagccggaaacgcauucaccgccggcaaaauuaucuucgcggccgucccaccgaacuuccccacagaaggccuaucacccucccaaguaaccauguucccacacauaaucgucgacgugcgucaacucgaacccguccucauaccccuucccgacguucgcaacaacuucuaccacuacaaccaaaccaacgacucuaccaucaaacucaucgccaugcucuacacaccccuacgcgcaaacaacgccggcgaagacgucuucaccguauccugccgcguccucacccgccccucccccgacuucgacuuuauauuccuggucccacccaccgucgaaucacgcaccaaacccuuuaccguacccauccugaccgucgaagaaaugacuaacucacgcuuccccauaccccucgaaaaacucuuuacaggucccuccggcgcauucgucguccagccccagaacggacgcugcaccacagacggcguccuacucggaaccacacaacuuagccccguuaacauaugcaccuuccgaggagacguaacccacaucgccggcagccgcaacuacacaaugaaccucgccucccucaauuggaacaacuacgaccccacagaagaaauacccgcaccccucggaaccccugacuuugucggcaaaauccaaggcguccuaacccaaaccacaaaaggagacggcucuacucgcggccacaaagcaacugucuacaccggcuccgcccccuucacgccuaaacucggcuccguccaguucuccacagacaccgaaaacgacuucgaaacacaccaaaauacaaaauucacaccagucggcgucauccaagauggcggaaccacccaccgaaacgaaccccaacaaugggcccuacccuccuacuccggacgcgacguccacaacguccaccuggccccugcuguagcccccaccuuccccggcgaacaacuacuauucuuccgaucaaccaugccagguugcuccggcuaccccaacauggaccuagauugcuuacucccacaagaauggguacaacacuuuuaccaagaagcugcacccgcccaaucugaugucgcccuccuacgcuucgucaaccccgacaccggccgcguccucuucgaaugcaaacuccacaaaucaggcuacgucacagucgcacacaccggccaacacgaucucgucauaccaccaaacgguuacuuccgauuugacuccuggguaaaccaauucuacacucucgccccaaugggaaacggcaccggccgccgcagggcccucuga

SEQ ID NO: 35598 - RNA, 1623 nt, Artificial Sequence
  derived and/or modified sequence opt11 from capsid_protein_VP1__Norovirus__AII02896
augaaaauggccagcaacgacgccaaccccuccgacggaucugccgccaaccucguccccgaagucuccaaugaagucauggcacuagaacccguggucggcgcugccauagcagccccuguagcaggacaacaaaacgucauagaucccuggauacgcaacaacuucguccaagccccaggcggagaauuuacgguaucuccccgcaacgcccccggagaaauacuuugguccgcaccccuaggccccgaccucaaccccuaccuaucccaccucgcacgaauguacaacgguuacgccggcggcuucgaaguccgugucauccucgcaggcaacgccuucaccgccggaaaaaucauauucgccgcagucccacccaacuuccccacagagggccuaucccccucacaagucaccauguucccacacaucaucgucgauguccgccaacuagaacccguccuaaucccccuccccgacguaaggaacaacuucuaccacuacaaccaaaccaacgacuccaccauaaaacucauagccaugcuauacaccccacuucgagcaaacaacgcaggagaagacgucuuuaccgucuccugccgaguauuaacacgccccuccccagacuucgacuucaucuuccucgucccucccaccguugaaucacguacaaaaccauucacaguccccauccucaccgucgaagaaaugaccaacucccgcuuccccaucccacucgaaaaacucuucacaggcccaucaggagccuucguaguccaaccacaaaauggacgcugcaccacagacggaguccuccuaggaaccacccaacucagccccguaaacaucugcaccuuucgaggcgacgucacccacaucgcaggcucccgcaacuacacuaugaaucuugccagcuuaaacuggaacaacuacgacccuaccgaagaaauccccgcuccccuaggcacccccgacuucguaggcaaaauucaaggcgugcuaacucaaacuaccaaaggagacggaucaacacgaggacauaaagccaccgucuacaccggcucugcccccuucacccccaaacuaggauccguccaauucucaacagacaccgaaaaugacuucgaaauacaccaaaacaccaaauucacccccguugguguuauccaagacggcggcaccacccaccgcaacgaaccacaacaaugggugcucccuuccuacuccggaagagacguacacaauguacaccucgcccccgcagucgcccccaccuuccccggagaacaacuacuguucuuccgcucuacaaugcccggaugcuccggauaccccaauauggaccuggacugccuacuuccacaagaauggguccaacacuucuaccaagaagcagcaccagcccaauccgacgucgccuuacucagauucguaaaccccgacaccggccgaguucuauucgaaugcaaacuccaccgcucaggauacgucaccgucgcacacacaggccaacacgaccucguaauuccacccaacggcuacuuccgcuucgacucuugggucaaccaauucuacacacuagcccccauggguaacggcaccggacgcagacgggcccuguga

SEQ ID NO: 35599 - RNA, 1647 nt, Artificial Sequence
  derived and/or modified sequence opt11 from capsid_protein_VP1__Norovirus__AII02899
augaaaauggccuccaacgacgccgcccccuccaaugauggggccgccggccucguacccgaaaucaacuccgaagccauggcccuagaaccaguugccggcgccgccaucgcagcaccacuaaccggccaacaaaauaucaucgauccauggaucaugaauaacuucguacaagcaccaggcggcgaguucacaguaucaccccguaacuccccuggugaagugcuccuuaaccuugaacucggacccgaaauaaaccccuaccucgcccaccuugcacgcauguauaacggauacgccggcggauuugaaguacaaguaguccucgcaggcaacgcauucacagccggaaaaaucaucuucgccgccaucccacccaacuuccccauugauaaccucuccgccgcacaaaucacaaugugcccccacguuaucgucgacguccgccaacucgaacccguaaaccuacccaugcccgacguucgaaauaacuucuuccauuacaaccaaggaucagacagccgccuccgacuuaucgcaaugcucuauacuccccuccgagccaacaacuccggcgacgacgucuucacagucucaugccgcguccucacucguccauccccagacuucuccuucaacuuccuaguaccgcccaccguagaaucaaaaaccaagcccuucucacucccaauccucaccaucucagaaauguccaacucccgcuuccccguacccaucgacucccuccacaccucaccaacugagaacaucgucguccaaugccagaauggacgagucacccuagacggagaacucaugggcaccacacaacuccuccccucucaaauaugcgcuuucagaggcaugcuuacccgcuccacuucucgggccucugaccaagcagacaccgcuacaccccgccucuucaacuacuacuggcacauccaacucgacaaccuaaacggaacccccuacgacccagccgaagacaucccaggcccccuuggcaccccagacuuccguggaaaaguauucggagucgcaagccagcgaaaccccgacgccaccacccgcgcccacgaagcaaaaaucgacaccaccuccggcagauucacacccaaacucggcucccuagaaaucagcaccgaauccggugacuucgaucaaucgcaacccaccagauucaccccagucggcaucggcgucgaucacgaagccgauuuccaacaauggacacuacccgacuacgccggucaauucacacacaacaugaaccucgcccccgccguagcaccaaauuuccccggagaacaacuauuauucuuccgaucccaacucccaucguccggaggccgaucaaacgggauacuagacugccuuguaccccaagaauggguccaacacuucuaccaagaaucagcucccucccaaacccaaguggcccuuguccgcuaugucaaccccgacaccgggcgcguccucuucgaagccaaacuccacaaacucggcuucaugaccauagcaaaauccggcgacucacccaucaccguaccacccaacggauacuuccgcuucgaauccuggguaaaccccuucuacacacuagcacccaugggcaccggcaacggacgccgccgcauucaauaa

SEQ ID NO: 35600 - RNA, 1623 nt, Artificial Sequence
  derived and/or modified sequence opt11 from capsid_protein_VP1__Norovirus__AII02902
augaaaauggccuccaacgacgcuaaccccuccgaugguuccgcagcuaaccucgucccugaagucagcaacgaagucauggcccucgagccaguagucggagccgcaaucgccgcaccagucgccggccaacaaaacgucaucgaccccuggauacgcaacaacuucguacaagcccccggcggcgaguucaccgucucaccccguaacgccccaggcgaaauccucugguccgcuccccucggaccagaccuaaaccccuaccuaucccaucuggcccgaauguacaacggauacgccggcggcuucgaaguccaaguuauccucgccggcaaugcuuucacggccggcaaaaucauuuucgcugccgucccucccaacuuucccaccgaaggccucucccccucccaaguaaccauguucccccauauaaucgucgacguccgacaacucgaacccguacucaucccccuacccgacguccgaaacaacuucuaccacuacaaccaaacaaacgacuccaccaucaaacucauugccaugcucuacacaccccuccgagcaaacaaugccggggaagacgucuucaccgucuccugccgcguucucacccgccccucaccugacuucgacuucauauuccucgucccaccaaccgucgaaucccgcacaaaaccauucacaguccccauccucaccguugaagaaaugacaaacuccagauuccccauaccucucgaaaaacucuucaccggacccucaggcgccuucgucguacaaccccaaaacggccgaugcacaacagauggcguucuacucggcaccacccaacucuccccagucaacauaugcaccuuccgcggcgacguaacccacaucgccggaucccgcaacuauaccaugaaccucgccucccuaaacuggaacaacuacgacccaaccgaagaaaucccggcaccauugggcaccccagacuucguaggaaaaauccaaggcguccucacccagacaacaaaaggagacggcagcacucggggccacaaagccaccguauacaccggcuccgcccccuucaccccuaagcuaggcuccguccaguucucuacagacaccgaaaacgacuucgagacccaccaaaacacaaaauucacacccguaggcgucauccaagacggcggcaccacccaccgcaacgaaccacaacaguggguucuccccuccuauuccggccgagacguacacaacguacaccucgccccagccguagccccaaccuucccaggcgaacaacuacucuucuuccgcucaaccaugcccggcugcuccggcuaucccaacauggaccuagacugccugcucccccaagaauggguacaacauuucuaccaagaagccgcucccgcccaauccgacgucgcacuccugcgcuucguaaacccagacaccggcagaguccucuucgaaugcaaacuccacaaauccggcuacgucaccgucgcacacaccggccaacacgaccucguaauacccccaaacggcuacuuccgcuuugacuccugggucaaucaauucuacacccuagcucccaugggcaacgguacaggccgccgacgagcacucuaa

SEQ ID NO: 35601 - RNA, 1647 nt, Artificial Sequence
  derived and/or modified sequence opt11 from capsid_protein_VP1__Norovirus__AIS24557
augaaaauggccagcaacgacgcagcccccucaaacgacggcgcugccggacucguucccgaaaucaauaacgaagcuauggcccucgacccuguagcuggcgccgccaucgcugcuccccuaaccggucaacaaaauaucauagacccauggaucaugaauaacuucguucaggccccuggcggagaguucaccguaucuccccgcaacucccccggugaagucuuacuuaaucucgaacucggacccgaaauaaaccccuaccucgcacaccuagcucgcauguacaaugguuacgccggcggauuugaaguacaaguaguacucgccggcaacgccuucaccgcaggcaaagucaucuucgccgccaucccacccaacuuccccacagacaaccucuccgcagcccaaaucaccaugugcccccacgucauagucgacguccgacaacucgaacccaucaaccuucccaugcccgacgucagaaacaacuucuuccacuacaaccaaggcuccgacucacgccuccgccucaucgcuaugcuguacacaccucuacgagccaacaauuccggcgacgacgucuucaccgucucaugccgaguccucacacgccccucccccgauuucuccuuuaauuuccuuguaccaccaacggucgaauccaaaaccaaacccuucacauuacccauacugaccauaagcgaaaugagcaacucacgauuccccguucccaucgacucucuacacaccucacccacagacaacaucgucguacaaugccaaaacggccgcgucacccucgacggcgaacuaaugggcaccacccaacuccugcccucccaaaucugcgccuuccgaggcguccucacccgcuccaccucccgcgccucugaccaagcagacgccgcuacccccagacucuucaacuacuacuggcacauucaacuagacaaccucaacggcaccccauacgaccccgccgaagacauccccgcaccccucggcaccccagacuuccgaggcaaagucuucggcgucgccucucaacgcaacccagacucaaccacgcgagcucacgaagccaaagucgacacgacaucaggccgauuuacccccaaacucggcucccuagaaaucuccaccgaaucaggagacuucgaccaaaaccaacccacccgcuucacacccguuggcaucggaguugauaacgaagcugauuuccagcaauggacacuacccgacuacagcggacaauucacccauaauaugaaccucgcccccgcugucgcccccaacuucccaggagaacaacuccucuucuuccguucccaacuccccucguccggcggccgaucaaacggcauccucgacugccucguaccccaagaauggguacaacacuuuuaccaagaaucugccccagcccaaacacaaguagcccucguccgcuacgucaacccagacaccggucguguacucuucgaagccaaacuccacaaauuaggcuacaugaccauagcaaaaagcggugacucaccaaucacugucccucccaacggcuacuuccgguucgaauccugggucaaccccuucuacacucucgcacccaugggaacuggaaacggaagacgacgaauccaauga

SEQ ID NO: 35602 - RNA, 1620 nt, Artificial Sequence
  derived and/or modified sequence opt11 from capsid_protein_VP1__Norovirus__AIY30135
augcguauguccgacggagccgcucccaaggcugacggauccgaagccucuggacaagaccucgucccuaccgcuguagaacaagccguccccauccaaccagucgcuggcgccgcccucgccgcccccgcagccggucaaauuaaccaaauagaccccuggaucuuccagaacuucguucaaugcccccucggcgaguucuccaucagcccacgcaacacucccggcgaaauccucuucgaccuagcucucggccccggccuaaaccccuaccucgcucacuuauccgcuauguacacaggaugggucggcaacauggaaguccaguuaguauuagccggcaacgcuuucaccgccggaaaagucgucgucgcccucguacccccuuacuucccuaaaggcucacucaccaccgcccaaauaaccugcuucccccacguaaugugcgauguccgcacccucgaacccauccagcuaccccuccucgacguacgccgcguucucuggcacgcaacacaagaccaagaggaguccaugcgccuagucugcaugcucuacacuccccuucgaaccaacuccccaggugacgaauccuucgucgucucgggcagacuacuaucaaaacccgccgccgacuuuaacuuugucuaccucaccccacccaucgaacgaacaauauaccgaauggucgaccuacccgucauccaaccccgccucugcacacacgcccgauggccagcgcccgucuauggccuccucguggacccgucacucccauccaacccccaauggcaaaacggaagaguccacgucgacggcacccuacucggcaccacccccguauccggcuccugggucuccugcuucgcagcagaagcagcguacgaguuccaaucgggaacaggccaaguagccacuuuuacccucaucgaacaagacggcuccgcauauguacccggcgaccgcgccgccccacucggcuaccccgacuucucaggacaacucgaaaucgaaguacaaacagaaacaaccaaaaccggcgacaaacucaaagucaccaccuucgaaaugauacucggucccaccacaaacgucgaccaagccccauaccaaggcaaagucuucgccucaaucaccgcagcugccagccucgaccuugucgacggcagaguccgcgccgucccccgcuccauauacggcuuccaagacguuauccccgaguauaacgacggucuccuagucccacucgccccacccauaggccccuuccuccccggagaaguccuccuacgguuccgcacuuacaugcgucaacuugacaccgcagacgccgccgccgaagccaucgacugcgcccuuccccaagaguucaucucaugguucgcguccaacgucuucacaguucagagcgaagcccuccuacugcgcuaccgaaacacacucaccgggcaacuccuauucgagugcaaacuauacuccgaaggauacauagcacuuuccuacucaggaucaggaccccuaacauucccuaccgacggauuuuucgaagucguauccuggguucccagacucuaccaacuugcauccguaggaucucucgccaccggucgcacccuuuaa

SEQ ID NO: 35603 - RNA, 1623 nt, Artificial Sequence
  derived and/or modified sequence opt11 from capsid_protein_VP1__Norovirus__AKE07100
augaaaauggccuccuccgacgcuaaccccuccgacggaucuacagccaaccuaguccccgaagucaacaacgaagucauggcccuagaacccgucgucggagcagccaucgccgcccccgucgccggacaacaaaaugucauagacccauggauucgcaacaacuucguacaagcccccggcggagaguucacaauaucaccucgaaacgcccccggcgaaauccucugguccgccccucucgguccagaccucaaucccuaccucucccaccuggcccgcauguacaacggcuacgccggaggauucgaaguccaagucauccucgccggcaacgcauuuacagccggcaaaguaauauucgccgcugucccacccaacuuccccacagaaggacuuucuccuucacaagucacaauguucccacauauagucguagacguacgccaacucgaacccguccuaauaccacuaccggacguccgaaacaacuucuaccacuacaaccagucaaacgaccccaccaucaaacucaucgccaugcucuacaccccucuccgcgccaacaacgccggugacgaugucuucaccguauccugcagaguccucacccgccccucccccgacuucgacuucaucuuccucgucccaccaacaguggaaagccgcacuaaacccuucucaauccccguacucaccaucgaagaaaugaccaacucccgcuuccccauuccccuagaaaaacuauucacgggccccuccuccgccuucgucguacaaccccaaaacggacgcuguucuaccgacgguguacuacucggcacaacccaacucuccccagucaacaucugcaccuuccgcggugacguaacccacauagcugguucccacaauuacacgaugaaccucgcaucucaaaacuggaacuccuaugaucccacugaagaaauaccagccccacuaggaacccccgacuucgucggcaaaauacaaggaguacucacacaaacaacccgugccgacggcuccacacgaggucacaaagccaccguccucaccggcucagccaacuucaccccaaaacucggccgcauccaauucgccacagauaccgacaacgacuuugaaaccaaucaaaacaccaaauucacccccgucggcguaauacaggacggcgacacugcccauagaaacgaaccacaacaauggguccuccccuccuacucaggacgaaacacccacaacguccaccucgccccggccguagcccccaccuuucccggcgaacagcuuuuauuuuuccguuccaccauuccaggcugcucagguuaccccaacauggaucuagacugccuccucccccaagaauggguccaauucuuuuaccaagaagcagcacccgcccaauccgacgucgcacuacuacgcuucgucaaccccgacaccggccguguccucuucgaaugcaaacugcacaaauccggauacaucaccgucgcccacacaggccagcaugaucuagucaucccucccaacggauacuuccgauuugauucuugggucaaccaauucuacacccuagcccccaugggaaacggcaccggccgccgccgcgcacucuaa

SEQ ID NO: 35604 - RNA, 1623 nt, Artificial Sequence
  derived and/or modified sequence opt11 from capsid_protein_VP1__Norovirus__AKE07103
augaagauggcauccuccgacgccaaccccucggacggaagcgccgccaaccuagucccagaagucaacaaugaagucauggcacucgagcccgugguaggcgccgccaucgccgcccccguagcuggccaacaaaacguaaucgacccauggauccgcaacaacuucguucaggcaccaggaggugaauuuacagucucccccagaaacgcaccaggcgagauccuauggucagcaccccucggccccgaccuuaaucccuaccucucucaccucgcccgaauguacaacggcuacgccggcggcuucgaaguccaaguaauacucgccggcaacgccuucaccgccggcaaaaucauauucgcagccguaccacccaauuuccccacagaaucccucucccccucccaagucaccauguucccccacauaaucguagacguccgacaacuagagccgguucuaaucccccuccccgacguccgcaacaacuucuaccacuacaaccaaagcaacgaccccaccaucaagcucauugccaugcucuacaccccacuccgcgccaacaacgccggcgacgacgucuucacaguauccugccgcguccucacucgacccucccccgacuuugacuucaucuuccucguacccccaaccgucgaaucacgcaccaagcccuucucuguaccaauccucaccgucgaagaaaugaccaacucucgcuuccccaucccccuggaaaaacuuuucacaggccccagcuccgccuucgucgugcaaccacaaaacggccgcugcaccaucgacgggguuuuacuuggaaccacucaacucuccccugucaacaucugcaccuuccgcggcgacguaacccacaucgcaggcacacacaacuacaccaugaaccucgcuacacaaaacuggaacucauacgacccaacagaagaaauacccgcuccccucgggacacccgacuucguaggcaaaauccaaggaguccuuacccaaacaacaaaaaccgacggcucuacacgcggccacaaagccacagucugcaucggcagcgccgacuucgcccccaaacucggacgcguccaguucgagaccgacacaaacaacgaccuagaaacaaaccaaaacaccaaauuuacacccgucggcgucauacaaaacggugaaacagcccacagaaacgaaccccaacaauggguccuacccuccuacuccggcagaaacacucccaacgugcaccuagcacccgcaguagccccuaccuuccccggcgaacaacuacucuucuuuagauccaccaugcccgguuguuccggcuaccccaacauggaccucgacugccuccuaccacaagaauggguccaauacuucuaucaagaagcagcaccagcacaauccgacguugcccuacucagauucgucaacccggauacaggacgaguacuauucgaaugcaaacuacacaaauccggcuauguaaccgucgcacacaccggcucacacgaccuagucauucccccgaacggcuacuucagauucgacucaugggucaaucaauuuuacacccuagcaccaauggguaacgguaccggccgccgacgugccaccuaa

SEQ ID NO: 35605 - RNA, 1623 nt, Artificial Sequence
  derived and/or modified sequence opt11 from capsid_protein_VP1__Norovirus__AKE07106
augaaaauggcuuccuccgacgcaaaccccuccgacggcuccaccgccaaccuuguccccgaagucaacgacgaaguaauggcccucgaaccaguuguuggcgccgcucuagccgcccccguagccggccagcaaaacguaauagacccuuggaucagaaauaacuucguccaagcuccaggaggcgaguucaccgucucccccagaaacgccccuggcgaaauccuuugguccgcuccccucggccccgaucuaaacccauaccucucacacuuagccagaauguacaacggcuacgccggcggcuucgaaguucaaguuauccucgccggcaacgccuucacugcaggcaaaguaauauucgccgccguucccccaaacuuuccaaccgaaggacuaucccccucccaagucaccauguucccccauauuaucgucgacguacgccagcucgaacccguccucauuccacuacccgacgcccgcaacaacuucuaccacuauaaccaaucaaacgaauccaccaucaaacucauagccaugcuauacacaccccuccgcgcaaauaacgccggcgacgacgucuucaccgucucuugccgcguguuaacacgaccaucacucgacuucgacuuuaucuuccucgucccaccaaccgucgaaucccgcacuaaacccuucucagucccuauccucacggucgaagaaaugaccaacucccgcuuccccaucccccuagaaagacuuuucacuggaccauccuccgccuucgccguccaaccccaaaacggccgcuguaccaccgacggaguccuacuagggaccacacaacuaucccccgucaacaucuguaccuuucgcggagacgucacccacacaaccggaucccacaauuacaccaugaaccucgcaagccagaaccguucaaacuaugaccccaccgaagaaauaccagcuccccuaggcaccccagauuucgucggcaaaauccaaggcgcccucacacaaaccacacgcgccgacggcucaacccgaggacauaaagccaccguauacaccggaucugccgacuucaccccgaaacuuggacgcguccaauuugcaaccgacacagaccacgacuucgacaccaaccaaaauaccaaauucacccccguaggcguaauccaagacggcuccaccacacaccgaaaugaaccacaacaaugggugcuccccagcuacucaggccgcaacacacacaacguccaccuagccccugcugucgcgccaaccuuccccggcgaacaacuacuauucuuccgcucaaccaugccaggaugcuccggcuacccaaacauggaccucgacugccuacucccccaagaaugggucgcacacuucuaccaagaagccgcccccgcacaauccgacgucgcacuacuccgcuucgucaaccccgacacuggccguguccucuucgaaugcaaacuccauaaaucgggcuacgucaccgucgcacacacuggccaacacgaccucgucaucccacccaauggcuacuuccgcuucgacuccugggucaaccaauuuuacacccuagccccgaugggcaacggcaccggccgacgccgagcccucuaa

SEQ ID NO: 35606 - RNA, 1719 nt, Artificial Sequence
  derived and/or modified sequence opt11 from capsid_protein_VP1__Norovirus__ALQ12260
augaaaauggcauccaacggcgccgcagcaccaucacaagacggcgccgcuaaccucguaccagagagccaacaagaaguacuagcucucgaaccagucgccggugcagcccuugccgcacccgucgcuggccaauuuaaugccauagaccccuggaucaaacaaaacuucguccaagcccccgcaggcgaauucacagucucuccaagaaacgcccccggcgaaguccucauggaccucgaauuaggccccgaaaugaacccauuccuagcccacuuagcacaaauguacaacgcauacgcuggcggaauggaaguccaaaucauccucgcaggcaacgcauucaccgcagguaaaaucauagugugcgccgucccucccaauuucccaccagaccgccucuccgcaucacaagcaaccaacuucccccacgucaucauggacguucgcacacucgaacccgucguccucccccucccagacgucagagcaggcuucuuccacuacaaccaacuucgcgaacccagaaugcgccuaaugacccugcuauacaccccccuccgcgccaacggcaccggcgaugacgccuuuacuguauccugccgcguucugacccgacccaugcucgacuucgaauucauguuccucguuccccccaccgucgaauccagagucacccccuucuccguucccaccuaccccguagucgaaaugaccaauucccgauggcccgcccgcaucucaggcaugcacgucaacgccaaccaaacccuagccguacaauuccaaaacggccgaugcacacucgacggccaacuuaugggaaccacucaguuaugcgcagccgaugucugcaggaugcggggccguuacaccagcacccgcgcagaccccgcaggauuaggaugggaccuagacgccaccacacucgucgacggaccagaagccagaguccaagcccgcaucuccgucucugcccaucuccaacuagaagaacuaucuggacaaccguacgaaguauacggagaacaacccgcaccacucggcaccccagacuuccagugccgacucaugggcgaacugguccgccucccauccgcaaaccccgucgcccaaucaagauuccgagacgccuucuucgauaccuauggcgcccuauucgcccccgcugucggcuccgucacagucacuguaaauaauagcuccucauccgacuuugcaaacgaccaaccuuucgaauuccucccuaucggcgucgaaaucggcaacuccgcccgcuacgaugaauucgcccuccccuccuauaacggcgcaauuggagaaaaccgacaucucgcacccaucgcugcccccggcuuccccggcgagaaccucauauucuucuccucaaaccuaccaguaugggacaguaccucugcccaaucaaaccgucgcauauccugccucuuaccaaacgaauucauccaacacuucuacgacuuacaagcccccucacagucagaugucgcccuccuccgcuacguccaucccgaaaccgaccgauuccuauucgaaugcaaacuguaccgcgacgccuuccucaccgucaacggcgcauccuacgccgaauuccccgugaacggcuacucucgauucgacucuuggguaaaacaauucuucacucuuagccccgucggaaccggaucaggccgacgaggucgcucacgaaaagcccaauga

SEQ ID NO: 35607 - RNA, 1620 nt, Artificial Sequence
  derived and/or modified sequence opt11 from capsid_protein_VP1__Norovirus__BAI49904
augaaaauggccucaaacgacgccaaccccucagauggaucaaccgccaaccucguccccgaagucaacaacgagguaauggcccucgaaccaguagucggagccgccaucgcagcccccgucgccggacaacaaaacguaaucgaucccuggauucguaauaacuucguccaagcacccgguggcgaguucacuguaucaccccgaaacgcccccggcgaaauccucugguccgcaccccuaggaccagaccucaaccccuaccucucccaccuugcccguauguacaacggcuaugccggcggauucgaaguccaaguaauccucgccggcaacgccuuuacagccggaaaaauaauauucgccgccgucccucccaacuuucccaccgaaggucucucccccucccaagucacaauguuuccccacauaaucguagacguccgccaacuagaaccaguccuuaucccacuccccgacguaagaaacaauuucuaucacuacaaccaaucuaacgacuccacaaucaaacucaucgccaugcucuacacgccccucagagcuaacaacgccggugaugacguauucaccguauccugccgcguccuaacccgccccuccccagacuucgauuucaucuuccucgucccaccuaccgucgaaucccgcacuaaacccuucaccguaccaaucuuaacugucgaagaaauguccaagucccgcuuccccaucccccuagaaaaacucuacacaggccccagcuccgcauucgucguccaaccccaaaacggccgaugcaccaccgacggcguacuccucggcacaacccaacucucagucguaaacaucugcaccuuccgaggcgacgucacccacaucgccggcucucacgacuacaccaugaaccuagccucacaaaauuggaacaauuacgacccuacagaagaaauucccgcaccucucgggacccccgacuucgucggcaaaauccaaggaaugcuaacccaaacgacccgagaagacggcucaacaagagcucacaaagcaaccgucucaacuggauccguacacuucacacccaaacuaggaucaguacaauacaccaccgacacaaacaacgacuuccaaaccggccaaaauacuaaauucacccccgucggcgucauccaagacggcaacaaccaccaaaaugaaccccaacaauggguccuacccaacuacuccggccgcaccggccacaacguacaccucgcccccgccgucgcaccaacauucccaggugaacaacuccucuucuuccgcuccaccaugcccggaugcucaggcuaccccaacaugaaccuagacugccuccucccccaagaauggguccaacauuuuuaccaagaagccgccccugcucagucggacgucgcccuccuccguuucgucaaccccgacaccggacgauuccuauucgaaugcaaacuccacaaaagcggcuacgucacagucgcucacacagguccccacgaccucgugaucccacccaacgguuauuuucgcuucgacucauggguaaaccaauucuacacacucgcccccaugggcaacggagccggcagacgucgcguacucuaa

SEQ ID NO: 35608 - RNA, 1623 nt, Artificial Sequence
  derived and/or modified sequence opt11 from capsid_protein_VP1__Norovirus__BAI49905
augaaaauggcaucaaacgacgccuccccaagcgacggcucaaccgccaaccuaguacccgaagucaacaacgaagugauggcacucgaaccggucgucggcgcugcuaucgcagccccagucgcaggccaacaaaacguaauugaccccuggauccgcaacaacuucguacaagcacccggcggcgaguucaccgucuccccacgaaaugccccaggagaaauacuauggucagcaccccucggcccagaccucaaccccuaccucucucaccuagcccguauguacaacggauaugccggcggcuucgaaguccaaguaauacuugccggaaacgcauucaccgccggaaaaaucaucuucgcagcaguuccgcccaauuuucccacagaaggccucucacccucccaaguuacaauguucccccacauaauagucgacgucagacaacuagaacccguucucaucccacucccggauguacgcaauaacuucuaccacuacaaccaaucaaacgacucaacaauaaaacuuaucgcgaugcuauacacaccccuucgcgccaacaacgccggagacgacgucuucaccguuucaugccgaguacucaccagacccuccccagacuucgacuucauauuccucgucccgcccaccgucgaaucccgcacaaaacccuucacaguucccauccuuaccgucgaagaaaugaccaauucacgcuuccccauaccccuugaaaaacuauucaccggcccauccuccgcauucguaguccaaccccaaaacggacgcuguaccacggacgguguucuccucggaacaacccaacuaagcccagucaacauaugcaccuuccgcggagacgucacccauauaccaucuacacgcacuuaccgcaugaaccucgcaucucaaaacuggaacaacuacgaccccaccgaagaaauccccgcaccccuaggaacaccagacuucgucgguaaaauacaaggcaugcucacgcaaacaaccaaaggagacgguagcacacgaggucacaaagccaccgucuccacaggauccgucgacuucacacccaaacugggcucaguccaguucgccaccgacaccgacaaugauuucgaaaccggccaaaacacccgauucaccccagucggcgucauccaagacggaagcuccgcccaccguaacgaaccccaacaguggguccucccugacuacuccggacgcacgguccacaacguacaccucgcccccgccgucgcccccacauuucccggcgaacaacuucucuucuuccgauccaccaugcccggcugcucaggcuauccaaacauggaccuggauugccugcucccacaagaauggguccaacacuucuaccaagaagccgcccccgcacaaucagacgucgcacuccuccgauucgucaaccccgacaccggccguguacucuuugaaugcaaacuccacaaaaccggauacgucaccgucgcucacaccggccaacacgaccucgucaucccuccaaauggcuacuuccgauucgacuccugggucaaccaauucuacacccucgcacccauggguaacggcgcaggccgccgacgugcucuguaa

SEQ ID NO: 35609 - RNA, 1623 nt, Artificial Sequence
  derived and/or modified sequence opt11 from capsid_protein_VP1__Norovirus__BAI49906
augaaaauggccuccaacgacgcaucucccagugacggcucuaccgccaaccucguaccagaagucaacaacgaagucauggcccuagaacccgucguuggagcagccaucgcagcaccagucgccggccagcaaaaugucaucgaccccuggauacgcaacaacuucguccaagcccccggcggagaguucaccgucucacccagaaacgcccccggagaaauacucugguccgccccacuaggcccagaccucaaccccuaccuaucccaccuugcaagaauguacaacggcuacgccggcggcuucgaaguucaaguuauccuagccggaaacgccuucacagccgguaaaaucaucuucgcagccguaccacccaauuuccccaccgaaggccucucccccucucaagucacaauguucccccacaucauugucgacguacgacaacucgaacccguccuuauaccccuccccgacguccgcaacaacuucuaccauuauaaucaaucuaaugacucaaccaucaaacuuaucgcaauguuauacaccccacuccgagccaacaacgccggcgacgacgucuucaccguauccugccgaguccuaacgagaccaagccccgacuucgacuucaucuuccuugucccacccacuguagaaucccgaacaaaacccuuuaccgucccaauucucaccgucgaagaaaugacaaacucccgcuuccccauaccccucgaaaaacuauuuaccggcccauccuccgcauucguaguccaaccacagaacggccgaugcacaaccgacggaguccuccuaggcaccacacaacucuccccagucaauauaugcacuuuccgcggcgacguaacccacauccccggaacccgcacauaccguaugaaccucgccucacaaaacuggaacaacuacgacccuacagaagaaauccccgccccacuagguacccccgacuucgucggcaaaauccaaggcaugcucacccaaaccacaaaaggcgacggcuccacccacggccacaaagccaccgucagcaccggcuccgucgacuucacuccuaaacuuggaucaguccaauucgcaaccgauaccgacaacgacuuugaaaccggccagaauacccguuucaccccugucggcgucauccaggacggauccagcgcccaccguaacgaaccucaacaauggguccucccagacuacuccggacgcaccguccacaacguacaccuagccccugcaguagccccaaccuuccccggagaacaacuccuuuucuuccgcuccacaaugcccggaugcucuggcuaccccaacauggaccucgacugccuacucccccaagaauggguccaacacuucuaccaagaagcugccccugcccaauccgacgucgcucuccuccgcuucgucaaccccgacacuggucgcguccucuucgagugcaaacuccacaaaacagguuaugucaccgucgcacacaccggccaacacgaccucguaauacccccaaacggcuacuucagauuugacuccugggucaaccaauucuacacacucgcaccaaugggcaacggcgccggccgacgacgugcccucuaa

SEQ ID NO: 35610 - RNA, 1623 nt, Artificial Sequence
  derived and/or modified sequence opt11 from capsid_protein_VP1__Norovirus__BAI49907
augaaaauggccucaaacgacgccagccccuccgacggcuccaccgccaaccucgucccagaagucaacaacgaaguaauggcccuugaacccgucgucggcgccgccaucgcugcccccgucgccggacaacagaacgucaucgacccauggauccgcaacaacuucguacaagcucccggcggcgaguucaccgucagcccccgaaacgcaccaggcgaaauacuuugguccgcaccccucggcccagaccuaaaccccuaccucucacaccuggcccguauguacaacggcuacgccggaggauucgaaguacaggucauccuagcaggcaaugccuucaccgccggaaaaauaaucuucgccgcggucccgcccaacuuccccaccgaaggacucucccccucccaagucacaauguuuccacacaucaucgucgacgucagacaacuugaacccguccucaucccucuuccagacgucagaaacaacuucuaccauuacaaucaaucuaacgacucaacaauaaaacucaucgcuaugcuauacacaccccuccgagccaacaacgcuggcgacgacgucuucaccguaucaugccgaguucucacccgacccuccccagauuucgacuuuaucuuucucgucccacccaccguugaaucccgcaccaagcccuucaccguccccauccucacaguugaagaaaugacuaacucucgauuccccaucccacucgaaaaacuauucaccggccccucauccgcauucgucguucaaccccaaaacggucggugcacaaccgacggaguacuacuaggcaccacccaacucucaccaguuaauaucuguaccuucagaggcgacguaacacacauucccggcacccgcacauaccgaaugaaccuagcaucacaaaacuggaacaacuacgacccaaccgaagaaauccccgcaccccuagguacccccgacuuugucggaaaaauacaaggagugcucacccaaaccacacgcggcgacggcucaacccgcggccacaaagcaacugucagcaccggcucaguugacuucaccccaaaacuaggcucuguacaauucgccaccgacaccgacaacgacuucgagaccggacaaaacacacgcuucacccccguaggaguaauacaagacggguccucugcccaccgcaacgaaccccaacaauggguucuccccgacuacuccggccgaaccguccacaacguccaccuagccccugccguagcaccuacauucccgggagaacaacuacuauucuuccgcuucacaaugccaggaugcuccggcuaccccaacauggaccucgacugccuccucccacaagaauggguccaacauuucuaccaagaggcagccccugcccaauccgacgucgcccuccucagguucguuaaccccgacacaggacgagucuuauucgaauguaaacuucacaaaaccgguuacgucacugucgcccacaccggccaacacgaccuugucauucccccuaacggcuacuuccgcuucgacagcuggguaaaccaauucuacacacuugccccaaugggaaacggcgcaggccgucgccgcgcccuuuaa

SEQ ID NO: 35611 - RNA, 1623 nt, Artificial Sequence
  derived and/or modified sequence opt11 from capsid_protein_VP1__Norovirus__BAI49909
augaaaauggccagcaacgacgccacccccucagacggauccacagccaaccuaguccccgaaguaaacaacgaaguaauggcccucgaaccugucguuggcgccgccaucgccgcacccguagccggccaacaaaacgucaucgaccccuggauacguaacaacuucguacaagcacccggaggugaguucacggucucaccccgcaacgccccaggugaaauccucugguccgccccacucggcccggaccuaaacccauaccucucccaccucgcccgcacauacaacggcuaugcuggcggauucgaaguccaagucauccuagccggcaacgccuucaccgccggaaaaauaauauucgcagcugucccaccaaauuuccccaccgaaggccucagcccuucccaaguaaccauguucccgcacaucaucguagacguccgccaacucgaacccguucuuauuccacuaccagacguucguaacaacuucuaccacuacaaucaaucuaaugacuccaccaucaaacucaucgcaaugcucuacaccccacuccgagccaacaacgccggcgacgacguauucaccgucucaugccgcguccucacaaggccaucucccgacuucgacuucaucuuccucguaccacccaccguagaaucacgcaccaaacccuucuccguacccauccuuaccgucgaagaaaugacaaacucccgcuuccccaucccccuagaaaaacucuucaccggucccucauccgccuucguaguacaaccucaaaacggacgaugcacaaccgauggcguccuccucggcaccacccaacuaagccccgucaauauauguacauuucgcggcgacguaacccacauagccggaacccaaaacuacacaaugaaucuagcaagccaaaauuggaacaacuacgaccccacagaagaaauccccgcuccccucggcaccccagacuucgucgggaagauccaagggguacuuacccaaaccacccgacgagacggauccacccguggucacaaagccaccguauccaccggauccguucacuucacacccaaacuaggcucaguccaauucuccacagauacauccaaugacuucgaaaccggacaaaacacccgcuucacccccgucggcguaguccaagacggcucgacaacccaccaaaacgaaccucaacaauggguccuccccaacuacuccggacgcgacucacacaauguccaccucgcccccgcaguugcaccaaccuucccaggagaacaauuacuuuucuuucgcuccacaaugcccggcuguuccgguuaccccaacaugaaccuagacugccuacucccacaagaauggguacaacacuucuaccaagaauccgcacccgcacaauccgacguagcacuccuacgcuuugucaaccccgauacaggccgcguacuuuucgaaugcaaacuccacaaauccggauacguaaccgucgcacacaccggacaacaugaccucgucauacccccaaacggcuacuuccgcuucgacagcugggucaaucaauucuacacccuugcccccaugggaaacggagccggccgacgcagagcacucuaa

SEQ ID NO: 35612 - RNA, 1623 nt, Artificial Sequence
  derived and/or modified sequence opt11 from capsid_protein_VP1__Norovirus__BAI49910
augaaaauggcaucaaacgacgcaaccccaucagacggcucaaccgcaaaccucgucccagaagucaacaacgaagucauggcucucgaacccgucgucggcgccgccaucgccgccccggucgcaggucaacaaaacgucaucgauccauggauccgcaacaauuucguccaagcccccggcggcgaauuuaccgucucaccccggaacgcccccggugaaauacucugguccgcuccccuaggcccggaccucaacccuuaccucucucaccuagcccguauguacaacggcuacgccggcggcuucgaaguccaagucauacucgccgggaacgccuucaccgcaggaaaaauaauauucgccgcagucccacccaacuuccccacugaaggccuuucuccaucccaaguuaccauguucccccacaucaucgucgacguacgucaacuagaaccaguccucauaccccuucccgacguacgcaacaacuucuaccacuacaaccaauccaacgacuccaccauaaaacuuaucgccaugcucuacacaccccugagagcaaacaacgccggcgacgacgucuucaccgucuccugccguguccucacccgaccgucacccgacuucgacuucauuuuccucgugcccccaaccgucgagucccgcaccaaaccauucagcgugcccauacucacaguagaagagaugaccaacagucgauucccuaucccccuagaaaaacuauuuacaggccccucuagcgcauucguaguacaaccccaaaacggacgcugcacuaccgacggcguccuccuaggcaccacccaacuuuccccuguaaauaucugcacauuccgcggcgacguuacacacaucgccggcacccaaaacuacaccaugaaucuagccucacaaaauuggaacaacuacgaccccacagaagaaaucccugcaccccucggcacccccgacuucgucggcaaaauccaaggaguucucacacaaacaacacgccgagacggguccacccgcggccacaaggccacggucuccaccggcuccguccacuucacaccuaaacucggauccguccaauucucaaccgacacaucuaacgacuucgaaaccggucaaaacacccguuucacccccgucggcgucguacaagacggcagcaccacucaucaaaacgaaccccaacaauggguccuucccaacuacuccggacgcgacagccacaacguacauuuagcccccgccguagcccccacuuuccccggagaacagcuacuauucuuucgcuccacaaugcccggcugcuccggauacccaaacaugaaccucgacugucuccucccccaagaauggguucaacacuucuaucaagaauccgcccccgcccaauccgaugucgccuuacuccgauucgucaacccagacacgggacgaguccucuucgaaugcgaacuucacaaaucaggcuaugucaccguagcccacacaggacaacacgaccucguaauacccccgaacggcuacuuccgcuucgacucaugggucaaccaauucuacacccuagcccccaugggcaacggagcuggacgccgccgcgcccuuuaa

SEQ ID NO: 35613 - RNA, 1623 nt, Artificial Sequence
  derived and/or modified sequence opt11 from capsid_protein_VP1__Norovirus__BAI49911
augaaaauggccuccaacgacgccucucccucagacggguccaccgccaacuuagucccggaagucaacaacgaagucauggcccucgaaccagucguuggagccgccaucgcagcccccguagcaggccaacagaaugucauagaccccuggauccgcaacaacuucguccaagcacccggcggagaauuuacaguguccccacgcaacgcacccggcgaaauacucugguccgcaccccucggcccagaccucaaccccuaccucucccaucucgcccgcauguacaacggcuacgccggagguuucgaaguccaagucauccucgccggcaacgccuucacagccggcaaaauaaucuucgccgccgucccaccaaacuuccccaccgaaggucuaucaccaucccaagucaccauguucccccacaucaucgucgacguccgccaacuagaacccguacuaaucccccuaccugacgucagaaacaacuucuaccacuauaaccaauccaacgacucaacaauuaaacucauagccaugcuauacacaccccuccgagccaacaacgccggagacgacgucuucaccgucagcugccguguccucacccgcccaagccccgacuuugacuucaucuuccuagucccacccacaguagaaucucguaccaaacccuucacaguacccauacucacaguagaagaaaugaccaacucccgauuucccauaccccucgaaaaacuauucaccggccccagcuccgcauucgucguccaaccacaaaauggccgcuguaccaccgacggcguccugcucgguaccacucaacuaucccccgugaacaucugcaccuuucgaggcgacgucacacacauaccugguaccagaaccuaccgcaugaaccucgcaucccaaaacuggaacaacuacgaccccaccgaagaaauacccgccccucucggcacccccgacuucguugggaaaauacaaggcaugcucacccagaccacccguggugauggccucacccgaggccacaaggccacagucuccacuggcucagucgacuucacacccaaacuaggcuccguccaauucgcaaccgacacagacaacgacuucgaaacaggccaaaacacccgcuucacuccagucggcguaauacaagacggcagcucggcccaccgcaacgaaccacaacaauggguccuuccugacuacuccggacgaaccguccacaacguccaucucgcacccgcagucgcccccacauuccccggcgaacaacuccuauucuuccgcuccacaaugcccggaugcuccggcuacccaaacauggaccucgacugccuccuaccccaagaauggguccaacacuucuaucaagaagccgcaccagcccaauccgacgucgcccuccuccgcuucguagacccagacacaggccgcguacuauucgaaugcaaacuacauaaaacaggcuacguaaccgucgcacacacaggccaacacgacuuagucauaccacccaacggauacuuccgauucgacuccugggucaaccaauucuacacccucgcacccaugggcaacggcgcaggccgacgccgcgcccuuuaa

SEQ ID NO: 35614 - RNA, 1623 nt, Artificial Sequence
  derived and/or modified sequence opt11 from capsid_protein_VP1__Norovirus__BAI49912
augaaaauggccuccaacgacgccucacccuccgacggcuccacugcaaaccucgucccagaagucaacaaugaagucauggcucucgaacccguagugggcgcugccaucgcagcccccguagccggccaacaaaacgucaucgaucccuggauccggaacaacuucguccaagccccuggcggcgaguucaccguuagcccccgaaacgcccccggagaaauccuuugguccgccccacuaggccccgaccucaacccauaccucucccaucuagcucgaauguacaacggcuacgccggcggcuucgaaguccaagucauccucgccggcaaugccuucaccgcaggcaaaaucaucuuugccgccguucccccaaacuuccccacugaaggccuauccccaucccaagucaccauguucccccacaucaucgucgacguccgacaacucgaacccguccuuaucccccuccccgacguccguaauaacuucuaccauuacaaccaauccaacgacucuaccauuaaacuaaucgccaugcuauacacccccuugagagccaacaacgcaggcgaugacgucuucaccguaucuugccgcguucucacccgcccauccccagacuucgacuucaucuuucucgucccucccaccguagaaucccggaccaaacccuucaccgucccaauacuuaccguagaagaaaugaccaauucacgcuuccccaucccccucgaaaaacucuucacuggccccuccucagcauucgugguacaaccacaaaacggucgcugcaccaccgacggcgugcuacucggcaccacucaauuaucaccaguaaacaucugcaccuuccgaggcgacguuacacauauacccggcacccgcaccuaccggaugaaccucgcaagccaaaacuggaacaacuaugacccaaccgaagaaaucccagcuccacucggcaccccagacuucgucggucgcauccaaggaaugcuuacacaaaccacaaaaggagacggaucuacacguggacacaaagcuaccguuagcaccggcuccguagacuucacccccaaacucggauccguucaauucgcaaccgacaccgauaaugacuucgaaaccggacaaaauacccguuucacacccgucggcgugauccaagacggauccagcgcccuacgcaacgaaccccaacaguggguccuaccagacuacuccggaagaaccguccacaacguacaccuagcacccgccgucgcacucaccuucccuggagaacaacuucuuuucuuccgaucuacaaugcccggcuguuccggcuacccuaacauggaucuugauugucuccucccccaagaauggguacaacacuucuaccaagaagccgcccccucccaguccgacgucgcccuccuccgauucguuaaccccgacacuggcagaguucucuucgaaugcaaacuccaccgcgccggcuacgucaccgucgcacacacaggccaacacgaccucgucauacccccaaauggauacuuccgcuucgacucauggguaaaccaauucuacacucucgcacccauggguaacggcgccggccgccgacgcgcccucuaa

SEQ ID NO: 35615 - RNA, 1623 nt, Artificial Sequence
  derived and/or modified sequence opt11 from capsid_protein_VP1__Norovirus__BAI49914
augaaaauggccucaaacgacgccucccccucagacggcucaaccgccaaccuuguaccugaagucaacaacgaaguaauggcacucgaacccgucgucggagcagcaauagcagcccccguugccggacagcaaaacgucaucgacccauggauccgcaauaacuucguccaagccccagguggcgaauuuaccguaucaccccgcaacgcccccggagaaauccucugguccgcuccccugggacccgaccuaaauccauaccuaucccaccucgcccgaauguacaacggcuacgccggcgguuucgaaguccaaguaauccuagccggcaacgcauucacggccgguaaaaucaucuucgccgccguaccucccaauuuccccacagaaggccucucccccucccaaguaaccauguucccccacauaaucguagacguccgccaacucgaaccaguccucaucccccuccccgacguccgcaacaauuucuaccacuauaaccaauccaacgacagcaccaucaaacucauagcaaugcucuacacaccccuccgcgccaacaaugcaggagacgacguguucaccgucuccugucgcguccuaacccgccccucccccgacuucgacuucauauuccuaguaccucccaccguugaaucccgcaccaaacccuucaccguacccauccucaccguagaagaaaugaccaacucuagauuccccaucccacuagaaaaacuuuucaccggccccagcuccgccuucgucguccagccccagaacggccgcugcaccaccgauggcguccuucucggcacaacacaauuaucuccuguaaacaucuguacauuccgcggagacgucacccacauccccggcacccgcacuuaccgcaugaaucucgccucccaaaacuggaacaacuacgaucccaccgaagaaauccccgcaccccucggcacaccagacuucgucggcaaaauccagggaaugcucacccagacuaccaaaggcgacggcucaacccggggccacaaagccaccgucuccaccggauccgucgauuucacacccaaacuaggcuccguccaauucgccaccgacacagacaaugauuucgaaaccggacaaaacacccgcuucacaccagugggagucauacaagacggaucauccacacaucgcaacgaaccacaacaauggguacucccugacuauucaggccgcaccguccacaacguccaccucgcccccgccguagcgcccaccuuccccggugaacaacuccucuucuuccggucuaccaugcccggcugcuccggcuacccaaacauggaccucgacugccuacucccccaagaauggguacaacacuucuaccaagaagcagcccccucccaauccgacgucgcccuacuccgauucguaaauccagauacgggccggguccuauucgaaugcaaacuucacaaagccggcuacgucacaguagcucacacaggacaacacgaccucgucauacccccaaacggcuacuuccgcuucgacuccuggguuaaccaauucuacacccuggccccaauggguaacggcgccggucgccgacgagcucucuaa

SEQ ID NO: 35616 - RNA, 1623 nt, Artificial Sequence
  derived and/or modified sequence opt11 from capsid_protein_VP1__Norovirus__BAI49916
augaagauggcauccaacgacgccaacccaucugacggguccgccgcgaaccucguaccagaagucaacaacgaagucauggcccucgaacccgucguaggagccgcaaucgcugcaccagucgccggccaacaaaacgucaucgacccauggauccgaaauaacuucguccaagcaccaggaggcgaguucaccguaucaccccgcaacgcaccaggcgaaauccucugguccgcaccccucggacccgaccuaaacccauaccuaucccaccuugcccgcauguacaacggcuacgccggcgguuucgaaguccaagucaucuuagccggcaacgccuucaccgcgggcaaaaucaucuucgcagcagucccacccaacuuccccacugaaggccucucucccucccaagucacuauguucccccacaucaucguagaugugcgucagcuagaaccaguacucaucccccuuccagauguccgcaacaacuucuaccauuacaaccaaucaaacgacucaaccaucaaacucauagcuaugcuauacacaccauuacgcgcuaacaacgccggcgaagacguauucaccguauccugucgcguccucacacgccccuccccagacuucgacuuuaucuuccuugucccacccaccguagaaagccgcaccaagcccuucacgguccccauccucaccgucgaagaaaugaccaauucccgcuuccccaucccccuagaaaaacucuuuaccggaccguccggggccuucguuguacaaccacaaaacggucgaugcaccaccgacggcguccuauuaggcaccacccaacucagcccaguaaauaucugcaccuuccgcggcgacguaacccacaucgcaggcucccgcaacuacaccaugaaccucgcaucacuaaacuggaacaauuaugacccaacagaagaaauccccgcaccccucggcacaccagacuucgucggcaaaauacaaggccuucucacgcagaccaccaaaggcgacggcuccacccgcggccacaaagcaaccguauacacaggcagcgccccuuucacccccaaacuuggcgguguccaauucuccaccgacacagaaaacgauuucgaaacccaccaaaacacaaaauucacccccgucggcguuauacaagacggauccacuacccaccgaaacgaaccccagcaauggguacuaccauccuacucaggacgaaacguccacaauguccaccuagcccccgccgucgcccccaccuucccaggagaacaacuccuauucuucagauccaccaugcccggauguuccggauaccccaauauggaccucgacugccuccucccccaagaauggguccaacacuucuaucaagaagcagcccccgcacaauccgacgucgcccuacuacgauucgucaacccagacacaggccgaguccucuucgaaugcaaacuccacaaaucaggcuacgucacugucgcccacaccggccaacacgaccucgugaucccacccaacggcuauuuucgcuucgacucaugggucaaccaauucuacacacucgcacccaugggaaacggcaccggacgacgccgcgcccuauaa

SEQ ID NO: 35617 - RNA, 1623 nt, Artificial Sequence
  derived and/or modified sequence opt11 from capsid_protein_VP1__Norovirus__BAI49917
augaagauggccucaaacgaugcuaaccccuccgacggcuccgccgccaaccucguccccgaagucaacaacgaggucauggcccuagagccugucgucggagccgcaaucgccgccccagucgccggccaacaaaacgucaucgaccccuggauacgcaacaacuucguacaagcccccggcggugaguucacuguaucaccccguaacgccccaggagaaauucuaugguccgccccacuaggucccgaccuaaacccauaccucucccaccucgcccgcauguacaacggauacgcgggcgguuucgaaguacaagucauacucgcgggcaacgccuucaccgccggcaaaaucauauucgcagcagucccacccaacuuccccacagaaggacucucccccucccagguuaccauguucccccacauaaucgucgacguccgacaacucgaaccaguccuaauaccccuaccagacguccgcaacaacuucuaccacuacaaccagucuaacgacuccacaaucaaacucaucgccaugcucuacacuccccuccgcgccaacaacgcaggcgaagacguauucaccguauccugccgcguccucacacguccaucacccgacuucgacuuuaucuuccuuguucccccuaccgucgagagccgcaccaaacccuucacaguacccauccugacaguugaagaagucacaaauucaagauuccccaucccccuagaaaaacuauuuaccggccccucaggcgcuuucgucguccagccccaaaacggucgaugcacuaccgacggaguucuacuaggcaccacccaacucucccccgucaacaucugcacauuccgcggugacgucacccacauagccggcacacggaauuacaccaugaaccucgccucccucaacuggaacaacuacgaccccaccgaagaaauccccgcuccccucggcacccccgacuuugucggcaaaauccaaggcguccucacacaaaccaccaaaggcgacggcuccacccgaggacauaaagccacgguauacaccgguucagcaccauuuacccccaaacucggcuccguccaguucuccacagacaccgaaaacgacuucgaaacacaccaaaacacaaaauucaccccuguuggcgucauucaggacgguggaacuacccaucgaaacgaaccccaacaauggguccuccccagcuacuccggacgaaacguccacaacguccacuuagccccagccgucgccccaaccuuccccggggaacaacuacucuucuuccgauccacaaugccaggaugcucaggcuacccaaacauggaucucgacugccuccucccccaagaauggguccaacacuucuaccaagaagcagcccccgcccaaucugacgucgcacucaugcgauucguaaacccggacaccggccgcguacucuucgaaugcaaacuucacaaauccggcuacgucacagucgcccacaccggccaacacgaccucgucauacccccuaacggcuacuuccgcuucgacuccugggucaaccaauucuacacgcuagcgcccaugggcaacggcacaggacgccgacgcgcccuauaa

SEQ ID NO: 35618 - RNA, 1623 nt, Artificial Sequence
  derived and/or modified sequence opt11 from capsid_protein_VP1__Norovirus__BAI49918
augaaaauggcaucaaacgacgccaacccauccgacggcuccgcagccaaccuaguccccgaaguaaacaacgaagucauggcacucgaacccgucgccggcgccgccauagccgcacccgucgcaggccaacaaaacguaauagaccccuggauccgcaacaacuucguacaagcacccggcggcgaguucacaguauccccacgcaacgcuccgggugaaauccuguggucagcaccgcucggccccgaccuaaaccccuaccuuucacaccuagcccguauguauaacggcuaugccggcggcuucgaaguacaagucauccucgccggcaacgccuucaccgccggaaaaauaauauuugcagccguaccacccaacuuccccaccgaaggccuaucccccucccaagucaccauguucccccacauaaucgucgacguccgccaacuagaacccgugcucauuccccuaccugacguccgcaacaacuucuaccacuacaaccaaucgaacgacucuacgaucaaacuaaucgcaaugcucuauaccccacuccgagcaaacaacgccggugaagacguauucaccguauccugccgcgucuuaacccgucccucccccgauuucgacuucaucuuccuugucccacccaccguagaaagccgcaccaaacccuucacaguccccauccucaccgucgaagaaaugacuaacuccagauucccuaucccccuagaaaagcuauucaccggcccuucgggcgccuucgucguccaaccacaaaacggcagaugcacaaccgacggcguccuccuaggaaccacacaacuuuccccagucaacauauguaccuuccgcggugaugucacccacauagcaggaacccgcaacuauaccaugaaccuagccucacucaacuggaacaacuacgaccccacagaagaaauccccgcaccccucggaacucccgacuuugucggcaaaauccaaggcguccucacccaaaccacaaaaggagacggaucuacccgcggccacaaagccaccgucuauaccggcucggccccguucacuccgaaacucggcagcguccaauucagcacagacaccgaaaacgacuucgaaacccaccaaaacaccaaauucacccccgucggcgucauacaagauggcggcaccacacaccguaacgaaccccaacaauggguccucccaagcuauuccggccgcaauguccacaacguccaccucgcuccagccguugcccccaccuuccccggagaacaacuccucuucuucagauccaccaugcccggaugcuccggauaccccaacauggaccucgacugccuacucccccaagaauggguccaacacuuuuaucaagaagcugcucccgcccaguccgaugucgcccucaugagauucgucaacccugacaccggccgcguccuauucgaaugcaaacuccacaaauccggauacgucaccguagcccacaccggucaacacgaccuaguaauacccccaaacggcuacuuccgcuucgacuccugggucaaccaauucuacacccuagcccccaugggaaacgguacaggacgccgucgagcgcuuuaa

SEQ ID NO: 35619 - RNA, 1623 nt, Artificial Sequence
  derived and/or modified sequence opt11 from capsid_protein_VP1__Norovirus__BAI49919
augaaaauggccuccaacgacgccaaccccucagacggcuccgcagcuaauuuagucccagaagucaacaacgaaguaauggcacucgaacccgucgucggagccgccaucgcagcccccgucgccggacaacaaaacaucaucgaccccuggauacgaaacaacuucguccaagcccccggcggagaauuuaccgucucaccccgcaacgcccccggcgaaauacuguggagcgccccacuuggccccgaccuaaaucccuaccuaucacaccuagcucgaauguacaacggcuaugccggcggauucgaaguccaaguaauccucgcaggaaacgccuucaccgccggcaagaucaucuucgccgccgucccacccaacuuccccacagaaggccucucgcccucacaaguaaccauguuuccccauaucauaguugacguacgucagcuagaaccaguucuaaucccccuccccgacguuagaaauaacuucuaccacuacaaccaaagcaacgacucaaccauuaaacuaaucgccaugcucuacacaccccuacgcgccaacaacgccggcgaagacgucuucaccguauccugccgagugcuaacccgccccucccccgacuucgacuucaucuuccuagucccucccaccgucgagucacgcaccaaacccuucaccguccccaucuuaaccgucgaagaaaugaccaacucccgcuuuccaaucccacucgaaaaacucuucacaggccccuccggagccuucgucguacagccacaaaacggccgcugcaccacagauggaguccuacucggcaccacccagcuauccccaguaaacauauguaccuuccgcggagacgucacacacaucgcaggcacacgaaauuacaccaugaaccucgcuucacucaacuggaacaacuacgaccccaccgaagagaucccagcaccccuaggcacucccgacuucgucggcaaaauacaaggcguccuaacccaaacaaccaagggcgacgggucaacacgcggacauaaagccaccguuuacacgggaagcgcacccuucacacccaaacuuggcucaguccaguucuccaccgacacagaaaaugauuucgaaacucaccaaaacaccaaauucacacccgugggcguuauacaagacggaggcacaacacaccgcaacgaaccacaacaauggguucuccccuccuacucagguaggaacguacacaacguccaccucgccccggccguagcacccaccuuccccggcgaacaacuccuauucuuccgaucaacaaugccaggcugcuccggauaccccaauauggaccucgacugccuacucccccaagaauggguccaacacuucuaccaagaagccgcacccgcccaaucagacgucgcccuaaugcgcuucgucaacccagacaccggccgcguccucuucgaaugcaagcuccacaaauccggcuacgugacuguagcucacaccggccaacacgaccucgucauucccccgaacggauacuucagauucgacucauggguaaaccaauuuuacacccucgcgcccaugggaaacggcaccggacgccgcagagcccucuaa

SEQ ID NO: 35620 - RNA, 1623 nt, Artificial Sequence
  derived and/or modified sequence opt11 from capsid_protein_VP1__Norovirus__BAI49920
augaaaauggccaguaacgacgcuaaccccucagacggauccgccgccaaccuaguacccgaaguaaacaaugaagucauggcacucgaacccgucgucggcgccgcuaucgcagcccccguagcaggacaacaaaacgugaucgaccccuggauccgcaacaauuucguacaagcucccggcggcgaguucacagucucccccagaaacgccccuggagaaauucucuggucagcaccacuaggacccgaccucaaccccuaccuaucccaccuugcacgaauguacaacggcuacgccggcggauucgaaguccaggucauccucgccggaaacgccuucacagccggcaaaaucauuuucgcugccguucccccaaacuuccccacugaaggacuuucccccucccaaguaaccauguucccccacaucaucgucgacgugcgccaacucgaacccguccuaaucccccuucccgacguacgaaacaauuucuaccacuauaaccaacucaacgacuccaccaucaaacucaucgcaaugcuauacacuccccuacgugcaaacaacgccggcgaagacguauuuaccguaucuugccgcguccucacccgucccucccccgacuucgacuucaucuuccucguuccacccaccguagaaucacgcaccaaacccuucaccguccccauacuaacuguagaagaaaugacuaacucacgguuccccauaccacucgaaaaacucuucaccggacccuccggagccuucgucguccaaccacaaaaugggcguugcacaaccgacggcguucucuuaggcaccacccaacuuuccccgguaaacaucugcaccuuccgaggcgacgucacacauaucgccggcuccagaaauuacaccaugaaccucgcuucccuaaacuggaacaacuacgaccccaccgaagaaaucccugcaccccuaggcaccccaggcuucgucgguaaaauccaaggcguccucacccaaaccaccaaaggcgacggcuccacacgcggccauaaagccacagucuauaccggcucagcccccuucacucccaaacuaggcuccguccaauucucaacggacaccgaaaacgacuucgaaacccaccaaaacacaaaauucacccccgucgguguaauccaggacggcuccaccacccaucgcaacgaaccccaacaauggguccuucccagcuacuccggccgaaacguccacaacguacaccuggccccggccgucgcccccaccuucccuggagagcaacuacuuuucuuucgaucuaccaugcccggcugcucuggcuacccaaacauggaccucgacugccuacuaccgcaagaauggguacaacauuucuaccaagaagccgcacccgcccaauccgauguagcucugcuccgcuucguaaacccagacaccggacgaguacucuucgaaugcaaacuccauaaauccgguuacgucaccgucgcucacaccggccaacacgaccucguaaucccacccaacggcuacuuccgcuucgauuccuggguaaaccaauucuacacacucgcccccaugggcaacggcaccggucgccgccgcgcccucuga

SEQ ID NO: 35621 - RNA, 1623 nt, Artificial Sequence
  derived and/or modified sequence opt11 from capsid_protein_VP1__Norovirus__BAI49921
augaaaauggccuccuccgacgccaaccccuccgacggcagcgccgcaaaucucgucccugaaguaaacaacgaagucauggcccucgaacccguagucggcgccgccaucgcugccccaguagccggccagcaaaacgucauugauccauggauccgcaacaacuuuguccaagcccccggcggcgaguucacagucucaccccguaacgcacccggcgagauccuauggucagcuccccuaggccccgaccucaacccauacuuaucgcaccuagcccggauguacaacggauacgccggcgguuucgaaguccaagucauacuggccggaaacgccuucacggccggcaaaauuauauucgcugccguaccacccaacuuccccaccgaaggucucucucccucccaagucacuauguucccucacaucauaaucgacguacgccaacuagaaccaguccuaaucccccuccccgacguccgcaacaacuucuaccacuacaaccaaucaaacgacucaacaaucaaacuaaucgccaugcucuacacuccacuccgcgccaacaacgccggcgaagacgucuuuaccgucagcugccgcguccucacacgaccaucccucgacuuugacuucaucuuccucguaccucccacugucgaaucccgcacaaaacccuucacaguacccauccuaacaguagaagaaaugaccaacucccgauucccuaucccacucgaaaaacucuucaccggacccucaggcgccuucguaguccaaccacaaaacggacgcugcaccacugacggcguccuccucggcacaacccaacuaucucccgucaacaucugcacccuccgcggcgacgucacccacaucgccggcucccgcaauuacacaaugaaccuagcuucccuaaacuggaacaacuacgacccaaccgaagaaauccccgcaccccucggaacacccgacuucgucggcaagauccaagguguucucacccaaaccacaaaaggcgaugggagcacacgcggccacaaggccacagucuauaccggauccgccccuuucacacccaaacuaggcucgguccaauucucuaccgacaccgaaaacgacuucgaaacacaccagaacaccaaauuuacacccguuggagucauacaggacggcucaaccacccaccgcaaugaaccccaacaauggguucugcccuccuacagcggccgcaacguccacaacguccaccucgcccccgccgucgcccccaccuuccccggcgaacaacuacucuucuuccgcucuaccaugccaggcuguucaggcuaccccaacauggaucuagacugccuccucccucaagaauggguccaacacuucuaucaagaagccgccccagcccagucagacguagcccuucuccguuucgucaaccccgacaccggccgcguccucuucgaaugcaaacuccauaaaagcggcuacgucaccguagcccacaccggccaacacgaccucguaauacccccaaauggcuauuuccgguucgauagcuggguaaaccaauucuacacucucgcccccauggggaacggcaccggcagacgcagagcccucuag

SEQ ID NO: 35622 - RNA, 1623 nt, Artificial Sequence
  derived and/or modified sequence opt11 from capsid_protein_VP1__Norovirus__BAI49923
augaaaauggccucaaacgacgccaaccccuccgacggcucagcagccaaucucgucccugaaguuaacaacgaggucauggcccuugaaccagucguaggcgcagccaucgccgcccccgucgccggccaaaccaacgucaucgaccccuggauacguaauaacuucguccaagccccaggcggcgaauuuacagucucaccccgcaaugcaccaggcgaaauccuaugguccgcuccccucggucccgaccuaaacccauaucucucccaccuagcccgaauguauaacggauacgccggcggcuucgaaguucaagucauucuagcaggcaacgccuucaccgccggcaaaaucaucuucgccgcaguucccccuaacuucccaaccgaaggucucucacccucccaagucacuauguucccccacaucaucgucgauguccgucagcuagaacccguccucaucccacuccccgacguccgcaacaacuucuaccacuacaaccaaagcaacgacucuaccaucaaacucaucgccaugcucuauacgccccugcgcgcaaacaacgccggugaagacguuuucaccgucucuugccgaguccucacccgaccaucaccugacuucgacuucaucuuccuaguuccgcccacagucgaaucucgaacaaaacccuucacaguccccauccuaacggucgaagaaaugaccaacucgcgcuuccccaucccacuagaaaaacucuucaccgggcccaguggcgcauucgucguccaaccacaaaacggcagaugcaccaccgacgguguacuucucggcacaacccaacuauccccaguaaacauaugcaccuuccgaggagacguaacccacaucgccggaucccgcaacuacacgaugaaucucgcuucccuuaauuggaacaacuacgacccaaccgaagaaauccccgcaccccucggcaccccagacuucgucggcaaaauccaaggcguccucacccaaaccaccaaaggcgacggcuccacucgaggacacaaagccaccgucuacacagggucagcccccuuuacccccaaacucggcuccguccaguucucuacugacacggaaaacgacuucgaaacacaccaaaauaccaaauuuacccccgucggcguuauacaagauggcuccacaacacaccgcaacgaaccacaacaauggguacucccguccuacagcggccgaaacguccacaacguccaccucgcccccgcagucgcacccaccuuucccggcgaacaacuucuuuucuuccgcucaaccaugccuggauguucgggcuaccccaauauggaccucgacugccuucucccccaagaauggguacaacacuucuaccaagaagccgcucccgcccaaagcgacgucgcccuacuccgcuucgucaacccagacacaggccgcguccucuucgagugcaaacuccacaagagcggauacguaacuguggcccacacuggccaacacgaccuagucaucccaccuaacggauacuuccgcuucgacuccugggucaaccaauucuacacccuggcccccaugggcaacggcaccggccgccgccgggcccucuaa

SEQ ID NO: 35623 - RNA, 1623 nt, Artificial Sequence
  derived and/or modified sequence opt11 from capsid_protein_VP1__Norovirus__BAI49924
augaaaauggcaagcaaugaugccaaccccuccgacggaucagcggccaaccucguccccgaagucaacaaugaaguuauggcccuagaacccguagucggagcagccauugccgcccccguagcaggccaacaaaacgucauagaccccuggauccggaauaacuucguucaagcccccggaggcgaauuuacaguaucuccccgcaacgccccaggcgaaauacuuugguccgcaccccuaggccccgaccuuaaccccuaccucucccaccucgcucgcauguacaacggauacgccggcggauucgaaguccaaguaauccucgccggcaacgcauucaccgccggaaaaaucaucuucgccgcagucccgcccaacuucccaacggaaggacucuccccaucccaagucacaauguucccacacaucaucguagacguccgacaacucgaacccguccuaauaccccuuccagacguccgaaacaacuucuaccacuacaaccaauccaacgacucuaccauaaaacucaucgccauguuauacacuccccuccgcgccaacaacgcaggagaagacguauucaccgucagcugccgcguccucacccgccccucucccgacuucgacuucauauuccucguacccccuaccguugaaucccgcaccaagccauucaccguucccauccuaaccguggaagaaaugacaaacucacgauucccaaucccccucgaaaaacucuucacgggucccuccuccgcuuucgucguccaaccacaaaacggccgcugcacaaccgacggaguccuccuuggcaccacccaacucucccccgucaauaucugcaccuuccgcggggacguaacccacaucgccggcucccguaacuacaucaugaaccucgccucccucaacuggaacaacuacgaccccaccgaagaaauaccagcuccccucggcacccccgacuucgucggcaagauccaaggaguacuuacccaaaccaccaaaggagacggaaguacucgaggacacaaagccaccgucuacaccgguucagccccauucacccccaaauuaggauccguacaauucucaaccgacaccgaaaacgacuucgaaacccaucaaaacacccgcuucacaccagucggcguuauccaagacggaggcaccacacauagaaacgaaccacaacaauggguacuuccauccuacagcggacgcaauguccccaauguacaccucgcccccgccguagccccaaccuuccccggcgaacaacuccucuucuuccgcuccaccaugcccggaugcucaggcuacccaaacauggaccucgacugccuccucccccaagaauggguccaacacuucuaccaagaagcugccccugcacaauccgacgucgcccuacuccgcuucguaaaccccgacacagggcgcguccuauucgaaugcaaacuacacaaauccggcuacgugaccgucgcgcacaccggccaacacgaccucgucaucccucccaacggcuacuucagauucgacuccuggguaaaccaauucuacacccucgcucccaugggaaacggcaccggccgccgcagaguccuauaa

SEQ ID NO: 35624 - RNA, 1623 nt, Artificial Sequence
  derived and/or modified sequence opt11 from capsid_protein_VP1__Norovirus__BAI49925
augaagauggcuagcaacgacgccaaccccagcgacggaucagcagccaaccucguacccgaaguaaacaacgaagucauggcccuagagcccguagucggcgccgccaucgcagccccagucgccggacaacaaaacgucaucgacccauggauccgcaacaacuucguccaagcccccggcggcgaguucaccguaagcccacgcuccgcacccggcgaaauccucugguccgcaccccucggccccgaccucaacccauaccuaucacaccuagcacgcauguacaacggauacgccggcgguuucgaaguacaagucauacuagccgguaacgccuucacagccggcaagaucaucuucgccgcagucccacccaacuuccccaccgaaggccuaucgcccagccaagucaccauguucccccacauaaucgucgacguccgacagcucgaacccguacucauaccacuacccgacguacgcaacaacuucuaccauuacaaccaaucuaacgacucuaccaucaaacucaucgcaaugcucuauaccccacuccgcgccaacaacgccggugaagacguuuucacagucucaugcaggguccucacccgcccaucaccagauuucgacuucauauuucucgucccuccaaccgucgaaucccgcacaaagcccuucacgguccccauucuuaccguugaagaaaugaccaauucacgauuccccauaccccuagaaaaacuauucacaggccccuccuccgcauuuguuguccagccacaaaacggccgcugcaccaccgacggcguccuucuaggcaccacccaacuaucccccgucaacaucugcaccuuccgcggagacguaacucacauugcuggcucccgaaauuacaccaugaaccucgcuucucucaacuggaacaacuacgauccaacagaagaaaucccagccccacucggcaccccagacuucguaggaaaaauucaaggcgucuuaacacaaaccaccaaaggcgacggcucaacacgcggccacaaagccacaguauacaccggauccgcacccuucaccccaaaacucggcucaguccaauucuccacagacaccgaaaacgacuucgaaacacaccaaaacacacgcuucacccccgucggcgucauacaagacggcggaaccacccaccgcaacgagccccaacaauggguccuccccucauacuccggucggaacguccccaacguacaccucgcccccgccgucgcaccgacauuccccggcgaacaacuccuguucuuccgauccaccaugcccggaugcuccggcuaccccaacauggaccucgacugccuacuaccccaagaauggguacaacacuucuaucaagaagccgcacccgcccaauccgacguagcccuccuccgauucgucaacccugacacuggcagaguacuauucgaaugcaaacuucacaaaucuggauacgucaccguagcucacaccggccaacacgaccuaguaaucccacccaacggcuacuucagauucgacucaugggucaaccaauuuuauacccucgcucccaugggaaacgguacaggcagacgccgaguccucuaa

SEQ ID NO: 35625 - RNA, 1623 nt, Artificial Sequence
  derived and/or modified sequence opt11 from capsid_protein_VP1__Norovirus__BAI49926
augaaaauggccuccaacgacgccaaccccuccgacggcucugccgcaaaccucgucccugaagucaacaacgaaguaauggcccucgaacccgucguaggcgccgcaauugccgccccuguagcuggccaacaaaacgugaucgacccauggauacgcaacaacuucguccaggccccaggcggcgaguucaccguaucaccucgaaacgcccccggcgaaauacucugguccgcaccucuaggccccgaccucaaucccuaccucucccaccucgcccgaauguacaacggauacgcgggcggauucgaaguccaagucauccucgccggaaacgccuucacagcaggcaaaauaaucuucgccgcagucccacccaacuuccccaccgaaggacugucccccucccaaguaaccauguucccccacaucaucguugacguccggcaacucgaacccguccucauaccacuccccgacguacgcaacaacuucuaccauuacaaccaauccaacgacucaaccaucaaacuuauagcaaugcucuacacuccccugcgggccaacaacgcgggcgaagacgucuucaccguuucaugccgaguucucacccgccccuccccagacuucgacuucaucuuccucguaccacccaccgucgaaucacgcaccaagcccuucacaguacccauucucaccguugaagaaaugaccaacucccgcuuccccauaccuuuagaaaaacucuucaccggaccauccggcgccuucguaguacagccccaaaauggccguugcacaacagacggcguacuacucgguacuacccaacucucccccgucaacaucugcacuuuccgcggcgacguaacccacaucgcuggaagccgcaacuacacaaugaaccucacaucccucaacuggaacaacuacgaccccacagaagaaauacccgcuccccucggcacaccagacuucguaggcaaaauacaaggucuacucacccaaaccacaaaaggugacggcucaacccgaggccacaaagccaccgucuacacaggcucagcacccuuuacaccuaaacuaggcucuguacaauuuagcaccgauaccgaaaacgacuucgaaacacaccaaaacacgaaauucacacccguuggcgucauacaagacgggagcaccacccacagaaacgagccccagcaauggguccuacccagcuacuccggaauaaacgugcacaacguccaccucgcccccgcugucgcccccaccuuccccggcgaacaacuccucuucuuccgcuccaccaugcccggauguucaggauacccaaacauggaucuugacugccuacuaccacaagaauggguacaacacuucuaccaagaagccgccccugcacaaucagacgucgcccuccuucgcuucguaaacccagauaccggacgcguccucuucgaaugcaaacuacauaaauccggcuacgucaccgucgcccacaccggacaacacgaccuaguaaucccaccuaacggcuacuuccguuucgacuccuggguaaaccaauucuacacccuagcacccaugggaaacggaaccggccgucgccgcgccuuauaa

SEQ ID NO: 35626 - RNA, 1623 nt, Artificial Sequence
  derived and/or modified sequence opt11 from capsid_protein_VP1__Norovirus__BAI49927
augaaaauggcaucaaacgacgccaaccccuccgaugguuccgcagccaaccuagucccagaaguaaacaacgaagucauggcccucgaaccaguggucggcgcagccaucgccgcccccgucgccggccagaccaacgucaucgaccccuggauccgcaacaacuucguacaagcccccggaggagaguucacaguaucccccaggaacgcuccaggagaaauacucuggucagcaccccucggccccgaccuaaaucccuaccucucucaccuugcccgcauguauaacggauacgcaggcggcuucgaaguccagguaauccucgcuggcaacgcauucaccgcaggcaaaaucaucuucgccgcaguaccacccaacuuccccaccgaaggccucagccccucccaaguaaccauguucccccacaucauuguagacguccgccaacucgaacccguacucauaccacuucccgaugugcguaauaacuucuaccacuacaaucaauccaacgauuccaccaucaaacuaaucgccauguuauauacaccccuaagagccaacaacgccggcgaagacguauucacaguaucgugccgaguccucaccagacccucucccgauuucgacuucaucuuccucguaccacccacagucgaaucacgaaccaaacccuuuacaguccccauccuaacaguagaagaaaugaccaacagccgcuuccccauaccccucgaaaaacuuuuuaccggaccaucaggagccuucgucguccaaccgcaaaacggccgaugcaccaccgacggcgugcuccucggaaccacucaacucucaccagucaauauauguacauuccgcggagacgucacucacaucgccggcagucgcaauuacacuaugaaccucgcaucacucaacuggaacaacuacgacccaaccgaagaaauccccgcaccccuaggaacaccugacuucguaggaaaaauccaaggcguccuaacacaaaccaccaaaggcgacggcagcacccgcggacacaaagccaccgucuacaccggcuccgccccuuucacccccaaacucggauccguccaauucuccaccgacaccgaaaacgacuucgaaacccaccagaacacaaaauuuacaccagucggcgucauacaagauggcggcaccacacaccgaaacgagccacaacaauggguccuucccuccuacuccggccgcaacguacacaacguucaccucgcccccgcugucgcccccacauuccccggcgaacaacuccuauucuuccguuccacaaugcccggcugcucgggcuaccccaacauggaccucgacugccuccuaccacaagaauggguccaacacuucuaccaagaagccgcucccgcccaaagcgacgucgcgcuccuccgauucguuaaccccgacaccggucgcguacucuucgaaugcaaacuacacaaauccggauaugucaccguagcccacaccggucaacacgaccucguaauaccacccaacgguuacuuccgcuucgauuccuggguaaaccaauucuacacccucgcccccaugggcaauggcacgggccgccgacgcgcccucuaa

SEQ ID NO: 35627 - RNA, 1623 nt, Artificial Sequence
  derived and/or modified sequence opt11 from capsid_protein_VP1__Norovirus__BAI49928
augaaaauggccuccaacgaugccaaccccagcgacggaucagcagccaaccucgucccagaagucaacaacgaaguaauggcccucgaacccgucguaggcgcagcuaucgcagcccccgucgcaggacagacgaacgucauagaccccuggauccguaacaacuucguacaagccccaggcggcgaguucaccguuagcccaagaaacgcacccggcgaaauccuauggucagcaccccucggcccagaccuaaacccauaccucagccaccuagcccgaauguacaacggcuacgcaggcggcuucgaaguccaaguaaucuuagccggcaacgcuuucacagccggcaaaauuauauucgccgccguaccacccaacuuucccacagaaggccuaucccccucacaagucacaauguucccccacaucaucgucgacguacgacagcucgaaccaguccuaauacccuuacccgacgucagaaacaacuuuuaccacuacaaccaaucaaacgacucuaccauaaaacucaucgccaugcucuacacaccccuucgcgcuaacaacgccggagaagacgucuucaccguguccugccgcguccucacccgaccaucacccgacuucgacuucaucuuccuaguacccccaaccguagaaucccgcaccaaaccauucacaguacccaucuuaaccgucgaagaaaugacaaacucccgcuuccucaucccccucgaaaaacucuucacaggaccaucaggcgccuucgucguccaaccccaaaacggaagaugcacaacugacggcgucuuacuugguaccacccaacucucccccgucaacaucugcacauuccgcggagacgucacacauaucgcgggcucacgcaacuacacaaugaaccuagcaucccucaacuggaacaacuacgauccaacagaagaaauccccgcaccccuaggcacccccgauuucgucggaaaaauccaagguguacuuacccaaaccaccaaaggcgacggcucaacccgcggccacaaagccaccgucuauaccggauccgcccccuucacacccaaacucggcucaguucaauucucaacugacacagagaacgacuucgaaacccaccaaaacacaaaguucaccccaguaggaguaauacaagacggcucaaccacccaccgcaacgaaccccaacaauggguucuccccucuuacuccggccgcaacguccacaauguccaccuagcccccgccgucgcacccaccuuccccggcgaacaacuccucuucuucagauccaccaugccaggaugcuccggauaccccaacauggaccucgacugccuacucccacaagaauggguacaacacuuuuaccaagaggccgcccccgcccaaucagacguugcccuccuccgauucgucaaccccgacaccggacgcguacuauucgaaugcaagcuccacaaaucuggcuacgucacgguagcccacacuggccagcacgaccucgucauuccuccaaacggcuacuuccgcuucgacucaugggucaaccaauucuacacccuagcaccuaugggcaacggcaccggaagacgccgagcccucuaa

SEQ ID NO: 35628 - RNA, 1620 nt, Artificial Sequence
  derived and/or modified sequence opt11 from capsid_protein_VP1__Norovirus__BAJ25070
augaagauggcauccucggacgcagccccuucaaacgacggugccaccggacuuguccccgaaaucaacacagaaacccuaccacuagaaccagucgccggugccgcaauagccgccccagucacuggccagaacaacaucaucgacccauggauccgcaacaacuucguacaagcacccaauggcgaauuuacugucuccccacgcaacucccccggugaaauccucaugaaccucgaacucggccccgaccuuaaccccuaccucgcccaccucagccgaauguacaacggauacgccggaggcguagaaguacaaguacuacuagccggcaacgccuucaccgccggaaaaauucucuucgccgccgucccacccaacuuccccguagacaugcucuccccagcccaaauaaccaugcucccccaccuuaucguagacguucgcacacuugaacccauaaugauaccccuccccgacguccgcaacgucuucuaccacuauaauaaccaacccgccccaagaaugcgccucgucgccaugcucuacaccccucuacgauccaacggaucuggagaagacguuuucacagucuccugcagaguccuaacacgcccaacccccgacuucgaauuuaccuaccucgucccaccauccgucgaaucgaaaaccaaaccauucucacuccccauacuaaccauaggcgaacucaccaacuccagauuccccgccccaaucgaucaacucuucacauccacgaacaacgacguaguaguccagccccaaaacggccgcugcacccucgacggcgaacuccaaggcaccacccaacuccucucgacagcaaucugcagcuaccgcggcaccaccuccaacccgaucgacgacugggacgaccacuuacuacaccucacccaccccaacggcgccaccuacgacccaaccgaagauguacccgccccuuucggaacucaagacuuccaaggcauacucuacggcaugcucacgcaaaacccucaaaccggcggcggugaagcagccaacucacgcggugucuauauauccuccacaucagacaaauucacccccaaacuaggcaccaucggcuugcaccacguccaaggaggcgacgucgcaaacaaucaaaagucaaaguucacacccauaggaauagcugaaaacgggaacacuccuuuccgccaauggguccucccaaacuacucaggccgccucacccuaaacacgaaccuagcuccagcaguaggccccaauuuccccggcgaacaaauccucuucuuccguagcaacguccccuccguucagggcggccacucaauagaaauagacugccuuauaccacaggaauggaucucccacuucuaccaagaaucagcccccucacaauccgacgucgcccuuauacgcuaugucaacccagacaccggacgcacccuauucgaagccaaacuccaccgacaaggcuucaucaccaucgccaccaccggcaacaaccccguagucgucccacccaacggcuacuuccgcuucgacaguugggucaaucaauucuacgcccucgcacccaugggaaccggaaacggccgccgccgcguacaauaa

SEQ ID NO: 35629 - RNA, 1620 nt, Artificial Sequence
  derived and/or modified sequence opt11 from capsid_protein_VP1__Norovirus__BAJ25072
augaaaauggccucaaacgacgcugcccccuccaacgauggugcaaccggccuaguccccgaaaucaacaccgaaacccucccccucgaaccagucgccggagcagccauagcagcaccuguaacuggccaaaacaauauaaucgacccuuggauccgcaccaacuucguacaagcacccaacggcgaguucaccgucucuccacgcaacucccccggcgaaauccuaaugaaucuugaacuaggccccgauuuaaacccguaccuagcccaccuagccagaauguacaacggcuacgccggaggaguggaaguccaaguccuccuagccggcaacgccuucaccgccggcaaaauccuauucgccgcaguacccccaaacuuucccgucgacaugcucucaccagcacaaauaaccaugcucccacaccucaucgucgacguccgcacauuagaacccaucaugaucccccuaccagauguacgcaaugucuucuaccacuacaacaaccaacccgcgccacgcaugcgccuggucgcaaugcucuacacuccccuaagauccaacggcuccggagaagacgucuucaccgucuccugccgcguccuaacccgucccacccccgacuucgaguucaccuaccuagugccucccucuguugaauccaaaaccaaacccuucucccuucccauccuaaccauaggcgaacucaccaacucccgauuccccgcuccaaucgaccaacucuucaccuccaccaacaacgacgucguaguucaaccacaaaacggccgcugcacccucgacggcgaacuacaaggaacaacacaacuccuguccaccgccgucugcucuuaccgaggcaccacauccaaccccauagacgacugggacgaucaccuccuacacuuaacacaccccaacggcgcuacauacgacccaaccgaagacguccccgcccccuucgggacccaggauuuccaaggaauccuauacggaaugcucacgcaaaacccccaagccggcggcggcgaagcggcaucaucccgcgguguauauaucucuuccaccuccgacaaauucacccccaaacuuggaaccauuggccuccaucgaguacaaggcggcgcgguagcagacaaccaaaaauccaaauuuaccccuaucggaaucgccgaaaacgacaacacucccuuucgccaauggguacuccccaacuacuccggacgacucacacucaacacaaaccuagcaccagcugucggacccaacuuccccggagaacaaauccuauucuuccgcuccaacgucccaagcguccaaggcggacacucaaucgaaaucgacugccucaucccccaagaauggguaucccacuucuaccaagaauccgcuccaucacaaucugaugucgcccuaauaagauacguaaaccccgacacaggacgaacccucuucgaagcaaaacuacaccgccaaggauucaucaccauagcaaccaccggaaacaaccccgucgucgucccacccaacggcuacuuccgauucgacuccugggucaaccaauucuacgcgcucgcacccaugggcaccggcaacggccgccgacgcguccaauaa

SEQ ID NO: 35630 - RNA, 1608 nt, Artificial Sequence
  derived and/or modified sequence opt11 from capsid_protein_VP1__Norovirus__BAJ25076
augaaaauggccucuaaugacgccaaccccuccuccgauggcuccgccaaccucguccccgaaaucuccaacgaagucauggcucuugaacccgucgccggcgccgccaucgcugcacccguagccgggcaacaaaacaucaucgaccccuggauccgcaacaacuucguccaagccccaggcggcgaauuuacaguauccccuagaaacgcccccggggaaguccuccucaaccuaccacucuccccagacauaaacccauaccuugcccaucucucccgaauguacaacgguuaugccggaggagucgaagucgaagucgucuuagccggcaacgccuucacugccggaaaaaucauauucgccgccguucccccaaacuuucccccagaaaaccucuccccgucccaaaucacaaugcucccacacaucaucgucgauguccgacaacucgaacccguucgaaucccccucccagacguccgcaacaacuucuaccacuacucucgggaaaacgauucaacccuacgucucaucgccaugcucuacacgccccuccgcgccaacaacgcuggcgacgacguauucaccgucuccugccgcguccucacccguccuagccccgacuuugacuucauauuccuagucccaccgacagucgaaucaaaauccaaacccuucaccaucccaaugcuaaccaucgaagaaaugaccaacucacgcuuccccgcaccccuagaacucaugacaaccggcccuucccacgacauaguaguccaaccccaaaacggccguugcacaauagacggcguacuccugggcaccacacaacuaucccccgucaacaucugcucccuccgcggcguccccaccaaacgcacaaacggcaacgacaacugcuucguccaacuagaaaacccaaacggcucugccuacgaccccaccgaagacaucccagccguauuaggaucccccgacuucgucggcgaacuuuauggaacuauaacacaacgcuccucagacaacucaacccgcgcccaccccuuuacccuaaacaccggcagcccucgauacacacccaaaauaggcuccguagauauccguguaaccgaugucucagaccuacaagaccacgaccccgucaaacucaccccuguaggccuauccggcgaccgcggaucuauccaccaauggcagcuaccaaacuacucaggcgucgccacucacaauaugcaccuagcccccucugucgccccacucuucccaggagaacagauccucuucuuucgcuccaccgucccaggaugcggaggcuacccaaacuccaacaucgacugccucaucccccaggaauggguccaacacuucuaccaagaaggagcacccgcucgcacagacguagcccuccuacgcuuuauuaaccccgacacaggcagaguccuauucgaaugcaaacuccacaaacacggcuucaucaccgucgcauacuccggcaaccacgaccucgucaugccacccaacggauacuuccguuucgaaagcugggucaaccaauuccauacccucgcacccaugggaaccggcucuggccgacgacguauucaauaa

SEQ ID NO: 35631 - RNA, 1644 nt, Artificial Sequence
  derived and/or modified sequence opt11 from capsid_protein_VP1__Norovirus__BAN16283
augaaaauggcauccuccgacgccgcccccagcaacgacggcgccgccaaccuagucccagaagccaacaaugaaguaauggcauuagaacccgucguaggcgcaagcaucgccgcacccgucgucggccaacaaaacaucaucgacccuuggauacgugaaaauuucguacaagccccacaaggcgaguucaccguaucuccccgcaacucucccggcgaaaugcuccucaaccucgaacucggcccagaacuaaaucccuaccucucacacuuaagcagaauguacaacggcuacgccggagggaugcaaguccaagucguacuagccggaaacgcuuucacugccggcaaaaucauauucgcugcugucccaccccauuuccccgucgaaaauaucuccgccgcccaaaucaccaugugcccacauguaaucgucgacguccgccaacucgaacccgugcuccucccccuucccgacauccgaaaccgguucuuccacuacaaccaagaaaacacgccccgcaugcgccucgucgcaaugcuauacacaccccuccgcgcuaacucaggagaagaugucuucaccguauccugccgcguccucacccgcccggccccagacuucgaguucaccuuccugguacccccaaccgucgaauccaagaccaaacccuucacccugccuauacucacccucggcgaacuaucaaauucccgauuccccgccccaaucgauaugcuauacaccgaccccaacgaaggcaucgucguccaaccacaaaacggacgcugcacccucgauggaacacuacaaggcaccacccaacucguccccacccaaaucugcgcauuccgggguacacuaauaggacaaaccucccgauccuccgauuccacagacuccgccccucgccgccgcgaccacccccuccauguacaacuaaagaaccucgacggaacacaauacgacccaaccgacgaaguacccgcaguacucggcgccaucgacuucaaaggcaccgucuucggcgucgcaucccaacgagacgucuccggcgaccaaguaggcgcuacccgagcacacgaaguacacaucaacacaacagacccccgcuacacacccaagcucgguucaauccucaugcacuccgaaucaggagacuuuguaaccggccaacccguccgcuucacucccauaggaaugggagacaacgacuggcaccaaugggaacucccagacuacucuggccaccuaacucucaacaugaaccuagcaccagccgucgcacccgcguuccccggcgaacgaauacucuucuuccguuccauaguaccaucagccgguggcuacggcaccggccaaaucgauugccuaaucccccaagaauggguacagcacuucuaccaagaagccgcccccagccaguccgcuguugcacuaauucgcuacgucaacccagauaccggucgcaacauauucgaagccaaacuccaccgcgaagguuucaucaccguagccaauuccggcaacaacccgauaguaguucccccaaacggauacuuccgcuuugaagccugggucaaccaauucuacacacucacccccaugggaaccggccaaggccgccgccgcaaccaauaa

SEQ ID NO: 35632 - RNA, 1644 nt, Artificial Sequence
  derived and/or modified sequence opt11 from capsid_protein_VP1__Norovirus__BAN16285
augaaaauggccuccaaugacgccgcccccuccaacgacggagcagccaaccucguccccgaagccaauaacgaagucauggcccucgaacccgucgucggagccucgaucgccgccccagucgugggccaacaaaacaucaucgacccauggauacgcgaaaauuuuguccaagcaccacaaggagaguucacaguaucaccucgcaacucacccggagaaaugcuacucaaucucgaacucggcccugaacucaacccauaccucucccaccuaagccgcauguauaacggguacgccggcggcaugcaaguccaaguaguacucgccggcaacgcauucaccgccggcaaaaucaucuucgcagccguaccuccccacuuucccguagaaaacaucucagccgcccaaaucaccaugugcccccacgucauagucgacguccgccagcuugaacccguacuucuuccccuaccagacauccgcaacagauucuuccacuauaaccaagaaaacaccccacgaaugcgccucguugcgaugcucuacacaccccuacgagcaaacucaggugaggacgucuuuacagucuccugucgcguccuaacccgccccgcacccgacuuugaguucacauuccucguaccacccaccgucgaaucaaaaaccaaacccuucacacuacccauccucacccuuggagaacucuccaacucacgcuuccccgcucccaucgacaugcucuacaccgaccccaacgaaggcaucgucguacaaccccaaaauggccgcugcacucucgacggaacacuacagggcacaacacaacucguccccacacaaauaugcgcuuuccgcggaacauuaauuggccaaaccucccgcuccuccgacuccacugacuccgccccacgccgaagagaccauccacuccacguccaacucaaaaaccuagacgguacacaauacgaucccaccgacgaaguaccagcaguacuaggcgccaucgauuuuaaaggcaccguuuucggaguagcgucccaacgcgacgucagcggacaacaagucggcgcaacccgagcacacgaaguacacaucaacacaaccgacccacgguacacccccaaacucggaaguauccucaugcacucagaaucugacgauuucgucacagggcagcccguacgauucacaccuaucggcaugggagacaacgacuggcaccaaugggaacuccccgacuacuccggacaucucacccuaaacaugaaccucgcaccagccgucgcccccgccuuccccggugaacgcauccuauucuuccgauccauggucccaucagcaggaggauacggaucaggccaaauagacugccucauuccccaagaauggguccagcacuucuaccaagaagcagccccaucacaaucugccgucgcucucauccgcuacgucaacccagacacaggccgcaacaucuucgaagccaaacuacaccgcgaaggcuuuauaaccgucgccaacuccggaaacaaccccaucgucgucccgcccaacggauacuuccgcuucgaagccugggucaaucaguucuacaccuuaacccccaugggaaccggccaaggccggcgacgaaaccaauaa

SEQ ID NO: 35633 - RNA, 1644 nt, Artificial Sequence
  derived and/or modified sequence opt11 from capsid_protein_VP1__Norovirus__BAN16287
augaaaauggccagcaacgacgccgcuccaagcaacgacggagcagcaaaccucgucccggaagccaauaacgaaguaauggcccucgaaccagucgcaggcgcuuccaucgcagcccccguagucggccaacaaaacaucauugaccccuggauucgagaaaacuucguccaagcaccccaaggcgaauuuaccguuagcccuagaaacucacccggugaaaugcuccucaaccucgaacuuggacccgaacucaaccccuaccucucccaccuaucccgaauguauaacggcuacgccggcggaaugcaaguccaagucguucucgccggcaacgcauucacugccggcaaaaucauauucgcagcugucccaccccauuuccccgucaaaaacaucagcgccgcccaaaucaccaugugcccccacguuaucgucgacguccgccaacucgaacccguucuccucccccuccccgacauccgaaaccguuucuuccacuacaaccaagaaaacacaccccgaaugagacucguagccaugcuauacacaccccuacgcgcaaacagcggagaagacgucuucacagucuccugcagaguccuaacccgccccgcgcccgacuucgaguucacauuccuaguuccacccaccgucgaauccaaaacuaaacccuucacacuccccauccuaacccuaggugaacuuuccaacuccagauucccagcacccaucgacaugcucuacacggaccccaacgaaggaauugucguccaaccccaaaacggccgcugcacacucgacggcacccuacaaggcaccacgcaacucgucccaacccaaaucugcgccuuccgaggcacccuaauaggacaaacaagccgcagcuccgauuccaccgacucagcaccccgccgccgggaccacccccuacacguccaacugaaaaaccuagacggcacacaauacgacccuacagacgaaguacccgccguccuuggcgccauagacuucaaaggcaccgucuucggcgucgccucccaacgagacguuucaggacaacaaguaggcgccacccgcgcacaugaaguacacaucaacacaaccgacccgcgcuacacacccaaacuagguuccauccuaauccacuccgaauccgacgacuucgucacaggccaaccaguccgcuuuaccccuaucggaaugggcgacaacgacuggcaccaaugggaacucccugauuacucuggccaccuuacccucaacaugaacuuagcccccgccgucgccccagccuuccccggcgaacgcauccucuucuuccgauccauggucccauccgccggcggcuacggaucaggccaaaucgacugccucauaccacaggaauggguccaacauuuuuaccaagaagcagcaccaucacaaagcgcagucgcacucauaagauacgucaaccccgacaccggccgcaacaucuucgaagccaaacuccaccgcgaaggauucaucacugucgccaacagcggcaacaacccaauagucgucccccauaacggauacuucagauucgaagcaugggucaaccaauucuacacccugacccccaugggcacgggccaaggccgccgacgcaaccaauaa

SEQ ID NO: 35634 - RNA, 1644 nt, Artificial Sequence
  derived and/or modified sequence opt11 from capsid_protein_VP1__Norovirus__BAN16289
augaaaauggcauccaacgacgccgccccauccaacgacggcgccgccaaucuagucccagaagccaacaacgaagucauggcccucgaacccgucgucggggccuccaucgcagcacccgucguaggccaacaaaacaucaucgacccauggauccgcgaaaacuucguccaagcuccccagggagaguucaccgucucccccagaaacagcccaggagaaaugcuccucaaccuagaacucggcccagaacuaaaccccuacuuaucccaccuuagccgaauguacaacggcuacgccgguggaaugcaaguccaagucguucucgccggcaacgcauucacugcaggcaaaaucaucuucgcggccgucccuccccacuucccggucgaaaauauauccgccgcccaaaucaccaugugcccccacgucauagucgacguacgacaacuagaacccguauuacuaccccuccccgacauacgcaaccguuucuuccauuacaaccaagaaaacaccccacgcaugcgccuagucgccaugcucuacacaccccuacgagccaacucaggagaagacgucuucaccguuuccugccggguccucacccgccccgcccccgacuucgaguucacauuccuaguaccucccacaguagaauccaaaaccaaacccuucacacuccccauucuaacccuaggagaacuauccaacuccagauuccccgcacccaucgacaugcucuacacugaccccaacgaaggcauagucguccaaccccaaaacggccgaugcacacucgacggaacacuacaaggcacaacccaacucguucccacgcaaauaugcgccuucagaggcacccuaaucggacaaacaucccguuccagcgacuccacagacucagcacccagacgccgugaccacccccuacacguccaacucaaaaaccuagacggcacccaauacgaccccaccgacgaaguuccugccguacucggcgcaaucgacuucaaagggacagugcuaggcgucgccucacaacgugacgucuccggacaacaagucggcgccaccagagcccacgaaguacacauaaacaccaccgacccccgcuacacacccaaacucggauccauacuaaugcauucggaauccgacgacuucguaacaggacaaccgguccgcuucacacccaucggaaugggcgacaacgacuggcaccaaugggaacucccagacuacuccggucaccucacccucaacaugaaccuagcucccgccgucgcaccagcauuccccggugaaagaauacuuuucuuccgauccauaguacccucagccggcggcuacgguuccggccaaaucgacugccucauaccgcaggaauggguccaacacuucuaccaagaagcagcccccucccagagcgccgucgcccugauacgcuacgucaaccccgacaccggccgcaacauuuucgaagccaaacuccaccgcgagggcuucauaaccgucgccaacucagggaacaaccccaucgucguacccccaaacggcuacuucagauucgaagccugggucaaccaauucuacacacucaccccaaugggcacaggccaaggccgucgacgaaaccaauaa

SEQ ID NO: 35635 - RNA, 1644 nt, Artificial Sequence
  derived and/or modified sequence opt11 from capsid_protein_VP1__Norovirus__BAN16291
augaaaauggccucaaacgacgccgccccaucaaacgacggagccgcaaaccucguccccgaagcaaacaacgaaguaauggcccucgaacccguugucggcgcauccaucgccgcccccgucguaggccaacaaaauaucauagaccccuggauacgagaaaacuucguccaggcaccccaaggcgaauuuacugucuccccacgcaacagccccggagaaaugcuacucaaccuagaacuaggacccgaacuaaaccccuaccucucccaccucucccgcauguacaacggcuacgcaggcggcaugcaaguccaaguaguacuagcagguaacgcauucacagcaggaaaaaucaucuucgcagccguaccaccccacuuccccgucgaaaacauauccgccgcacaaaucaccaugugcccacacguaauagucgacgucagacaacucgaacccguacuacuuccacuacccgacauacgcaaccgcuucuuccacuacaaccaagaagacacccccaggaugcgccuugucgccaugcuuuacacuccacuccgagccaacucaggcgaagacgucuucacaguuucaugccgaguacuaacacgccccgccccagacuucgaguucaccuuccucguaccacccacagucgaaucaaaaaccaaacccuucacccuacccauacuuacccucggcgaacuaucaaacucacgauucccggcuccaaucgacaugcuauacaccgaucccaacgaaaccauagucguccaaccccaaaacggucgaugcacacucgacggaacucuccaaggaacaacucagcucguacccacacaaaucugcucuuuccgaggaacccucaucucccaaacuucacgcuccgccgacucuaccgacucggcaccccgcguccgaaaccacccccuccacguucaaaugaaaaaccucgacggcaccccauacgaucccacagaugaaguaccagccguacucggcgccaucgacuucaagggaaccguuuucggagucgccucccaacgcaacacuacuggcaacuccgucggagcaacccgcgcucacgaaguacacaucgacaccacuaauccacgauacacccccaaacuagguuccguccucaugaacagcgaauccuccgacuucgacgacggacaaccaauacgcuucaccccaauaggcaugggcgcagacgacuggcaccaaugggaacuaccugaauacuccggacaccucacccucaacaugaaccucgccccagccgucgcccccgccuuccccggcgaacgcauucucuuuuuccgcucugucguccccagugccggcggcuacggaucaggucaaaucgacugccucauuccccaagaauggguccaacacuucuaucaagaagccgcacccucacaauccgcaguagccuuaauacgcuacgucaaccccgacaccggccgcaacaucuucgaagcaaaacugcaccgcgaaggcuucaucaccgucgccaacuccggcaacaaccccaucguuguaccaccaaacggcuacuuccgcuucgaagccuggguuaaccaauucuacacgcugacacccaugggcaccggccaaggacgucgccgcguccaauaa

SEQ ID NO: 35636 - RNA, 1644 nt, Artificial Sequence
  derived and/or modified sequence opt11 from capsid_protein_VP1__Norovirus__BAN16293
augaagauggccaguaacgacgccgcacccucaaacgauggcgccgcaaaccucguacccgaagccaacaacgaaguaauggcucucgaacccguuguaggcgcaucaaucgccgcccccguagucggccaacaaaacaucauugaccccuggauccgcgaaaacuucguccaagccccccaaggcgaauucaccgucagcccucgcaacucccccggagaaaugcuccucaaccuagaacucggccccgaacuaaaccccuaccuaucccaccuuucacgaauguauaacggcuacgccggcggcaugcaaguccaaguaguccuagcaggaaacgccuucacagccgguaaaauaaucuucgcagccguccccccccacuuccccguugaaaacauaucugcagcccagaucaccaugugcccccacgucauagucgacguccgacaacuugaacccguacuccuaccacuccccgacauccgaaaccgauucuuccacuacaaccaggaagacacaccucguaugcgacucgucgcuaugcucuacacgccccuccgagcuaacuccggcgaagacgucuucaccguuuccugccggguccugacucgccccgccccggacuucgaauucaccuuccuagucccuccaaccguagaauccaagaccaaaccguucacucuaccuauccuuacacucggggaacuguccaacucccgauuccccgcccccaucgacaugcuuuacaccgaccccaacgaaaccaucgucguccaaccacaaaacggccgcugcacccucgacggaacucuccagggcaccacccagcucguuccaacccaaauaugcuccuuccgaggaacacuaauaagccaaacaucccgcuccgccgacuccaccgacuccgccccccguguucgcaaccacccccuccacguccaacuaaaaaaccuagacggcacacccuacgaccccaccgacgaaguacccgcuguccucggcgccauugacuucaaaggaaccgucuucggaguagccucacagagaaacaccacaggcaacucaguaggcgcaacucgcgcccacgaaguacacaucgacacaaccaacccccgcuacacccccaaacuaggcagcguccucaugaacagugaauccucagacuucgacgacggacaaccaauacgcuucaccccaaucggcaugggggcagacgacuggcaccaaugggaacucccagaauacuccggccaucucacauuaaacaugaaccucgcccccgcagucgcccccgcauuccccggcgaacgaauacuuuucuuccgaucagucguccccucugccggagguuacggcucaggacaaaucgacugccuaauaccacaagaauggguccaacacuucuaccaagaggcugccccaucccaguccgccgucgcccucauccgcuacguaaaucccgacaccggacgcaacaucuucgaagccaaacuacaccgagaaggauucauuacaguagccaacucaggcaacaaccccauuguaguccccccaaacggcuacuuccgauucgaagcuugggucaaccaauucuacacccucacccccaugggcacaggccaaggccgcagacguguacaauaa

SEQ ID NO: 35637 - RNA, 1644 nt, Artificial Sequence
  derived and/or modified sequence opt11 from capsid_protein_VP1__Norovirus__BAN16295
augaaaauggcauccaacgacgcagcucccucaaacgacggagccgcaaaccucgugcccgaagccaacaacgaagucauggcccuagaaccugucguuggugccucaaucgccgccccagucgucggccaacaaaacaucaucgaccccuggauucgagaaaauuucguccaagcaccccaaggagaauuuacagucagccccaggaacucccccggcgaaaugcuccucaaccucgaacucggccccgaacucaaccccuaccucagucaccucucccgcauguacaacggauacgccgguggcaugcaaguccaagaaguacucgcagguaacgccuucacagccggcaaaaucauauucgcagcagucccaccucacuuccccgucgaaaacauaucagcagcacaaaucaccaugugcccccauguaaucgucgacguccgacaacucgaaccaguacuacucccccuacccgauauccgcaaccgcuucuuccacuacaaccaagaagauaccccacgcaugcgccucgucgccaugcucuacacuccccuccgcgccaacuccggcgaagacgucuucaccguauccugucgaguccucacccgccccgcccccgacuucgaguucaccuuccucguaccacccaccgucgaaucgaaaacaaaacccuucacccuacccauccucacacucggagaacuauccaacagucgauuccccgcccccaucgacaugcucuacaccgacccaaacgaaaccaucgucguccaaccacaaaacggaaggugcacacucgacggcacccuccaaggcaccacccaacucguccccacccaaauaugcuccuuccgcggcacacucaucucccaaaccucccgcuccgccgacuccaccgacuccgccccuagagucagaaaccacccccuacacguacaacugaaaaaccuagacggcacucccuacgaccccacagacgaaguccccgccguccucggagccauagacuucaaaggcaccgucuucggcgucgccucccagcgcaacaccacaggauccagcgucggcgccacccgcgcucaugaaguccacaucgacaccaccaauccccguuacacccccaaacucggcuccgugcugaugcacucagaauccuccgacuucgacgacggccaaccuacccgcuucacccccaucggcaugggagcagacgacuggcgucaaugggaacuccccgaauacuccggccauuuaaccuuaaacaugaaccucgcccccgccgucgcccccgccuuccccggcgaaaggauacuuuucuuccgcagcguagucccuagcgccggcggcuacggcuccggacaaaucgacugucuuaucccacaagaauggguacaacacuucuaccaggaagcagcccccucccaauccgcaguagcgcucauccgcuacgucaauccugacacaggccgaaacauauucgaagccaagcuccaccgcgaaggauuuaucaccguagccaacuccggcaauaaccccaucguagucccucccaacggauacuuccgauuugaagcaugggucaaccaauucuauacccugacacccaugggaacagggcaaggccgaaggcgcguccaauaa

SEQ ID NO: 35638 - RNA, 1653 nt, Artificial Sequence
  derived and/or modified sequence opt11 from capsid_protein_VP1__Norovirus__BAN16297
augaaaauggcaucaaacgacgccgcccccucaaacgacggcgcagcaaaccucguccccgaagcaaacaacgaaguuauggcccuagaaccagucgucggagcauccaucgcagccccagucgucggucaacaaaauaucauugaccccuggauccgcgaaaacuucguucaagcaccccaaggcgaauuuaccgucucccccagaaacagcccaggcgaaaugcuccucaaccucgaacucggcccagaacucaacccauaccucucacaccuaucacgaauguacaacggauacgcaggagguaugcagguccaagucguacucgcaggcaacgccuucaccgcagguaaaaucaucuucgccgcaguaccaccccacuuccccguugacaacaucuccgcagcccaaaucacaaugugcccucacguaauagucgaugucagacaacuugaacccguccuccuuccccuacccgacauccgcaaccgauucuuccacuacaaccaagaaaauacaccccgcaugcgccuagucgccaugcucuacacuccacuacgcgccaacucaggcgaagacgucuucacugucucuugccgcguacucacccgucccgccccagacuucgaguucaccuuccucgucccucccaccgucgaaucaaaaaccaaacccuucacccuacccguccugacccucggcgaacuauccaacucccgauucccugccgcaaucgacauguuauacacagacccuaacgaaucaaucguaguacaaccccaaaacggacgaugcacccuagacggaacacuacaaggcaccacacaacucguacccacccaaauaugcgccuuccgaggaacccuaaucucccaaaccgcccgcgccgccgacucgguagacagcccccaacgagcacgugaccacccucuacacguccaagucaaaaaccucgacgguacucaauacgacccuaccgacgacauaccagccguccucggagccauagacuucaaaggcaccgucuuuggagucgcuucccaacgagacgugucaggcacgcaagaacagggccacuacgccacccgagcccacgaagcccauauagacaccaccgaccccaaauacgcaccaaaacuuggcaccauccucaucaaauccgacucuaacgauuucaacaccaaccaacccauccgcuuuacucccgucggcaugggagacaacaacuggagacaaugggaacuccccgacuacuccggccgacuuacccuaaacaugaaccuagcccccgcagucagccccucauucccaggagaaagaauccuauucuuccgcuccaucguaccauccgccggaggcuacggcuccggcuauaucgacugucuaaucccccaagaauggguccaacacuuuuaccaagaagcagcuccaucccaauccgccguagcccucgucagguacgucaaccccgacacaggcagaaacaucuucgaagccaagcuccaccgcgaaggcuuucucaccgucgcaaacucaggaaacaaccccaucgucgucccuccaaacggcuacuucagauucgaagcaugggucaaucaauucuauacucuagcccccaugggcuccggccaagguagacgccgcgcccaauaa

SEQ ID NO: 35639 - RNA, 1623 nt, Artificial Sequence
  derived and/or modified sequence opt11 from capsid_protein_VP1__Norovirus__BAR42289
augaagauggcauccaacgacgcugcacccucaaacgacggcgcagccggccuuguccccgaaggaaacaacgaaacccucccacuagaacccgucgccggcgccgccaucgccgcccccgucacaggacaaaacaauauaaucgacccauggauccgcacaaacuucguacaagcccccaacggagaauuuaccgucucuccucgcaacucaccaggggaaauacuccucaaccuagaacuaggcccagaccucaaccccuacuuagcccaccucucccgcauguauaacggauacgccggaggcgucgaaguacagguccuccucgcaggcaacgccuucaccgccggcaaaaucuuauucgccgcagucccucccaacuuccccgucgaguucuuaucccccgcccaaaucaccaugcucccccaccuaaucgucgacguccgcacccucgaacccauaaugauaccccuacccgacguccgcaacacauucuuccacuacuccaaccaacccaauucccggaugcgccucguagcaauguuauacacaccccucagaucaaacggaaguggugacgacgucuucaccgucucuugccgcgugcuuacccgccccacccccgacuucgaguucacauaccuuguacccccuuccgucgaaucuaaaacuaaaccauucucgcuccccaucuuaacccuuucggaacuuacaaacucccgcuucccagucccaaucgacagccuauucaccgcccaaaacaacguccuccagguccaaugccaaaacggacgcugcacccuagacggagaacuccaaggaaccacccaacuacucccuacaggcauaugcgcauuccgaggccgagucaccgcacaaaucaaccaacgcgaccgauggcauaugcaacuucaaaaccuuaacggcaccaccuacgaccccacagacgacgucccagcaccccuaggcacccccgacuucaaaggcguagucuucggaaugguaagccaacgcaacguuggcaaugacgccccaggcucaacccgugcacaacaggccugggucucaaccuacucaccacaguucguccccaaacucggcucagucaaccuccgcaucucagauaacgacgacuuccaauuccaaccaacaaaauucaccccgguuggcguuaaugacgacgacgacggacacccauuccgacaaugggaacucccuaacuacuccggagaacucacccugaacaugaaccuagcacccccugucgccccaaacuuucccggcgaacaacuucucuucuuccgcucauucguacccugcuccggaggcuacaaccaaggcauaaucgacugccucaucccccaagaauggauccaacacuucuaccaagaaagcgcaccaucacaaucagacguugcacuaauccgauacgucaaccccgacaccggccgcacccucuucgaagcaaaacuucaccgcucaggcuacauuacagucgcccauuccggagacuacccccucguuguuccagcaaacgggcacuuccgcuucgacuccugggucaaccaauucuacucacuagcccccaugggcaccggaaacggcaggcgucgcgcucaauag

SEQ ID NO: 35640 - RNA, 1617 nt, Artificial Sequence
  derived and/or modified sequence opt11 from capsid_protein_VP1__Norovirus__BAR47616
augaaaauggcuucaaacgaugccgcacccucaaacgacggagccgccggccuagucccagaaggaaauaacgaaacccuuccccuugaaccaguugccggcgccgccaucgcagcccccguuaccggacaaaacaacauaauagacccauggauccgcaccaacuucguccaggccccaaacggagaauuuacugucucgccccgcaacucccccggcgaaauccuucucaaucuagaacucggaccugacuuaaaccccuaccucgcucaucucucucguauguacaacggcuacgccggcggagucgaaguccagguccuacucgcuggcaaugcauucaccgccggaaaaauacuauucgcagccguuccacccaacuuccccguagaauuucucucccccgcccaaaucaccaugcucccccacuuaaucgucgacguccgaacccucgaacccaucaugauaccccucccagacguacgcaauaccuucuuccacuacaacaaccagccaaacucccgcaugcgacucguagccaugcuauacacaccacuccgauccaacgguucaggagacgacgucuucaccgucuccugccgaguccucacccgcccaacccccgacuucgaguucacauaccucgucccacccucugucgaauccaagaccaaacccuucucacuccccauucucacccucucagaacucaccaacucccgauuccccguccccaucgacucccucuucacugcccaaaacaauguccuacaaguacagugccaaaacggccgcugcacacuagacggcgaacuccaaggaaccacacaacuccuccccucuggcaucugcgcauuccgcggccgcguaaccgccgaaacggaccaccgagacaaauggcacaugcaacuacaaaaccucaacggcaccacuuacgaucccacggacgacguacccgcacccuuaggcacacccgauuucaaaggcgucgucuucgggguagccucccaacgcaacgucggcaaugacgcaccaggaucuacccgcgcccacgaagccgucauaagcacuuacucuccacaauucguccccaaacuaggaucagucaacuuccgcuccaacgacaacgacuuccaacuccaacccaccaaauucaccccaguaggcaucaacgacgacggcgaccacccuuuucgucaaugggaacuccccgacuacuccggccuccuaacccucaauaugaaccucgcacccccaguagccccgaacuuccccggcgaacaacuucuauucuuccgcucguucguccccugcuccggcgguuacaaccaagguaucgucgacugccucauaccacaagaauggauacagcacuucuaucaagaaucggcccccucucaguccgacgucgcccucauacgcuacgucaaucccgacaccggaagaacccucuucgaagccaaacuccaccgaagcggcuacaucacugucgcccauuccggagacuacccucuuguagucccagccaacggcuacuuccgcuucgacuccugggucaaucaauucuacucccuugccccaaugggcaccggcaacggaagacgccgagcacaauaa

SEQ ID NO: 35641 - RNA, 1617 nt, Artificial Sequence
  derived and/or modified sequence opt11 from capsid_protein_VP1__Norovirus__BAR63715
augaaaauggccucuaacgacgccgcccccuccaaugacggagccgccggacucgucccagaaggcaacaacgaaacucucccccucgagcccgucgccggagccgcaaucgccgcccccgucaccggccaaaacaacaucaucgacccauggauccgaaccaacuucguucaagcccccaacggcgaguucacaguaucaccccgaaacucccccggcgaaauccuccucaaucucgaauuaggccccgaucucaaucccuaucucgcccaccuauccagaauguacaacggcuacgcuggcggcgucgaaguccaaguacuacucgccggaaacgcauucaccgccgguaaaauucuauucgcagccguucccccaaacuuccccgucgaauuucucucccccgcccaaaucaccaugcucccccaccucaucgucgacguccgcacccuagaaccaaucaugauaccacuccccgauguccgcaacaccuucuuccauuacaacaaccaaccuaacuccagaaugcgucucgucgcaaugcuauacaccccacuacgcuccaacggcucuggcgacgacguauuuaccgugucaugccgcgucuuaacccgucccacucccgacuucgaguucaccuaccucguaccacccuccgucgaauccaaaacuaaacccuucucacucccaauccucacccucuccgaacucaccaacucccgcuuucccguccccauagacucgcuuuucacagcacaaaacaacguacuccaaguccaaugccaaaacggccgauguacccuagacggcgaacugcaaggcaccacucaacuuuuaccaucggguauuugcgccuuccgcggccgagucaccgcagaaaccgaccaccgcgacaaauggcacaugcaauugcaaaaccucaacggcacaacauaugaccccaccgacgacguacccgcaccccucggcacacccgacuucaaaggagucgucuucggcguugccucccaacgaaacgucggcaacgacgcgcccgguagcacccgagcccacgaggcaguaaucuccaccuacagcccccaauucguacccaaacuuggcuccgucaacuuccgcucgaacgacaacgacuuccaacuccaaccaaccaaguucacgcccgucggcauaaaugacgacggggaccaccccuuccggcagugggaacucccagauuacuccggccuacucacccuuaacaugaaccucgccccacccguugcccccaacuucccuggcgaacaacuccucuucuuccgcucauucguccccugcagcggaggcuacaaccaaggcauaguagacugccucaucccccaagaauggauacaacacuucuaucaagaauccgcccccucccaaucagauguagcucuaauucgauacgucaacccagacacuggccgcacccuauucgaagcaaaacuccaccgcuccggcuauaucaccguagcccacucaggcgauuacccacucgucguccccgccaacggcuacuuccgauucgacuccugggucaaccaauucuacucccucgcacccaugggcaccggaaacggccgacgccgcgcccaauag

SEQ ID NO: 35642 - RNA, 1617 nt, Artificial Sequence
  derived and/or modified sequence opt11 from capsid_protein_VP1__Norovirus__BAR63718
augaaaauggccagcaacgaugccgcccccuccaacgauggcgccgccggccugguccccgaaggaaauaacgaaacccuaccucucgaaccagucgcuggggccgcuaucgccgcgccagugacaggacaaaacaacauuaucgacccauggauacgcaccaacuucguacaagcucccaacggcgaauuuacaguauccccucgcaacucacccggagaaauccuccucaaccuagaacucggacccgaccucaaccccuaucucgcacaccuaucacgaauguacaacggcuacgcaggaggcgucgaaguccaaguccuucucgccggaaaugcauucaccgcaggcaaaauacuuuucgccgccguaccacccaacuuucccgucgaauuucuaucacccgcccaaauaaccaugcuaccccaccucaucguagacguccguacccuagaaccaauaaugaucccacuccccgauguccguaacacauucuuccacuacaauaaccaaccaaacucccgcaugcgccucgucgccauguuauacacaccacuacgaagcaacggcuccggcgacgacgucuucacagucuccugcagaguccuuacccgcccaacacccgacuucgaauuuaccuaucucguaccacccucagucgaaucgaagacaaaacccuucucccuacccauacucacucucuccgaacucaccaacucccgauucccuguccccaucgacucucuauucaccgcccaaaacaacguccuucaaguucaaugccagaacggacgcugcacucuagacggcgaacuccaaggcacgacccaacuccuccccuccggcaucugcgcauuccgaggccgagucaccgccgaaaccgaccaucgagacaaauggcacaugcaacuccaaaaccuaaacggaaccaccuacgaccccacugacgacguccccgccccacuaggaacccccgacuucaaaggcgucgucuucggaguugccucacaacgaaacgucggcaacgacgcucccggcucaacacgcgcccacgaagcagucaucuccaccuauuccccucaauucguacccaaacucggaucugucaacuucagaucaaacgacaacgacuuccaacuccaacccaccaaauucacaccaguaggaaucaaugacgacggcgaccacccauuccgccaaugggaacuucccgacuacucaggucuacucacccucaacaugaaccucgcacccccaguagcccccaacuuccccggcgaacaacuucuuuucuuccgcucuuucgucccaugcucaggaggauacaaccaaggcaucgucgacugccuuaucccccaagaauggauucaacauuucuaccaagaauccgcccccucacaauccgacguagcccucauacgcuacgucaacccagacaccggccgcacccucuucgaagcaaaacuacaucgaucuggcuacaucaccgucgcgcacuccggcgacuacccacuugucguucccgccaacggcuacuuucgauucgacucaugggugaaucaauucuacucacucgcccccaugggcaccggaaacggacgccgacgcgcccaauaa

SEQ ID NO: 35643 - RNA, 1617 nt, Artificial Sequence
  derived and/or modified sequence opt11 from capsid_protein_VP1__Norovirus__BAR63721
augaaaauggccucaaacgacgccgcuccuuccaaugacggcgcagccggccucguccccgaaggaaacaacgagacccuaccccucgaaccaguagccggcgccgccaucgcugcacccgucaccggacaaaacaacauaaucgaccccuggauccgcaccaacuucguccaagccccaaacggcgaguucaccguaucaccccgaaacucccccggcgaaauccuucucaaccuagaacucggaccagaccucaacccauaccucgcucaccuaucccgaauguauaacggcuaugcaggcggcgucgaaguacaaguccuacucgccgguaacgcauucaccgccggcaaaauucucuucgcugcaguaccacccaacuuccccguagaauuucucucccccgcucaaaucaccaugcucccccaccucaucgucgacguacgaacucucgaacccauuaugauaccccuccccgacgucagaaacacauucuuccacuacaacaaccaacccaacagccgcaugcgacucgucgccaugcuauauacaccucuccgaucaaacggcuccggugacgacgucuucaccgucucaugccgcguccucacacgaccaacccccgacuucgaguucaccuaccucguaccacccagcgucgaaucaaaaaccaaacccuuuucucuccccauccuaaccuuaucagaacucaccaacucaagauuucccgucccgauagacucccucuucaccgcccagaacaacguccuccaaguccaaugccaaaacgggagaugcacccucgacggagaacuccaaggcaccacccaacuccuccccuccggcaucugcgcuuuccgaggccguguaaccgccgaaaccgaccaccgcgacaaauggcacaugcaacuccaaaaccuuaacgggaccaccuacgaccccaccgacgacguccccgcaccccuagguacacccgacuucaaaggaguagucuucggcgucgccucccaaagaaacgucggcaacgacgcccccggcuccacccgagcccacgaagccgucaucucuaccuacucuccccaauucguaccaaaacuggguuccguaaacuuccgcuccaacgacaacgacuuucaacuucaacccaccaaauucaccccagucggcauaaacgacgacggggaccacccuuuccgccaaugggaauuacccgauuacuccggccuccuuacucucaacaugaaccuagccccaccugucgccccaaauuucccuggcgaacagcuacucuucuuccgcucauucguccccugcuccggaggauacaaccaaggcaucgucgacugccucaucccacaagaauggauccaacauuucuaccaagaaucagcacccucgcagagcgacguagcacuaauccgcuacgucaaccccgacaccggccgcacacucuucgaagccaaacuacaccgcagcggcuacaucacggucgcccauuccggcgacuacccucuagucgucccagcaaacggauacuuccgauucgacucaugggugaaccaauucuacucccucgcccccaugggcaccggcaacggccgcagacgagcacaguaa

SEQ ID NO: 35644 - RNA, 1623 nt, Artificial Sequence
  derived and/or modified sequence opt11 from capsid_protein_VP1__Norovirus__BAS02083
augaaaauggccuccucagaugcaaaucccucugacggcuccgccgccaaccuaguccccgaagucaauaacgaaguaauggcccuagaacccgucgucggggccgccaucgccgcccccgucgcaggccaacaaaacgucaucgacccauggauccguaacaauuucguccaagcccccggaggcgaguucaccgucucaccccgaaacgcccccggagaaauacuuugguccgcaccccucggcccagaccucaaccccuaccuaucccaucucgcccgcauguacaauggauacgccgguggcuucgaaguccaagucauccucgccggcaacgcuuucaccgccggcaagguaaucuucgccgccgucccacccaacuuccccaccgaaggccucucccccucccaagucaccauguucccccacaucgucguugacguccgacaacuagaacccguccucauaccccuacccgacguccgcaacaacuucuaccacuacaaccaauccaacgacccaaccaucaaacuaaucgcaaugcucuacacaccccugcgugccaacaacgccggcgacgacgucuucaccguauccugccgaguacuuacccgaccuucccccgacuucgacuucaucuuccucguucccccaacagucgaauccagaaccaaaccauucuccguacccguucuaaccgucgaagaaaugaccaacucccgcuuccccaucccccuagaaaaacuauucaccggacccuccuccgccuuuguaguacaaccacaaaacggucgcugcaccacagacggcguacuccuaggcacuacccaacucuccccggucaacauaugcaccuuccgcggcgaugucacccauacaacuggcucacacaacuacacaaugaaucucgccucacaaaacugguccaacuacgaucccacagaagaaauacccgcaccccuagguacacccgacuucguaggaaaaauccaaggggucuuaacacaaaccacacgcaccgacggauccaccagaggccauaaagccaccgucuacaccggaucagccgauuucgcccccaaacucggccggguccaauucgaaaccgauacaaaccacgauuucgaagccaaccaaaacaccaaauucacacccgucggcguaauccaagacggcggcacaacccaccgcaaugagccccaacaauggguacuuccauccuacuccggccgcaacacacccaauguccaccucgccccggccgucgcccccacauucccaggcgaacaacuccucuucuuucguuccaccaugcccgguugcucuggcuaccccaacauggaccucgacugucuccucccacaagaauggguacaauacuucuaucaagaagcagcuccggcccaaagcgacgucgcccuccuccgauucgucaaccccgacaccggucgcguccucuucgaaugcaaacuacacaaaucaggcuacguaaccgucgcccacaccggccaacacgaccuaguaauuccgcccaacggauacuuccgauucgacuccugggucaaucaauucuacacccuagcccccaugggcaacggaaccggucgacgacgcgcccucuaa

SEQ ID NO: 35645 - RNA, 1635 nt, Artificial Sequence
  derived and/or modified sequence opt11 from capsid_protein_VP1__Norovirus__CRL46952
augaugauggcuagcaaagacgccaccccguccgcugacggagccaccggcgccggucagcuaguccccgaagucaauacagcagaucccaucccaaucgaccccguagcagguuccucaaccgcacucgcaacugcuggccaaguaaaccucaucgaccccuggauaaucaacaacuuuguccaagcuccccaaggcgaguucacuauaucuccaaacaacaccccaggcgauguacucuucgaccuccaacucggcccacaccuuaaccccuuccuuucacaccuaucccaaauguauaacggcugggugggaaacaugcgcguccgcgucguacucgccggaaacgcauucacagcaggaaaaguaaucaucugcugcguaccucccgguuuccaaucccgcacccucuccauagcacaagccacccuauuuccccacgucaucgccgacguacgcacccuagacccugucgaagucccacucgaagacgucagaaacgugcuguaccacaacaacgacacucaaccuaccaugcgccuacucugcaugcucuacacuccccuacgaaccggcggcgccucaggcgggacagacagcuucgucgucgccggccgcguccucacaugccccggacccgacuucaacuuccuauuccucguacccccaacagucgaacagaaaacccgccccuuuaccguaccuaacauaccccucaaauaccuauccaacucccgcaucccaaauccaauugaaggcaugucccucucccccgaccaaacccagaacguacaauuccaaaacggccguugcaccaucgacggccaaccccucggcaccaccccagucucaguaucccaacucugcaaauucagaggccgcaucacuuccggacaacgcguccucaaccuuaccgaacuagacggcucacccuucauggccuucgcugcccccgcuccggcaggcuuccccgacuuaggcagcugcgacuggcacaucgaaauguccaaaauacccaacagcucaacccaaaauaauccuauaguagucaacuccgucaaacccaacagccaacaauucguuccacaccuaucuucaaucacucucgacgacaucgucucaucaggaggcgacuacauaggcacaauacaguggacaucaccacccuccgacagcggcggcgcaaacacaaacuucuggaaaauccccgacuacggcuccucccucuccgaagccucccaacuagcacccgcagucuacccacccggcuucaaugaaguaauuguauacuucauggccuccaucccaggcccaaaccaauccggcuccccuaaccuaguccccugccuccucccccaagaauauauuacccacuucaucagcgaacaagcccccauccaaggagaagcugcccuccuacacuacgucgaccccgacaccaaccgaaaccucggugaguucaaacucuacccgggcgguuaccucacaugcguccccaacuccucauccacugguccccaacaacuuccucuagacggcgucuucguauucgcaucaugggucucucgcuucuaccaacucaaacccgucgguaccgccggcccagcacgaggccgccuaggcguccgucgcuaa

SEQ ID NO: 35646 - RNA, 1623 nt, Artificial Sequence
  derived and/or modified sequence opt11 from capsid_protein_VP1__Norovirus__CRL46955
augaugauggcauccaaagaugcucccaccucaccagacggagcaucuggagccggccaacucguccccgaagccaacacugcagaacaaaucuccauggacccaguagcuggagcaucuacagccgucgccaccgcaggucaagucaacaugauagauccauggauuuucaacaacuucguucaagcaccccaaggagaauuuacaaucucgcccaacaauacaccaggcgacauacuauucgaccuacaacucgguccccaccuaaaccccuuccucgcccaccucucccaaauguacaacggauggguuggcaacaugcgcguacgcauccuacuugcaggcaacgcauucaccgccggcaaaaucauuaucugcugcguaccacccggcuucgacgcccgcauucucaccaucgcccaagcaacacucuucccccaucuaaucgcagacguccgcacacuagaaccagucgaacucccacucgaagacguccgcaauguccuauaccacaacuccucccaaccccaaccaaccaugcgucuagucgcaauguuauacaccccucuccgaacaggcggcggcucaggcggcaccgacgccuucgucgucgccggccgaguccuuaccugcccugcccccgacuucucuuuccucuuccuagucccucccuccgucgaacagaaaacccgagucuucuccguccccaacaucccccuaaaagaccuuuccaauucccgaguccccguccccauccaaggcauguucaugucccccgacgucaaccaaucuguccaauuccaaaacggccgcugccaaauagacggacaacuccaaggcaccaccccagucucccuaucacaacucugcaaaauccgcgguaaaaccuccuccaacgcucgcguccucaaccuaucagaagucgacggcacuccguucaucccccuugaaucuccagcacccgucggauuccccgaccucggcggaugcgacuggcacgucaacuucacauuccaagcucaaaaccaagauccaucccaauccguaacuuucgccacgaacgacgccuccuucguuccauaccucggcuccaucagcccccacaacgguggcgauuuccacgccggagacaucaucggcucccucggcuggauauccgcccccuccgacaacagccaacucaacguuuggaccauuccuaaauacggaucuucacuccccgacguaacccaccucgccccugcaguuuucccacccggcuucggcgaaguaauccuauacuucuacuccaccuucccuggcuccggccaaccaucgcaacuccaaguccccugccuacucccccaagaauuuaucacccacuucugcaacgaacaagcccccaucgccggcgaagccgcccuccuccacuacguggaccccgacaccggccgaaaccucggcgaauuuaaacuauacccagauggcuucaugacaugcgucccaaauuccgucuccuccgguccccaaacacuucccaucaacggcgucuucguuuucguauccuggguaucccgcuucuaccaacuaaaaccaguaggcacggcauccgccgcucgacgacucggucuucgccgcaucuga

SEQ ID NO: 35647 - RNA, 1623 nt, Artificial Sequence
  derived and/or modified sequence opt11 from capsid_protein_VP1__Norovirus__CRL46958
augaaaauggcguccaacgacgcuaaucccagcgacggaucagccgccaaccuaguccccgaaguaaacaacgaagucauggcccuagaacccgucgucggagcagccaucgccgcacccgucgccggccaacaaaacaucauagacccauggauccgcaauaacuuuguacaagcaccaggcggagaguucaccguaucaccccgaaacgccccaggcgaaauccucuggucagccccacuaggccccgaccuaaaucccuaccucucccaccuagcccgcauguacaacggauacgcaggcggcuucgaaguacaagucauccuagccggcaacgccuucaccgccggaaaaauaaucuucgcagccgucccucccaacuuccccaccgaaggccucucacccucucaagucacuauguucccccacauaaucgucgacguccgucaacucgaaccaguacuaauaccacugcccgacguccgcaacaacuucuaccauuacaaccaaagcaacgacucaacaaucaaacuaaucgccaugcucuacaccccacuccgcgcuaauaacgcaggcgacgacgucuucaccgucuccugccgcguccuaacucgucccucucccgauuucgacuucaucuuccucgucccacccacagucgagucccgcaccaaaccuuucaccaucccaauccucaccguagaagagaugacaaacucccgcuucccuaucccccucgaaaaacucuacacaggccccuccuccgccuucgucguucaaccccaaaacggucgcuguacuaccgacggcguccuccucgguaccacacaacucucccccgucaacaucugcaccuucagaggagacgucaccaacauccaaggcagucacacauacacaaugaaccuagccucccucaacuggaacaacuacgacccaaccgaagaaacacccgcaccccucgguacccccgacuuugucggcaaaauccaaggaguccucacacaaacaaccaaaggacaagggagcacccguggccacaaagcaacagucuacaccggcagcgcaucauucacacccaaacucggaucaguccaauuccgcaccgacacccaaaacgacuucguaacccaucaaaacaccaaauucacacccgucggcgucauacaggacggcgacacaacccaccgaaacgaaccccaacaauggguccuccccaacuacucaggcgugaacacacauaacguacaccucgcccccgccguagccccaacgauuccaggcgaacaacuccucuucuuccgauccucaaugccaggcugcuccggcuaccccaauauggaucuagacugccuuguaccccaagaauggguccaacacuucuaccaagaagccgcacccgcccucucagacguagcacuccuccgcuucgugaaccccgacaccggacgaguucucuucgaaugcaaacuccacaagagcggauacgucacagucgcacacaccggacaccaugaccuagucaucccuccaaauggauacuuccgcuucgacuccugggucaaccaauucuacacccucgcccccaugggcaacgguacgggucgccgaagagugcuauaa

SEQ ID NO: 35648 - RNA, 1623 nt, Artificial Sequence
  derived and/or modified sequence opt11 from capsid_protein_VP1__Norovirus__CRL46961
augaaaauggccuccucugacgccaaccccuccgacggcucagcagccaaccuaguccccgaggucaacaacgaagugauggcacucgaaccugucgucggcgcagccaucgcagccccaguugcaggccaacaaaacgucaucgaccccuggauccgcaacaacuucguccaagcccccggcggcgaguucaccgucucaccccgcaaugcucccggcgaaauccuauggucugcaccccuuggcccagaucucaaccccuaucucucacaccucgcccggauguacaacggcuacgcuggcgguuucgaaguccaagucauccuagccggcaacgcauucaccgccggaaaaaucaucuucgcagcagucccaccuaacuuccccaccgaaggccucuccccuucccaagucacuauguucccacacaucaucgucgacguccgacaacuagaacccguccugauaccccuaccagacguucgcaacaauuucuaccacuacaaccaauccaacgacucgaccauuaaacuuaucgccaugcucuacacuccacuccgcgcgaacaaugcaggcgacgacguauucaccguaucaugcaggguccuaacacggccauccccagacuucgacuuuauauuccuuguaccgcccaccgucgaaucacgaaccaaacccuucucaguccccguccucaccguagaagaaaugaccaacucccgauucccaaucccacuagaaaaacuauucaccggccccuccuccgccuucgucguacaaccucaaaauggaaggugcacaacugacggcgugcuacucggcaccacucaacuaucccccgucaacaucugcaccuucagaggcgacgucagccacaucacgggcucucgcaauuacaccaugaaccucgcgucccaaaacuggaacaacuacgacccaacagaagaaauccccgcaccccucggcaccccugacuucgucggcaaaauacaaggcaugcuaacacaaaccacccgcgccgacggauccacccgcggccacaaagccaccgucuacaccggauccgccgacuucgccccuaaacuuggacgcguccaauucgaaacagacaccgaccacgauuucgaagccaaccaaaacacaaaauucacccccgucggugucauccaggacggcucuacaacccaccgcaacgaaccccagcaauggguacuucccagcuacuccggccguaacacccacaauguccaccuagccccagcaguagcacccaccuucccaggggaacaacuacuauucuuccgcagcacaaugcccggaugcucuggcuaucccaacauggaccucgacugccuucucccccaagaauggguccaauacuucuaccaagaagccgcccccgcccaauccgacgucgcacuccuacgcuucgugaaccccgacaccgggcgcguccuauucgaaugcaaacuccacaaaagcggcuacguaaccgucgcccacaccggccagcacgaccucgucauacccccaaacggauacuuccgcuucgauuccugggucaaucaguuuuacacgcucgcccccaugggcaacggaaccggccgccgccgagccgucuaa

SEQ ID NO: 35649 - RNA, 1623 nt, Artificial Sequence
  derived and/or modified sequence opt11 from capsid_protein_VP1__Norovirus__CRL46964
augaaaauggccuccuccgacgccaaccccagcgacggcuccgccgccaaccucgucccugaaguaaacaacgaggucauggcucucgaacccguuguaggcgcagcaauagcagccccaguagcgggccaacaaaacguuaucgaccccuggaucagaaacaacuucguccaagcaccaggcggcgaauuuaccgucagcccuagaaacgcacccggcgaaauccucugguccgcaccccuagggcccgaccucaaccccuaccucucccaccucgcacggauguacaauggcuacgcaggcggauucgaaguucaaguaauccucgccggaaacgcuuucaccgcaggcaaagucaucuucgcagccguacccccaaacuucccaaccgaaggacucucaccaucacaagucaccauguucccacacaucguugucgacguccgacaacuagaacccguccuuaucccccuacccgacguccgcaacaacuucuaccauuacaaccaauccaacgacccaacaaucaaacuaaucgccaugcuauacacaccccuccgcgcuaacaacgccggcgacgacgucuucaccgucuccugccgaguccucaccagaccaucccccgacuucgacuucauauuccucguuccacccacuguagaaucacgaaccaaacccuucucaguacccguccuaaccgucgaggaaaugacaaacucccgcuuucccaucccccuagaaaagcuauucaccggccccagcucagacuucgucguacaaccucaaaacggccgguguacaaccgacggcguccucuuaggcaccacacaacuaucccccgucaacaucugcacauuucgcggcgacgucacccauacaaccggcagccgaaacuacacaaugaaccucgccucccaaaacuggaacaacuacgaccccaccgaagaaacgccagcuccacuaggcacccccgacuucguaggaaaaauccgcggaaugcucacccaaacaacccgagcagacggcuccacccgcggccacaaagccacagucuacacaggcucagccgacuuugcacccaaacucggcaggguccaauucgaaaccgauaccgacaacgacuucgacgcuaaccaaaacacuaaauucacccccgucggcgucauccaagacggcacaacaacucaccgcaacgaaccccgacaguggguucuccccucauacuccggccggaauacccauaacguccaccuagcaccagccgucgccccuaccuucccaggugaacaacuacucuucuuccguucaacaaugcccggcugcucaggcuacccaaacauggaccucgacugccuccucccucaagaauggguacaauucuucuaccaagaagccgcccccgcccaauccgacguugcccuacuacgcuucgucaaccccgacacaggccgcguccucuucgaaugcaagcugcauaaauccggauacguaacagucgcccacacaggcccccacgaccucgucauuccacccaacggcuacuuccguuucgacucaugggucaaccaguucuacacacucgcccccaugggcaacggaaccggcagaagacgagcggucuag

SEQ ID NO: 35650 - RNA, 1644 nt, Artificial Sequence
  derived and/or modified sequence opt11 from capsid_protein_VP1__Norovirus__CRL46967
augaaaauggcaucuaacgacgcugcacccuccaacgacggcgccgcaaaccucguccccgaagcaaccucggaggucauggcccucgaacccguaguaggcgcauccaucgccgcccccguaguaggccaacaaaacauaauagaccccuggauccgugaaaacuucgugcaagcaccccaaggcgaguucacagugaguccccgcaacagccccggcgaaaugcuucucaaucuagaacucggaccagaacuaaaucccuaccucucacaccucagucgcauguacaacggcuacgccgggggaaugcaaguccaaguuguacucgccggcaacgccuucaccgcaggcaaaauaaucuucgcagcuguaccaccccacuuccccgucgaaaacaucuccgcagcacaaaucaccaugugcccacacguaaucgucgacguccgacaacuagaacccguacuccucccccuaccagacaucagaaaccgcuucuuccacuacaaccaggaaaacacaccccgcaugcgccucgucgccaugcuauacacaccccuccgcgccaacuccggcgaggacgucuucaccguaucgugccgcguacuaacacgaccagcacccgacuucgaguucacguuccucgucccucccaccgucgaaagcaaaacuaaacccuucacccuacccauacucacucucggagaacucuccaauucccgcuuccccgcccccaucgacauguuauacaccgacccaaacgaagcaaucgucguacaaccacaaaauggacguuguacccuagacggcacccuucaaggcaccacccaacucguccccacccaaauaugcucauuccggggaacgcucaucagccaaacaucacgaucagcagacuccaccgacuccgccccacgcguacguaaccacccccuccacguccagcuuaaaaaccuagacggaacacccuacgaccccaccgacgaagucccagccguacuaggcgccauugacuucaaaggcacugucuucggcgucgcaagccagcgcaacacaacaggcucauccaucggcgcaacccgugcacaugaaguccacauagacaccaccaacccccgcuacgcccccaaacuaggcuccguacuuauguacucagaauccacugacuucgacgacggacaaccaacacgauucacucccaucggcaugggcgccgacgacuggcaccaaugggaacuacccgaauacucgggccaucucacacucaacaugaaccucgcacccgcggucgccccugcguucccaggcgaacgaauccucuucuuccgauccgucgucccaucagccggcggauacggcagcggccacaucgacugucucaucccccaggaauggguccaacacuucuaccaagaagccgccccaucucaaagcgccgucgcacucauacgcuacgucaaccccgauaccggccguaacauuuucgaagccaaacuacaccgggaaggcuucauaaccguagccaacuccgggaacaacccaauaguagucccacccaacggcuauuuccgcuucgaagcauggguaaaccaguucuacacccucacccccaugggcaccggacaaggccgccgccgagugcaauaa

SEQ ID NO: 35651 - RNA, 1647 nt, Artificial Sequence
  derived and/or modified sequence opt11 from capsid_protein_VP1__Norovirus__CRL46970
augaagauggcuucaaacgacgccgccccaucaaacgacggcgccgcgggccuaguccccgaaauaaacaaugaagccauggcacuagagccaguagcaggagcugccaucgccgcaccccuuaccggccaacaaaacaucauagaccccuggaucaugaacaacuucgugcaagcuccaggcggcgaguucacuguaagcccccgaaacucucccggcgaaguacuccucaaccuagaacuaggucccgaaaucaaccccuaccucgcccaccucgcccgcauguacaacggcuaugccggaggauuugaaguccaagucguccuagcaggcaacgccuucaccgccggcaaaaucauauucgcugccauaccaccaaacuuccccaucgauaaccuauccgcagcacaaauaaccaugugcccucacgucaucgucgacguacgacaacucgaacccgucaaccuccccaugccugacguccggaacaacuucuuccacuacaaucaagguucagacucccgccuccgacucaucgcaaugcuuuacaccccacuccgcgccaacaacucaggagacgauguuuucacagucuccugccgcguccucacucgccccucacccgacuucucuuucaauuuccugguucccccaaccgucgaauccaaaaccaaacccuucucccucccuauccuaaccaucucagaaaugagcaacucacgcuuccccguccccauugacucacuacacaccuccccgaccgaaaacaucgucguccaaugccaaaacggccgcguaacccucgacggcgaacuaaugggcacaacacaacuccuuccaucccagaucugcgccuuccgaggcguccuaaccagauccacuucacgugcuucagaccaggccgacaccgccacuccccgccucuucaacuacuacuggcauauccaacucgacaaccuaaacggcacccccuacgaccccgcagaagacauacccggaccccucggcacccccgauuuccgaggcaaaguauucggaguagcaucucagcgaaaccuagauaccaccacccgcgcacacgaagccaaaauagacacuaccucuggacguuucacccccaaacucggaagccucgaaauuuccaccgaauccuccgacuucgaccaaucccagcccacacgcuucacccccguaggcaucggcguagaccacgaggccgacuuccaacaauggacucucccagacuacgccggccaauucacccauaacaugaaucucgcccccgccgucgcccccaacuucccaggcgaacaguuacuguucuuccgcucccaccucccaucaucaggaggccgauccaacgguauacucgacugccucgucccccaagaauggguccaacacuucuaccaagaaagcgcacccucccaaucccaagucgcccucguacgcuacgucaaccccgacaccggccgaguacuauucgaagcuaaacuccacaaacucggcuucaugacaauagccaaaaacggcgacucuccaaucaucgucccaccaaacggauacuuccgcuucgaauccugggucaaccccuucuauacccucgcccccaugggaaccggcaacggccgccgucgcauccaauaa

SEQ ID NO: 35652 - RNA, 1608 nt, Artificial Sequence
  derived and/or modified sequence opt11 from capsid_protein_VP1__Norovirus__CRL46973
augaaaauggccucaaacgaugccgcacccucaaacgacggugcagccggacuuguccccgaaguaaacaacgaaacaauggcccucgaacccgucgcaggagccuccaucgccgcaccccucaccggacagaacaacgucauagaucccuggauccgaaugaacuucguccaagcccccaacggagaguucacagucucaccccgaaacucccccggcgaaguacuucuugaacucgagcucggccccgaacucaaccccuuccucgcccacuuaucacgcauguacaacggcuacgcaggaggcgucgaaguccaaguucuccucgccggcaacgcuuucaccgcagguaaacucguauuugcagccaucccaccucacuucccccuugagaaccuguccccaggacaaaucaccauguucccacacgucaucauagacguccgaaccuuagaacccguccuacuaccacuaccagacguccgaaacaacuucuuccacuacaaccaacaacccgaagcacguaugaagcuaguugccaugcucuacacaccccuccgauccaacggaucuggcgacgacgucuuuaccguaucaugccgcguccuuaccagacccuccccagacuucgacuucaacuaccucgucccucccaccgucgaaucaaaaaccaaacccuucacacuccccauccuaacaaucggagaacucucuaacucuagauuccccguccccaucgacauccucuacacaucccccaacgaaggagucguaguacaaccccaaaacggccguuccacccuagacggugaacuacucggcaccacccaaauaguccccuccaacaucugcgcacuccgcggacgcauuaacgcacacgucccaaacgaacccaaccaauggaaccuucaagucaccaacgcaaacggaacccccuucgaccccaccgaagacguacccgccccacucggaacacccgacuuccaagcaaacaucuacggaguaacaggccaacgcaacucagacucaucaugccgcgcccacgauggcguccucgcaaccuggucccccaaauucacccccaaacucggaucagucguccuaggaacgugggaaaaagaagacuucaacaucaaucagccgacacgcuucaccccuaucggccuccacaauaccgaacacuucaaacaauggguacuccccaacuauagcggcaugcucacccuaaacaugaaccucgcacccucagucgccccacuauucccaggugaacaaauccuauucuuccgcuccuucaucccacucaacggcggaaaaucggacggcgcaauagauugccuccucccacaagaauggauccaacacuucuaccaagaauccgcacccucaccgacugacguagcacuaauacgauacaccaaccccgacaccggccgcguucucuucgaagccaaacuccaccgccaaggcuucaucaccguagccuccucaggaucaaaacccauaguugugccacccaacggcuacuuccgcuucgacuccuggguuaaccaauucuacucacuagcacccaugggaacugggaacggacgccgcagaguccaauaa

SEQ ID NO: 35653 - RNA, 1623 nt, Artificial Sequence
  derived and/or modified sequence opt11 from capsid_protein_VP1__Norovirus__CRL46976
augaaaauggccucuaacgacgccgcccccuccgacggcuccaccgccaaccuaguaccagaaguaaacaacgaggucauggcccucgaacccgucgucggagcagccaucgcagccccgguagccggucaacaaaacguuaucgacccuuggauccgcaacaacuuuguucaagccccaggcggagaguucaccgucucaccccgcaacgccccaggcgaaauacuaugguccgcaccccucggaccggaccuaaaccccuaccucucccaccuugcccgcauguacaacgguuacgccggcggcuucgaaguccaaguuauccucgccggcaaugccuucacggccggcaaaauaauauucgcagccguaccaccgaacuuccccaccgaaggccucucccccucccaagucacaauguucccccacaucaucgucgacguucgacaacucgaacccguccucaucccacuucccgacguacgcaauaacuucuaccacuacaaccaguccaacgacccaaccauuaagcuaaucgccaugcuuuacacaccccuccgcgcuaacaacgccggcgacgaugucuucaccguaucuugccgaguccucacccgccccucacccgacuucgacuucaucuuccucguucccccuaccgucgaaucccgcaccaaaccauucuccguacccguacuuaccgucgaagaaaugaccaacucucgcuucccaaucccacucgaaaaacucuucaccggucccucaucagccuucgucguccaaccccagaacggccguugcacaacagauggcguacuccuaggcaccacccaacucucacccgucaacauuuguaccuucagaggcgacgucauccacauccccggcucccgcaacuacaccaugaaccuagcgucccaaaacuggaacucauacgaccccaccgaagaaauccccgcaccccucggaacccccgacuuuguuggcaagauccaaggcguacuuacccaaaccacccgcacaaauggcuccacccgcggccacaaagccacaguauacaccggauccgccgauuucucaccaaaacucggccgcguccaauucgccaccgacaccgauaacgacuucgagaccaaccaaaacacgaaauucacucccgugggcgucauucaagacggcucuaccaccccacguaacgaaccacaacaauggguccuaccauccuacucuggccgaaacauacacaacguccaccucgcuccugccgucgcccccaccuucccaggcgaacaacuacuauucuuccgauccaccaugccaggaugcagcggcuacccaaacauggaccucgacugucuacugccccaagaauggguucaauacuucuaccaagaagccgcccccgcacaauccgacguggcccuccuucgauucguaaaucccgacacuggucguguccuauucgaaugcaaacuccauaaaucaggcuacgucacaguagcucacaccggccaacacgaccuagucauacccccuaacggcuacuuccgauucgacucuugggucaaccaauuuuacacucuagccccaauggguaacggcacgggccgacgccgcgcccuauaa

SEQ ID NO: 35654 - RNA, 1623 nt, Artificial Sequence
  derived and/or modified sequence opt11 from capsid_protein_VP1__Norovirus__CRL46979
augaaaauggcaucaucagacgccaaccccucagacggaagcacagcuaaccuaguacccgaagucaacaacgaaguaauggcccuugaaccaguagucggugccgccaucgccgcccccgucgccggccaacaaaacgucaucgauccauggauuaggaacaacuucguccaagcgccaggcggagaguucaccguaucaccaagaaacgcacccggcgaaauccucugguccgcaccccugggcccugaucucaaccccuaccuaucacaccucgcccgcauguacaacggcuaugccgggggcuucgaaguccaagucauccucgccggcaacgccuucacagcaggcaaaauuauauucgccgcagucccucccaacuuccccacagaaggccucucccccucccaagucacaauguucccccacauaauaguagauguccgucaacucgaacccguucuaaucccucuaccagacgucagaaacaacuucuaccacuacaaccaguccaaugacccaacaauaaaacucauagccaugcucuacacaccccuacgcgcuaacaaugcaggagacgacguauucaccgucuccugccgaguucucaccagaccgucccccgacuucgacuucauauuucucgucccacccaccgucgaaagcagaaccaaacccuucuccguccccguccucaccgucgaagaaaugaccaauuccagauuccccauaccccucgaaaaacucuucacaggaccauccuccgcauucguaguccaaccccaaaauggcagaugcaccaccgacggcguccuccucggcaccacccaacucucccccgugaauauauguacauuccgcggcgacgucauccacauccccggaucccgcaacuacaccaugaaccuagccagccaaaacuggaacucauacgaucccacugaagaaauccccgccccacuagguacaccagacuucgucggcaaaauccaaggcguccuaacccaaaccacccgcacaaacggauccacccgcggccacaaagccaccgucuacaccggcuccgccgacuuuucacccaaacuaggccgcguacaguucgcaaccgauaccgacaacgacuucgaaaccaaccaaaauacaaaauucacccccguaggcguaauccaagauggcuccaccacaccccgaaacgaaccucaacaauggguacuucccuccuacuccggccgcaacauccacaacguccaccuagcccccgccgucgcacccaccuuccccggcgaacaacuucucuucuuccgcuccaccaugccuggaugcucaggcuaccccaacauggaccuagacugccuccuaccccaagaauggguccaauacuucuaucaagaagccgcccccgcgcaauccgacgucgcccuccuuagauucgucaacccugacaccggcagaguccuauucgaaugcaaacuccacaaaucagguuacgucacaguggcccacaccggccaacacgaccuugucauaccaccaaacggauauuuccgcuucgacucaugggugaaccaauucuacacccuugccccaauggguaacggaacgggcagacgacgagcacucuag

SEQ ID NO: 35655 - RNA, 1623 nt, Artificial Sequence
  derived and/or modified sequence opt11 from capsid_VP1__Norovirus__ABC96332
augaaaauggccccgaacgacgcgucccccuccgacggauccacagccaaucuaguccccgaagugaauaacgaagucauggcccuagaacccgucgucggcgccgccaucgcagccccuguagcaggccaacaaaacgucaucgaccccuggauacguaacaauuucguacaagcacccggcggcgaguucaccgucucaccccguaacgcucccggugaaauccuaugguccgcaccacucggccccgaccuaaacccauaccucucucaccuagcccgcauguacaacggcuacgccggcggauucgaaguccaaguuauucucgcuggaaacgcauuuaccgccgguaaaaucaucuucgccgcagucccacccaacuuccccaccgaaggacucucacccucccagguaaccauguucccccacaucaucgucgacguucgacaacucgagcccguccuuaucccucuacccgacguacgcaacaacuucuaccacuauaaccaguccaacgacuccaccauaaaacucaucgccaugcucuacacaccccuccgcgcgaacaacgcaggcgacgacgucuucacugucuccugccguguccucacacgacccuccccugacuucgacuucauauuccucgucccacccacagucgaaucccgcaccaaacccuucacaguaccaauccucacugucgaagaaaugaccaacucccgcuuccccaucccccucgaaaaacucuucacaggcccaucaagcgccuucguaguccaaccccaaaacggccgcugcacuacugacggcguccuccucggaaccacccaacuuuccccugucuccaucugcaccuucagaggagacguaacccacaucccaggcacacgaauauaccgcaugaaccucgccucacaaaacuggaacaacuacgaccccaccgaagaaauccccgcaccccucggcaccccagacuuugucggcaaaauacaagguaugcucacccaaaccaccaaaggagacggcuccacgagaggccauaaagccaccgucuccaccggauccguagauuucaccccaaaacucggaucaguccaauucgccaccgauacagacaacgacuucgaaaccggccaaaacacacgauucacccccgucggcguaauacaagacggcuccucugcccaucgcaacgaaccccaacaauggguacucccagacuauuccggccgcaccguccacaacguccaccuugcaccagccgucgccccaacauuccccggcgaacaacuccuuuucuuccguuccaccaugcccggcugcuccggauaccccaacauggaccucgacugccuucuaccucaagaauggguucaacacuucuaccaagaagccgcaccaucacaaucagacgucgcccuccuccgcuucgucaaccccgacaccggccgaguccucuucgaaugcaaacuccacaaagccggcuacgucacggucgcccacaccggacagcacgaccuaguaauacccccaaacggcuacuuccgcuucgacuccuggguaaaccaauucuacacucucgccccaaugggcaacggcgcaggcagacgccgcgcucuuuga

SEQ ID NO: 35656 - RNA, 1623 nt, Artificial Sequence
  derived and/or modified sequence opt11 from major_capsid_protein_VP1__Norovirus__ADB27027
augaaaauggccuccaacgacgcaacaccauccgacggcuccacugccaaucucguacccgaagucaacaacgaagucauggcccuagaaccugucgucggcgccgccaucgccgcccccgucgccggccagcaaaacgucauagacccauggauucgcaacaacuucguccaggcccccggaggcgaguucaccgucucaccccgcaacgcuccaggagaaauccucuggucagccccacuaggccccgaccucaaccccuaucucucccaccucgcccgcauguacaacgguuacgcuggcggcuucgagguccaaguaauccucgcaggcaacgcauucaccgcugguaaaauaaucuucgcagcaguuccacccaacuuccccaccgaaggacuaagccccucccaaguuacaauguuuccccauaucaucguagacguccgacaacuagaacccguccucaucccccuacccgacguccgcaacaacuucuaccacuacaaucaaucaaacgaccccaccaucaaacucaucgccaugcuauacacaccccugcgcgccaacaacgccggggaugacguauucaccgucuccugccgcguacuaacccgcccuucccccgacuucgacuucauauuccucguaccgcccaccguagaaagccgaacaaaacccuucuccguacccauacucaccgucgaggaaaugaccaacucgcgauuccccaucccccuagagaaacuauuuaccggaccaucaucagccuucgucguccaaccccaaaauggccgaugcaccacugacggcguacuacucggaaccacccaacucucccccgucaacaucugcaccuuccgaggcgaugucacccauaucgcaggcagccgcaacuauaccaugaaccucgccacccaaaacuggaacuccuacgaccccaccgaagaaaucccugcaccacucggaaccccagacuucgucggcaaaauccaaggcguccucacccaaaccacacgcgcugacggcucaacacgcggccacaaagcaaccgucuacaccggcucugccgauuucucuccaaaacucggccguauacaauucgccaccgacaccgacaacgacuucgacgcuaaccaaaacacaaaguuuacacccgucggcgucauucaagacggcaacaccgcacaccgcaacgaaccccaacaauggguccuaccaagcuacucaggccgcaauucccacaacguucaccucgccccugcagucgcccccaccuucccaggagaacaacugcuguucuuccgcagcacaaugcccggcugcucuggcuaccccaacauggaucuagacugccuacucccacaagaauggguccaauacuucuaccaagaagcagcccccgcccaaucugacgucgcccuacuucgcuucgucaaccccgacaccggcagaguacucuucgaaugcaagcuccacaaaaccggcuacguaaccgucgcccauaccggccagcacgaccugguaauuccacccaauggauacuuccgcuucgauuccugggucaaccaauucuacacccucgcaccaauggggaacggcacaggccgccgccgcgcccuauaa

SEQ ID NO: 35657 - RNA, 1626 nt, Artificial Sequence
  derived and/or modified sequence opt11 from major_capsid_protein_VP1__Norovirus__AEE10003
augcgcauguccgacggcgcagcccccaaagccaauggcuccgaagccaguggacaagaccucguacccaccgccgucgaacaagccguccccauccaaccagucgcaggagcagcccuagccgccccugccgccggacaaaucaaccaaauagaucccuggaucuuucaaaacuucguccaaugcccacucggugaguucucuauuucaccccgcaacacucccggcgaaauacuauucgaccucgcacucggccccggccucaaccccuaccucgcccaccuuuccgcaauguacacgggcugggucggaaacauggaaguacaacucguccuagcaggcaacgccuucaccgcuggcaaaguagucguagcccuagucccacccuacuuccccaaaggaucccucacuaccgcccaaauaaccugcuucccccacgucaugugcgacguccgcacccuugaacccauccaacucccccuccuagacguacgccgcguucucuggcacgcuacccaagaccaagaagaaagcaugcgucucgucugcaugcucuacacaccacuccguaccaacucccccggcgacgaaaguuucgucgucuccggacgacuacucagcaaaccugcagccgacuucaacuucguuuaccucaccccucccauagaacgcacuauuuaccguauggucgaccuucccgucauacagccccgccuaugcacccacgccagauggccagcccccguuuacggacuccucgucgaccccucccuccccuccaacccccaauggcaaaauggccgaguucgagucgauggaacccuccuggguaccacccccgucuccggcucuugggucuccugcuucgccgccgaagcugcauacgaguuccaauccgguaccggcgaagucgcaacauucacccuaaucgaacaagacggauccgccuacgucccuggcgaccgcgcggcucccuuaggcuaccccgacuucuccggccaacucgaaaucgaaguccaaacugaaaccaccaaaacuggagacaaacuuaaagucacaaccuucgaaaugguccucggccccgaaaccaacguugaccaagcccccuaccaaggacgcguguacgcauccgucaacgccgccgccucccucgaccuagucgacggacgaguccgcgcagucccccgauccguauacucauuccaggacgucauucccgaauauaacgacggccuccucgucccccuagcacccccaauuggcccauuccuaccaggagaaguucuacuacguuuccguaccuacaugcgccaaauugacaccaccgacgcagcugcagaagccaucgacugcgcucucccccaagaguucauuucaugguuugccucaaacgcauucaccguccaauccgaagcacuccuucuacgcuaccgaaacacccuaacuggacaacuacuauucgaaugcaagcucuacuccgaaggcuacaucgcccucuccuauucugguucgggagcacucaccuucccgaccgacggguucuucgaagucguauccugggucccccgccucuaccaauuagccagcgucggcucacucgccacaggccgcacacucaaacaauaa

SEQ ID NO: 35658 - RNA, 1626 nt, Artificial Sequence
  derived and/or modified sequence opt11 from major_capsid_protein_VP1__Norovirus__AEE10006
augcgcauguccgacggagccgcccccaaagccaacggauccgaagccucaggccaggaccucguacccaccgcugucgaacaagccguaccaauccaaccagucgccggcgccgcccuugccgcccccgcagccggacaaauaaaccaaaucgaccccuggaucuuccaaaacuucguccaaugcccacuaggcgaauuuucaauuucaccccgcaacacuccaggcgaaauccuauucgaccucgcccucggaccaggccuuaacccauaccuagcacaucucuccgcaauguauaccggauggguaggcaacauggaaguucaacucguucucgcaggcaacgcguucaccgcaggaaaagucgucgucgcccuagucccaccauacuuccccaaaggaucccuaacaacagcccaaaucacaugcuucccucacgucaugugcgacguccgcacccucgaaccaauccaacuaccacuccuagacguacgacgcguccucuggcacgccacucaagaccaagaagaauccaugcgacucgucugcaugcuuuauaccccucuacgcaccaacucccccggcgaugaaucauucguaguaucaggacgccuccuuuccaaacccgccgcagacuucaacuucguauacuuaacaccacccaucgaacgcacaaucuaucgaauggucgaccuccccgucauccaaccccgucuaugcacacacgcccgcuggcccgccccugucuacggccuccuagucgaccccucgcuccccucaaacccccaguggcaaaacggccgagucagggucgacggcacccuccugggcacaacccccgucagcggcuccugggugucgugcuucgccgccgaagccgcauacgaguuccaauccggcaccggcgaaguagccaccuucacccuaaucgaacaagacggauccgccuacguccccggugaccgcgccgcaccccuaggcuacccagacuucucuggacaacuggaaaucgaaguucaaaccgaaacuacaaaaacuggagacaaacuaaaagucaccaccuuugaaaugguccuaggacccgaaacaaacgucgaccaagcacccuaccaaggccgcgucuacgccucagucaacgccgccgcaucccucgaccuagucgacggcagaguccgggcugucccaagaucagucuacucauuccaagacguaauacccgaauacaacgauggacuacuuguaccucuagcaccacccaucggccccuuccuacccggcgaaguacuccucagauuccgcaccuauaugcgucaaaucgacacaaccgacgcagccgccgaagccaucgacugcgcacucccccaagaguucauauccugguucgccucaaacgccuucaccguacaaucagaagcucuccuacuacguuaccgcaacacccucacaggccaacuccuauucgaaugcaaacucuacuccgaaggauacauagcccucuccuacuccggcagcggcgcacucaccuuccccacugacggcuucuucgaagucguaucauggguaccuaggcuauaccaacucgccucagucggauccuuagccacaggacgcacauuaaaacaauaa

SEQ ID NO: 35659 - RNA, 1626 nt, Artificial Sequence
  derived and/or modified sequence opt11 from major_capsid_protein_VP1__Norovirus__AEE10009
augagaaugagcgacggcgcagcccccaaagccaacggcuccgaagcauccggccaagaccuuguccccaccgccguagaacaagccgucccaauccaacccgucgccggcgccgcacuagccgccccagccgccggccaaaucaaccaaaucgacccauggaucuuccagaacuucguccaaugcccucuuggagaguucuccauuuccccacgcaacacccccggcgaaauccuuuucgaccucgccuuaggacccggccuaaacccauaccucgcccaccucuccgccauguacacaggcugggugggaaacauggaaguacaacuuguauuagcaggcaaugccuucacagcaggcaaaguaguagucgcacucguuccacccuacuuccccaaaggcucccucaccaccgcccaaauuaccugcuuuccucacguaaugugugacguccgaacccuagaaccuauccaacuaccccuccuggacguuagacgcguccuauggcacgccacacaagaccaagaagaaucuaugcgucucgucugcaugcucuacacaccccuccgcaccaacucccccggcgaugaauccuucguagucagcggacgucuccuauccaaaccagcagcggacuucaacuucguauaccucaccccacccaucgaacgcacuaucuaccguaugguggaccuccccgucauccaaccccgacucugcacacacgcccgcuggcccgcccccgucuacggccuacucguugaucccucccuacccuccaacccccaauggcaaaacggccgcguccgcguagacggcacccuccucggaaccacucccgucuccggcagcugggucagcugcuucgccgcagaagccgcauacgaguuccaauccggcacaggcgaagucgccaccuucacccuaauugaacaagacggcuccgccuacguccccggugaccgcgccgcaccccucggcuacccagacuucuccggacaguuagaaaucgaaguccaaaccgaaacaaccaaaacaggugacaaacuaaaaguaaccacauucgaaaugguacuaggcccagaaacaaacgucgaccaagcccccuaucaagggcgagucuaugcauccgucaacgcagccgccucacuagaccucguagacggccgcguacgagcagucccacgcuccguauacuccuuccaggacguaauaccagaauacaacgacggacuccucguaccacucgcaccacccaucggccccuuccuucccggagaaguucuccucagauuccgcaccuacaugcgccaaauagacaccaccgacgccgccgccgaagccauagacugcgcccuaccacaagaguucauaucgugguucgccuccaacgccuucaccguucaauccgaagcacuccuccuucgcuaccgcaacacccuaaccggccaacuccucuucgaaugcaaacucuacagcgaaggcuacauagcccucucauacucuggauccggcgccuuaaccuucccaaccgacggauucuucgaagucgucucaugggucccaagauuauaccaacucgccuccgucggcucccucgcuacuggucgcacauuaaaacaguaa

SEQ ID NO: 35660 - RNA, 1626 nt, Artificial Sequence
  derived and/or modified sequence opt11 from major_capsid_protein_VP1__Norovirus__AEE10015
augcggaugagcgacggcgccgcccccaaagccaauggcuccgaagccucaggacaagaccucguacccacagcuguagaacaagccguccccauccaaccuguagcgggagcagcccuagcagcccccgccgccggccaaaucaaccaaaucgaccccuggaucuuucaaaauuucguccaaugcccccuaggugaguucuccauaucaccccgcaacacuccaggagaaaucuuauucgaccucgcccuaggccccggccuuaaucccuaccucgcacaccucuccgccauguacaccggcuggguaggcaacauggaaguacaacucguacuugccggcaacgcauucacugcagguaaaguagucgucgcccucgucccacccuacuuccccaaggggucccucacuaccgcccaaauaaccugcuucccacacguuaugugcgacguccgcacacucgaaccuauccaacuaccccuccuagacguacgccgcguccuauggcacgcaacucaagaccaagaagaauccaugcgccuagucugcaugcucuauacuccccuacgcaccaacucacccggagacgaauccuucgucguaucaggccgccuucucucaaagccagccgccgacuucaauuucguauaccucaccccacccaucgaacgcaccaucuaccgcauggucgaccuccccguaauccaaccacgacucugcacccacgcccgcuggcccgcucccgucuacggccuccucgucgaccccucacuccccuccaacccccaauggcaaaacggucgcguccgcgucgacgguacccuucuaggcacuacccccguaucaggcuccuggguauccugcuucgcagccgaagccgcuuacgaguuccaauccggcaccggcgaaguagcaacuuucacacugaucgaacaagacggcuccgcauacguacccggagaccgcgcagcaccccuuggauaccccgauuuuagcggccaacucgaaaucgaaguacaaacagaaaccacaaaaacuggcgacaaacuaaaaguaaccacuuucgaaaugguccuagguccagaaaccaacgucgaccaagcccccuaccaaggccgcgucuaugccucagucaacgcagcugccucacucgaccucguagauggucgaguccgugccguaccccgaagcguauacucauuccaggacgucaucccagaauacaacgacgggcuccuagucccccucgcacccccgaucggccccuuucuccccggcgaaguacuucuacgauuccgaacauacaugcgccagaucgacaccaccgacgccgccgcugaggccaucgacugcgcccucccccaagaguucgucuccugguucgcaucaaacgcauucaccguacagucagaagcccuccuucucagauaccgcaacacccucaccggccaacuccucuucgaauguaaacuuuacucagaagguuacaucgcccuauccuauuccggcuccggcgcccugaccuuccccaccgacggcuucuucgaagucgucucauggguaccucgacuauaccaacucgcauccguaggaucccuagccacaggucgcacccucaaacaauaa

SEQ ID NO: 35661 - RNA, 1626 nt, Artificial Sequence
  derived and/or modified sequence opt11 from major_capsid_protein_VP1__Norovirus__AEE10018
augaggauguccgacggcgcagcccccaaagccaacggcucagaagccuccggccaggaucuuguacccaccgccguagaacaagccguaccuauccaaccaguagcuggcgcagcccuugcagcaccagccgccggccaaaucaaccaaaucgaccccuggauauuccaaaacuucguacaaugcccacuaggcgaguucuccaucuccccacgaaacacccccggcgaaauccucuucgaccuagcccucggcccaggacuaaaccccuaccucgcccaccucuccgccauguacacaggauggguaggcaacauggaaguacaacucguccuagcaggcaacgcauucacagcaggaaaagucgucgucgcccucgucccacccuacuuccccaaaggaucacuaaccacagcccaaauuaccugcuucccccacguaaugugcgacguccgcacacucgaacccauccaacuaccccuacuagacguccgacgaguacucuggcacgcaacccaagaccaagaagaaagcaugcgccuaguaugcaugcucuacacaccgcuccgcaccaacagccccggcgacgaauccuucgucguauccggccgccuccuauccaaacccgccgccgacuucaacuucgucuaccuaaccccacccaucgaacguaccaucuaucgcauggucgaccugcccgucauucaaccccgccuaugcacccacgccagauggccagcccccguuuacggccuccuagucgaccccucccucccaucaaacccccaauggcaaaacggacgaguccgcguugacggcacccuacucggcaccacccccgucaguggauccuggguauccuguuucgcagccgaagccgccuacgaguuccaauccggaaccggcgaagucgccacauucacacuaauagaacaagacggcuccgccuacgucccuggcgaccgggccgcaccccuaggcuaccccgacuuuagcggacaacuagaaaucgaaguccaaaccgaaacuacaaaaaccggcgacaaacucaaaguaaccaccuucgaaaugguccucggcccagaaaccaacgucgaccaagcccccuaccaaggccgcgucuacgccaguguuaacgcagccgcaagccucgaccucguagacggacgaguccgcgccgucccccgcucaguauacuccuuccaagacguuauaccagaauacaaugacggccuccuagucccucucgccccaccuaucgggccauuccuacccggcgaaguacuacuuagguuccgcaccuacaugcgacaaaucgacaccacagacgcagccgcagaagccaucgacugcgcccuaccccaagaguucauauccugguucgccuccaacgcuuucaccguccaauccgaagcccuacuguuacgcuaccgaaacacccucaccggccaacuccuauucgaaugcaaacuauacuccgaaggcuacauagcccuauccuacucaggcucaggcgcucucacauucccaaccgacggcuucuucgaagucguauccugggucccuagacuauaccaacucgcauccgucggcucacucgcaaccggacgaacacucaaacaauaa

SEQ ID NO: 35662 - RNA, 1626 nt, Artificial Sequence
  derived and/or modified sequence opt11 from major_capsid_protein_VP1__Norovirus__AEE10021
augcgaaugagcgacggcgcagccccaaaagccaacggcucagaagccucaggacaagaccuaguaccaaccgccgucgaacaagccgucccaauccaaccagucgccggcgccgcccuagccgcacccgccgccggacaaaucaaccaaauagacccauggauauuccaaaacuucguccaauguccucucggcgaguucuccaucucaccacgcaacacccccggcgaaauucucuucgaccucgcucugggccccggacuaaaccccuacuuagcccaccucuccgccauguacacuggcuggguaggcaacauggaaguacaacucguccuugcuggcaacgcuuucacugcaggcaaagucgucgucgcccucguucccccauacuuuccaaaaggcucccuuaccaccgcccaaaucacguguuucccccaugucaugugcgacguccggacccucgaaccaauccagcucccccuccucgacgucagacguguccucuggcacgcuacccaagaccaagaagaaucaaugcgucucgucuguaugcucuacacccccuuaagaaccaacagccccggagacgaaucuuucgucgucagcggccgccuccuaucaaagccagccgccgacuucaacuucgucuaccuuaccccaccaauagaacgcaccaucuaccguaugguagaccuaccgguaauucaaccccgcuuaugcacccacgcacgcuggcccgccccagucuacggccuccuaguagacccgucacuacccuccaacccccaauggcaaaacggccgcguacgcguagacggcacccuccucggcaccacccccgucucaggcuccuggguaucaugcuucgcagcagaagccgccuacgaguuccaauccggaaccggagaaguagcuaccuucacgcucauagaacaagacggcucagccuacguacccggugaucgagccgcaccccuaggguacccagacuucuccggccaacucgaaaucgaaguacaaaccgaaacaacuaaaaccggagacaaacuuaaagucaccacguucgaaaugguucucgguccagagaccaacgucgaccaagcacccuaccaaggccgcguauacgccucagucaacgccgcagccuccuuagaccuagucgacggacgcguaagagcagucccccgcuccgucuacuccuuccaagacguaauuccugaauacaaugacggccuccucgucccccucgccccacccaucggccccuuccucccaggcgaaguccuacuccguuuccgaacauacaugcgucaaauagacacuaccgaugcagccgccgaagccaucgacugcgcacucccacaagaguucguauccugguucgccuccaacgccuuuaccguccaaucagaagcccuccuacuccgcuaccgaaacacccucacuggacaacuccuauucgaauguaaacuauacucggaaggauacaucgcccuaagcuacuccggcuccggcgcacuaaccuuccccaccgacggcuucuucgaaguagucuccugggucccacgccuauaccaacucgcaagcgucggcagccucgccaccggccgaacccucaaacaauaa

SEQ ID NO: 35663 - RNA, 1626 nt, Artificial Sequence
  derived and/or modified sequence opt11 from major_capsid_protein_VP1__Norovirus__AEE10024
augcguauguccgauggcgccgccccaaaagcaaacggaucagaagcguccggacaagacuuaguccccacagcagucgaacaagccgucccaauacaacccgucgcaggcgcagccuuagccgcucccgcagccggccaaaucaaccaaauagacccauggaucuuccaaaacuucguucaaugcccccuaggcgaguucucaaucucaccuaggaacacaccaggcgaaauacuuuucgaccucgcacuuggaccuggacuaaacccauaccuagcccaccucucagccauguacaccggcugggucgguaacauggaaguccaacucguccuugcaggaaacgccuucaccgcuggcaaagucgucgucgcccucgucccacccuacuuccccaaaggcucccucaccacagcccaaauaacgugcuucccccacgucaugugcgacguacgaacccuugaacccauacaacucccccuccuugacguccgccgaguccucuggcacgcgacccaagaccaagaagaaucaaugcgccuagucugcaugcucuacacaccccuccgcaccaacucccccggggacgaaucauucguugucuccggccgacuccuaucuaaaccagcagccgacuuuaacuucguauaccucaccccacccaucgaacgcaccaucuaccgaaugguugaccuacccguaauccaaccccgacuaugcacccacgcccgcuggcccgcccccguguacggccugcuagucgacccaucccuccccucaaacccacaauggcaaaacggcagaguccacguagacggcacacuacuaggaaccacccccauuuccggcucaugggucucaugcuucgcagccgaagccgccuacgaguuccaauccggcaucggcgaaguagccacguucaaccucaucgaacaagacggcucagccuacacacccggcgaucgcgccgcgccccucggcuaccccgacuucucuggucagcucgaaauagaaguacaaacggaaaccaccaaaaccggugacaaacuaaaggucacuaccuucgaaauggcccucggccccaaaacgaacgucgaccaaacacccuaccaaggucguguauucgccucaaucacuguagcagccucccucgaucucgucgacggccgaguucgggcugucccccgcagcguauauggauuccaagauaccauccccgaauacaacgacggccuccucgucccccucgccccucccaucggacccuuccucccaggcgaaguacuauuaagauuccgcacauacaugcgucaacucgacgccaccgacgccgccgcagaagccaucgacugcgcccucccccaagaguucgucuccugguucgccucuaacgccuucaccguacaaucugaagcacuccuacuucgcuaucguaacacacucaccggacaacuccuuuucgaaugcaaacuuuacucagaaggcuacaucgcacuauccuacuccggcuccggaccccugaccuuccccaccgacgguuucuucgaagucgucucuuggguaccacgccuauaccaacucgccucuguaggaucgcucgccaccggaagaacccucaaacaauaa

SEQ ID NO: 35664 - RNA, 1626 nt, Artificial Sequence
  derived and/or modified sequence opt11 from major_capsid_protein_VP1__Norovirus__AEE10027
augcgcaugagcgacggcgcagcccccaaagccaacggauccgaagcuagcggacaagaccucguccccaccgcagucgaacaagccgucccaauacaacccgucgccggcgcagcccucgccgcucccgccgccggccaaaucaaccaaauagacccuuggaucuuccagaauuucguccaaugcccacucggagaauuuucaaucucuccccgcaacacaccaggugaaauacucuucgaucuugcccucggcccuggacuaaaccccuaccuagcccaccuauccgccauguacaccggcugggucggcaacauggaaguccaacucguccucgccgguaacgccuucaccgccgguaaaguaguugucgcucucgucccucccuacuuccccaaagguucacuuacuacagcacaaauuacaugcuucccccaugugaugugcgaugucagaacacucgaaccaauucaacucccccuccucgacguacgacgcguccuuuggcaugcaacccaagaccaagaagaauccaugcgacucgucugcaugcucuacacaccccuccgcaccaacucucccggugacgaauccuucgucguauccggccgacuacuuucaaaaccagccgccgacuucaacuucguuuaccucaccccacccaucgaacgcaccaucuaucguaugguugaccuacccgucuuacaaccccgccucugcacccacgcccgauggcccgcccccguauacggucugcucgucgaccccucccuccccuccaacccccaauggcaaaacggccgaguccacgucgacggcacccuucuuggaaccaccccuguuucaggcuccugggucucaugcuucgccgcagaagccgccuacgaguuccaauccggcacaggcgaagucgccaccuucaccaugaucgaacaagacggcuccgcauacguacccggcgaccgcgccgcaccccucggcuaccccgacuacucaggccaacuugaaauagaaguccaaaccgaaaccacaaaaaccggcgacaaacuucgcgucacaaccuucgaaaugauacucggacccaccaccaacguagaccaagccccauaccaaggaaaggucuacgccagccuauccacaagcgcaucacuaaaccucgucgacggccgcguuagggccguuccccgcucaguuuacuccuuccaagacguccuccccgaauacaacgauggccuccuagucccucuugcuccaccccucggccccuuccuacccggcgaaguucuucuucgcuuccgcacuuacaugcgccaacuagacaccgccgacgcaaccgcucaaccaaucgacugcgcacucccccaagaguucaucuccugguucgcuuccaacaacuuuacuguccaauccgacgcccuucuaauucgcuaucguaacacccucacuggccaacuccucuucgaagccaaacucuacuccgaagguuacaucgcagucuccuacuccggaucuggcccccucacauucccuaccgauggcuucuucgaaguggucuccugggucccccgccuauuccaacucgccuccgucggaagccucgccacuggccgcacccucaaacaguaa

SEQ ID NO: 35665 - RNA, 1608 nt, Artificial Sequence
  derived and/or modified sequence opt11 from major_capsid_protein_VP1__Norovirus__AGI96385
augaaaauggccucuaacgacgccgcccccuccaacgacggcgcggccggccuugucccagaagucaacaacgaaacaauggcccucgagccagucgcaggagcuucaaucgccgcaccccuaacaggccaaaacaacgucaucgaccccuggauucguaugaacuucguacaagccccaaacggcgaguucaccgucuccccucgaaacuccccaggcgaaguacuacuuaaccucgaacucggccccgaacucaacccauuccucgcccaccucucccgaauguacaacggcuacgccggcggcgccgaaguccagguccuccuagccggcaacgccuuuaccgcagguaaacuugucuucgccgccauaccuccccacuuccccuuagaaaaucuaucccccggacaaauaacaauguucccccacgucaucaucgacguccguacgcucgaacccguccuccuaccucuaccagacguccguaacaacuucuuccacuacaaccaacaacccgaaccccgcaugcgccucguagccaugcuauacacaccccuacgcuccaacgguuccggugacgacgucuucacagucuccugccgcguccuuacacgacccucccccgacuucgacuucaacuaccucgucccacccaccgucgaauccaaaacuaagccauucacucuacccauacucaccaucggcgaacucuccaacucccgauucccaguccccaucgacgaacucuauaccucucccaacgaaggcgucaucguccaaccacaaaacggccgcucaacacuugacggcgaacuccuaggcacaacccaacuuguccccuccaacauuugcgcccuucgcggccguauaaacgcccaagucccugacgaccaccaccaauggaaccuacaaguaaccaaugcaaacgggaccagcuucgacccaacggaagaugucccuacaccucucggcacccccgacuuccucgccaacaucuacggagucaccucacaacgaaaccccgauaauaccugccgagcacacgauggcguccucgccaccuggucccccaaguuuacacccaaacucggcuccgucguacucggcaccugggaagaauccgaccucgaccuaaaccaaccaacuagauucaccccugucggccucuacgacaccaaccacuucgaucaguggauucuucccaauuauuccggucgccuaacacucaacaugaaccuagcccccucagucgcaccccucuuccccggagaacaaauacuauucuuccgcucacacaucccccuaaaaggaggcacuuccaacggcgccauagacugucuacuaccccaagaauggauccaacacuucuaccaagaauccgccccaucccccacagauguugcccucauccgcuacaccaacccagacaccggccggguacuguuugaagccaaacuccaccgacaaggauucaucacugucgccaauucaggauccagacccaucgucguaccucccaacggauacuuucgcuuugacucguggguaaaccaguucuacucccuugcccccauggguacaggcaacggccgacgccgcguacaauaa

SEQ ID NO: 35666 - RNA, 1644 nt, Artificial Sequence
  derived and/or modified sequence opt11 from major_capsid_protein_VP1__Norovirus__AGI96397
augaaaauggccuccaacgacgccgcacccucaaacgacggagcagccaaccucguccccgaagcaaacaaugagguaauggcccucgaacccgucgucggcgccuccauagccgcacccgucgucggccaacaaaacaucaucgacccguggauccgcgaaaacuucguccaagcaccacaaggagaguuuaccguaucaccccgcaacuccccaggagaaaugcuccuuaacuuagaacucggccccgaacucaaccccuaccucucccacuuaucccgaauguacaacggauacgcgggcgguaugcaaguccaagucguccucgcgggcaacgcauucacagccggaaaaauaaucuucgccgccgucccaccccacuuccccgucgaaaacaucaacgccgcucagaucacaaugugcccacacgucaucguugacguccgccaacucgaaccaguacucuuaccacuaccagacauuagaaaccgcuuuuuccacuacaaccaagaaaacaccucccggaugagacuggucgcaaugcucuacacgccccuacgcgcuaacuccggcgaagaugucuucacugucuccugccgcguccugacccgacccgccccagacuucgaguucaccuuccucguacccccaaccgucgaauccaaaacaaaaccauucucacuacccauccuuacucucggggaacucucaaauucacgcuuccccgccccuaucgacaugcucuacaccgaccccaacgaaggaauagucguccaaccacaaaacggacgaugcacccuugacggcacccuacaaggcacaacacaacucgucccaacacaaaucugcgcuuuccgcggaacacucaucggccagaccucccguucgccagacuccacugacucagccccacgacgacgcgaccaccccuuacacguccaacucaaaaaccuagauggcacccaauacgaucccacagacgaaguccccgccguacuaggcgcaaucgacuucaaagguaccgucuucggcgucgccucccaacgugacgucuccggacaacaagucggcgccacccgcgcccacgaaguccacaucaacacaacugacccccgcuacaccccaaaacuaggcuccauacucauguacucugaauccgacgacuucgucaccggccaacccguccguuucaccccaaucggcaugggcgacaacgacuggcaccaaugggaacucccagacuacccuggccaccucacccucaacaugaaccucgcucccgcaguugcccccgccuucccuggugagcgaauccucuucuuccgcuccauaguaccauccgcaggcggcuacgguucuggucaaaucgacugccuaaucccucaagaauggguccaacacuucuaccaggaagccgcccccucccaaagcgccguagcccucauccgauacgucaacccagacacaggccgcaacaucuucgaggcgaagcuccaccgcgaaggauucaucaccgucgcaaacagcggcaacaaccccauagucguuccacccaacggguacuuccguuucgaagcauggguaaaccaguucuacacccuaacccccaugggcaccggucaaggccggcgccgcgaccaauaa

SEQ ID NO: 35667 - RNA, 1608 nt, Artificial Sequence
  derived and/or modified sequence opt11 from major_capsid_protein_VP1__Norovirus__AGI96398
augaaaauggccagcaacgacgccgcuccuucaaaugacggugccgccggccucguccccgaaguuaauaacgaaaccauggcccucgaacccguagccggcgccuccaucgcagcuccccucaccggccaaaacaacguaaucgaccccuggaucagaaugaacuucguccaagcccccaacggcgaguucaccguaucacccagaaauucaccaggggaaguccuccucaaccucgaacuaggucccgaacuaaaccccuuucucgcccaccucucccgaauguacaacggcuacgccggcggcgucgaaguacaaguccuacucgccggcaacgccuucaccgccggcaaacucgucuucgccgccauacccccacacuuuccccuagaaaaucuuuccccaggccaaaucaccauguucccccacgucaucauagacguuagaacccucgaacccguacuccucccccucccagacguccgcaacaacuucuuccauuauaaccaacaacccgaaccccguaugcgccuaguagccaugcucuacacaccacuacgauccaacgguuccggagacgacgucuucacagucuccugccgcguacuaacacgcccaucccccgacuuugacuucaauuaccuaguaccucccaccgucgaaucuaaaacaaaaccauucacccuaccaauacuaaccauaggcgaacucucaaauucgcgauuccccguacccaucgacgagcuauacaccucucccaacgaagguguaauagugcaaccacaaaacggccgcuccacccuugacggcgaacuccugggcaccacccaauuagucccuuccaacaucugcgcacuucgcggccgaaucaacgcccaaguacccgacgaccaccaccaauggaaccuacaaguaacaaacgcaaacggcacgucauucgaccccaccgaagacguaccagcaccccucggcacccccgauuuccuagccaacaucuacggcgucaccucccaacgaaacccugacaacacuugccgcgcccacgaugguguccuagccacauggucccccaaauucacacccaaacucggcuccgucguccuaggcaccugggaagaauccgaccuagaccucaaccagcccacacgcuucacacccgucggccuauaugauaccaaccacuucgaccaauggauucuucccaacuacuccggccgacucacacuaaacaugaaccucgccccauccgucgcuccccucuucccgggcgaacaaauacuauucuuucgaucccacaucccccuaaaaggugguaccucuaacggcgcaaucgacugcuuacuaccacaagaauggauucaacacuucuaccaagaauccgccccaucccccaccgacgucgcacuaauaagauacaccaaccccgacaccggccgcguccucuucgaagccaaacuacaccgccaaggauucauaacugucgcaaacucaggcagccgacccaucgucgucccacccaacggcuacuuccgauucgacuccugggucaaccaauucuacucacuagcacccauggguaccggaaacggccgacgccgcguacaauag

SEQ ID NO: 35668 - RNA, 1608 nt, Artificial Sequence
  derived and/or modified sequence opt11 from major_capsid_protein_VP1__Norovirus__AGI96399
augaaaauggcaucaaaugacgcagcccccuccaacgacgacgccgcgggacugguuccagaagucaacaacgaaacaauggcccucgaacccgucgcaggcgcuucuaucgcagccccucucaccggccagaacaacguaaucgaccccuggauccgaaugaacuucguccaagccccaaacggcgaguucacagucuccccacgcaacagcccuggcgaaguccuccucaaccuagaacucggccccgaacucaaccccuuccucgcccaccucagccgcauguacaacggguacgccggaggcguagaaguccaaguccuccuagccgggaacgccuucaccgccggaaaacucgucuucgccgcaaucccaccacauuuuccacuagaaaaccucucccccggccaaaucacuauguucccccauguaauaauagacguacgcacacuagaaccaguccuccucccacuccccgacguccgaaacaacuucuuccacuacaaccaacaacccgaaccacgcaugcgccuagucgcuaugcucuacaccccacuccgcuccaauggcagcggugacgaugucuucacagucucaugccgcguacucacccgacccucacccgauuucgacuucaauuaccucguacccccuaccguggaauccaaaacgaagccguucgcccucccaauccucacaaucggcgaacucuccaacucccgcuuccccguuccaaucgacgaacucuacaccucccccaaugaaggcgucauaguccaaccacaaaacggcagauccacacucgauggagaacuacucggaaccacacaacuuguccccuccaacaucugcgcacuccgaggccgaauaaacgcacaaguacccgaugaccaccaccaauggaaccuccaagucacuaacgcaaacggcaccuccuucgaccccacagaagacguucccgcaccacucgguacccccgacuuucucgccaacaucuacggagucaccucccaacgcaaccccgacaauaccugccgagcucacgacggcguacuugccacauggucccccaaauucaccccuaaacucggcucaguuguccucggaaccugggaagaaucagaccucgaccuaaaccagcccacucgauuuacccccguuggucucuacgacacuaaccacuucgaucaguggauccuucccaacuacucaggccgccuaacccucaauaugaaccucgcacccuccguugcaccacucuuccccggcgagcaaauccucuucuuccgaucccacaucccacuaaaaggcggcaccuccaacggcgccauagacugccuccuaccucaagaauggauccaacacuucuaccaagaaucagccccaucacuuaccgauguagcacucauccgauauacaaacccagacacaggucgcguccucuucgaagccaaacuccaccgacaaggcuucaucaccgucgcaaauuccggaucccgaccaaucgucgucccacccaacggcuacuuccgcuucgacaguuggguuaaccaauucuacucacucgcccccaugggcaccggcaacggacgccgacgaguacaguaa

SEQ ID NO: 35669 - RNA, 1617 nt, Artificial Sequence
  derived and/or modified sequence opt11 from major_capsid_protein_VP1__Norovirus__AGJ52175
augauggccuccaaagacgcuccuacuucccccgacggagccuccggugcaggucagcuagucccagaagcgaacaccgccgaacaaaucuccauggacccaguagccggcgccucgaccgccgucgccaccgccggccaagucaacaugaucgacccuuggauauucaacaacuucguccaagccccacaaggagaauuuacaaucucaccuaacaacaccccaggcgacauccucuucgaccuucaacuuggcccccaccuuaaccccuuccuagcccaucucucucaaauguacaacggaugggucggcaacaugcgagucagaauccuccucgccggcaacgcauucacagcuggcaaaaucaucaucugcugcgucccucccggcuucgacgcccgcauccuuaccaucgcccaagccacacucuucccccaucucaucgccgacguacgcacccuagaacccguagaacuaccccucgaagacguucgcaauguacucuaucauaacucuucacaaccgcaacccaccaugcgccuaguagcaaugcuauacacaccccugcgaacgggcggcggcucuggagguaccgacgcuuucguugucgccggacgaguccuuacaugccccgcccccgacuucuccuuccucuuccucguacccccgucagucgaacaaaagacccgcgucuucuccguucccaacauuccacucaaagaccucuccaacucacgagucccaguccccauacaaggcauguucaugucuccagacguuaaccaauccguccaauuccaaaacggccgcugccaaauagacggccaacuccaaggcacaaccccaguaucucucucccaacucugcaaaauacgcggaaaaaccuccucaaacgcccgaguacuaaaccuaagcgaagucgacggaaccccauucauaccccucgaauccccugccccugucggcuuccccgaccuagguggcugugacuggcacgucaacuucuccuuccaaacacaagaccgcgaccccucccaauccgucacauucgccaccaacgacgccucguucguccccuaccucggcucaguaucuccccacaauggugaaggcuuccaagcuggcgacaucaucggcucccuaggauggaucuccgcucccuccgacaacucacaauucaaugucugggccauucccaaguacggcuccucccuacaaaugucacccauccuccuccuccugugcucgccccgacucugggaagucauccucuacuucuacuccaccuucccaggaucaggucaacccucccaacuucaagucccaugccuacuaccccaagaguucaucacccacuucugcaacgaacaagccccaaucgcuggagaagcagcccuccuacacuacgucgaucccgacaccggacgcaaccuaggcgaguucaaacucuaccccgacggcuucaugaccugcguaccaaacucagucuccuccgguccccaaacacuucccaucaacggcguauucgucuucguaucaugggucucacgcuucuaccaacuaaaacccgucggcacagccuccgccgcacgccgccucggccuccgacgcaucuaa

SEQ ID NO: 35670 - RNA, 1641 nt, Artificial Sequence
  derived and/or modified sequence opt11 from major_capsid_protein_VP1__Norovirus__AGX01092
augaugauggccagcaaagacgcuccccaauccgccgauggagccucaggcgccggccaauuagucccagaaguaaacaccgcagauccacuucccauggaaccaguggccggcccgaccaccgccgucgccaccgccggccaagucaacaugaucgaccccuggauaguaaacaacuucguccaaucaccccaaggugaguucaccauuucccccaacaacacccccggcgacauccuauucgaccuccaacugggcccccaccuuaacccguuccucucccacuugucccaaauguacaacggcuggguaggcaacaugcgcguccggauccuacuagccggcaacgccuucuccgcaggcaaaaucaucguuugcuucgucccaccaggcuucaccucuuccucacucacaaucgcccaagccacacucuucccccacgucauagcagacguccguacccucgaacccaucgaaaugccccucgaagacgugcgcaacguccucuaucauaccaacgacaaccaaccaaccaugagacucgucuguaugcucuacacaccacuacguacugguggaggcuccggcucaagcgacucuuucguagucgccggccgaguacuaaccgcccccuccuccgacuucagcuuccucuuccucguaccacccaccaucgaacagaaaacccgugcauucacaguccccaacauaccucuccaaacacucuccaacucccgcuucccaucucuaauccaaggcaugauacuaucgcccgaugccucucaagucguccaauuccaaaacggacgaugccuaaucgauggacaacuacucggcacaaccccagccacaucaggucaacucuuccgcguccgagguaaaauaaaccaaggggcacgcacccucaaccucaccgaaguagacggcaaacccuuuauggccuucgacuccccagcccccgucggcuuccccgacuucggaaaaugcgacuggcacaugcgaaucucuaaaaccccuaacaacaccucaucaggagacccuaugcgaucagucuccguacaaaccaacguacaaggauucgucccucaccuaggcucaauacaauuugacgaaguuuucaaccacccaaccggagacuacaucggcaccaucgaauggaucagccaaccaucaacacccccaggaaccgacauaaaccucugggaaauacccgacuacggcuccucgcuaucccaagcagccaaccucgcacccccugucuuuccacccggcuucggcgaagcccuuguauacuucguaucagcauuccccggacccaacaacagauccgccccaaacgacgugccgugccuccucccccaagaauacaucacacacuucgucuccgagcaagcccccaccaugggagacgccgcacuccuacacuaugucgaccccgacaccaaccgcaaccucggcgaguucaaacucuacccuggaggauaccuaacaugcguccccaacggcgucggcgcaggaccccaacaacucccacucaacggcgucuuccuauucguuuccugggucucacgcuucuaccaacucaaaccagucggcacagcauccaccgcccgcggcagacuaggagucagacgcauauag

SEQ ID NO: 35671 - RNA, 1647 nt, Artificial Sequence
  derived and/or modified sequence opt11 from major_capsid_protein_VP1__Norovirus__AGX01095
augaaaauggcuagcaaugacgccgcccccuccaacgacggcgccgcaggucuaguccccgaaaucagcuccgaggccauggcacucgaacccguagccggcgcugccauagcagcuccccuaaccggacaacaaaacauaaucgacccauggaucaugaacaauuucguccaagcccccgggggugaguucacaguaucuccacgcaacagccccggggaaguacuacuaaaccuagaacuaggccccgaaaucaacccauaccuagcccaccuagcgcgcauguacaacggcuacgccggaggcuucgaaguccaagucguucuagccggaaacgccuucaccgccggaaaaauaauauuugccgccaucccucccaacuuccccaucgacaaccucucagccgcccaaaucaccaugugcccccacguuauagucgacguccgacaacucgaaccagucaaccucccaaugcccgacguacgaaacaacuucuuccacuacaaccaaggcuccgacuccagacuacgccucauagcuaugcucuacaccccacuccgcgccaacaacuccggcgacgaugucuucacagucucuugccgcguucugacccgucccagcccagacuucuccuucaacuuucucgucccgccuacagucgaauccaaaaccaaaccauucagccuacccaucuuaaccaucuccgaaauguccaacagccgauuccccguaccaauagacucacuccacaccagccccaccgaaaacaucgucguccaaugccaaaauggccgggucacccuagacggcgaacuaaugggcacuacccaacucuuacccucucagauuugcgccuuccgcggcacccuaacccgaucaacaucacgcgcaucagaccaagcagacacugccacaccccgucuauucaacuacuacuggcacauccaacucgacaaccucaacggcacccccuacgacccagccgaagauaucccagcacccuuaggcaccccagacuuccgcggcaaagucuucggaguagccucccaacgaaaucccgacgccaccacccgcgcccacgaagcaaaaauagauaccacauccggacgcuucacacccaaacucggcagucucgaaaucuccaccgaauccggcgacuucgaccaaaaccaacccacccgcuucacccccgucggcauuggcgucgaccacgaacccgacuuccaacaaugggcccuccccgacuacgcuggacaauucacccacaacaugaaccucgcacccgccguugcccccaacuuucccggcgaacagcuucucuucuuucgcucccaacuacccucauccggcggccgcuccaacggcauuuuagacugccucgucccacaagaauggguacaacacuucuaccaagaaagcgccccuucucagacccaagucgcccuaguacgauacgucaaucccgauacaggccgaguccucuucgaagccaaacuccauaaacuccgcuuuaugaccaucgccaaauccggagacuccccaaucaccgucccacccaauggcuacuucagauuugaauccuggguaaaccccuucuacacccucgcccccaugggcaccggcaauggaagacgccgcauacaauaa

SEQ ID NO: 35672 - RNA, 1623 nt, Artificial Sequence
  derived and/or modified sequence opt11 from major_capsid_protein_VP1__Norovirus__AGX01098
augaaaauggcuuccucagacgccaaccccucagacggcuccgcugcaaaccucguaccagaagucaacaacgaaguuauggcccuagaaccggucgucggagccgcaaucgccgccccagucgccggccaacaaaacgucaucgacccauggauacgcaacaacuucguacaagcccccggcggcgaguucaccgucucaccacguaacgcgcccggagaaauacuaugguccgcuccacucggccccgaucucaacccuuaccucagccaccuggcccgaauguacaacggauacgccggcggcuucgaaguccaaguaauacucgccggcaacgcauucacggccggaaaagucauauucgcagcaguacccccaaacuuucccaccgaaggccuuucccccucccaaguaaccauguucccacacaucgucguagacguccgccaacucgaaccaguccuaauaccccucccagacguccgaaacaacuucuaccacuacaaucaaucaaaugaccccacaaucaaacucauagccaugcuauauacuccccuccgcgccaacaacgccggagaugacguuuucaccguuuccugccgcguacucacccgcccauccccagacuucgacuucauauuccucguacccccaaccgucgaaucccguacaaaacccuucuccguccccguccucaccgucgaagaaaugacaaacagccguuucccuauacccuuagaaaaacuauucaccggccccucauccgccuucgucguccaaccccagaacggacgcugcaccaccgacggugucuuacucggcacaacacaacucagucccgucaacaucugcacauuccgcggcgacgucacccacaucaccggaucccgaaacuauacaaugaaccucgcaucccaaaacuggaacaacuacgacccaaccgaagaaauacccgccccacucggcgcgcccgacuucgucggcaaaauccaaggaguccuuacccagaccacccgcaccgacggcuccacacgcggccacaaagcaacuguauacaccggcuccgccgacuucgcacccaaacucggacgcguccaauucgaaacagacaccgaccacgacuucgaaguaaaccaaaacaccaaauucacgccaguaggcgucauccaagacgguggaacaacacaccgcaacgaaccacaacaauggguccuuccauccuacuccggacgaaacacacccaacguccaccuagccccagccgucgcaccuaccuucccaggcgaacaacuccucuucuuccgaucgacaaugcccgguugcuccggcuacccaaacauggaucucgacugccuccuuccccaggaauggguccaauauuuuuaccaagaagcagccccagcccaauccgacguagcccuccuccgcuucgucaaccccgacaccgggcgcguccucuuugaaugcaaacuacauaaauccggcuacguaaccgucgcacacaacggccaacacgaccucguaaucccacccaacggcuacuuccgauucgacuccugggucaaccaauucuacacucuugcacccaugggaaacgguaccggccgccgccgagcccucuaa

SEQ ID NO: 35673 - RNA, 1623 nt, Artificial Sequence
  derived and/or modified sequence opt11 from major_capsid_protein_VP1__Norovirus__AKI30060
augaaaauggccuccaacgaugccgcacccuccaacgacggcgcagccggacuuguccccgaaggcaacaacgaaacacuaccccuugagccaguggcaggcgccgcaauagcagcucccgucacuggccaaaacaacaucauagaccccuggauccgaacaaacuucguccaagcaccaaacggcgaauucacagucuccccacgaaacaguccaggagaaauacuucucaaccucgaacucgguccagaccucaacccauaccucgcacaccuaucaagaauguacaacggcuacgccgguggcguggaaguccaaguccuccucgccggcaacgcauucacagcaggaaaaauucuauucgccgccgucccccccaacuuccccgucgaauuccuauccccagcccaaaucacuaugcucccacaccucaucguugacguucgaacccuagaacccauaaugaucccccuccccgauguccgcaacacauucuuccacuauuccaaccaaccaaacucacguaugcgccucguugcuaugcuguacaccccccuacgcuccaacggaucaggggacgacgucuucaccgucuccugccgaguucucacccgcccaacccccgauuuugaauucaccuaucuaguaccucccuccguagaaagcaagacaaaacccuucucucucccaauccucacacuuuccgaacuaaccaacucccgcuuccccgucccaaucgauucacuuuucaccgcacaaaacaacguacuccaaguacaaugccaaaacggccgcugcacccucgacggagaacuccaaggcaccacccaacucuuacccuccggcaucugugccuuccgcggacgagucaccgcccaaaucaaccaacgcgaucguuggcacaugcaacuccaaaaccucaacggaaccaccuacgaccccaccgacgacguccccgcaccauuaggaacccccgacuucaaaggcgucgucuucggcauggucagccaacgcaacgucggcaacgacgcacccggcuccacucgcgcccaacaagccugggucuccaccuauuccccccaauucguccccaaacuuggcuccaucaacuuacgcaucuccgacaacgacgacuuccaauuccaacccacaaaauucaccccaguuggugucaacgacgacgacgacggccacccauucagacaaugggaacuccccaacuacucaggcgaacucacccucaacaugaaccuugcaccucccgucgcaccaaauuuccccggcgaacaacuccuauucuuccgcagcuucgugccaugcagcggaggauacaaccaaggcauaaucgacugucuaauuccucaagaauggauacaacacuucuaucaagaaucugcccccucacaaagcgaugucgcacuaauaagauacguaaaccccgacaccggacgaacacucuucgaagccaaacuccaccgcuccggauacauaaccgucgcccacaguggcgacuacccacuagucgucccagccaacggccacuucagauucgacucaugggucaaccaauucuacucccucgccccaaugggcaccggcaauggccgccgucgcgcccaguaa

SEQ ID NO: 35674 - RNA, 1626 nt, Artificial Sequence
  derived and/or modified sequence opt11 from major_capsid_protein_VP1__Norovirus__BAQ94514
augaaaauggccucaaacgacgcugccccaucaaacgauggagccgccucacucguucccgaagccauaaacgaaaccaugccccuugaacccgucgccggcgccuccauagcagcucccgucgccggccaaaccaacaucaucgacccauggauacgcacaaacuucguucaagcccccaacggcgaguucacugucagcccucgcaacuccccaggcgaaauccuccucaacuuagaacuaggccccgaucuuaaucccuaccucucccaucucucccgaauguacaacggcuacgccggugguguagaaguccaaguacuacucgccggaaacgcauucacagcaggcaagauacucuucgcagccauaccacccaacuuccccgucgacaugaucagccccgcccaaaucaccaugcuaccccaccugaucgucgacguacgaacacucgaaccaaucaugaucccccuccccgacguccgaaacguauucuaucacuucaacaaccaaccacaaccacgaaugcgccuuguagccaugcucuacaccccucucaggucuaacggcagcggcgacgacgucuucacaguaucaugccgcguucuaacacgaccaacaccggacuucgaguucuucuaccucguacccccgucagucgaaucuaaaaccaaauccuucacccucccuauccucaccauaagcgaaaugaccaacucccgcuuccccaucccuaucgaacaacucuacaccgcccccaacgaaacgaacgucguccaaugccaaaacggccgcugcacacucgauggagaacuacaaggcacuacacaacuccuaucaucagccaucugcuccuaucgcggucgaacacuagcuaacaaugacucaugggaccaaaaucuccuccaacuaagcuacccaaacggcgcuucauacgaccccacugacgaagucccagcaccacuagguacccaagacuucucaggcauccuuuacgguguccucacacaggacaaugucacagaaggcacuggcgaagccaaaaacgccaaagguaucuacauaucaacuacuuccggaaaauucacccccaaaauaggcucuaucggacuccacuccaucacuggcgacguccaucacaaccaacaaucacgauucacccccgucgguauagccguuaacgaaaacacccccuucaagcaauggguccuaccccacuacuccggcucauuagcccucaacacaaaccucgcccccgccgucgcgcccacuuuccccggcgaacaacuacucuucuuccgcucccgcgucccaugcguucaaggacuacauggccaagacgccuucaucgacugccuccucccccaagaaugggucaaccacuucuaccaggaagccgcacccucccaaaccgacgucgcccucauccgcuucgucaacccagacaccggccgaacccucuucgaagcuaaacuccaccgcucaggcuucauaacggucucccacaccggcaacuacccucucgucauucccccuaacggccacuuccgauucgacucaugggucaaccaauucuacucccucgcuccuaugggaacaggcaacggccgacgucgcauccaauaa

SEQ ID NO: 35675 - RNA, 1626 nt, Artificial Sequence
  derived and/or modified sequence opt11 from major_capsid_protein_VP1__Norovirus__BAQ94516
augaagauggccucaaaugacgcagcccccuccaacgacggagcugccucacucguccccgaagccaucaacgagaccaugccccuugaaccggucgccggcgcuuccauagcugccccuguagccggccaaaccaauaucaucgacccauggauccgcaccaacuucguccaagcaccaaacggagaguucacaguauccccucgaaacucacccggcgaaauucuauuaaaccuggaacucggucccgaccucaaccccuaccucucccaucuuucccgcauguacaacggauacgccgguggugucgaaguccaaguccuccucgcuggaaacgccuucaccgccggcaaaauccuauuugccgccaucccacccaacuuucccguagacaugauaucccccgcacaaaucaccaugcucccacaccucaucguugacguccgaacccuagaacccauaaugaucccccuuccagacguccgcaacgucuucuaccacuucaacaaccaaccccaaccccgaaugcggcucgucgcaaugcuauacacuccccuccgaucgaacggcuccggcgacgacgucuucaccgucuccugccgcguccucacacgccccacccccgacuucgaguucuucuaccuagucccacccucugucgaauccaaaaccaaacccuuuacccuccccaucuuaacaaucuccgaaaugacaaauagccguuuccccauccccaucgaacaacucuacaccgcucccaacgaaaccaacguaguucaaugccaaaacggccgcugcacccuagacggcgaacuccaaggaaccacccaacuacuaucaucagcuaucuguuccuaucgcggacgcacccucgccaacaacgacuccugggaccaaaaccuccuacaacucuccuaccccaacggcgccuccuacgaucccaccgacgaaguccccgcaccccuuggcacccaagacuucuccggaauccuguacggcguucuaacccaagauaacguaaccgaagguaccggcgaagccaaaaacgccaaaggaaucuacauuucaacuacauccggcaaguucacucccaaaaucggaucaaucggacuccacuccaucacaggagacguccaccacaaccaacaaucacgauuuacaccagucggcaucgccgucaacgaaaacacccccuucaaacaauggguccucccccacuacagcggaucacucgcccuaaauaccaaccuagcccccgccgucgccccaaccuucccaggcgagcaacuacucuucuuccgaucacgcgucccuugcguucaaggccuccacggccaggacgccuucaucgacugccuccucccccaagagugggucaaccauuucuaucaggaagccgcccccucacaaacugacgucgcacuaauccgauuuguuaacccagacaccggccgcacccucuucgaggccaaacuucaccgcucaggcuucauuaccguaucacacaccgguaacuacccccuugucauuccacccaacggccacuuccgcuucgacucaugggucaaccaauucuacucacuagcccccaugggaacaggcaacggacgacgccggauccaauaa

SEQ ID NO: 35676 - RNA, 1629 nt, Artificial Sequence
  derived and/or modified sequence opt11 from major_capsid_protein_VP1__Norovirus__BAQ94520
augaaaauggccagcaacgacgcagcucccuccaacgauggcgcagccucccuaguccccgaagccaucaacgaaaccaugccccuagaacccguagccggagccuccaucgcagcccccguagccggccaaacuaacauaaucgacccauggauacgcacgaacuucguacaggcccccaacggcgaguucaccgucucaccccgaaacucccccggcgaaauccucuuaaaucuagaacuuggaccugaccucaaccccuaccucgcucaccuaucucgcauguacaacggauacgccggcggaguagaaguccaaguacuccucgcaggcaacgccuucaccgcuggcaaaauucucuuugcagccaucccacccaacuucccaguagacaugaucucacccgcgcaaauaacuaugcucccccaccuaauagucgacguccgcacacucgaacccauaaugaucccccuaccagauguacgcaaugucuucuaccacuuuaacaaccaaccccaaccccggaugagacucgucgccaugcucuacacaccccuccgcuccaacggcuccggugacgacgucuucaccguauccugucgagucuuaacccgaccaaccccugacuucgaguucaucuaccuagucccacccucagucgaaaguaaaaccaaaccauucacccucccaauucucacaaucuccgaacuaaccaacucuagauucccaauaccuaucgaacaauuauacacugcacccaacgaaaacaacgucguccaaugccaaaacggacgcugcacccuagacggcgaacugcaagguacaacccaacucuuauccuccgcagucugcuccuaccgcggccgcaccguagccaauuccggcgacaacugggaccaaaaccuacuccaacuuaccuacccauccggcgccuccuaugaccccacagacgaaguccccgcaccacucggcacacaagacuucuccggcauucucuacggcguacuaacccaggacaacgucuccgaacgaaccggcgaggccaaaaacgccaaaggcauuuacaucucaaccacauccggcaaauucaccccaaaaaucggcuccaucggccuccacucaauaaccgaaaacguccaccccaaccaacaaucaagauuuacacccgucggcgucgcccaaaacgaaaacacacccuuccaacaauggguacuaccccacuaugccggagcccucgcacucaacacaaaccucgcccccgccgucgcccccaccuucccuggagaacaacuauuauucuuccgcucccggguaccuugcguccaaggacuccaaggacaagaugcauucauagauugccuacucccccaagaaugggucaaccacuuuuaucaagaagccgccccuucccaggccgacguagcucucaucagauacguaaaccccgacacaggccgcacccuauucgaagccaagcuccaccgaucaggcuucauuaccgucucacacacaggcgccuacccccuagucguaccacccaacggccauuuccgauucgacuccugggucaaccaauucuacucccucgcccccaugggcacggguaacggccgucgccgcguucaauaa

SEQ ID NO: 35677 - RNA, 1629 nt, Artificial Sequence
  derived and/or modified sequence opt11 from major_capsid_protein_VP1__Norovirus__BAQ94524
augaaaauggccucuaacgacgcagcuccgagcaacgacggcgccgccucgcucgucccagaagccaucaacgaaaccaugccucuugaacccgucgccggcgcaucaauagccgcacccgucgcaggccagaccaacaucaucgacccauggauccgcaccaacuucguccaagcucccaacggggaauuuacagucuccccacgcaacucucccggcgaaauccuacucaaccucgaacucggaccugaccuaaaucccuaccuugcccaccucucccgaauguacaauggauaugcaggcggaguugaaguccaaguccuccuagccggcaacgcauucaccgccggcaaaauccuauucgccgcuaucccaccaaacuucccggucgacaugaucucccccgcacaaauaaccaugcuaccccacuuaauaguugacguccgcacccuagaacccaucaugauuccacucccagauguacgcaauguguucuaccacuucaacaaccaacaccaaccacgaaugcgacucguagcaaugcucuacaccccucuacgcucaaacggaaguggcgaugacguauucaccgucuccugccguguccuaaccagaccaacccccgacuucgaguucauauaccucguacccccaucagucgaauccaaaaccaaaccauucacccucccaauccucaccaucucugaacucacgaacucucgcuuccccaucccaauagaacaacucuacaccgcccccaacgaaaacaacgucguccaaugccaaaacggccgcugcacccucgacggcgaacuacagggcacaacacagcuccucuccucugccgucugcuccuaccgcggccggaccguagccaacuccggagacaauugggaccaaaaccuccuccaacuaaccuauccauccggcgccucuuacgaccccaccgacgaagucccagcaccccucgggacccaagacuucucuggaauccucuacggaguacuaacccaagacaacguaucagaacgcacaggugaagccaaaaaugccaagggcaucuacaucuccacuaccagcggcaaauucacacccaaaaucggaucaaucggccuccacucaaucaccgaaaacguccaccccaaucagcaaucccgcuucaccccggucggcgucgcccaaaacgaaaacacacccuuccaacaauggguacuaccccacuacgcaggcgcccuugcccugaacacuaaccuagccccugccgucgccccaacauuccccggcgaacaacuccuauucuucaggucacgugucccaugcguacaaggacuccaaggacaagacgcauucaucgacugucuccucccucaagaaugggugaaccacuucuaucaagaagccgcccccucacaagccgacguagcccuaauccgcuacgucaacccagacacaggccgcacacucuucgaagcuaaauuacaccgcuccggauucaucaccguaucccacaccggcgccuacccccucgucguacccccuaacggccacuuccgcuucgacucaugggucaaccaauucuacucacucgcccccaugggaacaggaaacggccgccgccgaguccaauaa

SEQ ID NO: 35678 - RNA, 1629 nt, Artificial Sequence
  derived and/or modified sequence opt11 from major_capsid_protein_VP1__Norovirus__BAQ94526
augaaaauggcaagcaaugacgccgcaccaaguaacgauggcgccgcaagucucgucccagaagcaaucaacgaaaccaugccccucgaaccagucgccggcgcauccaucgcagccccaguugcuggccaaacaaacaucauagaccccuggaucagaacuaacuucguacaagcaccaaacggcgaauuuacagucuccccucgcaacucacccggcgaaauacuccuaaaucucgaacuuggccccgaucuaaacccuuaucucgcacaccuuucccgcauguacaacggcuacgccggaggcgucgaaguccaagugcuacucgccggaaaugccuucaccgcuggcaagaucuuauucgcagccauucccccuaacuuccccguagacaugaucagccccgcccaaaucaccaugcuaccccaccuaauuguagacguccgaacccuugaacccaucaugauuccgcuucccgauguucgaaacgucuuuuaccauuucaacaaucagccccaaccacgaaugcggcucgucgccaugcuauacacaccacuacgauccaacggcuccggcgacgacgucuucacagucucaugucgaguccuaacgcgacccacaccagacuucgaauuuaucuaccuagucccucccuccguagaaucaaagaccaaacccuucacccuacccauccucaccaccuccgaacuaacaaauucgcgauuucccauccccaucgaacaacucuacaccgcacccaacgaaaacaacguaguccaaugccaaaacggccgaugcacacucgacggugaacuccaaggcaccacccaacuccuuuccagcgcagucugcagcuaccgcggccgaaccgucgcuaacuccggagacaacugggaucaaaaccuccuucaacucaccuaccccucaggcgccagcuacgacccuacagacgaaguaccugcuccccuuggaacccaagacuucuccggcauccucuacggcguccucacccaggacaacgucuccgaacggaccggagaagccaaaaacgcaaaaggcaucuacaucuccaccaccuccggcaaauuuaccccaaaaaucggcucaaucggucuccacucaauaaccgaaaacguccaccccaaccaacaaucccgauucacaccagucggcgucgcacagaacgaaaacacccccuuccaacaauggguacugccacacuacgccggcgcccuugcccucaacaccaaccuugcuccugccgucgcacccacauuucccggagaacagcuccucuucuuccgcucucgcguccccugcguccaaggccuacaaggucaagacgccuucauagacugccuccuaccccaagaaugggucaaccacuucuaccaagaagccgcccccucccaagccgacguagcccuaauucgauacgucaauccagacaccggccgcacguuauucgaagccaaacuccaccgcucaggauucaucacugucucccacaccggugcuuacccccuggucguucccccaaacggauacuuccgcuucgacucaugggucaaccaauucuacucacuugccccaaugggcacaggcaacggccgccgccgcguccaauaa

SEQ ID NO: 35679 - RNA, 1587 nt, Artificial Sequence
  derived and/or modified sequence opt11 from VP1_capsid_protein__Norovirus__ACV89840
augaugauggccuccucagacgccaccccacccagcgaaggcgccaccaaccuaguccccgaagucaauacucaaguaguaccccucgaaccagucgccggcgccgccgcugcagccccuuucaccggccaaaauaacguaauagaccccuggaucuuccaaaacuucguccaagcaccccaaggagaguucaccguaagcccacgcaacaccccaggcgaaauacuacuccgcaucccccucggccccaaccuaaaccccuucuuagcccaucucucacgaauguacaacgccuggguaggcggcauggaagccgaaaugauccuagccggaaacgccuucaccgccggaaaacuccuaaucguagcccucccacccgguuucgaagccacccaacucacccccgcccaagccaccgccuucccccacgucaucgccgacguacgaacacucgaaccaauccccaucccccucccagacauacgaaacgugcuuuuccacuacaacggugacccaacaccaacaauccagauagucgucaugcucuacacaccccuucgcaccaacgguaacggagacgacguauucaccguaucuggccgacuacuaacccgacccgcgcccgacuucagcuucuccuuccucguaccucccacagucgaacagaaaacacgauccuucacacuccccaacuuagccguauccgaccuaucaaauucacguuuccccgcccccgucaacaucuuacgcgcagacccuaacaccacccucgcccuugacuaccaaaauggccgcugcacucuagacggagcccuccaaggcaccacacccaccaacucauccuuccuaggcuaccucagaggaaccgucgaucgcgucaacuccgaccaaguccacguacaccuacgcgaacccaauggagaucccuuccaacucggccucccgggcccccaaggcguccccgacuaccgcgcgacccucgacauauacguagacugggaaaacaaaaaccacggcaauccuugcgagggcacacucaacaccggcucccaaacagaauacacccccggccucggcacccucaccuucaacaagacauccggcgacacuccagaacaaggcgaccccgucauaaugcgacucgucgcuuuccgaucaaaccucacagaccaacuccccgcauacaacggcgccuuuggacaaggcgaaaaccucgcuccacccguauccccacccguccccggagaagucuuccuccaauucggcucccgcuacacccgccucggugaacgcgaacucgccguucagugccuacuccccuccgaauggaucacacacuucuacuccgaagcagcccccauucaaggcgaagcaaugcuucuccgcuacguccaacccgaccuagggcgcauacucuucgaagcaaaacuuuacaaagaaggauucgucacagucgcuggcgguaccaaccccgucaccuuccccaucgacggcaccuucgucgccguauccuggguaucucguaacuucguacucucccccaugggcucaggccaaggaagacgccgcgcagcucuagccgaauaa

SEQ ID NO: 35680 - RNA, 1587 nt, Artificial Sequence
  derived and/or modified sequence opt11 from VP1_capsid_protein__Norovirus__ACV89843
augaugauggccucaucagacgccacacccccauccgaaggagccacaaaccuuguacccgaagucaacacccaagucgucccacuagaacccgucgccggcgccgccgccgcagccccauucacaggucaaaacaacgucaucgaccccuggaucuuccaaaauuucguccaggcuccccaaggagaguucaccgucucucccagaaauacaccaggagaaauccuccuacgcauaccccucggccccaaccuaaacccauuccuagcccaccucagccgcauguauaacgcuugggucggaggcauggaagcugaaaugauccuagccgggaaugccuuuaccgccggcaagcuccucaucguagcccuaccacccggcuucgaagcuacccaacuaacucccgcucaagccacagcauucccccacgucaucgccgacguccgcacccuugaacccauccccauaccccuacccgacauccgcaacguccuauuucacuacaauggagaccccacccccaccauccaaauagucgucaugcuuuacaccccacuccgaaccaacggcaacggcgaugacgucuuuaccgucuccggccgccuacucacacgccccgcacccgacuuuucauucuccuuccucguacccccuaccguagagcagaaaacccgcccauucacacuccccaaccuggcagucucagaccuuuccaacagccgcuuccccgccccugucaacauccuccgcgccgaccccaacaccacccucgcccucgacuaccaaaacggacguugcacacuugacggcgcacuacaagguacuacaccgaccaacucuucuuuccuaggauaccuccgcggcacagucgacagaguaaacuccgaccaaguccacguccaccuacgcgaacccaacggcgacccauuccaacuuggacuacccggcccacaagguguccccgacuaccgugcaacccucgacaucuacguagacugggaaaacaaaaaccacggcaacccaugcgaaggcacacucaacacuggcucacaaacagaauacacacccggccuaggcacccuaacguucaacaaaaccagcggcgacacgcccgaacaaggcgacccugucaucaugcgccucgucgcuuuccgcuccaaccucaccgaccaacucccagcuuacaacggagccuucggccaaggagagaaccuagccccucccgucucacccccaguacccggcgagguauuucuccaauucggaucccgauacacccgccucggagagagagaacuagccguccaaugucuacuccccucagaauggaucacucacuuuuacuccgaagccgcccccauccaaggagaagccaugcuucuccgcuauguacaaccagacuuaggucgcauauuauucgaagccaaacucuacaaagaaggcuucgucacagucgcaggcggcaccaaccccgucaccuuccccaucgacggcacauucgucgcagucuccugggucucccgcaacuucguacucucaccaauggguuccggccaaggccgccgccgagccgcacuagccgaauaa

SEQ ID NO: 35681 - RNA, 1767 nt, Artificial Sequence
  derived and/or modified sequence opt11 from VP1_capsid_protein__Norovirus__AFV48046
augcgccuccaaugggaagcauggcgcuccacauuccccggcaugcaaccacccugcgugggcugcggucuaggccccucacuucuccgcccccgucgcaucguacagcccuaccuacuaaugcgaaugucagacgccguccaccggggaaaugccgccgacacccagggcgccuccgccggagaaggaucaaaccucguccccucaaccgucgaucaagcaaucccaauacaacccgucgcaggcgccgcaauagccgccccaacggcaggacaaguaaaccaaauagacccauggauaagagaaaauuucguacaaugcccccucggugaauuuacaguaucccccagaaauacacccggcgaaguucucuucaaccucgcucucggucccggccuaaaccccuaccuaucacaucucgcagccauguauaccggauggguaggcaacauggaaguucaauuaguccucgccggcaaugcauucaccgcaggcaaagucguagucgccuuaauucccccauacuucaacaugcaaacccuuaccacaucccaaauaaccugcuuuccacacaucaugugcgacguccgcacccuagaaccuauccuccuaccacuccucgacguccgacgcacucuauggcaccccacaaacucagaagacgacacuaugcgccuagucugcaugcuauacacuccccuaagaaccaacuccccgggcgacgaaucauucgucguaucaggccgacuuuuaucccgccccucccucgauuucaacuuccuauaccuaaccccacccaucgcacaaacccccuacgaacucccuacaguaccccgcauggucccuuccgaaaugacccacagucgcuggcccgcccccauauaccaagucguagccgacccaucacucgucgccaacccucaauggcaaaacggccgcgucaccaucgacggccaacuacuuggcacaacucccaucucauccacaugggucugcuccauagccggaacugccgauuaccgcuacauagccggcaccgauucauucgaagaaugcaaacucgcacucucccaaccaaacggcucccccuucguaguaggugacgcccccgcgcccuacgguuacccagacuucaacgccaccaucagcuucucuuuccaagucgaaacccgccaaaacuccgcauacucaguccgugaguucucucuuacaaccagcucucaaaccauuaaccaaucccccuacacaggcaccgucuacauggaccgcuccgaaacccaagacuaccaauaccaagacgaccguauccgaggcgucccacacuccguccaaucauucaaagaccaacugcccgacuaugucgaaagcggccaaccaccaaaccucgcaccacccaucggacccuucaugcccggggaaguucuaguacgcuuccguaccuacguacgccaagaagccaccgccgcccucuaccaagaccaacccaucgacugugcccuuccccaagaguucguaacccaccucgccacccauggcuauacccuugguucggacgcccuccuacucagauaucgcaaccuccgcaccggccaacucaucugcgaagccaaacuguacgcugaaggcuuccucgccauaucauacuccggcaccggcccccuccaacuccccacagacggcguauucgaagucguuagcuggguucaacgucuauaccaacucgcuccugucggcaccucaacugcuggucgcucccucggauccuaa

SEQ ID NO: 35682 - RNA, 1767 nt, Artificial Sequence
  derived and/or modified sequence opt11 from VP1_capsid_protein__Norovirus__AFV48048
augagacuccagugggaagccuggcgcuccacuuuccccggcaugcaaccuccuugcgucggcugcggccucggccccucccuauuacgccccagacguaucguccaacccuaucuccuaaugcgaaugucagacgccguccaccgcggaaacgccgccgacacucaaggcgccuccgcaggcgaagggagcaaucuuguccccucaaccgucgaccaagcaauccccauccaaccugucgcuggugcagcaaucgcagcccccaccgcgggccagguaaaccaaaucgacccuuggauccgagaaaacuucguccaaugcccacuuggcgaguucaccgucucaccccgaaacacccccggugaaguccuuuucaaccucgcacuuggccccggccucaaccccuaccucucccaucuagcagccauguacacuggcugggucggcaacauggaaguacaacucauccuagccggaaacgcuuucacugcaggaaaaguuguagucgcccucauaccuccauacuucaacaugcaaacucucacaacaucacaaaucacaugcuucccccacauaaugugcgacgucagaacccucgaacccauacuccucccccuacucgauguacgcagaacccucuggcacccaaccaacucugaagacgacaccaugcgccuaguaugcaugcuauacacaccccuccgcaccaacucucccggagacgagagcuucgucguuagcggccgccuccugucccguccaucucuagacuucaacuuccucuaucucacaccacccauagcccaaacccccuacgaacuacccaccguccccagaaugauccccucagaaaugacccacucacgcuggccagccccaaucuaccaggucgucgccgaccccagccuccuagccaacccacaauggcagaacggccgaguaaccaucgacggccaacuacucgggaccaccccgaucucaagcacauggguaugcuccaucgccggaaccgccgacuacagauacaucuccggcucagacuccuucgaagaaugcaaacuagcccucucccaacccaacggcucacccuucgucgucggcgacgcacccgccccauauggauacccagauuucuccgccaccauaucuuucucauuccaaguagaaacgcgccaaaacuccgccuacucagucagagaguucucccuaaccaccuccucucaaacaaucaaccaaucacccuacaccgggaccgucuacauggaccguuccgaaacucucgacuaucaauaccaagacgaccgcauccgaggcguuccccacuccguccacgcauuccgcgaccaacucccggacuacguagaauccggccaaccacccaaccucgccccaccuaucggacccuucaugcccggagaaguacuccuccgauuccgcaccuacguccgccaagaagccacagcagcccucuaccaagaccaaccaaucgacugcgcccuuccccaagaguucgucacccaccucgccacgcacggauacacacuagguuccgacgccuuacuccuccgauacagaaaccucagaaccggccaacuaaucugcgaagccaaacuauacgcagaaggauuccucgccauuucauauuccgguacaggcccccuccaacuucccaucgauggcguauucgaagucgucuccuggguacaacgacuuuaccaacucgcccccgucggaaccucaacagcuggucgaagccucgccuccuga

SEQ ID NO: 35683 - RNA, 1623 nt, Artificial Sequence
  derived and/or modified sequence opt11 from VP1_capsid_protein__Norovirus__AGH06682
augaugauggcauccaaagacgcccccaccucuccagacggcgccagcggugccggacaacucgucccagaagccaacacugcagaacaaaucucaauggaccccguagccggcgccagcaccgcaguugccaccgccggucaagucaacaugauugaccccuggaucuucaacaacuucguucaagcaccccaaggagaauuuaccaucucccccaauaacacacccggagacauccucuucgaccuccaacucggcccacaccuaaaccccuuccuagcccaccuaucacaaauguacaacggcugggucggaaacaugcguguccgaauccuacuagccggaaacgccuucaccgccggaaaaaucauaaucugcugcguacccccaggcuucgacgcccggauccucacuaucgcccaagcaacccuauucccacaccuaaucgcagacguccgcacccucgaacccgucgaacucccacucgaagacguccgcaacguccucuuccacaacagcucccagccacaaccaacuaugcgccuagucgcaaugcuauacacaccccuacgaaccgguggcggaucggguggaaccgacgccuucgucgucgccggacgcguacuaaccugccccgcccccgacuucuccuuccucuuccucguucccccauccgucgaacagaaaacccgugucuucagcgucccuaacaucccccucaaggaccucuccaacucccgaguuccaguuccuguccaaggcauguucaugucacccgacguuaaucaauccguucaauuccaaaacggucguugucaaaucgacggccaacuacaaggcaccaccccagucucccuuucucaacucugcaaaauacgcggcaaaaccuccucaaacgcucgcguccuuaaccucuccgaaguagacggcacccccuucaucccccuagaauccccagcaccagucggcuuccccgaccucggagggugcgacuggcacgucaacuucaccuuccaagcucaaaaccaagaucccucacaaucagucacauucgcgaccaacgacgcguccuucguccccuaccuaggcucuaucagcccccacaacggcggcgacuuccacgcaggcgacauaaucggaucccuaggcuggaucuccgcacccagcgacaacagccaacucaacguauggaccauacccaaauacggcuccuccuuacccgauguuacacaccuagccccugccgucuuuccgccaggauucggagaagucauccuauacuucuacuccacauucccaggcucaggacaaucaucucaacuacaaguccccugucuccucccccaagaauuuauuacccacuucugcaacgaacaagcccccaucgccggcgaagccgcucuccuccacuacgucgaccccgauacaggccgcaaucuaggagaauuuaaacuauacccagacggcuucaugacaugcguccccaacuccgucucuucaggcccucagacacuuccaauuaacggcguauucguauucgucuccugggucucacgauucuaccaacucaaacccgucggcacagccucugccgcacgccgccucggacuacgccgcauauag

SEQ ID NO: 35684 - RNA, 1620 nt, Artificial Sequence
  derived and/or modified sequence opt11 from VP1_capsid_protein__Norovirus__AGL98413
augaaaauggcauccuccgacgcuaacccaucagacggauccgcagccaaccucgucccagaagucaacaacgaaguaauggcccuagaaccagucgucggcgcagccaucgccgcccccguagcaggacaacaaaacaucauugauccauggauacgaaacaauuucguccaagcccccggcggcgaauuuaccgucucaccccgcaacgcccccggggaaauccuaugguccgcaccacuaggacccgaccucaaccccuaccucucccaccuaagccgaauguacaacggcuacgccggcggcuucgaaguccaagugauacuagcagggaacgccuucacagcaggcaaaguuaucuucgcagcuguaccacccaacuuccccacugaaggccucuccccaucacagguaacaauguucccccacauaauaguagacguccgacaacucgaaccaguucuaauaccacucccugacguuagaaacaacuucuaccacuacaaccaagcccacgacuccacacucaaacucauagccaugcucuacacaccccuccgugcuaacaacgcuggcgacgacguuuucaccgucuccugccgaguccucacccgccccucacccgacuucgacuucaucuuccuugucccucccaccguggaaagcagaacaaaaccauucaccgucccaauacucaccgucgaagaaauguccaacucaagauucccuaucccccuagaaaaacucuacaccggccccuccuccgccuucgucguccaaccccaaaacggccgcugcaccaccgauggcguccuacuuggcaccacccaacuauccgcagucaacaucugcaacuuccgcggcgacgucacccgcgucggcacaucucaugacuacaccaugaaccucgucucacaaaacuggaacaacuacgacccaacagaagaaaucccggcaccccugggcacccccgacuucguaggcaagauccaaggccuccuaacucaaaccacccgagcagacggcuccacccgagcccacaaagccaccgucucuaccggauccguccacuucaccccaaaacucggcucuguccaauucacaaccgauaccgacaacgacuuucagaccggacaaaacacaaaauucaccccaguugguguaauccaagauggagaccaccaccaaaacgaaccccaacaauggguauuacccaacuacuccgguaccuccggccacaacguccaccuagcgccagcagucgccccugcuuuccccggagaacaacuccucuucuuucguuccaccaugcccggcugcuccggcuauccaaacaugaacuuagacugccucuuaccccaagaauggguccuacacuucuaccaagaagccgcucccgcgcaaucagacguagcacuccuccgcuucguaaacccagacaccggccgaguccucuucgaaugcaaauuacacaaauccggcuacaucacagucgcccacaccggcccauacgaccucgucaucccgcccaauggcuacuucagauucgauucaugggucaaccaauucuacacccucgcucccaugggcaauggcaccggacgaagacgcgcccuauag

SEQ ID NO: 35685 - RNA, 1620 nt, Artificial Sequence
  derived and/or modified sequence opt11 from VP1_capsid_protein__Norovirus__AGL98414
augaagauggcauccuccgacgccaacccaucugacgggucuucagccaaccucguccccgaaguaaacaacgaaguaauggcauuagaacccguuguaggcgcagccaucgcagcccccgucgccggacagcaaaacaucauagaccccuggauccgcaacaacuucguccaagccccaggcggagaauuuaccguuagcccccguaacgcccccggcgaaauccuaugguccgcaccacucucaccagaccuaaaccccuaccuuucacacuuaucacgcauguacaacgguuaugcaggcggcuucgaaguacaagucauccuagcuggaaacgccuucaccgcaggcaaaaucgucuuugcagcaguacccccgaacuuccccacagaaggcuugucacccagccaagucacgauguucccccacauaauagucgacguccgucaacuugaaccaguccuaaucccacuucccgacguccgaaacaacuucuaccacuacaaccaagccaacgacucaacacucaaacucaucgcuaugcuauacaccccacuccgcgccaacaacgccggcgacgacguuuucaccgucuccugccgcguccuaacccgacccucccccgacuucgacuucaucuuccucgucccacccacaguagaauccagaaccaaacccuucaccguccccguccuaacuguagaagaaaugacaaacucaagauuccccauuccccuagaacgauuauucacuggccccucaaccgcguuugucguccaaccccaaaacggccgcugcaccacugacggagugcuucucggcacaacacaacucuccgccguaaauaucugcaauuuccguggcgaagucaaccacaucgcgggaacccacgacuacaccaugcgacucaccucacaaaauuggaacaauuacgacccgaccgaagaaauacccgcaccccucggcacccccgacuucgucggccgcauacaaggcguccucacccaaaccacccgcucagacggcucaacacgaucacacaaagccacaguaucaaccggauccguccacuucacccccaaacuaggcuccgugcaauucaccacagacaccacaaacgaucucaacgccggccaaaacaccaaauucacacccgucggcguagagcaaaccagcggcgaccaccaaagcgaaccccaacaauggacccuccccaauuacuccggcacccccaaccacaacguccaccucgcccccgccguagcaccaaccuucccaggagaacaacuccucuucuuucgcagcacgcugccaggaugcgguggcuaccccaacaugaaccucgacugccuacuaccacaagaauggguacuacacuucuaccaagaagcagcuccagcccaguccgacguagcacuuuuacgcuucguaaaccccgauaccggacgcguccucuucgaaugcaaacuacaccgcuccggcuucauaacaguugcgcacucaggcucccacgaccuaguaauacccccaaacggcuacuuccgcuucgacuccugggucaaccaauucuacacacucgcccccaugggaaacggaucaggucgccgcagagucguauaa

SEQ ID NO: 35686 - RNA, 1617 nt, Artificial Sequence
  derived and/or modified sequence opt11 from VP1_capsid_protein__Norovirus__AGL98416
augaaaauggccuccaacgacgccaaccccuccgacggcuccgcagccaaccuagucccagagguaaacaaugaaguaauggcccucgaacccgucgucggagccgcuaucgcggccccagucgccggacaacaaaacgucaucgaccccuggauccgcaacaacuucguacaagcccccggaggcgaguucaccguuucaccccgcaacgcaccaggcgaaauccucugguccaugccccucucccccgaacucaaccccuaccuuucccacuuaucccgcauguacaacggauacgccggcggcuucgaaguccaagucauccucgccggcaacgcauucacagccggcaagaucauauucgccgccauacccccuaacuucccaaccgacggacuaucacccucccaagucaccauguucccacacaucaucguugacguccgccaacucgaaccuguauuaaucccccucccagauguacgaaacaacuucuaccacuacaaccaagcaaacgacucaacccuaaaacucaucgcaaugcuguacacaccccuacgagcgaacaacgccggcgacgaugucuucaccgucucaugccgcguccuaacccgucccucacccgauuuugacuucaucuuccugguacccccaaccgucgaaucccgaaccaaaccuuucaccguccccauccuaaccgucgacgaaaugacgaacucccgcuucccaacaccccucgaaaaacuccacaccggacccaacaacuccaucgucguacaaccccaaaacggccgcugcaccauagauggagucuuacuagguaccacccaacuauccaccgucaacaucugcaacuuccgcggaagcacaacaagagccggucaaucccacgccuacacuaugaaccucgugucccaaaacuggaacaacuaugacccaaccgaagaaaucccugcuccccucggcacaccggacuucgucggaaaaaucgucggcaugcucucccagaccacacgcgaaaacucaucaacacgcgcccacaaagccaccguauccaccggcgacgcccacuucacacccaaauccggcucaguauuauuuacaaccgacaccgacgaccuucaaaacggacaaaacacucguuucacccccgucggcgucgcccaagacggcgaaccccaccaaaacgaaccccaacaauggagacucccuaacuacucaggcacccccggccacaacguucaccucgcaccaccaguugcccccacauuccccggcgaacaacuccucuucuuucgcuccaccaugcccggcugcggaggcuacccuaauauggaccucgacugccugcuaccacaagaauggguccgacauuucuaccaagaagcagccccagcccaaucggacgucgcacuccuccgcuucgucaacccagacaccggccgaguccucuucgaaugcaaauuacacaaagccggcuacaucaccguaucccacaccggccccuaugaccuaguuauacccccuaacggcuacuuccgguucgacucuugggucaaccaauucuacgcccucgcacccaugggcacaggcacaggacgacgacgagcacuauga

SEQ ID NO: 35687 - RNA, 1629 nt, Artificial Sequence
  derived and/or modified sequence opt11 from VP1,_capsid_protein__Norovirus__BAL60749
augaaaauggccuccaacgacgccgcccccuccaccgacggagccgcaggacucgucccagagagcaacaacgaaguuauggcacucgaacccgucgccggcgcggcccucgccgccccaguaaccggccaaacuaacaucaucgacccauggauccgagccaacuucguccaagcccccaacggcgaguucacugucuccccacgcaacgcacccggcgaaguccuacuuucccuggaacucggcccagaacuaaaccccuaccuagcccaccuggcacgcauguacaacggcuacgccggagguauggaaguccaagucaugcucgcaggcaacgcauucaccgccggcaaacucguauucgcugccguaccaccccacuuccccguagaaaaccuaucaccccaacaaaucacuauguucccccacgucaucauagacguacgcacccucgaaccagucuuacucccccuccccgacguccgcaauaauuucuuucacuacaaccaaaaagacgacccaaaaaugcguauaguugccaugcucuacacaccccucagaucuaacggcucaggcgacgacgucuucaccguaucuugccgcguacuaacucggccaagcccugacuucgacuucacauaccucguacccccaacugucgaaucaaaaacaaaacccuucacccuacccauccuaacccuaggcgaacucaguaacucucgauuccccgucuccaucgaccaaauguacaccucccccaacgaagucauauccguccaaugccaaaauggcagaugcacccucgauggugaauuacaaggaacuacccaacuacaagucuccggaauaugugcauucaaaggcgaagucacagcacaccuccacgacaacgaccaccuauacaacgucaccauaaccaaucucaacggaucacccuucgaccccuccgaagacguaccagcgccccuaggagucccagacuuccaaggccgaguauucggagucaucucucaacgcgauaagcaaaacgccgccggccacaacgaacccgccaaccgcggccacgacgcagucguucccaccuacacagcacaauacaccccaaaacuaggccaaguccaaaucggcaccuggcaaacagacgaccuccaagucaaccaacccguaaaauucacccccgucggccucaacgacacagaacacuucaaccaaugggucgucccccgauacgcaggcgcccuaaaccucaacacaaaccucgcacccucagucgcccccguauucccaggagaacgccuccucuuuuuccgcuccuacaucccacucaaaggaggcuacggaaacccagccaucgacugccugcuaccccaagaguggguacaacacuuuuaccaagaagccgcgcccagcauguccgaaguagcccuuguccgauacaucaaccccgacacuggacgugcccucuucgaagccaaacuacaccgugcuggcuucaugaccguaagcuccaacaccuccgcccccgucgucguaccagccaacggauauuuccgcuucgauuccugggucaaccaauucuacucucucgcacccaugggaaccggaaacggccgccgacgcguacaauaa

SEQ ID NO: 35688 - RNA, 1629 nt, Artificial Sequence
  derived and/or modified sequence opt11 from VP1,_capsid_protein__Norovirus__BAL60753
augaaaauggcauccaacgacgccgcccccucuacagacggagccgcaggccucgucccagaauccaauaacgaaguaauggcccuagagccagucgccggugcagcccucgccgcccccgucacaggccaaaccaacaucauagacccuuggauccgagcaaacuucguccaagcuccaaacggagaguucaccgucucaccccgcaacgcaccuggcgaaguacuucuaaaccuagaacuaggccccgaacucaaccccuaucuggcccaccucgccaggauguacaacggauacgccggcggaauggaaguacaagucaugcucgccggcaacgcauucaccgccggcaaacucgucuucgccgcgguaccaccccacuucccagucgaaaaccucuccccacaacaaaucaccauguucccacaugucauaaucgacguacgcacacucgaacccguccuccucccacuacccgacguccgaaacaacuucuuccacuacaaccaaaaagacgaccccaaaaugagaaucguagccaugcuauacacuccccuacgauccaacggcagcggcgacgacgucuucaccgucucuugccgcguccuuacaagacccucacccgacuucgacuucacauaccucguuccacccacaguagaauccaaaaccaaaccauucacucuccccauacuaacccuaggagaacucucaaacucccgcuuccccgucagcauagaccaaauguacaccucccccaacgaaguaauaucaguccaaugccaaaacggccguugcacacucgacggagaacuccaaggaaccacucaacuacaaguauccggaaucugcgccuucaaaggcgaagucaccgcccaccuccacgacaacgaucaccucuacaacguaacaaucaccaaccuaaauggcucacccuuugaccccucggaagauauccccgcaccccuaggagucccagacuuccaaggccgcguauucggagucaucucacaacgcgacaaacauaacucccccggccacaacgaaccggccaaccgcggccacgacgccgucguccccaccuacaccucccaauauacccccaaacucggccaaauacaaaucggcaccuggcaaaccgacgaccuaaccgucaaccaacccgucaaguucacccccguaggccuaaacgacacagaacacuucaaccaaugggucguaccacgcuacgcaggagcucucaaccuaaacacaaaucucgcaccgucagucgccccggucuuccccggagaaagacuccuguucuuccgaucauauaucccacuaaaaggaggcuacggcaacccagccauagacugccuccuaccccaagaauggguccaacacuucuaccaagaagccgcaccauccaugucagaagucgcccucguacgauacauaaacccagacacgggccgcgcccucuucgaagccaaacuccaccgugcaggcuucaugacaguuuccuccaauaccucugccccaguggucguaccagccaauggcuacuuccgcuucgauuccuggguuaaccaauucuauucgcucgccccaaugggaaccggaaacggucgccgcagaguucaauaa

SEQ ID NO: 35689 - RNA, 1629 nt, Artificial Sequence
  derived and/or modified sequence opt11 from VP1,_capsid_protein__Norovirus__BAL60755
augaaaauggccuccaacgacgccgcaccgucaaccgacggagccgcaggacuugugccagaaagcaacaacgaaguaauggcacuagaaccaguagcaggagcagcccuagcagcccccgucacaggacaaacuaacaucauagaccccuggauccgcgccaacuucguccaagcccccaacggagaguucaccgucuccccacgcaacgcacccggagaaguacuacucaaucuagaacucggacccgaacucaaccccuaccuagcccaccucgcccgcauguacaacggcuacgccggcggaauggaaguccaagucaugcucgccggcaacgccuucaccgccggaaaacucgucuucgcagcuguaccaccccacuuccccgucgaaaaccuaagcccccaacaaauaaccauguucccccacguaauaauagacguccgcacccuagaaccaguccuucuuccccuaccagacgugcgcaacaacuucuuucacuacaaccaaaaagacgacccaaaaaugcgcaucgucgcuaugcucuacaccccacucagauccaacggcucaggcgacgacgucuucacagucucaugccgcguacucacccgccccucgcccgacuucgacuucaccuaccuagucccacccaccgucgaaucaaaaaccaaacccuucacucucccuauccuuacacucggugaacucucaaacucccgauuucccguuucaauugaccaaauguacaccagccccaacgaagucauauccguacaaugccaaaacggccgaugcaccuuagacggcgaacuucaaggcaccacacagcuucaaguaucuggaaucugcgccuucaaaggcgaggucaccgcccaccuccaugacaacgaccaccuauacaacguuaccaucaccaaccuaaacggcucccccuucgacccuuccgaagacaucccagccccacucggugucccagauuuucagggccgcgucuucgguguuaucucccagcgcgacaaacacaacucccccggccacaacgaacccgcuaaccgaggccacgacgccgucguacccaccuacacaucgcaguacacccccaaacucggccaaauccaaaucggaaccuggcaaacagaugaccucaccgucaaccaaccuguaaaauucacacccgucggccuaaacgacaccgaacacuucaaccaaugggucgucccccgcuacgcaggagcucucaaccucaacaccaaccucgcacccucagucgcccccguuuuccccggcgaacgccuccuguuuuucagaucuuacaucccccucaaagguggcuacggcaaucccgccaucgacugccuccuaccccaagaauggguacagcacuucuaccaggaagcagcccccaguaugucagaagucgcccucguccgcuacauuaaucccgacacaggccgugcacucuucgaagccaaacuccaccgcgcuggcuucaugaccguauccucaaacacauccgcacccguagucguaccagccaauggauauuuccgcuucgacucaugggucaaccaauucuacucacuagcccccaugggcaccgguaacggccgcagacgcguccaauaa

SEQ ID NO: 35690 - RNA, 1629 nt, Artificial Sequence
  derived and/or modified sequence opt11 from VP1,_capsid_protein__Norovirus__BAL60759
augaaaauggcaucaaacgacgccgcaccuuccacugacggcgccgccggccucgucccagaauccaacaacgaagucauggcccucgaacccgucgccggcgccgcccuagcagcaccagugaccggccaaaccaacaucauugacccauggauucgugcaaacuucguccaagccccaaacggcgaguucacagucucaccccggaacgcccccggagaaguucuccucucccuagagcucggacccgaacucaaccccuaccucgcccaccucgcccgcauguacaacggacacgccggaggcauggaaguacaagucaugcucgcaggaaacgccuucacagccggaaaacucguauucgcagccgucccuccccacuuccccguagaaaaccuaucaccccaacaaaucacgauguucccccacguaaucaucgacguacgaacucuagaaccaguccuacuaccacuacccgacguaagaaacaacuucuuccacuacaaccaaaaagacgaccccaaaaugcgaauaguagcuaugcucuauaccccacucagauccaacggauccggcgacgacgucuuuacaguaucaugucgcguauuaacccgucccucaccagacuucgacuucacauaccuggucccacccacagucgaaagcaaaacaaaacccuucacccuucccauccucacucucggagaacuaagcaacagccgcuuccccguuuccauagaccaaauguacaccucccccaacgaagucauauccguacagugccaaaacggacggugcacccuagacggcgaacuccaaggaaccacucaacuacaagucuccggcauaugcgccuucaaaggcgaaguaacagcccaccuacacgacaacgaccaccuauacaacguaaccauaaccaaccucaacggcucacccuucgaucccucagaagacgugccagcuccccucggaguccccgacuuccaaggccgagucuucggcgucauaucccaacgcgauaaacaaaacgccgccggccacaacgaaccagccaaccgaggccacgacgcagucguacccaccuacaccgcccaauacacccccaaacucgggcaaguccaaauaggcacauggcaaaccgacgaccuccaaguaaaccaacccguuaaauucacccccguuggccucaacgacaccgaacacuuuaaccaauggguagucccuagauacgccggcgcccuaaaccuuaacaccaaccucgcucccuccgucgcccccguauuuccaggugaacgucuccucuucuuccgcucuuacaucccccuaaaaggcggcuacggcaaccccgccauagacugccuacuaccacaagaauggguacaacacuucuaccaggaagccgcccccucuauguccgaagucgcccuuguccgcuacaucaauccagacaccggccgagcccuauucgaagcaaaacuccaccgagcuggauuuaugaccgucagcuccaacaccuccgcucccgucgucguacccgccaacggauacuucagauucgacuccugggucaaccaauucuacucccucgcccccaugggcaccggaaacggccgccgccguguacaauaa

SEQ ID NO: 35691 - RNA, 1629 nt, Artificial Sequence
  derived and/or modified sequence opt11 from VP1,_capsid_protein__Norovirus__BAL60767
augaaaauggccucaaacgacgcugccccaagcacagacggugccgcuggccucguccccgaauccaacaacgaaguaauggcacucgaacccguagcaggcgccgcccucgcugcccccgucacgggccaaaccaacauaaucgaccccuggauccgcgccaacuucguacaagcaccaaacggagaguucaccguuuccccucgaaaugcccccggcgaaguccuccuaaaccucgaacuaggaccagaacuaaaucccuaccucgcccaccuagcccgaauguacaacggauacgccggcggcauggaaguccaagucaugcuagccggcaacgccuucaccgccggcaaacucgucuucgccgccgucccuccccacuuccccaucgaaaaccuauccccacagcaaaucacaauguucccacacguaauaaucgacguacguacccucgaacccguccuacucccccuuccagacguccgcaacaacuucuuccacuacaaccaaaaagacgacccaaaaaugcgcauagucgcaaugcucuacacgccacugcgcucaaacggcuccggagacgacgucuucacagucuccugccgcguccucacucgccccuccccagacuucgacuuuaccuaccuaguacccccaaccgucgaauccaaaacgaaacccuucacucuccccauccugacucucggcgaacucuccaauucccgauuccccguuagcauagaccaaauguacacaucgccaaacgaaguuaucagcguccaaugccaaaacggacgcugcacccucgacggcgaacuacaaggaaccacccaacuccaagucuccggcaucugcgccuuuaaaggcgaaguuacagcccaccuccacgacaacgaccaccuauauaacaucaccaucaccaaccucaacggcucccccuucgaccccucagaagacauucccgcuccccucggcaugccagacuuccagggccgagucuucggaauaaucagucaacgagaccgacacaacuccccaggccauaacgaaccagccaaccguggccacgaugcagucguaccuacauacacggcucaauacacucccaaacuaggccaaauccaaaucggcacauggcaaaccgacgaccucacagucucacaaccuguuaaauucacccccgucggucucaacgacaccgaacacuucaaccaauggguuguaccccgcuacgccggcgcacucaaccuuaacacuaaccuugcccccuccgucgcccccgucuuccccggcgaaagacuacucuuuuucagaucauacauaccacucaaagguggauacggcaacccggcuaucgacugucuccucccccaagaauggguacaacacuucuaccaagaagccgcucccuccaugucagaagucgcccuagucagauacaucaaccccgacaccggcagagcccuauuugaagccaaacuucaccgcgccggauucaugaccgucucuuccaacaccucagccccagucgucgucccugccaacggcuauuuccgcuucgacucaugggucaaccaauucuacucccucgccccaaugggcacaggcaacggacgacgccgcguccaauaa

SEQ ID NO: 35692 - RNA, 1629 nt, Artificial Sequence
  derived and/or modified sequence opt11 from VP1,_capsid_protein__Norovirus__BAL60769
augaaaauggccucgaacgaugccguccccucuaccgacggagccgccggacucgucccagaauccaacaacgaaguaauggcacuagaacccgucgccggcgccgcccuugccgcccccguuaccggacagaccaacaucaucgacccauggauacgagcaaacuucguccaagccccuaacggagaguuuaccgucucuccccguaacucccccggcgaaguccuccucaaucuagaacuaggccccgaacucaauccauaccucgcucaccuagcacguauguacaacggcuacgccggcggcauggaaguccaagucaugcucgcagguaacgcauucaccgccggcaagcucgucuucgcagccgucccuccccacuuccccgucgaaaaccuuucuccccaacaaaucaccauguucccccacgucauaauugacguccguacccucgaaccaguccuacuaccgcuccccgacguccgaaauaacuucuuccacuacaaccaaaaagacgaccccaaaaugcgcauagucgcaaugcucuacaccccacuacgcucuaacggauccggcgaugaugucuuuaccguaucaugccgaguucucacccgccccagccccgacuucgacuucacauaucuugucccucccaccgucgaaucaaaaaccaaaccauucacacuaccaauccucacacucggcgaacucuccaacucccgauucccagucuccaucgaccaaauguauacaucccccaacgaagucaucucuguccaaugccaaaacggccgcugcacacuagacggggaacuccaaggcaccacccaacuccaaguaagcggcaucugcgcguucaaaggcgaagucacagcccaccuccacgacaacgaacaccuuuauaacguaaccaucaccaaucucaacggcucuccauucgacccauccgaagacauacccgccccacucggagucccugacuuccagggucgcguauucggcguaauaucccaacgcgacaagcacaacacccccggccacaacgaacccgcaaacagagcccacgacgcagucguacccacauacaccgcccaauacacucccaaacucggccaaguacaaauaggcacauggcaaaccgacgaccucacagacaaccaaccaguuaaauucacccccguaggacuuaacgacaccgaacacuucaaccaaugggucguaccccgcuacgccggcgcgcucaaccugaacacaaaccuagcccccuccgucgcccccgucuuccccggcgaacgccuacuuuucuuccguucuuacauaccccuuaaaggcggcuacgguacuccagcaaucgauugccuccucccccaagaauggguccaacacuuuuaucaagaagccgcacccucuauguccgaaguagcacucguacgcuacaucaaccccgacaccggccgagcccucuucgaagcaaaacuacaccgcgccggcuucaugaccgucagcucaaacacauccgcacccgucguuguccccgccaacggauacuuccguuucgacuccuggguaaaccaauucuacucucuagccccaaugggcaccggaaacggacgccguagaauacaauga

SEQ ID NO: 35693 - RNA, 1629 nt, Artificial Sequence
  derived and/or modified sequence opt11 from VP1,_capsid_protein__Norovirus__BAL60771
augaaaauggccuccaacgacgccgcaccauccaccgacggagccgcaggccucguuccugaauccaacaacgaagucauggcacuagaacccguugccggagccgcacucgccgccccagucaccggucaaacaaacauuauagaucccuggauccgcgccaacuuuguccaagccccuaacggcgaauuuaccgucucuccccgcaacgcccccggagaaguucuccucaaccuagaacucggacccgaauuaaaccccuaccuggcccaccuagcccgaauguacaacggcuacgccggcggcauggaaguccaaguaaugcucgccggaaacgcauucacugccggcaaacucgucuucgccgcugucccuccccacuuccccgucgaaaaccuaucuccccaacaaauaaccauguucccccacgucaucaucgacguccgcacccuagaacccguucuccuuccacuccccgacguacgaaacaacuucuuccacuacaaccaaaaagaugaucccaaaaugcgcauagucgccaugcucuacaccccucuccgcuccaacggcucaggagacgacgucuucacagucucaugccgaguacuaacccgccccucaccagauuucgacuucacauaccuaguaccacccacaguagaauccaaaaccaaacccuucacccuccccauccucacccuuggcgaacucucgaacucucgcuuccccgucagcaucgaucaaauguacacuucccccaaugaagucaucucaguacaaugccaaaaugggcgaugcacccucgacggugaacuccaaggaacaacccaacuccaagucucagguaucugcgcauucaaaggcgaagucaccgcacaccuacacgacaacgaccaccucuacaacaucaccaucaccaaccuaaauggcucacccuucgaccccuccgaggacauaccagcaccccucggaguuccagacuuccaaggccgcguauucggcaucauaucccaacgcgauaaacacaauuccccagggcacaacgaaccagccaacagaggacacgacgccgucguacccaccuacaccgcccaguacacccccaaauuaggccaaauccaaaucggaacguggcaaaccgacgaccuuacugucagccaacccguaaaauuuacccccguaggacuaaacgacaccgaacacuucaaccaaugggucgucccccgcuacgccggcgccuuaaaccucaacacaaaccuugccccuucgguggcccccgucuuucccggcgagcgacuccucuucuuccgauccuauaucccacucaaaggcggcuauggcaacccagcaaucgacugucuccucccccaagaauggguccaacacuucuaccaagaagcugcccccuccauguccgaaguugcccucguacgcuacaucaauccagacacuggccgugcccucuucgaagcaaaacuacacagagcuggcuucaugaccgucuccagcaacaccuccgcaccagucgucguacccgccaacgguuacuuccgcuucgacucaugggucaaccaauucuacucccuagccccaaugggcacuggcaacggccgcagacgcguacaauaa

SEQ ID NO: 35694 - RNA, 1629 nt, Artificial Sequence
  derived and/or modified sequence opt11 from VP1,_capsid_protein__Norovirus__BAL60773
augaaaauggccucaaacgacgcagccccauccacagacggcgccgccggccuaguacccgaaagcaacaacgaagucauggcccucgaaccagucgccggcgcugcacuagccgcaccaguaacaggccaaaccaacauuaucgacccauggauacgcgccaauuucguccaagcccccaacggcgaauuuaccgucucuccgcgcaacgccccaggcgaaguccuacucaaccucgaacucggcccagaacuuaacccauaccucgcgcaucucgcccgcauguauaacggcuacgccggaggcauggaaguccaagucaugcucgccggaaacgccuucacagccggcaaacucguauucgccgccgucccaccacacuuccccguagaaaaucuguccccacaacaaaucaccauguucccccacgucaucaucgacguacgaacacuagaacccguccuacucccccuccccgacguccgaaauaacuucuuccacuacaaccaaaaagacgaccccaaaaugcgaauagucgccaugcucuacacaccccuacgauccaacggaucaggagacgacgucuucaccguauccugccgaguacucacccgccccucacccgacuucgacuucaccuaccuagucccaccaaccgucgaaucaaaaaccaaacccuucacccuaccgauccuaaccuuaggcgaacucucaaacucccgcuuccccgucagcaucgaccaaauguacaccucuccaaacgaaguuaucuccguacaaugccaaaauggcagaugcacccucgacggagaacuccaaggcacaacccaacuccaagucuccggcaucugcgcauucaaaggcgaagucacagcccaccuccacgacaacgaccaccucuacaacguaaccauaacaaaccucaacggcucacccuucgaccccucugaagacaucccagcaccccuuggcguacccgacuuucaaggccgcgucuuuggaauaaucucacagcgagacaagcacaacucccccggucauaacgaacccgccaaccguggacacgacgccgucguaccaaccuacacagcacaauacacccccaaacucggccaaauccaaaucggcaccuggcaaaccgacgacuuaaccguuaaccaaccagucaaauuuaccccagucggccucaacgacacugaacacuucaaccaauggguagucccccgauacgccggggcacucaaccucaacaccaacuuagcacccucuguagccccagucuuccccggagaacgccuccuguucuuccgcucauacauacccuuaaaaggaggcuauggaaacccagccaucgacugccuacuaccccaagaauggguccaacacuucuaccaagaagccgcucccucuaugagugaaguugcccuuguacgauacaucaaccccgacaccggacgugcccucuucgaagccaaacuccaucgcgccggcuucaugacagucuccagcaacaccuccgcucccguggucguucccgcuaacggguauuucagauucgacuccugggucaaccaauucuacucccucgcccccaugggcacaggaaacggcagacgacgaguccaauag

SEQ ID NO: 35695 - RNA, 1629 nt, Artificial Sequence
  derived and/or modified sequence opt11 from VP1,_capsid_protein__Norovirus__BAL60775
augaaaauggccucaaacgacgccgcccccucgacagacggcgcagccggccucguccccgaaucuaacaacgaagucauggcacucgaaccaguagcaggcgccgcccuagcggcacccguaaccggccaaacaaacauaaucgacccuuggauccgagccaacuuuguacaagcccccaacggcgaguucacagucuccccucgaaacgccccaggcgaaguucuacucaaccucgaacuaggcccagaacucaaccccuaccucgcacaccucgcccgcauguacaacggauacgccggcggcauggagguacaggucaugcucgccggcaacgcauucacugcgggaaaacucgucuucgccgcuguaccaccccacuuccccauugaaaaccucucaccccaacaaauaaccauguucccccacgucauaaucgacguccguacacuagaacccguuuuacucccacuccccgacguucgcaauaacuucuuccacuacaaccagaaagacgacccuaaaaugcgaaucguugcuaugcucuacacaccccuacgcuccaacgguuccggcgacgacgucuucaccgucuccugccgcguacuaacccgccccucccccgacuuugacuucaccuaccuuguacccccaacagucgaaucuaaaacgaagccauucacccuccccauccuuacucucggagaacucuccaauucacgcuuccccgucucaaucgaccaaauguacaccucccccaacgaagucauuuccguacagugccaaaacggccgauguacacucgacggcgaacuccaaggcacuacccagcuccaaguauccgggaucugcgccuucaaaggugaagucaccgcacaccuccacgacaacgaccaccucuacaacaucacaauaaccaaccuaaacggcucccccuucgaucccuccgaagacauccccgcuccccucggaguucccgacuuccaaggacgcgucuucggcauaauaucccaacgcgacaaacacaacucacccggccacaacgaaccggcaaaccgaggccacgacgccguagucccaacauauaccgcacaauacaccccaaaacuuggccaaauacaaauaggcaccuggcaaacagaugaucucaccgucucacaaccaguuaaauucaccccaguaggacuaaacgacaccgaacacuucaaccaaugggucgucccccguuacgccggugcccucaaccucaacacaaaccucgcccccuccguagcacccguauuccccggcgaacgccuccucuucuuccgcuccuauaucccccuuaaaggcggcuacggcaaucccgcaauagacugccuucucccccaagaguggguccaacacuucuaccaagaagccgcuccguccauguccgaagucgcccucguacgcuacaucaaccccgacaccggacgcgcacuuuucgaagccaagcuccacagagccggcuucaugacagucucuagcaacaccagcgccccaguggucguccccgccaacggguauuuccgcuucgacucauggguuaaccaauucuauucccucgcccccaugggcaccggaaacggccgccgccgaguucaauaa

SEQ ID NO: 35696 - RNA, 1629 nt, Artificial Sequence
  derived and/or modified sequence opt11 from VP1,_capsid_protein__Norovirus__BAL60777
augaaaauggccucaaacgacgccgcccccucuaccgacggcgccgccggccugguccccgaauccaacaacgaggucauggcacucgaaccaguugcaggcgcagcccuugcugccccaguuaccggacaaacaaacaucaucgaccccuggauacgggccaauuucguccaagcucccaacggcgaguucacaguuucaccccgaaacgcccccggugaaguucuacuuaaccucgaacucggcccagaacucaauccauaccuagcucaccucgcaagaauguauaacggauacgccgggggcauggaaguacaaguuaugcucgccggaaacgccuucacagccggcaaacuugucuuugccgccgucccaccacacuuccccaucgaaaaccuuucaccccaacaaauuaccauguucccccacguuaucaucgacguccgaacccuagaaccaguucuccucccacucccggacguacgaaacaacuucuuucacuacaaccaaaaggacgaccccaagaugcgcauagucgcaaugcuauauacaccccuccgcuccaacggaucaggcgacgacgucuucaccgucuccugccgaguacucacacgucccagcccagacuucgauuucaccuaccucgucccacccacaguugaauccaaaaccaaacccuucacccugcccauacuaacccucggcgaacucucaaauucacgauuccccguguccaucgaccaaauguacaccucccccaacgaagucaucucaguacaaugccagaacggccgcuguacacuagacggcgaacuccaagggaccacccagcuacaggucucaggcaucugcgcauucaaaggcgaaguaaccgcccaccuccacgauaacgaccaccuuuacaacaucaccaucacgaaccucaacggcucacccuucgacccaucugaagacauccccgcaccccucggcguccccgauuuccaaggccgcguauucggcauaauaucacaacgugauaaacacaacuccccaggccacaacgaaccagccaacagaggccacgacgccguaguccccacauacaccgcccaauacaccccaaaauuaggccaaauccaaauaggcaccuggcaaaccgaugaccucaccgucucccaacccgucaaauucacccccgucggccuaaacgacaccgaacacuucaaccaauggguggucccccgcuacgccggcgcacucaaccucaacaccaaccuagcacccucaguugccccagucuuccccggcgagcgacuccuauucuuccgaucuuacaucccccucaaaggcggcuauggaaaccccgcaaucgacugccuccuaccccaagaauggguacaacacuucuaccaagaagcugcucccuccauguccgaagucgcgcucguaagguacaucaaccccgacacgggacgcgcacucuucgaagccaaacuacacagagccggcuuuaugaccgucucuucuaacacauccgcccccguaguugucccagccaacggcuacuuucguuucgacucaugggucaaccaauucuacucccucgccccuaugggaaccggcaacggccgccgccgaguccaauaa

SEQ ID NO: 35697 - RNA, 1629 nt, Artificial Sequence
  derived and/or modified sequence opt11 from VP1,_capsid_protein__Norovirus__BAL60779
augaaaauggccucuaacgaugccgcccccuccaccgacggcgccgcaggccuaguccccgaaucaaacaacgagguaauggcccuagaaccgguagccggcgccgcacucgccgcaccagucaccggacaaaccaacaucauagacccuuggauucgcgcaaacuucguccaagcacccaacggcgaguucaccguaucaccccgcaacgcuccaggcgagguccuccucaaccucgaacucggcccagaacucaacccauaccuugcucaccucgcccgcauguacaacggcuacgccggcggcauggaaguccaaguuaugcuagcaggcaacgccuucacugccggcaagcuaguauucgccgccgucccaccccacuuccccaucgaaaaccucuccccacaacaaauuacuauguucccccacgucaucaucgacguaagaacacucgaacccguccuacucccacuaccagacguacgcaacaacuucuuccauuauaaccaaaaagacgaucccaaaaugcgaauaguagcaaugcuauacaccccacuucgauccaacggauccggcgaugacgucuucacgguauccugccgcguucugacccgccccucccccgacuucgacuucacauaccucguaccacccacugucgaauccaaaaccaaacccuucacccuaccaauccucacccuaggcgaacucaguaacuccagguucccugucuccauagaccagauguacacuucaccaaacgaaguuauauccguacaaugccaaaacggccgaugcacccucgacggcgaacuccaaggcaccacacaacuccaagucuccggcauaugcgccuucaaaggcgagguaacugcucaccuccaugacaacgaccaccucuacaacaucacaauaaccaaucucaacggcucucccuucgaccccuccgaagacauacccgcaccccucggcgugccugacuuccaaggccgcguauuuggaaucauaucccaacgugacaaacacaacucccccggacacaacgaacccgccaaucgcggccacgacgccguuguacccaccuacaccgcccaguacacucccaaacuaggccaaauacaaaucggcacauggcaaacggacgaccucacagucucacaaccaguaaaauucacccccguaggccuaaacgauacugaacacuucaaccaaugggucgucccuagauacgcaggagcccucaaucuuaacacaaaccuugccccaagcgucgcccccgucuuccccggcgaacgacuccucuucuuccgaucauacaucccccucaaaggaggcuacggcaaucccgcaaucgacugccuacuaccccaagaauggguccaacacuucuaccaagaagccgccccauccaugucagaaguagccuuaguccgcuacaucaaccccgacaccggccgagcccucuucgaagccaaacuacaccgcgcaggcuucaugaccguauccucaaacacaagcgcccccguugucgucccugccaacggcuacuuccguuucgacucaugggucaaccaauucuacucccucgccccuaugggcaccggcaacgggcgacgccgcguacaauaa

SEQ ID NO: 35698 - RNA, 1629 nt, Artificial Sequence
  derived and/or modified sequence opt11 from VP1,_capsid_protein__Norovirus__BAL60781
augaaaauggcuagcaacgacgccgccccaagcaccgacggcgcagccggccucguccccgaaucaaacaacgaggucauggcacucgagccuguagccggcgccgcccuagcagcccccgucaccggacaaacuaacaucaucgaccccuggauccgugcgaacuucguucaagcccccaacggcgaguucaccgucucaccucgaaacgcccccggagaaguccuccucaacuuagaacucggucccgaacuaaauccauaccuagcccaccuagcccgcauguacaauggcuacgcuggaggcauggaaguccaagucaugcuugccggcaacgccuucacagccggaaagcucguauucgccgccguuccaccacacuuccccgucgaaaaccuaagcccccaacaaauaacuauguucccccacguaaucaucgacguccgaacccuagaacccguucuccugccacuccccgacguacgcaauaacuucuuccacuacaaccaaaaagacgaccccaaaaugagaaucguugccaugcucuacacuccccuccguucaaacggcagcggcgacgacgucuucacuguaagcugccgaguacucacccgacccucccccgacuucgacuuuaccuaccuugugcccccaaccgucgaaucaaaaacuaaacccuucacccuccccauccuuacucucggcgaacuaucaaacagcagauuccccgucucaauagaccaaauguacacgucaccuaaugaagucaucucaguacaaugccaaaacggccgcugcacauuagacggagaacuacaaggaacaacccaauuacaagucuccggcauaugcgccuucaaaggagaaguaaccgcgcaccuccacgacaacgaucaccucuacaauguuacuaucaccaaccucaacggcucccccuucgaucccuccgaggacaucccagcuccccucggcguacccgacuuccaaggacgcgucuucggaaucgucucccaacgugacaaacacaacucacccggccacaacgaacccgccaacagaggccacgacgccgucguccccaccuacaccgcccaauacacaccaaaacucggucaaauccagaucgguaccuggcaaaccgacgaccucacagucaaccaacccgucaaauucacacccgucggccuuaacgacaucgaacacuucaaccaaugggucgucccccgcuacgccggagcccucaaccuaaacacuaaccucgccccaagcgucgcaccagucuuccccggcgaacgccuccucuucuucagauccuacauuccccuaaaaggcgguuacgggaacccggcaauagacugccuccugccacaagaauggguacaacacuucuaccaagaagcagcucccucaaugucagaagucgcccuaguccgcuacaucaaccccgacaccggucgcgcacucuucgaagcaaaacuccaccgggcuggauuuaugacaguaucaucaaacaccuccgcccccgucgucguccccgccaacggcuacuuucgcuucgacuccugggucaaccaauucuacucccucgcccccaugggcacaggcaacggccgacgccgcguccaauaa

SEQ ID NO: 35699 - RNA, 1629 nt, Artificial Sequence
  derived and/or modified sequence opt11 from VP1,_capsid_protein__Norovirus__BAL60783
augaaaauggcauccaacgacgcagcccccucuaccgacggcgccgccggccuugucccagaaucuaacaacgaagucauggcacuagaacccguagccggcgccgcccuagccgcacccguaacaggacaaaccaacaucauagaccccuggauccgcgcaaacuucguccaggcccccaacggcgaguucacugucucccccagaaacucccccggagaaguccuccuaaaccucgaacuaggaccugaacuaaaccccuaccucgcacaccuagcccgaauguacaacggauacgccggaggcauggaaguacaagucaugcucgccggaaacgccuucacagccggcaagcucguauuugcagcaguucccccgcacuuccccgucgaaaaucuuuccccacaacaaaucaccauguucccccacguaaucauagacgugagaacccucgaaccaguccuccucccccuccccgacguacgaaacaauuucuuccacuacaaucaaaaagacgaccccaaaaugcguaucgucgccaugcucuacacaccccuacgcuccaacgguucaggcgacgacgucuucaccgucucaugccgcguacucacccgccccagccccgacuuugacuucaccuaccuuguaccacccacagucgaaucaaaaacuaaacccuucacccuucccauccucaccuuaggcgaacucuccaacucccgcuucccagucucaaucgaccaaauguacaccucccccaaugaagucauuucaguccaaugucaaaacggccgcugcacccucgacggcgagcuccaaggcaccacccaacuacaaguaucugguauaugugccuucaaaggcgaagugaccgcccaccuucacgacaacgaacaccucuacaacguaaccaucaucaaccucaacggcagcccauucgaucccucagaagacauaccugcaccccuuggcguaccugacuuccaaggacgcguuuuuggcgucaucucccaacgcgacaaacauaacacccccggucacaacgaaccagccaaccgcgcacacgacgcagucguccccaccuacaccgcccaauacaccccaaaacucggacaaauccaaaucggaaccuggcaaaccgacgaccucaccaacaaccaacccguaaaauucacccccguaggccuaaacgacacagaacacuucgaccaaugggucguaccucgcuacgcaggcgcccuaaaccuuaauaccaaccucgcuccauccgucgccccggucuuccccggagaacgccuacucuucuuccgcuccuacauaccccuaaaaggcgguuacgguacccccgcaauagacugccuacugccccaagaauggguacaacacuucuaccaagaagccgccccauccaugucggaagucgcccuuguccgguacaucaacccagacacaggccgagcccucuucgaagccaaacuacaucgugccggauucaugaccguuuccucaaauaccuccgcccccguagucgugccagccaacggcuacuuccgauucgacuccuggguaaaucaauucuauucccuagcccccaugggcaccggaaacggucgacgacgcauccaguaa

SEQ ID NO: 35700 - RNA, 1629 nt, Artificial Sequence
  derived and/or modified sequence opt11 from VP1,_capsid_protein__Norovirus__BAL60785
augaaaauggccuccaacgacgcagcacccucaacugacggcgccgcuggucuugucccagaguccaacaacgagguuauggcucucgaaccgguagccggcgccgcccuagccgcccccgucacaggacaaaccaacaucaucgacccauggauccgcgccaacuucguacaagccccaaacggcgaguucaccgucucaccccguaacgcaccaggagaaguccuccucaaucuugaacuaggcccagaacucaaccccuaccucgcgcaucucgccagaauguacaacggcuaugccggcggcauggaaguacaagucaugcuagccggcaacgccuucacugccggcaaacucguguucgcagccguacccccucacuuucccauagaaaaccuaagcccccaacaaauaacaauguuuccccacgucaucaucgacguccgcacacucgaaccaguccugcucccucuacccgacguccgcaacaacuucuuccacuacaaccaaaaggacgaccccaaaaugcgcauaguagccaugcuauacacaccccuacgauccaauggcucaggcgacgacguauucaccgucucaugccgcguccucacccgccccuccccagacuucgacuucacauaccuagucccacccaccgucgaauccaaaaccaaacccuuuacccuacccauucuuacccucggcgaauuauccaacucccgcuuccccgucuccaucgaccaaauguacaccuccccaaacgaaguaaucucaguccaaugccaaaacggccgcugcacacucgacggagaauuacagggcaccacacaacuacaagucuccggcauaugcgcauucaaaggagaaguaacagcccaccuacacgacaacgaccaccucuacaauguaacaaucaccaaucuaaacggcucacccuuugaccccagugaagacauccccgcaccccucggaguacccgauuuccagggcagagucuucgguaucauaucccaacgggacaaacacaacucacccggccaaaaugaaccagccaaucgcgggcacgacgccgucgucccaaccuacacagcccaguacaccccaaaacucggccaaauacaaaucggcaccuggcaaacagacgaccugaccguaucccaacccgucaaauucacccccgucggccucaacgacacagaacacuucaaccaaugggucgucccccgcuacgccggcgcccuaaaccucaacacgaaccuagcaccaucagucgccccaguauucccaggcgaacgccuccucuucuuccguucuuacaucccgcuaaaaggcggcuacggcaaccccgccauagacugccuccucccucaagaauggguucaacacuucuaucaagaagcagccccaaguauguccgaagucgcccuaguccgcuauaucaacccagacaccggccgcgcccucuucgaagccaaacuacaccgagccggauucaugacagucucuucuaacaccucagcacccgucgucgucccagccaauggauacuuccgcuucgauagcugggucaaccaauucuacucccuagcccccaugggcaccggaaacggccgacgacgaguccaauaa

SEQ ID NO: 35701 - RNA, 1629 nt, Artificial Sequence
  derived and/or modified sequence opt11 from VP1,_capsid_protein__Norovirus__BAL60791
augaaaauggcauccaacgacgccgcuccaucaacagacggcgccgcaggccucguacccgaaucaaacaaugaaguuauggcccucgaacccguugccggcgccgcucucgccgcucccgucaccggacaaaccaauaucaucgaccccuggauacgagccaacuuuguccaagccccaaacggcgaauuuacagucuccccucgcaacgcccccggagagguacugcucaaccucgaacuaggccccgaacucaacccauaucuagcucaccuugcacgcauguacaacggauacgccggcgguauggagguccaagucaugcuagccggaaacgccuucacagcgggcaaacucgucuucgccgcaguacccccacacuuccccaucgaaaaccuaagcccccagcaaaucaccauguucccucacgucaucauagacguccgaacucuagagccuguacuacucccacuccccgacguccgaaacaacuuuuuccauuacaaucaaaaagacgaccccaaaaugagaauaguagcaaugcuuuacaccccacuccgcuccaacggcucaggagacgacgucuucacagucuccugccgcguuuuaacacgacccuccccugacuuugacuucaccuaccucgucccucccacugucgaaucaaaaacaaaacccuucacacuacccauccucacccucggcgaacucucaaacucccgauuccccgucucuaucgaccaaauguauacaagccccaacgaagucaucucgguccaaugccaaaacggacgcugcacccucgauggugaacuacaaggcaccacucaacuccaagucuccgguauaugcgccuucaaaggcgaaguaacggcucaccuccacgacaacgaccaccuauacaacaucacaaucaccaaccucaacgguucccccuucgauccauccgaagacauccccgcuccccucggcguacccgacuuccaaggacgcguauucggcauaaucucccaacgcgacaaacacaacuccccaggccacaacgaacccgcaaacagaggccacgacgccgucguccccacauauaccgcccaauacacccccaaacuuggccaaauccaaaucggaacauggcaaacugacgaccucaccgucucgcagcccgucaaauucacaccaguaggccucaacgacaccgaacacuucaaccaaugggucgucccccgauacgcaggcgccuuaaaccucaacaccaaccucgccccauccgucgcacccgucuuccccggcgaacgauuacucuucuuccguucauacaucccccucaaaggaggcuacggaaacccagcaauagacugccuccucccacaagaauggguucagcacuucuaccaagaagccgcgcccuccaugucagaagucgcccucguccgauacaucaaccccgauaccggccgcgcccuuuucgaagccaaacuccaccgcgcuggcuucaugaccgucuccucaaacacaucagcacccgucgucgucccagcgaauggauacuuccgcuucgacuccugggucaaccaauucuacucccucgcccccaugggaacugggaacggacgccgaagaguccaauaa

SEQ ID NO: 35702 - RNA, 1629 nt, Artificial Sequence
  derived and/or modified sequence opt11 from VP1,_capsid_protein__Norovirus__BAL60793
augaaaauggcauccaacgacgccgcccccuccacugacggagcagcuggccucguacccgaaagcaacaacgaagucauggcccuagaaccagucgccggcgccgcccuagccgcacccguaaccggccaaacaaauaucaucgaccccuggauccgcgccaacuucguccaagcccccaacggcgaguucaccguauccccaagaaaugcuccuggcgaaguccuccuaaaccuugaacucggacccgaacucaaccccuaccucgcccacuuagcacguauguacaacggcuaugccggcggcauggaaguacaagucaugcucgcugguaacgcuuucaccgcuggcaaacucgucuucgccgcagucccuccccacuuccccaucgaaaaccuuucuccacaacaaaucaccauguucccccacgucauaauagacguccgcacgcucgaacccguauuacucccccuccccgacguacgcaacaacuucuuucacuacaaccaaaaggacgacccuaaaaugcgcauaguagcaaugcuguacacaccccugcgcucaaacggcuccggcgacgacgucuucaccgucucaugccgcguucuaacccgaccaucacccgauuucgauuucaccuaccugguaccucccaccgucgaaucuaaaaccaaacccuucacccuccccauacucacccucggcgaacucucaaacucccgauuccccguaucaaucgaccaaauguacaccucucccaacgaaguuaucuccguacaaugucaaaacggaagaugcacccucgacggcgaacuccaaggaaccacacaacuccaaguauccggcaucugcgccuucaaaggcgaaguaaccgcccaccuucacgauaacgaccaccuauacaauaucaccaucaccaaccuuaacggcucgcccuucgacccaagcgaagacaucccagcccccuugggaguucccgacuuucaaggacguguguucgguaucaucucccaaagagacaaacacaacuccccaggccacaacgaaccagccaacagaggacacgacgccguagucccaacuuacaccgcacaauacacacccaaacuaggacaaauacaaauaggcaccuggcaaaccgacgaccucaccguaucucaacccguaaaauucacacccgucggccucaacgacacggaacauuucaaccagugggucguaccccgauacgcgggcgcacucaaccucaacacuaaccuugcccccucagucgccccagucuuccccggcgaacgacuccuauucuuccgaucuuacauaccacucaaaggcggauacggcaacccagccaucgacugccugcuuccccaagaaugggugcaacacuucuaccaagaagccgcccccucaauguccgaaguggcccucguccgcuacaucaaccccgacaccggcagagcccucuucgaagccaaacuccaccgagccggcuucaugaccgucuccuccaauacauccgccccagucguagucccugccaacggcuacuucagauuugacucuugggucaaucaauucuacucucuugcaccaaugggcaccggcaacggacgccguagaguccaauaa

SEQ ID NO: 35703 - RNA, 1629 nt, Artificial Sequence
  derived and/or modified sequence opt11 from VP1,_capsid_protein__Norovirus__BAL60795
augaaaauggccuccaacgacgccgcccccuccaccgacggcgcagccggccuuguccccgaauccaacaacgaaguaauggcccucgaacccgucgcaggcgccgcacuagcggcccccgucacaggucaaaccaacaucaucgacccauggauacgcgcuaacuuuguccaagccccaaacggagaguucaccguauccccuagaaacgcgcccggugaaguccuacuaaaccuggaacucggccccgaacucaaccccuaucuagcccaccuagcccgaauguauaacggcuacgccggcggcauggaaguccaagucaugcucgccggaaacgcuuucacagcaggcaagcuagucuucgccgcagucccaccacacuuccccaucgaaaaccucagcccccaacaaauuaccauguucccacauguaauuaucgacguacguacacuagaacccguacuacuucccuugccagacguccggaacaacuucuuccauuacaaccaaaaagacgacccaaaaaugcgaauuguggccaugcuauacacuccccuucgcuccaacggaagcggugacgacguuuucaccgucuccuguagaguccucacccgcccaucccccgacuucgacuucacauaccugguucccccaaccgucgaaucaaaaaccaaaccauuuacccucccaauccucacacucggcgaacuaagcaacucccguuuccccgucucaaucgaccaaauguacaccuccccuaacgaaguuaucucaguacaaugccaaaacggucgcugcacccucgacggcgaacuacaaggcaccacccaacuccaagucuccggcaucugcgccuucaaaggcgaagucaccgcccaccuucacgauaacgaccaccuauacaauaucaccaucaccaaccuaaacggcucgcccuucgacccuuccgaagacauacccgcaccucucggaguccccgacuuccaaggccgcgucuucggcauaaucucccaacgcgacaaacacaacagcccaggccacaacgaacccgccaaccgcggccacgacgccgucguaccaaccuacaccgcacaauacacccccaaacucggacaaauccaaauaggcaccuggcaaacagacgaccucaccgucagccaaccugucaaauucacccccgucggccucaacgacacagaacacuucaaccagugggucgucccacgauaugcaggcgcccucaaccucaacaccaaccucgcaccguccgucgcacccgucuuccccggugaacgccuccucuucuuuagauccuacaucccccuaaaaggcggcuauggcaaccccgcaauugacugccuccucccccaagaauggguccaacacuucuaccaagaagccgcccccuccaugucagaaguagcccucgucagauacaucaacccagacaccggcagagcacuuuucgaagcuaaacuccaccgagccggcuucaugacagucucauccaacaccucagcccccgucgucguccccgcaaauggcuacuuccgcuucgacagcugggucaaccaauucuacucucucgcacccauggguaccggcaacggacgccgccgcguccaauga

SEQ ID NO: 35704 - RNA, 1629 nt, Artificial Sequence
  derived and/or modified sequence opt11 from VP1,_capsid_protein__Norovirus__BAL60797
augaaaauggcaagcaacgacgccgcaccaagcaccgacggagcagcaggacucguccccgaaucuaacaaugaaguaauggcacucgaaccagucgccggugcagcacuagccgcacccgucaccggccaaaccaacaucauagacccauggaucagagccaacuucguccaagcccccaacggagaguucacuguaaguccccgaaaugcucccggcgaaguccuacucaaucucgaacugggcccugaauuaaaccccuaccucgcucaccuagcccgcauguacaacggcuaugccggcggaauggaaguccaagucaugcucgccggcaacgcauucaccgcagguaaacucgucuucgccgccgucccaccccacuuccccaucgaaaaccuaucuccacaacaaaucacaauguucccacacgucaucaucgacguccgcacccucgaacccguccugcucccccucccugauguuagaaacaacuucuuccacuacaaccaaaaggaugaccccaaaaugcgcaucgucgccaugcuauacacuccccuccgcuccaacggaucuggugacgacgucuucaccgucucuugccgcguccucacccgcccaucccccgacuucgacuucacauaccuaguuccucccaccgucgaaagcaaaacgaaacccuucacccuaccaauccucacccucggcgaacuuagcaacucacgcuucccuguaucaaucgaccaaauguauacuucccccaacgaagucauuuccguccaaugucagaacggccguugcacacuagacggagaacuccaaggcaccacccaacuucaaguauccggaaucugcgccuucaaaggcgaagucaccgcccaccuccacgacaacgaucaccucuacaacauaacaaucaccaaccuaaacggcucccccuucgacccuuccgaagacauccccgccccacucggaguaccagacuuucagggacgagucuucggcauaauaucccaacgcgacaaacacaacuccccaggccauaacgaacccgccaaccgcggccacgacgccgucguacccaccuacaccgcacaauacacuccaaaacucggccaaauccaaaucggcaccuggcaaaccgacgaccugaccguuagccaacccgucaaauucacaccagucggucuaaacgacacagaacacuucaaccaaugggucgucccacgcuacgccggcgcccucaaccucaacaccaaccuugcgccauccgucgcccccguauucccuggcgaacgccuucuuuucuuccgcuccuacaucccacuuaaagguggcuacggcaaccccgcaauugacugcuuacucccccaagaauggguucaacacuucuaccaagaagccgcacccucuauguccgaaguagcccucguacgauacaucaaccccgacaccggacgcgcccucuucgaagccaaacuccaccgagccggauucaugaccgucucguccaacaccuccgccccagucgucguucccgccaauggauacuucagauucgacuccugggucaaccaauucuacucccucgcccccaugggcacaggcaacggacggcgucgaguucaauga

SEQ ID NO: 35705 - RNA, 1629 nt, Artificial Sequence
  derived and/or modified sequence opt11 from VP1,_capsid_protein__Norovirus__BAL60799
augaaaauggcaucaaacgacgcagccccauccaccgacggcgccgcaggacucgucccagaauccaacaacgaagucauggcccuagaaccuguagcaggcgccgcacucgccgcgcccguaaccggccaaaccaacaucaucgaucccuggauccgcgcaaacuuuguccaggcccccaacggcgaguucacagucucaccccgaaacuccccaggagaaguccugcucaaccucgaacucggccccgaacucaacccauaucucgcccaccucgcaagaauguacaacggcuacgccggaggcauggaaguccaagucaugcuagcaggcaacgccuucacagccggaaaacuuguguucgcagccgucccgccccacuuccccgucgaaaaccucuccccacaacaaaucaccauguucccccacguaaucauagacguccguacacucgaaccaguccuucucccacuuccagacgucagaaacaacuuuuuccacuacaaccaaaaagaugacccaaaaaugcgcauugucgcuaugcuauacacgccccuaagauccaacgguuccggugacgacgucuucaccguaucaugccgcguacuaacccgccccagcccagacuucgauuucacauaccucgucccgcccaccguugaauccaaaacaaagccguucacccuacccauccuaacacucggcgaacucuccaacucucgcuucccagucuccauagaccaaauguacaccuccccuaacgaagucaucuccguccagugucaaaacggccgcugcacccuagacggcgaacugcaaggcaccacccaacuccaagucuccggcaucugcgccuucaaaggcgaagucaccgcacaccuccaugacaacgaccaccuauacaacgucaccaucaccaaccucaacggaucccccuucgaccccuccgaagacauacccgcaccacuuggaguccccgacuuccagggccguguuuucggaguuaucucccaaagagacaaacacaacacccccggccacaacgaaccagccaaccgcgcacacgacgccguaguuccuaccuacaccgcacaauacacacccaaacuuggccaaauacaaaucggcaccuggcagacugaugaccuaacagucaaccaaccaguuaauuucacccccgccggacuaucagacaccgaccacuucaaccaauggguagucccacgauacgccggagcgcucaaccucaacacaaaccuagccccaucagucgcaccagucuucccuggcgaacgucuacuauuuuuccgauccuacauuccacucaaaggcggauaugguacgccagccaucgacugccuccucccccaggaauggguccaacacuucuaccaagaagccgccccaucgaugucugaaguagcccucguccgauacaucaaccccgauaccggccgagcacucuucgaagccaaacuucaccgagccggcuucaugaccgucucauccaacaccagcgccccagucgucgucccagcaaacggcuauuuccgcuuugacuccuggguaaaccaauuuuacagccucgcccccaugggcacaggcaacggccgccggaggauccaauaa

SEQ ID NO: 35706 - RNA, 1629 nt, Artificial Sequence
  derived and/or modified sequence opt11 from VP1,_capsid_protein__Norovirus__BAL60801
augaaaauggccucaaacgaugcagccccaagcaccgacggcgccgccggccucguccccgaaucaaacaacgaaguaauggcccucgaaccaguagccggcgccgcacuugcagcccccgucacaggccaaaccaacauaaucgaccccuggauucgcgcaaacuuuguacaagcuccaaacggugaguucaccgucucaccacgaaacgccccaggagaaguacuccucaaccuagaacucggucccgaacucaacccauaccucgcccaccucgcccgaauguacaacggcuacgcaggcggcauggaaguacaagucaugcuagccgggaacgccuucaccgccggaaagcucgucuuugccgcuguuccaccccacuuccccaucgaaaaccucucuccccaacaaauaaccauguucccgcacgucaucauagacguacguacccucgaaccaguacuccucccccuccccgacguccggaacaacuucuuccauuacaaccaaaaagacgacccaaaaaugcgcaucgucgcgaugcucuauacaccccuucgauccaacggcuccggcgacgacgucuucaccguaucuugucgcguccuaacccgccccucgcccgacuucgacuucaccuaucuagucccucccaccgucgaauccaaaacaaaacccuucacgcuccccauccucacccucggugaacuaucuaauagcagauuucccguauccaucgaccaaauguauaccucacccaacgaagucaucuccguacaaugccaaaacggccgcugcacacucgacggagaacuccaaggaaccacccaacuacaagucuccggaaucugcgcauucaaaggcgaagucacugcccaccuccacgacaacgaccaccuuuacaacaucaccaucacaaaccuaaacgguucacccuucgaccccuccgaagacauccccgcuccccuaggcguccccgacuuccaaggccgcgucuucggcaucaucucacaacgagauaaacacaacucccccggccacaaugaacccgccaaccguggccacgacgcagucguccccacauacaccgcccaauacacccccaaacuaggccagauccaaauaggcacauggcaaaccgaugaccucacagucucccaacccgucaaauucacccccgucggccucaacgauacagaacauuucaaccaauggguugucccccgauacgcaggcgcccucaaccucaacacuaaccucgcaccuucugucgcccccgucuucccaggcgagcgccuacucuucuuccgauccuacaucccacuaaaaggcggcuacggcaaccccgccaucgacugcuuacucccccaagaguggguccaacacuucuaccaagaagcagcccccuccaugucugaagucgcccucguccgcuacauaaacccagacaccggccgcgcccucuucgaagccaaacuccaccgcgcaggcuucaugaccguuucuuccaacacaucagcuccagucgucgucccagccaauggauacuuccgauucgacagcuggguaaaucaguucuacucccucgcccccaugggaacuggaaacggacgccgacgaguccaauga

SEQ ID NO: 35707 - RNA, 1629 nt, Artificial Sequence
  derived and/or modified sequence opt11 from VP1,_capsid_protein__Norovirus__BAL60803
augaaaauggccuccaacgaugcagccccaucuaccgacggagccgccggccuagucccagaaucaaacaacgaagucauggcccucgaacccgucgccggcgccgcccucgccgcccccguaacaggccaaaccaacauaaucgaccccuggauccgugcaaacuucguacaagcccccaacggagaguucacagucucuccucgaaacgcucccggcgaaguacuacucaaccucgaacucggcccagaacucaaccccuaccucgcucaccucgcccgaauguacaacggauacgccggcggcauggaaguccaagucaugcuagccggcaacgccuucaccgcaggaaaacucgucuucgccgcaguaccaccccacuuccccauugaaaaccugucuccccaacaaaucaccauguucccccacguaauaaucgacguccgcacccucgaaccuguucuccuuccucucccagacguccgcaacaacuucuuccacuauaaucaaaaagacgacccuaaaaugcguaucgucgccaugcuauacacaccccuccgcucuaacggaucaggugacgacgucuucaccgucuccugccgcguacucacccgccccucccccgacuucgacuucacauaccucguuccaccaaccguagaaagcaaaacaaaacccuuuacccucccaauacuaacccucggcgaacuaucaaacucccguuucccagucuccaucgaccaaauguacacuuccccaaaugaagucauaucuguccaaugccaaaacggccgcugcacacuugauggugaacuccaaggcaccacucaacuacaaguaucaggcaucugcgccuucaaaggcgaagucaccgcucaccuucacgacaacgaccaccuguacaacaucaccauuaccaaccuuaacggaagccccuucgaccccuccgaagacauccccgcuccccucggcgucccagacuuccaaggccgagucuucgguaucaucagccaacgcgauaaacacaacucacccggccacaacgaaccagcaaaccgcggccacgacgccgucgucccaaccuauacagcacaauacacccccaaacucggccaaauccaaaucggcaccuggcaaaccgacgaccugacagucucacaacccguuaaauucacacccgucggucucaacgacaccgaacacuuuaaccaaugggucgucccgcgcuacgccggcgcacuaaacuuaaauaccaaccucgcuccaucagucgccccggucuuccccggugaacgccuccucuucuuccgaucguacaucccccuuaaaggcgguuacgguaaccccgcaaucgacugccuucucccccaagaauggguacaacacuucuaccaagaagccgcaccauccaugucugaaguugcccugguccgauacaucaaccccgacacaggacgcgcccuuuuugaggccaaacuacaccgcgccggcuucaugacugucuccucaaacaccucagcacccgucgucguucccgccaauggcuacuuccgcuucgacucauggguuaaucaauucuacucccuugcacccaugggcacaggcaacggucgacgccggguacaauaa

SEQ ID NO: 35708 - RNA, 1629 nt, Artificial Sequence
  derived and/or modified sequence opt11 from VP1,_capsid_protein__Norovirus__BAL60805
augaaaauggccuccaacgacgcugcccccucuaccgacggcgcagccggauuaguccccgaauccaacaacgaaguuauggcacuugaaccagucgcaggagcugcccucgccgcccccgucaccggccaaaccaacaucaucgacccuuggauccgagcaaacuucgugcaagcacccaacggcgaguucaccgucuccccucgcaacgcuccaggcgaaguccucuuaaaucucgaacuaggcccagaacuaaaccccuaccuagcccaccuagcacgaauguacaacggccacgccggugguauggaaguccaagucaugcuugcaggaaacgccuucacagccggcaagcuaguauucgccgccgucccaccccacuuccccaucgaaaaccuaagcccccaacaaaucacgauguucccccacgugaucaucgacguccgcacccuugaacccguccuacuaccccuccccgacgucaggaacaacuucuuccacuacaaccagaaagacgaucccaaaaugcgcauugucgccaugcuuuacacaccccuccgauccaacggcuccggcgacgacgucuucacagucuccugccgcguacuaacccgccccucccccgacuucgacuucaccuaucucgucccacccaccguugaauccaaaacuaaacccuucacacuacccauccucacacucggagagcucucaaauucccgcuucccagucucaaucgaccaaauguauacuucccccaacgaaguaauauccguccaaugccagaacggacgcuguacccucgacggcgaacuacaaggaaccacccaacuacaaguauccgguauaugcgccuucaaaggagaagucacagcccaccuacacgacaaugaccaccuauacaacauaaccaucacaaaccucaacggcucccccuucgacccaagcgaagacauacccgcaccccuugguguaccagacuuucaaggccgcgucuucggaaucauaucccaacgagacaaacacaacucaccaggccauaacgaacccgccaaccgaggacacgacgccgucguccccaccuacacagcccaauauacacccaaacucggccaaauucaaaucggaaccuggcaaacagacgaccucaccgucucacaacccgucaaauucacaccagucggucucaacgacacugagcacuucaaccaauggguaguaccacgauacgcaggcgcccucaaucucaauaccaaccucgcccccucagucgcccccguauucccuggagaacgcuuacucuucuuccgaagcuacaucccccucaaaggaggguacggaaaccccgccauagacugccuacucccacaagaauggguccaacacuucuaccaagaagcggcccccucaaugucugaagucgcccucguccgcuacaucaacccagacaccggccgagcccucuuugaagccaaacuccaccgagcuggauucaugaccguauccuccaacaccucagcacccgucguaguacccgcaaacggcuacuucagauucgacucaugggucaaccaauucuacucccucgcacccaugggcaccggcaacggccgccgacgcguacaauaa

SEQ ID NO: 35709 - RNA, 1629 nt, Artificial Sequence
  derived and/or modified sequence opt11 from VP1,_capsid_protein__Norovirus__BAL60809
augaaaauggccuccaacgacgccgcccccuccacggacggcgcggcaggacucgucccugaaucaaacaacgaagucauggcucucgaaccagucgccggcgcagcacucgccgcccccgugacgggccaaacaaacauaaucgaccccuggauccgcgccaacuuuguccaagccccgaacggcgaguucaccguaucucccagaaacucccccggcgaaguccuacuaaaccucgaacucggccccgaacucaaccccuaccuagcccaccucgccagaauguacaacggcuacgccggcggcauggaaguccaagucaugcuagccggcaacgccuucacugcaggcaaacucgucuucgcagccgugccaccccacuuccccguagaaaaccucucaccccaacaaauaacgauguucccccacguaaucaucgacguacgcacacuagagcccguucugcuaccccuacccgauguacgcaacaacuucuuccauuacaaucaaaaagacgaccccaaaaugcgcauaguagccaugcucuauacuccccucagauccaacggcuccggcgacgacgucuuuaccgucagcugcagaguacucacccgucccucccccgacuucgacuucacauaccucgucccaccaaccguugaauccaaaaccaaaccauucacccuacccauacuaacccuuggugaacuauccaacucccgcuucccuguuuccauagaccaaauguacaccucccccaacgaagucaucuccguacaaugccagaacggccgcugcacacuagacggcgaacuucagggcaccacucaacuccaagucuccggaaucugcgccuucaaaggugaagucaccgcccaccuccacgacaacgaccaccucuauaaugucacaaucaccaaccucaacggaucccccuucgaccccucugaagauauacccgccccacucggaguacccgauuuccaaggcagaguauucggcgugaucucccaaagagacaaacacaacaccccaggucacaacgaacccgccaaccgcgcccacgacgccguaguccccacauacaccgcacaauacacaccaaaacucggccaaauccaaaucggcaccuggcaaaccgacgaccucacagucaaccaacccgucaacuucacacccgucggccuaucagacaccgaucacuucaaucaauggguagucccacgauaugccggcgcccuuaaccuaaacaccaaccuagccccauccguagcccccguauuucccggcgaacgucuccucuucuuccgcuccuacauaccccuaaaaggcggcuacggcacccccgcaauugacugccuccucccccaggaauggguccaacacuucuaccaagaagccgcccccuccaugucugaagucgccuugguacgauacaucaacccagacaccggcagagcccucuucgaggcaaaacuccaccgcgcagguuucaugaccgucucaucaaacacgucagcccccgucgucguaccagccaacggcuauuuccgcuucgacuccugggucaaccaauucuacucccucgcccccaugggcaccggcaacggccgacgccgcauacaauaa

SEQ ID NO: 35710 - RNA, 1629 nt, Artificial Sequence
  derived and/or modified sequence opt11 from VP1,_capsid_protein__Norovirus__BAL60811
augaaaauggcuuccaacgacgccgcccccucaaccgacggcgcagccgggcucguccccgagucaaacaacgaagucauggcccucgaaccagucgccggcgcagcccuagccgcaccagucacuggccaaaccaacaucaucgaccccuggauccgcgcaaacuucguccaagccccaaacggcgaguucacagucucuccccgaaacgcacccggagaaguccuucuaaaccuagaacucggaccagaacucaaccccuaccucgcacaccucgcacgcauguacaacggcuaugcagggggaauggaaguccaagucaugcuagccggcaacgccuucacagccggcaaacucguuuucgccgcaguacccccacacuuccccguagaaaaccucagcccccagcagaucacuauguucccacaugucaucaucgauguccguacccucgaacccgugcugcucccccuuccagacguacgcaacaauuucuuccacuacaaccaaaaagacgacccaaaaaugcgaauugucgcaaugcuguacacaccccuccgauccaacgguuccggcgacgacgucuucacagucuccugucgcguccucacccgccccucccccgauuucgacuucaccuaccuugucccacccaccguagaaagcaaaaccaaacccuucacccucccaauccucacacucggcgaacucuccaacucccgcuuucccgucuccaucgaccaaauguacaccuccccaaacgaaguuaucucgguacaaugccaaaacggccgcuguacacuagacggagaacuucaaggaaccacgcaacuccaagucucgggcaucugcgcauucaaaggggaagucacagcccaccuucacgacaacgaccaccucuacaacauaaccaucacaaaccuaaaugguuccccuuucgaccccucagaagacauccccgcaccccugggcguaccagauuuccaaggcagagucuucggcauuauaucccaacgggauaaacauaacucucccggccacaacgaacccgccaaccgcggccacgacgccgucguccccaccuacacugcacaauacacacccaaacucggacaaauccaaauaggaacauggcaaacagacgaccuaacugucagccaacccgucaaauucacucccgucggucucaacgacacagaacacuucaaccaaugggucgugccccgcuacgccggugcccucaaccucaacacgaaccuagcgcccucuguagcacccgucuuccccggagaacgccuccuauucuuccgcuccuacauaccacucaaaggcggguacggcgaccccgccaucgacugccuacucccccaagaauggguucaacauuucuaccaagaagcagcccccuccauguccgaaguagcgcuaguccguuacaucaacccagacaccggacgcgcacuuuucgaagccaaacuccaccgcgccggcuuuaugaccgucucaucgaacaccuccgcccccguagucguccccgccaacggcuacuuccgcuucgacagcugggucaaccaauucuacucauuagccccaaugggcaccggcaacggaagacgccgcguacaauaa

SEQ ID NO: 35711 - RNA, 1629 nt, Artificial Sequence
  derived and/or modified sequence opt11 from VP1,_capsid_protein__Norovirus__BAL60813
augaaaauggcauccaacgacgccgcuccauccacagacggagccgccggacucgucccugaguccaacaacgaggucauggcccucgaaccagucgcaggagccgcacucgccgcccccguaaccggacaaaccaacaucaucgaccccuggauccgcgccaacuucguccaagccccaaacggcgaguucaccgucuccccacgcaacgcccccggugaaguacuccuuaaccuagaauuaggccccgaacuaaacccauaucuagcccaccuugcucgcauguacaacgguuaugccggcggcauggaaguccaaguaaugcucgccggcaacgccuucacagccggcaaauuaguauucgccgccguaccaccccacuucccaguagaaaaccugucuccccaacaaauuacaauguucccccacguaaucaucgacguaagaacccucgaaccuguucuacucccccucccugacguccgaaacaacuucuuccacuacaaccaaaaagacgaccccaaaaugcgaauugucgccaugcucuacacaccccuacgcuccaacggcuccggagacgacgucuucaccguuuccugccgcguacugacacgcccaucucccgacuucgacuucacauaccucgucccaccuaccgucgaaucaaaaacaaaacccuucacccucccaauccuaacccuuggcgaacucucuaacucccgcuuccccgucuccaucgaccaaauguauaccucacccaaugaaguuaucucaguccaaugccaaaacggccgaugcacccuagacggggaacuccaaggaacaacccaacuccaagucuccggcaucugcgccuucaaaggagaaguaaccgcccaccuccacgacaacgaccaccuauacaacaucacaaucaccaaccucaacggcucacccuucgauccuucagaagacauccccgcccccuuaggagucccagacuuccaaggccgcgucuucggcauaaucucacaacgagacaaacacaacucccccggccauaacgaacccgcuaaucgcggacacgacgcuguuguccccaccuacacagcacaauacacccccaaacuuggucaaauucaaaucggaacauggcaaacagacgaucuaacagucucccaacccguaaaauucacccccguaggccuaaacgacaccgaacauuucaaccaaugggucgucccccgcuaugcuggcgcucucaaccucaacacuaaccucgcacccuccgucgcucccguauuccccggagaaagacuacucuucuuucgcagcuacauuccacuaaagggaggcuacggcgaccccgccaucgacugccuccucccccaagaauggguccaacacuucuaccaagaagccgcacccuccaugucagaagucgcccuaguccgauacauaaaccccgacacaggcagggcacucuuugaagcuaaacuccaccgugccggauucaugaccgucuccuccaauaccuccgcaccaguaguaguccccgccaacggauacuuccgauucgacuccugggucaaccaauucuacucauuagcccccaugggcaccggcaauggccgccgucguguucaauaa

SEQ ID NO: 35712 - RNA, 1629 nt, Artificial Sequence
  derived and/or modified sequence opt11 from VP1,_capsid_protein__Norovirus__BAL60815
augaaaauggcaucuaaugacgcugcacccucaaccgacggcgcagcaggccucguccccgaauccaacaacgaagucauggcacucgaacccgucgcaggagccgcccuagcagcccccgucaccggccaaacaaacaucaucgacccuuggauacgagccaacuuuguccaagcccccaacggcgaguucaccguaucgccccguaacucccccggcgaaguacuccucaaccuugaacuaggcccagaacuaaacccauaccucgcccaccucgcccgcauguacaacggcuaugccggcggcauggaaguccaaguaaugcucgcaggaaaugcauucacugccggcaaacucgucuucgccgccgucccaccccacuuuccuguugaaaaccuaagcccccaacagaucaccauguucccacacgucaucauagauguccgcacucuagaacccguccuccucccacuuccugacguucgcaacaauuucuuccacuacaaccaaaaagacgaccccaaaaugcguaucguagccaugcucuacacccccuuacgcagcaacggcuccggcgacgacguuuucaccguauccugccgcguacuuacucggccuucccccgacuucgacuucacauaccuagucccacccaccguagaauccaaaacaaaacccuucacacuccccauccucacucucggugaacucucaaacucacgauucccagucucaaucgaccaaauguauaccagccccaacgaaguaaucuccguacaaugccaaaauggacggugcacccucgacggcgaacuccaaggcacaacccaacuccaagucucaggcaucugcgccuuuaaaggggaagucaccgcucaccuccacgacaacgaccaccuauacaacgucaccaucaccaaccucaacggcucccccuucgaccccuccgaagacauccccgccccacuagguguccccgacuuccaagggcgcguauucggcgucauaucccaaagagauaaacacaauaccccaggccacaacgaacccgccaaccgcgcacacgacgcaguuguacccaccuacaccgcacaauacacccccaaacuuggacaaauucaaauugguacuuggcagaccgacgaccuuacagucaaccaacccgucaacuuuacccccgucggccuauccgacacagaccacuucaaccaguggguagucccucgauacgcuggcgcccucaaccucaacacaaaccucgcccccuccgucgccccaguauucccaggcgaacgccuccuauucuuccgcucauacauaccccuaaaaggcggcuacggcacccccgcaauagacugccuccucccacaggaauggguccaacacuucuaccaggaagcagcccccuccaugucugaaguugcacucgugcgauacauaaaccccgacaccggccgcgcacucuucgaagccaaacuccaccgcgccggcuucaugaccguauccuccaacaccuccgccccaguagucguacccgccaacgguuacuuccgauucgacuccugggucaaccaauucuacucacuagcccccaugggcacaggaaacggccggcgcagaauacaauaa

SEQ ID NO: 35713 - RNA, 1629 nt, Artificial Sequence
  derived and/or modified sequence opt11 from VP1,_capsid_protein__Norovirus__BAL60817
augaaaauggccuccaacgaugccgcaccauccaccgacggagccgcaggccucguccccgaauccaauaacgaaguaauggcccuagaaccaguugccggcgcugcccucgcugccccagucacuggccaaacaaacauuaucgaccccuggauccgagcuaacuuuguacaagccccaaacggggaguucacagucucaccccgaaacgcacccggagaaguccuacucaaccucgaacucggcccagaacucaaccccuaccucgcucaccucgcucgaauguacaacgguuacgcaggaggcauggaaguccaagucaugcucgcuggcaacgccuucaccgccggcaaacucgucuuugcagccguaccuccccacuuccccauagaaaaccucucaccccaacaaauaaccauguucccucacgucauaauagacguccgcacccucgaaccaguacuacucccccuacccgacguacgaaacaacuucuuccauuacaaccaaaaagacgaucccaaaaugcgaauaguagcaaugcucuacacuccccuccgcuccaauggauccggagacgacguguucaccguuuccugccgaguacuaacccgcccuucccccgacuucgacuuuacauaccuagucccacccacuguagaauccaaaaccaaacccuuuacacuccccauccucacccucggugaacucuccaacucccgcuuccccguaucgauagaccaaauguacaccucccccaacgaaguuaucuccguccaaugccaaaacggccgcugcacccucgacggcgaacuccaaggaaccacccaacuacaaguuuccggcauaugcgccuucaaaggcgaagucacagcccaucugcacgauaacgaccaccuauacaacauaaccaucaccaaccuuaacggcucccccuucgacccauccgaagacauccccgcuccacuuggcguacccgacuuccaaggccgcgucuucggcauaaucucccaacgagauaaacacaacucccccggccacaaugaacccgccaacagaggccacgacgccgucguccccaccuacaccgcccaauacacacccaaacucggccaaauccaaauaggcaccuggcaaacugacgaccucaccgucucccaacccgucaaauucgcccccgucggccuuaaugauacagaacacuucaaccaauggguagucccccgauacgccggagcccuaaaccucaacaucaaccucgcacccuccgucgcccccgucuuccccggagaacgccuacucuucuuccgaucauacaucccccucaaagguggauacggcaaucccgccaucgacugccuacuuccccaagaauggguacaacacuucuaccaagaagcagcucccucaaugucugaaguggcgcucguucguuacauaaaccccgacaccggcagagcacucuucgaagcaaagcuacaccgcgccggauucaugaccgucucuagcaacacuucagcccccguagucguccccgcaaacggcuacuuccgcuucgacagcugggucaaucaauucuacucacucgcccccaugggaaccggcaacggacgacgccgaguccaguaa

SEQ ID NO: 35714 - RNA, 1629 nt, Artificial Sequence
  derived and/or modified sequence opt11 from VP1,_capsid_protein__Norovirus__BAL60819
augaaaauggccucaaacgaugccgcccccuccacagacggcgcagcaggucuugucccagaaagcaacaacgaaguaauggcccucgaaccagucgcaggcgcugcccuugcagccccagucaccggucaaacaaacaucaucgaccccuggauccgagccaacuucguccaagcacccaacggcgaguucacggucuccccucguaacgcaccaggcgaaguccuccucaaccucgaacuaggccccgaacugaaccccuaccucgcacaccucgcccgcauguacaacggcuacgcaggaggcauggaaguccaaguaaugcuagccggcaacgcauucaccgccggaaaacucguauuugccgcuguacccccacacuucccaaucgaaaaccuaucaccccaacaaaucacuauguucccucacgucaucauagacguacgaacccucgaaccaguacuacuaccucuccccgacgugcgaaacaacuucuuccacuacaaucaaaaggacgacccuaaaaugagaauagucgccaugcucuacacuccccuccgcuccaacggauccggcgacgacgucuucaccguaucaugccgcguccucacccgcccuuccccggacuucgacuucaccuaccuaguaccuccuaccguagaaucaaaaaccaaaccguucacccuaccaauccucacccucggcgaacuuuccaacucccgcuuccccgucuccaucgaccaaauguacaccuccccuaacgaagucauauccguccaaugucaaaauggccgcugcacccucgacggcgaacuccaaggcaccacccaauuacaagucuccggcaucugcgcauucaaaggcgaagucaccgcccaccuccacgacaacgaucaccucuacaauaucacgaucacaaaccuuaacggcucacccuucgacccaucagaagauauaccagcaccccugggcguacccgacuuccaaggacgaguuuucggaauuauaucacaacgcgacaaacacaacucccccggacacaacgaaccagccaaucgcggacacgacgccgucguccccaccuacaccgcccaauacacccccaaacucggccaaauacaaauuggaaccuggcaaacagacgaccucaccguaucucaacccgucaaauuuacaccagucggccucaacgacaccgaacacuucaaccaauggguaguaccccgauacgccggagcccuaaaucucaauacuaaucuagccccuuccguagccccagucuucccaggcgaacgccuccucuucuuccgcucauacaucccccucaagggcggcuaugggaacccagccaucgacugccuccucccucaagaauggguccaacacuucuaccaagaagccgcuccauccauguccgaaguugcacucguccgauacauaaaucccgacaccggacgagcccucuucgaagccaaacuacaccgcgccggcuucaugacaguaucuuccaauaccagcgcccccguaguuguccccgccaacggcuacuuccgcuucgacuccugggucaaccaauuuuacagccuagcccccaugggcaccggcaacggacgacgccgaguccaauaa

SEQ ID NO: 35715 - RNA, 1629 nt, Artificial Sequence
  derived and/or modified sequence opt11 from VP1,_capsid_protein__Norovirus__BAL60821
augaaaauggccucaaaugacgcagcccccuccaccgacggcgcugccggccucguacccgaauccaacaacgaggucauggcccuagaaccuguggccggagcagcccucgccgcccccgucacaggacaaaccaacauaauagaccccuggauccgugcaaauuucguccaagccccaaacggcgaguucaccgucucaccccgcaacgcccccggcgaaguccuccuaaaucucgaacuaggccccgaacucaaccccuaccucgcacaccuagcccgcauguacaacggcuacgcaggaggcauggaaguccaaguaaugcucgccggcaacgccuucaccgccggcaaacucgucuuugcugccguaccaccccacuuccccaucgaaaaccuuucuccccaacaaaucaccauguucccccacgucauaaucgacguaagaacacucgaaccgguccuacucccccuccccgacguccgcaacaacuucuuccacuauaaccaaaaagacgacccaaaaaugcgcaucgucgccauguuauacacaccccuccgcuccaacggcuccggagacgacgucuucaccguaucuugccgaguacucacccgccccucucccgacuucgacuucacuuaccucguaccacccacagucgaauccaaaaccaaacccuucacccuccccauacucacccuaggagaacucucuaacucacgauuccccgucuccaucgaccaaauguacacaucccccaacgaagucaucagcguccaaugccaaaacggccgcugcacacuagacggcgaacuccaaggaaccacccagcuacaggucucaggaauaugcgcuuucaaaggagaaguuaccgcccaccuccacgacaacgaccaccucuacaacauaacaauuaccaaccuuaacggcagccccuucgaccccuccgaggauauacccgcaccccuaggggucccagacuuccaaggcagaguauucggcaucaucucucaacgagauaaacacaauagccccgggcacaacgaacccgccaaccgcggccacgaugcgguaguccccacauacaccgcacaauauaccccuaaacuaggacaaauccaaaucgguaccuggcaaaccgaugaccuaaccgucucacaaccagucaaauucaccccuguaggccucaacgacacagaacacuucaaccaaugggucgucccccgcuacgcaggcgcacucaaccuaaacaccaaucucgcccccucagucgcaccaguauuccccggcgaacgccuacucuuuuuccguucauacaucccacuuaaaggcggauacggcaacccagcaaucgauugccuccuaccccaagaauggguccaacauuucuaucaggaagcggcacccuccauguccgaaguagcacuuguacgauacaucaaccccgacaccgggcgcgcccucuuugaagcaaaacuucaccgcgccggauucaugacugucuccuccaacacaagcgcgcccgucgucguucccgcuaacggcuacuuccgguucgacucauggguaaaucaauucuacucccucgccccuaugggcacuggaaacggccgacgccgaguccaauaa

SEQ ID NO: 35716 - RNA, 1629 nt, Artificial Sequence
  derived and/or modified sequence opt11 from VP1,_capsid_protein__Norovirus__BAL60823
augaaaauggcaucaaacgacgccgccccaucaaccgacggcgccgcuggacuuguccccgaaagcaacaacgaaguaauggcccuagaaccugucgcaggcgccgcccuugccgcacccgucaccggccaaacaaacaucaucgaccccuggauccgcgcaaacuuuguccaagcccccaacggagaguucaccguuucucccagaaacgcaccaggcgaaguccuccucaaccucgaacugggacccgaacuaaaccccuaccucgcccaucucgcccgcauguacaacggauacgccggcggucucgaaguucaagucaugcuagccggaaacgcuuucaccgcaggcaaacucgucuucgccgcuguacccccacacuucccuauagaaaaccucagcccccaacaaaucaccauguucccucacgucaucaucgacguccgaacccuugaaccaguccuacucccccuacccgacguucgcaacaacuucuuccacuauaaccagaaagacgaccccaaaaugcgcaucgucgcaaugcuauacacaccccuacgcucaaauggcuccggagacgacgucuucacuguauccugccgcguccuaacccgcccuucccccgacuucgacuucaccuaccuagucccaccgacugucgaauccaaaacaaaaccauucacacuccccauccucacccugggggaacucucaaacagccgauucccagucucuauagaccaaauguacaccagccccaacgaagucauuagcguccaaugccaaaacggccguugcacccuugacggcgaacuacaaggaaccacccaacuacaagucuccggaauaugcgcauucaaaggcgaagucacagcccaccuccacgauaacgaccaccucuacaacauaaccauuacaaaccuaaauggcuccccauucgaccccagcgaagacauacccgcaccacuuggaguucccgacuuccaaggucgagucuuuggcauaaucucacaacgcgacaaacacaauucaccaggccacaacgaaccagccaaccggggacaugacgccgucguccccaccuacacugcacaauacacccccaaacucggccaaauccaaaucggaaccuggcaaaccgaugaucucaccgucagccaaccaguaaaauucacccccguaggccuaaacgacaccgaacacuucaaccaaugggugguuccccgauacgccggcgcccucaaucuaaacaccaaccuagcccccuccgucgccccagucuucccaggugaacgccuacuauucuuccgcagcuacauaccccuaaaaggcggcuacggaaaccccgcuauagacugccuccuuccccaagaauggguccaacauuucuaccaagaagcagcccccucgauguccgaggucgcccucguccgcuacauaaacccggacaccggcagagcccucuucgaagcuaagcuacaccgagccggcuucaugaccguuuccucaaacaccuccgcgcccguggucguaccagccaaugguuacuucagauucgacucuuggguaaaccaguucuacucccuugcccccauggguaccggcaacggccgccgccgcguucaauaa

SEQ ID NO: 35717 - RNA, 1629 nt, Artificial Sequence
  derived and/or modified sequence opt11 from VP1,_capsid_protein__Norovirus__BAL60825
augaaaauggccuccaacgacgccgcacccucaaccgacggcgccgccggccucguacccgaauccaacaaugaagucauggcacuagaacccgucgccggcgcagcacuagcagcccccgugacaggacaaacaaacaucaucgacccuuggauccgagcgaauuucguccaagcacccaacggagaguucacaguaucccccagaaacucaccaggcgaaguacuccugaaccucgaacucggcccagaacucaaccccuaccucgcccaccucgcacgcauguacaacggcuacgcuggcggaauggaaguacaagucaugcuugccggcaacgcauucacagcuggcaaacucguauucgccgccgucccuccccacuuccccgucgaaaaccuaucaccccaacaaaucacaauguucccccacgucauaauagacguccgaacacuagaacccguccuccucccccucccagacguccggaacaacuucuuccauuacaaccaaaaagacgacccaaaaaugcgcauagucgccaugcuauacaccccacuacgcuccaauggcucaggugacgauguguucaccgucuccugccgcguacucacaagacccucccccgacuucgacuucacauaccucguacccccaacagucgaauccaaaaccaagagcuucacccucccaauucucacacucggcgaacucucaaacuccagauuccccgucucaaucgaucaaauguacaccagcccaaacgaaguaauauccgugcaaugucaaaacggccgcuguacccucgacggcgaacuucagggcacaacacaacuacaagucuccgguaucugcgccuucaaaggcgaagucacagcccaccuacacgacaacgaccaccuguacaaugucacaaucaccaaccuaaacggcucccccuuugacccaagcgaagacaucccugccccacuuggcguaccugacuuucaaggccgcguauuuggcgucaucucccaacgugacaaacacaacacaccgggccacaacgaaccugccaaccgcgcccacgacgccgucguccccaccuacaccgcccaauauacccccaaacuaggccaaauacaaaucggcacguggcaaaccgacgaccuaaccgucaaccaaccaguaaacuucacuccagucggccucucugacaccgaccacuucaaucaaugggucguccccagauacgccggcgcccucaacuuaaacacaaaccuagcacccuccgucgcccccguauuccccggcgaacgccuccucuucuuccgaucauauauaccccucaaaggcggcuacggcacccccgcaauagacugucuccucccccaagaauggguacagcacuucuaccaggaagccgcccccuccaugucugaaguagcacucguccgcuacaucaacccagacaccggccgagcccuuuucgaagcuaaacuacaccgugcaggcuucaugaccguauccucgaacacaucugcccccgucgucguacccgcaaacgguuacuuccgcuucgacucaugggucaaucaauucuacucccucgcccccaugggcacgggcaacggacgaaggcgcauccaauaa

SEQ ID NO: 35718 - RNA, 1629 nt, Artificial Sequence
  derived and/or modified sequence opt11 from VP1,_capsid_protein__Norovirus__BAL60827
augaaaauggcaucaaacgacgccgccccuuccaccgauggcgccgcaggccucguaccagaauccaacaacgaagucauggcacucgaacccguugccggcgccgcauuagccgcucccgucacaggccaaacuaacaucaucgaucccuggauccgcgccaacuucguccaagcacccaacggggaguucacugucucucccagaaacgccccaggcgaaguccuucucaaccuagaacucggccccgaacucaacccauauuuagcacaccucgcccgcauguacaauggauacgccgguggaauggaaguccaaguaaugcuagccggcaacgcuuucaccgccggcaaacucguuuucgcugcagucccaccccacuuccccauugaaaaccucagcccccaacaaauaaccauguucccccaugucauuaucgacguccgaacccuugaacccguacuccuccccuuaccagacguccgcaacaacuucuuccacuacaaccaaaaagaugaccccaaaaugcgcaucgucgccaugcucuacacaccucuacgguccaacggcuccggcgacgacgucuucaccguuucuugccgcguccucacacgccccucaccagacuucgacuucaccuaccucguacccccuaccgucgaaagcaaaacuaaaccauucacccuacccauccucacccucggugaguuaucaaacucacgcuucccagucucgaucgaccaaauguacacaucaccaaacgaagucauauccguccaaugccagaacggacguugcacccucgacggcgaacuccaaggaacaacccaacuccaagucucuggcaucugcgcauucaaaggcgaaguuaccgcucaucuacacgacaacgaccaccucuacaacauaacaauaacaaaccucaacggcucacccuucgacccaucagaagacauccccgcaccacucggcguacccgacuuccagggcagagucuucgguauaauaucccaacgcgacaaacacaacucccccggccacaacgaacccgccaaccgcggccacgacgccguaguacccacauacaccgcccaguacacccccaaacucggccaaauccaaauaggcaccuggcaaaccgacgaccuuacugucucccaacccgucaaauucacccccguaggccucaacgacaccgaacacuucaaccaauggguagucccacgauacgcuggcgcccucaaccucaacaccaaccuugcccccuccgucgcccccguauuccccggcgaacgacuacucuucuuccgaagcuacauaccccucaaaggcggcuacggcaaccccgccaucgauugccuccuaccccaagaauggguacaacacuucuaccaagaagccgcucccucaauguccgagguugcacucguccgauauauaaacccagacaccggccgagcccucuucgaagccaaacuucaccgcgccgguuucaugaccguauccucuaacaccuccgcccccguagucguucccgccaauggauacuuuagauucgacuccugggucaaccaauucuacucacucgcccccaugggcacaggcaacggccgacgcagaguucaguaa

SEQ ID NO: 35719 - RNA, 1629 nt, Artificial Sequence
  derived and/or modified sequence opt11 from VP1,_capsid_protein__Norovirus__BAL60829
augaaaauggccucaaacgacgcagcacccucgaccgacggcgcagcaggccucguaccagaaucuaacaacgaagucauggcacuagagccagucgccggcgccgcacuugccgcacccgucaccggacaaaccaacauaaucgacccauggauacgcgccaacuucguacaagcaccaaauggcgaguucaccgucucaccccgcaacgcucccggcgaaguccuacucaaccuagaacuaggaccagaacuaaacccauaccuagcccaccucgcacgcauguacaacgguuacgcaggaggcauggaaguacaagucaugcucgccggcaacgcguucaccgcuggcaaacucgucuucgcagcugucccaccucacuuccccaucgaaaaccucucaccccaacaaaucacaauguucccacaugucauuaucgacguccgaacccuagaacccguccuccuuccccuaccagacguccguaacaacuucuuccacuacaaccaaaaagaugaccccaaaaugcgcauugucgcaaugcuauacacuccccuaagguccaacggauccggcgaugacgucuucaccguauccugccgaguccuuacccgacccucucccgacuucgacuucaccuaucuagucccacccacugucgaauccaaaaccaaacccuuuacucuacccauacuaacucuuggagaacuauccaacucccgguuccccguauccaucgaccaaauguacacaucccccaacgaaguuauuucaguacaaugccaaaacggccguugcacccucgacggagaacugcagggcacgacccaacuccaagucucaggcaucugcgccuucaaaggagaagucaccgcccacuuacacgacaacgaccaucucuacaacaucaccauaaccaaucucaacggcucccccuucgaccccucagaggauaucccagcgcccuuaggcguaccugacuuccaaggccgugucuucggcaucaucucccaacgagacaaacacaacagccccggccacaacgaacccgcaaaccgcggccacgacgcugucguccccaccuacacagcccaguacacaccuaaacucggccaaauccaaauuggcacauggcaaaccgacgaccuaaccgucagccaaccaguaaaauucacccccguaggacucaacgacacagaacacuucaaucaaugggucguaccccgcuacgccggagcccucaaccucaacacaaaccucgcaccuucuguagccccugucuuccccggugaacgacuucuauucuuccggagcuacaucccacugaaagguggauacggcaaccccgccaucgacugccuccuaccccaagaauggguacaacacuucuaccaagaagccgccccuuccaugagcgaagucgcccucguccgcuacaucaacccagacacaggccgcgcacuauucgaagcgaaacuccaccgagccggcuucaugaccgucuccagcaacacuucagcccccguaguagucccagcgaacggcuacuuccgcuuugacuccugggucaaccaauucuacucccucgcccccaugggcaccgggaacggacgccgccggguccaauaa

SEQ ID NO: 35720 - RNA, 1629 nt, Artificial Sequence
  derived and/or modified sequence opt11 from VP1,_capsid_protein__Norovirus__BAL60831
augaaaauggccuccaacgacgccgcccccucaaccgacggcgccgccggccucguaccugaauccaacaaugaggucauggcauuagaacccgucgcaggcgccgcacucgccgcacccgugacuggucagacaaacaucaucgaccccuggauacgagcaaacuucguacaagccccgaacggagaguucaccgucuccccucgaaacgcccccggcgaaguccuccuuaaucuagaacuaggcccagaacuaaacccauaccucgcacaccuagcacgcauguacaacggauacgccggaggaauggaaguacaaguuauguuagccggcaacgccuucaccgcaggaaagcuagucuucgcggcagugcccccgcacuuccccaucgagaaccuaucaccacagcaaauaaccauguucccccacgucaucauagacguccgcacccuugaacccguacuauuaccccugccagacguccgcaacaacuucuuccacuacaaccaaaaagacgaccccaaaaugcgcaucgucgcuaugcucuacacaccccuccgcuccaacggauccggcgacgaugucuucacagucucaugccgcguccucacccggcccuccccagauuucgauuucacauaccucgucccucccacuguagaauccaaaaccaaacccuucacccuccccauccucacacucggcgaacuaucaaacucucgcuuccccgucucaaucgaccaaauguacacauccccaaacgaagucauauccguccaaugccaaaacggcagaugcacccucgacggcgaacuccaaggcaccacacaacuccaaguauccggcaucugcgcauucaaaggcgaagucaccgcccaccuccaugacaacgaucaucucuacaacauaaccauuaccaacuuaaacggcaguccauucgaccccagcgaagacauaccagcacccuuaggagucccugacuuccaaggccgcgucuucggcaucaucucccaacgcgacaaacauaacucccccggccacaacgaaccagccaaccgcggccacgacgcaguagucccaaccuacaccgcccaauacacccccaaauuaggacaaauccaaaucggaaccuggcaaacagacgaccuuaccguuucacaaccuguaaaauucacccccguuggacucaacgacaccgaacacuuuaaccaaugggucguuccucgauaugcuggcgcccuaaaccuaaacaccaaccuagcaccauccgucgcccccguauuuccuggcgaacgccuccuuuucuuccgcuccuacaucccccucaaaggaggcuacggcaaccccgccaucgacugccuccucccccaagaauggguccaacacuucuaccaagaagccgcacccuccaugucugaagucgcccuagucagauacaucaaccccgacacaggccgcgcacuauucgaagcaaaacuccaccgugccggcuuuaugaccguauccuccaacaccuccgcacccgucgucguccccgccaacggcuauuuccgauucgacuccugggucaaccaguucuacucccucgcacccaugggcacaggcaacggccgcagacgcguccaauaa

SEQ ID NO: 35721 - RNA, 1629 nt, Artificial Sequence
  derived and/or modified sequence opt11 from VP1,_capsid_protein__Norovirus__BAL60833
augaaaauggccucuaaugaugccgcccccuccaccgacggcgccgcaggccucguccccgaaucuaacaacgaaguaauggcacuagaaccagucgccggcgcagcccuggccgccccagucaccggccaaacuaacauaaucgauccauggauccgagccaacuucguacaagcucccaacggcgaauuuaccguaucccccaggaacagcccuggcgaaguccuacucaaccucgaacucggcccagaauuaaacccauaccucgcccaccucgcacggauguacaacggcuacgccggcgguauggaaguccaagucaugcucgccggcaacgcauucaccgccggcaagcuaguauucgccgccgucccaccccauuucccugucgaaaaccucucuccacaacaaaucaccauguucccccacgucauaauugacguacguacucucgaacccguauuacucccccuccccgacguucgaaacaacuucuuccacuacaaccagaaagacgacccaaaaaugcgcaucguagcaaugcucuacacuccccuccguuccaacggcuccggcgacgacgucuucaccgucucaugccgcguacucacccgucccucucccgacuucgacuucaccuaccuuguaccacccaccgucgaauccaaaacaaaacccuuuacccucccaauacucacacuaggagaacucuccaacucccgcuuccccgucucaauugaccagauguacacaucaccaaacgaagucaucucaguccaaugccaaaacggccgaugcacccucgauggcgaacuacaaggcaccacccaacuacaagucuccggcauuugcgccuucaaaggcgaagucaccgcccaccuacacgacaacgaccaccuauacaacguaacaaucacuaaccuaaacggcucccccuucgaucccuccgaagacauccccgcuccccuaggcgucccagacuuccaaggucgggucuucggcgucaucucucaaagagacaaacacaacaccccuggucacaacgaaccugccaaccgcgcccacgacgccgucgucccaaccuacacugcccaauacaccccuaaacuagggcaaauacaaaucggcaccuggcagacagacgaucuuaccguaaaccaacccgucaacuuuaccccaguaggacucaacgacacagaucacuucaaccaaugggucguuccccgcuacgccggagcccucaaccuaaacaccaaccucgcccccucagucgcccccgucuucccaggagaacgccuccucuucuuccgcuccuacauuccacucaaagguggcuacggcacccccgcaauagacugccuucucccccaagaaugggugcaacacuucuaccaagaagccgccccauccaugucugaagucgcucucguacgauauaucaauccagacacaggccgcgcccucuucgaagccaaacuccaccgcgcaggcuucaugaccguaucauccaacacauccgcccccgucgucguccccgccaacggauacuuccgcuucgacuccuggguaaaucaauucuacucacuagccccaaugggcaccggaaacggccgccggcgcauucaauaa

SEQ ID NO: 35722 - RNA, 1629 nt, Artificial Sequence
  derived and/or modified sequence opt11 from VP1,_capsid_protein__Norovirus__BAL60835
augaaaauggcaagcaacgacgcagcacccuccaccgacggagcagcuggccucguaccagaauccaacaacgaagucauggcacucgaacccguagccggagccgcccuggccgcgccugucacaggacaaaccaacauaauugaccccuggaucagagccaacuucguccaagccccaaacggcgaguucacgguauccccacgcaauucacccggcgaaguccuccucaaccucgaacucggccccgaacuaaaccccuaccucgcccaccuugcuagaauguacaaugguuaugccggcggcauggaaguccaagucaugcucgccggaaacgcauucaccgccggaaaacuugucuucgcagccgucccaccccacuuucccguagaaaaccuaucaccccaacaaaucacaauguucccacacgucaucaucgacguccgaacccucgaaccagugcuccucccccugccagacguccgcaacaacuucuuccacuacaaccaaaaggacgaccccaaaaugcgaauagucgccaugcuuuacacaccccuccgcucgaacggcucaggagacgacgucuuuaccguauccugccgcguccucacacgccccucccccgacuucgacuucaccuaccuugucccacccaccguugaauccaaaacaaaacccuucacccugcccauccucacccucggugaacuuagcaacucuagauuccccguuuccaucgaccaaauguacaccucccccaacgaagucaucuccguacagugccaaaacggccgaugcacccuugacggcgaacuacaaggcaccacccaacuccaagucucaggaauaugcgccuucaaaggcgaagucaccgcacaccuccacgacaacgaccaccucuacaaugucacuauaaccaacuuaaacggaucacccuucgaccccagcgaagacauuccagcuccacucgguguacccgacuuccaaggccgcgucuuuggcgucauuucccagagggacaaacacaacacacccggacacaacgaaccagccaaccgagcacacgacgccgucguccccaccuacacagcccaauacacacccaaacucggccaaauacaaauaggaaccuggcaaacagacgaccucacugucaaccaacccgccaacuucaccccuguaggacucucagacacggaccacuucaaccaauggguggugccccguuacgccggugcccucaaccuaaauacaaaccucgcccccuccgucgcacccgucuuucccggggaacgccuuuuauucuuccgcucauacauaccccuaaaaggaggcuauggcacccccgcuauagacugccuccuaccccaagaauggguccaacacuucuaccaagaagccgccccaucuauguccgaaguagcacucguccgcuacaucaacccugacaccggccgagcacucuucgaagccaaacuacaccgagccggcuucaugaccguauccagcaacaccucagcccccgucguaguccccgcaaacggcuacuuccgauucgacuccugggucaaccaauucuacagucuugcucccaugggcacagguaacggucgucgccggauccaauaa

SEQ ID NO: 35723 - RNA, 1629 nt, Artificial Sequence
  derived and/or modified sequence opt11 from VP1,_capsid_protein__Norovirus__BAL60837
augaaaauggcauccaacgaugcugcccccagcaccgacggugcagcaggccucgucccugaaucaaacaacgaaguuauggcacuagaaccagucgccggcgcagcccuagccgccccggucaccggucaaaccaacauaaucgaccccuggauccgagccaacuucguucaagcccccaacggcgaguucacagucuccccgcgcaacucccccggagaaguucuccucaaccucgaacucggccccgaacucaaccccuacuuagcccacuuagcgcguauguacaauggcuacgcaggagguauggaaguccaagucaugcuagcaggaaacgccuucaccgccggcaaacucgucuucgcagcaguacccccacacuuccccgucgaaaaccucagcccccaacaaaucacgauguucccccacgucaucaucgauguccgaacccucgaacccguccuccuaccccuccccgacguccgcaacaacuucuuccacuacaaccaaaaagacgaccccaaaaugcgcauugucgccaugcucuacaccccacuacgauccaacggcuccggagacgacguauucacugucucaugccgcguccucacccguccuagccccgacuucgacuucaccuaccuggucccacccaccguugaauccaaaacaaagcccuuuacccuacccaucuuaacucucggagaacucuccaacucacgcuuccccgucuccaucgaccaaauguacaccucuccaaacgaagucaucuccguccaaugccaaaauggccgcugcacacucgacggagaacuacaaggcaccacucaacuccaaguaucaggcaucugcgcauucaaaggagaagucaccgcccaccuucaugacaacgaccaccucuacaacguaaccauuaccaaccuaaacggcucacccuucgacccauccgaagacaucccagcaccccucggagucccagacuuccaaggccgagucuucggugucaucucccaacgagacaaacacaacacccccggccacaaugaaccagccaaccgcgcccacgacgccgucguaccuacauacacugcccaauacacccccaaacucggucagauacaaauaggcaccuggcaaaccgacgaccucacagucaaccaacccgucaacuucaccccagucggccucucagacaccgaccacuucaaccaaugggucguaccacgcuacgccggcgcccuuaaccucaacacaaaccucgcccccagcgucgcccccguauucccuggggaacgccuuuuauucuuccgcuccuacaucccccuaaaaggaggauacggaacccccgcaaucgacugcuuacuaccacaagaauggguccaacauuucuaccaagaagcagccccauccauguccgagguagcauuaguaagauacaucaaccccgacacaggccgagcccuauucgaagccaaacuacaucgcgccggauuuaugaccgucuccuccaacacaucagccccaguagucgugcccgccaacggguacuuccgcuuugacuccugggucaaucaauuuuacucccucgcacccaugggcacagguaacggccgccgccgaauacaauaa

SEQ ID NO: 35724 - RNA, 1629 nt, Artificial Sequence
  derived and/or modified sequence opt11 from VP1,_capsid_protein__Norovirus__BAL60839
augaaaauggccagcaacgacgccgccccaucaacugacggcgcagccggccucguccccgaaucuaauaaugaaguaauggcacucgaacccguagccggcgccgcccucgcagcaccagucacaggucaaaccaacaucaucgaccccuggauccgcgcuaacuucguccaggcacccaacggcgaguucacagucagcccucgaaacucaccaggagaaguccuucucaaccuagaacucggcccagaacucaacccauaccucgcccaccuugcccgcauguacaacggcuacgcaggcgguauggaaguccaagucaugcucgcaggcaaugccuucacagccggcaaacucguauucgccgccguaccaccccacuuccccgucgaaaaccucagcccccaacaaaucaccauguucccccacgucauaaucgacguacggacccuagaacccguccuccugccccuacccgauguccgcaacaacuucuuccacuauaaccaaaaagacgaccccaaaaugcgaauagucgccauguuauacacaccccuacgcuccaacggcuccggcgacgacgucuucaccgucuccugccgcguccuuacccgcccauccccggacuuugacuucaccuaccuagucccuccaacggucgaaucaaaaacaaaacccuucacccuccccauccucacccuaggcgagcucuccaacucccgauuccccgugucaaucgaccaaauguacacaagccccaaugaagucaucucgguccaaugccaaaacggccguugcacacuagacggcgaacuucaagguaccacacaacuacaaguuagcggcauaugcgccuucaaaggugaagucacagcucaccuacacgacaacgaccaccuauacaacguuacgauaaccaaucucaacggcuccccuuucgaccccucugaagacauacccgcaccccucggaguacccgacuuccagggccgcguauucggagucaucucccaacgugacaaacacaacacucccggacacaacgaacccgccaaccgcgcccacgacgccgucgucccaaccuacacagcccaauacaccccaaaacucggccaaauccagaucggcaccuggcaaacagacgaccuaacagucaaccaaccaguaaacuucaccccaguuggacucuccgauacagaccacuucaaccaauggguugucccacguuaugcaggcgcacucaaccuaaacaccaaccucgcaccaagcgucgcccccgucuucccaggcgaacgccuacucuucuuccgcuccuacaucccccucaaaggcggcuacggaacacccgccaucgacugccuccuaccccaagaauggguacaacacuucuaccaagaagccgcccccucgauguccgaaguugcccuaguccgcuacaucaacccagacaccggccgcgcccuuuucgaagccaaacuccaccgcgccggcuucaugaccgucuccucuaauaccucugcaccagucguuguacccgccaacggauacuuccgauucgacuccugggucaaccaauucuacucccucgccccaaugggcacaggaaacggacgacgucgcauucaauaa

SEQ ID NO: 35725 - RNA, 1629 nt, Artificial Sequence
  derived and/or modified sequence opt11 from VP1,_capsid_protein__Norovirus__BAL60841
augaaaauggcaucuaacgacgccgcccccuccaccgacggcgcagccggccucgucccugaaucaaacaacgaaguaauggcccucgaaccagucgcaggcgccgcccucgccgcccccgucacgggacaaacaaacauaauagaccccuggaucagagccaacuucguacaagcacccaacggagaguucacaguaucacccagaaacucccccggagaaguccuucucaaccucgaacuagguccugaacucaacccauaucuagcacaccucgcgagaauguacaacggcuacgccggcggcauggaaguccaagucaugcuagcaggcaacgccuucaccgccggaaaacucgucuucgccgcagucccaccccacuuucccguagaaaaccucagcccccaacaaauaaccauguucccgcacguaaucauagauguccgaacccuagaacccguacuauuaccccuccccgacguccgcaacaacuucuuccacuacaaccaaaaagacgaccccaaaaugcgaauugucgcaaugcuuuauacaccccucagguccaacggcagcggcgacgacgucuucaccgucuccugcagagucuugacccgccccucacccgacuucgacuucacauaccucguaccacccacggucgaaucaaaaacgaaacccuucacccuccccauccucacgcucggagaacucucuaacucucgguuucccgucuccauagaccaaauguacaccucccccaacgaagucaucuccguacaaugccaaaacggccguugcacccucgacggcgaacuccaaggcaccacacaacuccaagucucagguauaugcgccuucaaaggagaagucaccgcccaccuccacgacaacgaccaucucuacaacgucacuaucaccaaccucaacggcucacccuucgaccccuccgaagauauccccgcaccccucggcguccccgauuuccaaggccgagucuucggcgugaucucacaacgcgacaaacauaauacccccggacacaacgaacccgcuaaccgcgcccacgacgcagucgucccaacguacaccgcccaauacacccccaaacuaggccaaauacaaaucggcacauggcaaacagacgaccucaccgucaaucaacccguaaaauucacccccgucggacucaacgacaccgaccacuucaaccaaugggucgugccaagauaugcaggagcacucaaccucaacacuaaccucgccccauccgucgccccagucuuccccggagaacgccuucuguucuucagauccuacaucccacucaaaggaggauacggcaccuccgccaucgacugccuacucccacaagaauggguccaacacuucuaucaagaggccgcaccaucaaugagcgaagucgcccuaguccgguacauuaaccccgacacaggccgcgcacucuucgaagcuaaacuccaccgcgcaggauucaugaccgucuccuccaacacaucggcaccagucgucguccccgcaaacgguuacuuccguuucgacucauggguaaaccaguuuuacucccucgccccaaugggaaccggaaacggccgacgccggauccaauaa

SEQ ID NO: 35726 - RNA, 1629 nt, Artificial Sequence
  derived and/or modified sequence opt11 from VP1,_capsid_protein__Norovirus__BAL60843
augaaaauggcuucaaacgacgcagccccguccaccgauggcgccgccggccuuguucccgaaucaaacaacgaagucauggcacucgaacccgucgccggcgccgcccuugccgcccccgucaccggccaaacaaacaucaucgaucccuggauccgagccaauuuuguccaagcacccaacggagaauuuaccgucuccccaagaaacgcacccggcgaaguccuacuaaaccuagaacucggucccgaacucaaccccuaccucgcacaccucgccagaauguacaacggcuaugccggcggcauggaaguccaagucaugcuugccggaaacgccuucaccgccggcaaacucgucuucgccgccguacccccacacuuccccauagaaaaccucuccccacagcaaaucacaauguuuccucaugucaucauugacguccgcacacucgaacccguccuacucccacucccagacguccguaacaacuucuuccauuacaaccaaaaagaugaccccaaaaugcgcauaguagcaaugcucuacaccccauuacgaucaaacgggucgggcgaugaugucuucaccgucuccugccgcguucuaaccagaccuucacccgacuucgauuucaccuaccucgucccacccaccguagaaucaaaaaccaaacccuucacacuccccauccucacccucggagaacuuuccaacucacgauuccccguuuccaucgaccagauguauaccagucccaacgaagugaucuccgugcaaugucaaaacgggcgcugcacccucgacggcgaacuccaaggaaccacccaacuccaagucagcggaauaugcgcauucaaaggcgaaguaacagcucaccuacacgauaacgaccaccuauacaacaucaccaucacaaaccuuaacggcucacccuucgaccccucagaagacauccccgcuccccuaggaguccccgacuuccaaggaagagucuucggcauaaucucccagcgcgacaagcacaacucacccggccacaacgaacccgccaaccgaggucacgacgccguuguaccaaccuacaccgcccaauacaccccuaaacuaggccaaauacaaaucgguacuuggcaaacugacgaccuaacagucucccaacccgucaaauucacacccgucggccucaacgacaccgaacacuucaaucaauggguugucccccgcuacgcaggcgcccucaaccucaacacaaaccuagcacccucagucgcucccgucuucccuggagaacgacuacucuucuuccgcagcuauaucccacuuaaaggcggcuacggcaaucccgcaauagacugccugcuaccacaagaauggguccaacacuucuaccaagaagcagcacccucuaugucagaaguagcuuugguccgauacauaaaccccgacaccggccgggcccucuucgaagcaaaacuccaccgagcuggcuucaugacaguaucuuccaauaccuccgcacccguagucguaccagcgaacggcuacuuccgcuucgauucaugggucaaccaauucuauucccuagcccccauggguaccggcaacggccgccgccgaguccaauaa

SEQ ID NO: 35727 - RNA, 1629 nt, Artificial Sequence
  derived and/or modified sequence opt11 from VP1,_capsid_protein__Norovirus__BAL60845
augaaaauggccucgaacgaugccgcaccaucaaccgacggcgcggccggccucguuccagagucaaacaacgaagucauggcccucgaacccguagccggugcagcccucgcugcaccaguaacaggccagaccaacauaaucgaccccuggauccgcgcaaacuucguacaagcacccaacggcgaguucaccgucucuccccgcaacucacccggcgaaguccuccuaaaccuagaacuugguccugaacuuaauccuuaccucgcacaccuugcccggauguacaacggcuacgccggcggcauggaaguacaagucaugcuugccggaaacgcauucacugccgggaaacuuguauucgccgccgucccaccccacuuccccgucgaaaaccucuccccacaacaaaucacgauguucccccacgucaucaucgauguccgaacccucgaacccguccuacuuccccuccccgacguccgaaacaauuucuuccacuacaaccaaaaagacgacccaaaaaugcgaauagucgcgaugcuuuacaccccacuucgcucaaacggcucgggcgacgacgucuucacagucucaugccgaguccucacacgcccuucccccgacuucgacuucacauaucuugucccgcccaccgucgaauccaaaaccaaacccuuuacacuacccauccucacccucggagaacuuagcaacucccgcuuccccguauccauugaccaaauguacacuucaccaaaugaagucauuucaguucaaugccaaaacggccguugcacccucgacggcgaacuccaaggaaccacccaacuccaaguauccggcaucugcgccuuuaaaggcgaagucacggcgcaccuucaugacaaugaccaccucuacaacgucaccaucacaaaccucaacggcucucccuucgacccauccgaagacauccccgcaccccucggcguccccgacuuucagggccgcguauucggcguaaucucucaacgcgacaagcacaacacacccggccacaacgaacccgccaaccgagcccacgaugccgucgugcccaccuacacugcccaauacacgccaaaacuuggccaaauccaaauaggaacauggcaaacagacgaccucaccguuaaccaacccguuaacuuuaccccaguuggccucaaugacacagaccacuucaaccaaugggucguaccacgcuacgccggcgcacucaaucucaacacaaaccuagcaccauccgucgcccccgucuucccaggcgaacgccuccucuucuuucgaagcuacaucccucucaaaggcggcuacggcacccccgcuaucgauugccuacucccccaagaauggguacaacacuucuaccaagaagccgcccccagcaugucagaaguagcccucguccguuacaucaaccccgacaccggucgcgcccuauucgaagccaaacuccaccgcgcaggauucaugaccguauccuccaacacaucugccccugucgucguccccgcaaacggauacuuccgauucgauuccugggucaaccaauucuacagccucgcccccaugggcacuggaaacggccgacgccgcauccaauga

SEQ ID NO: 35728 - RNA, 1629 nt, Artificial Sequence
  derived and/or modified sequence opt11 from VP1,_capsid_protein__Norovirus__BAL60847
augaaaauggcaucaaacgacgccgcacccagcaccgacggcgccgcaggacucguccccgaauccaacaacgaagucauggcccucgaaccugucgccggcgccgcccucgcagcccccgugaccggccaaacaaacauaaucgaccccuggauccgagccaacuuuguacaagcgcccaauggugaguucaccguaucuccccgcaacuccccuggagaaguccuacucaaccucgaacucggacccgaacuaaaccccuaccucgcacaccuagccagaauguacaacggcuacgccggaggcauggaaguccaaguuaugcucgccggcaacgccuucaccgcaggcaaacucgucuucgcagccgucccuccccacuuucccgucgaaaaucuuucaccacaacaaauaacaauguucccccacgucauaaucgacguacguacgcucgaaccaguccuacucccccuaccagacguccgcaacaacuuuuuccauuacaaucaaaaagacgacccaaaaaugcguauagucgccaugcuauacacaccacuacgauccaacggaagcggcgacgauguuuucaccguaucaugcagaguccuaacacgcccaagcccagacuucgacuucaccuaccucguaccucccaccguugaauccaaaacaaaacccuucacacucccaauccucacacucggcgaauuaucaaacucacgauuccccgucuccauagaucaaauguacaccuccccaaacgaagugaucucaguacaaugccaaaacggccgcugcacccucgacggcgaacuccagggcacgacucaacuccagguuuccggcauaugcgccuucaaaggcgaagucacagcccaccuccacgacaacgaccaccucuacaacguaaccauaacaaaccucaacggcucucccuucgacccauccgaagacauccccgcccccuuaggcguccccgacuuccaaggccgggucuucggcgucaucucccaaagagacaaacacaacacccccggccacaacgaaccagcaaaccgagcccacgacgccgucguccccacauacaccgcacaauacacacccaaacucggacaaauccaaaucggcaccuggcagaccgacgaccucacugucaaccaacccguaaacuucacucccgucggucuauccgacaccgaccacuuuaaccaauggguagucccccgcuacgcaggcgcgcucaaucucaacaccaaccuagcaccaucagucgccccuguauuccccggcgaacgccuacuguucuuccgcuccuacaucccccucaaaggcggcuacggcacacccgccauagacugccuccucccccaagaauggguccaacacuucuaccaagaagcagcccccucaaugucugaagucgcccuaguccgcuacauuaacccagacacaggccgagcacuguucgaagcaaagcuacaucgagcaggauucaugacuguaucgucaaacaccuccgcacccgucgucguccccgccaacggcuacuuccgcuucgacuccuggguaaaccaauucuacucccucgccccaaugggaaccggaaacggccgaagacgaauccaauaa

SEQ ID NO: 35729 - RNA, 1629 nt, Artificial Sequence
  derived and/or modified sequence opt11 from VP1,_capsid_protein__Norovirus__BAL60849
augaaaauggcaucaaacgacgccgcccccucaacagacggcgccgcaggacucgucccagaaucaaacuccgagguaauggcucuagaaccagucgcuggcgccgcccucgcagcccccguaaccggacaaaccaacauaauagaccccuggauccgcgccaacuucguacaagcuccaaacggcgaguucacagucucaccccgcaacgcccccggagaaguccuacucaaccuagagcuaggccccgaacuaaauccuuaccucgcccaccucgcccgcauguacaacgguuacgcuggaggcauggaaguccaagucaugcuagccggcaaugccuucaccgcaggcaaacucgucuucgccgcagucccaccccacuuccccauagaaaaccucuccccucaacaaaucaccauguucccacacgucaucaucgacgugagaacccuugaacccguccuccucccacuccccgacguacgcaacaacuucuuccauuauaaccaaaaagacgaccccaaaaugagaaucgucgccaugcucuacacaccccuccgauccaacgguagcggcgacgacgucuucaccgucucaugccggguacucacccgucccucccccgacuucgacuucacauaccucguacccccgaccgucgaaucuaaaaccaaacccuucacccuacccauauuaacccucggcgaacucuccaacucucgauuccccguauccauugaccagauguacacuucacccaacgaaguaaucucaguccaaugccagaauggaagaugcacccucgacggcgaacuccaaggaaccacccaacuucaaguaagcggcauuugcgccuucaaaggcgaaguaaccgcccaccuccacgacaacgaccaccuguacaacauaacuaucacuaaccugaacggcucccccuucgaccccucagaagacauccccgcaccccuaggcguccccgacuuccaaggccgcgucuucggaaucaucucacaaagagacaaacacaacucccccggccacaaugaacccgccaaccgcggccacgacgccguagucccuaccuacaccgcacaauacacccccaaacucggccaaauccaaauagguacauggcaaaccgaugaccucaccguaucccaacccgucaaguucacccccguaggccuaaacgacaccgaacacuucaaccaaugggucguaccacgcuacgccggcgcacucaaucuaaacacaaaccuagcacccuccgucgcccccguauucccaggcgaacgacucuuauucuuucgcagcuacaucccccucaaaggcggcuacggcaaccccgccaucgacugccuucucccacaggaauggguccaacauuucuaucaagaggcagcacccucuauguccgaaguugcccuaguaagauacaucaaccccgacaccgggcgcgcccuauucgaagccaaacuacaccgagcaggauucaugacugucucauccaacacaucagccccagucgucguaccugccaacggauacuuccgcuuugacuccugggucaaccaauucuacucucuagccccaaugggcaccggcaacggccgccgacgcguccaauag

SEQ ID NO: 35730 - RNA, 1629 nt, Artificial Sequence
  derived and/or modified sequence opt11 from VP1,_capsid_protein__Norovirus__BAL60851
augaaaauggccuccaacgacgccgcccccagcaccgacggagccgccggccucgucccggaauccaacaacgaggucauggcacuugaacccguugcaggcgccgcccuagccgcgcccgucacgggacaaacaaacaucauagaccccuggauccgcgccaacuucguucaagcaccaaacggagaguucaccgucucaccccgaaacgcaccaggcgaaguuuuacucaaccuagagcucggcccagaacuaaacccauaccucgcccaccuagcgagaauguacaacggauacgccggaggcauggaaguccaagucaugcucgccggcaacgccuucaccgccggcaaacucgucuucgccgcagucccaccccacuuccccaucgaaaaccucagcccacaacaaaucaccauguucccacaugucaucauagaugucagaacucuagaacccguacuacuaccacuaccagacguacgaaacaacuucuuucacuacaaccaaaaagaugaccccaaaaugcguaucgucgccaugcuauauaccccacuccgauccaacggauccggagacgacguauucaccguaagcugucgcguccucacccgacccuccccagacuucgauuucaccuaccucgucccucccacaguagaaucaaaaaccaaacccuucacccuccccauacucacgcugggugaacucucaaacucccgcuuccccgucagcaucgaccaaauguacacaucacccaaugaagucaucuccguccaaugccaaaacggccgcugcacacucgacggcgaacuacaaggcaccacccaacuccaagucucaggaauaugugcauucaaaggcgaaguaaccgcccaccuccacgacaacgaccaccucuacaacaucacaaucaccaaucucaacggaucacccuucgacccaucagaagauauccccgcaccccuagguguccccgauuuucaaggacgcgucuuuggcaucauaucacaaagagauaaacacaacagcccuggccauaaugagcccgccaacagaggccacgacgcagucgucccaacauacaccgcacaauacacacccaagcucggccaaauccagaucggcaccuggcaaacagacgaccucaccguaucccaacccgucaaauucacaccugucggacuaaacgacaccgaacacuucaaccagugggucguacccagauaugccggugccuuaaaccuuaacacaaaucuggcccccuccgucgcccccgucuuccccggcgaacgacuacuauucuuccgcucauacaucccccugaaaggcggcuacggcaaccccgcuaucgacugccuccuaccccaagaguggguccaacacuucuaccaagaagcagcacccucaauguccgaagucgcccucguccgauacauaaacccugacaccggccgcgcgcuauuugaagccaaacuccaucgugccggcuucaugacaguuagcuccaauaccucagccccaguuguaguaccagcaaacggcuacuuccgcuucgacagcuggguaaaccaauucuacucucucgcccccaugggcacaggaaacggccgccgcagaguacaauaa

SEQ ID NO: 35731 - RNA, 1647 nt, Artificial Sequence
  derived and/or modified sequence opt11 from VP1__Norovirus__AAT00378
augaaaauggccucaaacgacgccacccccuccaacgacggugccgccggccuaguccccgaaaucaacaacgaagcaauggcacucgauccugucgcaggcgcagcaaucgcagcaccccucacaggucaacaaaacaucauagaccccuggaucaugaauaacuucguucaagcccccggaggcgaguucaccgucucuccccgcaacucgccaggcgaaguucuccucaaccucgaacucggcccugaaaucaacccauaccucgcccaccuagcucgaauguauaacggauacgccggcggcuucgaaguacaagucguccucgcaggaaacgcuuucaccgcuggcaaaauuaucuucgccgccaucccacccaacuucccaauagacaaccuguccgccgcccaaaucacaaugugcccccacguuauaguagacguccgccaacucgaaccagucaaucuccccaugccagacguccgcaauaacuucuuucacuacaaccaggguagcgacucacgccuccgccucaucgccaugcucuacacaccccuccgcgccaacaauuccggcgacgacgucuucacagucuccugccgaguccuaacacgccccagccccgauuucuccuucaacuuccucguacccccaaccgucgaaucuaaaacaaaacccuucacccucccaaucuuaacaauauccgaaauguccaacucucgcuucccaguccccaucgacucccuccacaccagcccaaccgaaaacaucgucguccaaugucaaaauggccgugucacccucgacggagaacucaugggcaccacacagcuacuaccaucccaaauaugcgccuuccgcggcguacucacucguucaaccucacgagcuucagaucaagcagauacugucacaccccgucucuucaacuacuacuggcacauccaacuagacaaccucaacggcaccccauacgaccccgcagaagacauccccggcccccuaggcacacccgacuuccgcggcaaaguauuuggcgucgcuucccaaagaaacccagacucaacaacacgagcccacgaagcaaaagucgacaccaccgccggacgauuuacacccaaacucggcucccucgaaauauccaccgaauccgacgauuucgaccaaaaccaaccaacacgcuucgcccccgucgggauaggcgucgaccgcgaagcagguuuccagcaauggucccuaccugacuacuccggacaauucucccgaaucaugucccuagcacccgcagucgcacccauauuccccggcgaacaacuucucuucuuccgaucacaacucccauccuccggaggucgcuccaacggcauacucgacugucucgucccccaagaauggguacaacacuuuuaccaagaaucagccccagcccaaacccaagucgcgcucguccgcuaugucaaccccgacacaggucgcguccucuucgaagccaaacuccacaaacucggcuucaugaccaucgccaaaaauggcgacucacccauaacggucccaccuaacggcuacuucagauucgaauccugggucaacccauuuuacacucucgccccaaugggcaccggcaacggacgccggcgcauccaauaa

SEQ ID NO: 35732 - RNA, 1626 nt, Artificial Sequence
  derived and/or modified sequence opt11 from VP1__Norovirus__ABD95934
augaaaauggccucuaacgacgccgcccccuccaacgacggugcagccggacucguccccgaaauaaacaccgaaacccuuccacuugaacccgucgcuggagccgcacuugccgccgccgucaccggacagagcaacaucaucgacccuuggauccgcacuaacuucguccaagccccuaacggcgaguucacuguaucuccccgcaacuccccaggcgaaguccuccucaaccucgaacucggcccagaccuaaacccuuaccucgcgcaccucucccgcauguacaacgguuacgcaggcggcgucgaaguacaaguccuucuagccggcaacgccuuuacagccggcaaaauucucuucgccgccgucccuccaaacuuccccguugaguuccuaucaccagcccaaauaacaauguuaccacaccucaucgucgacguccgcacacuagaaccuaucaugaucccacuacccgacguccgcaacaccuucuuccacuacaauaaccgccccucugagcgaaugcgccuugucgccaugcuauacacuccccuccguucaaacggcuccggugacgacgucuucaccguauccugccguguccuuacccgcccaaccccagacuucgaauuuaccuaccuaguaccacccagcgucgaaucaaaaaccaaacccuucucgcuacccaucuuaacaaucucagaacucacaaacucacgguuccccgcucccaucgacucccucuucaccgcacaaaauaacaaccuuaacguccaaugccagaauggacgcugcacccuggacggggaacuucaagguaccacccaacuucuacccacaggcaucugcgccuuccgaggcaaaaucuccgcagacguccaaaacucucaccaagaccgcuggcacaugcaacuaacaaaccuaaacggcacccccuucgaccccaccgaugacguccccgccccacucggaacacccgacuucacaggccugcuguucggugucgcaucucaacgaaacgucggagggaccggaaacaacaccacccgggcccacgaaguuguaaucgccaccaccucaacccaauucgucccgaaacuaggcucaaucaacuucggguccgaaucagaagacuuccaagucggcccacccacaaaauuuaccccugucggaauaaaaauagaaaccggccacucguuccggcaaugggacccacccaauuacucaggagcccuuacacucaacaugaaccucgcaccacccgucgcccccaacuuccccggcgaacaacuccuauucuucagaucuaacgucccaugcgccggcggcgucucagaaggcaucauugacugccuacucccccaagaauggauccaacacuucuaucaagaauccgcacccucccaauccgacgucgcacuuauccgcuacguuaacccagacaccggacgcacccucuucgaagccaaacuucaccgcaccggauacauaacaguagcccauucuggcgacuacccccucguaguucccuccaacggcuacuuccgcuucgacuccuggauaaaccaauucuacagccuagcaccaaugggcaccggcaacggccgccgccgcguucaauaa

SEQ ID NO: 35733 - RNA, 1623 nt, Artificial Sequence
  derived and/or modified sequence opt11 from VP1__Norovirus__ABG49509
augaaaauggcuucuaacgacgccaaccccucagacggcucuaccgccaaccuuguccccgaaguaaacaacgaaguaauggcccucgaacccgucgucggagccgccauagccgcccccguagccggucaacaaaacgucauagacccuuggauacgcaacaacuucguacaagccccaggcggagaguucaccgucuccccacgcaacgcaccgggcgaaauccucuggucagcaccccucggacccgaccuuaacccuuaccucucccaccucgcacgaauguacaacggauacgccggcggauucgaaguacagguuauccuugccggcaacgccuuuaccgccggcaaaaucaucuucgccgcugucccacccaacuuucccaccgaaggccucucacccucccaagucacaauguucccccauauaauagucgacguucgucaacucgaacccguacucaucccccuccccgacguacgcaacaauuuuuaccacuacaaccaauccaacgaccccaccauaaaacucaucgcaaugcuauacacaccccuacgcgccaacaacgcuggagaagacgucuuuaccgucuccugccgcguccuuacucgccccucccccgacuuugacuucauauuccugguaccacccacaguagaaucgcgcaccaaacccuuuaccguccccauacucaccgucgaagaaaugaccaacucucgcuuccccaucccccucgaaaaacuuuucaccggacccuccggcgccuuuguaguccaaccucaaaauggacguugcacuaccgacggaguccuacuaggaaccacccaacuuuccccagucaacauaugcaccuucagaggugacgucacccacauagcagacacacacaacuauaccaugaaccuagcuucccaaaacuggaacaacuaugaccccaccgaagaaauccccgcaccccucggaacccccgacuucgucggaaaaauccaaggaaugcucacacaaaccacccgcggcgacggcuccacccgcggccacaaagccacagucuccacaggagacguccacuucacccccaaacucggcucaauucaauucaacaccgauacaaacaacgauuucgaaaccggacaaaacacaaaauucacaccaguaggcgucguacaagacggcaacggcacccaccaaaacgagccccaacaauggguccuccccucuuacuccggccgcaccggacacaacguccaccuagcccccgccguagcaccuacuuuccccggagagcaacuauuauucuuccguuccacuaugcccggcugcuccggcuaccccaacaugaaccuagacugccuacuuccccaagaauggguacaacacuuuuaccaagaagcagcccccgcccaaagcgacgucgcacuacuccgcuucgucaacccugauaccggccgaguacucuuugaaugcaaacuacacaaauccggcuacgucaccgucgcacacacaggccaacacgaucucgucauaccucccaacggcuacuuccgcuucgacuccugggucaaccaauucuacacccucgcccccauggguaacggcaccggacguagacgagcacucuaa

SEQ ID NO: 35734 - RNA, 1623 nt, Artificial Sequence
  derived and/or modified sequence opt11 from VP1__Norovirus__ABP88833
augaaaauggccacaaacgacgccucaccuucagacggcuccaccgccaaccuaguucccgaagucaacaacgaaguaauggcccucgaaccggucgucggugcagccaucgcagccccagucgccggccagcaaaaugucauagaccccuggauccgcaacaacuucguccaagcccccggcggcgaguucaccgucuccccacgaaacgcacccggagaaauacucugguccgcaccccucggccccgaucucaaccccuaccuaucccaccuugccaggauguacaacggauacgccggcggcuuugaagucgaagucauacuagcaggcaacgcauucaccgccggcaaaaucauauucgcagccgucccucccaacuuccccaccgaaggccuaucccccucccagguaaccauguucccccacaucaucguagacguacgccaacucgaacccguacucaucccccuacccgacguccgcaacaacuucuaccacuacaaccaaucuaaugauuccaccauaaaacucaucgcuauguuauacaccccacuucgcgccaacaacgccggugacgacguauuuaccguauccugccgaguccucacacgccccucccccgacuucgacuuuauauuccuuguaccgcccaccgucgaaucccgcacaaaaccauucacaguaccgauccucacaguagaagaaaugacaaacucaagauuccccaucccacucgaaaaauuauucacaggacccuccuccgcccuuguaguccaaccacaaaacggucguuguacaaccgacggaguucuacucggcaccacccagcucuccccugucaacaucugcacuuucagaggcgacgucacacacaucucaggcacccguaccuaccgcaugaaccuugccucccaaaacuggaacaacuaugaccccaccgaagaaauaccagcaccccucggcacccccgacuucguaggaaaaauccaaggcaugcucacccaaaccaccaaaggcgacggcuccacucgaggccacaaagccacugucuccaccggcagcguagacuucaccccgaaacuagggagcguccaauucgccaccgacaccgacaaugacuucgaaaccggccaaaacacccgcuucacccccgucggcgucauccaagacggcucgucagcccaccgaaacgaaccccaacaauggguccuccccgacuacucaggccgaacaguccacaacguccaccuagcaccagcgguugcccccacauuuccaggugaacaacucccauucuuccgauccaccaugcccggcugcuccggauacccaaacauggaccucgacugccugcucccucaagaauggguucaacauuuuuaccaagaagcagcccccucccaaucagaugucgccuuguuacgauuuguaaaccccgacacaggccgcguucucuucgagugcaaacuacacaaagccggcuacgucaccgucgcccacacaggccaacacgaccuugugauacccccuaacggcuacuuccgauucgacaguugggucaaccaauccuacacacuagcacccaugggaaacggagcaggucgcagacgagcccucuaa

SEQ ID NO: 35735 - RNA, 1623 nt, Artificial Sequence
  derived and/or modified sequence opt11 from VP1__Norovirus__ABY27560
augaaaauggccuccuccgacgcuucaccauccgacggcuccaccgcuaaccucguccccgaaguuaacaacgaagucauggcccucgaaccagucgucggcgcggccaucgcagcaccagucgccggccaacaaaacgucauagaccccuggauacgcaacaacuucguccaagcccccggcggcgaguucaccguaagcccccgaaacgccccuggcgaaauacuaugguccgccccacucggacccgaccucaacccauaccuaucccaccucgcccgcauguauaacgguuaugccggaggauucgaaguccaagucauacucgccggcaacgcauuuaccgcggguaaaaucaucuucgccgccgucccacccaacuuccccacagaaggccuaucccccucucaaguaaccauguucccccacaucaucgucgacguccgccaacucgaacccguccuaaucccccuccccgacguccgcaacaacuucuaccauuacaaccaaucgaaugaccccaccaucaaacucauagccaugcucuacaccccgcuccgcgccaacaacgccggagacgacguauucaccgucuccugccgcguccucacccgccccucccccgacuucgacuucaucuuccucguucccccaaccgucgaaucacgcaccaaaccguucacaguacccauacuaaccgucgaagaaaugaccaacucucguuucccaaucccacuagaaaaacucuucaccgggcccucuggagccuucgugguacagccccaaaacggccgcugcacaacugacggaguucuccucggcaccacucaacucagcccaguaaacaucugcaccuuccgcggcgacguuacacacaucgccggaacgcacgacuauacgaugaaccucgcaucccaaaacuggaacaacuacgacccuaccgaagaaauucccgcaccacuuggcaccccagacuucgucggcaaaauccaaggaguccucacccaaaccacccgaggcgacggcuccacccgaggccacaaagcaacaguaucaacaggcuccguucacuucacaccaaaacucggcaguguccaauucaccaccgacacaaacaacgaccucgaaaccggccaaaauacaaaauucaccccaguaggcgucguccaagacggaaacucagcccaccaaaacgaaccgcaacaauggguacuaccuaacuacuccggccgaaccggacacaacguccaccucgcccccgcuguagcaccuaccuuccccggcgaacaauuacucuucuuccguucaacaaugcccggaugcagcggauacccaaauaugaaccuggacugccuccucccccaagaauggguccuccacuucuaucaagaagcagcucccgcacaaucugaugucgcacuauuacgauucguaaaccccgauacaggccgcguccuauucgaaugcaagcuccacaaauccggcuacgucacagucgcccacaccggcccacacgacuuagucaucccacccaacggauauuuccgauuugauucaugggucaaccaauucuacacccucgcccccaugggaaacggcgcaggacgucgccgagcccuuuaa

SEQ ID NO: 35736 - RNA, 1620 nt, Artificial Sequence
  derived and/or modified sequence opt11 from VP1__Norovirus__ACT76139
augaaaauggccucaucugacgcuaacccuuccgacggcucagccgcuaaccucguucccgaaguuaacaacgaagucauggcccucgagcccgucguaggggccgcaauugccgcccccgucgccggacaacagaacaucaucgaccccuggauacggaacaacuucguacaagccccaggcggagaguucacaguaucaccccgcaacgcacccggugaaauucuuuggucagccccgcuaggucccgaccucaaccccuaccuuucacaucuuucacgaauguauaacggauacgcuggcgguuucgaaguccaagucauccucgccggaaacgccuucaccgcaggaaaaguuaucuucgcagccgucccacccaacuuccccaccgaaggccucucccccagccaagucacaauguucccccacaucaucgucgacgucagacaacucgaacccguucucaucccacucccagacguccgcaacaacuucuaccacuacaaccaagcccacgacucuacccuaaaacucaucgcuaugcuauacacuccccuccgagccaauaacgccggcgacgacgucuucaccguauccugccguguccuaaccaggccgucccccgacuucgauuucaucuuccucgucccacccaccguggaaucaagaaccaaacccuucaccguccccauccucaccgucgaagaaauguccaauucacgcuucccaaucccccucgaaaaacucuacacaggcccauccuccgccuucgucguacaaccccaaaacggccgaugcaccacagacgguguccuccucggaacaacucagcuguccgcagucaacaucuguaacuuccgcggcgaugucacccgagucggaauuucucacgacuacaccaugaaccuagucucccaaaacuggaacaacuacgacccaaccgaagaaaucccagcaccccucggaacaccagacuucgucggcaaaauccaaggauugcucacccaaaccacccgcgcagacggcuccacccgugcacacaaagccaccguuucaaccggcuccguccacuuuacacccaaacugggaagcguccaauucaccaccgauaccaacaacgauuuccaaaccggccaaaauacaaaauucacccccgucggcgucauacaagacggugaccaccaccaaaacgaaccccaacaauggguacuccccaacuacagcgguaccucuggccacaacguucaccucgcccccgccguggcccccaccuucccaggcgaacaacuccucuucuuccgcucaaccaugccuggcugcuccggcuacccaaacaugaaccucgacugccuccuaccccaagaauggguccuccacuucuaccaagaagcagcacccgcccaaucagacguugcccuccucagauuuguaaaccccgacaccggacgcguacucuucgaaugcaaacuccacaaaucaggcuacaucaccguagcccacacaggcccguacgaccucgucauaccaccaaacggcuacuucagauucgacuccugggucaaccaauucuacacucuagcacccaugggcaacggcacaggccgacgccgagcccucuaa

SEQ ID NO: 35737 - RNA, 1620 nt, Artificial Sequence
  derived and/or modified sequence opt11 from VP1__Norovirus__ACT76142
augaaaauggccuccucugacgccaaccccuccgacggcuccacagccaaccuugucccagaaguaaacaaugaagucauggcucuagaacccgucguuggagccgccauagccgcacccgucgccggacaacaaaacaucaucgaccccuggauacgcaacaacuucguccaagcccccggcggcgaguucaccguaucaccccgaaaugcacccggcgaaauuuuaugguccgcuccccuuuccccggacuuaaaccccuaccucagccaccucuccagaauguacaacggcuacgccggaggcuucgaaguccaagucauacuugcuggcaacgccuucaccgccggcaaaauaaucuucgccgcaaucccgcccaacuuccccaccgaaggacucucccccucucaagucaccauguucccccacaucaucgucgacgucagacagcucgaaccaguccucaucccacucccagacguucguaacaauuucuaccacuacaaccaagcacacgacuccacacucaaacuaaucgcaaugcucuacacuccccugcgcgcuaacaacgccggcgacgacgucuucacagucuccugccgaguacucacccgaccaucaccagacuucgacuuuaucuuccucgucccacccaccguagaaucccgcacaaaacccuucaccgucccuauccucaccgucgaagaaaugucaaacucccgcuucccaauucccuuagaaaaguuauacacaggccccuccuccgccuucguuguccaaccccaaaacggacgaugcacuaccgacggagucuuacucggcaccacccaacucagcgccgucaacauuugcaacuuuagaggugacguaacacgcgucggcaucucacacgacuacaccaugaaccuagucucccaaaacuggaacaacuaugacccaaccgaagaaauaccagcuccccuuggcacccccgauuucgucggcaaaauccaaggccuacucacacaaaccacacgagccgacggcucaacccgagcccauaaagccaccguaucaacaggcucaguccacuucacacccaaacuuggcuccguccaauucacaaccgacacaaacaacgacuuccaaaccggccaaaacacaaaauucaccccagucgguguuauacaagacggagaccaccaucaaaacgagccacaacaauggguccucccaaacuacuccgguacgucaggacacaacguccaccucgcccccgccgucgcuccuacuuucccaggagaacaacuccuguucuuccgcuccaccaugcccggcugcuccggcuaccccaacaugaaucuggacugccuacuaccacaagagugggucucccacuucuaccaagaagcagcaccagcccaauccgauguagcccuacuacgcuucgucaaccccgacaccggccguguccucuucgaaugcaaacuccacaaauccggauauaucacagucgcccacacuggccccuacgaccucguaauuccuccaaacggcuacuuccgcuucgacagcugggucaaccaauucuacacacucgcccccaugggaaacggaagcggccgaaaacgcguacuguaa

SEQ ID NO: 35738 - RNA, 1620 nt, Artificial Sequence
  derived and/or modified sequence opt11 from VP1__Norovirus__ACT76145
augaaaauggccucauccgacgccaacccauccgacggcuccgccgccaaccuuguccccgaagucaacaacgaagucauggcccuagaaccagucgucggcgccgcaaucgcugcuccagucgcugggcaacaaaacauuauugacccauggauccgcaauaacuuuguccaggccccaggcggcgaguucaccgucagcccccgcaacgcacccggcgaaauccuaugguccgcaccccucggaccagaccuaaaccccuaucuaucccaccuaucccgcauguacaacggauaugcuggcggauucgaaguccaagucauacucgcgggcaacgccuuuaccgccggaaaggucaucuucgcugccguacccccaaacuuccccacagaaggccuuucccccucgcaagucacaauguucccacacaucaucguagacguccgucaacucgaaccaguccucauuccccugccagacguccgcaacaacuucuaccacuacaaccaaagccacgauuccacacucaaacuaaucgccaugcuuuacaccccucuacgcgcuaauaacgccggcgacgacguuuucaccgucuccugccgcguccuuacccgacccucaccagacuucgacuucaucuuccuaguuccacccacaguugaaucccgcacaaaacccuucacaguccccauacucacagucgaagaaauguccaauucccgcuuccccauaccccuagaaaaacucuacaccggacccuccucggccuucguuguccaaccccagaacggccgcugcaccaccgacggagucuuacucggcacaacccaacucucagccguaaacaucuguaacuuccguggcgacguaacccacaucguaggcucccacgauuacaccaugaaccucgucagucagaauugguccaacuacgacccaacagaagaaauccccgcaccacucgguacccccgacuuugucggaaaaauacaaggacuacucacccaaaccacacgagccgacggcucaaccagagcccacaaagcaacagucuccaccggcuccguccacuucacccccaaacuaggauccguccaauucaccaccgacacaaauaacgacuuccagaccggccaaaacaccaaauucacaccagucggcgucauccaagacggcgaccaucaccaaaaugagccccaacaauggguccuccccaacuacuccggcagaaccggccacaacguccaccucgcaccagcggucgcacccaccuuccccggagagcaacuccuuuucuuccgcucaacaaugcccggcugcagcggauaccccaacaugaaccucgacugccuccuaccccaagaauggguccuccacuucuaccaagaagccgcccccgcccaaucugacguagcccuacuccgcuucgucaacccagacaccggcagaguacuguuugaaugcaaacuccacaaauccggcuacauaaccguagcccacaccggacccuacgaccugguaaucccuccaaacggauacuuccgcuucgacucgugggucaaccaauucuauacacuagccccuaugggcaacggcaccggccgucgacgcgcacuauaa

SEQ ID NO: 35739 - RNA, 1620 nt, Artificial Sequence
  derived and/or modified sequence opt11 from VP1__Norovirus__ACT76148
augaaaauggcauccaacgacgccaaucccuccgacggcucagccgcaaaucuaguccccgaagucaacaacgaagucauggcccuagaacccgucgucggcgccgccaucgccgcccccgucgccggacaacaaaacgucauagaccccuggaucagaaacaacuucguccaagcacccggcggcgaguucaccguaucaccacgcaacgcaccaggcgaaauacucugguccgcaccacucggaccagaccuuaacccauaccucucccaccucucacgcauguacaacgguuacgcagggggcuucgaaguccaagucauccuagccggcaacgccuucaccgcaggcaaaguaaucuucgcagccguucccccuaacuuccccaccgaaggccucucucccucacaggucaccauguucccccauauaaucguagacguccgccaacucgaacccguacuaaucccucuccccgacguccgcaacaacuucuaccacuacaaccaagcccaugacucuacccucaaacuaaucgccaugcucuacaccccacuacgcgcaaacaacgcaggcgaugacgucuucacugucucgugcagaguccucacccgaccaucaccagacuucgacuuuaucuuccuuguaccucccaccgucgaaucucgcaccaaacccuucacaguacccauccuaacagucgaagagauguccaauucccgauuccccaucccccucgaaaaacucuacaccggaccaucuuccgccuucgucguccaaccccaaaacggccgauguaccaccgacggcguccuccuaggcaccacacaacucuccgcagucaacaucugcaacuuccguggcgacguuacacauaucgucggcucucacgacuacaccaugaaccucgucucucaaaacuggucaaacuaugaccccaccgaagaaauccccgcaccccuaggcacaccugacuucgucggaaaaauacaaggccuccuaacacaaacaacccgagcugacggauccaccagagcucacaaagccaccguauccacuggcagcguccauuucauacccaaacucggaucaguccaauucaccacagacacuaacaacgacuuccaaacaggacaaaacaccaaguucaccccagucggcgucauacaggauggcgaccaucaccaaaacgaaccccaacaauggguacuaccaaacuacuccggccgaacuggccacaauguccacuuagcccccgccguugcccccacauuuccaggcgaacaacuacucuucuuccgaucuacuguucccggcugcucaggcuaccccaacaugaaccucgacugccuccucccccaagagugggucucacacuucuaccaggaagccgcccccgcacaaucugauguagcccuccuccgcuucgucaacccagacacaggccgcguccucuucgaaugcaaacuacauaaauccggcuacaucaccgucgcccacaccggaccauacgaccucguccucccacccaacggcuauuuccgcuucgacucaugggucaaucaauucuacacacucgcccccaugggcaacggcaccggccgccgccgcgcccucuga

SEQ ID NO: 35740 - RNA, 1620 nt, Artificial Sequence
  derived and/or modified sequence opt11 from VP1__Norovirus__ACT76151
augaaaauggcauccucagacgccaauccaucugacggcuccgccgcaaaucuaguuccagaagucaacaacgaagucauggcccuagaacccgucgucggcgcugcaaucgcagccccugucgcaggccaacaaaauguaaucgaccccuggauacgcaacaacuucguccaagcccccggcggcgaauuuacaguaucaccacgcaacgcacccggcgaaauacuuuggucugccccacucggcccugaccucaacccauaccucucucaccucaguagaauguacaacggcuacgccggcggcuucgaaguacaaguaauccucgccggcaaugccuucaccgcuggcaaagucaucuucgcugcagucccacccaacuuccccaccgaaggacucucccccucccaaguaaccauguucccccacaucauagucgacguacgccaacuugaacccguacuaaucccccuacccgauguccgaaauaauuucuaccauuacaaccaagcucacgacucaacacucaaacucaucgccaugcucuacacuccccuccgcgccaacaacgccggcgacgacgucuucacagucuccugccgaguccuaaccagacccuccccagacuucgacuucaucuuccucgucccucccaccguagaaucacgaaccaaacccuucaccguccccauccuaaccguugaagaaaugagcaacucccgcuuccccauuccccuagaaaaacuauacacaggcccauccagcgccuucgucguccaaccacaaaacggccgcugcacuacagacggaguccuacugggcacaacacagcuuucagccgucaacaucugcaacuucagaggcgacguaacccgagucggcaucucccacgacuacacaaugaaccucguuucccaaaacuggaacaacuacgacccaaccgaagaaauccccgcaccccuaggaaccccagacuucguggguaaaauccaaggucuccucacccaaaccacccgagcagacggcuccaccagagcccacaaagcgaccguaucaaccgguuccgugcauuucacacccaaacuuggauccguacaauucacaaccgacacaaacaacgacuuucaaacuggccaaaacaccaaauucaccccagucggcguaauucaggacggcgaucaccaccaaaacgaaccccaacaauggguccuacccaacuacucaggcaccucaggccacaacguacaucucgcacccgccgucgcccccaccuuccccggcgaacaauuauuauucuuccgcucaaccaugccaggcugcuccggcuacccaaacaugaacuuagacugccuccuaccucaagaauggguccuacacuucuaccaagaagccgcaccagcccaauccgauguagcccuacucagauucguuaacccagacacaggacgcguccucuucgaauguaaacuacacaaauccggcuacaucacagucgcacacacaggccccuacgaccucguaaucccucccaacggcuauuuccgguucgacagcuggguaaaccaauucuacacacuagcccccaugggcaacggcacaggccgccgccgagcccuauaa

SEQ ID NO: 35741 - RNA, 1623 nt, Artificial Sequence
  derived and/or modified sequence opt11 from VP1__Norovirus__ACX31821
augaaaauggcauccaacgacgccaaccccuccgacggaucaacugccaaccucguacccgaagucaacaacgaaguaauggcucucgaaccagucgucggcgcagccauagccgccccagucgcaggacaacaaaacguaaucgacccauggauucgaaacaacuucguccaggccccaggcggugaauuuaccgucagcccacgcaacgcccccggcgaaauccucuggucagccccacuaggacccgaccucaacccauaccuaagccacuuagcccgcauguacaacggauacgccggcggcuucgaaguccaagucauccuagcaggcaacgccuucacagcaggcaaaaucauauucgccgccguaccacccaacuucccaacagaaggacuguccccaucgcaagugaccauguucccacacaucaucgucgacguccgucaacuagaaccaguacugaucccccuccccgacguccgaaauaacuucuaccacuacaaccaauccaacgauccaaccaucaaacuaauagcuaugcuauacacgccccuccgagccaacaacgcgggcgacgacgucuucaccgucucaugccgcguccucacccgcccauccccagacuucgacuucaucuuccucguaccaccaaccgucgaaucuagaacaaaacccuuuaccguccccauacuuaccguagaagaaaugaccaacucacgcuucccaauaccucuagaacgacucuacaccggaccuuccuccgcauucguaguacaaccacagaacgggcgcuguaccaccgacggaguacuccucggcacuacacaacuauccgcaguaaacauuugcaccuuccgcggcgacguuacacacaucgccggaucccgcaacuacaccaugaaccuagccucccaaaacuggaacaacuacgauccaaccgaagaaaucccagcaccacuaggaacaccugacuuugucggaaaaauacaaggcaugcuaacccaaacaacccgcucugacggcucaacccgaggccacaaagccacagucuuuacuggauccgcagacuucgcacccaaacuaggacgcguucaauucgcuaccgacacagauaacgacuucgaaagcggccaaaacacgaaauucaccccugugggagucauccaagacggaucaaccacccaccgcaacgaaccccaacaauggguccuccccaacuauucaggccgcacaggacauaacguccaccucgcccccgccgucgcaccaaccuaccccggagaacaacuccucuucuuccgauccaccaugcccggcugcuccggcuaccccaacauggaccuggacugccuccuaccacaagaauggguccaacacuucuaccaagaagcagcacccgcccaauccgacgucgcccucuuacgcuucguaaaccccgacaccggacgcguacuuuucgaaugcaaacuccacaaaucaggcuacguaaccguagcccacacaggccaacacgaccuaguuaucccgcccaacggcuacuuccgguucgacuccuggguaaaccaauucuacacccucgccccaaugggaaacggaacuggccgccgccgugcccucuaa

SEQ ID NO: 35742 - RNA, 1623 nt, Artificial Sequence
  derived and/or modified sequence opt11 from VP1__Norovirus__ACX31837
augaaaauggcauccaacgacgcaaaccccucagauggcucagcagccaaccucguacccgaagucucgaaugaaguaauggcccucgagcccguagucggcgccgcaaucgccgccccugucgccggccaacaaaacgucaucgacccuuggauccgcaacaacuucguacaagcccccggcggcgaguucaccguaucacccagaaacgcgcccggagaaauccucugguccgcgccccucggucccgaucucaacccauaccuaucccaccuggccagaauguauaacggauacgcaggcggcuucgaaguccaaguaauccuagccggcaacgccuucaccgcaggcaaaaucauauucgcagccgucccacccaacuuccccacagaaggccucucccccucccaggucacaauguucccccacauaaucgucgacguccgccaacuagaacccguccuuaucccccuacccgacguacgcaacaacuucuaccacuauaaccaauccaacgacuccaccauaaaacucaucgccaugcuauauacaccacuccgagcaaacaacgcuggugaagacgucuucaccguguccugccguguccuuacccgcccauccccugacuuugacuucaucuucuuaguacccccaaccguagaaucucgaacaaaaccuuuuaccguccccauccucaccgucgaagaaaugaccaacucccgcuuccccauaccccuagaaaaacucuucacuggaccauccggcgcauucgucguccaaccccaaaacggacgaugcaccaccgacggcguccuacucgggaccacacagcucucccccguaaacauuugcacuuucagaggcgacgucacacacaucgccggaucucgcaacuacaccaugaaccucgcaucuuuaaacuggaacaacuacgaccccacagaagaaauccccgcaccccuuggcacccccgacuucgucggaaaaauacaaggcguccuuacccaaaccaccaaaggcgacggcagcacccgcgggcacaaagccacaguauacaccgguuccgcccccuucaccccgaaacuaggauccguccaauucuccaccgacaccgaaaacgacuucgaaacccaucaaaacaccaaauuuacacccgucggcgucauucaagacggcucaaccacccacagaaacgaaccccaacaauggguacuccccucauacucuggccgaaauguccauaacguucaccucgcacccgccguagccccaacauuccccggcgagcaacuccucuucuuccgcuccacuaugcccggaugcuccggauaccccaacauggaccuagacugccuccucccacaagaguggguccaacacuuuuaccaagaagcagcaccagcccaaucugacgucgcacuccuccgcuucguaaaccccgacaccggccgcguuuuauucgaaugcaaacuacacaaaucaggcuaugucaccguagcccacaccggccaacacgaccuagucauuccucccaacggcuauuucagauucgacucaugggucaaccaauucuacacccucgcccccaugggcaacggcacaggacguaggcgcgcacucuaa

SEQ ID NO: 35743 - RNA, 1623 nt, Artificial Sequence
  derived and/or modified sequence opt11 from VP1__Norovirus__ACX31841
augaaaauggccuccaacgacgccaaccccagcgacggcagcgccgccaaccuaguccccgaaguaucaaacgaagucauggcccuagaacccgucguuggcgccgcaaucgcagcaccagucgccggacaacaaaacguaauugacccuuggauccgcaacaacuucguccaagccccaggcggcgaguucaccguaagcccacgcaacgccccaggagaaauccucugguccgcaccccuaggaccagaccuaaaucccuaccuaucgcaccucgcccgcauguacaacggcuacgccggcggcuucgaaguccaaguaauccuagccggcaacgcuuucaccgcaggaaaaaucauuuucgccgccguacccccaaacuuccccaccgaaggccucuccccaucccaaguaaccauguucccccauaucaucgucgacguccgacaacucgaaccaguacuuauucccuuacccgauguccggaauaacuucuaccacuacaaccaaagcaaugacucgaccauaaaacucaucgcaaugcucuacacaccccuacgcgcaaacaacgccggcgaagacgucuucaccguaucuugccgcguacuaacccgcccauccccagacuuugacuucaucuuccuuguucccccuacagucgaaucccgaaccaaacccuucaccguccccauacuaacaguagaagaaaugacaaacucccgauucccaaucccccucgaaaaacucuucaccggcccaucuggcgccuucgucguccaaccccaaaacggacgcugcacaacagacggaguacuacucggcacaacacaacucuccccagucaacaucugcacguuccgcggcgacgucacccacaucgccggaucccguaacuacaccaugaaccuagccucccucaacuggaacaacuaugacccaacagaggaaaucccugcaccacuaggcacccccgacuuugucggcaaaauccaaggcguacucacacaaaccaccaaaggagacggcucgacccgcggccacaaagccaccguauacacaggaucgacccccuucaccccuaaacucggaucaguccaguucucaacagacacagagaacgacuucgaaacccaccaaaacaccaaauucacuccaguaggcguuauccaagacggaucaacuacccaccggaacgaaccacaacaaugggugcuaccaagcuacucuggucgcgacguacacaacguacaucucgcgcccgccgucgcccccaccuucccuggcgaacaacuacuauucuuccgcucuaccaugcccggcugcagcggcuacccaaacauggaccucgacugccuccuaccucaagaauggguacaacauuuuuaucaagaagccgcccccgcccaauccgacguagcccuccuccgcuucgucaaccccgacacaggacgcguacucuuugaaugcaaacuccacaaaagcggcuacgucaccgucgcccacacgggacaacacgaccuaguaauaccacccaacgguuacuucagauucgacaguugggucaaccaauucuacacccucgcgcccaugggcaacggcacuggacgccgccgcgcacucuaa

SEQ ID NO: 35744 - RNA, 1623 nt, Artificial Sequence
  derived and/or modified sequence opt11 from VP1__Norovirus__ACX31851
augaaaauggcguccaacgacgccaaucccucuaacggcucagcagcaaaccucgucccagaaguaaacaaugaaguaauggcccucgaacccgucgucggagccgccaucgccgcccccgucgccggacaacaaaacguuaucgaccccuggauccgaaacaacuucguccaagcccccggcggcgaguucaccgucagcccccgcaaugcaccaggcgaaauccucugguccgcaccccuaggccccgaccuaaaccccuaccuaucacaccucgcccgaauguacaacggcuacgcaggagguuucgaaguacaagucauccucgccggaaacgccuucaccgcaggcaaaaucaucuucgcagccgucccgcccaacuuccccacagaaggccucucccccucccaagucacaauguucccacacaucaucgucgacguccgccaacucgaacccguccucaucccccuccccgacguacgcaacaacuucuaccacuacaaccaaucuaacgacaguaccauuaaauuaaucgccaugcucuacacuccccuccgagcaaacaacgcaggcgaagacguauucaccgucucgugucgaguccucacacgcccaagccccgacuucgacuucaucuuccuaguucccccaaccgucgaaucccgcaccaaaccauuuacuguaccaauccucaccgucgaagaaaugacaaacuccagauucccaaucccccucgaaaaacuauucaccggccccuccuccgcauucgucguccaaccccaaaacggaagaugcaccaccgacggcguccuacuuggcaccacacaacucucaccaguuaacaucugcaccuuuaggggagacgucacccacaucgcaggcucucgcaacuacaccaugaaccucgccucacuaaacuggaacaacuacgacccaacugaagaaaucccagcuccccucggcacaccagauuuugucggcaaaauacaaggcguacugacacaaaccaccaaaggcgacggcagcacccgcggacacaaagccaccgucuacacaggguccgcacccuucacaccaaaacuaggcagcguccaauucuccaccgacaccgaaaacgacuucgaaacucaccaaaacacaaaauucacccccguaggaguaauccaagacggcggaacaacacaccgaaacgaaccccagcaauggguacucccaagcuacuccggccgaaacgucccaaacguccaccuagcccccgcaguagcccccacauuccccggggaacaacuccuguuuuuccgaucaaccaugccaggcugcagcggauaccccaacauggaucucgacugccuccucccccaagaauggguccaacacuucuaccaagaagcagcccccgcucaauccgacgucgcacuacugcguuucguaaacccagauaccggccgaguccucuucgaaugcaaacuccauaaauccggauacguaacugucgcccacaccggacaacacgaucuaguaauacccccaaacggauacuuucgauucgacuccuggguuaaccaauucuacacccuagcucccaugggaaacggcaccggccgccgacgagcccucuaa

SEQ ID NO: 35745 - RNA, 1623 nt, Artificial Sequence
  derived and/or modified sequence opt11 from VP1__Norovirus__ACX31856
augaaaauggccucaaacgaugcaaaucccuccgacggcucagcagccaaccuuguaccagaagucaacaacgaaguaauggcccucgaacccgucguaggcgccgccaucgccgcacccgucgccggccaacaaaacgucaucgaccccuggauccgaaacaauuucguccaagcccccggcggagaguucacagucuccccucgcaacgcccccggagaaauccucugguccgcaccacucggcccagaccucaaccccuaucucucacaccucgccagaauguauaacggcuacgcgggcggcuuugaaguccaagucauacucgccggcaacgccuucaccgccggcaaaauaaucuucgccgcagucccacccaacuuucccaccgaaggccuaucccccucacaaguuacaauguucccacacaucaucgucgacguccgccaacucgaacccguccuaaucccccuccccgacguacgaaacaacuucuaucacuacaaccaaucaaacgacuccaccauuaaacucauagccaugcucuacacaccccuccgcgccaacaacgccggcgaagacguauucaccgucuccugccgaguccucacccgaccaucaccagacuucgacuucaucuuccugguaccacccaccguugaaucccgaaccaaacccuucaccguacccauccugaccguugaagaaaugacaaacucacgcuuccccauaccccucgaaaaacuuuucacgggccccucaucagccuucguaguccaaccacaaaacggccgcugcaccaccgacggaguccugcucgguaccacccaacuuucaccaguaaacaucugcacauuccgaggcgacguaacccacauagcaggauccagaaacuacacuaugaaccuagccucacucaacuggaacaacuaugaccccaccgaagaaauaccagcaccacucggaacacccgacuucguaggaaaaauccaaggcguccucacccaaacgacaaaaggcgacggcuccacccgcggccacaaagccaccgucuacaccggcucugcuccuuucacgccaaaacuaggcuccguacaauucagcaccgacaccgaaaacgacuucgaagcccaccaaaacaccaaauuuacacccguaggcguaauccaagacggaggaacuacccaucgaaacgaaccccaacaguggguccuacccuccuacucaggccgcaacguccccaacguccaucucgcccccgccgucgcccccacuuuccccggcgaacagcuucucuuuuuccgcucuaccaugcccggcugcuccgguuaccccaauauggaccuagacugccuacucccacaagaauggguccaacacuucuaccaagaagcagcgcccgcccaauccgacgucgcccuucuccgcuucgucaaccccgacacaggccgaguacucuuugaaugcaaacugcacaagucugguuacguaaccguagcacacacuggucaacacgaucuugucauacccucuaacggcuacuuccgcuucgacuccugggucaaccaguuuuacacacuagcacccaugggcaacgguaccggccgccgccgcguccucuaa

SEQ ID NO: 35746 - RNA, 1623 nt, Artificial Sequence
  derived and/or modified sequence opt11 from VP1__Norovirus__ACX31860
augaaaauggccuccaacgacgccaacccaucagacggguccgccgccaaccuugucccagaaguaaacaacgaaguaauggcucuugaacccgucgucggcgccgcaaucgccgcacccgucgccggucaacaaaacgucaucgacccuuggauucgaaacaacuuuguccaagcccccggaggugaauuuacugucucuccccgaaacgccccuggcgaaauacucugguccgcgccccucggccccgaucugaacccauaccuaucacaccuagcccgcauguacaacggcuacgccggcggcuucgaaguacaagucauccucgccggcaaugccuucaccgccgguaaaaucaucuucgccgcagucccacccaacuuccccacugaaggccucucucccucucaaguaaccauguucccccacaucaucguagacguacgacagcucgaacccguccucaucccccuacccgauguccgcaacaacuucuaccacuacaaccaaucaaaugacucuaccauaaaacucaucgccaugcuauacaccccacuacgcgcaaacaacgcaggcgacgacguauucacuguuuccugucgcgucuuaacccgcccaucaccagacuucgacuucaucuucuuagucccuccaaccgucgaaucacgcacuaagcccuucacaguccccauccucaccgucgaagaaaugaccaacucccgcuuccccauaccucucgaaaaacucuucacaggcccuuccggcgcauucgucguccaaccccaaaacggcagaugcacaaccgacggcguucuccuaggcaccacccaacucuccccugucaacaucugcacauuccgcggagacguaacccacaucgccggaucccgcgacuacacaaugaaccuagccucccuaaauuggaauaauuacgaccccaccgaagaaauccccgcaccccuaggcacccccgacuucgucggcaaaauccaagguguccucacacaaaccaccgaaggcgacggcucaacccgcggccacaaagccacgguauacaccggcucagcccccuucacacccaaacuaggcuccguucaauuuuccaccgacacugaaaacgacuucgaaacccaccaaaauaccaaauucaccccagucggcguuauccaagacggauccaccacacaccguaaugaaccacaacaauggguccucccauccuacucaggcagaaacguccacaacguacaccuagcccccgccguagccccaaccuuuccaggcgaacaacuucucuucuuccgcuccaccaugcccggcugcuccggcuaccccaacauggaccuagacugccuccucccucaagaauggguucaacauuucuaccaggaagccgcccccgcacaauccgacguagcacuccuacgcuucguuaaccccgacacuggccgcguccuauucgaaugcaagcuccacaaaagcgguuacguaacaguagcccacacuggccaacacgacuuggucauacccccaaacggcuacuuccguuucgacuccugggucaaccaauucuacacccucgcccccaugggcaacggaaccggucgacgacgcgcacuauaa

SEQ ID NO: 35747 - RNA, 1623 nt, Artificial Sequence
  derived and/or modified sequence opt11 from VP1__Norovirus__ACX31864
augaaaauggccagcagcgaugccaaccccuccgacggcagcacugcuaaccugguacccgaagucaacaacgaaguaauggcacucgaacccgucgucggcgccgccaucgccgcacccgucgccggccaacaaaacguaaucgaccccuggauccgaaacaacuuuguccaagccccaggaggagaguucaccguuuccccucguaacgcccccggcgaaauccucuggucagccccucuaggccccgacaugaaccccuaccuuucccaccuggcccgaauguacaacggauacgccggcggauucgaaguucaagucauccucgccggcaacgcuuucaccgcaggcaaaaucaucuucgcagccguacccccuaauuuccccaccgagggccuuuccccuucucaaguaaccauguucccacacaucauagucgacguucgucaacucgaaccaguccuuaucccccuaccugauguccgcaacaacuucuaccacuacaaucaauccaacgaccccaccauaaaacucaucgccaugcuuuacacaccccuucgcgcaaauaaugccggagacgacgucuucaccgucuccugccgcguccuaacccgucccuccccagacuucgauuucaucuuucucguaccacccaccguagaaucacgcacaaaacccuucucugucccaauacucaccguagaagaaaugacgaacucccgcuuccccaucccccuagaaaaacuauucaccggccccuccuccgccuucguuguccaaccacaaaacggccgaugcacuacagacggcguccuccucggcaccacacaacuaaguccagucaacaucuguaccuucagaggagacgucacccacaucgcaggaucccgcaacuauaccaugaaucucgccagucagaacuggaacucuuacgaccccaccgaagaaauccccgccccacucggcacacccgacuucguaggcaagauacaaggcguucucacccaaaccacccgcaccgacggcuccacacgcggccacaaggccaccguauacaccggcucagccgacuucucacccaaacucggccggguccaauucgccacagacaccgacaacgauuucguagccaaccaaaauaccaaauucaccccugucggcgucauccaagacggcaacacagcucaccgcaacgaaccacaacaauggguucuacccucauacuccggucguaauacacacaacguccaucuggcuccagcaguagccccaaccuuccccggcgaacaacuacuauuuuuccgcuccaccaugcccggcugcuccggauauccaaacauggaccucgacugccuccucccccaagaauggguccaauacuucuaccaagaagccgccccagcccaauccgacguugcacuccuucgauucgucaaccccgacaccggacgcguccucuucgaaugcaaacuccacaaauccggcuacgucaccguugcccacaccggccaacacgaccucguuauaccgcccaauggauacuuccgcuucgacucuugggucaaccaauucuacacccuagcccccaugggcaacggcaccggccgccgacgcgcccucuaa

SEQ ID NO: 35748 - RNA, 1623 nt, Artificial Sequence
  derived and/or modified sequence opt11 from VP1__Norovirus__ACX31889
augaaaauggcauccuccgacgcaaacccauccgauggauccacagccaaccuagucccggaagucaacaacgaagucauggcccuagaaccagucgucggcgcagccaucgccgcaccugucgcuggacaacagaacguaaucgaccccuggauccgaaacaacuucgugcaagcacccggaggcgaguucacagucuccccacguaacgcccccggcgaaauccuauggucagccccacucggccccgacaugaaccccuaccuaagccaccucgcccguauguacaacggcuacgccggcggauucgaaguacaagucaucuuagcgggcaacgccuucaccgcgggaaagaucauauucgcagccguucccccuaacuucccaaccgaaggucucagccccucccaagucaccauguucccccacaucaucgucgacguccgccaacuagaaccaguacucauacccuuaccggacguccgaaacaacuucuaccacuacaaccaaagcaacgacccgaccaucaaacucauagcaaugcucuauaccccacuccgcgcaaacaacgcaggcgacgacguauucaccguauccugccggguauuaacccgacccucacccgacuucgacuucaucuuccucgucccgccaacagucgaaucacgaaccaagcccuucucuguacccauacucaccguagaagaaaugacaaacucccgauuuccaaucccccucgaaaaacucuucaccggucccaguuccgccuucguaguccaaccccaaaacggccgcuguacaaccgacggaguccuccucggcacaacccaacuuucccccguuaacaucugcacauucagaggggacgucacccacauagccggaucacgcaacuacaccaugaaccucgccagccaaaacuggaacucauacgaccccacagaagaaaucccagcuccccucggaacccccgacuucgucggaaaaauccaaggcguccucacccaaaccacccgcacagacgggucuaccagaggccacaaagcuaccgucuacaccggauccgcagacuucucacccaaacucggcaggguacaauucgcuaccgacaccgacaaugacuucgacgcaaaccaaaacaccaaauucacccccguaggugucauacaagacggcaacaccgcacaucgaaacgaaccacaacaauggguccuaccaagcuacuccggacgcaacacccacaacguccaccucgcccccgccgucgcacccaccuuccccggagaacaacuacucuucuucagauccacaaugcccggcugcuccggauaccccaacauggaccuugacugccuacuaccacaagaauggguacaauacuucuaccaagaagcugcccccgcacaauccgacguggcccuccuucgcuucgucaacccagacacuggccgaguccucuucgaaugcaaacuccacaaauccggauacgucacaguagcacacacaggucaacaugaccuagucauucccccaaacggcuacuuccgauucgacucuugggucaaccaauucuacacccuagcccccaugggaaacggcacgggacgccgccgcgcucucuaa

SEQ ID NO: 35749 - RNA, 1608 nt, Artificial Sequence
  derived and/or modified sequence opt11 from VP1__Norovirus__ACX31893
augaaaauggccucaaacgacgccgcacccuccaacgacggcgccgccggccuuguacccgaaguaaacaacgaaacaauggcucucgaaccagucgccggagccucaauagccgcaccccucacagggcaaaacaacguaaucgacccguggauucgacucaacuucguccaagccccuaauggcgaguucaccguaucuccaagaaacagccccggcgaaguccuacucaaccucgaacucggucccgaacucaaccccuaucucgcccaccucucccgaauguacaacgguuacgccggaggcgucgaaguacaaguacuccucgccggcaacgccuucaccgcaggcaaacucguauucgcagcagucccaccccacuucccacucgaaaacaucucccccggccaaaucacaauguucccacacguaaucauagacguacgaacccuggaacccguacuacuaccacucccagacguccguaacaacuucuuucacuacaaccaacaaaacgaacaacgcaugcgccuggucgccaugcuauacacccccuuacgauccaacggcuccggcgacgacguauucaccguauccugccgcgugcucacccgcccaucccccgacuucgacuucaacuaucuagucccacccacagucgaaucaaaaaccaaacccuucacacuccccauacuuaccaucggcgaacucaccaacucccgcuuucccguccccaucgacgaacuauacaccucccccaacgaaucucuagucguacaaccacagaacggccggugcgcacuagacggcgaauuacaaggcaccacccaacuacuaccaaccgccaucugcuccuuucgcggacgcaucaaccaaaaagucucaggcgaaaaccauguauggaacaugcagguaaccaacauaaacgggaccccauucgacccaaccgaagacguaccagcaccacuuggaacccccgacuucuccggaaaacucuucggcguccucucccaacgcgaccacgacaacgcaugccguagccaugaugcaguaaucgccaccaacucggccaaauucaccccaaaacuaggcgccauccaaaucggcaccugggaacaagacgacguacauaucaaccaacccaccaaauucacccccgucggccuauucgaauccgaagguuucaaccaauggacacuucccaacuacuccggagcucucacccucaacaugggacuagcacccccaguagccccaaccuucccuggagaacaaauccucuucuuccgaucacacaucccccuaaaaggaggcguagcagaccccgucaucgauugccuacucccucaagaauggauccaacaccucuaccaagaauccgcaccaucccaaaccgacguagcacucauccgcuucacaaacccagauaccggccgcgugcuauucgaagccaaacugcaccgauccggauacauaaccguagccaauaccggaucccgccccauuguuguccccgcaaaugguuacuucagauucgacucuuggguaaaccaauucuauucccuagcccccaugggaaccggaaacggccgccgccgaguacaauag

SEQ ID NO: 35750 - RNA, 1749 nt, Artificial Sequence
  derived and/or modified sequence opt11 from VP1__Norovirus__ACX69259
augaaaauggccuccaacgacgccgccccccccucuuccgacggcgcagccaaccucguuccagaaaucaacaacgaaguaauggcccucgaacccgucgccggcgcccaacuagcagcacccguagcaggccaauucaacgccaucgaucccuggauccggcaaaauuucguacaagcaccagaaggcgaauucacaguauccccccgaaaugcaccuggugaaauccuccucaaccuagaacucggaccccacuuaaaucccuuccuacaacaccuagcucaaauguacaacgcauacgccgguggcauggaaguccaagucguccuagccggaaacgccuucacggccggcaaaauaauauucgcggccauaccaccacauuucccgcccgaacgacuuuccgccgcccaagcaacccaguucccacacgucaucguugacguacgucaacucgaaccaauaguacuaccacuacccgacguacgccacaaccuauuccacuucaaccaacaaaacgacgaacgcaugcaccucgucgccuuccuauacaccccccucagagccaacucaggaaacggagacgacgucuucaccgucuccugccgcguccucacacgcccaucccaagauuucgaauuuauguuccuaguaccaccuacugucgagaaaaaaacagucgcauucucacugccccaacuagcugucggcgaaaugucuaacuccagauggccagcucgcauaacgggcaugguaguggacccacgacucccucaaguccuucauauacaaaacggcagaugcacccucgacggaacccucaugggcaccacccaauugaacccaaaugacaucugccgcauccgcggcuacuucuccagcucccgcccagaacuccuaugcgaaggcgaagaauccgaaguaaacacaacacccaccgacucuggagccaccggcgaccaaacacccgaaguccgcacaggcacacgcgccacccaacgcugguucgccgucacagaacucaacggccaagucuacgaccccuucggcgaccaaccagccccucucggcgucccugacuucaaagcacgaauccucggcgcccucaugcgccugccaggaacaaacccaaccuccaacagccgcuuugaagaugccugggucgaaaccaacaaccaaaccaccuacgcccccgcaacuggaguuguagcaaucaccaccaacgacaacuccucuggcaacuacgcaaacgaccaaacuugcgaauucgucccucugggcauagaaauuaccgacuccgcacccuauaacgaauucgaccuucccucauacggcggagcagcauccucaggcaaccgcaaucuagccccgacagucgcaccgaccuuccccggcgaagcuauacugcucuucggcuccaauaugccgguuuacaaucguucguccggcacugacaacaaagacauccgaugccuccuccccaacgaauacguacaacaccucuacgacacacaagcccccucacucuccgacgucgcacugguccgcuacgucaauagagacacaggccgcguacucuucgaagcaaaacuccaccgcgacggcuucaugacagucaaugccucauccacaaccguccucccaguggacggauacuuccgauucgacucauggguaaaccaauucuacgcccuaucccccgucggcaacgccagcggccgccgaggacgcucacgccaagccaacuaa

SEQ ID NO: 35751 - RNA, 1647 nt, Artificial Sequence
  derived and/or modified sequence opt11 from VP1__Norovirus__ADF47131
augaaaauggccucaaacgacgccgcccccagcaaugauggcgccgcaggacucguaccagagaucaacaacgaagccauggcacucgaaccugucgcuggagcagccaucgcagcaccccuuaccggacaacaaaacauaauagaccccuggauuaugaacaacuucguccaagcccccggaggcgaguucaccgucagcccccgaaacucccccggagaaguccuacucaaccuggaacuaggccccgaaauuaacccauaccucgcccaccucgcacgcauguacaacggcuacgccggcggcuucgaaguacaagucguccuugccggaaacgccuuuaccgcuggcaaaaucaucuucgccgcaauaccacccaacuuccccaucgacaaccuauccgccgcccaaauaaccauguguccacacgucauaguagacguccgacaacucgaacccgucaaccucccuaugcccgacgucagaaacaacuucuuccacuacaaccaaggcuccgacucccgccuccgccucgucgccaugcuauacaccccacuccgcgccaacaauucuggcgacgaugucuucaccgucucaugccgcguccuaacucgcccgucccccgacuucuccuucaacuuccucgucccacccaccgucgaauccaaaaccaaacccuuuacacuccccauccuaaccaucuccgaaaugucaaacucacgcuuccccguccccaucgacucauuacacaccucacccaccgaaaacaucgucguacaaugccagaacggccgcguuacccuagauggagaacuaauggguaccacccagcuccuacccucccagaucugcgcuuuccgcggaguucuaacacggucuaccucccgagccucagaccaagccgacaccgccacgccccgccucuucaacuacuacuggcacauccagcucgacaaccucaauggcacccccuacgacccagcagaagacaucccuggaccacucggaacccccgacuuccggggcaaaguauucggcgucgcgucacaacgaaaccccgacuccaccacccgcgcccacgaagccaaagucgacaccaccgcuggucgcuucaccccuaaacuaggcucacucgaaauauccacagaaucaggugacuuuaaucagaaccaaccaacccgauucacacccgucggaauuggcguagaccaugaagaagacuuccaacaauggucacuacccgacuauuccggccaauucacccacaacaugaaccucgcucccgccguagcccccaacuucccaggugaacaacuccuuuucuuccgcucucaacuccccuccuccggaggccgcagcaacggcauacuagacugccucgucccccaagaauggguccaacacuucuaccaagaauccgccccgacccaaacacaagucgcacucguccgguaugucaaccccgacaccggccguguacucuucgaagccaaacuccacaaacucggcuuuaugacaaucgccaaaaacggcgacucccccauaaccguucccccaaacgguuacuuccgcuucgaauccuggguaaaccccuucuauacccucgcacccaccggcaccgaaaacggucgacgccgaguccaauaa

SEQ ID NO: 35752 - RNA, 1623 nt, Artificial Sequence
  derived and/or modified sequence opt11 from VP1__Norovirus__ADR78869
augaaaauggccuccaacgacgcaaaccccucggacggauccgccgcaaaccuaguccccgaagucaacaaugaaguaauggcucuagaacccgucgucggcgccgccauagcagccccaguugcuggacaacagaacgucaucgaccccuggauccgaaacaacuucguccaagcacccgguggugaauuuaccgucucaccccgcaacgccccgggagaaauccucuggucugcaccacuuggcccugaccuaaaucccuaccucucccaccuugcacgaauguacaacggauacgccgggggcuucgaaguccaagucauccuagcaggaaacgcuuuuaccgcaggaaaaaucauuuucgcagcgguacccccuaacuuccccaccgaaggacuuagcccaucccaagugaccauguucccccacauaaucgucgacguccgccaacucgaacccguacuuaucccacuccccgacguccgcaacaauuucuaucacuacaaccaaagcaacgacuccaccaucaaauuaauagccaugcucuacacuccacuccgcgccaacaacgcgggcgaagacguauucaccgucuccugccgcguacuaacaagaccuucacccgacuucgacuucaucuuccucguacccccaaccgucgaaucccgcacuaaacccuucaccguccccauccuuacagucgaggaaaugacuaacucccgcuucccaaucccccucgaaaaacucuuuaccggcccaucaggagccuucguaguccaaccucagaacggacgauguacaaccgacggcguccuacucggcacaacccaacucucaccagucaacaucugcacuuuccggggcgacgucacccacauagcgggguccagaaacuacaccaugaaccucgcaucacucaacuggaacaauuacgaucccaccgaagaaaucccagcaccccucggaacccccgacuucguaggcaaaauccaaggcguucuaacacaaacaacaaaaggcgacgguucuacccgaggacacaaagcaaccgucuacaccgguuccgcccccuucaccccuaaacucggaucaguacaauucuccacagacacagaaaacgacuucgaaacccaccaaaacacaaaauucacccccguaggcgucauccaagacggaucuaccacccaccgaaacgaaccccaacaaugggucuuacccucauacucaggacgcaacguacacaacguccaucucgcccccgccgucgcacccaccuuuccgggcgaacaacuccuauucuuccggucaacaaugccaggaugcuccggauaccccaacauggaccucgacugccuccucccccaagaauggguccaacacuucuaccaagaagccgcccccgcccaauccgacgucgcccuccuucgauucgucaaccccgauaccggacgaguccucuucgaaugcaaacuacacaaaagcggcuaugucaccguagcacacacaggccaacacgaccucgucauaccacccaacggcuacuuccgcuucgacuccugggucaaccaguucuauacccuagcccccaugggcaacggcaccggacgccgccgcgcacuauaa

SEQ ID NO: 35753 - RNA, 1623 nt, Artificial Sequence
  derived and/or modified sequence opt11 from VP1__Norovirus__ADR78872
augaaaauggcguccaacgacgcaaaccccuccgacggaucagcagccaaccucguccccgaaguaaacaacgaagucauggcccucgaacccgucgucggcgcagcaauagcggcccccguagccggccaacaaaacguaaucgaccccuggauccgcaacaacuucguucaagccccgggcggcgaguucaccgucucaccacgcaacgccccaggggaaauacuaugguccgcaccccucggcccagaccuuaaccccuaucuaucacaucuugcccgaauguacaacggauaugccggcggcuucgaaguucaagucauccuugccggaaacgccuucaccgccggaaaaaucaucuucgcagccgucccgcccaauuuccccacugaaggacucucccccucccaaguaaccauguucccccacauaauaguagacguccgacagcucgaacccguacucaucccacuccccgacguacgaaacaacuucuaccacuauaaccaauccaacgacucuacuauaaaacuuaucgcaaugcuguauacaccccucagagcaaacaacgccggcgaagacguauuuaccgucuccugccgaguccucacacgcccuucccccgacuucgacuuuaucuuccucguacccccaacagucgaaucccgcacaaaacccuucacaguaccaauccuaacaguagaagaaaugaccaacagcagauuccccauaccacucgaaaaacuauucaccggccccuccggcgcauucgucguccaaccacagaacggccgcugcaccacagacggaguccuuuuaggcaccacccaacucucacccgucaacauuuguaccuuccgcggcgacgucacccacaucucaggaucacgcaauuacaccaugaaccucgccucccucaacuggaauaacuacgaccccaccgaagaaauccccgcuccccuagggacacccgacuucgucggcaaaauccaaggcgugcuuacucaaaccacaaaaggcgacggaagcacccgaggccacaaagccacuguauacaccggcuccgcccccuuuacccccaaacuaggcuccguacaauucuccaccgacacagaaaaugacuucgaaacacaccaaaacaccaaauucaccccagucggcguaacccaagacggcagcaccacucaccguaacgaaccccaacaauggguccuccccuccuacuccggccguaacgugcacaacguacaccuagcccccgccguagcucccacuuuccccggcgaacaacuccucuucuucagaucaacaaugccaggcuguucaggcuaccccaacauggaccucgacugccuccuaccccaagaauggguacaacacuucuaccaagaagccgccccagcacaauccgacgucgcucuccuacgauucguaaacccagacacuggcaggguccucuucgaaugcaaacuucauaaaucuggcuacgucacagucgcccacaccggccaacacgaucuaguuaucccacccaacggcuacuuccgcuucgacagcugggucaaccaauucuacacccuggcucccaugggcaacggcaccggccgacgccgcgcccucuag

SEQ ID NO: 35754 - RNA, 1623 nt, Artificial Sequence
  derived and/or modified sequence opt11 from VP1__Norovirus__ADR78875
augaaaauggccagcaacgacgcaaaccccucagacggcuccgccgcaaaccuaguccccgaagucaacaaugaaguaauggcccuagaacccgucgucggcgcggcaauagcagcaccagucgccggccaacaaaacgucaucgaccccuggauacgaaacaacuucguccaagccccaggcggagaguucaccguaagcccccgaaacgcccccggcgaaauccucugguccgcaccccuagggccugaccucaaccccuaucucagccaucuugccagaauguacaacggauacgccggcggcuucgaaguacaaguaauacucgcaggcaacgccuucacugcuggcaagaucauauucgccgccgucccacccaacuuccccacagaaggccucucacccucccaaguaaccauguucccccacaucaucguagacguacgccaacucgaacccguccuaauaccccuucccgacguccgcaacaacuucuaucacuauaaccaaucgaacgacuccaccaucaaacucaucgccaugcuauacaccccacuacgagccaauaaugccggcgaagacgucuucaccguuuccugccgaguucuaacccgacccucacccgauuucgacuucaucuuccuaguaccacccacaguugaaucccgcacaaaacccuucaccguuccuauucuaaccguagaagaaaugaccaacucccgcuuccccauaccccucgaaaaacuauucacaggacccuccggagcuuucguuguacaaccccaaaacggccgcugcacaaccgacggugugcuucucgguaccacccaacucucccccguaaauaucugcaccuuccgaggcgaugucacccacaucgccggcucccgcaacuacaccaugaaccucgcaucacuaaacuggaauaacuacgaccccaccgaagaaauacccgcaccccucggaacaccagacuucgucggcaaaauccaagguguuuuaacucaaaccaccaaaggcgacggaucgacacgaggacacaaagccaccgucuacaccggcuccgccccauucacaccaaaacuaggauccguccaauucucaaccgacacggagaacgacuuugaaacccaccaaaacacaaaauucacuccugucggcgucauacaagacgguucaaccacucaccgcaacgaaccucaacaauggguacuacccuccuacucaggacgaaacguucacaacguacaccucgcccccgcaguugcccccacauuccccggagagcaacuccucuucuucagguccacgaugcccggcugcuccggcuaccccaacauggaccucgacugccuccuaccccaagaauggguccaacauuucuaccaggaggcggcacccgcccaaucugaugucgcccuccuucgauucgucaacccagacaccggacgcguucucuucgaaugcaaacuacacaaaucuggauacgucacagucgcacacacaggccaacacgaccucguaauaccacccaacggauacuuccgcuucgacuccuggguuaaccaauucuacacccuagcccccauggggaacggcaccggucgccgucgagcccucuga

SEQ ID NO: 35755 - RNA, 1623 nt, Artificial Sequence
  derived and/or modified sequence opt11 from VP1__Norovirus__ADR78878
augaaaauggcauccaacgacgcaaacccaucagacggcuccgcagcaaaccucgugccugaggucaacaacgaaguaauggcacucgaacccgucgucggcgccgcaauugccgcccccgucgccggccaacaaaacgucauagacccauggauccgcaacaacuucguccaagccccaggaggcgaauuuaccguaucaccucgcaacgccccaggcgaaauccucuggucugcuccccuuggaccagaccuaaaccccuaccucucacaccucgcccgaauguacaacggcuacgccggcggauucgagguccaaguaauacuugccggcaaugccuucacagccggaaaaauaaucuucgccgcaguaccacccaacuuccccaccgaagggcuaucucccucccagguaaccauguucccccacaucauugucgacguucgacaacuugaaccaguccucaucccacucccagauguccgcaacaacuucuaccacuacaaccaaucaaacgacucuaccaucaaacucauagccaugcucuacacaccccugcgagcaaacaacgccggugaagacgucuucaccgucuccugccgcguacuaacccgccccucucccgacuuugacuucaucuuccucguuccaccgaccguugaaucccgcacaaaacccuucaccguacccauccuaacugucgaagagaugaccaacucucgcuucccaaucccacucgaaaaacuauuuacaggccccucaggagccuucguaguacagccacaaaacggacgcugcaccaccgacggcguccuccucggaaccacccaacuaagccccgucaacauuugcaccuuccgaggugacguaacacacauagccggcucccgcaacuacaccaugaaccuagccagccuuaacuggaacaacuacgaucccaccgaagaaauaccagcaccccuaggcaccccagauuucguaggcaaaauccaaggaguauuaacccaaacaacuaaaggcgacggguccaccagaggccacaaagccaccgucuacacaggcagcgcacccuucaccccaaaacuuggcuccguacaauucuccacagacaccgaaaacgacuucgaaacucaucaaaacaccaaauucacccccgucggagucauacaggacggauccaccacacaccgcaacgaaccacaacaauggguacuccccagcuacagcggccgaaacguccacaacguccaccuugcccccgccguugccccaaccuuccccggagaacagcuacucuucuuccgcucgacaaugcccggcugcuccggcuacccaaacauggaccucgauugccuucucccccaagaauggguccaacacuucuaccaagaagccgccccagcccaaagcgacgucgcccuccuacgcuucgucaaccccgacaccggccgcguccucuucgaaugcaagcuccacaaaucgggcuacgucaccgucgcccacacuggucaacacgaccucguaaucccacccaacggcuacuuccguuuugacuccugggucaaccaauuuuacacucuagcucccauggguaacggaacaggccgccgacgugcacucuaa

SEQ ID NO: 35756 - RNA, 1623 nt, Artificial Sequence
  derived and/or modified sequence opt11 from VP1__Norovirus__ADR78881
augaaaauggccuccaacgacgcaaauccuuccgacggcuccgcagcaaaccucguacccgaagucaacaacgaaguaauggcccucgagcccgucgucggcgccgccaucgcugccccgguggccggacaacaaaacguaauagaccccuggauccgcaacaacuucguccaggccccuggcggagaguucaccguauccccacgaaaugcaccaggcgaaauacucugguccgcaccccugggaccugaccucaacccauaccuuucacaccucgccagaauguacaacggauacgccggcggauuugaaguucaagucauccucgcugguaacgccuuuacagccgguaaaaucaucuucgccgccguacccccaaacuuucccaccgaaggacuaucucccucucaagucaccauguucccccacauaaucguugacguccgccaacucgaacccguccucaucccgcuacccgacgucaggaacaacuucuaccacuacaaccaauccaacgauuccaccaucaaacucaucgccauguuauacaccccacugcgcgccaacaacgccggcgaagacgucuucaccguauccugccgcguuuuaacacgccccagccccgacuucgacuucauauuccucguacccccaaccgucgaaucccgcaccaaacccuucacagucccuauacucacuguagaagaaaugaccaacucucgcuuccccaucccccucgaaaaacucuuuaccggccccucaggcgccuucgucguccaaccccaaaacggacgcugcacaacugacggcguccuucuaggcaccacccaacuaucccccgucaacaucugcaccuuccgcggcgacguuacccacaucgccgguuccagaaacuacacaaugaaccuagcgucccucaacuggaacaacuacgaccccacugaagaaauccccgcaccguuaggcacccccgacuucgucggcaaaauacagggcguacucacccaaacuaccaaaggagacggcuccacacguggccacaaagccaccguauauacaggauccgccccauucacccccaaacuaggcagcguacaauucucaacagacaccgaaaacgacuucgaaacccaccaaaacacaaaauucacacccguaggcguuauccaagacggcuccacaacccaccgcaacgaaccacaacaauggguacucccauccuacuccggccgcaacguucacaacguccaccucgcccccgccguugccccaaccuuccccggagaacagcuccucuucuuccggucaaccaugccuggcugcuccggcuacccuaauauggaccucgacugccuccucccccaagaauggguccaacacuuuuaccaagaggccgcccccgcccaaucagacgucgcacuacuacgcuucguaaaccccgauaccggccgcguccucuucgaauguaaacuccacaaauccggcuacgucaccgucgcccauaccggucagcacgaucucgucaucccacccaacgguuacuuucgauucgacuccugggucaaccaauucuauacacuagcccccaugggcaacggcacaggccgccgacgagcacuauaa

SEQ ID NO: 35757 - RNA, 1623 nt, Artificial Sequence
  derived and/or modified sequence opt11 from VP1__Norovirus__ADR78884
augaaaauggcuuccaaugacgcuaacccauccgacggcuccgcagccaaccuuguacccgaaguaaacaaugaagucauggcgcuagagcccgucguaggugccgccaucgccgccccaguagccggccaacaaaacgucauagacccuuggauacgaaacaacuucguccaagcgcccggaggcgaauuuaccgucagcccccgcaacgcgcccggcgaaauccuauggucagcaccccuagggccagaccuuaacccauaccucucacaccucgcccgaauguacaacggcuacgccggcggcuucgaaguacaagucauacuagcaggcaacgccuucacagccggcaaaauaaucuucgccgcagucccacccaacuuccccaccgaaggccuuucgcccucacaggucaccauguucccccacaucauagucgacguacgacaacuagaacccguccucaucccccuacccgacguccgcaacaacuucuaucauuacaaucaauccaacgacucaaccaucaaacucaucgcaaugcucuacacuccccuccgcgccaacaacgccggugaagacgucuucaccgucuccugccgcgugcucacccgccccucccccgacuucgacuuuaucuuccucguacccccaacagucgaaagccgcacaaaaccuuucacggucccuauccucaccgucgaagaaaugacaaacucacgauuuccaaucccccucgaaaaacucuucaccggaccauccggugccuucgucguccaaccucaaaacggccgcugcaccaccgacggcguacuucucgguaccacacaacucuccccagucaacaucugcaccuuccgaggcgacgucacccacauagccggcucccgcaacuacaccaugaaucucgcaucccucaacuggaacaacuacgacccaaccgaggaaauccccgcaccccuaggcacccccgacuucgucggaaaaauacaaggcguccuuacccaaaccacaaaaggagacggcuccacccguggucacaaagcaaccguauacacaggauccgcacccuucacccccaaacuaggcuccguacaauucucaacagacaccgaaaaugacuucgaaacccaccaaaacaccaaauucacaccagucggugucauucaagacggcucaaccacccaccgcaaugaaccccaacaauggguccuucccucauacuccggccgcaauguccacaacguccaccucgcccccgcagucgccccuacauuccccggcgaacagcuccuauucuuccgcuccaccaugcccggaugcaguggcuaccccaacauggaccuugacugccuccucccacaagaauggguacaacacuucuaccaagaggccgcccccgcccaaucugacgucgcacuccuccgcuucguuaaccccgacacaggccgaguccucuucgaaugcaaacuccacaaauccggauacguaacagucgcucacacaggacaacacgaccucguaaucccacccaacggcuauuuccgcuucgacuccuggguuaaccaauucuacacccuagcccccaugggcaacggaaccggccgccgacgagcacuauaa

SEQ ID NO: 35758 - RNA, 1623 nt, Artificial Sequence
  derived and/or modified sequence opt11 from VP1__Norovirus__ADR78887
augaaaauggccucaaacgacgccaauccuucagauggcagcgccgccaaccuuguucccgaagucaacaacgaagucauggcccucgaacccgucgucggugccgccaucgcagcccccgucgccggccaacaaaacgucaucgaccccuggauccgcaacaacuucgugcaagcccccggaggugaguucacagucucaccccguaacgccccaggcgaaauccucuggucagcaccucuaggaccagaucucaaccccuaccuaucacaucucgcccgcauguacaacggauacgcaggcggcuucgaaguccaaguaauccuagccggcaaugccuucacugccggaaaaaucaucuuugccgcagucccgcccaacuuccccaccgaaggccugucccccucccagguaaccauguucccccacauuaucgucgacguccgccaacucgagcccguccucaucccccuccccgauguccgcaacaacuucuaccacuacaaccaguccaacgauucaaccaucaaacucaucgccaugcucuacacaccccuccgcgccaacaaugccggagaagacgucuucaccgucuccugccgaguacuaacccgaccaucacccgacuucgauuucaucuuccucguacccccgaccgucgaaucccgcaccaaacccuucaccguacccauacuaacaguagaagaaaugaccaacucccgauucccaaucccucuugaaaaacucuuuaccggacccuccggcgcauucgucguccaaccacagaacggcagaugcaccacagacgguguacugcucggcacgacccaacucucacccgucaacaucugcaccuuccgcggcgacguaacccacauagcuggaucccgcaacuacaccaugucccucgccucucucaacuggaacaacuacgaccccaccgaagagaucccagcaccccucggcaccccugacuucguaggcaaaauccaaggcguccuuacccaaacaaccaaaggggacggcuccacucgaggacauaaagccacagucuacaccggcuccgccccauucacacccaaacucggcuccguccaauucucuacagacacagaaaacgacuucgaaacccaccaaaacaccaaguucaccccagucggcgucauccaagacggauccacaacccaccgaaacgaaccccaacaauggguauuacccagcuacuccggccgcaacguccacaauguccaccuugcccccgcagucgcacccacauucccaggagaacaacuucucuucuuccgauccacaaugcccggcugcagcggcuaccccaacauggaccuagacugccuccucccccaagaauggguccaacacuuuuaccaagaagcagccccagcccagucagacgucgcacuacuccgcuucgugaaccccgacacaggccgcgucuuauucgaaugcaaacuacacaagagcggcuaugucacaguagcccauacaggacaacacgaucuaguuauucccccaaacggauacuuccgcuucgacagcugggucaaccaauucuacacccucgccccgaugggcaacggaaccggccguagacgagcccucuaa

SEQ ID NO: 35759 - RNA, 1623 nt, Artificial Sequence
  derived and/or modified sequence opt11 from VP1__Norovirus__ADR78890
augaaaauggccucuaacgacgcaaacccauccgacggaucugccgcaaaccucguucccgaagucaacaacgaggucauggcccucgaaccuguaguaggcgccgccaucgccgcccccguugccggccaacaaaacguaaucgacccauggauaagaaacaacuucguccaagccccaggcggagaauuuacugucucaccacguaacgcuccgggcgaaauacucugguccgcaccccuaggcccagaccucaaccccuaccucucccaccuagcccgcauguacaacggcuaugccggcggcuucgaaguccaagucauccucgccggcaacgcauucacagccggcaaaaucaucuucgccgccgucccacccaacuuccccaccgaaggacucagccccucacaagucaccauguucccccacaucaucgucgacguccgccaacucgaacccguccucauaccccuccccgacguccgaaacaacuucuaccacuacaaccaauccaacgacucuaccaucaaacucaucgccaugcuauacacaccccuaagagccaacaacgccggcgaagaugucuucaccguaucuugccgaguccuuacccgccccuccccagauuucgacuucauuuuccucgugcccccuaccgucgaaucccguaccaaacccuuuaccguccccaucuuaaccguagaagaaaugaccaacucccgcuucccuaucccacuagaaaaacucuucacaggccccucaggagccuucgucguacaaccccaaaacggcagaugcacuacugacggaguccuccuaggcaccacccaacucagcccagucaacauuugcaccuuccgaggagacgucacacacaucgccggcucccgcaauuacaccaugaaccucgcaucccuuaacuggaacaacuacgaccccaccgaagaaauccccgcgccccucggaacccccgacuucgucggaaaaauucaaggcgucuuaacacagaccaccaaaggcgacggcuccacccgcggccacaaagccaccgucuauacaggcuccgcccccuucacccccaaacuagguucaguccaauucuccaccgacaccgaaaacgacuucgaaacccaccaaaacacaaaauucaccccagucggaguaauacaagacggauccaccacacaccggaacgagccccaacaguggguccuacccuccuacuccggccgaaacguacacaacguucaccuagcccccgccguugcacccacuuucccuggcgagcaacuccucuucuuccgcuccacaaugccaggcugcucuggcuacccuaacauggaccucgacugccuccucccacaagaauggguucagcacuuuuaccaggaagccgccccggcacaauccgacgucgcccuucuucgcuucgucaaccccgacacaggcagagugcuauucgaaugcaaacuacacaagucgggcuacgucacuguagcccacacaggccaacacgaccuagucaucccacccaacggauacuuucgcuucgacuccuggguaaaccaauucuacacacuagccccuauggguaacggcaccgggcgccgccgcgcacucuaa

SEQ ID NO: 35760 - RNA, 1623 nt, Artificial Sequence
  derived and/or modified sequence opt11 from VP1__Norovirus__ADR78893
augaaaauggccuccaacgacgccaaccccuccgacggcuccgccgcaaaccucguccccgaaguaaacaacgaaguaauggcccuagaacccgucgucggugccgccaucgccgcccccgucgccggccaacaaaacguaaucgacccuuggauacgcaacaacuucguacaagcacccgguggcgaguucaccguaucaccccgcaacgccccaggugaaauccuuugguccgcaccccuaggccccgaccucaacccauaccuaucacaucuugcgcgcauguacaacggcuacgccggagguuucgaaguccaaguaauacucgccggcaacgccuucacugccggcaaaauaauauuugcagcagugccacccaacuuccccaccgaaggccucucaccaucccaagucacaauguuuccccacauaauagucgacguccgccaacuugaacccguacuaaucccccucccagacguccgcaacaacuucuaccacuacaaucaaucuaacgacuccaccaucaagcucaucgccaugcuuuacaccccacucagagcgaacaacgccggugaagacgucuucaccguaagcuguaggguacuaacacgccccucccccgacuucgacuucaucuuucucguaccucccaccgucgaaucccgcacaaaacccuucacaguccccauacuaaccgucgaagagaugacaaacucucgcuuccccauaccgcucgaaaaacuauucaccggcccaucaggcgccuucgucguacaaccgcaaaacggcagaugcaccacagacgggguccuacuaggcaccacgcaacuaucuccaguaaacaucugcacauuccgcggugacgucacccacauagcaggcucccgaaacuacaccaugaaccucgccagccucaacuggaacaacuacgaccccacagaagaaaucccagcaccccucggcacacccgacuucgucgguaaaauccaaggcguccuaacacaaacaacaaaaggugacggauccacccgcggccacaaagccaccguuuauacaggcuccgcaccauucacccccaaacuuggaucaguacaauucuccacagacacagaaaacgacuucgaaacccaccaaaacacaaaauucacucccgucggcgucauccaagauggaagcaccacccaccgcaacgaaccccaacaguggguccucccaagcuauuccggacgaaacguccacaacguccaccucgccccugcugucgcccccaccuuccccggcgaacagcuucuuuucuuuagauccaccaugccuggcugcuccggcuacccaaacauggaccucgacugccuucucccucaagaauggguccaacacuucuaccaagaagcggccccagcccaauccgacguagcccuccuccguuucgugaauccugacaccggccgcguacucuucgaaugcaaacuacacaaauccggauacgucaccguggcccacaccgggcaacacgaccucgucaucccucccaacggcuacuuccgcuucgacuccugggucaaccaauucuacacacuagcacccaugggcaacggcaccggccgccgccgagcccucuaa

SEQ ID NO: 35761 - RNA, 1623 nt, Artificial Sequence
  derived and/or modified sequence opt11 from VP1__Norovirus__ADR78896
augaaaauggccucaaaugacgcaaaccccuccgacggcuccgccgcaaaccuuguccccgaagucaacaacgaaguaauggcccuggaaccagucgucggagcagccauagcugcacccguagcaggccaacagaaugucauagauccauggauccgaaacaacuucguucaagcaccaggaggcgaauuuaccgucagcccccgaaaugcacccggcgaaauccuaugguccgcaccccucggccccgaccucaauccguaucuuucccaccucgcccgaauguacaacggcuacgccggcggcuucgaaguccaaguaauccucgccgguaacgccuucaccgcaggaaaaauaauauucgccgccgucccacccaacuuccccaccgaaggccuauccccaucccaaguaaccauguucccccacaucauaguugacguccgccaacuagaacccguccuaauuccccuccccgauguccgcaacaacuucuaccacuacaaccaauccaacgacagcaccaucaaacucaucgccaugcucuauacaccccuccgcgcaaacaaugccggcgaagacguauucaccgucuccugucgaguccuaacccgccccucccccgacuucgauuucauauuccucguacccccuacugucgaaucccgaacaaaacccuucaccgucccaauccuaaccguagaagaaaugaccaauucccgcuucccgauaccacuagaaaaacucuucaccggacccuccggcgccuucguaguccaaccccaaaacggacgcuguaccaccgacggcguccuacuuggcaccacacaacuuucccccgucaacaucugcaccuucagaggagacguaacacacaucgcaggaucccgcaacuacaccaugaaccuagcuucucucaacuggaacaacuacgacccaaccgaagaaauccccgcaccucucggcacacccgacuucgucggcaaaauacaaggcguacucacccaaaccaccaaaggugauggauccacccgaggacacaaagccaccgucuacacagguuccgcccccuucaccccaaaacucggaucaguccaguucuccaccgacaccgaaaacgacuucgaaacgcaccaaaacacaaaauucacccccgucggcgucauccaagacggcuccaccacccaccgcaacgaaccccaacaauggguacuccccucauacucaggacguaacguccauaacguccaccucgccccagcaguagcccccacauuccccggcgaacaacuacuauucuuucgcuccaccaugcccggcugcuccggguaccccaacauggaccucgacugccuccucccccaagaauggguccaacacuuuuaccaagaagcagcgcccgcccaauccgacgucgcacuacuccguuucguaaaccccgacacaggucgaguacuauucgaaugcaaacuacacaagucuggcuaugucaccgucgcucauaccggccaacacgaccucguaaucccaccaaauggcuacuuccgcuucgacagcuggguuaaccaauucuacacccuagcccccaugggcaacggcaccggacgcagacgugcacucuga

SEQ ID NO: 35762 - RNA, 1623 nt, Artificial Sequence
  derived and/or modified sequence opt11 from VP1__Norovirus__ADR78899
augaaaauggccuccaacgacgcaaacccuuccgacggcuccgcagcaaaccucgucccagaagucaacaacgaaguaauggcgcucgaacccgucgucggcgccgccaucgcagcaccaguagccggucaacaaaacgucaucgaccccuggauccgcaacaacuucguccaagcccccggaggagaguucaccgugucaccucgcaacgccccaggcgaaauccuauggucagcaccccucggccccgaccucaacccauaccucucccaccucgcacguauguacaacggauacgccggcgguuucgaaguacaagucauccucgcuggaaacgccuucacugccggcaaaaucauuuuugccgccgucccucccaacuuccccaccgaaggucuaucucccucucagguaaccauguucccccacauaaucguagacguccgccaacucgaacccgugcucaucccacucccugacguucgaaacaacuucuaccacuacaaucaauccaacgacucaaccaucaaacucaucgcaaugcuauacacaccccucagagcaaacaacgccggugaagacguauuuaccgugucuugccgaguucucacccgaccuuccccugacuucgacuuuaucuuccuagucccaccaaccgucgaaucccgaacaaagcccuucaccguccccauccucaccgucgaggaaaugacaaacucucgcuuccccauaccccucgaaaaacuuuucacuggcccaucuggagccuucguuguccaaccacaaaauggccgcuguacuaccgauggaguccuccucggaaccacccaacuaucccccgucaacaucugcacauuccgcggcgacgucacccacauagccggaucacgaaacuacaccaugaaccuagccucccucaacuggaauaacuacgaccccacagaagaaauccccgccccucucggugccccagacuucgucggcaaaauccaaggcguccucacacagacaacaaaaggagacggcuccacccgcggccauaaagccaccgucuacaccggcagugccccauucacccccaaacucggcuccguccaauucuccaccgacaccgaaaacgacuucgaaacccaccaaaacaccaaauucacccccguaggggucauacaagacggcuccaccacucaccgaaacgaaccccaacaauggguacuccccuccuauuccggacgcaacguucacaacguacaccucgcccccgccgucgcccccaccuucccaggcgaacagcuccuauucuuccgcucaacaaugcccggcuguuccggcuacccaaacauggacuuagacugccuccuuccccaagaauggguccaacacuucuaccaagaagccgcacccgcccaauccgacgucgcccuccuacgcuucgucaacccugacacuggccgcguccuauucgaaugcaaacugcacaaauccggauaugucaccgucgcccauaccggccaacacgaucuaguaauacccccaaacggcuacuuccgauuugacuccuggguaaaccaauucuacacccucgcccccaugggcaacggcacaggccgccgccgcgcacuauaa

SEQ ID NO: 35763 - RNA, 1623 nt, Artificial Sequence
  derived and/or modified sequence opt11 from VP1__Norovirus__ADR78902
augaaaauggccuccaaugacgccaaccccuccgacggcuccgccgcaaaucuaguaccagaagucaacaacgaagucauggcccuagagcccgucguaggggccgcaauagcugcacccguagcaggacaacaaaacgucaucgaccccuggauccgcaacaacuucguccaagcaccaggcggagaguucaccgucuccccacguaacgcccccggcgaaauccuuugguccgcaccccuaggcccagaccuaaaucccuaccuaucacacuuggccagaauguacaacggcuacgcaggagguuucgaaguacaagucauccucgcaggcaacgccuucaccgcaggcaaaaucaucuucgccgcuguacccccaaacuuuccaaccgaaggacucuccccaagccagguaacaauguucccccacaucaucgucgacguccgccaacuagaaccaguccuuaucccacucccagacguccgcaacaacuucuaccacuacaaccaaagcaacgacucuaccaucaaacucauagccaugcucuacacaccccuacgcgccaacaacgccggagaagacgucuucaccguaucaugccguguccuaacccgccccucccccgacuucgacuucaucuucuuaguucccccaaccguggaaucacgcaccaaacccuucaccguccccauccucaccgucgaagaaaugacaaacucacgauuccccauaccccucgaaaaacucuucaccggccccuccggagcuuucgugguccaaccgcaaaacggccgcugcaccaccgacggaguacuccuuggcaccacccaacuauccccaguaaacauaugcaccuuccguggcgacguuacccacauagccggaucccguaacuacaccaugaaccucgccucccuaaacuggaacaacuacgaccccacagaagaaaucccagcaccccucggcacuccagacuucgucggcaaaauacaaggcguacuaacacaaaccaccaaaggugacggauccacucgcggccacaaagccaccgucuauaccggaucugccccuuucacccccaaacucggcuccguccaauuuuccacagacaccgaaaacgacuucgaaacccaccaaaacacaaaauucaccccaguagguguaauacaagacggcuccaccacccaccgcaacgaaccacaacaauggguacucccauccuacucaggccgcaacguccauaacgugcaccuagccccugcagucgccccgaccuuccccggagaacaacuccuauucuuccgaucaaccaugcccggaugcuccggcuaccccaacauggaccuagacugccuccucccacaggaauggguacaacacuucuaccaagaagccgcaccggcacaauccgacgucgcacuucuccgcuucgucaacccugacacuggccgcguacuuuucgaaugcaaguuacacaaauccggauaugucaccguagcucacaccggccaacacgaccucgucauaccacccaacggauauuuucgcuucgacucuugggucaaccaauucuacacccucgcucccaugggaaacgguaccggccgccgcagagcccuauaa

SEQ ID NO: 35764 - RNA, 1623 nt, Artificial Sequence
  derived and/or modified sequence opt11 from VP1__Norovirus__ADR78905
augaaaauggcaucaaacgacgcaaaccccucagacgguucagcagccaaucucgucccagaagucaacaacgaagucauggcccuugaaccuguagucggcgccgccaucgccgcccccgucgcaggacaacaaaacguaauagaccccuggauacgaaacaacuucgugcaagccccaggaggcgaguucacgguaucaccgcgcaacgcccccggagaaauacuauggucagcuccccucggccccgaccucaaccccuaccucucucacuuagcccgaauguacaacggauacgccgggggcuucgaaguccaaguaauccucgccggcaacgcauucaccgccggaaagauuaucuucgcagccguaccacccaacuuccccaccgaaggacucagccccucgcaaguaacaauguucccacacaucauaguagacguacgacagcucgaacccguacuaauucccuuacccgacguacgaaacaacuucuaccacuacaaccaauccaacgacagcaccauaaaacuaaucgccaugcuuuacacaccccuacgcgccaacaaugccggcgaggacgucuuuaccgucuccugccgcguacucacacgccccagccccgacuucgacuucaucuuccuagucccacccaccgucgaaagccgcacaaaacccuucaccgucccaauccucaccgucgaagaaaugaccaacucccguuuccccaucccccucgagaaacuuuucacuggaccuuccggcgcuuucgucguacaaccucaaaacggucgcugcaccaccgacggaguucuccucggaaccacccaacucucacccgucaacauaugcacauuccgcggugacguaacccacauagcaggaucccgaaacuacacaaugaaccucgcaucccuaaacuggaacaacuacgaccccacagaagaaauucccgccccacucggaacacccgacuucguaggcaaaauccaaggaguccuaacccaaaccaccaaaggugacggcuccacccgaggccacaaagccaccgucuacaccggauccgcuccauucacccccaaacuaggcucaguucaauucuccacagauaccgaaaacgacuucgaaacccaucaaaacaccaaauucacccccgucggcgucauacaagacggcuccaccacccaccgcaacgaaccucaacaauggguccuccccuccuacucuggacgaaacguccacaacguccaucuagcccccgccgucgcacccacauucccaggagaacagcuccuauucuuccgcucaacaaugccuggaugcuccggauaccccaacauggaccuggacugccuccucccacaagaauggguacaacacuucuaccaagaagccgcccccgcacaauccgacgucgcccuccuccgauucguaaacccagacaccggccgcguacucuucgagugcaaacuccacaaauccgguuaugucacagucgcccacaccggacaacacgaucuugucauaccacccaacggcuacuucagauucgacucuuggguuaaccaauucuacacccuagcacccaugggaaacggaacaggcagacgccgcgcccuauga

SEQ ID NO: 35765 - RNA, 1623 nt, Artificial Sequence
  derived and/or modified sequence opt11 from VP1__Norovirus__ADR78908
augaaaauggccucgaaugacgccaaccccuccgacggcucagccgccaaccuuguuccugaagucaacaacgaagucauggcccucgaacccgucgucggcgccgcaaucgcagcgcccguugcaggccaacaaaacgucauagaccccuggauccgaaacaacuucguacaagcccccggcggcgaauuuaccguuagccccagaaacgccccgggagagauccucuggagcgcaccccucggcccagaccucaacccauaccucagccaccuagcccgcauguacaacggauaugcuggaggcuucgaaguccaaguuauacucgcaggcaacgccuucaccgcaggcaaaaucaucuucgcugccgucccgcccaacuuccccacugaaggccuaucccccucccaaguaaccauguucccccacauuaucgucgacguccgccaacuagaacccguccucaucccacuccccgacguaagaaacaacuucuaccacuacaaccaaucaaacgacucaaccauaaaacuaaucgcuaugcucuacacuccccuacgagcaaacaacgcaggagaagacguuuucaccguuagcugcagaguccuaacaagaccuagccccgauuuugacuucaucuuucucgugccacccaccgucgaaucccgcacaaaacccuucacaguacccauccuuacagucgaggaaaugaccaacucacgcuuccccaucccccucgaaaaacucuucaccggccccuccuccgcauucgucguccaaccucaaaacggcagaugcacgaccgacggcguacuacucggcaccacccagcucucacccgucaacaucugcaccuuccguggcgacgucacacacauagccggcagcagaaacuacaccaugaaccucgccucccucaacuggaacaacuacgauccaaccgaagaaauacccgcuccccucggcacacccgauuucgucggaaaaauccaaggcguccucacgcaaacaacaaagggcgacggcucaacccgcggccacaaagccaccgucuauacuggaucagcccccuucacacccaaacuuggcuccguccaauucucaacagacaccgaaaacgacuuugaaacacaucaaaacaccaaauucacacccguaggagucauccaagacggcagcacaacccaccgaaacgaaccgcaacaauggguccuccccucauacuccggccgcaacguccacaacguccaccucgccccagccgucgcacccacauuccccggagaacaacuacucuucuuccgcuccaccaugcccggcugcuccggcuaccccaacauggaccucgacugccuccuaccacaagaaugggugcaacacuucuaccaagaagccgcccccgcccaauccgacguagcauuacuccgcuucguaaaccccgacacaggcagaguacucuucgaaugcaaacuccacaaauccggauacgucaccgucgcacacaccggccaacacgaccucguaauacccccaaacggcuacuuccgauucgacuccuggguaaaccaauucuacacacuugcgccuaugggcaauggcacaggucgucgucgagcucuauaa

SEQ ID NO: 35766 - RNA, 1623 nt, Artificial Sequence
  derived and/or modified sequence opt11 from VP1__Norovirus__ADR78911
augaaaauggccuccaacgacgccaccccuucagacggcucaaccgcgaaccuuguccccgaagucaacaacgaaguaauggcacucgaaccagucguuggcgcugccauagcagcccccgucgccggccaacaaaacgucaucgacccauggauccgcaacaacuucguucaagcccccggcggggaguucacuguaagcccccguaacgcgccuggagaaauccuaugguccgcaccccucggccccgaucucaaccccuaccuaucccaccucgcccgaauguacaacggcuacgccggaggcuucgaaguccaagucauccucgccggaaaugccuucaccgccggcaaaaucaucuucgccgcugucccaccuaacuuccccaccgaaggccuuucccccucccaagucaccauguucccacacauaaucgucgacguccgucaacucgaacccguacuaauaccccuacccgacguacgcaacaauuucuaccacuacaaccaauccaacgaccccaccaucaaacuuaucgcaaugcucuacacuccccuccgcgccaacaacgcuggcgacgacgucuucaccgucucaugcagaguccucacacgcccaucccccgacuucgauuuuaucuuccuaguaccacccaccgucgagucacgaaccaaacccuucuccguacccauacuaaccguagaagaaaugacaaacucccgcuuccccaucccccuugaaaaacucuucaccggccccucauccgccuucgucguccaaccccaaaacggacgcugcaccacagacgggguacuccucggcaccacucaacuaagccccgugaacaucugcaccuuccgaggcgacgucacccacaucgccgguacccaaaacuacaccaugaaucuagcuagccaaaacuggaacaauuacgacccaaccgaagaaauccccgcaccccucggcacaccagacuucgucggcaaaauacaaggcguccuaacccaaacuacccgacgcgacggaagcacccgcggacacaaagccaccguaucaaccggauccguccacuucacccccaaacuaggcuccguccaacucucaaccgacaccuccaacgacuucgaaaccggacaaaacacaagauucacucccgugggcgucguccaagacggcuccaccacccaccaaaacgaaccccaacaauggguacuccccgacuacucuggccgcgacucacacaacguccaccucgcucccgccgucgcacccacauuucccggcgaacaacuccuguucuuccgaucgacuaugccagggugcuccggcuacccaaauaugaaccuagacugccugcucccccaagaauggguacaacauuucuaccaagaaucugcaccagcacaaucggacguagcacuccuccgcuucgucaacccagacaccggccguguccuauucgaaugcaaacuccacaaauccggauaugucaccgucgcucacaccggucaacaugaccucguaaucccuccaaacggauacuuucgauucgacuccugggucaaccaauucuacacccucgcaccaaugggcaacggcgcaggcagacgcagagcccucuga

SEQ ID NO: 35767 - RNA, 1623 nt, Artificial Sequence
  derived and/or modified sequence opt11 from VP1__Norovirus__ADR78914
augaaaauggcuuccaaugacgccacccccucugacggcuccaccgccaaccucgucccagaaguuaacaacgaaguuauggccuuagaacccgucguaggcgccgccaucgccgcuccaguagcuggccaacaaaacgucauugaccccuggauccgcaacaacuuuguacaagcccccggcggugaauuuacaguauccccaagaaacgccccaggcgaaauccucugguccgcaccacucggccccgaccucaaccccuaucucucccaccucgcccgcauguacaacggcuacgccggcggcuucgagguccaaguaauccuagccggcaaugccuuuaccgcgggcaaaaucaucuucgcagccgucccacccaacuuccccacagaaggccuaucccccucacaagucacaauguucccccacaucaucgucgauguccgacagcuagaacccguacuaauuccccuccccgauguacgcaacaauuucuaucacuacaaccaauccaacgacccgaccauaaagcugaucgcuaugcucuacacaccccugcgagcaaacaacgccggcgaugacgucuucaccguauccugccguguccucacccgacccucaccagacuucgacuuuauauuucucgucccuccgaccguagaaucccgaacuaagcccuucucaguccccauacuaaccguagaagaaaugaccaacucccgcuuccccauaccccuagaaaaacucuucaccggaccuuccuccgcuuucgucguacaaccccaaaacggaagaugcaccacagacggcguacuucuuggcaccacccaacuaucccccgucaacaucuguaccuuccgcggagacgucacccacaucgccggcacucagaauuacaccaugaaccucgccucccaaaacuggaacaacuacgacccuaccgaagaaauacccgcuccccucggcaccccagacuuugucggaaaaauucaaggaguacuaacgcagaccacacgccgggacggcuccacccgcggccacaaagccaccgucucaaccgguuccguccacuucacacccaaacuuggaucaguccaauucucaaccgacaccuccaacgacuucgaaacuggucaaaacacccgauucaccccagucggcguaguacaagacggguccaccacacaccaaaacgaaccccaacaauggguacuacccgacuacuccggccgagacucucacaauguccaccucgccccagccguagcccccaccuuccccggagaacaauuacucuucuuccgauccaccaugcccggaugcuccggauaccccaacaugaaucuagacugccuacucccccaagaauggguccaacacuucuaucaagaaucggcccccgcccaauccgacgucgcucucuuacgcuucguaaaccccgauaccggccgaguacuauucgaaugcaaacuccacaaauccggauacgucaccguagcccacaccggacaacacgaccuagucaucccacccaacggcuauuuucgcuucgacuccugggucaaccaauuuuauacacuugcgcccaugggcaacggugcuggacgccgacgcgcccucuaa

SEQ ID NO: 35768 - RNA, 1623 nt, Artificial Sequence
  derived and/or modified sequence opt11 from VP1__Norovirus__ADR78917
augaaaauggcaucuaacgacgccacacccuccgacggcuccacagccaaccucguccccgaggucaacaacgaaguaauggcccucgaaccaguugucggcgccgcaaucgcagcccccguagccggccaacaaaacguaaucgaccccuggauccgcaacaacuucguccaagcacccggcggcgaguucaccguaucaccccgcaacgccccaggcgaaauccucuggucagccccacucggccccgaccucaaccccuaccucucccaccucgcacgcauguacaacggcuacgccggcggcuucgaaguacaaguaauucucgccggcaacgcauucaccgccgguaaaauaaucuucgccgccgucccacccaauuuccccacagaaggacucucccccucccaagucaccauguucccccacaucauagucgacguccgccaacuugaaccuguacucauaccccuccccgacguccgcaacaacuucuaccacuacaaccaauccaacgaccccaccauaaaacucaucgccaugcucuacacccccuuacgagccaacaacgccggcgacgacguguucacagucucaugccgcguucuaacaagacccucacccgacuucgacuucauauuccuugucccaccaaccgucgaaagccgcaccaaacccuucucaguacccauccuaaccguugaagaaaugaccaacucacgauucccaauuccucucgaaaaacucuuuaccggaccauccuccgcuuucgucguccaaccacagaacggccguugcaccaccgacggcguccuccucggaaccacacaauuaucccccguuaacauaugcaccuuccgcggcgacguuacccacauugccggcacacaaaacuacaccaugaaccucgccucccaaaacuggaacaacuacgaccccaccgaggaaauccccgcgccccuaggcacacccgacuucguaggacgcauccaaggcguccuuacccaaaccacccgccgggacgguuccacccgcggccacaaagcaaccguauccaccggcuccguccacuucaccccaaaacucggcucaguccaauucuccaccgauaccucuaacgacuucgaaacaggucaaaacacacgcuucacccccgucggcgucguccaagacggcuccaccacccaccaaaacgaaccucaacaauggguccuacccgacuacuccggccgagauucccacaacguccaccuagcccccgccgucgcaccaacauuccccggcgaacaacuccucuucuuucgcuccaccaugccuggcugcuccggguauccaaacaugaaccucgacugccuccucccccaagaauggguccaacacuucuaucaagaaagcgccccagcacaaucagacgucgcccuccuccguuucgugaacccggacaccggccgcguacuuuucgaaugcaaacuccacaaauccggcuacgucaccgucgcccacacuggccaacacgaccucguaauacccccgaacggauacuuccgcuucgacuccuggguaaaccaauucuacacauuagccccaaugggcaacggugcagguagacgcagagcacuauaa

SEQ ID NO: 35769 - RNA, 1623 nt, Artificial Sequence
  derived and/or modified sequence opt11 from VP1__Norovirus__ADR78920
augaagauggcauccaacgacgccacccccucagacggcuccacagcaaaccucguucccgaaguaaacaacgaagucauggcacucgaaccggucgucggcgccgcuaucgccgcacccguagcuggccaacaaaacguaauagaccccuggauccgaaacaacuucguccaagccccagggggagaauuuaccgucucucccaggaacgcaccaggagaaauacucuggucagccccucuuggccccgaccuaaaccccuaccuaucccaccucgcacgcauguacaacggcuacgcaggcggcuucgaaguccaagucauuuuagccggcaacgcauucacagccggaaaaaucaucuucgcagccgucccacccaacuuccccaccgaaggccucagccccucccaagucacaauguucccacacaucaucgucgacguccgccaacucgaaccaguacuaauaccacucccagaugucagaaacaauuucuaucacuacaaccaauccaacgacccaaccauaaaacucaucgccaugcuauacacuccccuccgcgccaacaacgcaggcgacgacguauucaccgucagcugccgcguccucacccgcccguccccagacuucgauuucauauuccuaguuccuccaacagucgaaagccgcacgaaaccauuuuccguacccauccucaccgucgaagaaaugacaaacucccgcuuccccaucccccucgaaaaacucuucaccggccccuccucagcauucguaguacagccucagaacggccgcugcaccacagacgguguccuacucggaaccacccaauuaucccccgucaacaucugcaccuuucgaggagacgucacucacauagcuggcacucaaaacuacaccaugaaccuagccagccaaaacuggaacaacuacgauccaacugaagaaaucccagcuccccuaggaacccccgacuucgucggaaaaauccaagguguccucacccaaacaacccggcgcgacggauccacacgcggccacaaagccacaguuuccaccggcuccguccacuucacucccaaacuagguucaguacaauucuccaccgacacuucaaacgacuucgaaacaggccaaaacacccgauuuacccccguuggagucguccaagacggcgacacaacacaccaaaacgaaccacaacaauggguccuccccgacuacucaggacgcgacagccacaacguucaucuagcccccgccgucgcaccaaccuucccaggcgaacaacuccuauucuucagauccaccaugcccggcugcuccggcuacccaaacaugaaccuagacugucuacucccccaagaauggguacaacacuucuaccaagaauccgcaccagcccaauccgacguagcccuccuacgcuucguuaaucccgacaccggucgaguacucuucgaaugcaaacuccacaaauccggauacguuaccgucgcacacaccggccaacacgaccuaguaauaccacccaacggcuacuuccgcuucgacucauggguaaaccaauucuauacccucgcacccaugggaaacggcgcaggaagacgccgcgcccucuaa

SEQ ID NO: 35770 - RNA, 1623 nt, Artificial Sequence
  derived and/or modified sequence opt11 from VP1__Norovirus__ADR78923
augaaaauggccuccaacgacgcaacucccucggacggcuccaccgccaaccuuguacccgaagucaacaacgaagucauggcccucgaacccguagucggcgcagcaauugcugcccccgucgccggccaacaaaaugucauagaccccuggauccgaaacaacuucguccaagcccccggcggcgaguucacugucucaccccgcaacgcccccggagaaauacucugguccgcaccccuuggucccgaccuaaacccauaccucucccaccuugcccgaauguacaacggcuacgccggcggguucgaaguccaagucauccucgccggcaacgccuucaccgccgguaagauaaucuucgccgccguaccacccaacuuccccaccgaaggccuauccccuucccaagucacuauguucccccacaucaucguugacguccgccaacuugaaccgguacugaucccccuccccgacguccgaaauaacuucuaucacuauaaucaauccaaugauucuaccaucaaacuuauagccaugcuauacacaccacuacgcgcaaacaacgcgggcgacgacguauucaccguauccugccgaguccuaacccgcccaucacccgacuucgacuucauauuccucgucccacccacaguagaaucacgcacuaaacccuucucaguccccauucuaacaguagaggaaaugaccaacucccgcuuccccaucccccucgaaaaacucuucacaggaccaucaucggccuucgucguccagccacaaaacggacguuguaccaccgacggcguccuccucggaacaacccaacucuccccugucaacaucugcaccuuccgcggugacguaacccacaucgcuggcacacaaaauuacaccaugaaccucgccucccaaaacuggaacaacuacgacccaaccgaagaaauccccgcaccccucggcacacccgacuucgucggcaaaauccaaggcgugcuaacacaaaccaccagacgcgauggcuccacccgaggccacaaggccaccgucuccaccggcuccguccacuucacccccaaacucggauccguacaauucucuaccgacacauccaacgacuucgaaacgggccaaaacacacgcuuuacccccguuggagucguucaagacggcucuaccacccaccaaaacgaaccccaacaauggguacucccugacuacuccggacgcgauucacacaacguccaucuggcccccgccgucgcacccaccuuccccggagaacaauuacuauucuuccgcuccaccaugcccggcugcucuggguaccccaacaugaaccucgacugucuacucccucaagaauggguccaacauuucuaccaagaauccgcccccgcccaaagugacgucgcccuacuacgauucgucaaccccgauaccggccgaguccuauucgagugcaaacuacacaaauccggauauguaacggucgcccacaccggccaacacgaccucgucaucccacccaacggcuacuuccgauucgacucaugggucaaccaauucuacaccuuagcccccaugggcaacggcgccggccgcagacgcgcccucuaa

SEQ ID NO: 35771 - RNA, 1623 nt, Artificial Sequence
  derived and/or modified sequence opt11 from VP1__Norovirus__ADR78929
augaaaauggccucaaacgacgccucccccucagacggcucaaccgcaaaccuuguccccgaagucaacaacgaaguaauggcccucgagcccgucgucggcgcagcaaucgcagcccccgucgcuggccaacaaaacgucauagacccauggauaagaaacaacuucguacaagcccccggcggugaguucaccgucucaccccgaaacgcccccggcgaaauacucuggucagcuccccucggccccgaccucaacccguaccuaucacaccuugcccgcauguauaacggauacgccggcggcuucgaaguccaaguaauccucgccggaaacgcguuuaccgccggaaaaauaaucuucgccgccguaccucccaacuucccaacugaaggacuaucuccuucccaaguaaccauguucccacacauaaucgucgacguccgccaacuagaacccguccucaucccccuacccgacguucgaaauaacuucuaccacuacaaccaauccaaugacuccacaaucaaacuaaucgcaaugcucuacaccccacuacgagccaacaacgcaggcgacgacgucuuuaccgucucuugccgcguccuaacccgccccuccccagacuucgacuucaucuuccucgucccacccaccgucgaauccagaaccaaacccuucaccguccccauacucaccguagaagaaaugaccaauucccguuuccccaucccccuugaaaaacuauucaccggccccuccuccgccuucgucgugcaaccacagaacggucgaugcacaaccgacggcguccuccuaggcaccacccaacuuucccccguaaacaucuguaccuuucgcggugacgucacccacauauccggcacacgcaccuaccgaaugaaccuagccucucaaaacuggaauaacuacgacccaaccgaagaaauacccgcuccccuaggaacacccgacuuuguaggcaaaauccaaggcaugcucacacaaaccacaaaaggagacgguuccacacgcggccacaaagccaccguuuccaccggaagcgucgacuuuacaccaaaacucggcuccguacaauucgccaccgauacagacaaugacuucgaaaccggccaaaacacgcguuucacccccgucggugucauucaagacggcucaucagcccaucgcaacgaaccacaacaauggguccuacccgacuauucaggcagaaccguccacaacguccaccucgccccagccguugcacccacauuccccggagaacaacuacucuucuuccgguccacaaugcccggaugcuccggcuaccccaacauggaccuggacugccuccucccccaagaauggguucaacauuucuaccaagaagccgcucccucgcaaucagaugucgcccuacuccgguucgucaaccccgacaccggucgcguucucuuugaaugcaaacuccacaaagccggauacgucacagucgcucauaccggccaacacgaccucgucaucccacccaacggcuacuuccgcuucgacagcugggucaaccaauucuacacccucgcacccaugggcaauggagcaggccggcgcagagcccucuaa

SEQ ID NO: 35772 - RNA, 1623 nt, Artificial Sequence
  derived and/or modified sequence opt11 from VP1__Norovirus__ADR78932
augaaaauggccucaucagacgccuccccaucagacggcuccgcagcgaaccucguucccgaggucaacaacgaagucauggcccucgaaccagucgucggcgccgccaucgccgcacccgucgcaggccaacaaaauguaaucgaccccuggauacgcaacaacuucguacaagcaccaggcggcgaguucaccgucagcccccgcaacgcccccggcgaaauccuaugguccgccccacuaggucccgaccucaacccauaccucucucaccuugcccgcauguacaacggauacgcaggaggcuucgaaguacaaguaauacucgccggcaacgcuuucacagccggcaaaaucaucuucgcugccgucccacccaacuuccccacugaaggucucucccccucccaaguaaccauguucccccacaucaucgucgacguucgccaacucgaacccguccucauaccacuccccgacguacgaaacaacuucuaccacuacaaccaaucaaacgacucaaccaucaaacuaaucgcuaugcucuacaccccacuccgagcaaacaacgccggugacgauguguucacagugucuugucgcguccucacacgccccucacccgacuucgacuucaucuuccuagucccgcccacaguugaaucccgcacaaaacccuucacaguacccauacuuaccgucgaagaaaugacgaacucaagauuucccaucccccuugaaaaacuuuucaccggccccuccucagccuucguuguccaaccacaaaacggacgcugcaccacagacggaguucuccuaggaaccacucaacucucaccagucaacauaugcacuuuccgaggagacgucacacacauaucaggaucacgaaacuaccgcaugaaccucgcgucccaaaacuggaacaacuacgaccccacagaagaaauacccgccccucucggcaccccagacuucgucggcaaaauccaaggcaugcuaacacaaaccacaaaaggcgauggcagcacccgcggacacaaagccacugucucgaccggcagcguugacuucacucccaaacucggcucgguucaguuugccaccgacaccgacaacgacuucgaaacaggacaaaacaccagauucaccccuguuggcguaauacaagaugguucaucugcccaccgcaacgaaccccaacaauggguacuaccagacuacuccggaagaacuguacacaauguccauuuagcacccgccgucgcccccacauuccccggagaacaacuccucuucuuccgauccaccaugcccggcugcucgggcuaccccaacauggaccuagacugccuacuaccccaagaauggguccaacacuucuaccaagaagcagcgcccucccaaagcgacgucgcccuccucagauucgucaacccagacacaggcagaguccucuucgaaugcaaacuacauaaagccggcuacgucacugucgcccacaccggccaacacgaccucguaauaccacccaacggauauuuccgcuucgacuccuggguaaaccaauucuacacccucgcccccaugggcaacggugcaggccgacgccgagcccucuaa

SEQ ID NO: 35773 - RNA, 1623 nt, Artificial Sequence
  derived and/or modified sequence opt11 from VP1__Norovirus__ADR78938
augaaaauggccuccaacgacgccucgcccuccgacggaucuaccgccaaccuuguccccgaaguuaacaacgaagucauggcccucgaaccaguaguaggagccgcgaucgccgcccccgucgccggacaacaaaacgucaucgaucccuggauccgcaacaacuucguccaagcccccggcggcgaguucacuguaucaccccgaaacgcgcccggcgaaauauugugguccgccccgcuaggacccgaccuaaaccccuaccuaucccaccucgcccgaauguacaacggauacgcaggcgguuucgaaguccaaguaauccuagccgggaacgccuucaccgccggcaaaauaauauucgccgccguacccccuaacuucccuaccgaaggccucucaccaucccaagucaccauguucccccacauaaucgucgacguaagacaacuagaacccguccucauaccccuuccagacgucagaaauaauuuuuaucacuacaaccaauccaacgacucaaccaucaaauuaaucgccaugcucuacaccccacuucgagcaaauaacgccggagacgacguuuucacagucagcugccgcguacucacccgacccucccccgacuucgacuucauuuuccucgucccaccaaccgucgaaucccguaccaaaccuuucaccgugccaauacucaccgucgaggaaaugaccaacucccgcuuccccaucccacucgaaaaacucuuuacaggcccauccuccgccuucguuguccagccccaaaacggccgcugcaccaccgacggcguccuucugggcacgacacaacuaagcccugucaacaucugcaccuuccgcggagacgugacccauaucccaggaacacgaucauaccgcaugaaccuagccucacaaaacuggaacaauuacgacccaaccgaagaaauccccgcaccacucggaacccccgacuucgucggcaaaauccaaggaauguuaacccagaccaccaaacgcgacggcucaacacgaggccacaaagcaaccguuuccacuggcagugucgauuucaccccaaaacuaggauccguccaauucgccacagacaccgacaacgacuucgaaaccggccaaaacacccgguucaccccugucggcguaauccaagacgguucauccacccaccgcaacgaaccacaacaauggguccucccugacuacuccggucguaccguccacaauguacaccuagccccagccgucgccccaacuuuccccggugaacaacuacuauucuuucgcuccaccaugccaggcugcagcggcuaccccaacauggacuuagacugccuccuuccgcaagaauggguccaacauuucuaccaagaagccgcucccucccaaucagacguagcccuacugcgcuucguuaacccagacaccggacgcguucuguuugaaugcaaacuccacaaagcgggauacgucaccgucgcccacaccggccaacacgaccucgucaucccacccaacggcuauuuccgauucgauucauggguaaaccaauucuacacacuggcccccaugggcaacggcgccggccgacgacgagcccuauaa

SEQ ID NO: 35774 - RNA, 1623 nt, Artificial Sequence
  derived and/or modified sequence opt11 from VP1__Norovirus__ADR78941
augaaaauggcauccaaugaugccagccccuccgacggauccaccgcaaaccucguaccagaaguuaacaacgaaguaauggcccuggaaccaguugucggagccgccaucgcagcucccguagccggccaacaaaaugucauagaccccuggauccgcaacaauuucguacaggcaccagguggggaguucacagucuccccaaggaacgcccccggagaaauacuauggucugccccucucggccccgaccucaaccccuaccucucccaccucgcccgcauguacaacggauacgccggaggcuucgaaguacaagucauccuugcaggcaacgcuuucacagccggcaaaaucaucuucgcagccguacccccaaacuuucccaccgaaggacuaucacccucccaagucacaauguucccccacaucaucguagacguccgccaacucgaaccaguacucaucccacuaccggacguacgaaacaauuucuaccacuacaaccaaucaaacgacucuaccaucaagcuaaucgcuaugcucuacacaccccuacgagcaaauaacgccggcgacgacguauuuacaguuuccugucgaguccucacucgccccucccccgacuuugacuucauauuccuagugccacccaccguugaaucgcgcaccaaacccuucaccguccccauacucacagucgaagaaaugacuaacucccguuuccccaucccccucgagaaacucuuuaccggcccuucuucagccuucgucguccaaccucaaaacggacgcugcaccacagacgguguacuacuaggaaccacacaacucuccccugucaacaucugcacauuccgaggagacgucacccacaucccaggcacacgcaccuaccgcaugaaccucgccucccaaaacuggaacaacuacgaccccacugaagaaauacccgcuccccuagggacccccgacuucguuggcaaaauccaaggcaugcucacacaaacaacuaaaggcgacgguuccacacgcggacacaaagccaccguauccaccggauccgucgacuucaccccaaaacucggcuccgugcaauucgcaaccgacacagacaaugacuucgagacgggacaaaacacccgauucacgcccgucggcguaauacaagacggcuccucaacccaccgaaacgaaccccaacaauggguccucccagacuacucaggucgcaccguccacaacguccaccuagcccccgccgucgcacccaccuucccaggagagcaacuacucuucuuccgcuccaccaugccagguugcuccggauaccccaacauggaccucgacugccuccucccccaagaauggguccaacacuuuuaccaagaagccgcccccucccaauccgacgucgcacuccuccgcuuugucaaccccgacaccggccgaguccuauucgaaugcaaacuccacaaagcugguuacgucacugucgcccacaccggccaacacgaccuagucauacccccaaacggguacuucagauucgacagcugggucaaccaauucuacacacucgcacccaugggcaacggugcaggccgccgacgagcccuuuaa

SEQ ID NO: 35775 - RNA, 1623 nt, Artificial Sequence
  derived and/or modified sequence opt11 from VP1__Norovirus__ADR78944
augaaaauggcauccaacgacgccucccccuccgauggcucaacagccaaucuuguacccgaagucaacaacgaaguaauggcccuagaaccugucguaggcgcagcaaucgccgcuccggucgccggccaacagaacguuaucgaccccuggauaagaaacaacuucguucaagccccaggcggagaguucacagucucgccacgaaaugcacccggcgaaauccucugguccgcaccccucggacccgaccuaaaccccuacuuaucucaccuggcccgcauguacaacggcuacgcaggcggcuucgaaguccaggugauucuagcaggcaacgccuucacggccggaaaaaucaucuucgcugccguaccacccaacuuucccacagaaggccucucccccucccaagucacaauguucccccacauaaucguagacguccgccaacuagaacccguacucauaccccuaccagacguucgaaacaacuucuaccacuacaaccaaucaaaugacuccaccauaaaacuuauagccaugcucuauacaccacuucgagcgaacaacgccggagacgacguauucaccguauccugucguguacucacgcgaccaucccccgacuucgacuucaucuuccuaguacccccuaccguagaaagccgcaccaaacccuuuaccguccccauacuaaccgucgaagaaaugaccaacagccgauuccccaucccccuugaaaaacuuuucaccggcccaagcucagccuucgucguacaaccacaaaacggacgcugcaccacagauggcguacuccucggcacuacccaacuuucccccguuaacaucugcacauucagaggcgacgucacccacaucucuggcucacgcaccuaccguaugaaccuggcaucccaaaacuggaacaacuacgacccuacagaagaaauccccgccccacucggcacccccgacuucgucgguaagauacaaggcaugcugacccaaacgacaaaaggcgacggauccacccgcggccacaaagcaacaguaucaacaggcuccguagacuucacccccaaacuuggcuccguucaauucgcuaccgacaccgacaacgacuucgaaaccggucaaaacaccagauucacaccugucggcguaauccaagacggauccuccacccaccgcaacgaaccccaacaauggguccuccccgacuacucaggacgcacaguacacaauguccaccuagcccccgccgucgcacccaccuuccccggcgaacaacuacuauucuuccgaucaaccaugccgggaugcucuggcuacccaaacauggaccucgacugccuccucccccaagaauggguacaacacuucuaccaagaagccgcacccucccaaucggacguagcccuacuccgauucgucaaucccgacacaggaaggguccucuuugaaugcaagcuccacaaagcaggcuacgugaccgucgcccacaccggccaacaugaccucguaaucccacccaacggauacuuccgcuuugacucauggguuaaccaauucuacacccucgcccccaugggcaacggcgccggacgacgccgcgcacuauaa

SEQ ID NO: 35776 - RNA, 1623 nt, Artificial Sequence
  derived and/or modified sequence opt11 from VP1__Norovirus__ADR78947
augaaaauggcaagcaacgacgcaucccccuccgacggcuccaccgcaaaccucguccccgaaguuaacaacgaggucauggcccucgaaccgguaguaggcgccgcaauugccgcacccgucgccggccaacaaaacguuauagaccccuggauacgcaacaacuucguccaggcucccggaggagaguucaccguuucaccccgaaacgcuccaggcgaaauccuaugguccgcuccccuaggaccugaccucaacccauaccucucgcaucuugcccgcauguacaauggcuacgccggaggcuuugaaguccaagucauccuagccggaaacgcauucacugccggcaagaucaucuucgcagcaguaccacccaacuuccccacagaaggccuaucccccucccaagucaccauguucccccauaucauaguagacgucagacaauuagaacccguccucauuccccuaccagacgucagaaacaacuucuaccacuauaaccaaucaaacgacucaaccauaaaacuaauagcuaugcucuacacaccccuccgcgccaacaacgccggcgacgacgucuuuaccgucuccugccgaguccuaacccgacccuccccagacuuugacuucaucuuccuaguaccaccuaccguagaaucaaggacaaagcccuucaccguaccuauacuuaccgucgaagaaaugaccaacuccagauuccccaucccccucgaaaaacucuuuaccggcccaucuuccgccuucgucguacaaccgcagaacggacgaugcaccaccgauggcguccuacucgguaccacucaacucucccccgucaacaucugcaccuuccgaggcgacguaacccacauacccggcacacgcaccuaccgaaugaaccuagccucccaaaacuggaacaacuacgacccaacagaggaaaucccagcaccccugggcaccccagacuucgucggcaaaauucaaggcaugcucacccaaaccaccaaaggcgacggcucaacccgcggccacaaagccacugucucaaccggcucagucgacuucacaccaaaacucggcuccguccaauucgccacagacaccgacaacgacuucgaaaccggacaaaacacccgauuuaccccagucggagucauccaagacggcuccuccacacaccgcaacgagccacaacaauggguccuaccugacuacuccggcagaacaguccacaacguacaccuagccccugccgucgcccccaccuuccccggagaacagcuccuauucuucagauccaccaugcccggcugcuccggcuaccccaacauggaccuagacugucuacucccacaagaauggguacaacacuucuaccaagaagccgccccaucccaauccgacguagcucuccuucguuucguaaacccagacacaggcagagucuuauucgaauguaaacuccacaaagccggcuacgucaccgucgcccacaccggacaacacgaccucgucauucccccaaacggcuacuuccgauucgacucuugggucaaccaguucuacacccucgccccuaugggcaacggcgccggacgucggcgcgcacucuaa

SEQ ID NO: 35777 - RNA, 1623 nt, Artificial Sequence
  derived and/or modified sequence opt11 from VP1__Norovirus__ADR78950
augaaaauggccagcaacgacgcuucacccucagacggcucagccgcuaaccucguccccgaagucaacaacgaaguuauggcccuagagcccguaguaggcgccgccauagccgcccccguagccggccaacaaaacguaaucgaccccuggauccgcaacaacuuuguccaagccccaggcggcgaguucaccgucucuccccguaacgcgccaggcgaaauccucuggagcgcaccccucggaccagaccuaaacccauaccuaucccaccucgcccgcauguacaacggcuacgccggcggcuucgaaguccaaguacuccucgccggcaacgccuucacagccggcaagaucaucuucgccgcagucccacccaccuuccccacagaaggacucucucccucccaaguaaccauguucccccacauaaucguagauguacgacaacucgaaccaguccucaucccccucccagacgucagaaacaacuuuuaccacuacaaccaaagcaacgacuccaccauaaaacuuguggccaugcucuacacaccccuacgagccaacaacgccggcgacgacguauuuaccgucuccugccgcguccuaacccgcccguccccugacuucgacuucaucuuccucgucccacccaccguggaaagccguaccaagcccuuuacaguccccauacuaaccgucgaagaaaugacaaacucacgcuuccccaucccccucgaacgccuauuuacaggccccucauccgcuuucgucguccaaccccagaacggccgauguacaacagacggcguccuacucgguacuacacaacuaucccccguaaacaucuguaccuuccgaggcgacguaaccaacaucccuggaucucgcaccuaccguaugaaucucgcuucccaaaacuggaacaacuacgacccaaccgaagaaauaccagccccacucggcacccccgauuucguaggcaaaauacaaggaguacucacacaaacaaccaaaggcgauggcucaaccagaggccacaaagccacaguaagaacaggaucagcugacuucaccccgaaacuaggcucaguccaauucgcaacagacacagacaacgacuucgucacaggccaaaacaccagauucacccccgucggcguaauucacgacggcuccuccgcucaccgaaacgagccccaacaauggguccuccccgaauauuccggccgcagcguccacaacguccaccuggcacccgcaguagcccccaccuuccccggagaacaacucuuauucuuccgaucaaccaugcccgguugcuccggcuacccaaacauggaccuagacugccuccucccccaagaaugggugcaacacuucuaccaagaagccgcaccaucccaaucugacgucgcauuacuucgcuucguuaaccccgacacaggucgcguccucuucgaaugcaaacuccacaaagcaggcuacgucaccgucgcccacacuggacaacacgaccuagucauacccccaaacggauacuuccgauucgacucuuggguaaaccaauucuacacccucgccccaaugggcaacggcgcaggccgccggcgagcucucuaa

SEQ ID NO: 35778 - RNA, 1623 nt, Artificial Sequence
  derived and/or modified sequence opt11 from VP1__Norovirus__ADR78956
augaaaauggcaucuaacgacgccuccccaucagacggcuccaccgcgaaccuaguccccgaggucaacaacgaagucauggcccuagaaccuguugucggagccgcaaucgccgcccccguagcuggacaacaaaacguaaucgaccccuggauucgaaacaacuucguacaagcuccagguggugaguucaccguaucaccccgaaacgccccaggcgaaauccucugguccgcaccacucggaccagacuuaaaucccuaccucucccaucuagcacguauguacaacggcuaugccggcggcuucgaaguccaaguaauacucgccggcaaugccuucaccgcaggcaaaaucaucuucgccgcuguucccccaaacuuccccacagaaggccucuccccaucccaagucacaauguucccccacaucaucgucgacguccgucagcucgaacccguccuaauaccccuaccagacguccgcaacaacuucuaucauuacaaccaauccaacgacuccacaaucaagcuaaucgcaaugcucuacacaccacuacgagcaaacaacgccggagaugacgucuucacugucuccugccgcguacuuacccgccccucucccgauuucgacuucaucuuucuugucccgccgaccgucgaaucucgcaccaagcccuucacagucccaauccucaccgucgaagaaaugacuaacucccgcuucccaauaccccuggaaaaacucuucacaggacccucauccgccuucguaguccaaccacaaaauggccgcugcacaacggacgguguacuacuaggaaccacccaacugucaccaguaaacaucugcaccuucagaggcgacguaacccacauccccggaacccgcaccuaccgcaugaaccucgccagccaaaacuggaacaacuacgacccaacugaagaaaucccagcaccccucggaacucccgacuucgucggcaaaauacaaggcaugcucacccagaccaccaaaggcgacggcagcacacgcggacacaaagccaccgucucaacaggcuccgucgacuucacccccaaacuuggcuccguccaauucgccaccgacaccgacaacgacuucgaaacaggccaaaacacacgauucacccccgucggcgucauccaggacggauccuccgcacaccgcaacgaaccacaacaauggguucuccccgacuacagcggacgaacaguccacaauguccaccucgcccccgcuguagcacccaccuuccccggagaacaacuccucuucuuccgcuccacuaugccuggcugcuccggguacccaaacauggaccuagacugccuccucccccaagaauggguccaacacuucuaccaagaagccgcucccgcacaauccgacguagcccuucuccgcuucguaaaccccgacacaggccgaguccucuucgaaugcaaacuccacaaaaccggcuacguaaccguagcccacaccggucaacacgaccuagucaucccacccaacggcuacuuccgcuucgacagcugggucaaccaauucuacacccuagcccccaugggaaacggcgccggccgccgccgugcccuguaa

SEQ ID NO: 35779 - RNA, 1653 nt, Artificial Sequence
  derived and/or modified sequence opt11 from VP1__Norovirus__AEA02124
augaugauggccuccaaagacgccaccuccaacauggauggcaccuccggcgccggccaacucguccccgaaaacaauaacaccuccgaacccauaaacauggaaccaguugcaggcgccgucaccgcugcggccacagcaggccaagucaacaugaucgaccccuggaucaugaacaacuacguucaagcaccccaaggcgaauuuaccaucucacccaacaacacccccggcgacauacuauucgaccuccaacuaggcccccaucugaaccccuuccucgcccaccucucccaaauguacaauggcugggucggcaacaugaaaguccgcguaguccuggccggcaacgccuucagcgccggaaaaauuaucguuugcugcauaccucccggcuucucagcccccaacauauccauugcccaagccacuauguucccccacgucauagcagacguaagaguccucgaaccaaucgacaucccacucgacgauguucguaacguccuauuccacaccaacgacaacggcaaccaaaccaugcgucuacuuugcaugcuguacaccccgcuacgcagcggcggcaccucauccggaaccgacccauucgucaucgcaggccgaguccuaacuugcccaacacccgacuucaacuuccuauuccucguacccccaaccguugaacagaaaaccaaacaauucuccguacccaaccucccccucaacguaauguccaacagccgaguucccucccuccucaacgccaugguuguaucccccgaccaagcccaaguuguacaauuccaaaacggccgaugcacccuagacggccaaaugcucggcaccacaaccgucuccgcgucaugcgucgcccgcuuccgaggcaaaaccuuccaagcccccgacaaucgacuuggaauaaaucucgccgaaaucucaggggaacccuaccacgccuucgaaucuccagccccacucggcuuccccgacuucggcgauggcgacuggcacgucaccgcuaccaaaguaacccccucccaauuagaagccaacgaccccgucguaguuggaaacguccaaccuuacaacccccaauucgccccgcaccuuggcacgcucgucgucgaaaacccaacacccgaccagguagccaccgguaccgaccuccucuucaacaucacauggcucucaaaccgcgccaacaaccgauucaacccauggguuauccccaacuacggcuccacccuaacagaagccgcccagcucgccccauccaucuucccacccggauucggagaaaccaucguuuacuucaacucgaccuuccccgcaguuggcgccaccacucacgcagccaucccaugccuauuaccccaagaguucguagcccacuucgucaacgaacaagcacccauccgaggagaagcagcccuacuacacuacauugacccugacacccaccgcaaccugggcgaguucaaaaucuaccccgaaggcuucguuaccugcguccccaacguuggcggaacuggcccccaaucucuaccaaccaacggcgucuucgucuucgucuccugggucucccgauauuaccaacucaaaccagucggcacugccggccaagcacgccgacucggauuccgacgcgucuga

SEQ ID NO: 35780 - RNA, 1647 nt, Artificial Sequence
  derived and/or modified sequence opt11 from VP1__Norovirus__AED02033
augaaaauggccuccaacgacgccgcccccuccaacgacggcgcagccggucuaguccccgaaaucaacaaugaagccauggcacucgaacccguagccggagccgccaucgcugcuccccucacaggccaacaaaacaucauagacccauggaucaugaacaacuucguacaagcccccggaggagaguucaccgucagcccccgcaacucccccggagaaguccuacucaaucuagaacuuggccccgaaauuaacccauaccucgcccaccucgcacgcauguauaacggcuacgccggaggauucgaaguccaagucguacucgcaggcaacgcuuucacagccggcaaagucauauucgccgccauuccacccaacuuccccaucgacaaccuauccgccgcacagauaaccaugugcccgcacgucaucguugacguacgacagcuagaacccaucaaucuccccaugcccgacguacgaaacaauuucuuccacuacaaccagggauccgacucacgacuacgccucauagcaaugcucuacaccccacuucgcgccaacaacucaggagacgacgucuucacaguaagcugucguguccucacccgucccucacccgacuucagcuucaacuuccuugucccacccacugucgaauccaaaaccaaacccuucacccuccccauccugaccaucucagaaauguccaacucacgauuccccguacccaucgacucacuucacaccucccccacagaaaacaucguaguacaaugccaaaacggacgagucacccuugacggcgaacucaugggcaccacccaacuccuccccagccaaauaugcgccuuccgcggcacccucauccgauccaccucucgcgccucagaccaagccgacacuucaacaccccgccucuucaauuacuauuggcauauccaacuugacaacuuaaacggcaccccuuacgauccagccgaagacauaccagcaccccuagguaccccagacuuccgcggaaaagucuuuggcgucgccucacaaagaaaccccgacucaaccacccgcgcccacgaagcaaaaguagacacaaccuccggccgcuucacucccaaacuagguucacuagaaaucaucaccgaauccgacgacuucgaccucaaucaauccacuaaauucacccccgucggcauaggcguagauaacgaagcagaguuccaacaauggucccucccaaacuacucaggccaauucacccauaacaugaaccuugcccccgccguagccccaaacuuuccaggcgaacaacuccucuucuuccgcucucaacuaccauccucaggcggccgcaguaacggcguccuagacugcuuagucccccaagaauggguccaacacuucuaccaggaaucagccccggcccaaacccaaguagcccucguaagauacguaaacccugacaccggccgcguacucuucgaagcaaaacuccacaaacuaggcuucaugacaauagcaaagaacggcgacuccccaaucaccguaccgccgaacggcuacuuccgcuucgaaucaugggucaaccccuucuacacccuggcccccaugggcaccggaaauggacgccgccgcauccaauaa

SEQ ID NO: 35781 - RNA, 1647 nt, Artificial Sequence
  derived and/or modified sequence opt11 from VP1__Norovirus__AED02034
augaaaauggccagcaacgacgccgccccgucaaacgacggcgccgccggccucguccccgaaauaaauaacgaagccauggcucuagaaccaguugcaggcgcagccaucgcagcaccccuaacuggccaacaaaacaucaucgaccccuggaucaugaacaauuucguacaagccccaggaggcgaguucaccguuucaccacgcaacucccccggcgaaguccuacucaacuuagaacucggccccgaaaucaaccccuaccucgcccaccucgcucgcauguacaauggcuacgcuggcggcuucgaaguccaaguaguccuagccggcaacgccuucaccgccggaaaaguaauauucgccgccauacccccgaacuuccccaucgacaaccucucagccgcccaaaucaccaugugcccacacguaaucgucgacguacgccaacuagaacccaucaaccucccaaugcccgacguacgaaacaacuucuuccacuacaaccaaggaucggacagccgacuacgccuaaucgccaugcuauacacccccuuacgagccaauaacuccggcgacgacgucuucaccguuucaugccgaguacucacccgcccaucgccagacuuuucauucaacuuucuagucccacccaccgucgaaucaaaaacaaaacccuucacccuccccauccucaccaucucagaaauguccaacucccgguuccccguccccaucgauucacuucacacaucucucacagaaaacauagucguacaaugccaaaacggacgcgucaccuuagauggcgaacucaugggaaccacccagcuccuuccaucccaaaucugugccuuccgcggcacccucaccagaucaaccucccgcgcuuccgaucaagcagacacagcaacaccccgccuuuucaacuacuacuggcacauacaacuaaacaaccucaacggaacccccuacgacccagccgaagacauccccgcaccccucggcacccccgacuuccgaggcaaagucuucggcguugccucccaacgcaaccccgacucgaccacccgagcccacgaagcaaaaguagauacaaccuccggcagauucgcacccaaacucggcucacucgaaaucuccaccgaaaccgacgauuuuaaccaaaaccaacccacccgcuucaccccagucgggauugguguagacaacgaagcagacuuccaacaauggucacucccagauuacucaggccaauuuacccauaacaugaacuuagcacccgccgucgcccccaacuuccccggcgaacaacuacucuucuuccgaucacagcuacccucuucagggggccgcuccuccggcauccucgacugccucgucccccaagaauggguucaacacuucuaccaagaauccgcacccgcccaaacacaagucgcccuaguuagauacgucaacccagacaccggcagaguccuauucgaagccaaacuccacaagcucggauucaugaccauugccaaaaacggcgacucccccaucacaguaccacccaacggcuacuuccgcuucgaauccugggucaaucccuucuacacccuagcccccauggguaccggaaacggccgacgcagaauacaauaa

SEQ ID NO: 35782 - RNA, 1647 nt, Artificial Sequence
  derived and/or modified sequence opt11 from VP1__Norovirus__AED02035
augaagauggccucaaacgacgcagcacccucaaacgauggagcagccggacucguccccgaaauaaacaacgaagccauggcccucgagccagucgccggagccgccaucgccgcuccccuuaccggccaacagaacauaaucgacccauggauaaugaacaacuucguacaagcucccggaggcgaguucaccgucuccccgagaaacucccccggcgaaguccuacucaaccuggaacuaggacccgaaaucaacccauaccucgcacaccucgcacgaauguacaacgguuacgcaggaggauucgaaguccaagugguucuugccggcaacgccuucaccgccggcaaagucauauucgccgcuaucccaccaaacuucccaaucgacaaccucucagccgcccaaauaaccaugugcccccacguaaucgucgauguacgccagcucgaaccaauaaaccuaccaaugcccgaugucaggaacaacuucuuccacuacaaccaaggcuccgacucccgacuccgccuaaucgcaaugcuauacaccccacuccgcgccaacaacucgggagacgacgucuucaccgucuccugccgcguccucacacgacccucacccgacuucucuuucaacuuccucgucccacccaccgucgaauccaaaaccaaacccuucacccucccaauccuuacaaucuccgaaaugucaaauucucguuucccagugccaaucgacagccuccacaccaguccaacagaaaacaucguaguccagugccaaaacggucgagucacccuggacggagaacuaauggguaccacccaacuccugccuagccaaaucugcgccuuccgcggcacacugaccagauccacuucacgcacaggcgaccaagccgauaccgcaucuccccgccuauucaacuacuacuggcacauacaacucgacaaccuaaacggaacacccuacgauccagcagaagauauccccgccccucucggcacacccgacuucagaggaaaagucuucggagucgccagccaacgcaacccagacucaaccacacgcgcucacgaagccaaaguggacacaacaucaggccgcuucgcccccaaacucggaucacuagaaaucucuaccgaauccgacgacuuugacucaaaccaaccuacaagauucacaccggucggaaucggcguagaccgcgaaaccgacuuccaacaauggacccucccagaauauucaggacaauucacccacaacaugaaccucgcacccgcagucgccccuaacuucccaggagaacaacuccucuucuuccgcucacaacuccccucauccggcggccgaucaggagguauccuagacugccuaguaccccaagaauggguacaacacuuuuaccaagaaucugcacccgcccaaacccaagucgcccucgucagguacguaaacccagacaccggacgcguccucuucgaagccaagcuccacaagcucggcuucaugacaaucgccaaaaacggcgacuccccaauaaccgugccacccaacggauauuuccgcuucgaaagcugggucaaccccuucuauacacuagcacccaugggaaccggcaacggucgucgccgaauccaauaa

SEQ ID NO: 35783 - RNA, 1647 nt, Artificial Sequence
  derived and/or modified sequence opt11 from VP1__Norovirus__AED02037
augaaaauggcauccaacgaugccgcccccuccaacgacggcgcugccggccuaguccccgaaaucaacaacgaagccauggcccucgaccccguggcaggagcagcaauagccgcaccccuaaccggccaacagaauaucaucgaccccuggaucaugaacaacuucguccaagcccccggaggugaauuuaccgucucaccccgaaacucccccggcgaagugcuccucaaccucgaacucggucccgagauaaaccccuaccucgcacaccucgcucgaauguacaacggcuacgccggcggcuucgaaguccaagucguccucgcuggaaacgcguucacagccggaaagguaaucuucgccgccauaccucccaauuuccccauagacaaccucuccgccgcccagaucacaaugugcccacacguaaucguagacguccgucaacucgagcccaucaaccuaccaaugcccgacgucagaaacaacuucuuccauuacaaccaaggauccgacucccgccuaagacucaucgcaaugcuuuacacaccccuacgcgcaaacaacuccggcgacgacgucuucaccgucuccugccgcguccuaacacgccccucacccgacuucucauucaacuuccuagucccaccaaccgucgaauccaaaaccaaacccuucacccuuccuauauuaacaauauccgaaauguccaacucccgcuuccccgucccaauagacucacuucacacuucccccaccgaaucaaucguaguucaaugccaaaacggacgagucacccuagacggagaacuaaugggcaccacccaacuccuccccaaucaaaucugcgccuuucgaggcacccucacccgcuccaccaaccgagccucagaccaagccgacacagccacaccccgacucuucaaccaccacuggcacauucaacucgauaaccuuaacggcacccccuacgacccugccgaagacauaccagcaccucucggcaccccagacuuccgcggcaagguauucggaguagccagccaacgcaacccagacucaacaaccagagcccacgaagccaaaguagauaccaccuccgguagauuuacccccaaacuaggcucacucgaaaucacgaccgaauccgacgacuuugaccccaaccaauccaccaaauucacccccgucggcaucggcguugacaacgaagcagacuuccaacaauggucacuuccugacuacucaggccaauucacccacaauaugaaccuagccccagcagucgcccccaauuuucccggcgaacaacuucuauucuucagaucacaacuccccuccucaggcggccgguccaacggcauacuagacugccuaguuccccaagaaugggugcaacacuucuaccaagaguccgcccccgcacaaacccaagucgcccuaguacgcuacguaaaucccgacaccggcagaguccuuuucgaagccaagcuccacaaacucggcuuuaugacaaucgccaagaacggcgacucuccaaucaccgucccacccaacggcuacuuccgcuuugaaucuugggucaacccauucuacacacucgccccaaugggaaccggcaacgggagacgccgaauacaauag

SEQ ID NO: 35784 - RNA, 1647 nt, Artificial Sequence
  derived and/or modified sequence opt11 from VP1__Norovirus__AED02038
augaagauggcuucaaacgacgccgcccccucaaacgacggagcagccggacucguccccgaaauaaacaacgaagccauggcacucgaacccguagccggcgccgccaucgcugcaccccuaaccggccaacaaaauauaaucgaucccuggaucaugaauaauuucguacaagcacccggcggcgaauuuacugucucccccagaaauucccccggcgaaguacuucuaaaccucgaacuaggccccgaaaucaaccccuaccucgcccaccucgccagaauguacaacggauacgccggcggguucgaaguccaagugguucuggcaggcaacgccuucacagcuggcaaaguuauauucgcggccaucccaccuaacuucccaaucgacaaccugucagccgcccaaauaaccaugugcccccacguuaucguugacgucagacaauuagaacccauuaacuuacccaugcccgacguccgcaacaacuucuuccacuacaaccaagguucagacucacgucuccgacucaucgccaugcuauacaccccacuccgagcaaacaauuccggagacgacguauuuaccgucuccugccguguucucacaagacccucacccgacuucucauucaacuuccuuguaccacccaccgucgaaagcaaaaccaaacccuucacccucccaauccugaccaucagcgaaauguccaacucucgauuccccguaccaauagacucccuccacacuucucccaccgaaaacaucguaguccaaugccaaaacggacgcguaacacucgacggcgaacuaauggguaccacacaacuccuccccucacaaauaugcgcauuccgcggcacacuuacaagauccaccagccgcgcaggcgaccaagcagacaccgccaccccacgccucuuuaacuacuacuggcauauacaacucgacaaccuaaacggaacacccuacgaucccgccgaagacauacccgcuccccuaggcacccccgacuuucgcggaaaaguguucggcgucgccucccaacgaaaccccgacucaacuacacgagcccacgaagccaaagucgacaccaccuccggucgcuucgcacccaaacucggcucccucgaaaucucaaccgaauccuccgacuucgacucaaaccaacccacccguuucaccccaguaggcaucggagucgacaacgaagccgacuuccaacaauggucccuacccgacuauucuggacaauucacucacaacaugaaccuagcaccagccgucgcaccuaacuuccccggcgaacagcuccuauucuucagaucccaacuccccagcagcgggggccgauccaacggcauccuugacugccucgucccacaagaauggguccaacacuucuaucaagaauccgcccccgcccaaacccaagucgcccucguaagauacguaaacccggacaccggccgaguccuauucgaagcaaaacuccacaaacucggauucaugaccaucgccaaaaacggcgacagccccauaaccguaccacccaacggcuacuuccgcuuugaaucuuggguaaaccccuucuacacccuugcacccaugggcaccggcaacggccgccgaagaauccaauaa

SEQ ID NO: 35785 - RNA, 1647 nt, Artificial Sequence
  derived and/or modified sequence opt11 from VP1__Norovirus__AED02039
augaaaauggccucgaacgacgccgcacccuccaacgacggcgcggcuggccucguccccgaaaucaacaaugaagcaauggcccucgaacccgucgcuggcgccgccaucgcugcaccccuuaccggacaacaaaacaucaucgacccauggaucaugaacaacuucguacaagcaccaggcggcgaguucacagucagcccccgaaacucccccggcgaaguccuacuaaaccuugaacugggcccugaaaucaauccauaccucgcccaccuagcacgcauguacaaugguuaugccggcggauucgaaguccaggucgucuuagccggcaacgcauucacugccggcaaagucaucuucgcagccaucccacccaacuuccccauugacaaccucuccgccgcccaaauaaccaugugcccccacguuauagucgauguccgacaacucgaacccaucaaccuccccaugccagacguccgcaauaacuucuuccacuacaaccaaggaucagauucccgucuccgccuaaucgcaaugcucuauacuccccuccgcgcaaacaacuccggagacgacgucuucaccguauccugccgcguccuaacacgacccuccccagacuucuccuucaacuuccucguacccccaacggucgaaucaaaaaccaagccauucacccucccaauacucacaaucucggaaauguccaacucccguuuccccguccccaucgacucacuccacacaucaccuaccgaaaacaucgucguacaaugucaaaacggcagagucacccucgacggcgagcucaugggaacgacacaacuccuccccucccaaaucugcgccuuccgcgguacacuaacccgauccacaucucgcgcaggcgaccaagcagacaccgccacuccccgacucuucaacuacuacuggcacauacaauuagacaaccuuaauggcaccccauacgacccagcagaagacaucccugcaccccucggaaccccagauuuccguggcaaagucuucggcguagccucucaacgcaaccccgacucuaccaccagagcacacgaggccaaaguagacaccacuagcggccgcuucgccccaaaauuaggcucacuugaaauuuccaccgaaagcagcgacuucgacuccaaccaacccacccgcuucaccccaguaggcaucggaguagacaacgaggcagauuuccaacaauggucccuaccagacuacucaggccaauucacucacaacaugaaccuggcacccgccgucgcaccaaacuuccccggagaacaacuccucuucuuucgcagccaacucccaucaucaggaggccgcucccacggcauacucgacugccucgucccacaagaauggguacaacacuucuaccaagaguccgcccccgcacagacccaagucgcccucguccgcuacgucaaccccgacaccggucgcguccucuucgaagccaaacuccacaaacuaggauuuaugaccaucgccaaaaacggagacuccccaaucacagugccucccaacggauacuuccguuucgaauccugggucaaccccuucuacacacucgcacccaugggcaccggcaacaaaagacgacgcauacaauag

SEQ ID NO: 35786 - RNA, 1623 nt, Artificial Sequence
  derived and/or modified sequence opt11 from VP1__Norovirus__AEG79290
augaaaauggcauccaacgacgcaaaccccuccgacggcuccgcagccaaccucgucccagaagucaacaacgaaguaauggcacucgaacccguagcaggcgccgccuuagccgcaccagucgccggccagcaaaaugucaucgacccauggauccguaacaacuucguccaagccccaggcggcgaguucaccguaucgccacguaacgcccccggcgaaaucuuauggucagccccacuauccccagaccuaaaucccuaccuaucucaccucgcgcgcauguacaacucauaugcgggugguuucgaaguccaagucauccuagccggcaacgcuuucaccgccggcaaaaucaucuucgccgccguacccccaaacuucccaaucgaaggccucuccccaucacaaguaaccauguucccccacauaaucgucgacguccgccaacuagaacccguacucaucccccuaccagacguccgaaacaacuucuaucacuacaaccaauccaacgaacccaccauaaaauuaauagccaugcuauacacaccccugcgagccaacaacgccggcgaagacgucuuuaccgucuccugccgcguacugacacgccccuccccagacuucgacuucaucuuccuaguacccccuaccgucgaaucgagaaccaaacccuucaccgucccgaucuuaaccguagaagaaaugacaaacucacgcuucccgaucccccucgaaaaacuauucacaggcccuucauccuccuucgucguucaaccacaaaacggccgcugcaccaccgacggcguccuacucggcaccacacaacuaucacccguaaacauaugcacuuuccgcggagacgucacacacaucgcaggcucccgcaacuacacaaugaaccuagccuccauaaacuggaauaacuaugaccccacagaagaaaucccugccccacuugggaccccagacuucgucggaaaaauccaagguaugcucacccaaaccacccguggggacggcuccacgcgcggccaccgcgcaaccguauacacaggcuccgccccauucaccccaaaacuagguuccguccaguucaccacugacaccgacaacgacuucgaaaccaaccaaaauaccaaauucacccccguaggaguuguccaagacggagacaccgcccaccgcaacgaaccccaacaauggguccuacccuccuauuccggacgcaacguccagaacguucaccucgcccccgccgucgcuccaacauucccaggcgaacaacuccuuuucuuccgaucgaccaugccaggcugcucaggcuaccccaacauggaccuagacugccuacuaccacaagaauggguccaacacuucuaccaggaagccgcgcccgcccaaucagacgucgcccuccuacgcuucgugaacccugacacaggccgcguacuuuucgaaugcaaacuccauaaauccggauacguuaccguagcccacacuggacaacacgaccuuguaauacccccaaacggcuacuuccgauucgacagcugggucaaccaauucuauacacucgcaccaauggguaauggaacuggacgccgccgcgcucucuag

SEQ ID NO: 35787 - RNA, 1608 nt, Artificial Sequence
  derived and/or modified sequence opt11 from VP1__Norovirus__AEI29586
augaaaauggccuccaacgacgccgccccaucaaacgacggcgcugccggccucguccccgaagucaacaacgaaacaauggcccuagaaccuguagccggagccuccaucgcugccccacucaccggccaaaauaacguaaucgacccauggauacgauuaaacuucguccaagcccccaauggcgaauuuacugucucuccccgcaacuccccaggcgaaguccuccuuaaccucgaacucggccccgaacuaaacccauaccuagcccacuuaucccgaauguauaacgguuacgcuggaggcgucgaaguccagguccuacucgcuggcaacgccuucaccgccggaaaacuugucuucgccgcagucccaccccauuucccccucgaaaacaucucccccggacaaaucaccauguucccccacgucaucaucgacguccgaacacucgaacccguccuccucccccuacccgauguccgcaacaacuucuuccauuacaaccaacaaaacgaaccucgcaugcgucucgucgcaaugcucuacacaccccuccgcuccaacggcuccggcgacgaugucuuuaccgucuccugucggguacuuacccgacccucucccgacuucgauuucaacuaccuagucccacccaccgucgaauccaagaccaaacccuucacccuaccaauccucacaaucggcgaacuuaccaacucgcgauuccccguccccauugacgaauuauauacaucacccaacgaaucccuagucguacaaccccaaaacggccgcugcgcccucgauggcgaacuacaaggaaccacacaacuccuccccaccgccauaugcagcuuccgugggcgcaucaaccaaaaggucuccggagaaaaccacgucuggaauaugcaagucacaaacauagacgggacccccuucgaccccaccgaagacguccccgcuccucuugguacccccgauuucuccggaaaguuauucggcguucucagccaacgcgaccacgacaacgcaugccgcagccacgaugcuguuaucgccacgaacucagccaaauucacaccaaaacucggcgcaauccaaaucggaaccugggaacaagacgacguccacauuaaccaaccaaccaaauucacccccguaggacucuucgaaucagaaggauucaaccaauggacccucccuaauuacucuggcgcauuaacacucaacaugggacucgcacccccggucgcccccaccuuccccggagaacaaauccucuucuuccgcucccacaucccccucaagggcggcgucgcugacccggucaucgacugccuacuaccccaagaauggauacaacaccucuaccaggaauccgcucccagccaaaccgacguagcccuaauacgauucaccaaccccgacaccggacguguacucuucgaagcaaaacuccaccggucagguuacaucaccguagccaacaccggcagucggccaaucgucguacccgccaacggauacuuccgcuucgacuccugggucaaccaauucuacucacuagcuccaaugggcaccggcaacggccgccgccgaguccaauaa

SEQ ID NO: 35788 - RNA, 1623 nt, Artificial Sequence
  derived and/or modified sequence opt11 from VP1__Norovirus__AEJ82646
augaaaauggcauccaacgacgccacucccagcgacggcuccacagcaaaccucguccccgaaguaaacaacgaagucauggcucuagaacccgucgucggcgccgccauagccgccccagucgccggccagcaaaacguaaucgaccccuggauacgcaacaacuucguucaagcgccaggaggcgaguucacggucucgccccgcaacgccccaggcgaaauacucuggucagccccucucgguccugaccucaaccccuaccucucacaccucgcccguauguacaacggcuacgcuggcggcuucgaaguccaagucauccucgcaggaaacgucuucaccgccggcaaaaucaucuucgcagcagucccacccaacuucccuaccgaaggucucucaccgucacaagucaccauguucccccacauaaucguagacgucagacagcuagaaccaguccucauacccuuacccgacguccgaaacaacuucuaucacuauaaccaaucaaaugacccaaccauaaaacucauagccaugcuauacacuccacucagagccaacaacgccggagacgacgucuucacaguuagcugccgggucuuaacccgacccucccccgacuucgacuuuaucuuccucgccccucccacagucgaaucccgcacaaaacccuucuccgucccaauccuuaccgucgaagaaaugacuaacucucgcuuccccauacccuuagaaaaacucuuuaccggacccuccagcgccuucguuguccagccacaaaacggacgaugcaccacugacggcguccuccucggcaccacccaacucucaccuguaaacauauguaccuuccguggcgacgucacccacaucgcaggcacccaaaacuacacaaugaaccucgccucccaaaacuggaacaauuacgaccccaccgaagaaauuccagcaccccucggaacccccgacuucguaggcaaaauucaaggaguccuaacacaaacaacccgucgagacggcuccacccgcggacacaaggccaccguaucaaccggcagcguccacuucacccccaaacucggcuccauccaauucuccacagacaccucaaaugacuuugaaaccggccaaaacacccgcuucacucccguaggcgucgugcaagacggcagcacaacccaccaaaacgagccccaacaauggguucuccccgacuacucaggacgcgacagccacaacguccaucucgcacccgccguggcccccaccuucccaggcgaacagcuccucuucuuccgauccaccaugcccggcugcuccggcuaccccaacaugaaccucgacugcuuacucccccaagaguggguccaacacuucuaccaagaaagcgcacccgcacaauccgacguugcccuccucagauucgucaaccccgacaccggccgcguccucuucgaaugcaaacuucacaaaucaggcuacgucaccgucgcccacacaggucaacacgaccucgugauaccacccaacggcuacuuccgauucgauuccugggucaaccaauucuacacacuugcccccaugggcaacggcgcuggcagacgccgcgcccuauga

SEQ ID NO: 35789 - RNA, 1623 nt, Artificial Sequence
  derived and/or modified sequence opt11 from VP1__Norovirus__AER11308
augaaaauggccucuaacgacgccaccccguccgacggauccaccgccaaccucguuccggaagucaacaacgaagucauggcucuagaaccagucgucggagcagccauugccgcccccgucgccggccaacaaaacgucaucgaucccuggauacgcaacaacuucguccaagcccccggcggcgaguucaccgucucuccccgcaaugcccccggugaaauccucugguccgccccguuaggccccgaccuaaacccuuaucucagccaccucgcccgcauguacaacggcuacgccggcggcuucgaaguccaaguaauccucgcaggcaacgccuucaccgccggcaaaaucauauucgccgccguaccacccaacuuccccacagaaggccucucacccucccaagucacuauguucccccacaucaucgucgacguacgccaacucgagccaguccuaauaccccuucccgauguccgaaacaacuucuaccacuacaaccaaucaaacgaccccacuaucaaacucauagccaugcucuacacaccucuccgugccaacaacgccggcgacgacgucuucaccguauccugccgcguacuuaccagacccucccccgacuucgauuucaucuuucucguuccucccacaguagaaucucgcaccaaacccuucuccguccccauacucaccgucgaagaaaugacaaacucgagauuccccauaccacucgaaaaacucuucaccggucccuccucugccuucgucguccaaccccaaaacggcagaugcaccaccgacggaguccuccuggguaccacccaacuuucccccgucaacaucugcacuuuccgaggcgacgucacccauaucgccgguacccagaacuacacaaugaaucucgccucacaaaauuggaacaacuaugaccccaccgaagaaaucccugcaccccuaggaacccccgacuuugucggcaagauccagggcguccuuacucaaacgacccgccgcgacggcuccacacgaggacauaaagcaaccguaucaacagguucgguccacuucacccccaaacuaggcuccguacaauucuccaccgacacuuccaacgacuucgaaaccggucaaaacacacguuucacucccgucggggugguacaagacggcuccaccacccaucaaaacgaaccccaacaauggguccuaccuaacuacucaggccgagauagccacaacguccaccucgcacccgccgucgccccuaccuucccaggcgaacaacuucucuucuuccgcuccacaaugcccggcugcuccggcuaccccaacaugaaucuagacugccuccucccccaagaauggguccaacacuucuaccaagaauccgcuccggcucaaucagacgucgcccuccuccgcuucgucaaccccgacaccggccgaguucuauucgaaugcaaauuacacaaauccggcuacgucaccgucgcccacaccggacagcacgaccucgucaucccacccaacggcuacuuccgcuucgacucauggguaaaccaauucuauacccucgcccccaugggcaacggcgcaggccgccgccgcgcccuuuaa

SEQ ID NO: 35790 - RNA, 1623 nt, Artificial Sequence
  derived and/or modified sequence opt11 from VP1__Norovirus__AER11310
augaaaauggccuccaacgacgcaaccccaucagacggaucaacagcaaaccucgucccagaagucaacaaugaagucauggcccucgaaccaguaguaggcgccgcuaucgcugcacccgucgccggacagcaaaacgucaucgacccguggauucgcaacaacuucguccaagcccccggaggagaauuuaccguaagcccccgcaacgcaccaggcgaaauccucugguccgcaccacuaggacccgaccuaaacccuuaucucucccaccuugcccgaauguauaacggcuacgcaggcggcuucgaaguccaaguaauccucgccggcaacgccuucaccgcaggcaaaauaaucuucgccgcagucccacccaacuuccccacugaaggccuaucccccucccaagucacaauguucccccacaucaucguugacguccgccaacucgaacccguccucaucccccuccccgacguacggaacaacuucuaccacuacaaccaauccaacgaccccaccauaaaacucauagcaaugcucuacacaccccuacgcgcaaauaacgcaggcgacgacgucuucaccgucucaugccgcguccucacccgacccucccccgacuucgacuucaucuuccucguaccaccaaccgucgaaucucgcaccaaacccuucuccguccccauccucacggucgaagaaaugaccaauucccgcuuccccauaccccucgaaaaacucuucaccggaccaucauccgcauucgucgugcaaccucaaaacggccgcugcaccacagauggcguccuacucggcacaacacaacucucccccguaaacauaugcaccuuccgaggcgacgucacccacauagcuggcacucaaaacuacaccgucaaccuugcaucccaaaacuggaauaacuacgaccccacagaagaaauccccgcaccccucggcacccccgacuuugucggaaagauacaagguguccuuacccagaccacacgccgcgacggaucaacccgcggucacaaagccaccgucuccaccggcucgguccacuucacacccaaauuaggcagcguccaauucucuaccgacacuuccaacgacuucgaaaccggccaaaacacccgcuuuaccccagucggcgucguacaagacggcucaacaacccaccaaaacgaaccucaacaauggguucuacccaacuacucuggcagagacagccacaacguccaccuagcccccgccguagcccccacguuccccggcgaacaacuacuauucuuccgcucuaccaugcccggcugcuccggcuaccccaauaugaaccuugacugcuuacugccccaagaauggguucaacacuuuuaccaggaauccgcccccgcccaaucugacgucgcccuacucagauucgucaacccagacaccggacgaguccucuucgaaugcaaacuacauaaguccggcuacguaacugucgcccacaccggccaacacgaccuaguuaucccacccaacggcuacuucagauucgacagcuggguaaaccaauucuacacacucgcacccaugggcaacggcgccggacgccgccgcgcacucuaa

SEQ ID NO: 35791 - RNA, 1623 nt, Artificial Sequence
  derived and/or modified sequence opt11 from VP1__Norovirus__AER11312
augaaaauagcauccucagacgccaaccccuccgacggaucaaccgcaaaccucguacccgaagucaacaacgaaguaauggcccuugaacccgucgucggagccgccaucgccgcccccguagcuggccaacaaaacgucauagaccccuggauccggaacaauuucguacaagccccaggcggugaauuuaccguaagcccccgcaacgcacccggcgaaauccuuugguccgcuccccuagguccagaccucaaccccuaucucucccaccuagccagaauguacaacuccuacgcaggaggcuucgaaguacaagucauacuggccggcaaugccuucacagccggcaaaaucauauucgccgccguaccacccaacuuccccaccgaaggccuaucccccucccaagucaccauguucccccacaucauagucgacguccgccaacuagaaccaguacuaauuccacuaccugacguccgcaacaacuuuuaccacuacaaccaaaguaacgauccaacaaucaaacucauagccaugcucuacaccccucuacgcgccaauaacgccggagacgacguauucaccgucuccugccgaguccuaacccgacccucucccgacuucgacuucauauuccuugugccacccacaguagaaagucgcacaaaacccuucuccguccccauacucaccgucgaagaaaugaccaacucccguuuucccaucccccucgaaaaacuauuuaccggcccaucauccgcauucgucguacaaccccaaaacggacgaugcaccaccgacggaguccucuuaggcaccacccaacucuccccuguuaacauauguacauuccgcggcgacgucacacacauugccuccacacaagaauacaccaugaaccuagccucccaaaacuggaacaacuaugaccccaccgaagaaauccccgcaccccuaggcacacccgauuucguuggaaaaauccaagguguccucacccaaaccacccgacgggacgggucaacacgcggccacaaagccacugucucuacaggaucgguccacuucacccccaagcucggccgcauccaauucuccaccgacaccuccaacgacuucgaaaccggccaaaacacgcgcuucacccccgucgguguaguccaggacggcuccacaacccaccaaaacgaaccccaacaauggguccuaccaaacuacucuggccgcgacucacacaacguccaccucgcccccgccgucgccccauccuucccaggcgaacaacuccucuucuuccgcuccacuaugcccgggugcucaggcuaccccaacaugaaccucgacugccuccucccccaagaauggguacaacacuucuaucaagaagccgcccccgcccaaucagacgucgcccuccuccgcuucguaaaucccgacacaggccgcguccucuucgaaugcaaauuacacaaaucaggcuacgugacaguugcccacacaggacaacacgaucucgucaucccacccaacggcuacuuccgcuuugacucuugggucaaucaauucuacacccuugcacccaugggcaacggcaccggccgucgccgcgcccuauaa

SEQ ID NO: 35792 - RNA, 1623 nt, Artificial Sequence
  derived and/or modified sequence opt11 from VP1__Norovirus__AER11314
augaaaauggccagcaacgacgccaacccuuccgacggcucggcugcuaaccucguacccgaagucaacaacgaagucauggcccucgaaccagucgucggcgcagcaaucgcagcacccguagcaggacagcaaaaugucauagaccccuggauccgcaacaacuucguccaagccccuggcggagaguucaccguauccccacgcaacgcaccuggcgaaauccucugguccgcuccccuuggcccagaccucaaccccuaccucucacaccucgcccgcauguacaacggauacgccggcggauucgaaguucaagucauccucgccggaaacgccuuuaccgccggaaaaaucaucuucgcagccgugcccccuaacuucccuaccgaaggucucucccccucccaaguaaccauguucccucacaucauaguagacguccgacaacucgaacccguccucaucccccuccccgacguucgcaacaacuuuuaccacuauaaccaaucgaacgacucaacaaucaaacucaucgccaugcucuacacuccacuacgcgccaacaacgccggagaggacguauucacuguaucaugccgaguacuuacacgaccauccccagauuuugauuucaucuuccuagucccaccgaccguagaaucucgaaccaaacccuuuaccguccccauucuaacagucgaagaaaugaccaacucccgcuuuccaauaccccuggaaaaacuauuuaccgggccaucaggcgcauucgucguccaaccacaaaacggccgaugcaccaccgacggcgucuuacucggcaccacgcaacucucacccguaaacaucugcaccuuccgcggagacgugacccacaucgccggcacacgaaacuacaccaugaaucucgcaagccucaacuggaacaacuacgaccccaccgaagagauaccggcaccccucggcaccccugacuuuguaggcaaaauacaaggcguccucacccaaacaaccaaaggagacggcucaacccguggccauaaagcaaccgucuacaccggcucggcaccauucacuccaaaacucggcuccguccaauucucaaccgacaccgaaaacgacuucgaaacacaccaaaacaccaaauucacacccgucggcgucauccaagacggcggcaccacccaccguaacgaaccacaacaauggguucuacccucauacuccggccgcaacguccauaacguccaucucgccccagccguagccccuaccuuccccggagaacagcuccuauucuuccgcuccaccaugcccggaugcagcggcuaccccaacauggaccuugacugccuacugccccaggaauggguccagcacuucuaucaggaagcagcccccgcucaauccgacgucgcccucaugcgauucgucaaccccgacacuggacgaguccucuucgagugcaaacuccacaaaucuggauacgucaccgucgcccacaccggccaacacgaccucgucauaccacccaacggcuacuuccgcuuugacucaugggucaaucaauucuacacccucgcccccaugggcaacggcaccggacgacgccgggcccuuuga

SEQ ID NO: 35793 - RNA, 1623 nt, Artificial Sequence
  derived and/or modified sequence opt11 from VP1__Norovirus__AER11316
augaaaauggccuccaacgacgccaaccccucggacggcuccgccgcuaaccucguccccgaaguaaacaacgaggugauggcacucgaacccguagucggcgccgccauugcagcccccgucgccggccaacagaaugucaucgacccauggauccgaaacaauuucguacaagcccccggcggcgaguucaccguaucaccacgcaacgcccccggagaaauccuauggucagcaccccuaggccccgaccucaacccauaccuuucucaccucgcccgaauguacaacggcuaugccggcggcuucgaaguccaagucaucuuagcaggaaacgccuucacagccggcaaaauuauauucgccgcagucccaccaaacuuuccaacagaaggccucucacccucccaaguaaccauguucccacacauaauaguugacguacgccaauuagaaccaguccuaauaccccuacccgacguccgcaauaacuucuaccacuacaaccaauccaacgacucaaccauuaagcuaaucgcaaugcucuacacaccccuccgcgccaacaacgccggcgaagacguuuucaccgucuccugccgcguccuaacccgccccagcccagacuucgacuucauauuccugguaccacccacaguagaaucccgcaccaaacccuuuaccguccccauccucaccgucgaagaaaugaccaacucucgcuuccccauaccccuagaaaaacuuuucacaggacccucaggagcauucgucguccaaccccaaaacggucgaugcaccacagacggaguacuacucgguaccacccaacuuucccccgucaauaucugcacauuucgcggagauguaacccacaucgccggcucccgcaacuacaccaugaaucucgccucccuaaacuggaacaacuacgauccaaccgaagaaaucccugcuccauuaggcacaccagacuucguaggaaaaauccaaggcguucucacacaaacaaccaaaggcgacggcucaacacgcggccacaaagccacagucuauaccggaucugcacccuucacuccaaaacuagguucuguccaauucucuacagacaccgaaaacgacuucgaaacacaccaaaacacaaaauucacccccguuggaguuauucaagacggauccacaacacaccgaaacgaaccccaacaauggguccuccccucauacucaggucgcaacguccacaacguccaccucgcacccgccgucgcacccaccuucccuggagaacaacuccuguuuuuccgcucaaccaugccaggcugcuccggcuaccccaacauggaccuugacugccuccucccccaagaauggguccaacacuucuaccaagaagcagcacccgcucaaucugacgucgcacuccuuagauucgucaaccccgacaccggacgcguauuauucgaaugcaaacuacacaaauccggauacguaacuguagcccacaccggccaacacgaccucgucaucccacccaacggauacuuccgcuucgacagcugggucaaccaguucuacacccucgcccccaugggaaacggcaccggcagacgccgcgcacucuga

SEQ ID NO: 35794 - RNA, 1623 nt, Artificial Sequence
  derived and/or modified sequence opt11 from VP1__Norovirus__AER11318
augaaaauggccuccaacgacgccaaccccuccgacggcucugccgcaaaccucgucccagaaguaaacaacgaagugauggcccuagaaccaguugucggagccgccaucgcagcacccgucgccggccaacaaaacguuauagaccccuggauacgcaauaacuucguccaagcccccggcggcgaguucacagucucccccagaaaugccccaggcgaaauccucuggucugcaccccucgggccagaccuaaaccccuaccucucccaccuagccagaauguacaacggcuacgccggaggcuucgaaguacaaguaauccuagccggcaacgccuucaccgcuggcaaaaucaucuucgcagccgucccacccaacuuccccaccgaaggccuaucucccucccaaguaaccauguucccacauauaauaguagacguccgccagcucgaacccguccugaucccacuccccgacguccgcaacaacuucuaccacuacaaccaauccaaugacucuacaaucaaacucauagccaugcuauacacuccccuacgcgccaauaacgcaggcgaagacgucuuuacugucuccugccgcguacuaacccgccccucccccgacuucgacuucaucuuucucguacccccaaccgucgagucacgcacuaaacccuucaccguccccauacucaccgucgaagaaaugacgaacucccgauucccaaucccacucgaaaaacucuucaccggcccuuccggcgcauucgucguccagccccaaaacggaagaugcacaacggacgguguccuccuaggaaccacacaacuaucccccgucaacauaugcaccuuccgcggcgacgucacccacaucgcaggcucucgcaacuacaccaugaaccucgccucucucaacuggaacaacuaugacccaaccgaagaaaucccagcaccucucggaaccccugacuucgucggaaaaauccaagguguccucacccaaaccacuaaaggcgacggcuccaccagaggccauaaagccaccgucuauacaggcucagcccccuucaccccaaaacuaggcagcguccaauucuccaccgacaccgaaaacgacuucgaaacacaccaaaacaccaaauucacaccaguaggagucauccaagauggcuccaccacccaccgcaacgaaccccaacaauggguacuuccauccuacagcggccgaaacguccacaacguccaccucgcccccgccgucgcccccacuuuccccggcgaacaacuacuauucuuuagauccaccaugcccggaugcucaggcuaccccaacauggaccucgacugccuucucccccaagaauggguucaacauuucuaccaagaagccgcacccgcucaaucagacgucgcacuccuccgcuucgucaaccccgacacaggacgcguccuauucgaaugcaaacugcacaaaucaggcuacguaaccguagcccacacaggccaacacgaucucguuauaccacccaacggcuacuuccgauucgacuccugggucaaccaauucuacacccucgcccccaugggcaacggaacaggucgacgacgagcccucuaa

SEQ ID NO: 35795 - RNA, 1623 nt, Artificial Sequence
  derived and/or modified sequence opt11 from VP1__Norovirus__AER11320
augaaaauggcgucuaacgacgccaaccccucugacggcucagccgccaaucuaguccccgaagucaacaacgaaguuauggcacuugaaccuguugucggcgcagccaucgcugcccccgucgccggacaacagaacgucauagacccauggauccgaaacaacuucguacaagcacccggcggcgaauucaccgucuccccccgcaacgcccccggcgaaauccucuggucagccccacucggcccagaccuaaaccccuaccuaucacaccucgcccgcauguacaacggcuacgcuggcgguuucgaaguccaagucauccuagcuggcaaugccuucaccgccggaaaaaucaucuucgccgccguuccccccaauuucccuacagaaggccuuucccccucucaaguuaccauguucccccacaucgucguugacguccgucaacucgaacccguacucauuccccucccagacguccgcaacaacuucuaccacuacaaccaauccaacgacuccacaauaaaacucaucgccauguuauacaccccccuuagagccaacaacgcuggagaagacgucuucaccguuucaugccgaguccucacccguccaagccccgacuucgacuucaucuuccucguaccccccacagucgaaucucgaacaaaaccuuucaccguccccauacucaccguugaagaaaugacgaacucccgcuuccccaucccccuugaaaaacucuucacaggacccucaggggcguucgucguccaaccgcaaaacggccgcugcacaaccgacggcguccuccucggcaccacccaacucucacccgucaacauaugcaccuuccgcggcgacguuacacacaucgcaggcucccgcaacuacacuaugaaccucgcaucacuaaacuggaacaacuacgaccccaccgaagaaauacccgcucccuuaggcaccccagacuucguaggcaaaauccaaggcguccucacccaaaccacaaaaggcgacggauccacacgcggccacaaggcaaccguuuacaccggauccgccccuuucacccccaaacucggcuccguacaauucucuacugacaccgaaaacgauuucgaaacccaccagaacaccaaauucacccccgucgggguuauccaagacggcuccaccacccaccguaacgaaccucaacaauggguccuucccuccuacuccggccgaaacguccacaacguccaccucgcaccagccgucgccccaacauuccccggcgaacaauuacucuucuuccgcuccacgaugcccggaugcuccggauaccccaacauggaccucgacugccuccucccacaagaauggguccaacacuucuaccaagaagcggcacccgcccaaucagacguagcacuccuccgauucguaaacccagacaccggccgcguguuauucgaaugcaaacuccauaaaucuggauaugucaccgucgcccacaccggacagcacgaccuagucauaccacccaacggauauuuccgauucgacuccugggucaaucaauucuacacccucgccccgaugggaaacggaaccggccgccgacgcgcccucuaa

SEQ ID NO: 35796 - RNA, 1623 nt, Artificial Sequence
  derived and/or modified sequence opt11 from VP1__Norovirus__AER11324
augaaaauggccuccaacgacgccaaccccuccgacggcuccgcugccaacuuaguccccgaaguaaacaacgaaguaauggcgcucgaacccgucguuggcgccgcuaucgcugcccccgucgccggccagcagaauguaauagacccauggauccgcaacaacuucguccaagcacccggaggcgaauuuaccgucuccccuagaaacgcccccggcgaaauccuuuggucagcuccccucggucccgaccuaaaccccuaccuaucccaccuugcccgcauguauaacggauacgccggcggcuuugaaguccaagucauacucgccgguaacgccuucacagcaggaaaaauaauauucgccgccgugcccccaaacuuccccaccgaaggacuaucccccucccaagucacaauguucccacacaucaucgucgacgucagacaacuagagccaguacucaucccacucccagacguaaggaacaacuucuaccacuacaaccaauccaacgacucaaccauaaaacucaucgcaaugcucuacacaccccuccgcgccaacaacgccggugaagacgucuucaccgucuccugcagaguucugacccgcccauccccagacuucgacuucaucuuccucgucccaccuaccguggaaagucguaccaaaccauucaccguccccauccucaccguagaagaaaugacaaacucuagauucccaaucccccucgaaaaacucuucacuggaccguccggcgccuucgucguccaaccccaaaacggccgcugcaccacugacggcguacuacucggaaccacacaacuaucccccgucaacauaugcacauuucggggcgacgucacccacaucgccggcucacgcaacuacaccaugaaccucgccagccucaacuggaacaacuacgaucccaccgaagaaaucccagcaccccucggaaccccagacuucgucggcaaaauacaaggaguacucacccaaaccacaaaaggcgacggaucuacacgcggccacaaagcgaccgucuacacaggcuccgccccauucacccccaaacuaggcuccguccaauuuuccaccgacaccgaaaacgacuucgaaacacaccaaaacacaaaauuuacaccagucggugucauccaggacggcuccacuacucaucgcaacgaaccccagcaauggguccuaccuuccuacucuggucgcaacguccacaacguccaccuagcaccagcuguagcccccacauuccccggagagcagcuccucuucuuucgcuccaccaugcccggcuguucggguuaccccaacauggaccucgacugccuucucccccaagaauggguccaacauuucuaccaagaagccgccccagcacaauccgacguagcccuacuccgcuuugucaacccagacaccggcagagucuuauucgaaugcaaacuucacaaaucuggcuacgucacagucgcccacacuggacaacacgaucuagucauuccucccaacggcuacuuccgauucgacucuuggguaaaccaguucuacacccucgcccccaugggcaacgguaccgguagacgacgagcccuuuaa

SEQ ID NO: 35797 - RNA, 1623 nt, Artificial Sequence
  derived and/or modified sequence opt11 from VP1__Norovirus__AER11326
augaaaauggccuccaacgacgccaaccccucagacggcucagcagccaaccucgugcccgaagucaacaacgaaguaauggcacuagaacccgucgucggcgcugccaucgccgccccagucgcaggucaacaaaacguaaucgaccccuggauuagaaacaacuucguccaagcaccaggcggagaauuuaccgucucaccccgcaacgcacccggcgaaauacuaugguccgccccacucggucccgaccucaacccauaccuaagccaccuagcucgcauguauaacggcuacgccggcggauucgaaguccaagucauucuagccggcaacgcauucacagccgguaaaaucaucuucgccgccguaccacccaacuucccaaccgaaggccuaucucccucacaaguaaccauguucccccacauaaucgucgacguucgccaacucgaacccguccucauaccccuucccgacguacgaaacaacuucuaccacuacaaccaaagcaacgacucgaccauuaaacucauagccaugcucuacacaccgcuccgcgccaacaacgccggcgaagacgucuucaccguuagcugccgcguucuaacacgaccuucccccgacuuugacuucauauaccucgucccacccacaguagaaucccgaacgaaacccuucaccguacccauccucacaguggaagaaaugaccaacucacgauucccaaucccccuagaaaaacucuucaccgggccuucuggagccuucgucguacaaccccaaaacggacgcugcacaaccgacggaguccuucucgguaccacccaacuaucccccguaaauauaugcaccuuccgcggcgacgucacacacauagcaggcucccgcaacuacaccaugaaccucgcaucccuuaacuggaacaacuacgacccaaccgaagaaauccccgcgccgcucggcaccccagacuucgucggcaaaauccaaggcguccuaacccaaacaaccaaaggcgacggcucaacacgcggccacaaagccaccguauacacaggaggagccccuuucacacccaaacugggcagcguccaauucaguacagacaccgaaaaugacuucgaaacccaccaaaacaccaaauuuacccccgugggcguaauacaagacggcagcaccacccaccgaaacgaaccccaacaaugggucuuacccagcuacuccggccgcaacguccacaacguacaucucgcacccgccgucgcaccaaccuuccccggcgaacaacuccucuucuuccgcucaacaaugccaggaugcucaggcuaccccaacauggaucuagacugcuuacuaccacaagaauggguacaacacuucuaccaagaagccgcccccgcacagucagacgucgcccuccuccgcuucgucaacccagacaccggcagaguccuauucgaaugcaaacuucacaaaucugguuacgucaccgucgcccacaccggccaacacgaccucgucauucccccaaacggcuacuuccgcuucgacucauggguaaaccaauucuacacauuagcccccauggggaacggcaccggccgccggagagccuuauaa

SEQ ID NO: 35798 - RNA, 1623 nt, Artificial Sequence
  derived and/or modified sequence opt11 from VP1__Norovirus__AER11328
augaaaauggcuagcaacgacgcuaacccaagcgacggcuccgcggccaaucucgucccagaagucaacaacgaaguaauggcucuagaaccaguagucggcgccgccaucgcagcccccgucgccggccaacaaaacguuaucgaccccuggauccgaaacaacuucguccaggccccgggcggcgaauuuaccgucagcccccgcaacgccccaggcgaaauacuaugguccgcaccccuaggccccgaccucaacccauaccucucccaccuagcccguauguacaacggcuacgccggcggcuucgaaguccaaguaauccucgccggcaacgccuucacagccggaaaaaucauauucgccgccgucccacccaacuuccccaccgaaggacuaucccccucccaagucaccauguucccccacaucaucgucgacguucgucaacuagaaccaguacucauaccccucccugacgucagaaacaacuucuaccacuacaaccaauccaacgacucaaccauuaaacuaaucgccaugcuuuacaccccucuccgcgcuaacaaugcaggagaggacgucuucaccgucuccugcagaguacuuacucgcccaucacccgacuuugacuucaucuuccucgucccgcccacaguagaaucacgaaccaaacccuuuaccguccccauccucacaguugaagaaaugaccaacucacgcuucccaauaccccuagaaaaacucuucaccggcccaucauccgccuucguaguccaaccucaaaauggccgcugcaccaccgacgguguacuccuaggaaccacccagcucucccccguaaacaucugcacauuccgcggugacgucacccacauagccggaucccgaaauuacaccaugaaucucgcaucacucaacuggaacaacuacgaccccaccgaagaaauccccgcaccccucggaacaccagacuucguagggaaaauccaaggaguacuaacccaaaccacaaaaggagacggcucuacgcgcggacacaaagccacagucuacaccggcucugcccccuucacaccgaaacuaggcucaguacaauucucaaccgacaccgaaaaugauuucgaaacccaccaaaacacuaaauucacccccgucggcguaauacaagacggaucaaccacccaccgcaacgaaccccaacaauggguccuccccucuuacuccggucgcaacguacacaacguccaccuagccccagcagucgcaccaacauuucccggcgaacaacuccuuuucuuccgcucaaccaugcccggcugcuccggcuaucccaacauggaccuagacugccuccuaccgcaagaauggguccagcacuucuaccaagaagccgcgccagcacaauccgacgucgcccuccuccguuucgucaauccagacaccggacgaguacuuuucgaaugcaagcuacacaaauccggauaugucaccgucgcccacacaggccaacaugaccuagucauacccccaaacggauacuuccgcuucgacagcugggucaaucaauucuacacauuagcacccaugggcaacggcaccggacgccgacgcgcccuauaa

SEQ ID NO: 35799 - RNA, 1623 nt, Artificial Sequence
  derived and/or modified sequence opt11 from VP1__Norovirus__AER11330
augaaaauggccucuaacgacgccaaucccagcgacggcuccgccgcaaaccucgucccagaagucaacaacgaaguaauggcccuggaacccgucgucggugcugcaaucgccgcccccgucgccggacaacaaaacgucaucgaccccuggauacgcaauaacuucguacaggcccccggcggcgaguucaccgucagcccccgcaacgcaccaggugaaauccucuggagcgcaccacucggccccgaccuaaacccuuaccuaucccaccucgcuagaauguacaauggcuacgccggcggcuucgaaguccaagucauccucgcuggcaacgccuuuaccgccggaaaaaucauauucgcagcagucccacccaacuuccccacagaaggacuauccccaucucaaguuacuauguucccccacauaauagucgacguacgacaacucgaaccuguuuuaaucccccucccagacguacgaaacaacuucuaccacuacaaccaauccaacgacuccaccaucaaacuaaucgccaugcucuacaccccacuacgugccaacaacgccggcgaagacgucuucaccgucagcugccgcguacucacucgcccuucaccagacuucgacuucauauuccucguaccacccaccgucgaaucccgcacaaaaccauucacuguaccaauacucaccguugaagaaaugaccaacucccgauuccccaucccccucgaaaaacucuuuaccggccccuccggcgccuucgucguccaaccccagaacggaagaugcacaacagacggcguauuacucggcacaacucaacuaucgccggucaacauaugcaccuuccgcggcgacgucacccacaucgccggaucgcguaacuacaccaugaaccucgccucccucaacuggaacaacuacgaccccaccgaagagacccccgcaccccucggaaccccagacuucgucggaaaaauccaaggaguucuaacacaaaccacaaaaggcgacggcagcacucgcggucacaaagcaaccguauacaccggcagcgcgccauucacaccgaaacuagggucaguacaauucucaaccgacaccgaaaacgacuucgaaacucaccaaaacaccaaauucacacccgucggaguaauccaggauggcucaaccacccaccggaacgaaccccaacaauggguacucccuuccuacuccggacgaaacguucacaacguccaccucgcccccgccgucgcccccacauuccccggcgaacaacuccucuucuuccgcucuaccaugcccgguugcuccggcuaccccaacauggaucuugacugccuucucccccaagaauggguucaacauuucuaccaagaagccgccccugcacaauccgacguagcccuccucagguucgucaacccagacacaggccgcguccucuuugaaugcaaacuccauaaauccgguuacguaaccguagcgcacaccggccaacacgaccucgucauaccucccaacggauauuucagguucgacagcugggucaaccaauucuacacccucgcaccaauggguaacggaaccgggcgacgcagagcacuauaa

SEQ ID NO: 35800 - RNA, 1623 nt, Artificial Sequence
  derived and/or modified sequence opt11 from VP1__Norovirus__AER11332
augaaaauggcauccaacgacgccaaccccuccgacggaagcgccgcaaaccucguccccgaaguaaauaacgaaguaauggcacuagaacccgucgucggagcagccauagccgcccccguagcaggacaacaaaacgucauagaccccuggauacgaaacaacuucguucaagcaccugguggcgaguucacuguuucccccagaaacgccccaggcgaaauacucugguccgcaccccuuggccccgaccuaaaccccuaccucucacaccuagcccgaauguacaacggcuaugccggaggcuucgaaguccaagucauccuugcaggaaacgccuucacagccggaaaaauaauauucgcagcugucccacccaacuuccccacagaaggucucucccccucccaagucacaauguucccccacaucauagucgacguacgccaacuggaacccguccucaucccccucccagacguccgcaauaacuucuaccacuacaaccaaucaaacgacucaacaaucaaacucaucgccaugcucuacacuccacuccgcgcuaacaacgcaggagaagacguauucacagucucaugucguguccucacccgcccuucccccgacuucgacuucaucuuccuagucccgcccacaguugaaagcagaaccaagcccuucacugucccaauccuaaccgucgaggaaaugaccaacucccgcuuucccauaccacucgaaaaacucuucaccggacccucauccgccuucgucguccaaccgcaaaacggccgcugcacaacugauggcguccugcuaggcacuacccaacucagcccaguaaacauaugcaccuuccggggcgacguaacccacaucgccggcucccgaaacuacaccaugaaccucgcaucacucaacuggaacaacuacgacccaacagaagaaauacccgcuccccucggaaccccagacuuuguaggcaaaauacaaggcguccucacccaaaccaccaaaggcgacggcucaacccgcggccauaaagccaccgucuacaccgguuccgccccauucacaccaaaacucggcuccguccaauucuccaccgacaccgaaaacgacuucgagacccaccaaaacaccaaauucacaccugucggcguaauccaagacggaucuacaacccaccgcaaugaaccacaacaauggguccuaccauccuacucaggaagaaacguccaaaacguccaccucgcacccgccgucgcaccaaccuuccccggagaacaacuccucuucuuccggagcaccaugcccggcugcucaggauaccccaacauggaccucgacugccuccucccccaagaauggguccaacacuucuaccaagaagcagcccccgcccagagcgacguagcccuccuccgauuugucaaccccgacacaggccgcguacucuucgaaugcaaacuccacaaaucuggauacgugacaguugcccacacuggacaacacgaccuagucaucccacccaacggcuacuuccgauucgacucaugggucaaccaguucuacacucucgcccccaugggaaacggaacuggacgccgucgcgcacucuga

SEQ ID NO: 35801 - RNA, 1623 nt, Artificial Sequence
  derived and/or modified sequence opt11 from VP1__Norovirus__AER11334
augaaaauggcuuccaacgacgccaacccuucggauggcucagccgccaaccucguaccagaaguuaacaacgaaguaauggcccucgaacccguaguaggagccgccaucgcagcaccagucgcaggacaacaaaaugucauugaccccuggaucagaaacaacuucguccaagcccccggcggggaauuuacagucucaccccgaaacgcaccaggcgaaauccuaugguccgcaccccucggcccugaccucaaccccuaucuuucccaccucgcccgaauguacaauggauaugccggcggauucgaaguacaagucauacucgccggcaaugccuucaccgccggaaaaaucaucuucgcagccgucccgcccaacuuccccaccgaaggccuaucccccucgcaagucaccauguucccccacaucaucgucgauguucgacaacuugaaccgguacuuaucccccuccccgacgucagaaacaacuucuaccacuacaaucaaucaaacgacuccacaaucaaacucauagccauguuauauaccccacuccgcgcaaacaaugccggcgaagacgucuucaccgucagcugccggguccuaacccgcccaucaccugacuucgacuucaucuuccucguacccccaacaguagaaucccgcaccaaacccuucacgguccccauccucaccgucgaagaaaugacaaacucccgauuccccauaccccucgaaaaacucuucaccggcccauccuccgccuucgucguacaaccacaaaacggccgaugcaccaccgacggcguccuccuaggaaccacccaacugucaccggucaacauaugcaccuuccgaggcgacgucacccacauagcugguucacgcaacuacacaaugaaccucgccagccuuaacuggaacaacuacgaucccaccgaagaaauccccgcaccacucggcacccccgacuucgucgguaaaauccaaggcguccucacacaaacaaccaaaggcgacggcucaacccgcggccacaaagccacagucuacaccggcucagccccauucacgccaaaacucggcuccguccaauucuccaccgauacugaaaacgauuucgaaacccaccaaaacaccaaauucacucccgucggugucauccaagacggcagcaccacacacagaaacgaaccccaacaauggguccucccaagcuacucaggcagaaacguccacaacguacaccuagccccugccguagcaccaaccuucccaggcgaacaacuccucuucuuccgaucaaccaugcccggcugcuccggcuaccccaacauggaccuagacugccuccucccccaagaauggguccagcacuucuaccaagaagccgccccagcccaaucagacgucgcacuccuacgauucguuaacccugacacaggacgcguucuauucgaaugcaaacuccacaaaaguggcuacgucacagucgcacacaccggccaacacgaccucguaaucccucccaacggauacuuccgcuucgacucauggguuaaccaguucuacacccucgcccccaugggcaacgguaccggucgacgacgagcccucuga

SEQ ID NO: 35802 - RNA, 1623 nt, Artificial Sequence
  derived and/or modified sequence opt11 from VP1__Norovirus__AER11336
augaaaauggccuccaacgacgcuucaccauccgauggauccgccgccaaccucguccccgaagucaacaacgaagucauggcccuagaaccaguggucggcgcagcaauugccgcccccgucgcaggccaacaaaacgucaucgaccccuggauccguaacaacuucguccaagcccccggcggcgaguucaccguaucuccccgaaacgcaccuggcgaaauccucugguccgccccacuuggucccgaucucaaccccuaccucucccaccuagcccgcauguacaacgguuacgcgggaggcuucgaaguccaagucauacuagcuggaaacgccuucacagccggcaaaaucaucuucgcagccgugcccccaaacuuccccacagaaggccucucucccucccaggucaccauguucccacacaucaucgucgacguacgacaacuggaaccaguccucauaccccucccagacguccgaaacaacuucuaccauuacaaccaaucaaacgacuccaccauuaaacuaauagcaaugcucuacaccccacuucgcgcaaacaaugccggagaagacgucuucaccgucagcugccgcguccuaacccgcccaucuccggacuucgacuucauauuccuaguuccgcccaccguagaaucacgcaccaaacccuuuacaguaccuauccuaacagucgaagaaaugaccaacucccguuuccccaucccccucgaaaagcuauucaccggccccagcggcgccuuugucguccagccccaaaacggccgcugcacaaccgacggcguccuccucggcacaacccaacucuccccugucaacauuuguaccuuccgaggcgacguaacacacaucgccggcucacgcaacuacaccaugaaccuagccgcccucaacuggaacaacuacgacccuaccgaagaaaucccagcaccccucggcacccccgacuucguaggcaaaauccaagguguacuaacccaaaccaccaaggccgacggauccacccgcggacacaaagcaacuguauacaccggcuccgcagacuucacccccaaacuuggcucuguccaauucaacaccgacaccgaaaacgacuucgaaacacaucaaaacaccaaauucacccccguuggcgucauccaagacggcuccaccacucaccgaaacgaaccccaacaauggguccuuccgucauacuccggacgcaacguccacaacguccaccucgccccagccguagcaccaacuuucccaggcgaacaacuacucuucuuccgauccaccaugcccggcugcucuggcuacccuaauauggaccucgacugccuccucccccaagaauggguccaacacuucuaccaggaagccgccccagcccaaucagacgucgcacuucuacgcuucguaaaccccgacacaggccgaguacuuuucgaaugcaaacuacacaaauccggcuacgucaccguugcacacaccggacaacacgaucuuguaaucccacccaacggcuacuuuagguuugacuccugggucaaccaauucuacacucucgcccccaugggaaacggaacgggacgccgccgugcgcucuaa

SEQ ID NO: 35803 - RNA, 1623 nt, Artificial Sequence
  derived and/or modified sequence opt11 from VP1__Norovirus__AER11340
augaaaauggccuccaaugacgccucacccucggacggaucugcagccaaccucguccccgaaguaaacaacgaagucauggcacuagaacccguagucggagccgccaucgccgcacccgucgcuggccaacaaaauguaaucgacccuuggauacgcaacaacuucguacaagcaccuggcggcgaauuuaccguaucaccccgcaacgccccuggcgaaauacucuggucagcaccccuaggucccgaccuuaaccccuaccucucccaccuagcccgcauguacaauggauacgccggaggcuucgaaguccaaguaauacucgccggaaacgccuucaccgccggaaaaauaaucuucgccgccgucccacccaacuuccccaccgaaggacuauccccaucccaagucacaauguucccacacaucaucgucgacguucgacaacucgaacccguccuuauacccuuacccgacguaagaaacaacuucuaucacuacaaccaauccaacgacucaaccauaaagcuaaucgccaugcucuacacaccccuccgugcaaauaacgccggagaagacgucuucaccgucucaugccgcguccucacacgcccaucccccgacuucgacuucaucuuccuaguaccuccaacaguagaaucacgcaccaaacccuucaccguacccauucucacagucgaggaaaugacaaacucccgcuucccuaucccacucgaaaaacucuucaccggccccuccggcgccuucgucguccaaccccaaaacggacgcugcaccaccgacggcguacuacucggcaccacccagcucuccccagucaacaucugcacauuccgaggcgacgucacccacaucgccggaagccgcaacuacaccaugaaccucgccgcccucaacuggaacaacuacgaccccacugaagaaaucccagcuccccucggcacccccgacuucguagguaaaauccaaggaguacucacacaaaccacaaaagccgacggcuccacccgcggacacaaagccaccgucuacacaggauccgccgauuucacaccaaaacuagguuccguccaguucucaaccgacaccgaaaacgacuucgaaacccaucaaaacaccaaauucacucccguuggcgucauccaagacggcuccaccacccaccgcaacgaaccccaacaauggguccuacccuccuacuccggccgaaacguccacaacguacaccuugcccccgccguagcucccaccuuccccggugaacaacuacucuucuuucgauccaccaugcccggcugcucaggcuacccaaauauggaccuagacugccuuuuaccucaagaauggguacaacacuuuuaccaagaagccgcccccgcccaauccgacgucgcccuacuuagguucguaaacccagauacaggccgcguucucuucgaaugcaaacuccauaagucaggcuacguaacgguagcccacacaggacaacacgaccuaguaauacccccgaacggcuacuuccgcuucgacuccuggguaaaccaauucuacacccucgcccccauggguaacggcacaggccguagaagggcauuauga

SEQ ID NO: 35804 - RNA, 1623 nt, Artificial Sequence
  derived and/or modified sequence opt11 from VP1__Norovirus__AER11342
augaaaauggccuccaaugacgccucacccucagacggcucagccgccaaucuagucccagaaguaaacaacgaagucauggcccucgaacccguagucggcgcggcaaucgcugcaccagucgcaggccaacaaaacguaaucgacccuuggaucagaaacaauuucgugcaggcccccggaggagaguucaccgucuccccacgcaacgcacccggcgaaauccucuggucugccccucucggcccugaccucaaccccuaccugucccaccucgcacgcauguacaacggcuacgcaggaggcuucgaaguccaagucauccucgccgggaacgccuucacugcaggcaaaaucaucuucgccgcugucccaccaaacuuccccaccgagggccuaucaccaucccaagucaccauguuuccccacauaauagucgacguccgccaacucgaaccaguccucaucccccuaccagacguccgcaacaacuucuaccacuacaaccaauccaacgacuccaccauuaaacuuaucgccaugcucuacacgccgcuccgcgccaacaacgccggcgaagacgucuucaccgucuccugcagaguccugacccgcccaucccccgacuucgacuucauuuuccucguaccacccaccgucgaauccagaaccaaacccuucaccguacccauucucaccgucgaagaaaugacuaacucccguuucccaauaccgcuagaaaaacucuucaccggaccuagcggagccuucgucguccaaccccaaaacggaagaugcacaaccgacggcguucuccucggaacaacccaacuuuccccaguaaacaucugcaccuuccgcggcgacgucacccacaucgccggcucccguaacuacacuaugaaccucgccgcacuaaacuggaacaacuacgaccccacugaagaaauacccgcaccccuaggcacccccgacuucguaggcaaaauucagggcgugcucacccaaaccacaaaagcugacggcuccacgcgcggccacaaagcaacugucuacaccggauccgccgacuucaccccaaaacuaggcuccguacaauuuuccaccgacaccgaaaacgacuucgaaacccaccaaaauaccaaauucacccccgucggagucauccaagacggcucaacaacacaccgcaacgagccccaacaauggguccuaccgucuuauuccggccgcaacguccacaacguccaccuagcccccgccgucgcccccacguuccccggagaacaacuccucuucuuccgcuccacaaugcccgguugcucaggcuacccaaacauggaccucgacugccuccucccucaagaauggguacaacauuucuaccaagaagccgcccccgcccaaucugacgucgcacuccuccgcuucgucaaccccgauaccggccgcguccuguucgaaugcaaacuccacaaauccggauacgucacggucgcucacacgggccaacacgaccuugucauucccccaaacggauacuuccgcuucgauuccuggguaaaccaauucuacaccuuagcacccaugggcaauggcacaggccgacgacgcgcccuauaa

SEQ ID NO: 35805 - RNA, 1623 nt, Artificial Sequence
  derived and/or modified sequence opt11 from VP1__Norovirus__AER11344
augaaaauggccuccaaugacgccucaccaucagacggauccgcugccaaccuuguccccgaagucaacaacgaaguaauggcccucgaacccgucgucggcgccgcuauagccgcaccaguagccggccaaaagaacguaaucgaucccuggauucgaaacaacuucguccaagcccccggcggagaguucacagucucaccccgaaacgcgcccggugaaauccucuggucugccccacuaggacccgaccucaaccccuaccuaucacaccucgccagaauguacaacggcuacgccggcggauucgaaguccaagucauucucgccggaaacgccuucacagcaggcaaaaucaucuucgcagcuguaccucccaacuuccccaccgaaggccugucccccucucaagucaccauguucccccacauaaucgucgacguccgacaacucgaacccguccuaaucccucuucccgauguccgcaacaacuuuuaccacuacaaccaauccaacgacucuaccauuaaacuaauagccaugcucuacacgccccuccgugccaacaacgcaggagaagacgucuucaccguuagcugucgcguccucacucgccccucccccgacuucgacuucaucuuccucgucccucccaccgucgaaucccgcacaaaaccuuucaccguccccauccucaccguagaggaaaugacuaacucccgcuuuccaaucccucuugaaaaacucuucaccggcccuuccggcgcauucguaguccaaccccaaaauggccgcugcaccaccgacggcguccuccucggcacgacacaacuuucacccgucaacaucugcacauucagaggagacgucacccacaucgcaggcucccgcaacuacaccaugaaucucgccgcccucaacuggaacaacuacgacccaaccgaggaaauaccagccccacuaggaaccccagacuucguaggcaaaauacaaggcguccucacacaaacaaccaaagccgacggcucaacccgaggccacaaagccaccgucuacacaggauccgcugacuucaccccaaaacuaggcuccguccaauucuccaccgacaccgagaacgauuucgagacucaccaaaacaccaaauucaccccagucggcguaauccaagacggcuccacaacacaucgaaaugaaccucaacaauggguccucccgagcuacucuggacgaaacguccacaacguacaccuagccccagcagucgcaccgaccuuccccggcgaacaacuacuauucuuccgaucaaccaugcccggcugcuccgguuaucccaacauggaccucgauugccuccuaccacaagaauggguccaacacuucuaccaagaagccgcacccgcccaauccgacgucgcccuucuucgcuucgugaauccagacacuggccgcguacucuucgaaugcaaacuccacaaaucaggcuacguaaccgucgcccacaccggacaacacgaucucguaauaccucccaacggcuacuuccgcuucgauagcugggucaaccaauucuacacccucgcccccaugggcaacggaaccggacgccgucgcgcccuuuaa

SEQ ID NO: 35806 - RNA, 1623 nt, Artificial Sequence
  derived and/or modified sequence opt11 from VP1__Norovirus__AER11346
augaaaauggcauccaacgacgccuccccuagcgacggcucagccgccaaccuaguucccgaagucaacaaugaaguaauggcccuggaacccgucgugggcgccgcaauagcugccccagucgccggccaacaaaacgucauagaccccuggauccgcaauaacuucguccaagccccuggaggagaguucaccguaucuccacgcaacgccccuggagaaauccuaugguccgccccucucggacccgaccucaaccccuaccuaucacaccucgcacgaauguacaacgguuacgccggcggcuuugaaguccaaguaauacuagccggcaacgccuucaccgccggcaaaaucauauucgccgcagucccucccaauuuccccaccgaaggcuuaucacccucccaagucacaauguucccccacaucaucgucgacguccgacaacuagaacccguccucaucccccuccccgacguuagaaacaacuucuaccacuacaaccaauccaacgacuccaccaucaaacuuauagcaauguuauacacgccccugcgcgcaaauaacgcgggagaagauguauucaccgucucuugccgaguccuaacccgccccucccccgacuuugacuucaucuuccucguaccacccaccguugaaucccgaaccaaacccuucaccguccccauccucacaguugaagaaaugaccaacucccgauuccccaucccccucgaaaaacucuucacuggcccaucaggugccuucgucguacaaccccaaaacggccgaugcacaaccgacggaguccuacuaggaacuacccaacuuuccccggucaacauuugcacauuccgaggcgacguaacucacaucgccggcucccgcaacuacaccaugaaucucgccgcccuaaacuggaacaauuacgaucccaccgaagaaaucccagcaccccucggcacacccgacuucgucggaaaaauccaaggaguccucacccagacaaccaaagccgauggcuccacacgcggacacaaagccaccgucuacaccggcucagccgacuucacaccaaaacucggcagcguccaauucucaaccgacaccgaaaaugacuucgaaacccaccagaauacuaaauucaccccugucggcgucauucaagacggcuccacaacccaccgaaacgaaccacaacaguggguccuccccuccuacucaggacgcaauguccacaacguccaccucgcccccgccgucgccccaacauuccccggcgaacaacuccucuucuuccgcuccacuaugcccggcugcagcgguuacccuaacauggaucuugacugccuucucccacaagaaugggugcaacacuucuaucaagaagccgccccagcacaaucugacgucgcccuccuacguuuuguaaaccccgacacaggacgaguacuauucgaaugcaaacuccacaaaucaggcuacgucaccgucgcccacacaggacaacacgaccucgucaucccacccaacggauacuuccgauucgacuccugggucaaccaauucuacacacucgcacccaugggcaacggaacaggacgccgucgcgcgcuuuag

SEQ ID NO: 35807 - RNA, 1623 nt, Artificial Sequence
  derived and/or modified sequence opt11 from VP1__Norovirus__AER11348
augaaaauggccuccaacgaugcaucccccuccgacggcuccgcagcuaaccuaguccccgaaguaaacaacgaaguaauggcucucgaacccgucgucggagccgccauugccgcacccgucgccggccagcaaaacgucaucgaccccuggauacgcaauaauuucguacaggccccaggaggcgaguucacugucagcccccgaaaugcccccggcgaaauccucugguccgcaccacucgggcccgaccucaaccccuaccucucacaccuggcccgcauguacaacggcuacgcaggcggguucgaaguccaagucauacucgccgguaaugcauucaccgccggcaaaaucaucuucgcggccgucccuccgaacuuccccacggaaggccucuccucaucccaagucacaauguucccucacaucaucgucgacguccgucaacuagaacccguacucaucccacuacccgacguacgaaacaauuucuaccacuacaaccaaagcuccgacuccaccaucaaacuuauagccaugcucuacacaccccuccgcgccaacaacgcuggcgaagacgucuucaccgucucaugccgcgucuuaacccgccccagccccgacuucgacuucaucuuccucgucccgcccaccgucgaaucucguaccaaaccauucaccguccccauccuaacugucgaagaaaugaccaacucacgcuucccaaucccucuugaaaaacucuucacaggccccucaggugcuuucguaguacaaccacagaacggacgcugcaccaccgacgggguacuccucggcacaacucaacucucgccagucaacaucugcaccuuccgcggugacguaacccacauagcuggaucccgcaacuacacaaugaaucucgccgcccucaacuggaacaacuacgacccgaccgaagaaauacccgcaccccucggcacaccagacuucgucggcaaaauacaaggagugcuaacacaaaccaccaaagccgacggauccacccgaggucauaaagccacaguauacaccggcuccgccgacuucaccccaaaacuaggcagcguacaauucuccaccgacaccgaaaacgacuucgaaacccaccaaaacacaaaauucacccccguuggcgucauccaagacggaucaaccacccaccguaaugaaccccaacaguggguccuccccucauacucaggccgcaacguacacaacguccaccuugcacccgcugucgcccccacauucccaggcgaacaacuccuauucuuccgauccacaaugcccggaugcagcggcuaccccaacauggaccucgacugccuacucccacaagaauggguacaacacuuuuaccaagaagccgcccccgcacaaagcgacguagcccuacuacgcuucguaaacccugacaccggccgcgucuuauucgaaugcaagcuccacaaaagcggcuacguuacuguagcacacacaggccaacacgaccuagucaucccacccaacggcuacuucagauucgacucaugggucaaccaauucuauacacucgcccccaugggcaacggcaccggacgacgccgagcacucuaa

SEQ ID NO: 35808 - RNA, 1623 nt, Artificial Sequence
  derived and/or modified sequence opt11 from VP1__Norovirus__AER11350
augaaaauggccuccuccgacgccaaccccagcgacggauccacugccaaccuagucccagaagucaacaacgaagucauggcucuggaacccguagucggcgccgcaauugccgcacccguagccggccaacaaaacguaaucgacccguggauccgcuccaacuucguccaagcacccggcggcgaguucacagucaguccccgcaacgcccccggcgaaauauuauggagcgcaccccucggcccagaccucaacccauaucucagccacuuagcccgcauguacaauggcuacgccggcggcuucgaaguacaaguaauacucgcaggcaacgcauucaccgccggcaaaaucauauucgccgccgugcccccaaacuucccaaccgaaggacucucaccuucccaagucacgauguucccucacauaaucgucgacguacgacaacuagaacccguccuaauuccacuacccgacguccgcaacaacuucuaccacuacaaccaaaguaacgaccccacaaucaaacuuaucgcuaugcucuacaccccacuccgagccaacaacgccggugacgacgucuucaccguauccugccgcguccucacccgacccucaccagacuucgauuucaucuuccugguacccccuaccgucgaaucgcgaacuaaaccuuucuccgucccaauccuuacggucgaagaaaugaccaacucccgcuuuccaaucccccuggaaaaacuuuucacaggacccuccuccgcauucgucguacaaccccaaaauggcagaugcaccacugauggcgucuuccucggcacaacccaacucuccccagucaacaucugcacuuucagaggcgacgucacacacaucaccggcucacgcaacuacaccaugaaccuugcaacccaaaacuggaacuccuacgacccaaccgaagaaauccccgccccacuaggcacacccgacuucguaggcaaaauccaaggaguacucacccaaaccacucgagcugacggcagcacucgcggacacaaggcaacagucuacacugguuccgccgacuucgcccccaaacucggacgcguccaauucgccacagacacagacaacgacuucgacgccaaccaaaacaccaaauucacucccguuggcguaauacaagacggcgauaccgcccaccgcaacgaaccccaacaauggguucuacccuccuacagcggacgcaacucccacaacguccauuuagccccagcaguagcccccaccuuccccggcgaacaacuccuuuucuuccgaucaacaaugcccggaugcucuggcuacccaaacauggauuuagacugccuccuaccucaagaauggguacaauacuucuaccaagaagcagcacccgcacaauccgacguagcccuccuacguuuuguuaaucccgacacaggccgcguacuauuugaaugcaaacuccacaaauccggauacgucacagucgcccacaccggacaacacgaccucgucaucccucccaacggcuauuuccgcuucgacucauggguuaaccaauuuuacacccucgcccccaugggaaauggcacaggacgccgccgagcccucuaa

SEQ ID NO: 35809 - RNA, 1623 nt, Artificial Sequence
  derived and/or modified sequence opt11 from VP1__Norovirus__AER11352
augaaaauggccuccuccgacgcaaaccccuccgacggcuccacagccaaccucgucccugaaguaaacaacgaagucauggcccucgaacccguugucggagccgcaauagccgcccccguagccggccaacaaaacgucaucgaccccuggauacguaacaacuucguucaagcccccggcggugaauuuaccgucucuccccgcaacgcccccggugaaauacuauggucagccccacuaggccccgaccucaaccccuaccucucccaccucgcccgcauguauaaugguuacgccggcggauucgaaguccaagucauccucgccggcaacgccuucaccgccggaaaaaucaucuucgccgccguaccacccaacuuccccaccgaaggacuaucucccucccaagucacaauguucccacacaucaucguggacguccgacaacucgaacccguucuuaucccccucccagacguucgcaacaacuucuaccacuacaaccaaucaaacgaccccaccaucaaacucauagccaugcuauauacacccuuacgcgcaaacaacgccggagacgacgucuucaccguauccugccgaguccucacacgacccucccccgacuucgacuucauauuccucguacccccuaccgucgaaagccgcaccaaacccuucucugucccgauacugaccgucgaagaaaugaccaacucccguuuccccaucccccucgaaaaacuauucaccggccccucaucugccuucgucguccaaccccaaaacggccgcugcacaacagauggcguccugcucggaacaacacaacuuuccccagucaacaucugcaccuuccgcggugacgugacucacaucaccggcucccguaacuacacuaugaaccucgccacccaaaacuggaacucauaugaccccaccgaagaaauccccgcaccccuaggaaccccagacuucguaggcaaaauccaagguguacucacucaaacaacccgcgccgacggcucaacacgaggucacaaagccaccgucuacaccggcuccgcggacuucgcccccaaacuaggccgagugcaauucgccacagacaccgacaacgacuucgacgcaaaccaaaacaccaaauucacacccgucggcgugauccaagacggaggcaccgcccaccgaaacgaaccccagcaaugggucuuaccaucauacuccggacgaaacucacacaacguacaccucgcccccgccgucgccccaaccuuccccggcgaacaacuucucuucuuccguuccaccaugccagggugcagcggcuaccccaacauggaccucgacugucuccuaccccaagaauggguccaauacuucuaccaagaagccgcgcccgcccaaucagacguagcccuucuccgauucgucaaccccgacaccggacgaguacuuuucgaaugcaaacuccacaaaucaggcuacgucacuguagcccacaccggucaacacgaccuagucaucccacccaacggcuacuuucgcuucgauuccuggguaaaucaauucuacacacucgcacccaugggaaacggcaccggccgacgucgcgcucuauaa

SEQ ID NO: 35810 - RNA, 1623 nt, Artificial Sequence
  derived and/or modified sequence opt11 from VP1__Norovirus__AER11354
augaaaauggcauccaacgacgccaacccauccgacggaagugccgccaaccucguccccgaaguaaacaacgaaguaauggcccucgaacccgucguaggagcagccaucgccgcccccguagcaggacaacagaacguaaucgacccauggaucagaaacaacuucgugcaagcccccggcggagaguucaccgucucaccacgcaacgcccccggagaaauccuuugguccgcaccucuaggcccagaccucaaccccuaucucucccaccuagcacgaauguacaacggauacgcaggcggcuucgaaguucaaguaaucuuagcaggcaacgccuuuacagcaggaaaaaucaucuucgcagcugucccacccaacuuccccaccgaaggccucucccccucccaagucaccauguuuccccacaucauagucgacguccgccaacuugaacccguccucaucccccuacccgacguucgcaauaacuucuaccacuacaaccaaucaaacgacucaaccauaaaacucaucgcaaugcucuacacaccccuaagagcuaacaacgccggagacgacgucuucaccgucuccugccgaguacucacccgcccauccccagacuucgauuuuauuuuucuagucccucccaccguugaaucacgcaccaaacccuucaccguccccauccucaccguagaagaaaugaccaacucccgcuucccaaucccccucgaaaaacuauucaccggccccuccucugccuucgugguucagccccaaaacggacgaugcaccaccgacggaguccuauugggaaccacccaacucagccccgugaacaucugcaccuuccggggcgacgucacccacaucgccggaucccgcaacuacacuaugaaccucgccucacuaaacuggaauaacuacgacccaacagaagaaauccccgcaccccuugguacgcccgacuucgucggaaagauacaaggcguacucacccaaacaacaaaaggagacggcuccacccgcggacacaaagcuaccgucuacacuggcuccgccgacuucacccccaaacucggcuccguccaauucgccaccgacaccgaaaacgauuucgaaacccaccaaaacaccaaauucacccccguaggagucauccaagacggcucuaccacccaccgcaacgaaccccaacaaugggucccacccuccuacucuggacgaaacguccacaacguacaccucgcccccgccgucgcacccaacuuccccggagaacaacuccuuuucuucaggucaaccaugcccggaugcuccggcuaccccaacauggaccucgacugccuauuaccccaagaauggguacaacauuuuuaccaagaagccgcccccgcccaaucagacguagcccuacuccgcuucgucaaccccgacaccggucgaguacuauucgaaugcaaacuccacaaauccggcuacguuaccguagcccacacaggacaacacgaccucguuauacccccaaacggauacuuccgcuuugacuccugggucaaccaauucuacacucuagccccaaugggcaacgguacuggaagacgcagagcccucuaa

SEQ ID NO: 35811 - RNA, 1623 nt, Artificial Sequence
  derived and/or modified sequence opt11 from VP1__Norovirus__AER11356
augaaaauggccuccaacgaugccaacccauccgacggaucagccgcaaaccucguccccgaaguaaacaacgaaguaauggcacucgaacccguagucggcgccgccaucgccgcaccagucgccggucaacaaaacguaaucgaccccuggauccguaacaauuuuguccaagcccccggcggcgaguucaccguaucaccacguaaugccccuggugaaauccucugguccgcaccacucggacccgaccucaaccccuaccuaucccaccuagcacgcauguacaacggcuacgcaggcggcuucgaaguacaagucauccuagcaggaaacgcauucacagccggcaaaaucaucuuugccgcaguaccacccaacuuccccacugaagguuuaucccccucccaagucaccauguuuccccacaucaucguagauguccgccaacuagaacccguacucaucccccuccccgacguccgcaacaacuucuaccacuacaaucaauccaacgacucaaccaucaaacuuauagccaugcucuacacaccccuccgcgcaaacaacgccggagacgacgucuucaccguaaguugccgcguccucacccguccaagucccgacuucgacuucaucuuccucgucccacccaccgucgaaucacgcacaaagcccuucaccguaccgauccugacaguagaagaaaugaccaacucacgcuucccaauaccccucgaaaaacucuucaccggccccucuucagcuuucguuguccaaccccaaaacggcagaugcaccaccgacggcguccuccucggaacaacacaacucucaccgguuaacauaugcacauucagaggcgacguaacacacauugccggcucacgaaacuacacaaugaaccucgccucccuaaacuggaacaacuacgacccaacagaagaaauccccgcaccacuaggcacccccgacuucgucggcaaaauccaaggaguccucacccaaacaacaaaaggcgacggcuccacccgcggccacaaagccaccguauauaccgguagcgccgacuucacacccaaacuuggcuccguccaauucgcaacagacaccgaaaacgacuucgaaacccaccaaaacaccaaauucacacccguagguguaauccaggauggcuccacaacucacagaaacgaaccacaacaauggguccuucccucguacucuggccggaacguccacaacguccaccuggcucccgcagucgcccccaacuuccccggagaacagcuacuguucuuucgauccaccaugccaggaugcuccggauaccccaauauggaccucgacugcuuacucccccaagaauggguacaacacuucuaccaagaagccgcacccgcacaauccgacgucgcccuccucagauucgucaacccagacaccggccgcguccuauucgaaugcaagcuccacaaaucaggcuacgucacaguagcacacacgggccaacacgaccucgucaucccgcccaacggauacuuccguuucgacuccuggguuaaccaauucuacacccucgcccccaugggaaacggaaccggucgacgacgcgcccucuag

SEQ ID NO: 35812 - RNA, 1623 nt, Artificial Sequence
  derived and/or modified sequence opt11 from VP1__Norovirus__AER11358
augaaaauggccuccuccgacgccaacccaucagacggcucuacagccaaccucguuccagaagucaacaacgaggucauggcccuagaacccgucgucggcgccgcaaucgccgcccccgucgccggccaacaaaacgucaucgacccauggauccguaacaauuuuguccaagccccuggcggcgaguucaccgucucaccacgcaacgccccuggagaaauccuuugguccgcaccccucggaccagaccucaaccccuaccucucacaccucgcccgaauguacaauggauacgccggcgguuucgaaguccaggucauccucgccggcaacgccuucaccgccggcaaaaucaucuucgccgcggucccacccaacuuccccacagaaggauugucccccagccaagucaccauguucccccacaucaucguagacguccgccaacucgaaccaguccuaaucccccuacccgacguuagaaacaacuuuuaccacuacaaccagucaaacgacuccaccaucaaacucauagccaugcuguacacuccccuacgagccaacaaugccggcgacgacguguucacagucuccugccgcguccuaacccgccccucccccgacuucgacuucaucuuccuuguaccucccaccguggaaucccgcacaaaacccuucuccguccccguacucaccguagaagagaugaccaacucccgauuucccaucccccucgaaaaacuguucacgggccccuccuccgccuucgucguccagccacaaaacggaagaugcacaacagauggaguacuacucggcacuacacaacuuuccccagucaacaucugcacuuuccgcggcgaugucacccacauacccggcucucgcaacuacaccaugaaccucgcuucccaaaacuggaacuccuacgacccaaccgaagaaauccccgccccucucgguacaccagacuucguaggaaaaauccaaggaguccuaacccaaaccacccgcacuaacgguuccacccgcggccacaaagccacagucuacaccggcuccgccgacuucucaccaaaacucggccguguacaauucgccaccgacacagacaaugacuucgaaaccaaccaaaacaccaaauucacgcccgucggcgucauccaagacggcucuaccaccccacgcaacgaaccccaacaauggguacuccccagcuacuccggccgcaauauacacaacguccaccucgccccugccgucgcacccaccuucccaggcgaacaacuccuauucuuccgauccaccaugcccggaugcucagguuacccuaacauggacuuagacugccuccucccacaagaaugggugcaauacuuuuaccaagaagcugcacccgcacaauccgacguagcccuacuccguuuugucaacccugauacuggccguguacuuuucgaaugcaaacuccacaaaucuggcuaugucaccgucgcccacaccggccaacacgaucucgucauacccccaaacggauacuuccguuuugauuccugggucaaccaauucuacacccuagccccaaugggaaacggcacuggucgacgcagagcccuguaa

SEQ ID NO: 35813 - RNA, 1623 nt, Artificial Sequence
  derived and/or modified sequence opt11 from VP1__Norovirus__AER11360
augaaaauggccagcagcgaugccaaccccuccgacggcuccacagcaaaccucguacccgagguuaacaacgaagucauggcccuugaaccaguagucggagcagcaauagcagcgccagucgccggacaacaaaacgucauagaccccuggauccgaaacaauuucguccaagccccagggggcgaguucaccgugucccccagaaacgcccccggagaaauccuaugguccgcaccccucggccccgaucucaaccccuaccucucccaccuugccagaauguacaacggcuacgccggcgguuucgaaguccaaguuauacuagccggcaacgccuucaccgccggcaaaaucaucuucgccgcagucccacccaacuuccccaccgaaggccucucacccucccaagucacaauguucccccaccuaaucgucgacguucgccaacucgaacccguccuaaucccccuacccgacguaagaaauaauuucuaccacuacaaccaauccaacgacucaacaauuaaacuaaucgcuaugcucuacacaccccuacgcgcuaacaacgccggcgacgacgucuucacugucucuugccgaguacuaacacgucccucccccgauuucgacuuuaucuuccucguaccacccacagucgaaucacgcacuaaacccuucucaguccccguacuaaccguagaagaaaugaccaauucgcgcuuccccaucccccuugaaaaguuauuuaccggacccuccucagcauucguaguacaaccccaaaacggccgcugcacaaccgacggaguccuccucggcaccacacaacucucacccguaaacaucugcaccuuccgcggcgacgucacccacauuccaggcucacgcaacuacaccaugaaccuagccucccaaaacuggaacucauacgacccaaccgaagaaauccccgcaccccucggcacccccgacuuugucggcaaaauccaaggaguccucacccaaaccacacguaccaacggcucaacccgcggccauaaggccacagucuacaccggaucggccgacuucagccccaaacuaggccguguccaauucgccacagacacagauaacgacuucgagacaaaucaaaauaccaaauucacacccguaggcgucauccaagacgguuccaccacuccccgaaacgaaccccaacaauggguacuccccucuuacucaggccgaaacauccacaacguccaccucgcacccgccgucgcccccacauuccccggagaacaacuccuuuucuuccgcucaacaaugccaggaugcucuggauaccccaacauggaccucgacugccuccucccccaagaauggguccaauauuucuaccaagaagcugcccccgcccaaagugacgucgcccuccuuagauucgucaaccccgacaccggccgcgucuuauucgaaugcaaacuccacaaauccggcuacguaaccgucgcucacaccggccaacacgaccucgucauuccacccaacggauacuuccgcuucgacucaugggucaaccaguucuacacccucgcccccaugggaaacgguaccggccggcgacgcgcacuauaa

SEQ ID NO: 35814 - RNA, 1647 nt, Artificial Sequence
  derived and/or modified sequence opt11 from VP1__Norovirus__AEX10549
augaaaauggccuccaacgaugccgcacccuccaacgacggcgccgcaggccuuguccccgaaaucaacaacgaagccauggcccucgaacccgucgcuggcgccgccaucgcagcaccccuaaccggacaacaaaacaucauagacccauggaucaugaacaacuucguccaagcaccuggcggcgaguucaccguaucaccccgcaacuccccaggcgaaguccuucucaaccuugaacucggcccagaaauaaacccauaccucgcucaccuagcccgcauguauaacggcuacgcaggcggcuucgaaguccaagucguccucgccggcaacgcuuucacagccggcaaaguaaucuucgccgcuauuccgcccaacuuccccaccgacaaucuauccgccgcucagaucaccaugugcccccacguaaucgucgauguccgacaacuagaacccaucaacuuacccaugcccgacguccgcaacaacuucuuccacuacaaccaaggcuccgacucccgccuacgccucgucgccaugcuauacacaccacucagagcaaacaacucaggagacgacgucuucacagucuccugccgcguccuaaccagacccucucccgacuucuccuuuaacuuccuuguacccccuaccgucgaauccaaaacaaaacccuucacccuacccauccucaccaucucagaaauguccaacucccgauuccccguccccaucgacucccuccacacuucacccacugauaacaucgucguccaaugccaaaacggccgcgucacacuagacggagaacucaugggcaccacccagcuacucccuucacaaaucugcgccuuccgcggaguacuaacccgcuccacaucccgagcuuccgaucaagccgacaccgccaccccacgccuauucaacuaccacuggcauauacaacucgacaaccuaaacggaacccccuacgaccccgcagaagacauccccgcaccacucggcacccccgacuuccgaggcaaagucuucggagucgccucacaacgcaauccugacucaacaacccgcgcucacgaagccaaagucgacaccaccucugggagauucacuccaaaacuagguucacuagaaaucuccacugaauccggcgacuucgaccaaaaccaacccacacgauuuacccccguaggcaucggcguagacaacgaagccgacuuccagcaauggacccuacccgacuacucaggccaauucacacacaacaugaaucuagccccagccguugccccaaauuucccaggcgagcaauuacucuucuuccgaucgcaccucccuucgucaggcggccgcagcaacggcauccucgauugccucgucccccaagaguggguccaacacuucuaccaagaauccgcucccgcccaaacccaagucgcccuaguaagguacgucaauccugacacaggccgaguccucuucgaagccaaacuucacaagcucgguuucaugacaauugcaaaaagcggcgacucccccaucaccguacccccgaacggcuacuuccgcuucgaauccugggucaaccccuucuacacccuagcucccaugggcaccggcaacggacgccgaagaauccaauaa

SEQ ID NO: 35815 - RNA, 1623 nt, Artificial Sequence
  derived and/or modified sequence opt11 from VP1__Norovirus__AEX91910
augaagauggccuccucagacgccaacccguccgacggcucuacagccaaccucguacccgaagucaacaacgaagucauggcccucgaacccgucgucggugcugcaaucgcagccccgguagccggccaacaaaacgucauagaccccuggauucgcaauaacuuuguccaagcacccggcggagaguucaccguuucaccccgaaacgcacccggagaaauccuaugguccgcgccucucggcccagaccucaacccuuaccucucccaccucgcaagaauguacaacggcuacgccggaggcuucgaaguccaaguaauccucgccggcaaugccuucaccgccggcaagaucaucuucgcagcugucccuccaaacuuccccacugaaggauuauccccaucccaagucaccauguucccccacaucaucguugacgucagacaacucgaaccaguccugauaccccuccccgacguccgcaacaacuucuaccacuacaaccaauccaacgaccccacaaucaaacuuaucgcaaugcucuacacaccccuccgcgcuaacaacgccggagacgacgucuuuaccgucuccugccgcguccucaccagaccaucccccgauuucgacuucaucuuccuagucccucccaccgucgaaucucguacaaaacccuucuccguaccaguccuuaccguagaagaaaugaccaacucacgcuuucccaucccccuagaaaaacucuucacuggcccaucaucagcauucgucguccaaccucaaaacggccgcugcacaaccgacggcguccuccucggcaccacccaacuaagccccgucaacaucugcaccuuccgaggcgaugucacccacaucccaggcuccagaaauuacaccaugaaccucgcaucccaaaacuggaacucuuacgacccaacugaagaaacgcccgcaccccucggcacccccgacuucgucggaaaaauacaaggaguacucacccagacuaccagaacaaacggcagcacccgcggccacaaagccacuguauacacuggcagcgccgacuucucccccaaacucggccgaguccaauucgccaccgacaccgauaaugacuucgaaaccaaccaaaacacaaaauucaccccaguaggcgucauccaagacgguagcacaacaccccgcaacgaaccacaacaguggguccuccccagcuacuccggccgcaauauccacaacguucaccucgccccugccguagcccccaccuucccaggcgaacagcuacucuucuuccguuccacuaugccaggcugcuccggcuaccccaacauggaucuagacugccuccucccccaagaaugggugcaauacuucuaccaagaagcugcccccgcacaaucagauguagcucuccuaagauucgucaacccagacaccggccgaguucucuucgaaugcaaacuccacaaaucaggauacgucaccgucgcucacaccggccaacacgaccucguaaucccacccaacggcuacuuccgcuucgacagcugggucaaccaauucuacacccucgcaccaaugggcaauggaaccggccgacgcagagcccuauga

SEQ ID NO: 35816 - RNA, 1737 nt, Artificial Sequence
  derived and/or modified sequence opt11 from VP1__Norovirus__AFD30970
augaaaauggccucaucagacgcaaccccaagcucagacggagccggcaaccucguccccgaaagccagcaagaaguccucccccucgcacccguagccggugccgcccucgccgcaccagucgucggccaacaaaacaucaucgaccccuggauaaaagaaaacuucguccaagcaccccaaggcgaauuuacgguuucccccaaaaacagcccuggagaaguccuaguaaaccucgaacucucgccccgccucaacccauacuuagaccaccucuccaaaauguacaacgccuacgcaggaggcauggaagucgaaaucauccucgcuggaaacgcauucaccgccggcaaaguccucaucgcugccguaccacccaacuuccccauugaaaacauauccgccucccaggcuagccaguucccccacguaaucguagacguacgaacccucgaacccauucgacucccccucccagacguaaggacaaacuucuuccacuacaccacccaagaagaaccccguaugcgcaucgucgcauggcuauacacaccacuacgcacaaacggaucaggcgacgacuccuucacagucuccggaagaauacucacccgaccuucacccgacuucgaauuuuccuuccuuguacccccaaccgucgaaacgaaaacggucagcuucucgguacccggccuggucguggaagacaugagcaauucucgauggccugcccaaaucaacggccuagucguccguggcaacgaagcccaagucguccacuuccaaaacggccgcugcaccaccgaaggcacccuacuaggaaccaccacacucuccauuaacucgaucugcggccuccgcggccucuccgugagccaagccucaguccgcggugcacccgcacuaaccgaagaaaugccaccccuugaagacgaagucgccgacggcgcagcagccaccuacacacuagcccgagcugcagacaccacccucuggcuccgagucgaagaacccgacggacgccccuacgacauuuucggcgaccaacccgcaccccuaggcacccccgacuuuacagccguaauaguaggcaccgccauacgcccccgaaccgcaucaggugccuaccugcacgaugcuuacgucgacacaaccccaggcgacgccgacuucacacccucaaccggaaacacuaaaaucguccuccgcggcggaggaucaggccacguaggccaaggccacuauuggcaguuccguccaaucgccguagaaggaggcggaucacguccccaauaccaagaauacaaccugccagacuaugccggccccacugcguccaaccacgaucucgccccgcccguggcacccagaaugccaggagaacuucuccuucucuucgaaagcgauaugccugucugggacaacggagccggagcagccccagcccaaaagauccacugccuucuccccaacgaguucaucacacaccucuucgaccuacaagcccccgcacucgccgaagcagcacuccugcguuacguacaccccgacuccggucgcacacuauuugaaugcaagcucuauagagaaggcuacauggucguagccgccccggccggucgccuaaacuucccccuagacggcuacuuccgcuucgacucauggguaagcgcuuuuuacauucuaucacccgucggcagcggacaaggccgccgcggcagauccaaagccgccuaa

SEQ ID NO: 35817 - RNA, 1623 nt, Artificial Sequence
  derived and/or modified sequence opt11 from VP1__Norovirus__AFH88383
augaugauggcauccaaagacgcacccaccucucccgauggcgcuuccggagcaggccaacuaguccccgaagcuaacaccgccgaacaaauaucaauggaccccguagcaggggccucaaccgcugucgccaccgccggccaagucaacaugauagaccccuggaucuucaacaacuucguucaggcaccacaaggcgaauucaccaucucaccaaacaauacaccaggcgacauccucuucgaccuccaacucggcccccacuuaaacccuuuccucgcacaccucucccaaauguacaacggaugggucggcaacaugcgagucagaauccuccucgccgguaacgccuucaccgcuggcaaaaucauuaucuguugcgucccacccggcuucgacgcccgcauacucaccauagcacaagccacauuauucccacaccuaaucgcagacguccguacccucgaaccagucgaacucccucuagaagacguucgaaacguacucuaccacaacucaucccaaccucagcccaccaugcgccucgucgccaugcuauacaccccccuccguaccggaggcggauccggcggaacagacgccuucgucguagcuggccggguacuaaccugccccgccccagacuucucauuucucuuccuagucccccccuccgucgaacaaaaaacacguguauuuuccguacccaacaucccccuaaaggaccuauccaacucccggguaccaguacccguccaaggaauguucaugucccccgacguaaaccaauccguacaguuccaaaacggccgcugccaaaucgacggccaacuccaaggaacuaccccuguaucccucucccaacugugcaaaauccgcggcaaaaccucaucaaacgcucggguccucaaccucuccgaagucgacggaacacccuucaucccccucgaauccccagcacccgucgguuuccccgaccucggaggcugcgacuggcauguaaauuucaccuuccaagcacaaaaucaagacccaucccaaucggucacauucgccaccaacgacgcaucauucguccccuaccuaggcuccauaucaccccacaacgggggagacuuccacgcuggcgacaucauuggaucacuaggauggaucuccgccccaucagacaacucccaacucaacgucuggacaauucccaaauacggauccucccuccccgacgucacccaccucgcacccgccguguucccccccggcuucggagaagucauacucuacuucuauucaaccuuccccggauccggccaaccaucacaacuccaaguacccugccuacucccccaagaauucaucacccacuucugcaacgaacaagcaccuaucgccggcgaagcagcccuacuccacuacgucgacccagacaccggccggaaccucggcgaauucaaacucuaccccgauggcuucaugaccuguguacccaacuccguguccucaggcccccaaacccuaccaauuaacggcgucuucgucuucgucuccugggucuccagauucuaccaacucaaaccagucgggaccgccuccgccgcuaggcgccucggccuccgccgcaucuaa

SEQ ID NO: 35818 - RNA, 1671 nt, Artificial Sequence
  derived and/or modified sequence opt11 from VP1__Norovirus__AFJ21376
augaaaauggccuccuccgacgcagccccauccacagacggagcuggcaaccuaguaccagaaucacaacaagaaguccucccacucgcacccgucgccggcgcugcccuagccgcacccgucguaggccagacaaacaucauagaccccuggaucaaagaaaacuucguccaagcgccccaaggcgaguucaccguaucacccaaaaacuccccaggugaaauccucguaaaccuagaacucggaccaaaacugaacccauaccuugaccaucucucccguauguacaauuccuacgccggcggcauagacgucauggucguacucgccggcaaugcauucaccgccggcaaaguccuuaucgccgccauacccccaaacuucccugucgaaggcguuagcgcuucccaagccacacaauucccacacgucaucaucgacguccgcacccuagaccccguccggcucccccuccccgauguccgaucaaccuucuuccacuacaccaacgacaccgaaccaaaaaugcgccucgucaucuggcucuacaccccacuccgcaccaacgguuccggagacgacucuuuuacagucuccggcagaauacuuacccgcccaucccaagacuucgaauuugccuuccuaaucccgcccaccgucgaaaccaaaaccacuccuuucagcguacccggcuucucuguccaagaaaugucaaacucucgcuggcccgcugcuaucuccgccaugguaguucgcggaaacgaaccccaagucguacaauuccaaaauggccgagcacaccucgacggaaugcuccuuggaaccacaccagucucuccaaacuacauagccuccuaccgagguaucuccacagguaacucucgcuccgcaucaucagaagccgacgagcgcgccgucggcucauucgacguuuggguccgccuccaggaaccagacggacaacccuaugacaucuuuggaaaacaaccagcccccauaggcacccccgacuucaaagccguaaucgucggcuucgccgcccgcccccucacguccggcagcuacgcaaacgaggcauacguaaacacaaccgccucagauuacgcacccgcaacaggcaacaugcgauucaccguccgcaacggcggaaccggccacaucucagccaacaaauacugggaauuuaaauccuucggcgucgaaggagaacgccacaccgacauccaauaccaggaauacgaacuccccgacuacuccggacaagucgccucaaaccacaaccucgccccacccgucgcaccccgaaugcccggcgaaucccuccuacucuuccaaucaaacaugcccgucugggacgacggccacggcgaauccacuccaaagaaaauccacugccuccuuccacaagaguucaucggacacuucuucgaccgacaagcacccucauuaggcgacgccgcacuucuacgcuacgucaaccaggaaacaaaccgcguauuauucgaaugcaaacuauaccgggacggauacauaacuguagcagcgucuucaggccuacuagacuucccacucgacggcuucuuccgauucgacuccugggucucauccuucuacauacucucacccgucggcucaggccaaggaagaagaggccgcguccgcuuccaauag

SEQ ID NO: 35819 - RNA, 1608 nt, Artificial Sequence
  derived and/or modified sequence opt11 from VP1__Norovirus__AFJ21379
augaaaauggccuccuccgacgcugcccccucaaacgacggugcagcaggucucguccccgaagucaauaacgagaccauggcucucgaaccagucgccggcgccuccauagccgcaccccuaaccggccaaaacaacgucaucgaccccuggauccgccucaacuucguacaagcccccaacggagaguucaccguaucccccagaaacagccccggugaaguccuccucaaccucgaacucggaccugaacuaaaucccuaccucgcccaucuaagccgaauguauaacggcuacgcaggcggcguugaaguucaaguccuacuugccggaaacgccuucaccgcaggcaaacucguauucgccgccguaccuccacacuucccccuagaaaacaucucacccggccaaaucaccauguuuccccacguaaucaucgacguccgaacccuagaacccguacuucuaccccucccagacguccgcaauaacuucuuccacuacaaccaacaaaacgaaccaagaaugcgucucgucgccaugcucuacaccccacuccgcuccaacggaucaggcgaugaugucuuuaccgugucaugccgcguacuaacccgucccucccccgacuucgacuucaacuaccucguacccccaacugucgaauccaaaaccaaaccuuucacgcucccaauccucacaaugggggaacucaccaacucccgauucccagucccuaucgacgaacuauacaccucccccaacgaaucccuagucguccaaccccaaaacggccgcugcgcccucgacggcgaacuccagggcacgacccaacuccuucccaccgccaucugcuccuuccgcggccgcaucaaucaaaaagucagcggcgacaaccaugucuggaacaugcaagucaccaacauaaacggaacccccuucgaccccaccgaagacguccccgcaccacuaggcacacccgacuucucaggcaaacuauucggcguccuaucccaacgagaccacgauaaugccugccgcucacacgacgcagucaucgccaccaacuccgcaaaauuuacccccaaacucggagccauccaaaucggaacuugggaacaagacgacguccauauaaaccaaccaaccaaauucaccccgguuggccucuucgaaucagaaggauucaaccaauggacccucccuaacuacuccggcgcacucacucucaacaugggccucgcgccacccguagccccaacauuccccggcgaacaaauccuauucuuccgcucccacaucccccuuaaaggcggcgucgccgaccccgucauugacugccuccuuccacaagaauggauacaacaccucuaccaggaauccgccccaucccaaaccgacgucgcccucauccgcuucacaaacccggacacaggccgcguccuauucgaagcaaaacuacaccgaagcggguacaucacagucgccaacacuggcucccgccccaucguaguuccagccaacggcuacuuccgcuucgacuccugggucaaucaauucuacucacuugcccccaugggaaccggcaacggccgccgacgcguccaauaa

SEQ ID NO: 35820 - RNA, 1608 nt, Artificial Sequence
  derived and/or modified sequence opt11 from VP1__Norovirus__AFJ21382
augaaaauggccucuaacgacgcagccccauccaacgacggcgcagccggccuaguucccgaagucaacaacgaaaccauggcacuagaaccggucgccggagccagcaucgcagccccacucaccggccaaaacaacgucauagacccauggauccgacucaacuucguccaagcccccaacggcgaguucaccguauccccacgcaacucccccggagaaguccugcucaaucuagaacucggaccagaacucaacccuuaccucgcacaccucagccgaauguacaacggauacgcaggaggcgucgagguccaaguacugcucgccggcaacgcauucaccgccggcaagcucguauucgcagccgucccaccccacuucccccuagaaaacauuucacccggucaaauaacuauguucccccacgugaucauagacguucgaacccucgaacccguccuccucccccuucccgacgucagaaacaauuucuuccacuacaaccagcagaacgaaccccgcaugcgccucguagcaaugcuauacacuccccuaagaucaaacggcucgggcgacgacguauucaccgucuccugccgcguccucacacgaccgucaccagacuucgacuucaacuaccucguaccacccacugucgaaucuaaaacaaaacccuucacccuacccauccucaccauaggcgaacucacaaauuccagauuccccguccccauagacgaguuauacaccucgcccaacgaaucccuagucguccaaccccaaaacggacgaugcgcacuagacggagaacuccaaggcaccacccaacuacucccaaccgccaucugcucauuccgcggacgcaucaaccagaaagucagcggcgaaaaucacguauggaacaugcaagucaccaacaucaacggcaccccuuucgacccaacagaagacguaccagcaccccucggcaccccggacuucuccggcaaacucuucggcguccuaagccaacgggaucacgauaacgccugccgaucgcacgacgccgucauagcaacaaacucggccaaguucacccccaaacuuggcgcaauccaaaucggaaccugggaacaagacgauguccacaucaaccagcccaccaaauucacccccguaggccucuucgaauccgaaggcuucaaccaauggacccuacccaacuacuccggcgcacuuacacucaacaugggccucgcaccacccgucgcccccacuuuccccggagaacaaauacuuuucuuccgcucacacaucccccuaaaaggcggagucgccgaucccgucaucgacugucuccuaccacaagaauggauccaacaccuuuaccaagaauccgcccccucucaaaccgacgucgcccucauccgcuucacaaaccccgacacugguagaguacuauucgaagccaaacuccacagaagcggauacaucaccguagccaacaccggaagccgccccaucgucgucccugccaacggcuacuuccgauucgacucauggguaaaccaauucuacucucucgcucccaugggcaccggcaacggccgccgccgaguucaauaa

SEQ ID NO: 35821 - RNA, 1623 nt, Artificial Sequence
  derived and/or modified sequence opt11 from VP1__Norovirus__AFJ21387
augaaaauggcuucuaacgacgccaaccccagcgacggaucugcugccaaccucgucccugaaguaaacaaugaagucauggcccucgaacccguagucggugccgccaucgccgcccccgucgccggacagcaaaauguaauagaccccuggauucgcaacaacuucguccaggcccccgggggcgaguucaccgucucuccccgaaacgcccccggcgagauacucugguccgcaccccucggccccgaccucaaccccuaccuaucccaccuagcacgaauguacaacggcuacgccggcggcuucgagguacaagucauccuugcuggcaacgccuucaccgccggaaaaaucaucuuugcagcagucccacccaauuuucccaccgaaggacuaucacccucccaagucaccauguucccccacaucaucgucgauguccgccagcucgaacccguccucaucccccuacccgacguccgcaacaacuucuaccacuauaaccaaucaaacgacagcacaauaaaacucaucgccaugcuuuacacuccccuccgagcuaacaacgcgggugaagacguauucaccgucucaugccgaguccucacacgaccaucccccgacuucgacuucaucuuccucgucccaccaaccgucgaaucccgaaccaaacccuucacagucccaauauuaaccgucgaagagaugaccaacuccagauuccccaucccccuagaaaaacucuucaccggccccuccggcgcauucgucguccaaccccaaaauggacgcugcaccacagacggaguccuccucggcacuacccaacuauccccagucaauaucugcacauucaggggugacgucacccacaucgccggcucccgcaacuacaccaugaaccuagccucacucaacuggaacaacuacgaccccacagaagaaauccccgcaccccucggaaccccagacuucgucggcaaaauccaaggcguccuaacccaaaccaccaaaggcgacgguuccacacgcggccacaaagccaccaucuacaccggauccgcacccuucacucccaaacucggcucgguacaauucuccaccgacaccgaaaacgacuucgaaacccaccaaaacaccaaauuuacacccgucggagugauacaagacggcucaacaacccaucgaaaugagccacaacaauggguccuacccuccuacagcggacgcaacguucacaacguccaccuagcaccagccguugcacccaccuuccccggagagcaacuccuuuucuucagaucaacaaugcccggcugcucaggauaccccaacauggaccucgacugccuacucccacaagaauggguccaacauuucuaccaggaagccgcccccgcccaauccgacgucgcccuacucagauuuguaaacccagacaccggccgcguacuauucgaaugcaaacuucauaaauccggcuacguaaccguugcccacaccggccaacaugaccucgucaucccucccaauggcuacuuccgcuucgacuccugggucaaccaguuuuacacacucgcgcccaugggcaacggaaccggucgccgcagagcccucuag

SEQ ID NO: 35822 - RNA, 1623 nt, Artificial Sequence
  derived and/or modified sequence opt11 from VP1__Norovirus__AFJ21388
augaaaauggcauccaacgacgccaaccccucagauggcucagccgccaaccuagucccggaagucucgaaugaagucauggcccuugagcccgucgucggcgccgcaaucgccgcccccgucgcaggacaacaaaacguaaucgaccccuggauccgcaacaacuucguccaagcuccuggaggcgaguucaccguaagccccagaaacgcaccaggcgaaauccucugguccgcgccccucggcccagaccucaacccauaccucucacacuuagcccgcauguacaacggauacgcuggcggcuuugaaguacaaguuaucuuagccggcaacgcuuucaccgcuggaaaaaucaucuucgccgccgugcccccaaacuucccaacagaaggccuaucaccaucacaagucacuauguucccccacaucauaguagauguccgccaacucgaacccguucucaucccacucccugacguccgcaauaacuucuaccauuacaaccaaucaaacgacuccaccaucaaacucauagccaugcucuauacaccccuacgcgccaacaacgccggcgaagacgucuuuaccgucucaugcagaguccucacccgccccagccccgacuucgacuucaucuuucuagucccgccaaccgucgaaucacgcaccaaacccuuuacaguccccauccuaaccgucgaagagaugacaaacucccgcuucccaauccccuuggaaaaacuauucaccggcccauccggcgcauucgucguccaaccccaaaacggacgcugcacaaccgacggcguacuccuaggcaccacacaacuaucaccagucaauaucuguaccuuccgcggagacgucacacacaucgccggaagucgcaacuauaccaugaaucucgccucccucaacuggaacaacuacgaccccaccgaagaaauccccgcaccccuaggaaccccagauuucgucggcaaaauccaaggcgugcuuacccaaaccacuaaaggagacggauccacccgaggccacaaagccaccguauacaccggcuccgcacccuuuacaccaaaauuaggcucaguccaauucuccaccgauaccgaaaacgacuucgaaacucaccaaaacacuaaguucaccccaguaggcgucauccaagacggcagcacaacacaccgaaacgaaccacaacaauggguacuccccuccuacuccggaagaaacguccacaacguccaccuugcacccgccguagcccccaccuuucccggcgaacaacuccuuuucuuccgcuccaccaugccuggcugcuccggauaccccaacauggaccuggacugcuuacucccccaagaguggguacaacacuucuaucaagaagccgcccccgcccaauccgacgucgcccuacuccgcuucgucaaccccgacacaggacgcguccucuucgaaugcaaacuacacaaaucaggcuacgucaccguugcacacacaggccaacacgaccucguaauaccucccaauggcuacuuccgcuucgacuccuggguaaaccaauucuacacccuagcacccaugggcaacggcaccggccgccgacgugcccucuaa

SEQ ID NO: 35823 - RNA, 1623 nt, Artificial Sequence
  derived and/or modified sequence opt11 from VP1__Norovirus__AFJ21389
augaaaauggccagcaacgacgccaacccaucugacggcuccgcagcaaaccucgucccagaaguaaauaacgagguuauggcccucgaacccgucguuggcgccgccauagccgcccccguagcaggccaacaaaacguaauagacccauggauccggaacaacuucguccaagcacccggaggagaguucaccgucucaccacgaaacgcccccggagaaauccucuggucugcaccccucggaccugaccuaaacccauaccucucccaccucgcccgaauguacaacggcuacgccggagguuucgaaguccaaguaauacucgccggcaacgccuucaccgccggcaaaauaauauuugcagccgucccucccaacuuccccacggaaggacucucaccaucacaaguaaccauguucccacauaucaucgucgacguacgacaacuagaacccguacucauccccuuaccagacguccgaaacaacuucuaccacuauaaccaaucaaacgacaguaccaucaaacuaauagcaaugcuauacacaccccuucgcgccaacaacgccggcgaagacgucuucaccgucuccugccgcguccuuacccgcccaagccccgacuucgacuucaucuuccuuguaccaccgaccgucgaaucccgaaccaagcccuucacaguaccaauucucacggucgaagaaaugaccaacucacgcuuccccauuccgcuagaaaaacuauucaccggaccuucaggagcauucguaguacaaccgcaaaacggccgaugcaccaccgacggcguacuccuuggcacaacacaacucagccccgucaacaucugcaccuuccgcggcgacgucacucacaucgccggcucccgcaacuacaccaugaaccucgcauccuuaaacuggaacaacuacgauccgacagaagaaaucccagcaccccucggaaccccagacuucgucggcaaaauccaaggcguccucacccaaacgaccaaaggagacggauccacccgaggccacaaagccacagucuacacugguucugccccauucaccccuaagcucggcucaguacaauucuccacugacaccgaaaacgacuucgaaacucaccaaaacaccaaauucaccccagucggcguaauccaagacggcuccaccacccaccgcaacgaaccccaacaauggguccuaccaucauacagcggcagaaacguucacaacguacaccucgcccccgccguagccccaaccuuuccuggugaacaacuccuauucuuccgcuccaccaugccagguugcucaggcuaccccaacauggacuuagacugccuacuaccccaagaauggguacaacacuucuaccaagaagccgcccccgcucaguccgacguagcucuacuacgauucgucaaccccgacacgggccgaguacuauucgaaugcaaacuccacaaaucaggcuacguaacugucgcccacacuggccaacacgaccucgucaucccuccuaacggcuacuuccgcuucgacucuugggucaaccaauucuacacccucgcccccaugggaaacggcacaggccgccgucgcgcacucuag

SEQ ID NO: 35824 - RNA, 1623 nt, Artificial Sequence
  derived and/or modified sequence opt11 from VP1__Norovirus__AFJ21390
augaagauggcaucaaacgacgccaaccccuccgauggaagcgcagcgaaccucguacccgaagucaacaacgaagucauggcccuagagcccgucguaggcgccgccaucgccgcacccguggcaggucaacaaaacguaaucgacccauggauccgcaacaacuucguccaagccccagguggcgaguucaccgucuccccacgcaaugcucccggagaaauccuaugguccgcaccccuaggcccugaccucaaucccuaccuaucacaccucgcaagaauguacaacggcuacgccggcggauucgaaguccaaguaauccuagcaggaaacgccuucacagccggaaaaaucaucuucgccgcaguacccccaaacuucccaaccgagggccucucccccucacaagucaccauguucccacacauaauagucgacguacgccaacuggaaccaguccucauaccccuucccgacguacgcaacaacuucuaccacuauaaccaauccaacgacucaaccaucaaacuaaucgcuaugcucuacaccccacuacgcgcaaacaacgccggcgaagacgucuucaccguaucaugcagaguacucacccgacccucccccgacuucgacuucaucuuucuaguacccccaaccgucgaaucccgcaccaaacccuucaccgucccaauacuaacggucgaagaaaugaccaacucaagauuccccauaccccucgaaaaacucuucaccggcccaucuucugccuucgucguccaaccccaaaacggacgcugcaccaccgacggaguccuucucggcaccacccaacucuccccugucaacaucugcaccuuccgaggcgacgucacccacaucgccggaucccgcaacuaugcaaugaaccucgcaucacucaauuggaacaacuacgacccuacagaagaaaucccagccccacucgguacacccgacuuugucggcaagauccaaggacuacuuacacaaaccaccaaaggcgacggaucgacacgaggccacaaagccacugucuacaccggcagcgccccauucacacccaaacucggcuccguacaguucucuacugauacagaaaacgacuucgaaacccaccaaaauacaaaauucacccccguaggcgucauccaagauggauccacaacccaccgcaacgaaccccaacaauggguacuaccaucauacuccggccgcaacguccacaacguucaccuagcacccgcggucgcccccaccuuccccggagaacaacuacucuucuuccgaucaaccaugcccggcugcuccggcuaucccaacauggaccucgauugcuuacucccccaagaauggguacaacacuucuaccaagaagcagcccccgcgcaaucagacguugcacuacuccgcuucguuaacccugacaccggccgaguucucuuugaaugcaagcuccacaaauccgguuacgucaccgucgcucacacaggccaacacgaccucgucauacccccuaacggcuacuuccgcuucgacucaugggucaaccaauucuacacacuagcucccaugggcaacggaaccggccgccgccgcgccuuauaa

SEQ ID NO: 35825 - RNA, 1623 nt, Artificial Sequence
  derived and/or modified sequence opt11 from VP1__Norovirus__AFJ21391
augaaaauggcuuccuccgacgcaaaucccucagauggcuccaccgccaaccuaguccccgaaguuaacaacgaagucauggcccucgaacccgucgucggagccgccaucgccgcccccgucgcaggccaacaaaacgucauagaccccuggauacgcaacaacuucguccaagccccaggcggcgaauuuaccgucuccccacgcaaugcccccggcgaaauccucugguccgcuccccucggacccgaccuuaacccauaccucucacaccucgcccgaauguauaacuccuacgccggaggcuucgaaguccaagucauccucgccggcaacgccuucaccgccggcaagaucaucuucgccgccguaccacccaacuuccccaccgaaggccucucacccucccaaguaacuauguucccacacaucaucgucgacguacgacaacuugaacccguucuuaucccccucccagacguccgcaacaacuucuaccacuauaaccaauccuccgaccccaccaucaaacucaucgcaaugcucuacacuccccuccgcgcaaacaacgccggagacgacgucuuuaccgucagcugcagaguucucacccgccccuccccagacuucgacuucauauuccucgucccucccacaguagaaucccgaacaaaacccuucucaguccccauacucacagucgaagaaaugaccaacucucgauucccuauaccacucgaaaaacucuuuacaggccccuccuccgccuucgucguccaaccccaaaacggaagaugcaccacagacggcguccuucuuggcacaacccagcucucaccaguaaauauuugcaccuuccgaggcgacguuacccacaucgccggcacucaagaauacaccaugaaccucgcaucccaaaacuggaacaacuacgaccccaccgaagaaaucccagccccacucgguacgcccgacuucgucggaaaaauccaaggcguacuaacccaaaccacccgacgagacggcucgacccgcggucacaaagccaccgucagcaccggcuccguccacuucacccccaaacugggccgcauacaauucuccaccgacaccucuaacgacuuugaaaccggacaaaacacccgguucacccccguagguguaguacaagauggauccaccacccaccaaaacgaaccacaacaauggguccuccccaacuacucaggccgcgauucacacaacguccaccucgccccugccgucgcaccauccuuccccggagaacaacuauuauucuucagaagcaccaugcccggcugcuccggauaccccaacauggaccucgauugccuccuaccccaagaauggguccaacacuuuuaccaagaagccgcaccagcccaaucagaugucgcccuacuacgcuucgucaaccccgacaccgggcgagucuuauucgaaugcaaacuucacaagagcgguuacguaacuguagcccacacaggucaacacgaccucgucaucccacccaacggauacuuccgcuucgacuccugggucaaccaauucuacacacuagcccccauggggaauggcacaggccgccgccgugcccucuaa

SEQ ID NO: 35826 - RNA, 1623 nt, Artificial Sequence
  derived and/or modified sequence opt11 from VP1__Norovirus__AFJ21392
augaaaauggccucuuccgaugcuaaccccucggacggcucaaccgcgaaccuaguucccgaagucaauaacgagguaauggcccucgaacccguuguaggcgccgcaaucgcggcccccguagccggacaacaaaacgucaucgaccccuggauccgaaauaacuuuguccaagccccaggaggagaguucaccgucucaccucgcaacgcccccggcgaaauccucugguccgcaccccucggccccgaccuaaacccauaccuuucccaccuagcccgcauguacaacggauacgccggcggauucgaaguccaagucauccuugccggcaacgcauucaccgcuggcaaaaucauuuuugccgccgucccacccaacuuuccaaccgaaggccucuccccuucccaagucaccauguucccucacaucaucgucgacguacgccaacucgaacccguacuaauuccacuucccgacguacgcaacaacuucuaccacuacaaccaauccaacgacuccaccauaaaacuuaucgccaugcuguacaccccucuccgagcaaacaacgcuggcgaagacgucuucacaguuuccugcagaguucucacucgccccuccccagacuucgacuucaucuuucucguucccccaaccgucgaaucccgcaccaagccuuucaccgucccuauccuuaccgucgaagaaaugaccaacucuagauucccaauaccacuagaaaaacuauucacuggccccuccggcgccuucguaguccaaccccagaacggucguuguacaaccgacggcguucuccucggaaccacccaauuaucccccgucaacaucugcaccuuccgcggcgacgucacccacaucgccggaagccgcaacuacacuaugaaccuugccucgcucaacuggaacaacuacgaucccaccgaagaaauccccgcaccccuuggcacaccagacuucgugggcaaaauacaaggcguccuaacccaaaccacaaaaggagacggcuccacccgcggccacaaagcaacagucuacacagguucagcccccuucaccccuaaacucggcucuguacaauucucaacagacaccgaaaacgacuucgaaacccaccaaaacaccaaauuuacacccguaggcgucauccaagacggcucaaccacacaccgaaaugaaccacaacaauggguccucccaagcuacuccggacgaaacguacacaacguacaccuagcuccagccgucgccccaaccuucccaggcgaacaacuacucuucuuccgcuccacaaugcccggcugcucaggcuaccccaacauggaccucgacugccuacuuccccaagaauggguccaacacuucuaccaagaagccgcccccgcccaauccgacgucgcccuccuucgauucgucaacccagacaccggcagaguucucuucgaaugcaaacuucauaaguccggcuacgucacuguggcccacaccggccaacacgaucucgucaucccacccaauggcuacuuccgcuucgacgcaugggucaaccaauucuacacccucgcccccaugggcaacggcaccggaagaaaacgcgcccuuuaa

SEQ ID NO: 35827 - RNA, 1623 nt, Artificial Sequence
  derived and/or modified sequence opt11 from VP1__Norovirus__AFJ21393
augaaaauggccucaaacgacgccaacccaucugacggcucugcugcaaaucuaguacccgaagucaacaacgaaguaauggcccucgaaccaguagucggcgccgccaucgccgcccccgucgccggccagcaaaacguaaucgacccauggauacgcaacaacuucguacaagcccccggaggcgaauuuacagucucaccacgcaacgccccaggcgaaauucucuggucagcaccccucggacccgaccuuaacccauaccugucccaccucgcacggauguacaacggguacgcaggcggauucgagguacaagucauccuagcaggaaacgccuuuaccgccggaaaaaucauauucgcggcugugcccccaaacuuccccaccgaaggacugucccccagccaagucaccauguucccccacauaauagucgacguccgacaacucgaaccaguccuaaucccacuaccugacguaaggaauaacuucuaccacuauaaccaauccaacgacuccacaauaaaacucaucgccaugcucuauacaccccuccgcgcaaacaacgccggagaagacgucuucaccguaucaugccgaguccuaacucgcccaucacccgacuucgacuucaucuuccuuguaccacccaccgucgaaucccgcaccaaacccuucaccguacccauacucacggucgaagaaaugaccaacagccgcuuccccauaccccucgaaaaacuauucaccggacccucaucugccuucgucguacaaccccaaaacggccgaugcacaacugauggcguccuacuaggcaccacacaacuaucccccgucaauaucuguaccuuccgcggcgaugugacccacaucgccggcucccgaaacuauaccaugaaccucgccagccuaaacuggaacaacuacgaccccacagaagaaaucccagccccacucgguacacccgacuucguuggaaaaauccagggcguacucacccaaacuacaaaaggagacggcuccacucgcggacauaaggccacagucuacaccggcuccgcccccuucacccccaaacucggcuccguccaguucuccacugauacagaaaacgacuucgagacccaccaaaacaccaaauucaccccaguaggagucauccaagacggcucuacaacccaucgaaacgaaccccaacaauggguccuccccucauacuccggccgaaacguucacaacguacaucuugcacccgccgucgcccccacguuccccggcgaacaacuacuuuucuuccgcucaaccaugcccggcuguucaggcuaccccaacauggaccucgauugccuucucccccaagaauggguccaacacuucuaccaagaagcagcacccgcucaguccgacguggcacuccuccgcuucguaaaccccgacacuggacgcguacuauucgaaugcaaacuccacaaauccggauacguaaccgucgcccacaccggucaacacgaccucgucaucccaccaaacggcuacuuccgauucgauagcuggguuaaccaguuuuacacacuggcccccaugggcaacggcaccggccgccgcagagcucucuaa

SEQ ID NO: 35828 - RNA, 1623 nt, Artificial Sequence
  derived and/or modified sequence opt11 from VP1__Norovirus__AFJ21394
augaaaauggcaucaaacgacgccaaccccuccgauggcuccgcugccaaccucguccccgaaguaaacaacgaagucauggcccuagaacccgucgucggcgcugcaaucgccgccccagucgcuggacaacaaaacgucaucgacccauggauccgcaacaacuucgugcaagcccccggcggcgaauuuaccgucucaccccgcaacgcaccaggcgaaauucucuggucugcaccccucggacccgaccuaaacccauaucuaagccaucucgcccgcauguacaacggauacgccggcggcuuugaaguacaagucauacucgcaggcaacgccuuuacagcaggcaaaaucauauucgcagccguuccacccaacuuccccaccgaaggccucucccccucacaagucaccauguucccccacaucaucgucgacguccgacaacuagaacccguccuaauaccccuacccgacguccgcaacaacuucuaccacuauaaucaaucaaaugacagcacuaucaaacuuaucgcaaugcucuacacuccccuucgagccaacaacgccggagaagacgucuucaccgucuccugccgcguucucacacgcccaucucccgacuucgacuucaucuuucucgucccucccacugucgaaucccgcaccaaacccuucaccguucccauccuuaccgucgaagaaaugaccaacucccgcuuccccaucccccuagaaaaacuauucacaggcccguccggagccuucguaguccaaccccaaaacggccgcugcaccaccgacgguguacuacuaggcacaacacaacugucgccagugaacaucugcaccuucagaggcgacgucacccacauagcaggcucccgaaacuacaccaugaaccuagccucacugaauuggaacaacuacgacccaaccgaagaaauccccgcgccccucggcacccccgacuuugucggcaaaauccaaggcguccuuacacaaaccaccaaaggcgacgguucaacccgcggacauaaagccacugucuacaccggcuccgcacccuucacucccaaacucggcuccguacaauucucuaccgacaccgaaaacgauuucgaaacccaccaaaacaccaaauuuacucccguaggagucauccaagacggcagcacaacccaccgcaacgaaccccaacaauggguccucccauccuacuccggacgaaacguccacaacguacaccuagccccagccguagcccccaccuucccaggcgaacagcuccucuucuuccgcuccacuaugcccggaugcaguggcuacccaaacauggaccuagacugccuucucccccaagaauggguacaacacuuuuaccaagaagcugccccagcccaauccgacgucgcacuccuacgcuucgucaacccagacacaggccgcguccucuucgaaugcaaacuacacaaauccggcuacguuaccguagcucacacaggccaacacgacuuaguaauucccccaaacggcuacuuccgcuucgacucaugggucaaccaauucuauacccuagcaccaaugggcaacggaaccggucgccgccgcgcccucuaa

SEQ ID NO: 35829 - RNA, 1623 nt, Artificial Sequence
  derived and/or modified sequence opt11 from VP1__Norovirus__AFJ21395
augaaaauggcaucaaacgacgccaaccccuccgacggcucagccgccaaccuaguccccgaggucaauaacgaaguuauggcccucgaacccguagucggagccgccaucgcggcaccagucgcaggccaacaaaacgucaucgacccauggauacgcaacaauuucguucaagcccccggcggcgaguucaccgucucaccccgcaacgcaccuggcgaaauacuaugguccgcaccccucggacccgaccugaaccccuaccucucccaccuugcccgcauguacaacggcuaugccggaggcuucgaaguccaggugauccuagccggcaaugccuucaccgccggcaaaauaauauuugccgccgucccacccaacuuccccacggaaggccucucacccucacaaguaacaauguucccacauaucaucgucgacgucagacaacuagaacccguccuaauaccccucccagacguccgaaacaacuucuaccacuauaaccaaagcaacgacuccaccaucaaacucaucgccaugcucuacacccccuuaagggcgaacaacgcuggugaagacgucuucaccguaucaugccguguccuuacccgaccaucucccgacuucgacuuuauauuccucgucccuccaacuguagaaucccgaacaaaacccuucaccguccccauacucacaguagaagaaaugacaaacagucgauuccccaucccacucgaaaaacucuucaccggccccuccuccgcauucguaguccaaccucagaacggccgaugcaccacagacggaguccuccucggcacuacccaacugagcccaguaaacaucugcacuuuccggggugacguaacucauaucgccgguagccgcaacuauaccaugaaccucgccucccucaauuggaacaauuacgaccccaccgaagaaauccccgccccacuaggcacacccgacuucguaggaaaaauucaaggcguccuaacccaaaccaccaaaggcgacggcuccacccgaggacacaaagccaccguauacaccggcucagcccccuucacaccuaaacucggcuccguccaauucuccaccgacaccgaaaacgacuucgaaacccaccaaaacaccaaauucacccccgucggcguuauccaagacggcagcacgacccaucgcaacgaaccccaacaauggguacucccgucauacuccggacgcaacguccacaacguccaccucgccccagcagucgcccccaccuuccccggagaacaacuccucuucuucagaucaaccaugccaggcugcucaggcuaccccaacauggaccucgacugccuacuaccccaagaauggguccaacacuucuaccaagaagccgcccccgcccaauccgacgucgcccuacuacgauucgucaaccccgacacaggacgcguccuauucgaaugcaaacuccacaaaucuggcuacguaacagucgcccacaccggacaacacgaccucguaaucccacccaacggauacuucagauucgacuccuggguuaaccaauucuacacccuagcccccaugggcaacggcacaggacgacgacgagcccucuaa

SEQ ID NO: 35830 - RNA, 1623 nt, Artificial Sequence
  derived and/or modified sequence opt11 from VP1__Norovirus__AFJ21396
augaaaauggccucaaacgacgccaaccccucagacggcucagcagccaaccuagucccagaagucaacaacgaaguaauggcccucgaacccgucgucggagccgccaucgccgccccugucgcaggccaacaaaacguaaucgauccauggauccgcaacaacuucguacaagcaccaggcggcgaguucaccguaucaccccgcaacgcccccggagaaauccuaugguccgcuccccuaggaccagaccucaaccccuaccucucccaccucgcccgcauguacaacggauacgcaggcggcuucgaaguccaagucauccucgcagguaaugccuucaccgccggcaaaaucaucuucgccgcaguacccccaaacuuccccaccgaaggccucagcccuagccaagucaccauguucccucacauaaucgucgacguccgacagcucgaacccguccuaauuccccucccagacguccgcaacaauuucuaccacuauaaucaaagcaacgauucuaccauaaaacuaaucgcaaugcuuuacaccccacuccgcgccaacaacgcaggcgaagaugucuucaccguauccugccgaguccucacucgcccaucaccagacuuugacuucaucuuucuagucccacccaccguggaaucccgaaccaaacccuuuacgguucccauccugaccguagaagaaaugacaaacagcagguuccccaucccccuagaaaaacucuucacuggccccuccggcgcauucgucguccaaccacaaaacggacgcuguaccaccgacggaguacuacuaggcaccacccaauuaucacccguaaacaucugcaccuuccguggagacguaacucacaucgcaggcucccgcaacuacacaaugaaccucgccucccucaauuggaacaacuacgaccccacugaagaaauacccgcuccacuaggcacucccgacuucgucggcaagauccaggggguccucacccaaaccaccaaaggcgaugggucaacccgcggccacaaagccacugucuauaccggauccgcaccauucacgccaaaacucggauccguacaauucucaacggacacagaaaacgacuucgaaacacaccagaacaccaaguucaccccaguaggcguaauccaagacggcucaacaacccaccgaaaugaaccucaacaauggguccucccauccuacuccggccgcaacguccacaacguacaccucgcacccgccgucgcccccaccuuucccggcgaacaacuacuuuucuuccgaucuacaaugccaggaugcuccgguuauccaaacauggaccucgacugccuccuuccccaagaauggguccaacacuucuaccaggaagcagcacccgcucaaagcgacgucgcccuacuaagauucgucaacccagacaccggacgcguccucuucgagugcaaacuccacaaaucaggcuacgucaccgucgcacacaccggccaacacgaccucguaauacccccuaacggauacuuccgauucgacuccugggucaaccaauucuacacccucgcuccaaugggaaacggcaccggccgacgcagagcacucuaa

SEQ ID NO: 35831 - RNA, 1623 nt, Artificial Sequence
  derived and/or modified sequence opt11 from VP1__Norovirus__AFJ21397
augaaaauggccuccucagacgccaaccccuccgacggauccaccgcaaaccucguaccugaagucaacaacgaaguuauggcucucgaacccguugucggcgccgcuaucgccgcuccagucgccggacaacagaacgucaucgaccccuggauccgcaacaacuucguccaggcaccugguggagaauuuaccgucuccccaaggaaugccccaggugaaauccuaugguccgccccucucggcccagaccucaacccauaccucucucaccucgcacgcauguacaauucuuacgcaggcggcuucgaaguccaagucauccuugccgguaacgccuucaccgccggcaaaaucaucuucgcagcaguaccucccaacuuccccaccgaaggacuaucacccucacaagucacaauguucccccacauaauagucgacguacgccaacucgaccccguccuaaucccccuaccggacguccgaaacaacuucuaccacuacaaccaaucaaacgaucccacaaucaaacuuaucgccaugcucuacacaccccuucgcgccaacaaugcgggcgacgauguauucaccguuuccugccgcguucucacccgacccucacccgacuucgacuucaucuuccuugucccacccaccguagaaucacgcacuaaacccuucuccgucccuauccucaccgucgaagaaaugacaaacucccgauuccccauaccccucgaaaaacuuuucaccggaccuuccucagccuucguuguacaaccacaaaacggacgcuguaccacagacggcguccuccucggcaccacccaacucuccccaguaaacaucuguacauuccgcggcgacguuacacacaucgccggcacacaagaauacacaaugaaccucgccucucaaaacuggaacaacuacgaccccaccgaagaaauccccgcuccccucggcaccccugacuucguuggcaagauccaaggcguacuaacccaaacaacccgcggcgacggcuccaccagaggccacaaagccaccgucuccacuggcucuguccacuucaccccuaaacuaggucgcauacaguucucaaccgacaccuccaacgacuucgaaacuggacaaaacacaagauucacacccgucggcgucguccaagacggcuccacuacccaccaaaacgaaccacaacaauggguccucccaaacuacagcggccgagacucucacaacguccaccucgcccccgccgucgcacccagcuuccccggagaacaacuccuauucuuccgcucgaccaugccaggcugcuccggcuaccccaauaugaaccucgacugccuacucccacaagaauggguacaacacuuuuaccaagaagccgcucccgcacaauccgacguugcccuacuucgcuucgucaaccccgacacaggccgcguccucuucgaaugcaaacuccacaaauccggcuacgucaccgucgcccacaccggccaacacgaccucguuauacccccuaacggcuacuuucgcuucgacuccugggucaaccaauucuacacccucgcccccaugggcaacggcaccggccgccgcagagcccuauaa

SEQ ID NO: 35832 - RNA, 1623 nt, Artificial Sequence
  derived and/or modified sequence opt11 from VP1__Norovirus__AFJ21398
augaagauggccucaaacgacgccaaccccagcgauggcuccgcugccaaucuaguaccagaagucaacaacgaagucauggcacucgaacccgucgucggagccgcaaucgcagcaccugucgccggccaacaaaacguaauugauccauggauccguaacaacuucguccaagcucccggaggugaguucacagucucaccccgaaacgcccccggcgaaauccuuugguccgcaccccucggccccgaccucaaccccuaccucucacaccuagcccgcauguacaacggauaugccggcggauucgaaguccaagucauccucgccggcaacgcauucacagccggcaagaucaucuucgccgccguaccuccgaacuuccccacagaaggccucucccccucccaaguaaccauguucccccacauaauaguggacguacgccaacucgaacccguucucauaccacucccagacgucaggaauaacuucuaccauuacaaccaaucuaaugacucaaccaucaagcucaucgccaugcucuacacaccccuccgcgcuaacaacgccggcgaagacgucuucacagucuccugccgaguccuaacccgccccucccccgacuuugacuuuaucuucuuagucccucccaccgucgaaucccguacaaaacccuucaccguaccaauccuaaccguagaagaaaugacuaacucccgauuccccauuccacuggaaaaacucuucaccggccccucauccgccuucguuguucaaccccaaaacggccgaugcaccaccgacgguguacuccucggcaccacacaacucucccccgucaacaucugcacauuccgcggcgacguaacccacauugccggcucacgaaacuacacuaugaaccucgccucucucaacuggaacaacuacgaccccaccgaagaaaucccagccccacucggcacccccgacuucgucggcaaaauacaaggaguccucacccaaaccacuaaaggcgacggcucaacacgaggccacaaggcaacagucuacacaggaagcgcccccuucacacccaaacucggcucuguacaauucucuaccgacaccgaaaacgacuucgaaacccaucaaaacacuaaauucacccccguaggcgucauccaggacggcggaaccacccaccgcaacgaaccccaacaauggguacuucccuccuacuccggacgcaacgucccuaacgugcaccucgcccccgccguugcaccuacauuucccggcgaacaacuccuauucuuccgcuccaccaugcccggaugcucuggcuacccuaacauggaccucgacugucuccucccccaggaauggguacaacacuucuaucaagaagccgcucccgcccaauccgacguagcccuacuacgcuucgucaacccagacaccggacgaguacucuucgagugcaaacuccacaaauccggauacguaaccgucgcccacacuggccaacacgacuugguaaucccaucaaacggcuacuuccgcuucgauucaugggucaaccaauucuacacacucgccccaaugggcaacggcaccggucgucgccgcgcacucuaa

SEQ ID NO: 35833 - RNA, 1623 nt, Artificial Sequence
  derived and/or modified sequence opt11 from VP1__Norovirus__AFJ21399
augaaaauggcauccaacgacgccucaccgucagacggaucagcugcuaaucucguccccgaaguaaacaacgaaguaauggcccucgaacccguagucggcgccgccauagccgcacccgucgccggccaacaaaacguuaucgaccccuggauccguaacaauuucgugcaagcaccuggcggagaguucaccgucuccccucgcaacgcccccggcgaaauccuaugguccgccccacucggccccgacuuaaacccauaccuuucccaccuugcccguauguacaacggcuacgccggugguuucgaaguccaagucauacuugcaggcaacgcauucacagccggcaaaauaauauucgccgccgucccacccaacuucccaacagaaggccuauccccaucccaagucaccauguucccccacaucaucguagacguccgccaacuugaacccguccuaaucccacuccccgaugugcgcaacaacuuuuaccacuacaaccaaucaaacgacucaacuaucaaacucaucgccaugcuauacacaccccuccgcgcaaacaacgccggcgaggacguauucacuguaucuugccgcguccucacccgucccucacccgacuucgacuucaucuucuuaguaccaccaacgguagaaucccgaaccaaacccuucacugucccuauacucacagucgaagaaaugacuaacucacgauucccaaucccacucgaaaaacucuucacuggacccuccggcgccuucgucguccaaccccaaaacggccgaugcaccacagacggcguacuccuaggcaccacccaacuuucaccaguaaacaucugcaccuuucgcggcgacgucacccacaucgcugguucccgcaacuacaccaugaaucucgccgcacuuaacuggaacaacuacgaccccacagaagaaauacccgcaccucuaggcacucccgacuucgucggaaaaauacaagguguacucacacaaaccaccaaagcagacggcagcacacgcggccacaaggccacagucuacaccggcuccgccgacuucacgcccaaacucggaucuguccaauucucaacugacaccgaaaacgacuucgaaacacaucaaaacacaaaauucacaccugucggcgucauccaagacgguaacaccacccaccguaacgaaccccaacaauggguccucccuucauacagcggccgcaacguccacaacguccaccucgcccccgcagucgccccaaccuuccccggcgaacaacuccucuucuuucgguccaccaugccuggaugcucaggcuacccaaacauggaccuagacugccuacucccacaagaauggguacaacauuucuaccaagaagcagcccccgcucaaagcgacguagcccuccuacguuucgucaaccccgacaccggccgaguacucuucgaaugcaaacuucacaaauccggcuacguaaccgucgcccacaccggccaacacgaccucguaaucccacccaacggcuacuuccgauucgacuccugggucaaccaguuuuacacccucgccccuaugggcaacggcacaggccgacgccgcgccuuauag

SEQ ID NO: 35834 - RNA, 1623 nt, Artificial Sequence
  derived and/or modified sequence opt11 from VP1__Norovirus__AFJ21400
augaaaauggcaagcaacgacgccaacccauccgacggcuccgccgcaaaccucgucccagaaguaaacaacgaagucauggcccucgaaccagucgucggcgccgcaaucgccgcccccguugcaggccagcaaaacguaauagacccauggauccgaaacaacuuuguccaagcacccggcggcgaguucacagucaguccccgcaacgcgccgggugaaauucucuggucagcaccccucggacccgaccucaaucccuaccuuucccaucucgcccgcauguacaacggauacgcaggcggcuucgaaguccaagucauccucgcuggcaaugccuucacagcaggaaaaaucaucuucgccgccguuccaccaaacuuccccaccgaaggacucucacccucccaagucaccauguucccacacauuaucgucgacguacgacaacucgaaccaguacuuaucccccuacccgacguccgcaacaacuucuaccacuauaaccaaucaaacgacucaacaaucaaacuaauagcuaugcucuacacaccccuaagagcaaacaaugccggcgaagacguuuucacugucuccugccgaguccucacccgccccagccccgacuucgacuucaucuuccuaguacccccaacagucgaaucacguaccaaacccuucaccgucccuaucuuaaccgucgaagaaaugacuaacucaagauucccaauaccccuagaaaaacucuucaccggccccucauccgccuucgucguccaaccccaaaauggccgaugcacaacugacggcguccugcucggcacaacacaauuaucaccagucaauaucugcaccuucagaggagacguaacacauauagccggcucccgcaacuacaccaugaaccucgccucccucaauuggaacaacuacgaccccacagaagaaaucccagccccacucggcacccccgacuucgucggcaaaauccaaggcguccucacccaaacaacuaaaggagacggaucaacccgaggccacaaagccaccguuuacaccggcuccgcccccuucacucccaaacucggcucaguccaauucagcaccgauaccgaaaacgacuucgaaacucaccaaaacacaaaauucaccccagucggcgucauccaagacggcgguaccacacacagaaacgaaccucaacaauggguccuccccucauacuccggccgcaacguccccaacguccaccuugcccccgccguggcacccaccuucccaggcgaacaacuacuuuucuuccgcuccaccaugcccggcugcuccggcuaccccaacauggaccucgacugccuuuuaccccaagaauggguacaacacuucuaccaagaagccgccccggcccaauccgacgucgcacuacuuagauucguaaacccagacaccggccgaguacucuucgaaugcaaauuacacaaaucugguuacguaaccguagcccacacuggucagcaugaccuagucauacccuccaacggcuacuucagauucgacuccuggguuaaccaauuuuacacacucgcaccaaugggcaacggaaccggccgucgcagggcccuauaa

SEQ ID NO: 35835 - RNA, 1623 nt, Artificial Sequence
  derived and/or modified sequence opt11 from VP1__Norovirus__AFJ21401
augaaaauggccuccaacgacgccaacccuuccgacggcuccgccgccaaccucguccccgaagucuccaacgaaguaauggcccucgaaccuguagucggcgccgccaucgccgcacccgucgccggccaacaaaacgucaucgaccccuggauaagaaauaacuucguacaagccccaggcggugaauuuaccgucucaccccgaaacgcccccggagaaauacucugguccgcuccucuuggacccgaccuaaaucccuaccuaucccaccucgcaagaauguauaacggcuacgccggcggcuucgaaguacaagucauccuagccggcaacgccuucaccgccggcaagaucaucuucgcugccguucccccaaacuucccaacugaaggacucucccccucccaagucacaauguucccacacauaaucguagacguacgccaacuagaaccgguccuuaucccccucccagacguccgaaacaacuucuaccacuacaaccaauccaacgacucaacaauaaaacuaaucgccaugcuauacacaccccuucgcgccaauaacgcuggcgaagacgucuucaccguaagcugccgcguccucacccgcccaucccccgacuucgacuucaucuuccucguaccucccaccgucgaaucccgcaccaaacccuucaccguacccauccuuaccguagaagaaaugacuaauucccgcuuccccaucccccucgaaaaacucuucaccggccccuccggagcauucgucguccaaccccaaaacggucgaugcaccacagacggcguauuacucggaaccacacaacuaucacccguaaacaucugcacuuuccgcggcgacgucacccacaucgccggcucacgagacuacaccaugaaccucgccucccucaacuggaacaacuaugacccaacugaagaaacuccagcaccccuaggcacaccugacuucguaggcaagauccaaggcaugcucacccaaacaaccaaaggagacggauccacucggggccacaaggcaacaguauacaccgguuccgccccauucacaccaaaacucggauccguucgauucuccaccgacaccgaaaacgacuucgaaacccaccaaaauacaaaguucacacccgucggaguaauacaagacgguucaaccacacacaggaacgaaccccaacaauggguccuccccuccuacuccggacgcgacguacacaacguccaccuagcacccgccguugcacccacauuccccggcgaacaacuccucuucuuccgauccaccaugcccggcugcuccggcuaccccaacauggaccuggacugccuucuaccccaagaauggguccaacacuucuaccaagaagcagcucccgcacaaucugacguagcccuucuucgcuucgucaacccggacacaggacgaguacucuucgaaugcaaacuucacaaauccggauacguaaccgucgcccacaccggacagcacgaucucgucaucccucccaacggcuacuuccgauucgacuccugggucaaucaauuuuacacccucgcacccauggguaacggcaccggccgcagacgagcccucuaa

SEQ ID NO: 35836 - RNA, 1623 nt, Artificial Sequence
  derived and/or modified sequence opt11 from VP1__Norovirus__AFJ21402
augaaaauggcuucaaacgacgccaaccccuccgacggaucagcggcaaacuuaguacccgaaguauccaacgaagucauggcccucgaacccguaguuggcgcugcaaucgcagcaccugucgcgggacaacaaaacgucaucgacccguggauccggaacaacuucguacaagcccccggaggcgaguucaccgucuccccacgaaacgcccccggugaaauccucugguccgccccacucggcccugaccuaaaccccuaccucucucaccucgcccgaauguauaacggcuacgccggcggcuucgaaguucaggucauacucgcgggaaacgccuucaccgccggcaaaaucaucuucgcagccguaccuccuaauuuccccacagaaggacucucacccucacaagucaccauguucccccacauaaucguugacguccggcaacucgaacccguacuuauaccucuccccgauguccgcaacaacuuuuaccacuacaaccaauccaacgacuccaccaucaaacuuauugccaugcuuuacacaccccuccgcgcaaacaacgccggcgaagacgucuucaccguaucaugccguguccuaaccagacccucaccagacuucgacuucauuuuccucguaccacccaccgucgaaagccgcaccaaacccuucacaguucccauccucacagucgaagaaaugaccaacucccgauuucccaucccccucgaaaaacucuucaccggacccucuggcgccuucguaguccaaccacaaaacggccgcuguaccaccgacgggguacuacuaggcaccacccaacuaagcccaguuaacaucugcaccuuucgaggugauguaacacacaucgccggcucccgcgacuacaccaugaaccucgccagccucaacuggaacaacuacgacccuacagaagaaauccccgcaccacuuggcacuccugacuucguggguaaaauacaaggaauguuaacacaaacaaccaaaggagacggauccacccgcggacacaaagcaaccguauacacaggaucagcccccuucacccccaaacucggcucaguccgcuucuccaccgacacagaaaacgacuucgaaacccaccaaaacaccaaauucacccccgucggcgucauacaagacggcagcaccacccaccgcaacgaaccccaacaauggguacuccccucuuacuccggccgugauguacacaauguccaccuagcaccagccgucgcccccaccuucccaggcgaacaacuacucuucuuccgcucaacuaugccagguugcuccggauacccaaauauggaccuggacugccuucucccccaagaauggguccaacacuuuuaccaagaagcugccccagcccaauccgacgucgcccuccucagauucguaaauccagacaccggccgcguccuuuucgaaugcaaacuccacaaaucaggcuacgucaccgucgcccacaccggccaacacgaccuagucaucccacccaacggauacuuccgcuucgacucauggguaaaccaauucuacacacucgcucccaugggcaacggcaccggucgccgccgcgcccucuaa

SEQ ID NO: 35837 - RNA, 1623 nt, Artificial Sequence
  derived and/or modified sequence opt11 from VP1__Norovirus__AFJ21403
augaaaauggcauccaacgacgccaaccccucugacggcuccgccgccaaccugguccccgaaguuuccaacgaagucauggcccucgaaccaguaguaggcgccgccaucgccgcacccguagccggccagcaaaacguuaucgaccccuggauacgcaauaacuucguacaagccccaggcggcgaguucacagucagcccccgcaaugcaccaggcgaaaucuuauggucggcaccccucggccccgaucuaaacccauaucucucacaucuagcccgcauguacaacggauacgccggcggcuucgaaguccaagucaucuuagcaggaaaugccuuuaccgcugguaaaaucaucuucgcggccguuccucccaacuuucccacagaaggacuaucacccucccaagucaccauguucccccauaucaucgucgacguccgccaacuagaacccguucucaucccccuccccgacgucagaaacaacuucuaccacuacaaccaauccaacgacuccaccaucaaacucaucgccaugcucuacacaccccuacgcgccaacaaugccggagaagacgucuucaccguaucgugccgcguacucacccgucccucccccgacuucgacuucaucuuccucguuccacccacagucgaaucacgaacaaaacccuucacaguccccauccuuacagucgaagaaaugaccaacucaagauuccccaucccccucgaaaaacucuucaccggaccuuccggcgccuucgucguccaaccacaaaacggacgcugcaccaccgacggcguccuccuaggcaccacacaacucucacccgucaacaucugcacauuucgcggcgacgucacacauauagccggcagccgcgacuacacaaugaaccuagccucccucaacuggaacaacuacgaccccaccgaagaaaucccagcuccccucggcacucccgauuuugucggcaaaauccaaggcaugcuaacacagaccacuaaaggcgauggcuccacccgaggucacaaagccaccguauauaccggcuccgcccccuucacccccaaacucggauccguccgcuucucaacagacaccgaaaacgacuucgaaacccaccaaaacacaaaauucaccccuguaggcgucauccaggacggaucaacaacacaucgcaacgaaccacaacaauggguacuacccuccuacucagggcgugacguacauaacguccaucucgccccagccgucgcccccacauuucccggagaacaacuacuuuucuuccgcuccacaaugcccggcugcucaggcuacccaaacauggaccucgauugccuacucccccaagaguggguccaacauuucuaucaagaagccgccccggcccaaucagacgucgcauuacuucgauucgugaaccccgacaccggccgcguacucuucgaaugcaaacuccauaaauccggauacguuacagucgcccacaccggccaacaugaccuagucaucccacccaacgguuacuuccgcuucgacagcugggucaaucaauucuacacccuugcccccaugggcaacggcaccggccgccgcagggcucuuuga

SEQ ID NO: 35838 - RNA, 1623 nt, Artificial Sequence
  derived and/or modified sequence opt11 from VP1__Norovirus__AFJ21404
augaagauggccucaaacgacgcaaacccaucagacggauccgcagccaaccuuguucccgaaguaucaaacgaagucauggcacuugaacccgucguaggugcagcaauagcagcccccgucgcaggccaacaaaacgucaucgaccccuggauccgcaacaacuucguccaggcacccggaggcgaauuuaccgucucaccgcgcaacgcccccggcgaaauccuauggucagcaccccucgggcccgaccucaaccccuaccucucccaccucgcccgaauguauaacggcuacgccggcgguuuugaaguccaagucauccuagccggcaacgcauucaccgccggcaaaauaaucuuugcugcaguaccacccaacuucccuaccgaaggccucucccccucccaagucaccauguucccacacaucaucguagacgugcgucaacuagaaccuguccucaucccucuaccugauguaagaaacaacuucuaccacuauaaccaauccaacgacucaacgaucaagcuaaucgccaugcuguacacaccccuaagagccaacaacgcaggcgaagacgucuucaccguuucaugucgaguccuaacccgaccaucaccagauuuugacuucaucuucuuaguucccccaaccgucgaaucacgcaccaaacccuucaccguccccauccuaaccgucgaagaaaugacgaacucccgauuccccaucccacuagaaaaacuuuucaccggucccuccggcgccuucguuguccaaccccaaaacggccgauguacaacagacggaguacuacucggcacuacccaacuaucccccgucaauaucugcacauuccgcggcgacguaacacacaucgcaggcucucgagacuacaccaugaaccucgcaucccuaaacuggaacaacuacgaccccaccgaagaaauaccagccccacucggcacccccgacuucgucggcaagauccaaggcaugcuaacccaaacaaccaaaggcgacggcuccacacgaggccauaaagccacugucuacaccggcucagccccauuuaccccaaaacucggcuccguacgcuucuccaccgacaccgaaaacgacuucgaaacccaccaaaacaccaaauucacccccgucggcgucauccaagacggcagcacaacccaccgaaacgaaccccaacaguggguccuacccucauauuccggccgcgacguccacaacguacaccuagccccagccguugcccccaccuucccaggugaacaacuccucuucuuccgcucaacaaugccuggaugcucaggcuaccccaacauggaccucgacugccuacuaccucaagaauggguacaacacuucuaccaagaagccgcacccgcucaguccgacguagcccuccuaagauuugucaaccccgauacaggacgcguacucuucgaaugcaaacuacacaaaucuggcuacgucaccgucgcacacaccggacaacaugaccucgucaucccacccaacggguacuuccgcuucgacucauggguaaaccaauuuuacacccuagcucccauggguaacggcacaggccgccgacgagcccucuag

SEQ ID NO: 35839 - RNA, 1623 nt, Artificial Sequence
  derived and/or modified sequence opt11 from VP1__Norovirus__AFJ21405
augaaaauggccucaaacgacgcaaaccccagcgacggauccgcggcgaaccucguccccgaagucaacaacgaagucauggcccucgaacccgucgucggcgccgcaaucgccgcacccguagccggccaacaaaacgucaucgaccccuggauccgcaacaacuucguccaagcacccgguggcgaguucaccguaucaccccgaaacgcuccuggcgaaauccucuggucugccccacucggcccugaccucaaccccuaccucucucaccucgcacgaauguacaacggcuacgccggaggcuucgaaguccaaguaauccucgccggcaaugccuucaccgccggcaaaaucauauucgccgccguuccacccaacuuccccacugaaggccucucccccucccaagucacaauguucccccacauuaucgucgacguccgccagcuggaacccguccucaucccccuccccgacgucagaaacaacuucuaucacuacaaccaauccaacgauuccaccaucaaacuaaucgcaaugcucuacacuccccuacgcgcaaacaacgcaggcgacgacgucuucaccguguccugccgcguacucacuagacccuccccagacuucgacuucaucuuccucgucccacccaccguagaaucucgcacuaaacccuucaccguccccauucuaaccgucgaagaaaugaccaacucacgcuucccaauaccccuggaaaaacucuucaccggcccaucuagcgccuucguaguccaaccccaaaacggccgcugcaccaccgacggcguccuccuaggcaccacccagcucagccccgucaacaucugcacauuccgaggcgacgucacccacauagccggaucccgcaacuacaccaugaaccuagccucccuaaacuggaacaacuacgaccccaccgaagagauaccagcuccccucggcaccccggacuucguaggcaaaauacaagguguccuuacccaaacaacaaaaggcgacggcuccacccgaggacauaaagccaccgucuacaccggcagcgccgacuucacccccaaacucgguagcguucaauucuccaccgacacagaaaacgacuucgagacccaccaaaacaccaaauucacgccagucggcguaauacaagacggcuccacuacccaccgcaacgaaccccaacaauggguacuccccuccuauucaggccgcaacguccacaacguccaccuugcccccgccguagccccaaacuucccaggcgaacaacuacuuuucuuccggagcacuaugcccggcugcuccggcuaccccaacauggaucucgacugccuacuuccccaagaauggguccaacacuucuaccaagaagccgcccccgcccaaucagacgucgcccuacuccgauuugugaacccagacacaggccgcguucucuucgaaugcaagcuccacaaacccggcuacgucaccgucgcacacacuggucaacacgaucuugucauucccccaaacggcuacuuucgauucgacuccugggucaaccaguucuacacccucgcccccaugggaaacggugccggacgacgcagagcacucuaa

SEQ ID NO: 35840 - RNA, 1623 nt, Artificial Sequence
  derived and/or modified sequence opt11 from VP1__Norovirus__AFJ21406
augaaaauggccaguuccgacgccaaccccuccgacggauccaccgcaaaccucgucccagaagucaacaacgaaguaauggcccucgaacccgucguuggcgccgccaucgccgcacccguagccggucaacaaaacgucaucgaccccuggauccgcaacaacuucguccaagcccccgguggcgaguucacagucucaccccgcaaugcacccggagaaauccucuggucagcaccccucggaccagaccucaaccccuaucucucccaccuagcccgcauguacaacggcuacgccggcggcuucgaaguccaagucauccucgccggaaaugccuucaccgcagguaaaauaaucuucgccgccgucccaccaaacuucccaaccgaaggccuaagcccaucacaagucacaauguucccacacaucaucgucgacguaagacaacuagaacccguccucaucccacuucccgacguccgaaacaacuucuaccacuacaaccaaagcaacgaccccaccaucaaacuaauagccaugcucuacacuccccuacgagccaacaacgcuggcgacgacguauucaccgucucgugccgcguacugacccgcccuucuccagacuucgacuucauuuuccuagugcccccaaccgucgaaucucgcaccaaacccuucucugucccaguccuaaccguagaagagaugaccaacuccagauuccccauaccucuagaaaaacucuucacaggccccuccuccgcauucguaguccaaccccaaaauggcagaugcaccacagacggcguccuccuaggaaccacacaauuaucccccgucaacaucugcaccuuccgcggcgacgucacacacauccccggaucucgcaacuacaccaugaaccucgcaucccagaacuggaacuccuacgacccuaccgaagaaauccccgcaccacucggcacccccgacuucgucggcaaaauccaaggaguccuuacccagaccacacguaccaacggaucuacccgcggccacaaagccaccgucuacaccggcucagccgacuucucacccaaacuaggccggguccaauucgcaaccgacacugauaacgacuucgaaacaaaccagaacacaaaauucacaccagugggcgucauccaagacggcagcacaaccccacgaaacgagccccaacaguggguccucccguccuacuccggccgaaacauacacaacguacaccucgcccccgcagucgcccccaccuuucccggcgaacaacuacucuucuuccgcuccacaaugccaggaugcuccggcuaucccaacauggaucuagacugccuacuaccacaagaauggguacaauacuucuaucaagaagcugccccagcucaauccgacguagcccuacugcgcuucguaaaucccgauaccggccgcguccuauucgaaugcaaacuacacaaaucaggauacgucacaguagcccacaccggacagcacgaccuaguaauacccccaaacggcuacuuccgauuugauuccugggucaaccaauucuacacgcuugcccccaugggcaacggcacaggccgaagacgggcccucuaa

SEQ ID NO: 35841 - RNA, 1623 nt, Artificial Sequence
  derived and/or modified sequence opt11 from VP1__Norovirus__AFJ21407
augaaaauggccuccucagacgccaacccuucagacggcuccacagccaaccucgucccugaaguaaacaaugaagugauggcccucgaacccguuguuggagccgcaaucgcagccccagucgccggccaacaaaacgucaucgaccccuggguccgcaacaacuuuguacaagcccccggaggagaguucacagucuccccacgaaacgcccccggcgaaauacuuuggucagcgccccuagguccagaccucaacccauaccuaucccaccucgcccgcauguacaacggauacgccggcggcuucgaaguucaaguuauccuugccggcaacgccuucaccgcuggcaaaaucaucuuugcugccgucccacccaauuuccccacagaaggccucagccccucacaaguaaccauguucccccacauuaucgucgacguccgacaacuugaaccaguacuaaucccccucccagacguucgaaacaacuucuaccacuacaaccaaagcaacgacccgaccauaaaacucaucgccauguuauacaccccacuccgagcaaacaacgccggagacgaugucuucaccgucucaugccgcguacuuacacgacccucccccgacuucgacuucaucuucuuaguaccaccaaccguagaaucccgcacaaagccauucuccguccccauacuuacugucgaagaaaugacaaacucccgauucccaaucccccuagaaaaacuauucaccggucccuccuccgcauucgucguccaaccccaaaacggccgcugcacuacagacggaguacuccucggcaccacacaacucuccccagucaauaucugcaccuucagaggcgacgucacccacaucgcaggcucccacaacuacaccaugaaccucgcaucccaaaacuggaacagcuacgaccccacagaagaaaucccagcaccccucggcaccccugacuucguagguaaaauccaaggcguccuaacccaaaccacccgaaccgacgguucgacacgcggccacaaagcgaccguauacaccggcagcacugaguucucaccaaaacucggccggguacaauucgccaccgacacuaacaacgacuucgacgcuaaccaaaacaccaaauucacccccgucggugucauccaagacggcggcaccacccaccgaaacgaaccccaacaauggguccuccccuccuacagcggccgcaacacucacaacguccaucuagcccccgccgucgcacccacauuccccggcgaacaacuccuauucuuccgauccaccaugcccggaugcucaggcuaccccaacauggaccucgacugccuccuuccccaagaauggguccaauacuucuaccaggaagcagcccccgcucaauccgacgucgcacuccuacgauucgucaacccagacaccggacggguccucuucgaaugcaaacuucacaaauccggauacgucaccgucgcacacacaggccaacacgaccucgucauaccacccaacggcuauuuccgauucgacuccugggucaaccaguucuauacccucgcccccaugggcaacggaacaggccggcgccgcgcacucuaa

SEQ ID NO: 35842 - RNA, 1623 nt, Artificial Sequence
  derived and/or modified sequence opt11 from VP1__Norovirus__AFJ21409
augaaaauggccagcucagacgccaaucccuccgacggaucaaccgcaaaccuaguccccgaggucaacaacgaagucauggcacuagaaccuguaguuggcgccgccaucgccgcaccagucgccggucaacaaaacgucaucgaucccuggauccgcaacaacuucguccaagcccccggaggcgaguucaccguauccccucgcaacgcacccggcgaaauacuauggucugccccacuagguccagaccucaaucccuaccucucccaccucgccaggauguauaacggcuacgcgggcggauucgaaguccaagucauccucgcuggcaacgccuucaccgcaggcaaaauaaucuucgcagccguaccacccaacuuucccaccgaaggacuaucacccucccaggucaccauguuuccucauaucaucgucgacguacgacaacucgaaccaguccucaucccccugcccgacguacgcaacaacuucuaccacuacaaccaaagcaacgacccuacaaucaaacucaucgcuaugcucuauacuccccuccgcgccaacaacgcaggcgacgacgucuucaccguaucgugccgaguccucacccgaccaucccccgacuucgacuucaucuuccuagucccaccaaccguggaaucccgaaccaaaccauucuccgugccaauccuaaccguggaagaaaugaccaacagccgcuuucccaucccacuagaaaaacucuucaccggccccuccuccgccuucguuguucaaccccaaaacggacgaugcaccaccgacggcguacugcucggaaccacccaacuaagccccgucaacaucugcaccuuccguggcgacgucacccacaucacaggaucccgcaacuauacuaugaaccucgccacccaaaacuggaacucauacgacccaacagaagaaauaccagccccacucggaacacccgacuucgucggaaagauccaaggcguccucacccaaaccacacgagccgacggcagcacacgcggacacaaagccaccgucuacacaggaucagccgauuucgcacccaagcucggccguguacaauucgccaccgacacagacaacgacuuugacgccaaccagaacaccaaauucacacccguaggcgucauccaagacggcgacaccgcccaccgcaacgaaccccagcaauggguccucccauccuacuccggccgaaacucccacaacgugcaccucgcccccgcugucgcacccaccuuuccuggcgaacaacuccuauucuuccgaucuacuaugcccggaugcucaggcuaucccaauauggaccuagacugcuuacuuccccaagaauggguacaauacuucuaccaagaagcugcacccgcccaauccgacguagcccuccuacgauucguaaaccccgauaccggacggguccuuuucgaaugcaaacuccacaaauccgguuacgucaccgucgcccacacaggccaacacgaccuagucauacccccaaauggauacuuccgauuugacuccugggucaaccaauucuacacacucgccccaaugggaaauggcacuggcagacgacgcgcgcucuaa

SEQ ID NO: 35843 - RNA, 1623 nt, Artificial Sequence
  derived and/or modified sequence opt11 from VP1__Norovirus__AFJ21410
augaaaauggcaucauccgacgcuaaucccuccgacggcucgaccgccaaccucguccccgaaguaaacaacgaaguaauggcccucgaaccagucguaggcgccgcaaucgccgcuccaguagccggucaacaaaacgucaucgaccccuggauacgcaacaacuucguacaagcccccggcggagaauuuaccgucucgccacggaacgcccccggcgaaauacucuggucagcaccacugggccccgaccuaaacccauaccucucacaccuagcccgcauguauaacggcuacgcaggaggauucgaaguccaagucauacucgccggcaacgccuucaccgcaggaaaaaucguguucgccgccgugccacccaacuuccccaccgaaggucucucaccuucacaggucacaauguuuccacauauaauugucgacguccgacaacucgaacccguucuuaucccgcucccagacguccgcaacaauuucuaccacuacaaccaauccaacgauccaacaauaaaacuaaucgccaugcuuuacacaccccuaagagccaacaacgccggcgacgacgucuucaccguuuccugccgcguacuaaccagacccucccccgacuucgacuucauauuccucguucccccaaccguugaaucccgaaccaaacccuucucaguccccauccucacugucgaagaaaugaccaacucaagauuccccaucccgcuagaaaaacuuuucacaggccccucauccgcauucguaguccaaccacaaaauggaagaugcaccacagacggcguccuacucggcaccacccagcuuucccccgucaacaucugcacauuccgaggcgacgucacucacaucgccggcucacacaacuacaccaugaaccucgcaucacagaacuggaacuccuacgacccaaccgaagaaauaccggcuccacucggcaccccagacuucgucggcaaaauccaagguguccuaacucaaaccacccgcaccgauggcucaacccgcggacacaaagcaaccgucuacacaggcucagcagaguucucacccaaacucggccgcguacaauucgccacggacacaaacaacgacuucgacgccaaccagaacaccaaauucacaccagucggcgucauacaagacggaggaaccacacaccggaacgaaccacaacaguggguccuccccuccuacucuggacgaaacacccacaacguccaccucgcccccgcagucgccccaaccuucccaggagaacaacuacucuucuucagauccaccaugccagguugcuccggauacccaaacauggaccucgacugccuccucccccaagaauggguacaauacuucuaucaagaagcagcgcccgcccaauccgacgucgcccuccuccgauucguaaacccagacacuggccgaguccucuucgaaugcaagcuccauaaauccggcuacgucaccgucgcccacaccggccaacacgaccuaguaaucccacccaacggauacuuucgcuucgacucuugggucaaucaauucuacacacucgcacccaugggcaacggcaccggccgacgccgugcccuauaa

SEQ ID NO: 35844 - RNA, 1623 nt, Artificial Sequence
  derived and/or modified sequence opt11 from VP1__Norovirus__AFJ21411
augaaaauggcaagcagcgaugcaaacccauccgacggcuccacagccaaccucguccccgaagucaacaacgaaguaauggcccucgaacccguagucggagcagccaucgccgcaccagucgccggccagcaaaacgucauagaccccuggauacgcaacaacuucguacaggccccaggcggcgaauuuacaguuagcccccguaacgcccccggcgaaauacucugguccgcaccacucggccccgaccucaaccccuaccucucccaccuagcccgcauguacaacggcuacgccggcgguuucgaaguacaagucauccucgccggcaacgccuucacugccgguaaaaucguauucgccgccguacccccaaacuucccaaccgaaggccucucacccucucaagucacaauguucccccacauaauagucgacguccgacaacucgaacccguccuaaucccccuacccgacguccgcaacaacuucuaccacuacaaccaauccaacgacccuacaaucaaacuaauugcuaugcucuacacaccccucagagcaaacaacgccggagacgacguuuucaccguuuccugucgcguccuuaccaggcccuccccugacuucgacuucaucuuccucgucccacccaccguugaaucccgcaccaaacccuucuccguccccauccuuaccgucgaagaaaugaccaacucccgcuuccccaucccacuugaaaaacucuucaccggacccuccucugcuuucgucguccagccccagaacgggcgaugcaccacagacgggguccuccuaggcaccacccaacucucacccguaaacaucugcaccuuccgaggcgacguaacccacaucgcuggaucacacaacuacaccaugaaccucgcuucccaaaacuggaacucauacgaccccacagaagaaauacccgccccacucggaacaccagacuucgucggcaaaauacaaggaguccucacacaaacuacacgaaccgacggaucaacgagaggacacaaagcaaccguuuacaccggauccgccgaauuuucccccaaacucggccgcguccaauucgccaccgacacgaacaaugacuucgacgccaaccagaauacaaaguucacacccgucggaguaauccaagauggcggaacuacucaccguaacgaaccacaacaauggguacucccauccuacagcggcagaaacacucauaacguucaccucgcccccgccgucgccccaacauuccccggagaacaacuacuuuucuuccgcuccacaaugcccggaugcuccggcuaucccaacauggaccuagacugccuacuuccacaagaauggguucaauacuucuaccaagaagcagccccagcccaauccgacgucgcacuccugcgguucgucaacccagauaccggacgcguccucuucgaaugcaaacuacacaaauccggcuacguaaccgucgcacacacaggccaacacgaccucgucaucccacccaacggcuacuuccgcuucgacuccugggucaaccaauucuacacacucgcccccaugggcaacggaacaggccgacgccgcgcacucuaa

SEQ ID NO: 35845 - RNA, 1623 nt, Artificial Sequence
  derived and/or modified sequence opt11 from VP1__Norovirus__AFJ21413
augaaaauggcaucauccgacgcaaaccccuccgacggcucuacagccaaccucgugccugaagucaacaacgaaguaauggcacuggaaccugucgucggagccgccauugccgccccagucgccggucaacaaaacgucauagaccccuggauccgcaacaacuucguccaggcccccggcggcgaguucaccguauccccucgcaacgccccaggcgaaauacucugguccgcaccacuaggacccgaccucaaccccuaccucucacaccuagcccgcauguacaacggcuacgccggcggcuucgaaguccaagucauccucgccggcaacgcauucaccgccggcaaaauagucuucgccgccguacccccuaacuuccccacagaaggccucucccccucgcaagucacgauguucccccacauaauagucgauguaagacagcuagaacccguccucauccccuuaccugacguccgcaacaacuucuaccacuauaaccaaucaaacgaccccaccauaaaacucaucgccaugcucuauacaccccuccgagccaacaacgccggcgacgauguauucaccgucuccugccgaguccuaacgcgccccucacccgacuucgacuuuaucuuccuuguaccucccaccgucgaaucucgcacaaaacccuucuccguccccauccucaccgucgaagaaaugaccaacucacguuuccccaucccccuagaaaaacucuucaccggccccuccuccgccuucgucguccaaccacagaacggacgcugcacuacagacggcguccuccucggaaccacacaacuaucccccgucaacauaugcaccuuccgcggcgaugucacucacaucgccggcucacacaacuacaccaugaaccucgccucacaaaacuggaacucauacgauccaacagaagaaauccccgcaccccuuggaacccccgacuucgucggcaaaauccaaggaguacucacccagacaacucgcacugacggcucaacccgcggccacaaagcaaccguuuacacuggaucggccgaguucucacccaaacuaggacgaguccaauucgccaccgacaccaacaacgacuucgacgccaaccaaaauaccaaauuuacccccgucggugucauccaagacgguggcaccacacaccgaaaugaaccacaacaauggguacuacccuccuacagcggacgcaacacccacaacguccaucuagcacccgcagucgcaccuacauucccaggcgaacaacuccucuucuuccgcucaacaaugccaggaugcuccggcuaccccaacauggaccuagacugccuccucccccaagaauggguacaauacuucuaccaagaagccgcccccgcccaaucagaugucgcacuacuccgauucguaaaccccgacaccggacgcguacuauucgaauguaaacuccacaaaucuggcuaugucacagucgcacacaccggccaacacgaccucgucaucccacccaacggcuacuuccgauucgacuccugggucaaccaauucuacacccucgcccccaugggaaauggaaccggacgacgucgcgcacuauaa

SEQ ID NO: 35846 - RNA, 1623 nt, Artificial Sequence
  derived and/or modified sequence opt11 from VP1__Norovirus__AFJ21414
augaaaauggccucaucagacgccaaccccucagauggcagcaccgccaaccucguacccgaagucaacaacgaagucauggcccucgaacccguggucggcgccgcuauagccgccccugucgccggacaacaaaacgucauagacccuuggauccguaacaacuucguacaagcacccggaggcgaauuuaccguauccccacgaaacgcccccggcgaaauacuaugguccgcuccccucggacccgaccuaaaccccuaccucucccaccuagcccgcauguacaauggcuacgccggcggcuucgaaguucaagucaucuuagcaggcaacgcauucaccgccggcaaaaucaucuucgcugccgucccaccaaacuuccccaccgaaggucuaagccccucacagguaacuauguucccccacaucauagucgacguccgccaacuugaacccguucuuauaccccuccccgacguccgaaacaacuucuaucacuacaaccagucuaacgauccuaccaucaaacucaucgccaugcucuacacaccccuacgagcaaacaacgccggcgacgaugucuucaccgucuccugccgcguacuaacccgcccaucccccgacuucgacuucauauucuuagucccaccaaccgucgaaucacgaaccaaacccuucuccgucccuguacucaccguugaagaaaugaccaacucccgauuccccaucccccuagaaaaacucuucaccggcccaagcuccgcuuucguaguacaaccacaaaacggccgcugcacaacagacggcguccuucucgguaccacacaacucuccccagugaauaucuguaccuuucggggugaugucacccacaucccaggcucucgcaacuauacaaugaaccuugccucacaaaacuggaacagcuacgaucccacagaagaaaucccagcaccccucgguacucccgacuucgucgguaaaauccaaggaguccuaacccaaaccacccgcaccaacggcuccacccgaggccacaaagccacuguuuacaccggauccgccgacuucucccccaaacucggccgcguccaguucgcuacugacacugacaacgauuucgaaacaaaccaaaauacuaaauucacccccgucggaguaauccaagacggauccacuacaccacgcaaugaaccccaacaauggguccucccauccuacucaggccgaaacauccacaacguacaccuagcccccgccgucgccccaacauuccccggcgaacaacuccuauucuuccguuccaccaugcccggcugcucaggauaccccaacauggaucucgacugccuacucccacaagaauggguccaauacuucuaccaagaagccgcaccagcucaaucagacguagccuuacuucgcuuuguuaacccagacaccggacgcguccucuucgaauguaaacuccauaaauccggcuacgucaccgucgcucacaccggucaacacgaccucguaaucccacccaacggauacuuccgcuuugacuccugggucaaccaauucuacacccucgcccccaugggcaacggcacuggacgccgccgagcccucuga

SEQ ID NO: 35847 - RNA, 1623 nt, Artificial Sequence
  derived and/or modified sequence opt11 from VP1__Norovirus__AFJ21415
augaaaauggcaagcucugaugccaaccccuccgacggaucuaccgccaaccucgucccugaggucaacaacgaagucauggcauuggaacccguagucggcgcagcaaucgcggcccccguugcaggccagcaaaacgucaucgaccccuggauccgcaacaacuucguccaagcccccggcggugaguucacagucuccccacgcaacgcacccggagaaaucuuauggucagccccgcucggcccugaccuaaacccauaccuaucacaccucgcacgcauguacaacgguuacgcaggcggauucgaaguccaagucauucucgcuggcaacgccuuuacagcaggcaaaaucgucuucgcugcugucccacccaacuuccccacugaaggccucagccccucacaagucacgauguucccccacaucaucguugacguccgccaacucgaacccguccuaaucccacucccagacguacgaaauaacuucuaccacuacaaccaaagcaacgaccccaccaucaaacucaucgccaugcucuacaccccacuucgagcaaacaacgcuggcgacgacgucuucacagucuccugccgaguccuaacccgacccucucccgacuucgacuucaucuuccuagucccaccaacagucgaaucacgcacaaaacccuucuccguccccauacuaacagucgaagaaaugaccaacuccagauuccccauaccccucgaaaaacucuucaccggcccuuccuccgccuucgucguccaaccccaaaacggccgcugcacaaccgacggaguauugcuaggcacaacccaacucucacccgucaacauauguaccuuccgcggugacguuacccacaucgcaggcucccacaacuacaccaugaaccucgccucacaaaacuggaacucauacgaccccaccgaagaaauaccugcaccccuaggaacaccugacuucgucggaaaaauacaaggcguacucacccaaacaacccguaccgacgguucuacccgcggccacaaagccacugucuacacaggaagugccgaauuuucaccuaaacucggccgcguacaauucgccaccgacaccaacaacgacuucgacgccaaccaaaacaccaaguucaccccagucggcguaauacaagacggaggcaccacccaucgcaacgaaccccaacaauggguccucccaucauauuccggacgaaacacccauaacgugcaccuagcccccgcaguagccccaaccuuuccuggcgaacaacucuuauucuuccgcucuacaaugcccggcugcuccggcuacccaaacauggaccucgacugcuuacucccccaagaauggguccaauacuucuaccaagaagccgcccccgcucaauccgacguagcccuccucagauucguaaaccccgacacaggccgaguacucuucgaaugcaaacuacacaaauccggcuacguaaccgucgcccacacaggccaacacgaccuagucaucccacccaacggcuacuuccgcuucgacucauggguaaaccaguucuacacccucgcacccauggguaacggcaccggccgccgccgcgcacuauaa

SEQ ID NO: 35848 - RNA, 1623 nt, Artificial Sequence
  derived and/or modified sequence opt11 from VP1__Norovirus__AFJ21416
augaaaauggccuccuccgacgccaaccccuccgacgggucuaccgccaaccucguccccgaagucaauaacgaagucauggcccucgaacccguagucggagccgccaucgcagcaccaguugccggccaacaaaacguaaucgaccccuggauccgaaacaacuucguccaggcucccggcggcgaguucacugucucaccccgcaacgcccccggcgaaauccucugguccgcuccccuuggccccgaccuuaaccccuaccucucccaccuagcccgaauguacaacggcuacgccggcggcuucgaaguccaagucauacucgccggcaacgccuuuaccgccgguaaaaucaucuucgccgccgucccacccaacuuccccaccgaaggccuaucccccucccaagucacaauguucccccacauuaucguugacguacgccaacucgaacccguccuaaucccccuccccgacguccgcaacaacuucuaccacuacaaccaaagcaaugaccccaccaucaaauuaaucgccaugcuuuacaccccacuaagagccaacaacgccggagacgacgucuucacagucuccugccgaguacucacucgacccucaccggacuucgacuucaucuuccuagucccucccaccgucgaaagccgcaccaaacccuucucgguccccguccuaaccgucgaagaaaugaccaacucacgauucccaauaccccuagaaaaacuauucacuggccccuccuccgccuucgucguacaaccccaaaacggccgcugcaccaccgacggcguccuccuaggcacaacucaacucucaccagucaacaucugcaccuuccgcggcgacgucacccacauacccggcucacgcaauuacacaaugaaccucgccucacagaacuggaacuccuacgauccuacugaagaaauaccagccccacuuggaacacccgauuucgucggcaaaauacaaggcguccucacacagacaacucgcacaaacggauccacccgaggacacaaagcaacagucuacaccggcucagccgacuuuagccccaaacucggccguguccaauucgccacagauaccgacaacgacuucgaaacuaaccagaacaccaaauucaccccaguuggcgucauacaagacggcuccaccacaccccgcaacgaaccccaacaauggguucucccauccuacucaggccgaaauauccacaacguccaccucgcccccgccgucgccccaacauuccccggagaacaacuucucuucuuccgauccacaaugcccggcugcuccggcuaccccaacauggaucucgacugccuccucccccaagaauggguucaguauuucuaccaagaagcagcacccgcccaauccgacgucgcccuccuccgauucguaaacccagacacaggccguguacucuucgaaugcaaacuccacaaauccggcuacgucacagucgcacacaccggacaacaugaccucguuaucccaccgaacgguuauuuccgcuucgacucuuggguuaaccaauucuacacccuugcacccaugggaaacggcaccggccgccgucgcgcccucuga

SEQ ID NO: 35849 - RNA, 1623 nt, Artificial Sequence
  derived and/or modified sequence opt11 from VP1__Norovirus__AFJ21417
augaaaauggccucauccgacgccaacccuucugacggauccaccgccaaccuuguacccgaaguuaacaacgaagucauggcccucgaaccaguaguaggagccgccaucgccgcccccgucgccggccaacaaaacguaauagacccauggauucggaacaacuucguccaagcccccggcggcgaauuuaccgucuccccacgaaacgcacccggcgaaauuuuaugguccgcaccccucggccccgacuuaaaccccuaccucucacaccucgcccgaauguacaacggcuacgccggaggcuucgaaguccaaguuaucuuagcaggaaacgcauucaccgccggcaagaucgucuucgccgcuguaccacccaauuuccccaccgaaggccucucuccaucccaaguaaccauguucccccacauaaucgucgacguccgacaacucgaacccguccuaaucccacuccccgacguacgcaacaacuucuaccacuacaaccaaucaaaugacccaaccauuaaacucauagcuaugcuauacaccccacucagagccaacaacgccggcgacgacgucuucacagucuccugccgcguacuaacacgcccauccccagacuuugauuuuaucuuccucgucccuccaacagucgaaucucgaacuaaacccuucucaguaccaauacuuaccguugaagaaaugacuaacucacgcuucccaauaccucucgaaaaacucuucaccggacccuccuccgccuucgucguccagccccaaaacggacguugcacaaccgacggaguccuucucggaaccacccaacuaucucccgucaacauaugcaccuuccgcggagacgucacccacaucgccggcucccacaacuacaccaugaaccuagccucccaaaauuggaacucuuacgaccccaccgaagaaauuccggccccucucggaaccccagacuucgucggcaaaauacaaggcguccuuacccaaaccacacgcacagacggauccacacggggccacaaagcaaccguauacaccggcuccgcagaguucucacccaaacuaggccgcguacaauucgccaccgacaccaacaacgacuucgacgccaaccaaaacaccaaauucacccccgucggcgucauccaagacggcggcaccacccaccgcaacgaaccacaacaauggguccuccccucauauucuggacgcaacacccacaacguccaccuggcacccgcugucgccccgaccuucccaggagaacaacuucuuuucuuccgcucuacuaugcccggauguucuggauaccccaacauggacuuagacugccuacucccacaagaauggguccaauacuucuaccaggaagccgccccugcccaaagcgacgucgcacuccuucguuucguaaaccccgacacaggacgaguccucuucgaaugcaaacuccacaaaucaggauaugucacagucgcacacaccggccaacacgaucuagucauuccacccaacggcuauuuccguuucgacuccugggucaaccaauucuacacacuagcccccaugggcaacggcaccggucgccgucgcgcucucuaa

SEQ ID NO: 35850 - RNA, 1623 nt, Artificial Sequence
  derived and/or modified sequence opt11 from VP1__Norovirus__AFJ21418
augaaaauggccuccuccgacgccaacccaagcgacggauccaccgccaaccucguccccgaagucaacaaugaagugauggcccucgaacccgucguaggcgccgcaaucgccgcccccgucgccggccaacagaacauaauagacccguggauccggaacaacuucguccaagccccaggcggagaauuuaccgucuccccacgaaaugcacccggcgaaauccuuuggucagcaccccucggccccgaccuaaaccccuaccucucccaccuagcccgcauguacaacggcuacgcaggcggauucgaaguccaaguaauccuagcgggcaacgccuucaccgcaggaaaaaucguguucgcagccguacccccaaauuuccccacagaaggacucagccccucccaaguaaccauguucccccacaucaucgucgacguacgccagcucgaaccaguccucaucccccugcccgacguccgcaacaauuucuaccacuacaaccaauccaaugauccaaccaucaaacucaucgcaaugcuauacacccccuuacgugcaaauaacgccggcgacgacgucuucaccgucuccugccgaguacuuaccaggcccucacccgacuucgacuucaucuuccuagucccacccaccgucgaaucccgaacaaaacccuucuccgucccuauccuaaccgucgaagaaaugaccaacucccgauucccaauaccccuggaaaaacucuucaccggccccuccucggcauucgucguccagccccaaaacggaaggugcaccaccgacggcguccuacucggcaccacccaacucucccccgucaacaucugcaccuuccgaggcgacguaacccacaucgccggcucacacaacuacacaaugaaccuagccucccaaaacuggaacuccuacgacccaaccgaagaaaucccggcaccccucggaaccccagacuucgucggcaaaauccaagggguccucacccaaaccacacgcaccgacggcuccacgcgaggccacaaagccaccgucuacaccggcuccgcugaguucucccccaaacucggcagaauccaauucgccaccgacacaaacaacgacuucgacgcaaaccaaaacacaaaauuuacccccguaggcguaauccaagacgggggcaccacccaccgaaaugaaccccaacaauggguccuccccuccuacucgggccgaaacacacacaacguucacuuagcucccgcagucgcccccaccuuuccaggcgaacaacuccucuucuuccgauccacccuucccggcugcucaggauacccuaacauggaccucgauugccuccuaccacaagaauggguccaauacuucuaccaagaagccgcccccgcacaaucagacguagcccuucuccgcuucgucaacccagauaccggccgcguccucuuugaaugcaaacuccacaaaucaggcuacguaacagucgcccacaccggccaacacgaccucguaauaccucccaacggauacuuucgauucgacuccuggguaaaccaauucuacacccuagcacccaugggcaauggcacaggccgccgccgcgcucucuaa

SEQ ID NO: 35851 - RNA, 1623 nt, Artificial Sequence
  derived and/or modified sequence opt11 from VP1__Norovirus__AFJ21419
augaaaauggccuccuccgacgccaaccccuccgacgguuccacugcaaaccuagucccagaaguuaacaacgaggucauggcacucgaacccgucgucggagccgccaucgcugcuccagucgccggccaacaaaacguaaucgaccccuggauccgaaacaacuucguccaagcccccggaggcgaguucaccguaucaccaagaaacgcccccggcgaaauacuaugguccgccccacuaggaccagaccucaaccccuaccuaucccacuuagcccgcauguacaacggcuacgcaggagguuucgaaguacaagucauacucgcaggcaacgccuucaccgccggaaaaaucauauucgcugccguaccacccaacuuucccaccgaaggccucucccccucccaaguuaccauguucccccacaucaucguugacguuagacaacucgagcccguacucaucccacucccggacguccgaaacaacuucuaccacuacaaccaauccaacgaccccaccauaaagcucaucgccaugcucuacacaccccuccgcgcuaacaacgcaggcgaugacgucuucacugucuccugccgcguccuaacucgaccaucaccggacuucgacuucaucuuccucguaccucccaccgucgaaucaagaaccaaacccuucuccguuccgauccucacagucgaagagaugacuaauucaagauucccaaucccccucgaaaaacuauuuaccggacccuccucaaccuucgucguacaaccacaaaacggcagaugcaccacagacggcguccuacuuggcaccacccaacuaucaccaguaaauaucugcacguuuagaggcgacguaacccacaucgcuggaucccauaacuacaccaugaaccuugccucccaaaauuggaacuccuacgaccccaccgaagaaauccccgcccccuuagggacccccgacuucgucggcaaaauccaaggcguucucacccaaaccacccgcaccgacggauccacgcgcggccacaaagccaccgucuauacuggcagugccgaguucucccccaaauuaggcagaguccaauucgcgaccgauaccaacaacgacuuugacgccaaccagaacacaaaauucacucccgucggcgucauccaggacggcggcaccacccaccgaaacgaaccccaacaauggguccuacccucauauucaggccgcaacacccacaacguccaccuggcacccgccguagcaccaaccuuccccggagaacaacuccuauucuuccgcucaaccaugccaggcuguuccggcuaccccaacauggaccucgacugccuaaucccccaagaauggguacaauacuucuaccaagaagcagccccagcccaauccgacgucgcacuccuacgcuucguaaaucccgauaccggccguguccuuuucgaaugcaaacuccacaaauccggcuacgucacagucgcccacacaggacaacacgaccucguuauacccccaaauggcuauuuucgcuucgacuccuggguaaaccaauucuacacacuagccccaaugggaaacggcaccggacgacgucgugcacucuaa

SEQ ID NO: 35852 - RNA, 1623 nt, Artificial Sequence
  derived and/or modified sequence opt11 from VP1__Norovirus__AFJ21420
augaagauggccagcuccgacgccaaccccucugauggcucaacagcaaaucuagucccugaagucaacaacgagguaauggcccuagaacccguaguaggcgccgccaucgcagcccccguagccggacaacaaaacgucaucgaccccuggauccgcaacaacuucguccaagccccaggaggcgaguucaccgucucaccacgcaaugccccaggcgaaauccuuugguccgccccacucggccccgaccuaaaccccuaccucucgcaccucgcacgcauguauaacggcuacgccggcggcuucgaaguccaaguuauacuagcuggaaacgccuucaccgcaggcaaaaucgucuuugcagcagucccacccaacuuccccaccgaagggcuaucacccucccaaguaaccauguucccccacauaauugucgacgucagacaacuugaacccguccuaaucccccuccccgacguccgcaacaacuucuaccacuacaaccaauccaacgaccccaccauaaaauuaauagccauguuauacacaccacuacgagcaaacaacgccggugacgauguauucaccgucuccugccgaguccucacccgcccauccccagacuucgacuucaucuucuuagucccacccacaguagaaucacgaaccaaaccauucuccguaccaauccuuacagucgaagaaaugacaaacucccgcuucccaaucccccucgaaaaacucuuuaccggccccuccuccgcauucgucguacaaccgcaaaacggccgcugcaccacagacgguguccuccuuggcaccacccaacucucacccgucaacaucugcaccuuucgaggagacguaacacacauagcuggcagccacaacuacaccaugaaccuagcaucccaaaacuggaacuccuacgaccccaccgaagaaaucccagccccucucggcaccccagacuuugucggcaaaauccagggcguacucacacaaacaacccgaaccgauggcuccacacgcggacacaaggccaccgucuacaccggaucugccgaguucagccccaaacucggccgaguccaauucgcaacagacacuaacaacgacuucgaugccaaccaaaacacaaaguucacccccgucggagucauccaagacggcgguaccacccacagaaacgaaccacaacaauggguccucccguccuacuccggccgaaacacacacaauguccaccucgccccagccgucgcccccacauuucccggcgaacaacuccuguucuuucguuccacaaugcccggaugcucaggcuaccccaauauggaccuugacugccuacucccccaagaauggguccaauacuucuaccaggaagcagcccccgcacaauccgacguagcacuacuacgauucgucaauccugacacuggucgaguucuauucgagugcaaacuacacaagucagguuacgucacagucgcgcauacgggacaacacgaccuagucaucccacccaacggauacuuccgauucgacagcuggguaaaccaauucuauacccuagccccaaugggcaacggcaccggccgccgccgagcccucuaa

SEQ ID NO: 35853 - RNA, 1623 nt, Artificial Sequence
  derived and/or modified sequence opt11 from VP1__Norovirus__AFJ21421
augaaaauggccagcucugaugccaaccccucagacggcuccacagccaaccucguacccgaagucaacaacgaagucauggcacuugaaccagucgucggcgccgccaucgccgccccaguggccggacaacaaaacgucauagaccccuggauaagaaacaacuucguccaagccccaggcggcgaguucacugucuccccucgcaacgccccaggcgaaauccucuggucagcaccccucggccccgaccugaaccccuaccuaucccaccucgcccgcauguacaacggcuacgcaggcggauucgaagugcaagucauccucgcuggcaaugccuucaccgccggaaaaauuguuuucgccgucgucccacccaacuuccccaccgaaggacuaucaccuucacaagucacaauguuuccacacauaauagucgacguccgccaacucgaacccguccuuaucccauuacccgacguacgaaacaacuucuaccacuacaaccaaaguaacgauccuaccaucaaacucauagccaugcucuacacaccccuccgcgccaacaacgccggagacgacguauucaccgucuccugccguguauuaacacgacccucccccgacuucgacuucaucuuucucguuccacccacuguugaaucccgaaccaagcccuucucaguacccauacucaccgucgaggaaaugacuaacucccgauucccaauaccccuggaaaaacuauucaccggaccauccuccgccuucgucguccaaccacaaaacggacgcugcaccacugacgggguccugcuagggaccacccaauuauccccagucaauaucugcacauuccgcggugauguaacccacaucgccggaucccacaacuacacuaugaaucucgcaagccaaaacuggaacagcuacgaucccacugaggaaauaccagcuccccucggcacccccgacuuuguuggcaaaauccaaggcguacuaacccaaaccacacgcacugacggauccacucgaggccacaaagccaccgucuacaccggauccgccgaauuuucacccaaacucggacgcguccaauucgccaccgacacaaacaacgacuucgaugccaaccaaaacacuaaauucacccccguuggcgucauccaagauggcggcaccacccaccgcaacgaaccucaacaauggguccuuccgucauacucaggccgaaacacccacaauguccaccucgcccccgccguagcccccacauucccaggugaacaacuccucuucuuccgaucuaccaugccuggcugcucaggcuaccccaacauggaccuagacugccuccuaccccaagaauggguacaguacuucuaccaagaagcagcccccgcacaauccgacguagcccuacuucgauucgucaacccagacacaggacguguacucuucgaaugcaaacuccacaaauccggauacgugaccguugcccacaucggccaacaugaccuaguaauaccucccaauggcuacuuccguuucgauuccuggguaaaccaauucuacaccuuagcucccaugggcaacggcacuggacgccgacgugcucucuaa

SEQ ID NO: 35854 - RNA, 1623 nt, Artificial Sequence
  derived and/or modified sequence opt11 from VP1__Norovirus__AFJ21422
augaaaauggccuccuccgacgccaaccccuccgacggcuccaccgcaaaccuaguaccagaagucaacaacgaagucauggccuuagaacccguagucggcgccgcaaucgcagcaccaguugccggccaacaaaacguaauagaccccuggauacgcaacaacuucguacaagcccccggaggcgaauuuaccgucuccccucgcaacgccccaggcgaaauccuauggucagccccgcucggaccagaccucaacccauaccucucucaccucgcccgaauguacaacggauacgccggcggauucgaaguucaaguuauccuagccggcaacgccuucaccgcaggcaaaauaguauucgccgcagucccucccaacuuccccaccgaaggccucucccccucccaagucaccauguucccccacauaaucgucgacguccgccaacuagaacccguucucaucccccuacccgacguccgaaacaacuucuaccacuacaaccagucaaacgaccccacaaucaaacuaaucgccaugcuuuacacaccccuccgcgccaacaacgccggagacgacgucuucacaguuuccugccgcguccucacucgacccucccccgacuucgacuucaucuuccucguacccccgacagucgaaucucgaaccaagccauucucagucccaauacucaccgucgaagaaaugacgaacuccagauucccuaucccccucgaaaaacuuuucaccggaccauccucagccuucgucguacaaccccaaaacggccgcugcaccaccgacggaguccuccuaggcaccacccaacuaucccccguaaacauaugcaccuuccguggcgacguuacccacaucgccggaucucacaacuacaccaugaaccucgccucccaaaacuggaacuccuacgaccccacagaagaaaucccagccccgcucggcacccccgacuucguaggaaaaauacaaggcguccucacccaaaccacaagaaccgacggcuccaccagaggccauaaagccacugucuacacgggguccgccgaauuuagccccaagcucggccgaguccaauucgccaccgacaccaauaacgacuucgacgccaaccaaaacaccaaauucaccccaguaggcgucauccaagacggaggcacuacccaccgaaacgaaccacaacaguggguacuucccuccuacucaggacgaaacacccauaacguccaccucgccccagcagucgcaccaacauucccaggcgaacaacucuuauucuuccgcucuaccaugccaggcugcuccggcuacccaaacauggaccucgauugccuucuuccccaagaauggguccaauacuucuaccaagaagcugcacccgcccaaucugacgucgcccuccuccgauucguaaaucccgacacaggcagagucuuguucgaaugcaaacuccacaaaagcggauacgucaccgucgcacacaccggccaacacgaucucguaaucccacccaauggcuacuuccgcuucgauuccuggguaaaucaauucuacacccucgcgcccaugggaaacggcaccggacgccgcagggcacucuga

SEQ ID NO: 35855 - RNA, 1623 nt, Artificial Sequence
  derived and/or modified sequence opt11 from VP1__Norovirus__AFJ21423
augaaaauggcauccuccgacgcaaacccauccgacggcucuacugccaaccucguacccgaaguaaacaacgaagucauggcccuugaacccgucgucggcgccgcaaucgccgcccccguggcaggccaacaaaacgucaucgaccccuggauacgcaacaacuucguccaagccccaggcggugaauuuaccgucagcccccgcaacgccccuggcgaaauccuauggucagcgccccucggaccugaccucaaccccuaccucucacaccucgcccgcauguacaacggcuacgccggcggauucgaaguacaagucauccuagccggcaacgccuucaccgccggcaaaaucauauucgccgcugucccaccaaacuuccccaccgaaggccucucccccucccaagucacaauguucccacacaucaucgucgauguccgacaacuugaacccguccuaauaccccucccagacguacgcaacaacuucuaccacuacaaucaaagcaacgaccccaccauuaaacucaucgccaugcucuacaccccacuccgagccaacaacgccggcgaugacgucuucacagucucaugcagaguacucacccgucccucucccgacuucgacuucaucuuccucguaccacccaccguagaaucacgaaccaaacccuucuccgucccaguccucaccguagaagaaaugacaaacagccguuucccaaucccccucgaaaaacucuucaccggccccucaagcgcuuucguaguccaaccacaaaacggaagaugcacaaccgacggcguccuccuaggcaccacucaacucucaccagucaacaucugcaccuucagaggagacgucacccacaucuccggcucucgcaacuacacaaugaaccuagcaucccaaaacuggaacuccuacgaccccaccgaagaaauccccgcaccccuuggaacccccgacuucgucggcaaaauccaaggcguccuaacacaaacaacccgcacaaauggcagcacccgcgggcacaaagccacaguuuacacaggcagcgccgacuucucccccaagcuaggccgcguucaauucgccacagacaccgacaacgacuucgaaacaaaccaaaauaccaaguucacaccagucggcgucauccaagacggauccacaaccccacgcaacgaaccacagcaauggguucuccccuccuacuccggacgcaacauccacaauguccaccuagccccagccguagcuccaaccuuuccaggggaacaacucuuauucuuccgaucaaccaugccaggcugcuccggcuaccccaacauggaccuagacugucuacucccacaagaauggguucaauacuucuaccaagaagcagcccccgcucaaucagacgucgcccuucuccgauucgucaacccagacaccggcagaguucuuuucgaaugcaaacuccauaaauccggcuaugugaccgucgcgcauaccggacaacaugaccucguaaucccucccaacggcuacuuccgauucgacuccuggguuaaccaauucuacacgcucgcacccaugggcaacggaaccggcagacgccgcgcccucuaa

SEQ ID NO: 35856 - RNA, 1623 nt, Artificial Sequence
  derived and/or modified sequence opt11 from VP1__Norovirus__AFJ21424
augaaaauggccucauccgacgcaaacccaucugacggcuccaccgccaaucuuguacccgaaguuaacaacgaggucauggcucuagaacccgucgucggcgccgccauagccgcccccguagcaggccaacaaaacguaaucgacccguggauacgcaacaacuucguccaagcccccggaggagaguucacugucucaccccgcaacgcccccggugaaauacucugguccgccccucuaggccccgaccucaaccccuaccuuucccaccuagcccgaauguacaauggcuacgccggaggauucgaaguccaagucauccucgcaggaaacgccuucaccgccggaaaaaucaucuucgccgccguaccacccaacuuccccaccgaaggccuauccccuucccaagucaccauguucccccauauaauagucgacguuagacaacucgaaccaguccucaucccccuucccgauguacguaacaacuucuaccacuacaaccaauccaacgacccaaccaucaaacucaucgccaugcucuacacuccccuccgcgcaaacaacgccggcgacgacgucuucaccgucuccugccgcguccuuacccgcccaucccccgacuucgacuucaucuuccucgucccacccaccgucgaaucccguaccaaacccuucuccguaccaguacuaaccguugaagaaaugaccaacucacguuuccccaucccacucgaaaagcuauucaccggaccauccuccgccuucgucguccaaccccaaaacggaagaugcacaaccgacggaguccuccucggcaccacccaacuuucccccgucaacaucugcacuuuccgaggagacgucacccauaucccaggcagccguaauuacacaaugaaucuagccucccaaaacuggaacuccuacgaucccacagaagaaauccccgcuccccucggcacaccagacuucgucggaaaaauccaaggcguccucacccaaaccacacgcacuaacggcuccacaagaggccacaaggccaccgucuacaccggcuccgccgacuuuagccccaaacucggacgcguccaauucgcaacggacaccgauaacgacuucgaaaccaaccaaaacacuaaauuuaccccaguaggcgucauacaagacggcuccacaacuccccgcaacgaaccacaacaauggguccucccuucuuacucuggccggaacauccacaacguacaccuagcccccgccguagcacccaccuucccaggcgaacaacuacucuucuuccgcucuaccaugcccggaugcuccggcuacccaaauauggaccucgacugcuuacuuccucaagaauggguccaauacuucuaccaagaagccgcccccgcucaauccgaugucgcacuccuccgcuucguuaauccugauaccggccgcguccuguucgaaugcaaacuccacaaauccggcuacgucacagucgcccacaccggccaacacgaccucguaauaccuccgaaugguuacuuccgcuucgauucaugggucaaccaguucuacacacuagcacccaugggcaacggaaccggcagacgccgagcccuuuaa

SEQ ID NO: 35857 - RNA, 1623 nt, Artificial Sequence
  derived and/or modified sequence opt11 from VP1__Norovirus__AFJ21425
augaagauggccuccuccgacgccaaucccuccgacggcucaaccgccaaccucgucccagaagucaauaacgaagucauggcucuggaacccgucguuggagccgccauagcagccccagucgcuggccagcagaacgucaucgaccccuggauccgcaacaacuucguccaagcacccggcggagaauuuacagucuccccacgcaacgcacccggcgaaauacuuugguccgcaccccuaggaccagaccuaaaccccuaucucucacaccuagcccguauguacaauggcuacgcaggaggauucgaaguccaagucauacucgccggcaacgcauucaccgccggcaaaaucauauucgccgccgucccucccaacuuccccacugaaggacucuccccaucacaaguuaccauguucccccacaucaucguagauguacgccaacucgaacccguacuaaucccccucccagacguccgaaacaauuucuaccacuacaaccagucaaacgacccaacaaucaaacucauagccaugcuguacacgccccuccgcgccaacaacgccggcgacgacgucuucacugucagcugccgaguacuaacccgccccucccccgacuucgacuucauauuccugguacccccaaccgucgaaagccgaaccaaacccuucucagucccaguccucaccgucgaagaaaugaccaacucccguuuccccauccccuuagaaaaacuauucacaggccccuccuccgccuucgucguccaaccccaaaacggccgaugcaccaccgacggaguccuccucggcacaacccaacuauccccugucaacaucuguaccuuccgaggugacguaacucacauccccggcucacgcaacuacacaaugaaccuagccucccaaaacuggaacaacuacgacccaaccgaagaaaucccagcaccccucggaaccccagacuucgucggcaaaauccaaggcguucuaacacagaccacaagaacaaacggcuccacaagaggacacaaagccaccgucuacaccggcuccgccgacuucagccccaaacucggaagaguccaauucgcaacugacaccgacaacgacuucgaaacaaaccaaaacacaaaauucacaccagucggcgucauccaagacggcucaacaacaccccgcaacgaaccccaacaauggguacuccccuccuacuccggccgcaauauacacaacguccaccuggcccccgcugucgcaccuaccuuccccggcgaacaacuccuuuucuuccgcuccaccaugccaggcugcuccggauauccuaauauggaccuagacugccuccuuccgcaagaauggguacaauacuucuaccaagaagccgccccagcacaauccgacguagcacuacuccgauucgucaaccccgacaccggccgaguucucuucgaauguaaacuccacaaauccgguuacgucacagucgcccacaccggccaacacgaccuaguaaucccaccaaacggguacuuccgcuucgacucuugggucaaccaauuuuacacccucgcuccaaugggaaacggcacuggacgcagacgagcccucuaa

SEQ ID NO: 35858 - RNA, 1623 nt, Artificial Sequence
  derived and/or modified sequence opt11 from VP1__Norovirus__AFJ21426
augaagauggcauccuccgacgccaacccaucugacggaucaaccgcuaaccucguccccgaagucaacaacgaagucauggcacuagaaccggucgucggagcagccaucgccgcccccgucgcaggacaacaaaacgucaucgaccccuggauccgaaacaacuucguccaagcccccggcggcgaguucacugucagcccccgcaacgcaccgggagaaauccucuggucagcaccccuaggaccagaccuaaaccccuaccucucccaccuagcaagaauguacaacggcuacgccggaggauucgaaguacaagucauccucgcaggaaaugcauucacagccggcaaaaucaucuucgccgccgucccacccaacuuucccaccgaaggccucucccccucacaaguaacgauguucccccacaucaucgucgacgucagacagcucgaacccguacucaucccccuacccgacguccgaaacaacuucuaccacuacaaccaauccaacgaccccaccauaaaacuuaucgccaugcucuacacgccccuccgcgcuaacaacgcaggcgacgacgucuucacaguguccugccgcguccucacccgucccucaccagauuucgacuuuauauuccucguacccccaaccgucgaaucccgcacuaaacccuucuccguaccaguccucacugucgaagaaaugaccaacuccagauuccccauaccccuagaaaaacuauucaccggacccucaucagccuucguaguccagccccaaaacggucguugcaccacagacggcguacuacucggaacaacccaacuuagucccgucaacaucugcaccuuccgaggagacguuacacacauucccggcucccgaaauuacacaaugaaccucgccucccaaaacuggaacuccuacgacccaaccgaagaaauaccagccccacuaggaacccccgacuucguaggaaaaauccagggcguacucacucaaaccacacguaccaacggauccacccgaggccacaaagccaccgucuacaccggcuccgccgacuucucacccaagcucggcaggguccaauucgccaccgacacagacaacgacuucgaaaccaaccagaacaccaaauucacaccggucggcgugauccaagacggcucuacaaccccacgcaacgaaccccaacaauggguacuuccaagcuacuccggccgcaauauccacaacguacaccuugccccagcugucgcaccaaccuuccccggugaacaacuccucuucuuccgaucaacaaugccaggaugcuccggcuaccccaacauggaccuugacugccuacuaccccaagaauggguccaauacuucuaccaagaagccgccccagcacaaagcgacgucgcacuccucagauucguaaaccccgacacaggacgaguucucuucgagugcaaacuacacaaauccggauacgucaccgucgcucacacuggccaacacgaccuagucauucccccaaacggcuacuuccgcuucgacucauggguaaaccaauuuuacacacucgcacccauggguaacggcaccggacggcgccgcgcccuauaa

SEQ ID NO: 35859 - RNA, 1623 nt, Artificial Sequence
  derived and/or modified sequence opt11 from VP1__Norovirus__AFJ21428
augaaaauggccuccagcgacgccaaccccucagacggcucaacugccaaccucguccccgaaguaaauaacgaagucauggcccucgaacccgucguaggcgccgccaucgcugcccccgucgccggccagcaaaacgucaucgaccccuggauacguaacaauuucguccaagcccccggcggugaguucaccguaucaccccgcaacgcccccggcgaaauacucugguccgcaccccucggccccgaccucaauccauaccucucccaccuagccagaauguacaacgguuacgcaggcggauucgaaguccaagucauacuagcgggcaacgccuuuacagccggcaaaauaaucuucgccgcaguacccccuaacuuccccaccgaaggcuuauccccaucccaagucacuauguucccccacaucaucgucgacguccgccaacucgaacccguccuaauaccacuuccagacguucgaaacaacuucuaucacuacaaucaauccaacgacucaaccaucaaacucaucgcaaugcucuacacuccucuacgcgccaacaacgccggagacgacgucuucaccgucagcugccgaguccucacccgcccauccccugacuucgacuucauauuccucgucccacccacagucgaaucccgaaccaaacccuucuccguccccguacuuacaguggaagaaaugaccaacucccguuucccaauaccacuagaaaaacucuucacuggccccuccuccgcauucgucguccaaccucaaaacggccgaugcaccaccgacggaguccuucuuggcaccacccaacuuucacccgucaacaucugcacauuccgcggagauguaacccacaucuccggcucccgaaacuacaccaugaaccucgcaucccaaaacuggaacagcuacgacccagccgaagaaauccccgcaccacuuggcacccccgacuucgucggaaagauccaaggcguccucacacaaaccacacgcaccaacggguccacaagaggccauaaagccacagucuacacaggcuccgccgacuucucaccaaaacuuggccgaguccaauucgcaacagauaccgacaacgacuucgaaaccaaccaaaacacuaaauucacucccguuggcgucauccaagacggcucaaccacaccccgcaacgaaccccaacaauggguccuccccuccuauuccggacgcaacauccacaacguccaccucgcccccgcuguagcgcccaccuuccccggugaacaauuacucuucuuccgcuccaccaugcccggcugcuccggauacccaaacauggaccucgacugucuacuaccucaagaauggguccaauacuucuaccaggaagcagcccccgcccaauccgaugucgcacuccuacguuucgucaaccccgacacaggcagaguccucuucgaaugcaaacuccacaaauccggauacgucaccgucgcacacaccggacaacacgaccucgucauaccacccaacggcuacuuccgauucgacuccugggucaaccaguucuauacccucgcacccaugggaaacggcacaggcagacgacgcgcacucuga

SEQ ID NO: 35860 - RNA, 1623 nt, Artificial Sequence
  derived and/or modified sequence opt11 from VP1__Norovirus__AFJ21429
augaaaauggccucuucugacgcgaaccccucagacggcuccaccgccaaccucgucccagaaguuaacaacgaagucauggcucucgaacccguugucggcgcugcuaucgccgcacccguagccggccaacagaacgucaucgauccauggaucagaaacaacuucguacaagcucccggcggugaguucaccguaucaccccgcaacgccccaggugaaauccucugguccgcaccccuaggccccgaccucaacccauacuuaucccaccucgcccguauguacaacggcuacgccggcggcuucgaaguccaagucauccucgccgguaacgccuucacagccggcaaaauuauauucgccgcagucccacccaacuuccccaccgaaggccucucacccucucaaguaaccauguucccacacauaaucgucgacguacgucaacucgaaccaguccucauaccccuccccgacguccgcaacaacuucuaccacuacaaccaaucaaaugaccccacuaucaaacuaaucgcaaugcuuuacacaccccuccgagccaauaacgcaggcgacgacgucuucaccgucuccugccgcguacucacucgaccaucacccgacuucgacuuuaucuuccucguaccucccaccguagaaucccgcacaaaacccuucucuguccccguccuaaccguagaagaaaugaccaacucccgcuuccccauaccccucgaaaaacucuucacaggacccuccuccgccuucguuguccaaccccaaaacggccgaugcacaacagacggcguccuccucggcaccacacaacucucacccgucaauaucugcacauuccgaggugauguaacucacauccccggaucacgcaacuacacuaugaaccucgccucccaaaacuggaacuccuacgaccccacagaagaaaucccagccccacucggaaccccagacuucgucggaaagauacaaggaguacuaacccaaaccacacgcaccaauggcuccacccgcggccacaaagccaccgucuacacaggaucagcagacuucucaccaaaacuagggcgaguccaauucgcaaccgacacugacaacgauuucgaaaccaaccaaaacaccaaauucacccccgucggagucauccaagauggcuccaccaccccacgcaaugaaccucaacaauggguacuaccuuccuacucaggucggaacauacacaacguccaccuugccccagccgucgcaccaaccuuccccggcgaacagcuccucuucuuccgaucgacaaugcccgggugcuccggcuaccccaacauggaccucgacugccuacuaccccaagaauggguccaauacuucuaccaagaagcugcuccagcacaauccgacgucgcccuccuacgcuucgugaacccagauaccggacguguacucuucgaaugcaaacuucacaaauccggcuacgucaccguagcccacacaggccaacacgaccucguuaucccgcccaacggcuauuuccgcuucgacucaugggucaaccaauucuacacccucgcacccauggguaacgggacuggccgccgccgcgcacuuuaa

SEQ ID NO: 35861 - RNA, 1623 nt, Artificial Sequence
  derived and/or modified sequence opt11 from VP1__Norovirus__AFJ21430
augaagauggcaucaucagacgccaacccuucugacggcucaaccgccaaccuaguacccgaaguuaacaacgaagucauggcccucgaacccguaguaggcgccgccauagcugccccagucgccggccaacaaaacgucauugaccccuggauaagaaacaauuucguccaagcccccgguggcgaauuuaccgucagcccccgcaacgcaccaggcgaaauccuaugguccgcuccacuuggccccgaccuaaacccauaccuaucccaccucgcccgcauguacaacggcuacgccggcggcuucgaaguacaagucauccuagcaggaaacgcuuucacagccggcaaaaucauauucgcagccgugccaccuaacuucccaaccgaaggucuaucucccucccaagucaccauguucccccauaucaucgucgacguccgacaacuugaacccguccuuaucccacuccccgacguacgaaacaacuucuaccacuacaaccaauccaacgacccuaccaucaaacucaucgccaugcucuacaccccucucagagcuaacaaugcuggagaugacgucuucaccgugagcugccgcguucucacacgucccagcccagacuucgacuucaucuuucucgugccacccacaguagaaucccgcacaaaaccauucucuguccccguacucaccguggaagaaaugaccaacucacgcuuccccauccccuuagaaaaacucuucacaggaccauccuccgcauucgucguccaaccacaaaauggacguugcaccaccgauggaguucuccucggcacaacccaacuuuccccuguaaacauauguacauuccgcggcgacguaacacauauccccggcagccgcaacuacacuaugaaccucgccucacaaaacuggaacuccuacgacccaaccgaagaaauccccgcaccccuaggcacccccgacuucgucggaaaaauacaaggcguccucacccaaacaacacggaccaacggauccacacgcggccauaaagcaaccgucuacaccggaucagccgauuucuccccaaaacucggccgcguccaauucgcgaccgacacagacaacgacuucgaaaccaaucaaaacaccaaauucacccccguaggcguuauacaagacggcucaacgacaccccgcaacgaaccacaacaauggguccuaccauccuacuccggccgaaacauacacaacguacacuuagcccccgccguagcccccaccuuucccggcgaacaacuccucuucuuccgcucaacaaugccaggaugcucuggcuacccuaacauggaccuugauugccuccucccccaagaauggguccaauauuucuaucaagaagccgcccccgcccaaucagacgucgcacuccuccgcuucgucaaccccgacaccggccgcguccucuucgaaugcaaacuacauaaaucaggauacgucacuguagcacacacaggacaacacgaccucgucauaccgccuaacggauacuuccgauucgacucauggguaaaccaauucuacacacuugcacccaugggcaacggcacaggccgccgccgcgcccucuaa

SEQ ID NO: 35862 - RNA, 1623 nt, Artificial Sequence
  derived and/or modified sequence opt11 from VP1__Norovirus__AFJ21431
augaaaauggccucauccgacgccaaccccuccgacggcuccacagcaaaccucgucccagaagucaacaacgaagucauggcccuagaacccguagucggcgccgcaaucgcagccccagucgccggccaacaaaacgucauagacccauggauaagaaacaacuuuguccaagcaccagggggcgaauuuaccgucucuccacgaaacgccccgggcgaaauccuuuggucagcuccauuaggaccagaccuaaaccccuaucucagccaccuugcccgcauguacaauggcuacgcaggcggcuucgaaguccaggucauucucgccggcaacgcauucaccgccggcaaaaucaucuucgccgcagucccacccaauuuccccacagaaggauugucacccucccaaguaaccauguucccccauaucauugucgacguccgccaacucgaacccguacuuaucccacucccagacguccgcaacaacuucuaccacuacaaccaauccaacgaccccaccauaaaacucaucgccaugcucuacacuccccuccgagcaaacaacgcaggcgacgacgucuucaccgucucaugccgaguacucacccgccccagccccgacuucgacuucaucuuccuugugcccccuaccgucgaaucucgcaccaaaccauucucagucccagucuuaaccgucgaagaaaugaccaacucacgcuucccaauaccucuagaaaaacucuuuaccggaccaucauccgccuucgucguccaaccacaaaauggccgaugcaccaccgacggaguccuucuuggcacaacccaacugagcccgguaaacauaugcaccuuccgaggcgacguuacacacauaccaggcuccaggaacuauaccaugaaccucgcaucccaaaauuggaacagcuacgaccccaccgaagaaauccccgcaccccucggcacccccgauuucgucggcaaaauccaaggcguccucacgcaaacaaccagaaccaacggcuccacacgcggccacaaagccaccgucuacaccggcuccgcagacuucucccccaaacucggccgcguccaauuugcaaccgacacugacaacgacuucgaaaccaaccaaaacacuaaauucaccccagucggcguaauccaagacggcucaacaacaccccgaaacgaaccacaacaauggguacuacccuccuacucuggacgcaacauccacaacguccaccuagcaccagccguagccccaaccuucccgggagaacaacuccucuucuuccgauccaccaugccuggaugcucuggauacccuaacauggaccuagacugccuccucccucaagaauggguccaauacuucuaccaagaagccgcccccgcccaauccgacgucgcccuacuacguuucgucaauccagacaccggccguguccucuucgaaugcaaacuccacaaauccggauacguuaccguagcccacaccggccaacacgaccuagucaucccaccaaacggauacuuccgcuucgacucguggguaaaccaauuuuacacccuugcccccaugggcaacggaacaggacgccgcagagcacucuag

SEQ ID NO: 35863 - RNA, 1623 nt, Artificial Sequence
  derived and/or modified sequence opt11 from VP1__Norovirus__AFJ21432
augaaaauggccuccucagacgccaacccauccgauggcuccacagccaaccucguacccgaaguuaacaacgaaguaauggcacuagaaccgguugucggcgcugccauagcagcacccgucgccggacaacaaaacgucauagacccauggauccgcaacaacuucguacaagcgcccggcggcgaguucaccguaucaccccggaacgccccgggcgaaauacuauggucugccccacuaggaccugaccuaaacccauaccuuucccaccuagcccguauguacaacggcuacgccggcggauucgaaguacaaguaauucuagcuggcaacgccuucaccgccggcaaaaucauauucgccgccguaccacccaacuuuccaaccgaaggacucucucccucccaaguaaccauguucccccacauaaucgucgacguacgccaacuagagccaguccucauaccccucccugacguacgaaacaauuucuaccacuacaaccaauccaaugaccccaccaucaaacuaaucgccaugcucuacaccccucucagagcaaacaacgccggggacgacguauucaccgucucaugcagaguccuaacccgaccauccccagacuucgacuucaucuuccuagucccacccacagucgaaucccgcacuaaacccuucagcguccccguccucaccgucgaagaaaugacaaacucucgcuuucccauaccccucgaaaaacuauucacagguccauccuccgcauucgucguccagccccaaaacgguagaugcaccacagacggcguccuacuuggcaccacccaacuaucucccguaaacauaugcaccuuucgcggcgacguuacccacacgcccggaucacacaacuauaccaugaaucucgcaucccaaaacuggaacuccuacgaccccacagaagaaauuccugcaccccuaggcacccccgacuucguaggcaaaauccaaggcguauuaacacaaaccacaagaaccaacggcuccacucgaggccacaaagccaccgucuacaccggcuccgccgacuucucccccaaacuaggccgaguccaauucgccaccgacaccgacaacgacuucgaaaccaaccaaaacacuaaauucacccccguaggugucauccaagacggaagcacaacuccccgaaacgaaccccaacaauggguacuacccucauacucuggucgcaacauacacaacguccaccuagccccagccgucgcccccaccuucccaggcgaacaacuccucuucuuuagaucuaccaugccuggcugcucaggcuaccccaacauggaccucgacugccuucuaccccaagaauggguccaauacuucuaccaagaagccgcaccagcucaauccgacgucgcacuacuccgcuucgucaaccccgacaccggccgcguacucuucgaaugcaagcuccacaaauccggcuacgucaccgucgcccacaccggacaacacgacuuagucauuccacccaacggcuauuuccguuucgacuccuggguuaaccaauucuacacgcuagcccccaugggcaacggaaccggacgucgccgagcccucuga

SEQ ID NO: 35864 - RNA, 1623 nt, Artificial Sequence
  derived and/or modified sequence opt11 from VP1__Norovirus__AFJ21433
augaaaauggccucgagcgacgcaaaccccuccgauggcucaacagcgaaccucgucccagaagucaacaacgaagucauggcccuagaaccagucguaggcgccgccaucgcugcccccgucgccggccaacagaacgucaucgacccauggauacgcaacaacuucguccaagcccccggcggugaguucaccguaucaccaagaaacgcacccggcgaaauccuaugguccgcuccccuaggcccggaccucaacccauaccuaucccaccuugcccgaauguacaacggcuacgccggcggcuucgaaguccaagucauucuagccggcaacgccuucacagcaggcaaaauaaucuucgccgccguacccccaaauuucccaaccgaaggccucuccccaucacaagucacaauguucccccacaucaucgucgacguacgccaacuagaacccguucucauaccccuccccgacguuagaaacaacuucuaccacuacaaccaauccaacgaccccaccauaaaacucaucgccaugcucuacacaccccuccgcgcuaacaaugccggcgacgacguuuucaccgucucuugccgcguccucacccgacccagccccgacuuugacuucaucuuccucguacccccaaccgucgaaucccgaaccaaacccuucucugucccaguccucaccguccaggaaaugaccaauucacgcuuccccaucccccuagaaaaacucuucaccggccccuccuccgcuuucgucguccaaccccagaacggccgcugcacaaccgacgguguccuccucgggaccacacaacuaucacccgucaacaucugcacauuccgcggcgacgucacacauauacccggaucacgcaacuacaccaugaaccuugcuucccaaaacuggaacuccuacgacccaacugaagaaaucccagcaccccucggcacacccgacuucgucgguaaaauccagggcguccucacccaaaccaccaggacaaacggauccacaagaggccacaaggccaccguauacaccggcucagccgacuucucaccaaaacuaggucgcguccaauucgcaaccgacaccgacaacgacuucgagaccaaucaaaacacuaaauuuaccccuguagggguaauucaagacggaagcacaacccccagaaaugaaccccaacaauggguccugccaucauacuccggccgaaauauccacaacguccaccucgcacccgcagucgcacccaccuucccuggcgaacaacuccuguucuuccgcuccacaaugccuggcugcucaggcuaccccaacauggaccuggacugccuacucccccaagaauggguccaauacuucuaccaagaagcggcccccgcccaauccgacguagcacuucuacguuucgucaaccccgacacaggacgaguacucuucgaaugcaaacuccacaaauccggcuacgucacugucgcccacaccggccaacacgaccucgugauacccccuaacggcuacuuccgcuucgacucaugggucaaccaauuuuacacccucgcacccaugggcaacggaaccggucgccgccgcgcccucuga

SEQ ID NO: 35865 - RNA, 1623 nt, Artificial Sequence
  derived and/or modified sequence opt11 from VP1__Norovirus__AFJ21434
augaagauggccucauccgacgccaaccccagcgacggaucaaccgccaaccucguuccagaagucaacaacgaagucauggcccucgaaccaguaguaggcgccgccaucgccgcacccguagccggccaacaaaacguaaucgaucccuggauacgcaacaacuucguccaagcacccggcggcgaguuuaccguuuccccucgcaacgcccccggcgaaauacugugguccgcuccacuaggccccgaucucaaccccuaccucucccacuuagcccgaauguacaacggcuaugcuggaggcuucgaaguccaagucauccucgccgguaacgccuucaccgccggcaaaaucauauucgccgccguaccaccaaacuucccgaccgaaggccucucacccucccaagucaccauguucccucacauaauaguagacguacgacaacucgaacccguauuaaucccccuccccgacguccgaaacaacuucuaccacuacaaccaaagcaacgacuccaccauuaaacuaaucgccauguuauauacuccccuccgcgccaacaacgccggcgacgaugucuucaccgucuccugucgcguccucacccgccccucccccgacuucgauuucauuuuccucgucccacccaccguugaauccagaacuaaaccuuucuccguccccguauuaaccgucgaagaaaugacaaacucccgauuccccaucccgcuggaaaaacucuucaccggcccauccucggccuucgucguccaaccucaaaacggcagaugcacuaccgacggcguacuucuaggaaccacccaacuaucccccgucaacauuugcaccuucagaggcgacgucacacacaucuccggcucccgcaacuacaccaugaaccucgcaucacaaaacuggaacuccuacgaccccaccgaagaaauccccgcuccccuuggcacccccgacuucguaggaaaaauccaaggaguccuaacccaaaccacccgcacaaauggauccacccgcggacacaaggccaccgucuacacaggauccgccgacuucucccccaaacucggccguguccaauucgcaaccgacaccgacaacgacuucgaaaccaaccaaaacaccaaauucacacccguaggcgucauacaagacgguucaaccacaccacgcaacgaaccccaacaauggguacuaccauccuacucaggccgcaauauccacaacguacaccucgcccccgccguugcccccaccuuucccggagaacagcuccucuucuuccgcucuacaaugcccggcuguucaggcuaccccaacauggacuuagacugccugcucccccaggaauggguccaauauuucuaccaagaggccgccccugcucaaucagacgucgcccuacuccgauucgucaaucccgacacaggccgaguccucuucgagugcaaacuacacaaaucaggcuacguaaccgucgcacacacaggccaacacgaccucgucauacccccaaacggcuacuuccgcuucgauagcugggucaaccaauucuacacccuagcccccaugggcaacggcaccggacgacgccgcgcucuauag

SEQ ID NO: 35866 - RNA, 1623 nt, Artificial Sequence
  derived and/or modified sequence opt11 from VP1__Norovirus__AFJ21436
augaaaauggcuuccucagacgcaaaccccuccgacggcuccacagcaaaccuaguacccgaaguuaacaaugaagucauggcacucgaacccgucguuggcgccgcaaucgccgcaccagucgcaggccaacaaaacgucauagaccccuggauccgcaacaacuucguccaagcccccggaggcgaauuuaccgucucaccccgaaacgcccccggcgaaauccucuggucggcuccccucggccccgaccucaacccauaccucucccaccucgcccgcauguacaacggauacgccggcggcuucgaaguccaaguuauccuagccggcaacgccuucaccgcuggaaaaaucaucuucgcagccguacccccaaacuuccccaccgaaggucucuccccuucccaagucaccauguucccucacaucaucgucgacguccgccaacuugaacccguccuaaucccccuacccgacguccgcaauaacuucuaccacuacaaccagucuaacgacccaaccauaaaacuaaucgccaugcucuacacuccucuccgagccaacaaugccggagacgacgucuucaccguaagcugccgaguccuaacacgccccagccccgacuucgacuucauuuuccucgucccgcccaccgucgaaucccgaaccaaaccauucuccguccccguucucaccgucgaagaaaugacaaauucccgguuccccaucccccuggaaaaacucuucaccggccccuccagcgccuucgucguccaaccccaaaauggacgaugcaccaccgacgguguacuccucggcacuacccaacuuucccccgucaacauaugcacuuuccgcggcgacgucacccacauccccggcucccgcaacuacaccaugaaccuagcaagucaaaacuggaacuccuacgaccccaccgaagaaauccccgccccucucggaaccccugacuucgucggcaagauccaaggcguccucacccaaacuacccguaccaauggcuccacccgcggccacaaagcaacagucuacacaggcagugccgacuucuccccgaaacuaggcaggguacaauucgcaaccgacacagauaacgauuuugaaaccaaccaaaacacaaaauucacccccguugggguaauccaagacggcagcacuacaccacguaacgaaccccaacaguggguccucccauccuacagcggccgcaauauacacaacguacaccucgcccccgccguagccccgaccuuccccggagaacaacuccuauucuuccgcuccaccaugcccgguugcucaggcuaccccaacauggaucucgacugucuucucccacaagaauggguccaauacuucuaccaagaagcugcaccagcucaauccgacguagcacuacuaagauuuguaaaccccgacaccggaagaguccucuucgaaugcaaacuccacaaaagcggcuacgucacagucgcacacacaggccagcacgaucucgucaucccacccaacggauacuuccgguuugacucaugggucaaccaauucuacacccucgcccccaugggcaacggaacaggccgccgucgagcgcucuaa

SEQ ID NO: 35867 - RNA, 1623 nt, Artificial Sequence
  derived and/or modified sequence opt11 from VP1__Norovirus__AFJ21437
augaaaauggcauccuccgaugcaaacccaagcgacggcuccaccgccaaccuuguuccugaagugaacaaugaggucauggcccucgaaccuguugucggcgccgcaaucgccgccccaguugccggacaacagaacguaauugaccccuggauacgcaacaacuucguccaagcacccggcggcgaauuuaccguaagcccccgcaacgcaccaggcgaaauccucugguccgcaccccucggacccgaccuaaacccauaccuaucacaccucgcccgcauguacaacggauacgcuggcggauucgaaguacaagucauccuagcgggcaacgcuuucaccgccggcaagauuaucuucgccgcuguacccccuaacuucccaaccgaaggacucucucccucucaagucaccauguucccccacauaaucgucgacguccgacaacucgaaccaguacucauccccuuacccgacguccgaaacaacuucuaucacuacaaccaauccaacgacucaacaaucaaacucauagcaaugcuuuacaccccacuacgagcaaacaacgccggagacgacguuuucacagucuccugcagaguccucacccgccccagccccgauuucgacuucaucuuccuagucccucccaccguugaaucccgcaccaaacccuucuccgugcccguccuuaccguugaggaaaugacaaacucucgcuuccccauaccccuugaaaaacucuuuaccggccccuccagcgccuuugucguccaaccccaaaacggccgcugcacaacugauggcguccuacuagguaccacacaacuaagccccgucaacauuugcaccuuccgcggagacguaacccacaucuccggcucccgaaacuacaccaugaaccuugccucacaaaacuggaacucuuacgacccaaccgaagagauccccgcgccccuuggcaccccagacuucgucgguaaaauacaaggcguccuaacccagaccacccgcaccaacggcuccacccgcggccacaaagccaccgucuauaccggcucagccgauuucuccccuaagcucggccgaguccaauuugccaccgacacugacaaugacuucgaaaccaaccaaaacacgaaguucacccccgucggugucauacaagacggcuccaccaccccacgcaaugaaccacaacaauggguccucccauccuauucaggccgcaacauccacaacguacaccucgcccccgcaguagccccaaccuuuccaggcgaacaacuccucuucuuccgcucaaccaugccaggcugcucaggauaucccaacauggaccuugauugccuccuaccccaagaauggguccaauacuucuaccaagaagccgcgcccgcccaaucugauguugcccuacucagauuugucaaucccgacaccggcagaguccuuuucgaaugcaagcuccacaaauccggcuacguaaccgucgcccacaccggacaacacgaucucgucaucccacccaacggcuacuuccgcuucgacuccugggucaaccaauucuauacccuagcgccuauggggaacggcacuggucgccgccgcgcccucuga

SEQ ID NO: 35868 - RNA, 1623 nt, Artificial Sequence
  derived and/or modified sequence opt11 from VP1__Norovirus__AFJ21438
augaaaauggcaucaucagacgccaaccccuccgauggcuccacugcaaaccucguccccgaaguuaacaacgaagucauggcacuugaacccguagucggcgccgcaauagccgcccccguugccggccaacaaaacgucaucgaccccuggauccgaaacaacuucguacaagcccccggcggagaguucaccgucucacccagaaacgccccuggagaaauccuuuggucugccccacuaggccccgaccuaaaccccuaccucucccaccucgcccguauguacaacggcuacgcaggcggcuucgaaguacaaguaauacucgcaggcaacgccuucaccgcaggcaaaaucaucuucgcagcaguuccucccaacuuccccaccgaagggcuaucccccucccaaguaaccauguucccccacaucaucguagacguccgccaacucgaaccaguccucaucccccuccccgacguacgaaacaacuucuaccacuacaaucaaucaaaugacccaaccaucaaacucaucgccaugcucuacacaccccuacgcgccaacaaugccggcgaugacguauuuaccgucucaugccguguccuuacccgacccucaccagacuucgacuucaucuuccucgucccacccaccguagaauccagaaccaaacccuucagcguacccguccuuaccgucgaggaaaugaccaacucccgguucccuaucccccucgaaaaacucuuuaccggaccaucauccgccuucguuguccaaccucaaaacggucgcugcacaaccgacggaguccuccucggaaccacccaacucucccccgucaacaucugcaccuuccgaggcgacgucacacacaucccaggcuccagaaacuauaccaugaaccucgcaucccaaaacuggaacucuuacgacccuacagaagaaauccccgcaccccucggcacccccgauuucguaggaaaaauccaaggcguacucacccaaaccacucgcacaaacggaagcacccgaggccacaaagcaaccgucuacacaggcuccgccgacuuuagccccaagcucggcagaguccaauucgccacagacacugauaacgacuucgaaaccaaccaaaauacaaaauucacccccguaggcgucauccaagacggcuccacaacaccccgaaacgaaccccaacaauggguacucccuagcuacagcggccguaacauucacaacguccaccuagcccccgcagucgccccaacauucccaggcgaacaacuucuauucuuccgcuccaccaugcccggcuguuccggauacccaaacauggaccucgacugccuccucccccaagaaugggugcaguacuuuuaccaagaagcagcccccgcacaaucggacguggcccuacuccguuucguaaacccggacaccggucgcguccucuucgaaugcaagcuccacaaauccgguuacgucacagucgcacacauaggucaauacgaccucguaaucccacccaacggcuauuuccgauucgauagcuggguaaaucaauucuacacacucgcgcccaugggcaacggaacuggccgacgacgcgcucucuaa

SEQ ID NO: 35869 - RNA, 1623 nt, Artificial Sequence
  derived and/or modified sequence opt11 from VP1__Norovirus__AFJ21439
augaaaauggccagcuccgacgccaaccccucagacggcagcacagccaaccuagucccagaagucaacaaugaaguaauggcccucgaaccaguuguaggcgccgccaucgcugcccccgucgccggccaacagaauguuauugaccccuggauccgaaacaacuucgugcaagcaccaggcggugaguucaccguuucuccccgcaacgcccccggcgaaauuuuaugguccgcaccccuaggcccagaccucaaccccuaccucucccaccuagcccgcauguacaacggcuacgcuggcggcuucgaaguccaagucauccuagccggcaaugccuucaccgccggaaagauaaucuucgccgccgucccaccuaacuuccccaccgaaggccucucucccucccaaguaaccauguucccucacauaaucgucgacguccgccaacuagaacccguucucauaccccuacccgacgucagaaacaacuucuaccacuacaaccagucaaacgaccccacaauaaaacuaaucgcuaugcucuacaccccucuccgagcaaacaacgccggcgaugacgucuucaccgucucuugccgcguccuaacccgcccuucacccgacuucgacuucaucuuccucgucccgcccaccguagaaucccgcacaaaacccuucucaguccccguccuuacaguagaagaaaugacaaacucccgauuccccauaccccucgaaaaacucuucaccggccccuccucagccuucguaguacaaccucaaaacggcagaugcaccacugacggcguccuccucggcacaacacaacucuccccagucaacaucugcacauuccgcggcgacguaacccacauuucuggcucucgcaacuacacaaugaaccucgccucccaaaacuggaacucauacgaccccaccgaagaaauaccagcaccccucggcacacccgacuucgucggcaaaauccaaggcguccucacccaaacaaccagaacaaacggcuccacacguggacacaaagccacagucuacaccggcucagccgacuucucaccaaaacucggccgcguccaauucgcgacagacaccgacaacgacuucgaaaccaaccaaaacaccaaauucacccccgucggcguaauacaagacggauccacaacaccccgcaacgaaccacaacaauggguccuccccuccuacuccggacgcaacauucacaacguccaccuagccccggccguagcccccacguuccccggugaacaacuacucuucuuccgaucaacaaugcccggcugcucuggcuaccccaauauggaccucgacugccuccucccccaagaauggguacaauacuuuuaccaagaggccgcucccgcccaauccgacgucgcucuacuccgcuucguaaaccccgacaccggccgcguacucuucgaaugcaaacuccacaaaucuggcuauguaaccgucgcucacacaggccagcacgaccuaguaaucccacccaacggcuacuucagauucgacuccugggucaaccaauucuacacccucgcacccaugggcaacggcaccggcagacgccgcgcccucuaa

SEQ ID NO: 35870 - RNA, 1623 nt, Artificial Sequence
  derived and/or modified sequence opt11 from VP1__Norovirus__AFJ21440
augaaaauggccucuucagacgccaacccaucagacggcagcacagccaacuuaguccccgaaguaaauaacgaagucauggcacucgaaccaguaguaggcgccgccaucgcugcccccgucgcuggccaacaaaacguaaucgacccauggauccgaaacaacuucguccaagcacccggaggcgaguucaccguaagcccccgaaacgcccccggagaaauacuauggucggcaccccucggcccagaccucaauccauaccucucacaccuagcccguauguacaacggcuacgcaggcggcuuugaaguacaaguaauacuagcaggaaacgccuucaccgcaggaaaaaucaucuucgccgccguaccacccaacuuccccacagaaggccucucccccucucaagucacaauguucccccacaucaucguugacguucgacagcucgaaccaguacucaucccacucccagacguccgcaacaacuucuaccacuauaaccaauccaacgacccgaccaucaaacuaaucgccaugcucuacaccccacuccgugccaacaacgccggcgacgacguauucaccgucucuugccggguacuaacccgccccagcccagauuuugacuuuaucuuucuugucccaccaacagucgaaucccgcaccaaaccauucuccguccccguccuaaccgucgaagaaaugaccaacucacgauuccccaucccccucgagaaacuauucaccggccccuccuccgccuucgugguccaaccccaaaacggccgaugcaccacagacggaguuuuauuaggcacaacccaacuauccccagucaacaucugcacauuccgaggagacgucacccacauccccggcagccgaaacuacacaaugaaccuagccagccaaaacuggaacucauacgaccccacagaagagauccccgcuccccuaggcacaccagacuucguaggcaaaauacaaggcguauuaacccaaacaacgcgcgccaacggcuccacacgaggccacaaagccaccgucuacaccggcucagccgacuucuccccaaagcuaggccgaguacaauuugccaccgauacagacaacgacuucgaaaccaaccaaaauacaaaauuuacccccguuggagucauacaagacggcuccaccacaccccggaacgaaccacaacaauggguauuaccaagcuacucuggccguaacauccacaacguccaccuagcccccgccgucgcccccaccuuccccggcgaacaacuccucuucuucagauccaccaugcccggcugcuccggcuaccccaacauggaccucgacugccuccucccccaagaauggguacaauacuucuaccaagaagcagcccccgcgcaauccgacguagcccuccuccgauuuguaaacccagacaccggcagaguccucuucgaaugcaaacuccauaaaucaggauacgucaccgucgcccacaccggccaacacgaucugguaauaccacccaacggcuacuuccgauucgauagcugggucaaccaauucuacacgcucgccccaaugggaaauggaaccggccguagacgcgcauuauaa

SEQ ID NO: 35871 - RNA, 1623 nt, Artificial Sequence
  derived and/or modified sequence opt11 from VP1__Norovirus__AFJ21441
augaaaauggccucaagcgacgcaaaccccuccgacggaucaaccgccaaccucguccccgaaguaaacaccgaagucauggcccuagagcccgucgucggcgccgccaucgcagcacccgucgcaggccaacaaaacgucauagacccauggauacgcaacaacuucguccaagccccaggcggcgaauuuacagucucaccccgcaacgcccccggcgaaauccucugguccgcaccccugggcccugaccucaacccuuacuuaucccaucuugcccgcauguacaacggauacgccggcggauuugaaguccaaguuauccucgcaggaaacgccuucaccgcgggcaaaauaaucuucgccgccguuccacccaacuuccccacagaaggacuaucccccagccaagucaccauguucccccacaucaucgucgacgucagacaacuagagccaguccucauaccccuaccagacguccgcaacaacuucuaccacuacaaccaauccaacgacccaaccaucaaacuaaucgccaugcucuauacaccccuacgagcaaacaacgccggagacgacgucuucaccgucuccugccguguccucacccgccccuccccagacuucgacuucaucuuccucguacccccuaccguagaaucccgcaccaaaccauuuuccguacccguacuuaccgucgaagaaaugacaaacagccgauuccccauaccauuagaaaaacucuucaccggccccuccuccgccuucgucguccaaccccaaaacggucgaugcaccaccgacggaguccuacuaggcacuacccaacucucccccguaaacauaugcaccuucagaggcgacgucacucacauccccggcucccgcaacuacacaaugaaccucgccagccaaaacuggaacuccuacgaccccaccgaagaaauccccgcuccccucggaaccccagacuucgucggcaaaauccaaggcguucuuacacaaaccacccgcacaaacggauccacacgaggccacaaagccaccgucuacacgggaucagcagacuucuccccuaaacucggacgcguucaauuugcaaccgacacagacaacgacuucgaaaccaaccaaaacaccaaauucacaccuguaggagucauccaagacggcucaaccacgccccgaaacgaaccacaacaauggguccuuccauccuacuccggucgaaauauccacaacguacaccucgcccccgcaguagccccuacuuuccccggcgaacaacuccuuuucuuccgcucgacaaugcccggcugcuccggcuaccccaacauggaccuagacugccuccuaccccaagaaugggugcaauauuucuaccaagaggcagcacccgcccaaucagacgcagcacuucuacguuucguaaaccccgacacuggucgcguacucuucgaaugcaaacuccauaaauccggauacguaacuguugcccacaccggucagcacgaccuagucaucccacccaacggauacuucagauucgacucaugggucaaccaauucuacacccuagcccccaugggcaacggaacuggaagacgccgcgcccuauaa

SEQ ID NO: 35872 - RNA, 1623 nt, Artificial Sequence
  derived and/or modified sequence opt11 from VP1__Norovirus__AFJ21442
augaaaauggcauccaacgacgccaacccauccgacggcucggccgcuaaccucguaccggaagucaauaacgaagucauggcccucgaacccguagucggcgccgccaucgccgcccccgucgcaggccagcaaaacgucaucgacccauggauccgcaacaacuucguacaagcccccgguggcgaguucaccgucucaccccgcaacgccccuggcgaaaucuuaugguccgccccacucggccccgaccuaaaucccuaccuaucccaccuugcucgcauguacaacggcuacgcaggcggauuugaaguacaagucauccucgccggcaacgccuucacugccggcaaaaucauauucgcagccgucccaccuaacuuuccaaccgaaggccuauccccaucacaaguuaccauguucccccacaucauagucgacguucgccaacuagaacccguccuaaucccucuccccgacguccgcaacaacuucuaccacuacaaccaguccaacgacucgaccaucaaacuaaucgccaugcuauacacuccucuccgagccaacaacgccggcgacgacguuuucacuguaucuugccgcguccucacccgccccuccccugacuucgacuucaucuuucucguacccccaacagucgaaucgcgaacaaagucauucacagucccaauacucacagucgaagaaaugaccaacucaagauuccccauaccccuugaaaaacuauucacaggacccucuuccgccuucgucguccagccacaaaauggccguugcacaaccgacggcgugcuacuuggaaccacccaacucucacccguuaacaucugcaccuuccgcggagacguaacccacauagcaggcucgcgcaacuacaccaugaaccuagccucacuaaacuggaacaacuaugaccccacagaagaaauccccgccccacucggcaccccagacuucgucggcaagauccaagguguacucacccaaacaaccaaaggcgacggcucaacacgcggacacaaagccacagucuacaccggauccgccgauuucacccccaaacucggcagcguccaauucggaacagacacagacaacgacuucgaaacccaccaaaacacuaaauucaccccugucggcguaauccaggacggauccacuacacaucgaaacgaaccccagcaauggguacuaccuuccuauuccggcagaaacguacacaacguccaccuugcccccgccguugcacccaacuucccuggcgaacagcuccuguucuuccgcucuacaaugcccggcugcucaggcuacccaaacauggaccuagauugucuccucccccaagaauggguacaacacuucuaccaagaagccgcucccgcacaauccgacguagcccuccuacgguucguaaacccagacacaggccgaguucuauucgaauguaaacuccacaaaucaggcuacgucaccgucgcacacaccggccaacacgaccucgucaucccuccaaacggcuacuuccgauucgacuccuggguaaaccaauucuacacacucgcucccaugggcaacggagccggccgaaaacgcgcacuauaa

SEQ ID NO: 35873 - RNA, 1623 nt, Artificial Sequence
  derived and/or modified sequence opt11 from VP1__Norovirus__AFJ21443
augaaaauggccucauccgaugcaaacccauccgacggcucuacagcaaaccucguacccgaaguuaacaacgaagucauggcccuagaaccaguuguuggagcagccaucgccgccccagucgccggccagcaaaacgucaucgaccccuggauccgaaacaacuucguccaggcgccaggcggcgaguucaccguaucgccccgcaaugcccccggagaaauccucugguccgcuccacucggacccgaccuaaacccauaccuaucacaccucgcccgcauguacaacggcuacgccggcgguuuugaaguucaaguaauacucgccggaaacgccuucaccgcuggcaaaaucauauucgcagccguaccaccaaacuucccuaccgaaggucuauccccaucccaaguuaccauguucccccacaugaucguagacgugcgucaacucgaacccguccucaucccccuucccgacguccgcaacaacuucuaccacuacaaccaaucaaacgacccaaccaucaaacuaauagcaaugcucuacacaccccucagagcaaacaacgccggagacgacguauucaccguuagcugccgcgugcuuaccagacccuccccagauuucgacuucaucuuccucguacccccaacugucgaaucccgcacaaaacccuuuucuguacccguacucaccgucgaagaaaugaccaacucccgcuuccccaucccccuagaaaaacucuucacaggcccaucauccgcauucguaguccaaccacaaaacggccgcugcaccacagacggcguacuccucggcacaacccaacuauccccaguaaacaucugcacauuccgcggcgacguaacccacacuccaggcucacacaacuacaccaugaaccucgccagccaaaacuggaacucauacgacccgaccgaagaaauacccgcaccccucggcacuccagauuucguaggcaaaauccaaggggucuugacacaaaccacacgcaccaacggcuccacccgcggccacaaagccacagucuacacaggauccgccgacuucucccccaaacuaggcagaguacaauucgccaccgauaccgacaacgacuucgaaacaaaccaaaauacuaaauuuacccccguaggcgucauacaagacggcucaaccacaccucgaaacgaaccccaacaauggguccuaccauccuacuccggccgcaacauccacaacguccaccucgccccggcagucgcacccacuuucccuggugaacaacucuuauucuuccgcucuacaaugcccggaugcuccggguaccccaacauggaccucgacugccuccucccucaagaauggguccaauacuucuaccaagaagccgcacccgcacaguccgacguagcacuccuccgcuucgucaacccagacacgggccgcguucucuucgaauguaagcuccacaaaucaggcuacgucaccguagcucacacaggccaacacgaccucgucauacccccaaacggcuacuuccgauucgacuccugggucaaccaauucuacacccucgccccuaugggaaacggcaccggccgucgccgcgcccucuaa

SEQ ID NO: 35874 - RNA, 1623 nt, Artificial Sequence
  derived and/or modified sequence opt11 from VP1__Norovirus__AFJ21444
augaaaauggccagcuccgacgcuaaccccuccgacggauccaccgcaaaccucguacccgaagucaacaacgaagucauggcccuagaacccgucgucggcgccgccaucgcugcacccguugccggccaacaaaacgucaucgaccccuggauccgaaauaacuucguacaagccccuggcggcgaguucacagucucgccccgaaacgccccaggagaaauccucuggagcgcaccccucggcccagaccugaaucccuaccucucucaccuagccagaauguacaacggcuacgcaggcggcuucgaaguacaagucauacuagcaggaaaugcauucacagccggaaaaaucauauucgccgccguacccccgaacuucccaaccgaaggacucuccccuucccaagucacaauguucccacacaucauaguagacguccgccaacucgaacccguccucaucccccuccccgauguucgcaacaacuucuaccacuacaaccaaagcaacgaccccaccauaaaauuaauagccaugcuauacaccccucuucgcgccaacaacgcaggcgaugacgucuucaccgucucgugcagaguacuaacccgcccuuccccggacuucgauuucaucuuccuagucccacccaccgucgaaagccgaaccaaaccauucagcguaccaauccucaccgucgaagaaaugaccaacucccgcuuccccaucccccucgaaaaacucuucacaggcccaagcagcgcauucgucguccaaccacaaaacggccgcugcaccacagacggcguacuccuaggcaccacccaacuuuccccaguaaacauuugcaccuuccgcggcgacgucacgcacaccgccggcucgcacaacuacaccaugaaccucgccucacaaaacuggaacuccuacgacccaaccgaagaaauacccgcuccccuaggcacacccgacuucguaggcaaaauccaaggcguccucacccaaaccacucgcgccgacggcucaacacgaggccacaaagccacagucuacaccgguuccgcagaguucucccccaaacucggccguguacaauucgccacagacaccgacaaugacuucgacgcaaaccaaaacaccaaauucaccccaguaggaguaauacaagacggaggcaccacccacagaaacgaaccccaacaauggguacuaccuucguacuccggccgaaacacacacaacguucaccucgcccccgccgucgcaccaacguucccaggcgaacaacuccuauucuuccgauccaccaugccaggcugcuccggcuacccaaacauggaccucgacugccuccuaccccaagaauggguacaguacuucuaucaagaagcagcccccgcacaaagcgacgucgcccuccuccgauucguaaaccccgacaccggccgcgucuuauucgaaugcaaauuacauaaaucaggcuacgucacagucgcucacaccggccaacacgaccuaguuaucccgcccaacggauauuuccgauucgacuccuggguaaaccaauucuacacacucgcccccaugggcaacggcacaggccgacgacgugcacucuaa

SEQ ID NO: 35875 - RNA, 1623 nt, Artificial Sequence
  derived and/or modified sequence opt11 from VP1__Norovirus__AFJ21445
augaaaauggcuuccucugacgccaaccccuccgacggcuccacagcaaaucucguccccgaagucaacaacgaaguaauggcccucgaacccgucguaggugcagcuaucgccgcccccgucgccggccagcaaaacguaauagaccccuggauucgaaauaacuucguccaggccccugguggcgaguucaccguaucaccccgcaacgccccaggagaaauccucuggucagccccucuuggcccagaccucaaccccuaccucucccaccucgcccgcauguacaacggguacgcgggaggcuucgagguccaaguuauccucgccggcaacgccuucaccgccggcaaaauaaucuucgccgccguucccccaaacuuccccaccgaaggccuauccccaucccaagucacuauguucccacacaucauugucgacguccgccaacucgaacccguccucaucccccuucccgacgucagaaacaacuucuaccauuauaaccaaucaaacgaccccaccaucaaacucaucgccaugcucuacaccccacuacgcgccaacaacgccggcgaugacgucuuuaccgucucaugcagaguucuaacucgucccucccccgacuucgacuucaucuuccucgucccaccuaccguagaaucccgcaccaaacccuucucaguccccguacucacaguugaagaaaugaccaacucucgauuccccauaccccucgaaaaacucuuuaccggccccucuucagcuuucguaguccaaccacagaacggccgcugcaccaccgacggcguccuccuaggaaccacccaacuaucucccgucaacaucugcacauuccguggcgacgucacccauauccccggcucccgcaacuacacaaugaaccuagccucccaaaacuggaacuccuacgaccccaccgaagaaauccccgcaccccucgguaccccagacuucgucggcaaaauacaagggguacucacccagaccacccgcaccaacggauccacccguggccauaaagccaccgucuacaccggaucggccgacuucucacccaaacucggccgcguacaauucgcuacagauaccgacaacgacuucgaaaccaaccagaacaccaaguucacccccguaggugucauccaagacggcucaaccacaccccgcaacgaaccacagcaauggguccuccccagcuacuccggacguaacauccacaacguccaccuagcccccgccgucgcccccaccuuccccggcgagcaacuccucuucuuccgaucaaccaugccuggcugcuccggcuacccaaacauggaccucgacugccuccucccacaagaauggguccaauacuuuuaccaagaagcagcucccgcccaaucagacguggcccuacuccgcuucguaaaccccgacaccggccgcguccuauucgaaugcaaacuacacaaaucaggcuacguaaccguugcacacacuggucaacacgaccucgucaucccucccaacggauacuucagauucgacuccuggguuaaccaauucuacacacucgcccccaugggaaacggcaccggccgccgacgcgcccucuag

SEQ ID NO: 35876 - RNA, 1623 nt, Artificial Sequence
  derived and/or modified sequence opt11 from VP1__Norovirus__AFJ21446
augaaaauggccucaagcgacgcaaaccccuccgacggcuccaccgccaaucucgugcccgaagucaacaacgaagucauggcacucgaacccguagucggcgccgccaucgccgcgccagucgccggccaacaaaacgucaucgaccccuggauccguaacaacuuuguccaagcacccggcggcgaauuuaccgucucaccccgcaacgccccaggcgaaauccucugguccgcaccccucggacccgaccuaaacccauaucuaucacaucucgcccgaauguacaauggcuacgccggcggauucgaaguacaaguaauauuagccggaaacgccuucaccgcaggcaagauaaucuucgccgccgucccacccaacuuccccaccgaaggccucucccccucucaagucaccauguucccacacaucauaguagacguccgccaacuagaaccaguccuuaucccccuuccagacguccguaauaacuucuaccacuacaaccaauccaaugaccccaccaucaaacuuaucgcuaugcucuacacuccccuccgugccaacaaugccggcgacgacgucuucaccguauccugccgcguccuaacacgacccagcccagacuucgacuucaucuuucuaguacccccaaccguagagucacgcaccaaaccauucuccguccccguccucaccgucgaagaaaugaccaacucccgauuccccguaccacucgaaaaacuguucacuggcccauccucagccuucguaguacaaccccaaaacggccgaugcaccaccgacggcguccuucucgguacaacacaacuaagccccguaaacauaugcacauuccgcggcgauguaacacacauacccggcucacgcaacuacaccaugaaccuagccucccaaaacuggaacuccuacgaccccacagaagaaauacccgcaccccucggcacacccgacuucgucggcaaaauccaagggguccuuacccaaaccacccgcaccaacggcucaaccagaggccauaaagccaccgucuacacaggcucagccgauuucucaccaaaacuuggccgcguccaauucgcaaccgacaccgacaacgacuucgaaaccaaccagaacacaaaauucaccccagucgguguaauacaagacggaagcaccacaccccgaaacgaaccacagcaauggguccuacccucauacucgggacgaaacauccauaacguacaucucgcccccgcagucgcccccaccuuccccggagaacaacuccucuucuuccgguccaccaugcccggcugcuccggguauccuaacauggaccuagacugccuccucccccaagaauggguccaguacuucuaccaggaggccgcuccagcucaaucugacguagcacuccuacgauucgucaaucccgacaccggccgcguucuuuucgaaugcaagcuccacaagucaggcuacgucacugucgcccacacaggucaacaugaucuaguaauaccacccaauggauacuuccgcuucgauuccuggguaaaccaguucuacacccucgcccccaugggcaacggaacaggacgacgccgcgcgcuauaa

SEQ ID NO: 35877 - RNA, 1623 nt, Artificial Sequence
  derived and/or modified sequence opt11 from VP1__Norovirus__AFJ21448
augaaaauggccuccuccgacgccaaccccucagacggauccaccgcaaaccuaguccccgaggucaacaacgaagugauggcccucgaacccgucgucggagcagccauagccgcacccguugccggccaacaaaacguaaucgaccccuggauccgcaauaacuucguccaagcaccuggaggcgaguucaccgucuccccucgaaacgcccccggagaaauacuauggagcgcuccccuaggacccgaccucaaccccuaccucucccaccucgcccgcauguauaacggauacgccgguggcuucgaaguacaaguaauccucgccggaaacgcuuucaccgccggcaaaauaaucuucgccgccguaccgcccaacuucccaacugaaggccuaucccccucccaagucacaauguucccccacauaaucguagacguccgacaacuggaacccguccucaucccacucccagacguccgaaacaacuucuaccacuauaaccaauccaacgacccaacaauaaaacucaucgcuaugcuauauaccccacuucgcgcuaacaaugccggcgaugacgucuucaccguaucuugccgaguccucacacgacccucccccgacuucgacuucauauuccucgucccacccaccgucgaaucccgaaccaaaccuuucucaguaccuguccuaaccgucgaagaaaugaccaacucccgcuuccccaucccccucgaaaaacuauucaccggaccauccucagccuucgucguccaaccacaaaacggccgguguaccacagacggcguccuucuaggaaccacccaacucucucccgucaacauaugcacuuuucgcggugacgucacccacauccccggcucccgaaacuacacaaugaaccucgcaucacaaaacuggaacagcuacgaccccacagaagaaaucccugcaccccucggcaccccugacuucgucggcaaaauccaaggcguccuuacccaaaccacccgcacuaacggcuccacccgcggucacaaagccaccgucuacacaggaucugcagacuucucccccaaacucggacgaguucaauucgcaacagauaccgacaacgacuucgaaaccaaucaaaacacaaaauucacacccguaggagucauacaagacggcucaaccaccccacgcaacgaaccccaacaauggguccuacccucauacucaggcagaaacauucacaacguccaccuagcaccagccgucgccccaacauuccccggagaacaacuccucuucuuccgcuccacaaugcccggcugcuccggauacccaaacauggaccuagacugccuacucccccaggaauggguccaauacuucuaccaagaagcggcccccgcacaauccgacgucgcccuccuacgcuuugucaacccugacaccggccgcguccucuucgaaugcaaacuccacaaaucuggauacgucaccgucgcucauacaggccaacacgaucucgucaucccaccaaacggcuacuuccguuucgacuccugggucaaucaguucuacacccucgcaccaaugggcaauggcaccggccgccgccgugccuuauaa

SEQ ID NO: 35878 - RNA, 1623 nt, Artificial Sequence
  derived and/or modified sequence opt11 from VP1__Norovirus__AFJ21451
augaaaauggccucaaacgacgccaacccauccgacggcuccgccgccaaccuuguccccgaaguuaacaacgaaguaauggcccucgaaccuguugucggcgcagccaucgcugcucccgucgccggccaacaaaacgucauagacccauggauacgcaacaacuucguccaagccccaggcggagaauuuaccguaucaccccggaacgccccaggcgaaacccucugguccgcaccccucggaccagaccuaaaucccuaucuaucccaccucgcccgaauguacaacggcuacgccggcggauucgaaguccaagucauccucgccggcaacgccuucaccgcaggcaaaaucaucuucgccgccgucccacccaacuuccccacugaaggccucucccccucucaaguuacaauguucccccacauaauagucgacguacgccaacucgaaccuguccucauacccuuaccagacguacgcaacaacuucuaccacuacaaccaaucuaacgacuccaccauaaaacuaaucgcaaugcucuauacaccccuccgcgcaaacaacgcaggcgacgacgucuucaccgucucaugucgaguccuaaccagaccaucgcccgacuucgacuucaucuuccucgucccaccaacuguagaaucaagaaccaaaccauucaccguccccauccuuacugucgaagaaaugacaaauagucgguuccccauaccccuugaaaagcuguucacaggaccaucaagcgcauucgucguacaaccccaaaacggccgcugcaccacagacggcguccuccucggcaccacucaacuuuccccagucaauaucugcaccuuccgcggcgacgucacccacaucgccggcuccagaaacuacaccaugaaccucgcaucucucaacuggaacaacuacgaccccaccgaagaaaucccagcuccccucggcaccccagacuucgucggcaaaauccaaggaaugcucacccaaaccacccaaggugacggaucaacccgcggccacaaggccaccgucuacacuggcuccgcagacuucacccccaaacucggcucaguccaauucgcaaccgacaccgaaaacgacuucgaaacccaccaaaacaccaaauucacccccguaggagucauacaagacggcuccacaacccaucgaaacgaaccucaacaaugggcccugccaucauacucaggacguuccgcacacaacguacaccuagcucccgccgucgcccccaacuucccaggagaacaacuccucuucuuccguuccaccaugcccggauguucuggcuaccccaacauggaccucgacugccuucucccccaagaauggguccaacacuucuaccaagaagcugcacccgcacaaucagacgucgcacuccuacgauucgucaaccccgacacaggccgcguccucuucgaaugcaaacuccacaaauccggcuacguaacaguagcucacaccggccaacacgaccuagucauaccacccaacggcuacuuccgauucgacagcugggucaaccaauucuauacacuugcccccaugggcaauggcacuggccgccgccgcgcgcuuuaa

SEQ ID NO: 35879 - RNA, 1623 nt, Artificial Sequence
  derived and/or modified sequence opt11 from VP1__Norovirus__AFJ21454
augaaaauggcaucaagcgacgccaaccccuccgacggcucuaccgccaaccucguccccgaagucaacaacgaaguaauggcacucgaacccgucgucggcgccgcaauugcagcacccgucgccggucaacaaaacguaaucgaccccuggauccgcaacaacuucguccaagcccccggcggcgaguucaccgucucaccccgcaacgcacccggagaaauccucuggucagcaccccucggacccgaccuaaacccauaccuaucucaccucgcacguauguacaacggauacgccgguggcuucgaaguccaagugauccuagccggcaacgccuucaccgcgggcaaaaucaucuuugccgccguuccucccaacuuccccacagaaggccucucucccucucaagucacaauguucccccacauaaucguagacguccgccaacucgaacccguccucauaccgcuccccgacgucagaaacaacuucuaccacuauaaccaguccaacgacccaaccauaaaacuaauagccaugcucuacacaccccuccgcgcaaacaaugccggggacgacgucuuuaccgugucuugucguguucucacccgacccucuccugacuuugacuucaucuuccucgucccacccaccguagaaucccgcaccaaacccuucucagucccaguccuaaccgucgaagaaaugaccaacucccgcuuuccuaucccacuagaaaaacucuucacaggccccucguccgccuucgucguccaaccacaaaacggacgcugcaccaccgauggcguacuccuagguacaacacaacuaucaccagucaacauaugcacguuccgcggagacgugacccacauaccuucaucacggaauuacaccaugaaucucgcaucccaaaacuggaacucuuacgacccaaccgaagagaucccugcaccccucggcacccccgacuucguagguaaaauacaaggcguccucacccaaaccacccgcaccgacggcuccacccgcggacacaaggccaccgucuacacuggauccgccgauuucucacccaaacucggucggguccaauucgccacagacaccgacaaugacuucgaaacaaaucaaaacaccaaauucaccccuguaggagucauccaagacggauccaccacacaccgcaaugaaccccaacaauggguucuccccucauauucaggccgaaauauccacaacguccaccucgccccagccgucgcccccacguucccaggcgaacaacuacuauucuuccgcuccaccaugccaggaugcucuggcuaucccaacauggaccuagacugccuauuaccccaagaauggguacaauacuucuaccaagaagccgccccagcccaauccgacguagcacugcuucgauucgucaacccagacaccggccgcguacucuucgaaugcaagcuccacaaauccggcuacgucaccgucgcacacacaggccaacacgaccucgucaucccucccaacggcuacuucagauucgacuccuggguaaaccaauucuacacccucgcccccaugggaaacggcaccggccgacgacgugcccuauga

SEQ ID NO: 35880 - RNA, 1623 nt, Artificial Sequence
  derived and/or modified sequence opt11 from VP1__Norovirus__AFL70023
augaaaauggcauccaacgacgccaaccccagcgacggcuccaccgccaaccuagucccugaagucaacaacgaaguaauggcacucgaacccguugucggcgccgccaucgccgcccccgucgccggacaacagaacgucaucgacccauggauaagaaacaacuucguccaggccccaggcggagaguucacagugagcccccgcaacgcccccggcgaaauccucugguccgccccacuuggaccagaccucaaccccuaccuagcacaccucgcccgaauguacaacggauacgcuggcggguucgaaguccaagucaucuuagcaggaaaugccuucaccgcaggcaagaucaucuucgccgccgucccacccaacuuccccacggaaggacucucccccucccaaguaacaauguucccccacaucgucgucgacguacgacaacucgagcccguccucaucccccucccggacgucgguaacaacuucuaccacuacaaucaguccaacgacccaaccaucaaacuuaucgccaugcucuacacacccuuacgcgcaaacaacgccggagaagacgucuucaccgucuccugccgaguccuuacccgaccauccccagacuucgacuucauauuccucgucccucccaccguggaaucacgcaccaaacccuucacaguccccauccucaccguagaagaaaugacaaacucccgcuuccccauuccccucgagaaacucuucaccggucccucuggagcuuucgucguacaaccacaaaacggccgcugcacaacagacggaguccuccuagggacuacacaacuuuccccagucaacaucugcaccuuccgcggagacguuacccacaucgccgguacccacaacuacaccaugaaccucgccucccagaacuggaacaacuacgacccaaccgaagaaauacccgcaccucucggcacaccagacuucgucggacgcauacaaggaaugcucacccaaaccacccgcggcgacgguucuacacgcggccacaaagccaccguauccacaggcgacgugcacuucacuccaaaacuagguagcauacaauucaacaccgacaccaacaacgacuucgaaaccggacaaaacaccaaauucacccccgucggcgucguccaagacggaaacggggcccaucaaaacgaaccccaacaauggguauuaccaucguacucaggccgaaccggccacaacguucaccucgcaccagccgucgcccccacauuccccggcgaacaacuccuauucuuccgauccaccaugccaggcugcuccggauaccccaacaugaaccucgacugccuccuuccccaagaauggguacaacacuucuaccaagaagcagcccccgcccaguccgacgucgcccuacuacgauucgucaaccccgacaccggccgcguccuauucgagugcaaacuacacaaauccggauacgucacugucgcacacacaggccaacacgaccucguaaucccacccaacggcuacuuccguuuugacucuuggguaaaccaauucuacacccucgccccaauggguaacggaaccggucgaagacgagcacucuga
